United States Patent 9,328,346 (POLYCOMB-ASSOCIATED NON-CODING RNAS) - sequence listing, part 102

SEQ ID NO: 19164 - RNA, 1128 nt, Homo sapiens
acucuuuucugccaaucaaagcacacaacuuuauugaugauacacacagaugcggacuuggguggaagagguuaagucgguacaauagacagaagagcagugcacuuuuuugaugaauagguucacuauccaucaggcgcguguagaagaaagagcaaacgaaaaauaauucaaccuaagcugcaacaaaugcauuuucagcucaagccgcgauaugccucuggucucugcaaagcggucccgcuuggacagggagaccaccacaggcaacaauagcacucgugaugcuguaauuugauguucuuuguccacagcaggcagcugaagugauccccucaccacaugaaggaggcugcaagggaggaauuuacaaugccaacauugccugcagacugcacaaccaagaaguuacucaaagcucugugggagccccugccuggccaauaagagugugguccuggauugagcccuggaacuuucacccaaugagguggugauuggcuaaggcuggaucuucaguagcacccucugcagauucuuugacaucugcaaaccaagcgcguuguggguggauuccgucccauuguguucgagagggccguuuauggggcagggguuuccaggagaaucucucuguuuccauuucugauaaagagggacaugaaugagaagagcaucugggcaccgacuaacucccccgccaagacuggcuuuucagacaaacccaucagcgguuucaaaaccugaaccuuagcacauccacuucccucugauaucaaaggaaacuucaagucugaagcggacuuggcaagcauguuauuaauaacugucaugcuuauuaacaaauuuaauccggccugcugcagaaaugaguugcagcaacgugacacagucucccgacacacuucauugauguacaucuuaaucuggcccugacuuucaauacucgcauuuaaguuauccggggcacacaaagccucucuaacaguggggucuggaguggggcucguguuucuagccauugagaggcuggccaaauggcuauugauauccuggcuaaauggaaagcccgcauccuugggcucggcaaacaacaguuuucccugaaugaaaagacacuuggagagg

SEQ ID NO: 19165 - RNA, 8795 nt, Homo sapiens
gauggucuuacccucaaaucgaccuccaccgauuaggauuaaauuccuuccucuucuuuugccuggcguugugccgcaaccuacagaaagacuggccacccgggagaggcuuggacccacuagacacagagccauggucaguaagacacagccacaggcagaaagacgggaaacugccgccacugagcgcuugguggacggacuaguccccagaacacaaaacucuuuucuaauucggaggccugguugucagagguuucccaccccuauuaccucucuugggguucugcugacauaucgcguugcaucucaccacccccgcccccauauccagccauuccccuccggcacuguccugguggacuaggggccaacacccaggccacagcucccuuuccggauugcggcccuaggcucccagcagauucccauuucccagucucugagcucuuccccaaacaccccgcagcucaccguuucgcagcaucgaaaugggcugcaagcgggacauaugucuuggaaagcgggcggcgagugggagagacgacggaggcgccucaguacccgcgacggucucggcccuacgcccucaagcaccccgacuuuauggaaucuuccagguacugaccugcagggauucgggacaauuuccuucuccucuuccuuuuucccuccgccgcaggccggcccgcccucagggcaguggggagcugguacucagacgggaacaacgaccaggacaagaaggacuucugcacacgucagcucuuggucacgugagggcuacgucauccaccaacucggguccccaauuuccccucccaccagcagugcggcagaagagggcccgccccccuccuuucccucccccacaccaggccuuauuacucuuucuucuucgauaaucucaucaccuuguaguuguguuucccuuccaccgauuaccagaaagggacggcaucuuccccuggggcuaugggccacuuguacuuuuaugaaaaauugccucuuccuucccuaggcuccugggacagcagccucucccuccaccuccccucccccgagcuaugaaagucuaccauuuccucugaaaucuagucccagaucugaaaggaacaagcgaucagaaaagaaaaucuggaaugagagugugguuuuuacuuucuuaauacuuuguuauuuuuguuccguccucccccacccccagccugcauucuuuuuaugagaaaaaaaaauacuauaaagcuauuuccauuuuagaaaaaaaugaguggaggcugaagaaugauguugggugauggccuccaaaagucccacauuuucucacuugguggagaguguuacacacuucacucaaagcaaucuuaaugucuucuggggccuagcacacagcacagcccugagugagcuaaucagugugucuggcaauacguaagucuucugacuagaccagucuucugaauaggagagcuacagacuuucaccugcacccauuagcaaggaggaggcauuaaacccacaaaagccagaacgcagaaaaaaaaaaaacuaaggagaaaacauaagugcacaguagguaucugugagauaaagcaugcacacugaaaaaaugagugugcauaaaaagaacauuacaaaauaugcuugggcaaaauagagaauaucaucuauaaaugaaauaaguauuagaggaacacagaccaagacaaaauuggcugaaacugggaccuagcaauuaguaugaaacuauuuuacuuacugguuugauaaacugaauaauucacccaucaucaaugauuuaccuuuuuuaaaguaggaaaaggaauaaaauaauuacauccccucauuauuuaaguuaaccagauuugauuucaguugcuugcaaccaaaccaccuuaacuaaagcacaacacaaaaacagguaacaauacaaaaaguaauauagcuuuucagaacauagggucuucagugagauauucacuaauaguuugaauaaaagguuauuauuugaguauaacuuuuaaaauacacagacaauaugggaguaaaucaagagacugaggaaguugagaacaggcaaacccccaggaaaauucauaucuguguaacuucugggaggcaguacuagaaugugauugaaauuuauuuaguaaacagaaaccaaaucaacuauaugauccuguguuuagagaaagaucauguguagcaaaggggcuuauucaagcauaggaauauaugaaaaggacagucagaagaaaguguugguauuucccacccaagcacugccuggaggagaaaaaguguuggcuaaggagaauggaacauuucacuuucucuggcagagucaugcccaugauguguaauaguacuucaugcguccucagcugaaacccccuucuuaaaaugaacaaauacccuugcucugauugcaggcucaccaaacaaccuucuaagguugugguuucccaaguaguagcuugucuacagggaaagaauaggcagguaagacugacggaaaccuccaguacccccugacaauuguauuucugagggcaaauuauucaguugucacuccuguugaaacagcuucccuuguggucuacuuauggggagagaaugcagagaucccuagguuugagcauucagaucuguuuauauauaagucucuaugaaugggagucuuuccuugaggcauccagaggcaauucuucucagcauacaaacaaaaucaggauuuggucaugcaauacugaggaagagacccugaacuguagacgcaaccuugggggaauccugugggagaagccagauggccuuggcucaaaggacaaccuugugcaucaccauuucauaaccauaccuuucuaauguuuaguuaaugguggaaauuacaacuaagauacucuguggcauauuaugcccccagcacuaccguuauagauaaacaaaagguuaauuuucaaagugauaaaagggcuccugcaaaucaacaacaacaucugaaacaguuuaaauuucucccugggaaaagaaaggaagugcauuuuacauuuuacugacccuauuguuuuccucagcaaaaggguggguauugugcucaaaacagaacaaccaaaagcugccuuacuaaaauuucaaucuucauuagagagauaaaaaccugaaaaccgguggacuuaugacauccugaaaagacgucuaucaauuccuucuaccuaaaccccucggagaugagccuugucuucaacauuuccuccuuaaguuaaccaggcuuguucucuguugcuugcaaccaaacaaccuuaaguaagacacaauaccaaaauuacacaauacaaaaaguaauauaacuuuucaagauaacaaccuucuauaauuuauuuuuuucacccuccacaauuccauuagugucaccauuugcuggucguuuuuuguuucugggugcuuuguaaguuacauaucacaugugaacugauuuaagccaaaaguuuuguuuuggcagugguuucacaguaguuuuuugcggacucagaaacuuuuaacaguagugucugaggacuucuuuaagcauuuuccuuucucacuuuugaaagguaugugagccuuauaacauguccuuaaguaaauauuucuugguagauguauaauggagagcaaaguaguuuuuuuuuuaaugcuagucuccagguaggaauugauagaaucguggauuagaagaacaaagagguaagagaauugaaaggguuuuuauaaccaugggguuuuaggaaguuuuagacagggaguggauucaaaccaggaaaggucuggcauacugggagaaugguagugagaaguuauacaucggacuaacuggagaauauaccaaaaggguggagauauuuuauacuacugaggagagguaggaguaaaguuuuuguccuugaagccuggcuaaguguugugaaagugaguucuuauuguaaagccaugucugugacaccaagucaucugucuuuauuaagcuuuacauacuccuuaguuuuuucuaauguauauauucaaaacaaacaaaagccacuuauacaacuaccuagcagccaaacacugaaugauggacuguugaaucugagaguucuguuaguaagccuucauaaguauaauucacuugucuaggggaaguuaauaaagggucaugaaaaaaaaaugagguaaagauuuagagagauaagaugugauauuggugaguuuggacuauaaaaggggaagaccagaaaguugugacauauugacuucugaauauucaccagcaaggcacuaggacucccuggcuugccuccugaaagggccuccuccacacaggagccccucacuggggagccccucccucuggggugucauauuucaauguucuaagagguugccuggagugucuauauuuagaguaugacuccucagcagggacagguggaugcaugaggacuaacuucugcauacuuggucccugaguuuugggauuauucugaggggcuuguacugguggcucaaugaaguuguaauagaaggcaggaaaugaaaaguccucuuuuuuucuggcaacugcuugagauccugugcauugcccuuccacuugugaggggaaaaaaugacacagacaucagggguguugcacugauucccagucacccacagacccucaccaccaucuccacuggaaaaugcugaacacucaccacugcuaggguagcauaaaauacaugaauggcagacaacagagagaucgccaacagugucaugauggaaagaaaauuaccucuaucaagucucauuuucaucaauaggauaacaggaaauucucuaauuucuggaagauuuauagguugcaccacaaacuucagaauagauuguaaauaaagcccugugaaugaaaggcaggcuaaucuguggagucacuaaucuguaaaguucaucugaagauguaagauucaucugaaguuggggucugcauaaaaucuguccuuugaagccagagugaaagucacccagcaaucuucuaugaagaucucagucaucugacaccuaacacuaugaguucagccaggagaaagaaagggacaauaguucacuuacuuaaaauggucaaaauuagaacacugaccuucucgguauagauucauuuauccaucaauuuauaaaucauguugaaagcacaacugguuuuguuucuaaggguguguuuuuacauuuuaauauguuguuugaaagcugcuauuuccugugcaguccgaagaaaauauguucaacuugauacaaacuaacuucaucaaaucaaugaggccuccuauuaacugggaaaucuugcuuauguuauauauauauauaucuguaaaaaaaaaaaaagauuugaauuauuucuucuccaagugggaaaagcuuuauuguuuuuuuccgauuacaaaauaguguaguucaagucaauaaaaaagaaaggacaaaauauaacuuaaauguuaucaaaauacuaauuaaaaucucaccacugccuggacuuccguuucugcccccucacccaauguugguguagagacugaacacggaaaaguguagaaauuuaagaaaggggcugcagaaguuucagagccaaggaaaggaugagacaauuccccaagaaguguaaaugaaggguagacucaggaaaagaugcugccccuuccuaaagaugcugccccuuccuggaauuagagaaacauaaauucaaacaccagaaagacagggccacuucugguuucugguauuguuacagaggaaaaaagugacagggcccacuguggggguugagggggagauacaaggcaggcuggcgccugccgcacugcuugugggaguggaaauugggggccagagcgcacuggugacguggccgucacgugaccaagagccgccuagagcacaaguccugcuagucgccuccgucuggguaccagcccccuauuacucugcaggcgugugaagaaagaaggaaacuagcucggaccgugcaggucggugcgagggugggcgcugcuugagaggagguauggguggaagagggccaagaacgccacagauccgaguucaggccgaucacagcugggucccuuucucgccuacuuucuaaauacugcuacccacccccaccccaccccgugcucauuuuaguagagagaaguggcggguuucgggugggggugaggggagugaauggcguuuccagagacuccgagaaaagaaagguucuagugucccgggugcugguccguccaccaagcacuccguccccucggucccuugucuguuugcagguuuguaggucuguuggccuguagguuucggcacaaguuucagcgagagaaggagaaaacugccuugguuggaaccuugcaggucagugugaaggugggauuagcccaggaccauggguggggguggcggaggaggggggcugggauaugagagggccagguccgagucgcccucuccuggccccuucuuucuccacacccacucccauuucagugcagggaaagggguguggcggccuuugcuggggaaauggcggacgacaaguggggcggaggaggccugcguccggaaagucaguagaguaugagaaauauuuuaaacucaagugucuaaaauucacaaaaacagaaauugggaccuguguccucaguucauccacuacacuuucauuucuccauugccgccuaccugucuuugcauuuguccuucugccagacucuauccucuaucaccguggagggaccacugacaacagaagacaagggaaaacgaaggaauuuaucugacuuugguagagguuaaugagagaaacugcccuuaaucuuuggggguggaggucugguguaggagacuaccugagagguacucacacugucacccuccuagcuaucauagcagagacccaucuccugcccuucccuguggacccaggaagagaaaugggggcuccugaggucgauagaggaagacagaaaagaaaagaacaaagaaauuguauccuguuaaucugccuuuaucaccaacucgaaauccacccugucugugaggcacaaagccaaacauagucccgagcccuaauacucuguuucacccacagauucaucacaagagagcuacaagagccuggaagaagcugaagacugcuacccuccauccuuacucacccuggaccugagagaccucuucaaucagguggagcaaggcccucuccuguccugccccaaggcuggcacagacuugagcaugggccgggcucgggaaguggguuggauggcggcaggacugaugauuggggcuggugccugcuacugcguuuacaaacugaccauaggaagagaugacagugagaagcuggaggaggagggggaagaggagugggacgaugaccaggagcuggaugaggaggagccugauauuugguuugauuuugaaacuauggcucggcccuggacugaggauggggauuggacugaaccuggggccccagguggcacugaggacaggcccucagggggaggcaaggccaaccgagcacacccaauaaaacagcggccauuccccuaugaacauaaaaauacuuggagugcucaaaauuguaaaaauggcaguuguguucuggaccucuccaagugucuuuucauucagggaaaacuguuguuugccgagcccaaggaugcgggcuuuccauuuagccaggauaucaauagccauuuggccagccucucaauggcuagaaacacgagccccacuccagaccccacuguuagagaggcuuugugugccccggauaacuuaaaugcgaguauugaaagucagggccagauuaagauguacaucaaugaagugugucgggagacugugucacguugcugcaacucauuucugcagcaggccggauuaaauuuguuaauaagcaugacaguuauuaauaacaugcuugccaaguccgcuucagacuugaaguuuccuuugauaucagagggaaguggaugugcuaagguucagguuuugaaaccgcugauggguuugucugaaaagccagucuuggcgggggaguuagucggugcccagaugcucuucucauucaugucccucuuuaucagaaauggaaacagagagauucuccuggaaaccccugccccauaaacggcccucucgaacacaaugggacggaauccacccacaacgcgcuugguuugcagaugucaaagaaucugcagagggugcuacugaagauccagccuuagccaaucaccaccucauugggugaaaguuccagggcucaauccaggaccacacucuuauuggccaggcaggggcucccacagagcuuugaguaacuucuugguugugcagucugcaggcaauguuggcauuguaaauuccucccuugcagccuccuucauguggugaggggaucacuucagcugccugcuguggacaaagaacaucaaauuacagcaucacgagugcuauuguugccugugguggucucccuguccaagcgggaccgcuuugcagagaccagaggcauaucgcggcuugagcugaaaaugcauuuguugcagcuuagguugaauuauuuuucguuugcucuuucuucuacacgcgccugauggauagugaaccuauucaucaaaaaagugcacugcucuucugucuauuguaccgacuuaaccucuuccacccaaguccgcaucuguguguaucaucaauaaaguugugugcuuugauuggcagaaaagagucauggu

SEQ ID NO: 19166 - RNA, 9324 nt, Homo sapiens
gcagacggcgcggaucgcagggagccgguccgccgccggaacgggagccugggugugcguguggaguccggacucgugggagacgaucgcgaugaacacggugcugucgcgggcgaacucacuguucgccuucucgcugagcgugauggcggcgcucaccuucggcugcuucaucaccaccgccuucaaagacaggagcgucccggugcggcugcacgucucgcggaucaugcugugagugaggccgggccggcggugcaggacgccgggaccgggcuggggcggaagccgaagccgggccgccgcgccggggcugccgugccggggccgcgggcagggcguccggaucgcccuccugagcggcaguucgcccccgagggcggucgucagggguggacgucgcaggcuuuuccggcguccccucggaacuugcaccccuccaccguaaauucccgggcuugcucuuaaauuuuaauuuugagcguuccucaggucggugccuccgcuugcuuccuguuccucacuucccuccacccacgccuggccaaugagggagcaacacaacagcagagccggcgccgccgcccgccugggcuggcgccucccgcgcguccggugccgcucgugguccgcaugcgaggcccuccaggcgcugccgccgcgcucugggucgggcuuccgugggguuuccuggcggcucuggaggccacaggacgggguugucuuugugucauucaucacccgaguuugcccuguuugacauucccuuuacaguuguugccuuugcaccuucagaaggcaguaaacaguuggagcugcuuugaaguuggccagagauguugggcacugagagaauuaagcaucuuagccuucugauacagcgagauuuuuguuuuguuggguuucuuuauuucuuuuucuuuugccaaccacuugaagaagucugcgaaaacgccaaaaaaugcaguucgaaaugacagugccauuucgcuauugccuauuuuguccuugauuuuauucucuggcacuuuugucuuuaaucgucguauuuuuccaucucuuguucucauacccuucuacucuauuuccgucuuacacaaguucuuuaaccuuaguuuauuucuuugucagaaucgccaagaagccaguuaucaaauagcgagccuucuccccccaccuuuuuuuuuuuuuuuuaaauuacuguacugauguuuguuagauauuguucgaauagaccugggguggacaucagcacugccauugucagcccugugaggguuagaagagcuuggugcauauuaaacacugaacagauguuagcuguuguugucuugagcaaguuuucuuaccauucugggccuuaauuucuuuuuguuuaagauggaaguaauaccuaauuuuuagguugugagaauuauuugaaaugugaaaaauauugucagugggucugagccguaguaaacaguaaauagcagcugguuacaguaguauccccuuaaugggguagguauacguuccaagacccccaguggauggcugaaaccacggauagcaccaaacccuauauauacuugguuuuuuccuauaccguacauacauaccuaccuaugauaaaacuuacaaguuaagcacaauaagagauuaacaauaacauaauagaacuguaacaauauacuauaauaaaaguuaugugaauaugaucucuuuccccuucucucaaaauaacuuauuuuacuggacucaccuauuuucacaccagauugaccgcggauaauugaaaccggaaagugaaaccucggauaagggggugauuacuguaucacccuuuaauaugccaucuguuaguauucguaucaccuuguagucauguguagcuuucuucuacccauucugcaaaauugcuuuacaucaaguauuuacuauucuuuuuagcaguuuuuauccccuucugaguuuuguuagggauucucuugagguauaugcaauuagcugaagaccuacuuuaauauuggauuagaauguuucuccuguuuucacacuuacagguuucucugguguuuacucguuucuuuguggaauugcaguuucaccuaugcacacaccuguauucuuucucuuuaagaaguuacgugaauuguguauguucuguuggaaggaugguaaaacuuuuaucuuuauuccuagaaaaaauguagaagauuucacuggaccuagagaaagaagugaucugggauuuaucacauuugauauaacugcugauauccuuuaagaaaauauuucguugcguuuucuguaguuuuauaaugagauauguguuguuuaaugauuugggauacagugugacuaucucauugaaucagccaaaccuuggaaauuccgccuuuuucaucaguaaaauaauguuaauaccuccccaugacacuuggagaaaacuucauagauucaugaguaguugugugaacauacuuuaaauucuuaaccgaaacauuaaauugauugaaaacuacauaagaaaguuugaaucuguauuuuagaaagaaaaaauaaaauuagaucauuuggauaagaaggaaaaauauuaccaaugcucagccugccugugaauauuucauguacaauuucaaauaauauauccauauuuuauuauagcagagagaaacauauguuuaaaaagugaauuacguguguuaugauuugaaaaggucauaucaaaauuauugguaaccugugguugcuuuuugccgucauaacucuuuuuauaaggacuuuuauaaaagucagaaaauauuaacaauuauaagaguuucuuugguggugauauuuaaauauuuucucuugagauugaguuucuaucuuuugacaacucugaucauuuuggccaggcuagucuuuuuuagggucuuucuuagguuaauaucuuggcaauguucucugccauuucuagccugauuucaucugccuuuuuaauaccccgugauuuaaaugguuguggagauugaacgaucugaacuugugugaaaguaccugucugaacaguuaaagcugaucauauacuuggggaauuuaucuaauuugccuuucuaugaccaugaaauuuacuuuuagcuuaaguuuugguaauuauuggauuuagaaauaggcuaagaauuaguucuguagguaccuuuuuaggaaauagaguguaccaucggaagagucuuaugcugaauuucauguguauuuuuaagucuuuguguaauuuuuaaaaaucugcuuaagggaauuuaggucuacugugaggguaguaauuuuguguauccagagaauuauagugaaauuuccugguaucuaugguauuuauauauuaccaaucucauuauuuguaguuucuucagauuuucuuaaugcugcugcuacuacuacuugaaauuguugcuguucuuguaaacagcaguccuagacuuaguucuaaaggagugauucuuagugguuacacauaauuaauaauggaauguaacaaauguguuacuaccaguguggaaacucauauaguaaaaugaguuaacuuaacaauuaacauaauacuuaaaaauccaaauauuaacuccgcuuauuucuugguauuggcaccagucuuguuaauucuggugaaguucuuguccucuuugggagacugaauugagccacauuggugucauuugcaucuuugagagacauuuuaaugucuacuugcaugugaccaaaagugacauguacaauuuauuauacuugguuaauuauugagccuuguuuauguuugcauauuguuaaauuuaaaugguggugauuguuuauacuuuagagcuccaguggaauuguauuugcuugaaauaucgaguccucuuuuuuuuuuuuuuaacuuaguugauguuacagaaaaccaaauuuuggauuuguucuuuucuuacuagucaaaguaucucagcuaguaauccuuggaggaguaugggaggaugccaguaaucucauacugacauuuuuuuguuuuggaauaagcuggauuucacaauguauuuaucuucugcauauuuuuauuaaauuaguggcacauuauguuucugggccgccucuuuucuacuuuaguauuacuguuauggauaaauaaccuaagaauaauuaagaucuauuuaaaagugauauacugcucauaaauuuauauuuuccuuaauuuacuuacaucuagagaauauauuugauuggaauguuaagcaguuguuucuuuauuuaucagcagaauauucaacaaaaaauaauguaaguauaucuaauuagaaguauuuuaauagcuauuuaaagucuuacucuuuacgaaagaauacacauuuuuauauauuuaaaauaucugaccugaguuaccuagcaaaacaucacaagccaguggagguagcuguguuaugaaaacauuugaucuuuugggagccuuuuuguuguuguuguuguuuguuuguuuguuuucuguuuguucuauuuagcucucuagcauuggggucuccagaauggagacuugcuauaugaacagacguuaauguucauauucagcccuuaagucagauagaugggcacaugccuucuacaauaugcagauauucuggaggaaaggaggaauucuguaggucaagaaguucaccaugcuaccuaguauuuauucauuugcuuucagcauguuguaaaauauugcaguauaugcaauacauaaguggauuauauuauaaaauuuuagccaauccuuucaaaauggaaaaguggcuuaaaaagauuucugcaaagaaaucacagauugaagauaaugcuaauaauccaugcauauguaaacaguaggaaaaugguggagcucauacuuguauuccucuucugagcugcugugucacacugaaggauuaaaaaaacacaaagacaaccuagauagaucugauaacuuggcugagacacugucaaugauauuaauuaacaauaguaagaucagaaagauauugcugaacuaucaacuaggaaauggaguggguagccgguaguauugccaccacucagcuguuuccuuuuuuuuuuuacuuuuuuuuuuuuuuuuaagacagagucucgugcuuguagcccgggcuggaguacaguagcgccgucaaucucagcucacugcaagcuuugccuccuagauucaagcaguucuccugccucagccuccugaguagcugggauuacaggcgccugccaccauucccagcuaauuuuuguauuuuuaguagagacgguuucaccauguuggcuaggcuggucucgaacuccuaaccucaggucauccgcaugccucguccucccaaagugcuaggauuacaggcauaagccaccgcgcccggccguuguuuacucuuuaagcuaaaauauucucucuccacagcugcaauuagagagcugcauggugaccuacuugaaucaacaaaauuugagaccugugauuauaauucucauuaugacuauauauaaucaaaagcuguaaagauuguuaauaauuuucaaaccuucugagauuauuuuaaaauccaucuuaguaccagauaccuuucuuuaaaaaaaaaaaaaaaaagaacauggugcaagguguuuuugguagucuacauuaagccauauagcuacaauuaauuaauauccuuaccuauugagaacaauuugccuuuguuuuaggguugcaugggauucauuaaucugaguaucugaguacuugaacugguuuuuuguuguuguuguuguuuuuauuuauuuauuuuuaacacggaguuuuacucuuguuguccaggcuggaguacaguaguaugaucucggcucacugcaaccuccacauccuggguucaagugauuccccugccucagccccccaaguagcugggauuacaggcacccaccaccaugcuaauaacuuucaaucauaaacuaauaguuuuaauagguuuugauauaaugguuuaauagcuuuuaauuauaaaacuuauuaugaauuauaauuugugauuuaaaaaacuaguucaggccgggcacaguggcucacaccuguaaucccagcacuuugggaggcugaggcagguggaccaccugaggucaggaguuccagaccagccuggccaacauggugaaaccccaucucugcuaaaaauacaaaaaauuagccaggcguaguggugcgcgccuguaauccuagcuacuugggaggcugaggcaggagaaucgcaugaaccugggagguggagguugcagugagcugagauugugccauuguacuccacccugguugacagagcaagacucuaucuccaaaaaaaaaaggaagaaauaacugcucuacauuucuuuuuaguuaauguagucaucauauacugaguaauuggccuuaaaagcgaauagaugcuaacuuaauaagagcaaauuccuugggauuuaguaguggccacaaauuuuuuuuauuuccauuucauacuuuuaauuuucuaaauggaacuuauuuguaauauguugaaagaguagcuuaaaagaauugucugaccucuagaauuuugccuugaugagacaacaaugcauguauuuucuuaauuaaagggaaaaaagaucuuuaaaaggcuucauuucuuuagugauuucuuaaagcuuuuguaaagaaaucuuggagaagauuucuuauaaauuuucaugacauaauuaaucagcaguaaccuguauuagcagugugauggaacagggauuggcucuugucuguuuuccuggcaccauuuaggauccaugcugagcuggagggucuuagaaauuuuauagggaaaagugauuuaaaagaauacuucccuucuagggauuuaauucaucuguuccuccaaaggccucacuuuuuggagaucuuauagaucaaaaaccuugcauuaaguuaugaaggcacuaaguaauacaguugaguuagcagaaggaaugaacuccuucagggaauugucauucuucucucugagaaaaguuugccccuuuuuuguaucucucucuuugcuaucauuuguaugcauuaagauuucagcaagcuccucaaguugaauucauuaacaugucaaacuauuugcuuacuaauacuuuuaauuugaagugauaagaugguauuucugaugaguuaucuaauuaauuuucauuuuaauauaggcucugaaccaaguuguccuaugggacaagauuguuuugagaggugauaauccgaagcugcugcugaaagauaugaaaacaaaauauuuuuucuuugacgauggaaauggucucaagugagcaauucuuggucauuuuuuuacauuuaauaagaggugaaaaagagagaaagauguauuuuuauuuuaaagaaaaauacuugagaguaaaaggagaaaaauugggaaagaaguauuuaugcauaucugaacugaaagauuggguggaaaugcaaagugagaucuaagauaagcaauucucuugcaguuucugaaaugucauagucaaacuaauaaagcuucuauccuaagcguguacaaggaauacgggcuuguucagaugcgguagggcugugguggucaaaucaaagggcuccuuucugagcgugagucgggaaaccuuagaagcagcauguugggucuaggaguugauaauaguuaaaagaaguaguauugguucuccaaacgugacuucucuaaagcucauuuuagucagugugauugaucucucagguuauuuuuaccucuuagacucuagugguaaacauuggaaauaauuuuagaagaaagcuauuucgaccaagccaaacgucuguauuugcaaugaaaauuucagaacaugagaauuuuguuaagguuuguccaucuagauaauugacagaguuaggcuucaaaucauugcucugauucuuagcucgucucuuuuuacauuuacuguuuuaaucauuuaaacuuuucgguugaugguucuaacugcagcugugaguuuagaugggucauccugggauaucaguaaauguagugccccugucuucuagcauuguccuuggauuuuaagugacaugagaaaauaguucuuuuugcagauuaacauauuaggauuucuguuaggaauagaugguuauaaauaaaguauuugacaucucaguguuugucuuaaaauuuuuuuugaacuacuagugucucugaugacuuguguuuauuauaucuuuuuauaggggaaacaggaaugucacuuugacccugucuuggaacgucguaccaaaugcuggaauucuaccucuugugacaggaucaggacacguaucugucccauuuccagauacauaugaaauaacgaagaguuauuaaauuauucugaauuugaaacaacauauuuuuauacuuaaugaauuguaucucauuaaucucuucccuuacaucuucauguauuguugguuuguuuuuugguuuuggguuuuuuuuuuuuuuuuuuugguauaagaacuaacaucaaaaggccuguuuaaagggaaagguuaaugggcuacuuaauauuaugaacaaaacaaaaaaacaaggcugccacaguggaauauuaucuuacaagaauaagaacuacauaaaacagauuuguaaaaaauacauauuugaaguauucccuguauuuccauuauucuuuauggaauauaaaguaagcaugaaagguaguuaaaacuuucaggugccuguagagucauaauaacuguauuuuaugccuugcauucacgcaaauucacauuggaugugauuuaaaaguagacauucucuuuuuccucuuuuaggauauguuugauuacuggaaaauuaauaugguuauuuguuagaagucugguuuauaaaaaagccaaaagugauggaauuuauuccauuugucuuaggaaggcccauaauacuuguuuuucuuacaugugacuagcaacuuucuccacuuaaagacuaaauaccucuuuauaugauguaaauuauucuaauucauuuuaaaaucuuuuaggucagcaaaaugugugucuucagugcuuucucuaaaaacguuccuuuauagcuuuguacuuuuuuuuuuagcguugccauugaaaguuaaaauguuugcaugguuuacccucugaguuauguuucuucuagugagcaugccugcugucacuaagugaauuauuuacuacuuuuuguaggucuauauuuuaauaauuauugggauaauaauaauugugguaugcuuuccauuuacaaaccacucauauacuuuaguguaugucauccucaauaaucuaaugagguaaguaguauaaguguuagcucuuugcagauaaga

SEQ ID NO: 19167 - RNA, 9324 nt, Homo sapiens
ucuuaucugcaaagagcuaacacuuauacuacuuaccucauuagauuauugaggaugacauacacuaaaguauaugagugguuuguaaauggaaagcauaccacaauuauuauuaucccaauaauuauuaaaauauagaccuacaaaaaguaguaaauaauucacuuagugacagcaggcaugcucacuagaagaaacauaacucagaggguaaaccaugcaaacauuuuaacuuucaauggcaacgcuaaaaaaaaaaguacaaagcuauaaaggaacguuuuuagagaaagcacugaagacacacauuuugcugaccuaaaagauuuuaaaaugaauuagaauaauuuacaucauauaaagagguauuuagucuuuaaguggagaaaguugcuagucacauguaagaaaaacaaguauuaugggccuuccuaagacaaauggaauaaauuccaucacuuuuggcuuuuuuauaaaccagacuucuaacaaauaaccauauuaauuuuccaguaaucaaacauauccuaaaagaggaaaaagagaaugucuacuuuuaaaucacauccaaugugaauuugcgugaaugcaaggcauaaaauacaguuauuaugacucuacaggcaccugaaaguuuuaacuaccuuucaugcuuacuuuauauuccauaaagaauaauggaaauacagggaauacuucaaauauguauuuuuuacaaaucuguuuuauguaguucuuauucuuguaagauaauauuccacuguggcagccuuguuuuuuuguuuuguucauaauauuaaguagcccauuaaccuuucccuuuaaacaggccuuuugauguuaguucuuauaccaaaaaaaaaaaaaaaaaaacccaaaaccaaaaaacaaaccaacaauacaugaagauguaagggaagagauuaaugagauacaauucauuaaguauaaaaauauguuguuucaaauucagaauaauuuaauaacucuucguuauuucauauguaucuggaaaugggacagauacguguccugauccugucacaagagguagaauuccagcauuugguacgacguuccaagacagggucaaagugacauuccuguuuccccuauaaaaagauauaauaaacacaagucaucagagacacuaguaguucaaaaaaaauuuuaagacaaacacugagaugucaaauacuuuauuuauaaccaucuauuccuaacagaaauccuaauauguuaaucugcaaaaagaacuauuuucucaugucacuuaaaauccaaggacaaugcuagaagacaggggcacuacauuuacugauaucccaggaugacccaucuaaacucacagcugcaguuagaaccaucaaccgaaaaguuuaaaugauuaaaacaguaaauguaaaaagagacgagcuaagaaucagagcaaugauuugaagccuaacucugucaauuaucuagauggacaaaccuuaacaaaauucucauguucugaaauuuucauugcaaauacagacguuuggcuuggucgaaauagcuuucuucuaaaauuauuuccaauguuuaccacuagagucuaagagguaaaaauaaccugagagaucaaucacacugacuaaaaugagcuuuagagaagucacguuuggagaaccaauacuacuucuuuuaacuauuaucaacuccuagacccaacaugcugcuucuaagguuucccgacucacgcucagaaaggagcccuuugauuugaccaccacagcccuaccgcaucugaacaagcccguauuccuuguacacgcuuaggauagaagcuuuauuaguuugacuaugacauuucagaaacugcaagagaauugcuuaucuuagaucucacuuugcauuuccacccaaucuuucaguucagauaugcauaaauacuucuuucccaauuuuucuccuuuuacucucaaguauuuuucuuuaaaauaaaaauacaucuuucucucuuuuucaccucuuauuaaauguaaaaaaaugaccaagaauugcucacuugagaccauuuccaucgucaaagaaaaaauauuuuguuuucauaucuuucagcagcagcuucggauuaucaccucucaaaacaaucuugucccauaggacaacuugguucagagccuauauuaaaaugaaaauuaauuagauaacucaucagaaauaccaucuuaucacuucaaauuaaaaguauuaguaagcaaauaguuugacauguuaaugaauucaacuugaggagcuugcugaaaucuuaaugcauacaaaugauagcaaagagagagauacaaaaaaggggcaaacuuuucucagagagaagaaugacaauucccugaaggaguucauuccuucugcuaacucaacuguauuacuuagugccuucauaacuuaaugcaagguuuuugaucuauaagaucuccaaaaagugaggccuuuggaggaacagaugaauuaaaucccuagaagggaaguauucuuuuaaaucacuuuucccuauaaaauuucuaagacccuccagcucagcauggauccuaaauggugccaggaaaacagacaagagccaaucccuguuccaucacacugcuaauacagguuacugcugauuaauuaugucaugaaaauuuauaagaaaucuucuccaagauuucuuuacaaaagcuuuaagaaaucacuaaagaaaugaagccuuuuaaagaucuuuuuucccuuuaauuaagaaaauacaugcauuguugucucaucaaggcaaaauucuagaggucagacaauucuuuuaagcuacucuuucaacauauuacaaauaaguuccauuuagaaaauuaaaaguaugaaauggaaauaaaaaaaauuuguggccacuacuaaaucccaaggaauuugcucuuauuaaguuagcaucuauucgcuuuuaaggccaauuacucaguauaugaugacuacauuaacuaaaaagaaauguagagcaguuauuucuuccuuuuuuuuuuggagauagagucuugcucugucaaccaggguggaguacaauggcacaaucucagcucacugcaaccuccaccucccagguucaugcgauucuccugccucagccucccaaguagcuaggauuacaggcgcgcaccacuacgccuggcuaauuuuuuguauuuuuagcagagaugggguuucaccauguuggccaggcuggucuggaacuccugaccucaggugguccaccugccucagccucccaaagugcugggauuacaggugugagccacugugcccggccugaacuaguuuuuuaaaucacaaauuauaauucauaauaaguuuuauaauuaaaagcuauuaaaccauuauaucaaaaccuauuaaaacuauuaguuuaugauugaaaguuauuagcaugguggugggugccuguaaucccagcuacuuggggggcugaggcaggggaaucacuugaacccaggauguggagguugcagugagccgagaucauacuacuguacuccagccuggacaacaagaguaaaacuccguguuaaaaauaaauaaauaaaaacaacaacaacaacaaaaaaccaguucaaguacucagauacucagauuaaugaaucccaugcaacccuaaaacaaaggcaaauuguucucaauagguaaggauauuaauuaauuguagcuauauggcuuaauguagacuaccaaaaacaccuugcaccauguucuuuuuuuuuuuuuuuuuaaagaaagguaucugguacuaagauggauuuuaaaauaaucucagaagguuugaaaauuauuaacaaucuuuacagcuuuugauuauauauagucauaaugagaauuauaaucacaggucucaaauuuuguugauucaaguaggucaccaugcagcucucuaauugcagcuguggagagagaauauuuuagcuuaaagaguaaacaacggccgggcgcgguggcuuaugccuguaauccuagcacuuugggaggacgaggcaugcggaugaccugagguuaggaguucgagaccagccuagccaacauggugaaaccgucucuacuaaaaauacaaaaauuagcugggaaugguggcaggcgccuguaaucccagcuacucaggaggcugaggcaggagaacugcuugaaucuaggaggcaaagcuugcagugagcugagauugacggcgcuacuguacuccagcccgggcuacaagcacgagacucugucuuaaaaaaaaaaaaaaaaguaaaaaaaaaaaggaaacagcugagugguggcaauacuaccggcuacccacuccauuuccuaguugauaguucagcaauaucuuucugaucuuacuauuguuaauuaauaucauugacagugucucagccaaguuaucagaucuaucuagguugucuuuguguuuuuuuaauccuucagugugacacagcagcucagaagaggaauacaaguaugagcuccaccauuuuccuacuguuuacauaugcauggauuauuagcauuaucuucaaucugugauuucuuugcagaaaucuuuuuaagccacuuuuccauuuugaaaggauuggcuaaaauuuuauaauauaauccacuuauguauugcauauacugcaauauuuuacaacaugcugaaagcaaaugaauaaauacuagguagcauggugaacuucuugaccuacagaauuccuccuuuccuccagaauaucugcauauuguagaaggcaugugcccaucuaucugacuuaagggcugaauaugaacauuaacgucuguucauauagcaagucuccauucuggagaccccaaugcuagagagcuaaauagaacaaacagaaaacaaacaaacaaacaacaacaacaacaaaaaggcucccaaaagaucaaauguuuucauaacacagcuaccuccacuggcuugugauguuuugcuagguaacucaggucagauauuuuaaauauauaaaaauguguauucuuucguaaagaguaagacuuuaaauagcuauuaaaauacuucuaauuagauauacuuacauuauuuuuuguugaauauucugcugauaaauaaagaaacaacugcuuaacauuccaaucaaauauauucucuagauguaaguaaauuaaggaaaauauaaauuuaugagcaguauaucacuuuuaaauagaucuuaauuauucuuagguuauuuauccauaacaguaauacuaaaguagaaaagaggcggcccagaaacauaaugugccacuaauuuaauaaaaauaugcagaagauaaauacauugugaaauccagcuuauuccaaaacaaaaaaaugucaguaugagauuacuggcauccucccauacuccuccaaggauuacuagcugagauacuuugacuaguaagaaaagaacaaauccaaaauuugguuuucuguaacaucaacuaaguuaaaaaaaaaaaaaagaggacucgauauuucaagcaaauacaauuccacuggagcucuaaaguauaaacaaucaccaccauuuaaauuuaacaauaugcaaacauaaacaaggcucaauaauuaaccaaguauaauaaauuguacaugucacuuuuggucacaugcaaguagacauuaaaaugucucucaaagaugcaaaugacaccaauguggcucaauucagucucccaaagaggacaagaacuucaccagaauuaacaagacuggugccaauaccaagaaauaagcggaguuaauauuuggauuuuuaaguauuauguuaauuguuaaguuaacucauuuuacuauaugaguuuccacacugguaguaacacauuuguuacauuccauuauuaauuauguguaaccacuaagaaucacuccuuuagaacuaagucuaggacugcuguuuacaagaacagcaacaauuucaaguaguaguagcagcagcauuaagaaaaucugaagaaacuacaaauaaugagauugguaauauauaaauaccauagauaccaggaaauuucacuauaauucucuggauacacaaaauuacuacccucacaguagaccuaaauucccuuaagcagauuuuuaaaaauuacacaaagacuuaaaaauacacaugaaauucagcauaagacucuuccgaugguacacucuauuuccuaaaaagguaccuacagaacuaauucuuagccuauuucuaaauccaauaauuaccaaaacuuaagcuaaaaguaaauuucauggucauagaaaggcaaauuagauaaauuccccaaguauaugaucagcuuuaacuguucagacagguacuuucacacaaguucagaucguucaaucuccacaaccauuuaaaucacgggguauuaaaaaggcagaugaaaucaggcuagaaauggcagagaacauugccaagauauuaaccuaagaaagacccuaaaaaagacuagccuggccaaaaugaucagaguugucaaaagauagaaacucaaucucaagagaaaauauuuaaauaucaccaccaaagaaacucuuauaauuguuaauauuuucugacuuuuauaaaaguccuuauaaaaagaguuaugacggcaaaaagcaaccacagguuaccaauaauuuugauaugaccuuuucaaaucauaacacacguaauucacuuuuuaaacauauguuucucucugcuauaauaaaauauggauauauuauuugaaauuguacaugaaauauucacaggcaggcugagcauugguaauauuuuuccuucuuauccaaaugaucuaauuuuauuuuuucuuucuaaaauacagauucaaacuuucuuauguaguuuucaaucaauuuaauguuucgguuaagaauuuaaaguauguucacacaacuacucaugaaucuaugaaguuuucuccaagugucauggggagguauuaacauuauuuuacugaugaaaaaggcggaauuuccaagguuuggcugauucaaugagauagucacacuguaucccaaaucauuaaacaacacauaucucauuauaaaacuacagaaaacgcaacgaaauauuuucuuaaaggauaucagcaguuauaucaaaugugauaaaucccagaucacuucuuucucuagguccagugaaaucuucuacauuuuuucuaggaauaaagauaaaaguuuuaccauccuuccaacagaacauacacaauucacguaacuucuuaaagagaaagaauacaggugugugcauaggugaaacugcaauuccacaaagaaacgaguaaacaccagagaaaccuguaagugugaaaacaggagaaacauucuaauccaauauuaaaguaggucuucagcuaauugcauauaccucaagagaaucccuaacaaaacucagaaggggauaaaaacugcuaaaaagaauaguaaauacuugauguaaagcaauuuugcagaauggguagaagaaagcuacacaugacuacaaggugauacgaauacuaacagauggcauauuaaagggugauacaguaaucacccccuuauccgagguuucacuuuccgguuucaauuauccgcggucaaucuggugugaaaauaggugaguccaguaaaauaaguuauuuugagagaaggggaaagagaucauauucacauaacuuuuauuauaguauauuguuacaguucuauuauguuauuguuaaucucuuauugugcuuaacuuguaaguuuuaucauagguagguauguauguacgguauaggaaaaaaccaaguauauauaggguuuggugcuauccgugguuucagccauccacugggggucuuggaacguauaccuaccccauuaaggggauacuacuguaaccagcugcuauuuacuguuuacuacggcucagacccacugacaauauuuuucacauuucaaauaauucucacaaccuaaaaauuagguauuacuuccaucuuaaacaaaaagaaauuaaggcccagaaugguaagaaaacuugcucaagacaacaacagcuaacaucuguucaguguuuaauaugcaccaagcucuucuaacccucacagggcugacaauggcagugcugauguccaccccaggucuauucgaacaauaucuaacaaacaucaguacaguaauuuaaaaaaaaaaaaaaaagguggggggagaaggcucgcuauuugauaacuggcuucuuggcgauucugacaaagaaauaaacuaagguuaaagaacuuguguaagacggaaauagaguagaaggguaugagaacaagagauggaaaaauacgacgauuaaagacaaaagugccagagaauaaaaucaaggacaaaauaggcaauagcgaaauggcacugucauuucgaacugcauuuuuuggcguuuucgcagacuucuucaagugguuggcaaaagaaaaagaaauaaagaaacccaacaaaacaaaaaucucgcuguaucagaaggcuaagaugcuuaauucucucagugcccaacaucucuggccaacuucaaagcagcuccaacuguuuacugccuucugaaggugcaaaggcaacaacuguaaagggaaugucaaacagggcaaacucgggugaugaaugacacaaagacaaccccguccuguggccuccagagccgccaggaaaccccacggaagcccgacccagagcgcggcggcagcgccuggagggccucgcaugcggaccacgagcggcaccggacgcgcgggaggcgccagcccaggcgggcggcggcgccggcucugcuguuguguugcucccucauuggccaggcguggguggagggaagugaggaacaggaagcaagcggaggcaccgaccugaggaacgcucaaaauuaaaauuuaagagcaagcccgggaauuuacgguggaggggugcaaguuccgaggggacgccggaaaagccugcgacguccaccccugacgaccgcccucgggggcgaacugccgcucaggagggcgauccggacgcccugcccgcggccccggcacggcagccccggcgcggcggcccggcuucggcuuccgccccagcccggucccggcguccugcaccgccggcccggccucacucacagcaugauccgcgagacgugcagccgcaccgggacgcuccugucuuugaaggcgguggugaugaagcagccgaaggugagcgccgccaucacgcucagcgagaaggcgaacagugaguucgcccgcgacagcaccguguucaucgcgaucgucucccacgaguccggacuccacacgcacacccaggcucccguuccggcggcggaccggcucccugcgauccgcgccgucugc

SEQ ID NO: 19168 - RNA, 9594 nt, Homo sapiens
cagacggcgcggaucgcagggagccgguccgccgccggaacgggagccugggugugcguguggaguccggacucgugggagacgaucgcgaugaacacggugcugucgcgggcgaacucacuguucgccuucucgcugagcgugauggcggcgcucaccuucggcugcuucaucaccaccgccuucaaagacaggagcgucccggugcggcugcacgucucgcggaucaugcugugagugaggccgggccggcggugcaggacgccgggaccgggcuggggcggaagccgaagccgggccgccgcgccggggcugccgugccggggccgcgggcagggcguccggaucgcccuccugagcggcaguucgcccccgagggcggucgucagggguggacgucgcaggcuuuuccggcguccccucggaacuugcaccccuccaccguaaauucccgggcuugcucuuaaauuuuaauuuugagcguuccucaggucggugccuccgcuugcuuccuguuccucacuucccuccacccacgccuggccaaugagggagcaacacaacagcagagccggcgccgccgcccgccugggcuggcgccucccgcgcguccggugccgcucgugguccgcaugcgaggcccuccaggcgcugccgccgcgcucugggucgggcuuccgugggguuuccuggcggcucuggaggccacaggacgggguugucuuugugucauucaucacccgaguuugcccuguuugacauucccuuuacaguuguugccuuugcaccuucagaaggcaguaaacaguuggagcugcuuugaaguuggccagagauguugggcacugagagaauuaagcaucuuagccuucugauacagcgagauuuuuguuuuguuggguuucuuuauuucuuuuucuuuugccaaccacuugaagaagucugcgaaaacgccaaaaaaugcaguucgaaaugacagugccauuucgcuauugccuauuuuguccuugauuuuauucucuggcacuuuugucuuuaaucgucguauuuuuccaucucuuguucucauacccuucuacucuauuuccgucuuacacaaguucuuuaaccuuaguuuauuucuuugucagaaucgccaagaagccaguuaucaaauagcgagccuucuccccccaccuuuuuuuuuuuuuuuuaaauuacuguacugauguuuguuagauauuguucgaauagaccugggguggacaucagcacugccauugucagcccugugaggguuagaagagcuuggugcauauuaaacacugaacagauguuagcuguuguugucuugagcaaguuuucuuaccauucugggccuuaauuucuuuuuguuuaagauggaaguaauaccuaauuuuuagguugugagaauuauuugaaaugugaaaaauauugucagugggucugagccguaguaaacaguaaauagcagcugguuacaguaguauccccuuaaugggguagguauacguuccaagacccccaguggauggcugaaaccacggauagcaccaaacccuauauauacuugguuuuuuccuauaccguacauacauaccuaccuaugauaaaacuuacaaguuaagcacaauaagagauuaacaauaacauaauagaacuguaacaauauacuauaauaaaaguuaugugaauaugaucucuuuccccuucucucaaaauaacuuauuuuacuggacucaccuauuuucacaccagauugaccgcggauaauugaaaccggaaagugaaaccucggauaagggggugauuacuguaucacccuuuaauaugccaucuguuaguauucguaucaccuuguagucauguguagcuuucuucuacccauucugcaaaauugcuuuacaucaaguauuuacuauucuuuuuagcaguuuuuauccccuucugaguuuuguuagggauucucuugagguauaugcaauuagcugaagaccuacuuuaauauuggauuagaauguuucuccuguuuucacacuuacagguuucucugguguuuacucguuucuuuguggaauugcaguuucaccuaugcacacaccuguauucuuucucuuuaagaaguuacgugaauuguguauguucuguuggaaggaugguaaaacuuuuaucuuuauuccuagaaaaaauguagaagauuucacuggaccuagagaaagaagugaucugggauuuaucacauuugauauaacugcugauauccuuuaagaaaauauuucguugcguuuucuguaguuuuauaaugagauauguguuguuuaaugauuugggauacagugugacuaucucauugaaucagccaaaccuuggaaauuccgccuuuuucaucaguaaaauaauguuaauaccuccccaugacacuuggagaaaacuucauagauucaugaguaguugugugaacauacuuuaaauucuuaaccgaaacauuaaauugauugaaaacuacauaagaaaguuugaaucuguauuuuagaaagaaaaaauaaaauuagaucauuuggauaagaaggaaaaauauuaccaaugcucagccugccugugaauauuucauguacaauuucaaauaauauauccauauuuuauuauagcagagagaaacauauguuuaaaaagugaauuacguguguuaugauuugaaaaggucauaucaaaauuauugguaaccugugguugcuuuuugccgucauaacucuuuuuauaaggacuuuuauaaaagucagaaaauauuaacaauuauaagaguuucuuugguggugauauuuaaauauuuucucuugagauugaguuucuaucuuuugacaacucugaucauuuuggccaggcuagucuuuuuuagggucuuucuuagguuaauaucuuggcaauguucucugccauuucuagccugauuucaucugccuuuuuaauaccccgugauuuaaaugguuguggagauugaacgaucugaacuugugugaaaguaccugucugaacaguuaaagcugaucauauacuuggggaauuuaucuaauuugccuuucuaugaccaugaaauuuacuuuuagcuuaaguuuugguaauuauuggauuuagaaauaggcuaagaauuaguucuguagguaccuuuuuaggaaauagaguguaccaucggaagagucuuaugcugaauuucauguguauuuuuaagucuuuguguaauuuuuaaaaaucugcuuaagggaauuuaggucuacugugaggguaguaauuuuguguauccagagaauuauagugaaauuuccugguaucuaugguauuuauauauuaccaaucucauuauuuguaguuucuucagauuuucuuaaugcugcugcuacuacuacuugaaauuguugcuguucuuguaaacagcaguccuagacuuaguucuaaaggagugauucuuagugguuacacauaauuaauaauggaauguaacaaauguguuacuaccaguguggaaacucauauaguaaaaugaguuaacuuaacaauuaacauaauacuuaaaaauccaaauauuaacuccgcuuauuucuugguauuggcaccagucuuguuaauucuggugaaguucuuguccucuuugggagacugaauugagccacauuggugucauuugcaucuuugagagacauuuuaaugucuacuugcaugugaccaaaagugacauguacaauuuauuauacuugguuaauuauugagccuuguuuauguuugcauauuguuaaauuuaaaugguggugauuguuuauacuuuagagcuccaguggaauuguauuugcuugaaauaucgaguccucuuuuuuuuuuuuuuaacuuaguugauguuacagaaaaccaaauuuuggauuuguucuuuucuuacuagucaaaguaucucagcuaguaauccuuggaggaguaugggaggaugccaguaaucucauacugacauuuuuuuguuuuggaauaagcuggauuucacaauguauuuaucuucugcauauuuuuauuaaauuaguggcacauuauguuucugggccgccucuuuucuacuuuaguauuacuguuauggauaaauaaccuaagaauaauuaagaucuauuuaaaagugauauacugcucauaaauuuauauuuuccuuaauuuacuuacaucuagagaauauauuugauuggaauguuaagcaguuguuucuuuauuuaucagcagaauauucaacaaaaaauaauguaaguauaucuaauuagaaguauuuuaauagcuauuuaaagucuuacucuuuacgaaagaauacacauuuuuauauauuuaaaauaucugaccugaguuaccuagcaaaacaucacaagccaguggagguagcuguguuaugaaaacauuugaucuuuugggagccuuuuuguuguuguuguuguuuguuuguuuguuuucuguuuguucuauuuagcucucuagcauuggggucuccagaauggagacuugcuauaugaacagacguuaauguucauauucagcccuuaagucagauagaugggcacaugccuucuacaauaugcagauauucuggaggaaaggaggaauucuguaggucaagaaguucaccaugcuaccuaguauuuauucauuugcuuucagcauguuguaaaauauugcaguauaugcaauacauaaguggauuauauuauaaaauuuuagccaauccuuucaaaauggaaaaguggcuuaaaaagauuucugcaaagaaaucacagauugaagauaaugcuaauaauccaugcauauguaaacaguaggaaaaugguggagcucauacuuguauuccucuucugagcugcugugucacacugaaggauuaaaaaaacacaaagacaaccuagauagaucugauaacuuggcugagacacugucaaugauauuaauuaacaauaguaagaucagaaagauauugcugaacuaucaacuaggaaauggaguggguagccgguaguauugccaccacucagcuguuuccuuuuuuuuuuuacuuuuuuuuuuuuuuuuaagacagagucucgugcuuguagcccgggcuggaguacaguagcgccgucaaucucagcucacugcaagcuuugccuccuagauucaagcaguucuccugccucagccuccugaguagcugggauuacaggcgccugccaccauucccagcuaauuuuuguauuuuuaguagagacgguuucaccauguuggcuaggcuggucucgaacuccuaaccucaggucauccgcaugccucguccucccaaagugcuaggauuacaggcauaagccaccgcgcccggccguuguuuacucuuuaagcuaaaauauucucucuccacagcugcaauuagagagcugcauggugaccuacuugaaucaacaaaauuugagaccugugauuauaauucucauuaugacuauauauaaucaaaagcuguaaagauuguuaauaauuuucaaaccuucugagauuauuuuaaaauccaucuuaguaccagauaccuuucuuuaaaaaaaaaaaaaaaaagaacauggugcaagguguuuuugguagucuacauuaagccauauagcuacaauuaauuaauauccuuaccuauugagaacaauuugccuuuguuuuaggguugcaugggauucauuaaucugaguaucugaguacuugaacugguuuuuuguuguuguuguuguuuuuauuuauuuauuuuuaacacggaguuuuacucuuguuguccaggcuggaguacaguaguaugaucucggcucacugcaaccuccacauccuggguucaagugauuccccugccucagccccccaaguagcugggauuacaggcacccaccaccaugcuaauaacuuucaaucauaaacuaauaguuuuaauagguuuugauauaaugguuuaauagcuuuuaauuauaaaacuuauuaugaauuauaauuugugauuuaaaaaacuaguucaggccgggcacaguggcucacaccuguaaucccagcacuuugggaggcugaggcagguggaccaccugaggucaggaguuccagaccagccuggccaacauggugaaaccccaucucugcuaaaaauacaaaaaauuagccaggcguaguggugcgcgccuguaauccuagcuacuugggaggcugaggcaggagaaucgcaugaaccugggagguggagguugcagugagcugagauugugccauuguacuccacccugguugacagagcaagacucuaucuccaaaaaaaaaaggaagaaauaacugcucuacauuucuuuuuaguuaauguagucaucauauacugaguaauuggccuuaaaagcgaauagaugcuaacuuaauaagagcaaauuccuugggauuuaguaguggccacaaauuuuuuuuauuuccauuucauacuuuuaauuuucuaaauggaacuuauuuguaauauguugaaagaguagcuuaaaagaauugucugaccucuagaauuuugccuugaugagacaacaaugcauguauuuucuuaauuaaagggaaaaaagaucuuuaaaaggcuucauuucuuuagugauuucuuaaagcuuuuguaaagaaaucuuggagaagauuucuuauaaauuuucaugacauaauuaaucagcaguaaccuguauuagcagugugauggaacagggauuggcucuugucuguuuuccuggcaccauuuaggauccaugcugagcuggagggucuuagaaauuuuauagggaaaagugauuuaaaagaauacuucccuucuagggauuuaauucaucuguuccuccaaaggccucacuuuuuggagaucuuauagaucaaaaaccuugcauuaaguuaugaaggcacuaaguaauacaguugaguuagcagaaggaaugaacuccuucagggaauugucauucuucucucugagaaaaguuugccccuuuuuuguaucucucucuuugcuaucauuuguaugcauuaagauuucagcaagcuccucaaguugaauucauuaacaugucaaacuauuugcuuacuaauacuuuuaauuugaagugauaagaugguauuucugaugaguuaucuaauuaauuuucauuuuaauauaggcucugaaccaaguuguccuaugggacaagauuguuuugagaggugauaauccgaagcugcugcugaaagauaugaaaacaaaauauuuuuucuuugacgauggaaauggucucaagugagcaauucuuggucauuuuuuuacauuuaauaagaggugaaaaagagagaaagauguauuuuuauuuuaaagaaaaauacuugagaguaaaaggagaaaaauugggaaagaaguauuuaugcauaucugaacugaaagauuggguggaaaugcaaagugagaucuaagauaagcaauucucuugcaguuucugaaaugucauagucaaacuaauaaagcuucuauccuaagcguguacaaggaauacgggcuuguucagaugcgguagggcugugguggucaaaucaaagggcuccuuucugagcgugagucgggaaaccuuagaagcagcauguugggucuaggaguugauaauaguuaaaagaaguaguauugguucuccaaacgugacuucucuaaagcucauuuuagucagugugauugaucucucagguuauuuuuaccucuuagacucuagugguaaacauuggaaauaauuuuagaagaaagcuauuucgaccaagccaaacgucuguauuugcaaugaaaauuucagaacaugagaauuuuguuaagguuuguccaucuagauaauugacagaguuaggcuucaaaucauugcucugauucuuagcucgucucuuuuuacauuuacuguuuuaaucauuuaaacuuuucgguugaugguucuaacugcagcugugaguuuagaugggucauccugggauaucaguaaauguagugccccugucuucuagcauuguccuuggauuuuaagugacaugagaaaauaguucuuuuugcagauuaacauauuaggauuucuguuaggaauagaugguuauaaauaaaguauuugacaucucaguguuugucuuaaaauuuuuuuugaacuacuagugucucugaugacuuguguuuauuauaucuuuuuauaggggaaacaggaaugucacuuugacccugucuuggaacgucguaccaaaugcuggaauucuaccucuugugacaggaucaggacacguaucugucccauuuccagauacauaugaaauaacgaagaguuauuaaauuauucugaauuugaaacaacauauuuuuauacuuaaugaauuguaucucauuaaucucuucccuuacaucuucauguauuguugguuuguuuuuugguuuuggguuuuuuuuuuuuuuuuuuugguauaagaacuaacaucaaaaggccuguuuaaagggaaagguuaaugggcuacuuaauauuaugaacaaaacaaaaaaacaaggcugccacaguggaauauuaucuuacaagaauaagaacuacauaaaacagauuuguaaaaaauacauauuugaaguauucccuguauuuccauuauucuuuauggaauauaaaguaagcaugaaagguaguuaaaacuuucaggugccuguagagucauaauaacuguauuuuaugccuugcauucacgcaaauucacauuggaugugauuuaaaaguagacauucucuuuuuccucuuuuaggauauguuugauuacuggaaaauuaauaugguuauuuguuagaagucugguuuauaaaaaagccaaaagugauggaauuuauuccauuugucuuaggaaggcccauaauacuuguuuuucuuacaugugacuagcaacuuucuccacuuaaagacuaaauaccucuuuauaugauguaaauuauucuaauucauuuuaaaaucuuuuaggucagcaaaaugugugucuucagugcuuucucuaaaaacguuccuuuauagcuuuguacuuuuuuuuuuagcguugccauugaaaguuaaaauguuugcaugguuuacccucugaguuauguuucuucuagugagcaugccugcugucacuaagugaauuauuuacuacuuuuuguaggucuauauuuuaauaauuauugggauaauaauaauugugguaugcuuuccauuuacaaaccacucauauacuuuaguguaugucauccucaauaaucuaaugagguaaguaguauaaguguuagcucuuugcagauaagaaacugaaacccagaaguuuauugaauugcuucauuguuaccuagccagcaaggaguggaauuaaaacuugaacucagaucuucuaauuuucugagcucauccuuucucuuauaccucagauugcagacuaaucaaauuuuacuuaaaaccuuccugauauuuuuguuacccuggacacccuuucuauucuagaaaagguuucccauuuuauauggaagugacuaauuuucaagcugccaacaacuuauaucgagguaauauuuuauucucu

SEQ ID NO: 19169 - RNA, 9594 nt, Homo sapiens
agagaauaaaauauuaccucgauauaaguuguuggcagcuugaaaauuagucacuuccauauaaaaugggaaaccuuuucuagaauagaaaggguguccaggguaacaaaaauaucaggaagguuuuaaguaaaauuugauuagucugcaaucugagguauaagagaaaggaugagcucagaaaauuagaagaucugaguucaaguuuuaauuccacuccuugcuggcuagguaacaaugaagcaauucaauaaacuucuggguuucaguuucuuaucugcaaagagcuaacacuuauacuacuuaccucauuagauuauugaggaugacauacacuaaaguauaugagugguuuguaaauggaaagcauaccacaauuauuauuaucccaauaauuauuaaaauauagaccuacaaaaaguaguaaauaauucacuuagugacagcaggcaugcucacuagaagaaacauaacucagaggguaaaccaugcaaacauuuuaacuuucaauggcaacgcuaaaaaaaaaaguacaaagcuauaaaggaacguuuuuagagaaagcacugaagacacacauuuugcugaccuaaaagauuuuaaaaugaauuagaauaauuuacaucauauaaagagguauuuagucuuuaaguggagaaaguugcuagucacauguaagaaaaacaaguauuaugggccuuccuaagacaaauggaauaaauuccaucacuuuuggcuuuuuuauaaaccagacuucuaacaaauaaccauauuaauuuuccaguaaucaaacauauccuaaaagaggaaaaagagaaugucuacuuuuaaaucacauccaaugugaauuugcgugaaugcaaggcauaaaauacaguuauuaugacucuacaggcaccugaaaguuuuaacuaccuuucaugcuuacuuuauauuccauaaagaauaauggaaauacagggaauacuucaaauauguauuuuuuacaaaucuguuuuauguaguucuuauucuuguaagauaauauuccacuguggcagccuuguuuuuuuguuuuguucauaauauuaaguagcccauuaaccuuucccuuuaaacaggccuuuugauguuaguucuuauaccaaaaaaaaaaaaaaaaaaacccaaaaccaaaaaacaaaccaacaauacaugaagauguaagggaagagauuaaugagauacaauucauuaaguauaaaaauauguuguuucaaauucagaauaauuuaauaacucuucguuauuucauauguaucuggaaaugggacagauacguguccugauccugucacaagagguagaauuccagcauuugguacgacguuccaagacagggucaaagugacauuccuguuuccccuauaaaaagauauaauaaacacaagucaucagagacacuaguaguucaaaaaaaauuuuaagacaaacacugagaugucaaauacuuuauuuauaaccaucuauuccuaacagaaauccuaauauguuaaucugcaaaaagaacuauuuucucaugucacuuaaaauccaaggacaaugcuagaagacaggggcacuacauuuacugauaucccaggaugacccaucuaaacucacagcugcaguuagaaccaucaaccgaaaaguuuaaaugauuaaaacaguaaauguaaaaagagacgagcuaagaaucagagcaaugauuugaagccuaacucugucaauuaucuagauggacaaaccuuaacaaaauucucauguucugaaauuuucauugcaaauacagacguuuggcuuggucgaaauagcuuucuucuaaaauuauuuccaauguuuaccacuagagucuaagagguaaaaauaaccugagagaucaaucacacugacuaaaaugagcuuuagagaagucacguuuggagaaccaauacuacuucuuuuaacuauuaucaacuccuagacccaacaugcugcuucuaagguuucccgacucacgcucagaaaggagcccuuugauuugaccaccacagcccuaccgcaucugaacaagcccguauuccuuguacacgcuuaggauagaagcuuuauuaguuugacuaugacauuucagaaacugcaagagaauugcuuaucuuagaucucacuuugcauuuccacccaaucuuucaguucagauaugcauaaauacuucuuucccaauuuuucuccuuuuacucucaaguauuuuucuuuaaaauaaaaauacaucuuucucucuuuuucaccucuuauuaaauguaaaaaaaugaccaagaauugcucacuugagaccauuuccaucgucaaagaaaaaauauuuuguuuucauaucuuucagcagcagcuucggauuaucaccucucaaaacaaucuugucccauaggacaacuugguucagagccuauauuaaaaugaaaauuaauuagauaacucaucagaaauaccaucuuaucacuucaaauuaaaaguauuaguaagcaaauaguuugacauguuaaugaauucaacuugaggagcuugcugaaaucuuaaugcauacaaaugauagcaaagagagagauacaaaaaaggggcaaacuuuucucagagagaagaaugacaauucccugaaggaguucauuccuucugcuaacucaacuguauuacuuagugccuucauaacuuaaugcaagguuuuugaucuauaagaucuccaaaaagugaggccuuuggaggaacagaugaauuaaaucccuagaagggaaguauucuuuuaaaucacuuuucccuauaaaauuucuaagacccuccagcucagcauggauccuaaauggugccaggaaaacagacaagagccaaucccuguuccaucacacugcuaauacagguuacugcugauuaauuaugucaugaaaauuuauaagaaaucuucuccaagauuucuuuacaaaagcuuuaagaaaucacuaaagaaaugaagccuuuuaaagaucuuuuuucccuuuaauuaagaaaauacaugcauuguugucucaucaaggcaaaauucuagaggucagacaauucuuuuaagcuacucuuucaacauauuacaaauaaguuccauuuagaaaauuaaaaguaugaaauggaaauaaaaaaaauuuguggccacuacuaaaucccaaggaauuugcucuuauuaaguuagcaucuauucgcuuuuaaggccaauuacucaguauaugaugacuacauuaacuaaaaagaaauguagagcaguuauuucuuccuuuuuuuuuuggagauagagucuugcucugucaaccaggguggaguacaauggcacaaucucagcucacugcaaccuccaccucccagguucaugcgauucuccugccucagccucccaaguagcuaggauuacaggcgcgcaccacuacgccuggcuaauuuuuuguauuuuuagcagagaugggguuucaccauguuggccaggcuggucuggaacuccugaccucaggugguccaccugccucagccucccaaagugcugggauuacaggugugagccacugugcccggccugaacuaguuuuuuaaaucacaaauuauaauucauaauaaguuuuauaauuaaaagcuauuaaaccauuauaucaaaaccuauuaaaacuauuaguuuaugauugaaaguuauuagcaugguggugggugccuguaaucccagcuacuuggggggcugaggcaggggaaucacuugaacccaggauguggagguugcagugagccgagaucauacuacuguacuccagccuggacaacaagaguaaaacuccguguuaaaaauaaauaaauaaaaacaacaacaacaacaaaaaaccaguucaaguacucagauacucagauuaaugaaucccaugcaacccuaaaacaaaggcaaauuguucucaauagguaaggauauuaauuaauuguagcuauauggcuuaauguagacuaccaaaaacaccuugcaccauguucuuuuuuuuuuuuuuuuuaaagaaagguaucugguacuaagauggauuuuaaaauaaucucagaagguuugaaaauuauuaacaaucuuuacagcuuuugauuauauauagucauaaugagaauuauaaucacaggucucaaauuuuguugauucaaguaggucaccaugcagcucucuaauugcagcuguggagagagaauauuuuagcuuaaagaguaaacaacggccgggcgcgguggcuuaugccuguaauccuagcacuuugggaggacgaggcaugcggaugaccugagguuaggaguucgagaccagccuagccaacauggugaaaccgucucuacuaaaaauacaaaaauuagcugggaaugguggcaggcgccuguaaucccagcuacucaggaggcugaggcaggagaacugcuugaaucuaggaggcaaagcuugcagugagcugagauugacggcgcuacuguacuccagcccgggcuacaagcacgagacucugucuuaaaaaaaaaaaaaaaaguaaaaaaaaaaaggaaacagcugagugguggcaauacuaccggcuacccacuccauuuccuaguugauaguucagcaauaucuuucugaucuuacuauuguuaauuaauaucauugacagugucucagccaaguuaucagaucuaucuagguugucuuuguguuuuuuuaauccuucagugugacacagcagcucagaagaggaauacaaguaugagcuccaccauuuuccuacuguuuacauaugcauggauuauuagcauuaucuucaaucugugauuucuuugcagaaaucuuuuuaagccacuuuuccauuuugaaaggauuggcuaaaauuuuauaauauaauccacuuauguauugcauauacugcaauauuuuacaacaugcugaaagcaaaugaauaaauacuagguagcauggugaacuucuugaccuacagaauuccuccuuuccuccagaauaucugcauauuguagaaggcaugugcccaucuaucugacuuaagggcugaauaugaacauuaacgucuguucauauagcaagucuccauucuggagaccccaaugcuagagagcuaaauagaacaaacagaaaacaaacaaacaaacaacaacaacaacaaaaaggcucccaaaagaucaaauguuuucauaacacagcuaccuccacuggcuugugauguuuugcuagguaacucaggucagauauuuuaaauauauaaaaauguguauucuuucguaaagaguaagacuuuaaauagcuauuaaaauacuucuaauuagauauacuuacauuauuuuuuguugaauauucugcugauaaauaaagaaacaacugcuuaacauuccaaucaaauauauucucuagauguaaguaaauuaaggaaaauauaaauuuaugagcaguauaucacuuuuaaauagaucuuaauuauucuuagguuauuuauccauaacaguaauacuaaaguagaaaagaggcggcccagaaacauaaugugccacuaauuuaauaaaaauaugcagaagauaaauacauugugaaauccagcuuauuccaaaacaaaaaaaugucaguaugagauuacuggcauccucccauacuccuccaaggauuacuagcugagauacuuugacuaguaagaaaagaacaaauccaaaauuugguuuucuguaacaucaacuaaguuaaaaaaaaaaaaaagaggacucgauauuucaagcaaauacaauuccacuggagcucuaaaguauaaacaaucaccaccauuuaaauuuaacaauaugcaaacauaaacaaggcucaauaauuaaccaaguauaauaaauuguacaugucacuuuuggucacaugcaaguagacauuaaaaugucucucaaagaugcaaaugacaccaauguggcucaauucagucucccaaagaggacaagaacuucaccagaauuaacaagacuggugccaauaccaagaaauaagcggaguuaauauuuggauuuuuaaguauuauguuaauuguuaaguuaacucauuuuacuauaugaguuuccacacugguaguaacacauuuguuacauuccauuauuaauuauguguaaccacuaagaaucacuccuuuagaacuaagucuaggacugcuguuuacaagaacagcaacaauuucaaguaguaguagcagcagcauuaagaaaaucugaagaaacuacaaauaaugagauugguaauauauaaauaccauagauaccaggaaauuucacuauaauucucuggauacacaaaauuacuacccucacaguagaccuaaauucccuuaagcagauuuuuaaaaauuacacaaagacuuaaaaauacacaugaaauucagcauaagacucuuccgaugguacacucuauuuccuaaaaagguaccuacagaacuaauucuuagccuauuucuaaauccaauaauuaccaaaacuuaagcuaaaaguaaauuucauggucauagaaaggcaaauuagauaaauuccccaaguauaugaucagcuuuaacuguucagacagguacuuucacacaaguucagaucguucaaucuccacaaccauuuaaaucacgggguauuaaaaaggcagaugaaaucaggcuagaaauggcagagaacauugccaagauauuaaccuaagaaagacccuaaaaaagacuagccuggccaaaaugaucagaguugucaaaagauagaaacucaaucucaagagaaaauauuuaaauaucaccaccaaagaaacucuuauaauuguuaauauuuucugacuuuuauaaaaguccuuauaaaaagaguuaugacggcaaaaagcaaccacagguuaccaauaauuuugauaugaccuuuucaaaucauaacacacguaauucacuuuuuaaacauauguuucucucugcuauaauaaaauauggauauauuauuugaaauuguacaugaaauauucacaggcaggcugagcauugguaauauuuuuccuucuuauccaaaugaucuaauuuuauuuuuucuuucuaaaauacagauucaaacuuucuuauguaguuuucaaucaauuuaauguuucgguuaagaauuuaaaguauguucacacaacuacucaugaaucuaugaaguuuucuccaagugucauggggagguauuaacauuauuuuacugaugaaaaaggcggaauuuccaagguuuggcugauucaaugagauagucacacuguaucccaaaucauuaaacaacacauaucucauuauaaaacuacagaaaacgcaacgaaauauuuucuuaaaggauaucagcaguuauaucaaaugugauaaaucccagaucacuucuuucucuagguccagugaaaucuucuacauuuuuucuaggaauaaagauaaaaguuuuaccauccuuccaacagaacauacacaauucacguaacuucuuaaagagaaagaauacaggugugugcauaggugaaacugcaauuccacaaagaaacgaguaaacaccagagaaaccuguaagugugaaaacaggagaaacauucuaauccaauauuaaaguaggucuucagcuaauugcauauaccucaagagaaucccuaacaaaacucagaaggggauaaaaacugcuaaaaagaauaguaaauacuugauguaaagcaauuuugcagaauggguagaagaaagcuacacaugacuacaaggugauacgaauacuaacagauggcauauuaaagggugauacaguaaucacccccuuauccgagguuucacuuuccgguuucaauuauccgcggucaaucuggugugaaaauaggugaguccaguaaaauaaguuauuuugagagaaggggaaagagaucauauucacauaacuuuuauuauaguauauuguuacaguucuauuauguuauuguuaaucucuuauugugcuuaacuuguaaguuuuaucauagguagguauguauguacgguauaggaaaaaaccaaguauauauaggguuuggugcuauccgugguuucagccauccacugggggucuuggaacguauaccuaccccauuaaggggauacuacuguaaccagcugcuauuuacuguuuacuacggcucagacccacugacaauauuuuucacauuucaaauaauucucacaaccuaaaaauuagguauuacuuccaucuuaaacaaaaagaaauuaaggcccagaaugguaagaaaacuugcucaagacaacaacagcuaacaucuguucaguguuuaauaugcaccaagcucuucuaacccucacagggcugacaauggcagugcugauguccaccccaggucuauucgaacaauaucuaacaaacaucaguacaguaauuuaaaaaaaaaaaaaaaagguggggggagaaggcucgcuauuugauaacuggcuucuuggcgauucugacaaagaaauaaacuaagguuaaagaacuuguguaagacggaaauagaguagaaggguaugagaacaagagauggaaaaauacgacgauuaaagacaaaagugccagagaauaaaaucaaggacaaaauaggcaauagcgaaauggcacugucauuucgaacugcauuuuuuggcguuuucgcagacuucuucaagugguuggcaaaagaaaaagaaauaaagaaacccaacaaaacaaaaaucucgcuguaucagaaggcuaagaugcuuaauucucucagugcccaacaucucuggccaacuucaaagcagcuccaacuguuuacugccuucugaaggugcaaaggcaacaacuguaaagggaaugucaaacagggcaaacucgggugaugaaugacacaaagacaaccccguccuguggccuccagagccgccaggaaaccccacggaagcccgacccagagcgcggcggcagcgccuggagggccucgcaugcggaccacgagcggcaccggacgcgcgggaggcgccagcccaggcgggcggcggcgccggcucugcuguuguguugcucccucauuggccaggcguggguggagggaagugaggaacaggaagcaagcggaggcaccgaccugaggaacgcucaaaauuaaaauuuaagagcaagcccgggaauuuacgguggaggggugcaaguuccgaggggacgccggaaaagccugcgacguccaccccugacgaccgcccucgggggcgaacugccgcucaggagggcgauccggacgcccugcccgcggccccggcacggcagccccggcgcggcggcccggcuucggcuuccgccccagcccggucccggcguccugcaccgccggcccggccucacucacagcaugauccgcgagacgugcagccgcaccgggacgcuccugucuuugaaggcgguggugaugaagcagccgaaggugagcgccgccaucacgcucagcgagaaggcgaacagugaguucgcccgcgacagcaccguguucaucgcgaucgucucccacgaguccggacuccacacgcacacccaggcucccguuccggcggcggaccggcucccugcgauccgcgccgucug

SEQ ID NO: 19170 - RNA, 1648 nt, Homo sapiens
auugcuuuuuaaaggugcuuuauuaacuucacuauaaugagcaucuuuccaugcaauagguaaaauucuucugcuaacaaaaaucuuacagacugguucaaaaacacaauauucaauuagaagcugguaauaggagacccacguaaacaagugacagguaaagguuuacaacaagggcacaucaugaacauguaaauucgaaagcaggggucuguuuccguaauaacuuuagggaaaccaucaggauucagggcauaaggcaaaacucaucaugauggucauggugaggggggucagugcugacugcccgcagacuaugacucaacugcuuuucccucagcuuuuccaucagcugucucaccuccuccccaauccuuuccauauucucuucucucauccuugccugugguucuccaagccuaugcaucauaucccaucuauacugcaggaugggcugccuaacgcggaaccgccuacgauuuccucuaggcacacaguauucaccagcauccaaagggagggccaagggcuccccuuuauuagcaacuugcuccuuuucuucauuuucuugguuggcauuuuccaugcugagacuguuuacugcucguuucucuuuggacuccauuacuccuaggagacaaaaggagagagaaggggcugaacagcuggugaacgcuucaguaccgaggacagaggcacggcuacucauuuuucaggauuccgcgucauggcuaucaacauguuuuguuuuguuuaauuucacguuucccaccagagagguuucgugcgcccacuagggggcccccauucgagcccgcccccccccccaccucucgugucuuccccuaccugcccccaaacccaccauuuucccuacagauccaucccuagaucucggcaggcaccaaaauggaggacgggagaugggggaguugggaggggaccucagacuggacucugcacccgcccccaccaccgucccucgcacugaccugggccuauccuuguagucuccuccuucucccgauucucgccacgaggugcgccgccgggacacuuggccccgcagaccugcagaagggcugggguguggggagggggggcugcugcagcggaacgcuagcuccuucuccgccuagggcccuccucacugccagcgccccgcgucucccgccccccgcucccacccucggccgccucgccccccgugguguucaccguuuuccugcaaggacucgggaaugguuuuccaucgcucuugguugcucugcugccccuggagccccagccgccacugcuuccccaccccaggggaccacuauguucccaagaauguugggguguggagaaagcuggcggggauccccugcgcuguucugcgcucgucgggggggucggugagccucugcuggccuagccagggcgcgcgggccccggggcccuuaccugguccgcuuucccccgggccggaugccagcccgccgagcgcagggcagcggggagcugguagcgagacacgagugacgacugcaccgaaggcugcguagcucugcagcucccggucacgugagggccgugcgucaccgccaagcucacccuccuucucaccaacccccacgggccggcggccaguuaacugguacucccc

SEQ ID NO: 19171 - RNA, 5921 nt, Homo sapiens
agcaaaaacugugauuacaacaggucuuugacucaaacuuauaccccaguccaaaucccaaauggagucaucacaucugacuccuauggagaagaagggucuugugauugaaaacagaaggguuauuuugcuaagggcucugaaagaccuuguggcccaagcaacccuagagaagucccaccuguguuaagugucacuauaaagcagagagaagcuuuagaagacagugaaaguucaaccuacugaggacuccagggaacucggugggguuuuggcccucaaggacugcagugcaucagcaguaguggggccagcagggagcacagcacucagcagaagaggcagcaguguugggcaggcauggcaggaaccaggggaagagacaggguucaauagcagaggacugauagguaagcccccaccucugccuacuggacuugauccugaguacaaguugcaucaugccaggcccucccuuaaauauuggugcuucuauaguggguugggauuccguaugcacaggugggaacaagaucucacugagcacagcuguuacugccucauuucuuccccacugcagcccugugaagcaaauauuuuccccaugaaaagacugagucuuaaacguguguaucuguaauaauugccaguuuauuccucuggcuaagagauccagagguaauuugagguuuacauuucuuuuuaaaguucuuucaucaagaguuuaggugcccccauugcccucauaagcugguugcaaauuauuugacucuuacuuguaaaaaaaauccuuaauucuuuuugugugugagacacguguucauuaaaaaguacauauaagcaaaaagaacaaaaagaagaaaacaaauaaaauuucacaccacacagaaauaagcuugguuaaguuugugauauauguuauauggauguauguauacacacacgcacacacacaaaguuuggaauuuuauccuacauaugugagcugauauuaaauaugcugcuuugccauaaccuguuauguuuuacuuuacaacauggaaugaacauauucccaugcaaaugugugaaaguuuccaauugaaaaauagaccuggaaaaugggucaaaauccaaaauccaaugagaugcugguaccaaggaaauuaccuaaaacaaaauuucaucagaugauuaaaaguaaaauggaggucaaagauacaucagaaaaugcuaacagaaagaaagcuggggccagauuuuaauauuaggcaaaaaugaauucaaggccuaaagcacacaggauaaggacggcugcgugaaugucuuugcuuccaaugcaucaucacaaacuuguuucuuacucuucuuaucucuucccuaagccuuucaagcucaucuacuccucuuaucauuucuucaggguccaaaugccuaacggguguguccucuuuaaaucccuggccaggcugauucggcccuccucugggguuuccuucugcuuccuggcuuacgccuucuucggaagguugaggauuuccuucugccuccugugguacauccuccaaagggcgaucuuccucggccuuuggcauguucugugguuuucccucauuuucuucacaagacuuuugcauauugaguauuuuuuauuuccuuuuugaauaaauuaauccuagaaaacaaggaaacaaaacuacuagauuccaggcaaacagaccagcagucagaguauggggucccauagcgacuggccuuuuuugacucaguacccuaauugucaaaaguuuuccaacuagagaaagcuggauccucaggcucagaacuccccugacuccaccucccuucgcgcccccuuucguuccagcuccaucuuucuccuccugcuccugcccaccaucuucccagcaggcccugcuacaagccucuccuaauacugaaaugggagcaguacggaagcaauuaacccuucucccgccucuggucuccaacacucccgcccuucagacuuucccaggcccucucaaccuccagccucucaccugagacggcugguccagucucuggccuccccucccccuucagcgucucuuaagccuccuccucccccgccucauuuccgcugcaggcucggcaccggccucuggcacuuaauccggauggggaggggcugcugcgaccccaggaugugcuuuggugucacucacacuuccacccccacccgaagagaccugaagcaauugcaccuuuacaaaaacugaccugcagggauucaggggauuuuccucucucuucccucaccucgauuugugucgcgcccaaaaaaccaaauauccugcagacagaugggaguguuuggugagcagacuaguaccuggaucacgggucccuuucaugauucuaggccauguugguguaaaguuucccauguccucauccucgcccuccuuuuauggcaaccccgcccuccuccgugcccaccguuuuucugcaagcagggaguaggaaaagcaaguuucuuccaaacaguuucuaugucucucucucaggacccuuaauuagcuacccuucucucucuccacccgccaucccccaccaaacagccccaaauuuccugcacaaaaugggaguuuggcggaacagaaguggggaaagcagugccggccccgcuugcuuucugcucucggccuccucgaccccagggucuccaagucagcgcccacguuuauacuaaccugaaaggaucuugggcacuuuucuccuucuccagcaauaaggagcugcuacagggaaacaggcccuggacuauaaggacuucugcacacgucgacuccuggucacgugagagucgcgucaucacugagcucgaguccccaguuaccccucccauuaacacugcagcccgcccgcugcguucccuccacuugauacugucaaucuuuuuucguauuugccaaucggagacaauaaacuguuaucuucgcccuggaguauuuauucgccuuucucagauuaccaggaggaucagccuuuuagggguaaucgaccauuucuccuucuuugaggaaucaucucuuucuucugcucccaauacucccaccuccccuccuccaagaccccuacaguccaccauuuccccuggaauccuauccagcauugaaaugggcaaaggugguagaucgggaagagggggcuggaaaagaaucuaagguugaaaguggaggauuugacuaauccucuugaauaguuuucuguuguguucuauguuuucagcaaucagcauacuuuuaaaaaugguaucagaaaacggaugccucauaagcaauauguaacacuuaauaugaaggacaaauuaguuauaucaauguguaagacuuuggaaaaguuuucuaauggcuggaaaugaaaugacaauauucacaacauauugauguguuagaauuuuuuaaaaucuuaccaaacagcacuuaaaaaauugacucccaaauuaauguguggaaggaggccuaguuuucucuuguuagcaauuuuguauagguaaucuacuacucuuucuauuucuggcagaacucaaguuaucaaguguuggaugucugaucuuuuucauugaugaccacugguggcauccacuaagguuucacuuggaggcuucagacagacuuccuccccauuuccucuauaggauucaguaucuuguuaaucagauaaguccacagaaaagccugcuuuccacugaguaaaauucuuuuggaacucaaaguaguauguuucuuggaaaacauuucguuguugggaaauaacucauacacucaugaaacacucagaaaagagaauucucuguaucucaccaucaggcuugaggcuucuuugcauggcauuuucauucauggcacucuugagauagucugguaucauccacugugucccauuaaaagaacuauugacaugcauaauuguuaugauuagaaagcaaagagaacaacauugcuguaaaaaauaauauuaaacaggaaacugauaucccugcaacucagaauccacugguacuuggaaggaugguggugccuggaguggcauucuggccaauggagccagcuggagagucagaagaagacagagggggucuuuugucuaggguggucacagcaggaugccuuagccaacaagaacacccaccagagaagagaaaagaagguuuggaaaaaauaaauauuuuuuggacuuaaugauuuauaguugaagcaugacaaauuucuuccacacuugagggauaaauguucuauuguuugagagagagcuuuuaauauaaauauaacuagcaaauuauaaagauuuaaucauugccuaucaccaaauguuuccacucuuuuaaauguaaccauuuagugaggaacaacucugaucuuuuaaaagaaaaaucaucagcagcaaaauggacuuuguguguguguacacuucuaugaaguuuaaccaauguauagauuuguuuaaccaccacugcaaucagaauacaguucaaucacccccagaaacuccugcaugcugucucuuguaguccuauuugacugccuucccuaaacucuggcaaccacuaauauauuccccauuacuacacuuuugucuuauucagaauauuauguaaaugauuucauuuuucaauuuuugugcacuggcuucuuuugggacuggcuucuuucacucagcauaaugcccuggacauccauuugaguuguugcauguaucaauaguuuauucucuuuuuugcugaguaguauucuguuauuuagcuauuccacaguuugcuuauucauucaccugcugaaggacauuugaguuauucccagcucuaagcaauuaugaaaagaacugcuguaaacauucaugaacagauuuaggccauugcuucacuucuggacuuccugccuccagcgccucccucucucccuuuaauccaccuuacacauuaccuugucccugcuuucaacagucauucuccugcucagugacccuggaugguaaccgcaccacucaccaaguaaauccuauacuccuuaucuugacauucagccuccaucagaauugaaccucaggacauguuucuagccucaucaucuccuucucugccccauccaaaauaaacccuuacuucauugucuacagaagcagugagaucaaauuaaaaauuaaaaacuaauaauaauaaacaacccuuagucacugugcccaagcaugccuuauacuucucucuuuguccuuguucgucauuaucuuguuccugauugcccuccucuuccuccuagauccuggugcugcucauucuuagaggucaagaccuaaucacccagccucugaagcuggaagugaucucucccuccucugucauugcugcacaugaaaucugcacccuucguguaacccuuaacaaagguuaccuuguaccuuuccguguguguguguguguguguguguguguguguguguguuggggguggaggguaucuaaccaggaagauggucagaugugaguugaggguagggagcaaggaucaggcuccagcuauuacgcuucuuuaguggcucuaguaauguuaaacagugggucucucagaaaucucagggucucagaaagagcuguuugccauuuggcucacagacaaacuucauuuugcuugcacaaaauugaagcagaaguuucauuguacucuccuuuacuuauucugcuuuacauauagccacagcaauauuaauaccauguuuauggagcuauuggcaaagguuauugaccuugucuuccuaaauacucacaguagagauuaguuagcucacugguacacaccugacaaagagccaggugauacaggccuucaccuucauccuuguuccggggcaauuucagugugucaauacaacacucagcuaccuuugaaauuaagucaaucaga

SEQ ID NO: 19172 - RNA, 5921 nt, Homo sapiens
ucugauugacuuaauuucaaagguagcugaguguuguauugacacacugaaauugccccggaacaaggaugaaggugaaggccuguaucaccuggcucuuugucagguguguaccagugagcuaacuaaucucuacugugaguauuuaggaagacaaggucaauaaccuuugccaauagcuccauaaacaugguauuaauauugcuguggcuauauguaaagcagaauaaguaaaggagaguacaaugaaacuucugcuucaauuuugugcaagcaaaaugaaguuugucugugagccaaauggcaaacagcucuuucugagacccugagauuucugagagacccacuguuuaacauuacuagagccacuaaagaagcguaauagcuggagccugauccuugcucccuacccucaacucacaucugaccaucuuccugguuagauacccuccacccccaacacacacacacacacacacacacacacacacacacacggaaagguacaagguaaccuuuguuaaggguuacacgaagggugcagauuucaugugcagcaaugacagaggagggagagaucacuuccagcuucagaggcugggugauuaggucuugaccucuaagaaugagcagcaccaggaucuaggaggaagaggagggcaaucaggaacaagauaaugacgaacaaggacaaagagagaaguauaaggcaugcuugggcacagugacuaaggguuguuuauuauuauuaguuuuuaauuuuuaauuugaucucacugcuucuguagacaaugaaguaaggguuuauuuuggauggggcagagaaggagaugaugaggcuagaaacauguccugagguucaauucugauggaggcugaaugucaagauaaggaguauaggauuuacuuggugaguggugcgguuaccauccagggucacugagcaggagaaugacuguugaaagcagggacaagguaauguguaagguggauuaaagggagagagggaggcgcuggaggcaggaaguccagaagugaagcaauggccuaaaucuguucaugaauguuuacagcaguucuuuucauaauugcuuagagcugggaauaacucaaauguccuucagcaggugaaugaauaagcaaacuguggaauagcuaaauaacagaauacuacucagcaaaaaagagaauaaacuauugauacaugcaacaacucaaauggauguccagggcauuaugcugagugaaagaagccagucccaaaagaagccagugcacaaaaauugaaaaaugaaaucauuuacauaauauucugaauaagacaaaaguguaguaauggggaauauauuagugguugccagaguuuagggaaggcagucaaauaggacuacaagagacagcaugcaggaguuucugggggugauugaacuguauucugauugcaguggugguuaaacaaaucuauacauugguuaaacuucauagaaguguacacacacacaaaguccauuuugcugcugaugauuuuucuuuuaaaagaucagaguuguuccucacuaaaugguuacauuuaaaagaguggaaacauuuggugauaggcaaugauuaaaucuuuauaauuugcuaguuauauuuauauuaaaagcucucucucaaacaauagaacauuuaucccucaaguguggaagaaauuugucaugcuucaacuauaaaucauuaaguccaaaaaauauuuauuuuuuccaaaccuucuuuucucuucucugguggguguucuuguuggcuaaggcauccugcugugaccacccuagacaaaagacccccucugucuucuucugacucuccagcuggcuccauuggccagaaugccacuccaggcaccaccauccuuccaaguaccaguggauucugaguugcagggauaucaguuuccuguuuaauauuauuuuuuacagcaauguuguucucuuugcuuucuaaucauaacaauuaugcaugucaauaguucuuuuaaugggacacaguggaugauaccagacuaucucaagagugccaugaaugaaaaugccaugcaaagaagccucaagccugauggugagauacagagaauucucuuuucugaguguuucaugaguguaugaguuauuucccaacaacgaaauguuuuccaagaaacauacuacuuugaguuccaaaagaauuuuacucaguggaaagcaggcuuuucuguggacuuaucugauuaacaagauacugaauccuauagaggaaauggggaggaagucugucugaagccuccaagugaaaccuuaguggaugccaccaguggucaucaaugaaaaagaucagacauccaacacuugauaacuugaguucugccagaaauagaaagaguaguagauuaccuauacaaaauugcuaacaagagaaaacuaggccuccuuccacacauuaauuugggagucaauuuuuuaagugcuguuugguaagauuuuaaaaaauucuaacacaucaauauguugugaauauugucauuucauuuccagccauuagaaaacuuuuccaaagucuuacacauugauauaacuaauuuguccuucauauuaaguguuacauauugcuuaugaggcauccguuuucugauaccauuuuuaaaaguaugcugauugcugaaaacauagaacacaacagaaaacuauucaagaggauuagucaaauccuccacuuucaaccuuagauucuuuuccagcccccucuucccgaucuaccaccuuugcccauuucaaugcuggauaggauuccaggggaaaugguggacuguaggggucuuggaggaggggaggugggaguauugggagcagaagaaagagaugauuccucaaagaaggagaaauggucgauuaccccuaaaaggcugauccuccugguaaucugagaaaggcgaauaaauacuccagggcgaagauaacaguuuauugucuccgauuggcaaauacgaaaaaagauugacaguaucaaguggagggaacgcagcgggcgggcugcaguguuaaugggagggguaacuggggacucgagcucagugaugacgcgacucucacgugaccaggagucgacgugugcagaaguccuuauaguccagggccuguuucccuguagcagcuccuuauugcuggagaaggagaaaagugcccaagauccuuucagguuaguauaaacgugggcgcugacuuggagacccuggggucgaggaggccgagagcagaaagcaagcggggccggcacugcuuuccccacuucuguuccgccaaacucccauuuugugcaggaaauuuggggcuguuuggugggggauggcggguggagagagagaaggguagcuaauuaaggguccugagagagagacauagaaacuguuuggaagaaacuugcuuuuccuacucccugcuugcagaaaaacggugggcacggaggagggcgggguugccauaaaaggagggcgaggaugaggacaugggaaacuuuacaccaacauggccuagaaucaugaaagggacccgugauccagguacuagucugcucaccaaacacucccaucugucugcaggauauuugguuuuuugggcgcgacacaaaucgaggugagggaagagagaggaaaauccccugaaucccugcaggucaguuuuuguaaaggugcaauugcuucaggucucuucggguggggguggaagugugagugacaccaaagcacauccuggggucgcagcagccccuccccauccggauuaagugccagaggccggugccgagccugcagcggaaaugaggcgggggaggaggaggcuuaagagacgcugaagggggaggggaggccagagacuggaccagccgucucaggugagaggcuggagguugagagggccugggaaagucugaagggcgggaguguuggagaccagaggcgggagaaggguuaauugcuuccguacugcucccauuucaguauuaggagaggcuuguagcagggccugcugggaagauggugggcaggagcaggaggagaaagauggagcuggaacgaaagggggcgcgaagggagguggagucaggggaguucugagccugaggauccagcuuucucuaguuggaaaacuuuugacaauuaggguacugagucaaaaaaggccagucgcuaugggaccccauacucugacugcuggucuguuugccuggaaucuaguaguuuuguuuccuuguuuucuaggauuaauuuauucaaaaaggaaauaaaaaauacucaauaugcaaaagucuugugaagaaaaugagggaaaaccacagaacaugccaaaggccgaggaagaucgcccuuuggaggauguaccacaggaggcagaaggaaauccucaaccuuccgaagaaggcguaagccaggaagcagaaggaaaccccagaggagggccgaaucagccuggccagggauuuaaagaggacacacccguuaggcauuuggacccugaagaaaugauaagaggaguagaugagcuugaaaggcuuagggaagagauaagaagaguaagaaacaaguuugugaugaugcauuggaagcaaagacauucacgcagccguccuuauccugugugcuuuaggccuugaauucauuuuugccuaauauuaaaaucuggccccagcuuucuuucuguuagcauuuucugauguaucuuugaccuccauuuuacuuuuaaucaucugaugaaauuuuguuuuagguaauuuccuugguaccagcaucucauuggauuuuggauuuugacccauuuuccaggucuauuuuucaauuggaaacuuucacacauuugcaugggaauauguucauuccauguuguaaaguaaaacauaacagguuauggcaaagcagcauauuuaauaucagcucacauauguaggauaaaauuccaaacuuugugugugugcguguguguauacauacauccauauaacauauaucacaaacuuaaccaagcuuauuucuguguggugugaaauuuuauuuguuuucuucuuuuuguucuuuuugcuuauauguacuuuuuaaugaacacgugucucacacacaaaaagaauuaaggauuuuuuuuacaaguaagagucaaauaauuugcaaccagcuuaugagggcaaugggggcaccuaaacucuugaugaaagaacuuuaaaaagaaauguaaaccucaaauuaccucuggaucucuuagccagaggaauaaacuggcaauuauuacagauacacacguuuaagacucagucuuuucauggggaaaauauuugcuucacagggcugcaguggggaagaaaugaggcaguaacagcugugcucagugagaucuuguucccaccugugcauacggaaucccaacccacuauagaagcaccaauauuuaagggagggccuggcaugaugcaacuuguacucaggaucaaguccaguaggcagaggugggggcuuaccuaucaguccucugcuauugaacccugucucuuccccugguuccugccaugccugcccaacacugcugccucuucugcugagugcugugcucccugcuggccccacuacugcugaugcacugcaguccuugagggccaaaaccccaccgaguucccuggaguccucaguagguugaacuuucacugucuucuaaagcuucucucugcuuuauagugacacuuaacacaggugggacuucucuaggguugcuugggccacaaggucuuucagagcccuuagcaaaauaacccuucuguuuucaaucacaagacccuucuucuccauaggagucagaugugaugacuccauuugggauuuggacugggguauaaguuugagucaaagaccuguuguaaucacaguuuuugcu

SEQ ID NO: 19173 - RNA, 2008 nt, Homo sapiens
acguagaucucaugugaccaggagucgacgugugcagaaguccugguaaucugguccuuguucccgucuggauaccagcuuccuucagcagcgcaggcgguggucccugaggcccguggaaggagucaaacuugcgggaauuuugcagguuggugucacuguagguguugacuggggauuucuaguguggggggguuuaaggcagagacuugugggagugccggucagguccgucccuccacccuccaccuccaggucuacgggaacugaugacccuugggaaagggacuagggguccuaggagaagaacagggagaccugugguaguuuaaaaauaaucauccucugcuaucuaagacugcuuuccggacccccacccuccucccgaaccccgccucagucuuaaagauaguuuggaaauaaucugcuuucucacucuuugucugaugggaaaaacgaacugacuugcaugcacuguggagagggggugaacuaggggaaacaaaaggugggaaacuuuccauauccgaaacccuaaaggaggaaagcuacgugugucagucucuggcgcuggucggcccaccaagcgcucgccccacccccaccguccccucccguuuccaguuuaucugcagggcuguuguuuccagcaagacccaaagcuagaaaaggaggaggaagaaacugacccgaucagugccagguaggugagaggaauauuauaaagucuccugggguggagacaaagguuguaagcgccaccguuccugccggcucccuuccaccccaccccuuuccccucuucuuuucucucccccuucuccuuuccccucuuccucugccugccagccaccuuucucuuuucuggccuggucccuguguuaggcccuaugggggaaaaaggucuggggagggcuggacggcggaaaggagggccuuggaaaagguuagagggaaggacaagagagaagugaggagguggaaaguggagguaaaaggaguggggauagugaagcucugauugcugacugggcuucuuagguggaagauauuuuauaacagcucugaauaaaaaaaauuaaaugcuaaggccucuguccacagcaccuguccacucaccaagucuuuaacuuacugucuucuuuuugcuuucuagaagucauuguauucaaagaagaauaagcaagaaagaaaagaaggaaggaagagagguagacagauacaagaugaaauccugucaaaaaauggaaggaaaaccagaaaaugagagugaaccaaagcaugaggaagagccaaagccugaggaaaagccagaagaggaggagaagcuagaggaggaggccaaagcaaaaggaacuuuuagagaaaggcugauucaaucucuccaggaguuuaaagaagauauacacaacaggcauuuaagcaaugaagauauguuuagagaaguggaugaaauagaugagauaaggagagucagaaacaaacuuauagugaugcguuggaagguuaaucgaaaccauccuuaccccuauuuaauguaguuuaccuugauuuuuaucugauauuaacaauaccauauagcuugcuuuuuauuagcauuuccugauauuccuuuguccauauuucuacuuauaaccuguugcuauuaaugguuuuagauguaucucuuguuaucugcaucucauuguuuauuguauuuugaaccaaucuacaagucucugucuuuuaauaaaagaacuuuacacauuuguaaaaaagagguucuugguaagauauaaaauggaaaaaggcuaaguaauaugugaauaucauauuuuugaaagguaaaaaguacauuuguauauuacauauauggacauaacuugugaaggaugaaagaaaguacagccucucgguggugggauuaugaaugauuuuucuccuuuugcuuguuuguauuuucuauauuccuaaaauuaacacacauuauuauugcuagaauaauaaaaguuuuauaaaaaagaagcaa

SEQ ID NO: 19174 - RNA, 2008 nt, Homo sapiens
uugcuucuuuuuuauaaaacuuuuauuauucuagcaauaauaauguguguuaauuuuaggaauauagaaaauacaaacaagcaaaaggagaaaaaucauucauaaucccaccaccgagaggcuguacuuucuuucauccuucacaaguuauguccauauauguaauauacaaauguacuuuuuaccuuucaaaaauaugauauucacauauuacuuagccuuuuuccauuuuauaucuuaccaagaaccucuuuuuuacaaauguguaaaguucuuuuauuaaaagacagagacuuguagauugguucaaaauacaauaaacaaugagaugcagauaacaagagauacaucuaaaaccauuaauagcaacagguuauaaguagaaauauggacaaaggaauaucaggaaaugcuaauaaaaagcaagcuauaugguauuguuaauaucagauaaaaaucaagguaaacuacauuaaauagggguaaggaugguuucgauuaaccuuccaacgcaucacuauaaguuuguuucugacucuccuuaucucaucuauuucauccacuucucuaaacauaucuucauugcuuaaaugccuguuguguauaucuucuuuaaacuccuggagagauugaaucagccuuucucuaaaaguuccuuuugcuuuggccuccuccucuagcuucuccuccucuucuggcuuuuccucaggcuuuggcucuuccucaugcuuugguucacucucauuuucugguuuuccuuccauuuuuugacaggauuucaucuuguaucugucuaccucucuuccuuccuucuuuucuuucuugcuuauucuucuuugaauacaaugacuucuagaaagcaaaaagaagacaguaaguuaaagacuuggugaguggacaggugcuguggacagaggccuuagcauuuaauuuuuuuuauucagagcuguuauaaaauaucuuccaccuaagaagcccagucagcaaucagagcuucacuauccccacuccuuuuaccuccacuuuccaccuccucacuucucucuuguccuucccucuaaccuuuuccaaggcccuccuuuccgccguccagcccuccccagaccuuuuucccccauagggccuaacacagggaccaggccagaaaagagaaagguggcuggcaggcagaggaagaggggaaaggagaagggggagagaaaagaagaggggaaaggggugggguggaagggagccggcaggaacgguggcgcuuacaaccuuugucuccaccccaggagacuuuauaauauuccucucaccuaccuggcacugaucgggucaguuucuuccuccuccuuuucuagcuuugggucuugcuggaaacaacagcccugcagauaaacuggaaacgggaggggacgguggggguggggcgagcgcuuggugggccgaccagcgccagagacugacacacguagcuuuccuccuuuaggguuucggauauggaaaguuucccaccuuuuguuuccccuaguucacccccucuccacagugcaugcaagucaguucguuuuucccaucagacaaagagugagaaagcagauuauuuccaaacuaucuuuaagacugaggcgggguucgggaggaggguggggguccggaaagcagucuuagauagcagaggaugauuauuuuuaaacuaccacaggucucccuguucuucuccuaggaccccuagucccuuucccaagggucaucaguucccguagaccuggagguggaggguggagggacggaccugaccggcacucccacaagucucugccuuaaacccccccacacuagaaauccccagucaacaccuacagugacaccaaccugcaaaauucccgcaaguuugacuccuuccacgggccucagggaccaccgccugcgcugcugaaggaagcugguauccagacgggaacaaggaccagauuaccaggacuucugcacacgucgacuccuggucacaugagaucuacgu

SEQ ID NO: 19175 - RNA, 2185 nt, Homo sapiens
cacgugaccaggagccucuaugugcccaagucccucucgucccggucuuuuuuuugccuguccaccaucucccuauuacccuuuggucgagagggaaagcagaagaaguaaguucccucuacccucuuaaaucggugugagugucggcgcugccuaguaacccggggaaugggguugacagaaucgggauggcggaguccaggccuuucccuaagcuccagccccgccccccgcgcccacauuucugugcaaaauaugguggucuuuggggcgggguggggaggcgaguaccucccccgucccccgggagggggguacagacauuuggaaauaguuucuaaaaaugcuucgcuuccacuucucaucugaaaagaaauggcaagcuuugcgggguggggaggugggagcacggaggacgaagcuugacgcaggggcugagacgaaaagagaacccgagagcuaggggagcgugcaggcaguggcuggugcccagaaagugggggguggggggugucagucaguccgucccuccuccccacuccccgcccccuacccugucuugcgucugugugcaggucugcuggucacagcggggcaccucgaggagaggacgacuaggagcacacggcccggaaagguccaggucagggaagggguacgcagugggccgggacuggggcgcgaggguggacgccgaaaggcauggagucugcaggccgcacugucccgccccugucacugcgggcgaggccuguagcaaagccugcugggaaaauggugggcuuucgggaaggagggggcgaccgggaagcggcggagucgggagagccggagagccucugggaaagcgcaagguugaggaccuggcccccgaaucaggaaaaggcagguauuggaacccacggccuggguguuaguccagccgcuuaguauucugacucuauucugccuuucuugucuccuaagaauaacugugcuugaagaagaaaauucccaacauggacaaaccacgcaaagaaaaugaagaagagccgcagagcgcgcccaagaccgaugaggagaggccuccgguggagcacucucccgaaaagcagucccccgaggagcagucuucggaggagcaguccucggaggaggaguucuuuccugaggagcucuugccugagcuccugccugagaugcuccucucggaggagcgcccuccgcaggagggucuuuccaggaaggaccuguuugaggggcgcccucccauggagcagccuccuuguggaguaggaaaacauaagcuugaagaaggaagcuuuaaagaaagguuggcucguucucgcccgcaauuuagaggggacauacauggcagaaauuuaagcaaugaggagaugauacaggcagcagaugagcuagaagagaugaaaagaguaagaaacaaacugaugauaaugcacuggaaggcaaaacggagccguccuuauccuauuuaauguguucggccuuuaauucuguuuugccugcuaauaguauugccauugccaccuggacuuucuguuugcauuuucuuaaugccuuuucccauauucugaauuuuaacuuuuugugaggcuuuauuuuagauguuuagcauguaacucgcuuaaaguugagguuucccccuaaaaucuacaaguuucccucuuucagucaugagcccuacacauuugcaugaaagauguacauuauauauugugaaacgaaaaaagcaauuuucaaaugguauauauuguaucccauuuuuguaaaaaaaauguauauuuauauauuaauaugcaaagaaaaagcuaaaaguauagacuucaaaggcauaacagugguugugugguaagauaauaggugauuuuuuaaauuuuuguuuuaucugaauuucucauuuuuucaggacaaacguuuuacuuguguugcaaaaauauauaaugaaaaaaucacacaauuuugaagaaaacugucaaucagcuuauaacgacaauguggcacuuaauaaauacuugucagaacuuuaaaaaaagugaauccuauguuuuuuucugaaucucuuaggcacaaauauuagccagauauggauuauauuuaauagucauuuuguucucauuuaaauaggaauaauacuugcuuuacagugcuacugugggaccagaugagaaaaagguugugugag

SEQ ID NO: 19176 - RNA, 2185 nt, Homo sapiens
cucacacaaccuuuuucucaucuggucccacaguagcacuguaaagcaaguauuauuccuauuuaaaugagaacaaaaugacuauuaaauauaauccauaucuggcuaauauuugugccuaagagauucagaaaaaaacauaggauucacuuuuuuuaaaguucugacaaguauuuauuaagugccacauugucguuauaagcugauugacaguuuucuucaaaauugugugauuuuuucauuauauauuuuugcaacacaaguaaaacguuuguccugaaaaaaugagaaauucagauaaaacaaaaauuuaaaaaaucaccuauuaucuuaccacacaaccacuguuaugccuuugaagucuauacuuuuagcuuuuucuuugcauauuaauauauaaauauacauuuuuuuuacaaaaaugggauacaauauauaccauuugaaaauugcuuuuuucguuucacaauauauaauguacaucuuucaugcaaauguguagggcucaugacugaaagagggaaacuuguagauuuuagggggaaaccucaacuuuaagcgaguuacaugcuaaacaucuaaaauaaagccucacaaaaaguuaaaauucagaauaugggaaaaggcauuaagaaaaugcaaacagaaaguccagguggcaauggcaauacuauuagcaggcaaaacagaauuaaaggccgaacacauuaaauaggauaaggacggcuccguuuugccuuccagugcauuaucaucaguuuguuucuuacucuuuucaucucuucuagcucaucugcugccuguaucaucuccucauugcuuaaauuucugccauguauguccccucuaaauugcgggcgagaacgagccaaccuuucuuuaaagcuuccuucuucaagcuuauguuuuccuacuccacaaggaggcugcuccaugggagggcgccccucaaacagguccuuccuggaaagacccuccugcggagggcgcuccuccgagaggagcaucucaggcaggagcucaggcaagagcuccucaggaaagaacuccuccuccgaggacugcuccuccgaagacugcuccucgggggacugcuuuucgggagagugcuccaccggaggccucuccucaucggucuugggcgcgcucugcggcucuucuucauuuucuuugcgugguuuguccauguugggaauuuucuucuucaagcacaguuauucuuaggagacaagaaaggcagaauagagucagaauacuaagcggcuggacuaacacccaggccguggguuccaauaccugccuuuuccugauucgggggccagguccucaaccuugcgcuuucccagaggcucuccggcucucccgacuccgccgcuucccggucgcccccuccuucccgaaagcccaccauuuucccagcaggcuuugcuacaggccucgcccgcagugacaggggcgggacagugcggccugcagacuccaugccuuucggcguccacccucgcgccccagucccggcccacugcguaccccuucccugaccuggaccuuuccgggccgugugcuccuagucguccucuccucgaggugccccgcugugaccagcagaccugcacacagacgcaagacaggguagggggcggggaguggggaggagggacggacugacugacaccccccaccccccacuuucugggcaccagccacugccugcacgcuccccuagcucucggguucucuuuucgucucagccccugcgucaagcuucguccuccgugcucccaccuccccaccccgcaaagcuugccauuucuuuucagaugagaaguggaagcgaagcauuuuuagaaacuauuuccaaaugucuguaccccccucccgggggacgggggagguacucgccuccccaccccgccccaaagaccaccauauuuugcacagaaaugugggcgcggggggcggggcuggagcuuagggaaaggccuggacuccgccaucccgauucugucaaccccauuccccggguuacuaggcagcgccgacacucacaccgauuuaagaggguagagggaacuuacuucuucugcuuucccucucgaccaaaggguaauagggagaugguggacaggcaaaaaaaagaccgggacgagagggacuugggcacauagaggcuccuggucacgug

SEQ ID NO: 19177 - RNA, 16995 nt, Homo sapiens
uuuuggaucuaauaaaguacuuuaugacuuuccugaauauuccuaagauuuuuuuuaaugaaacaauuaacaagaagaaaucauccaaaauaaaagaaacuaccuauauguuuaacugggacauauuaaauuaucaguuuuugaaauguuaccagcuacguaggaggcugagguggaucgcuugaggccaggaguuugagaucagccugggcaacauaguaagacccccaucuacaaaacaacagcaacaaaaaaauuagccagccuugguggcauacaucuuuagcuccagcuacuugagaggcugaggcaggaggaucccuugaucccaggaguucgaaguugcagcgagcuauaguggcaccacugcacucuagccugggugacagagugagaccccaccaucucuaaaaaaagaaagagaaauauauauuaacauguauauuguguucuuauauuuuucucuccucucauuuccagcagagauccaagagagggagauuuguggcagaucuggaaguagaagcugcuugaagccggugauuuuuuuuuuuuucuuuagacagggucuugcccugucacucagguuggacuacagugguacaaucauggcucacugcagacucaaacuccuggggucaagggauccucccaccucagccucccaaguagcugggacuacaggcacacauuagcuaauuuuuuuuuuuuuuuuguagaaauugggucuugcuauguugcucaggcuugucuugaacuccuagccucaagcaauccuccugcgacuucccaaagugcugggauuacaggcacgagcuacugugcccagcccauauauucugaaaaggauuauauucauugaugaaaucaagccagaugucccuggaugggaauggagggcauuuuagggcagcaagagaauagaggucagggucuauacuuccuuucaguggcagagacaugagcauuucuucauaucaggacccaaagaagacucugugaugggccgggggaagcugguugccuagucuuggcaaacauuccacuacccagaggguuggauagaagcagcagggacaaaggaacugaagauaccaugccaguucaguaaaugagcaccucaucccuaaccaguguggacagacagcugaagacagcagggaucuccucaggcuuuggugcuagauaagaccauagaaugccuguacaacuaauggagaugaggaauccccaguaauaagugauguggauuucccacuagcaugcuaggguuuggauaucagagucauauuuauguucauuuaaaggcgcuuugaaaaugugacauuucuuauaugcucaagggugugaacuaagauccauaucuguuugguaggccuccuauucaaaauuucauuaacaaauccuuauuuucuuuuggaauguuuucaugaguaucgugggcuauuuuacaacugucuucuuaaugggauaggagucaagaauucaauuaguuggcuaggcccuagauuccacagaguaugaggaugagaggccccaagccugcccaucuggucacccaucauucacuaaugcaaaauuugaaucauuucagccaucugacaccagggauuugccuacuuaaaugaaguauucacuaagacgcaaagucuaaguagucuucauugaauacacauuuaaugagcaacuucuacaugcuaaguaccaguguuagagagaucugauaauuagguucaguaaucaaugggcugcauauaauuauaaaaccuccuuucuucuuuacauugauccuuucuccugccacucucccacuacagaauuuggggaagaauaauugacaccugaugggucuagucaucacaugauggugugauggucacaaugcagccagccuacaacguagccugguuucugcuacucuugacaauauauugacaccuaaaagcauguucaauaacuuacuagcaccuauugcaaggaggaugacaacagugauagaaaauacuucauuauuuuaaguauuuaugucuaaggaaaaugaaccuguuuacuugcaauuugcaguucuuuucaaaacuagccuaugugcaucuauggccuaucucccuugucucuuuuuaaauuuuaaagauauuaacaauuuguauuuauguguuugacuauucuacuguguugcauaccuaauaauucccuucauguuguuuuauaauaaaguuauuuaaaguauuuauguauuaaaaucuauccaccuuuuccuguaggcauccugucaauaaucuaauauuuagaaaggucaucugagccaagaugauaaaauauccuucauuuuaagcaaacaaucuaugguuucacuuaucaaauguaaaucuuuaauucguuuggaauguacuuuggaauaaaauguaaugcaaaagaucuaacauuccccuccaauauuuugacuaucccauucuuucacuacuaauucaaauauuaccucuaacauaacuaauaaguuaaacacacauacacagacacagauauuuccauucuguuacccugaucuguuuuggugcccaaaauacacuuuuagaguaccauuuuauaacaaauuuuucuauguggcaacuucucuuuaguuuucucagaauuuuuccauuuucauguuuuauuuucauuaagucauuuaaaaauaaacuaguuuuauuagccuugaacuuccuuuguauaucaauuuggggagaaaaagaaaaccauacauaugaucugaucccaauuuguuuuaaaaauguuguaugaucuuuauuacaaauauuuacguauacacauaauuccaagaauaucugguaaaguauuaacuauuucaggugugugcuagguaucucccauuuguccuccucccacuuaccacccgcaacuacccuccuccaccccccuccccaccaucuacuuuccuuccugcucugugucccccacacuuaccaacacagacuauacaaaaggucuuccuugcccucuggcuuccaguuuggacaaagggaaauacccagcaggcgauguucggaagagagcaaagucaagcauuuaugcccucucauugcauuuucucuucucagggucgcugugagcugacugcauccugaagauuacagcuacugucagguggaccuuuccacacagcuguauaccauuccaguaaccccucccuuccuucccucugcuccucccgucccuuccccucuucgucuccuuugcagagggguaguaacacuguuaugcccugaauugugcacccaccccuccccacacccgccaaauucauguugaaguccuaauccccaauaccucagauugugacuguaguuggaaauagggucuuuacagagauaacuaaaugaggucacugggguguguccuaauccaaugaauaguguccuuacaagagauuaggauacagauacacagaaaaaggccaugugaugacaaggaggacggccauguagaagccaaggaggccucaaaaaaauccucuggcaacaccuugaucugacuucuaacauccagaacugugagaaaauaaacuuauuguuuaagccacucagucugagguacuuacggcagccugagccagcuaauauacacuacaacccuaccccucugguggcaacucagggaaaaaauucuuuaacucuccucaaaucacccauuuuugagucccauuuauuugcugggaccuugaaggauccaguagaauuacaugauucuuauuugcauuuguucuuacuauguuuucuaaaauuucuacaauaaccacagaauaccaaccuuauuucuacaauaaccagaauaccaaccaguaacaugaaaggcacacuacaaauuacuugcuuugaaauuuagaaacaaauuuuauuuaagaucugaaauacaauuccuaaaauaucaacuuuuccagaaaaccguggcuacacaauaaugcauugccucuaucauguuagaacgugcauuagacucaaauacaaaaaccaugaaacaaaucaccauccuucaacaauuugagcaaagauagaaugccuaagaacaacauagauggacuugcagaggaugggcuguuuuacuucaagcaccauaaaaaaaaaaaaagagcacaaaugcauggguuuucagguauauacauuaaguugaaccuuuggcacuaggaaucagggcguuuugucacauagcauuaacacauauuagaaaauuguguagugucaaagggauaggaaccaccagcauucaagcaauguugucaacuaggcaauaaaauguucuacugaauguuucuucuuuguucuaauuacugcauacacugguagcaacuuugaaaugagaaaaggagcuuacacuccuuuuauuuucuguuuaaaacagaacggaaaacaaacugaaacauaagcccuguuauacauuaacgauuuuaaagaacaucaauuuuacaagaaaaagacuaagaacaaaaaguguuuacagauacaggacaaaaauggugagcugucuguagacgcucacagggcuuugcggugguacucagcagaagccacuuuguaaucacuggcaguaaagagagaugcagaauucuuugccagauauuuuaggaaaucaugcaaauagcccaacaauaaugcaaggcuuuucucaucaaggggcguauaggccaacauugcuccaauucuuacaaauaaucucaguagguguggugcuccauaaaccugggacauuggagcaucagggugagccaagaggauuucagcauacuggggccucucaaauuuguagagcagcugagugcccaacaucacauugaaauauucuuuuauuccugccacaacuucauuaaccgcauauuccuuauuaucaacauuucccugcgauuucuugcaauuugcauacuccuccagaauugcaucuacauuuuucuuggcagggaguugaaacagcugcuucugccugguaacuaagucccaguccucaacaagccaugguuuuaauucuucaggaaucuucacuuuaaccuccauucuauucuuaaacgccuccucacuuucaacaguggggucugcccgggcccuuuucuuccgagggggcugaggugcuucgcugguacugccaccaucuccguuuccaggagucuucugcuuguucuuucuggucuuccucacggauccugaagggggguucucugcagagcgaccaccccaucuuccugggagagcugguucaagauuuuucugcuguggaccagcugucuucuuuccugaggaggccccucucauuuuacuucucugcauguugcuucuaguugguuuuuugaaguucucuucuucugcagauugcuguccacgagguugagaacccugcuuucuggaacucauucaacccuguuuuuauuccaaccacuguaauauauaaaauauuuuacuugguuguuuucuauggcaaccuuuaacuauguuucauaaaggcccaucagagaauaacacauucuaacucccuuaaaaucuggauuucaaauccuauuucaggacccuuuauaagugauuuuuuauuuuuuuaccuccuuucccucucucugauccucacuaccagccacuacucucaucucacccaaauacucaucacaacuacccauaaauuacucuguugaugccacucacaagauaggaaagcaauuuucaagaaagaaggaauuaaaugaaaaacuauaaaagacaguggaguugaaauuuaagacuuuugaacaggagaaaugacaauauggaauagggaagguuauauuuaauugacuaagggcaaaaugaguaacaguaaagguucuuguauuaguccagaaaggccugaauuaggaugaugacagagucaagagaaacugaagaauacagaaaucaugaagaauauaguaaccaaaggagggaggaaucugcaauuucaagccuggguaauuaaugaacuuaaugaaagcacugaauuuaggguuuaguuuggaaucagaaauaaaaugacagaacauagguaauucauccauucauuaaucuauucaguuugucauuauacauuacugcauaucugcuuugggacaaguacuaugguaguugcuagagauccaaauaucuaaagugacaauuauaaaacgauaagguuaguauaaugacaguuauaggcacaaaauaguuugggagcagacacaagaaaugguacaugacaccacugucagugauuguuuaagaagguaaaaaaaagauuggugagggaggagucagugaugacucccagguaugggugauuagguuauuaguauuaucaccaaaugauaauacuccuccauuuacagguggagaaaauggauuggaggaaaaguuguguugggccuauugugugugagauguacaguuaaacauaaaauuguaaagcucaguuuuguccagcuaacuggguacccaccccacaacccaaaacaaaaaaaaaaaaauaaagcucgggugagaaguaaaagccagaaauggagaucugagaguaacaucacauagcugguaguggacacuacgagggccaaugaaaucagggagaagagaggaagaacuucaaguauggaauucuggaaaaccuaaggacgaaaggcauuuaagggaugcacagagaccacaaaugaaacaaaaauguuaagaguagccauaacagaauuagaagaauguuauuuuggaugccaaagaugaugagcguuccaagaagaaaaagguauaaucuacaguguaaagugcagcagggagugcuaguaagauaaggaugcaaaaaauagucuuccauuauucuuauggugugacagaggaaacaauuccuuugacuuacacaaucuuccuucuuucccuuccaagaacuccuagugauuucccagaugaaaucuuauagaucuucugggauggucuagaagggugaagugggagauacaaccuagaaagaaaggcagguaucugcaaugaagaugaacuuuugugaaaucaucuaagaaaaagaaaaaaaaugaguaauuuauaaacaugugguuuauauguuuacauuuaaacacauauaugaaucauauaccacaauuguaaaucgugguaucagagaaaauacuugaguucugcugucagacagaucuuuacuucaauuaggcuccgucauuuaugaguugugagaccucaggcaagacauguaagcucucuuagccuuuuucucaucuguggaauguggcaaauuaccuauagccuucacagguuccugugagaauuucauaaaggugauguggcugaacagcuagcacaguauguugcgggaauauuugcacauggauacaaagauguucaauguagugguguuugcaauacugaagaacuggaaaacaccuaccuauucuucaacaggaaaaugauaacauaaauuauguaugaauacuacagaagaacauucaaaugaauuaagcagagaucuguguacugacauggaaagauguucaauauauauuauuagguaaauaggcaguggcauaauacuacaggaucccaaaugcaauaggaucuuaaagagacagauaaggccgggcgcagugggucacaccugugaucccagcacuucgggaggccaaggcaggcagaucacgagaucaggaguuugagaccagccuggccaacguagugaaacccugucucuacuaaaaauacaaaaaaaaaaaaaaaaaaaaguagcagggcaugguggugcacgccuguagucucagcuacucaggagacugaggcaggagaaucgcuugaacccgagaggcagagguugcagugagcugagauugagaucguaccacugcacucuagccugggcgacagagacuccaucuccaaaaaaaaaaagauaguacagguagagaaauaagcauuagugugaaauaguuuuuaggaagagugugcugucauuuguguguguguuuuaaacagaugucuauaaauaugcauggaaauaucuagacagauaaauaucagccuguuaaaaucaggguaaccucugagaaagggaugauuguagacuagccuuaaaccagguuucucuaguaacuacaacuuucacccacagaaaaagcccagcagccauucuguagccauuaacacuguaggcaggugucagggaggcucugagaagaaaaucagagauaagaaauguuuguuaguagcaccugugggcaaaaaaaaaaaaaaaaaaaaaaaaagaaaagaaaagaaaacaaggccgggcacgguggcucacgccuguaaucccagcauuuuggguggccgagguggccaaaucucuugaggucaggaguucaagaccagccuggccaacauggugaaacccugucccuacuaaaaacacaaaaauuagccaggcuuaguggugcacaccuauaaucccagcuacuugggaggcugaggcaggagaaucacuugaaccugggagauggagguugcagugagccaggagaucgugccacugcacuccagccugggugacagugagacucugucaaacaaacaaacaaauaaauaaauaugcaugcaugcaugcuugaagacuagaucccugaaccaggaaagccaguuauugggaagaaaggccuggaugcuaguacuuucacuaagcaaacaauauccucuaacugaaaaagcacaaagcuuugagcagaaauucaaggguaaagucagucuucagaaagcaucaaaauuuguaaauauggagacugaucccugugggaaucagaaaccuucuggcugagagggacacggagacacauccugugaaggaucagacaguggugauaguggccacuguaucauggcauuaaauuguaagcuaucaugcuuccagaauaauguuucuaaaagaauugcuuugugaccaggacagaccagauacaguaucugaagacuucagagaauuguuaauacagguugaguauuccuuauccaaaaugcuugggaugagaaguguuucagauauuggaauauuugcauaugugugagaauaucuuggggaugggaccccagucuaaacaggaaauucauuuauguuucauauacaccuuauacacauggucuugaagguaauuuuauacaguauuuuaaacauuucuuugcaccugucacaugaggucagauguggaaucaucuacuaguggcauguuggcacucagaaaguuucagauuuuggagcauuucagauuaggguuacugaaccugcaugaguaaauccagaaagcccaucuuggggcucauagugcagagguuccauaaaacaaagggaugauagugaaaauaccaccuaaagaaagcaacaugaccuagugccaaccagacuguguaaaacacauuaaguagagccaagcuggacaaaaaccauucuggaagucacauuggucccugguggguauauaauugugaauugggguggagggggcugugacucaacacauggagaaaaugagggcacaaauuagggacaacagucaccaacuauuuugccaccuguucccuacaggucagcucuaggguaagccagaaauucagaaaacacauuuguacuuauguuugucuuaguuuucuaucuuuaauuuuacaccaguuuaaucucuguauaaauaauacauuuaaacagaggugagcucauaagggcuaucaaaucuuagauuuuuccuuuuaaaaaauuuacuaugauaaccaauaaucuucccauguuaagguuauuauaugcauccauuuugagucauauaauagauauucugucaaaugagcauaccuuaauuuacuuagccacuccuucccuggaaauauccagugcacaccucccaccaauauauucuuuaauaaucaaugaaaacauuuuguguaaacauuuuuuugcucucgcuuccuuuuguuccuuuaagacucucagaagcgggcuuagugagucaagagauagaacacucucaauacacugccaaauuacucccucugcacaaguugugccaauuucuaaucccacaagcaguguguaaaaauauuuacuaugccucaugcucugaccaguacuggggaucauuuaaaaaauuuuuuuuccuuucauuuuuaaguuuaaaaauuaagaacaaauacuuugauagauuucuuuuauaacuccuuaauccaucuaguaguuugcaagucaugaacugacaaucuucguucaccucaaguaauuagaucuugugguaccauuuauauuuccuuuuuauaacuauagauaacaaauuauauaaagaugugaacauucuucccuuaucaccucccccucucccaccccaauccuaggaguauccugagugagcauguaugccuucaaaucuuuucauguacauucacauaaaauguaacuuuaaagacucaauguguauauuauacacauagguaugugaauauauagcaugcauuuauuuaauuuguuuugacaaaggugagauccauacugcucugcaccuugcuuugcucacuucucauaggcaucuuuccaugucaguacauaccuaccucuucuuuuuaauauucauaacacauucuauaauguuauguacuauaaccagucucugaacauuuagguuguucccaauauuucauuauuacaaaaauacugcaaugcacaucaguguauacaaauauuagagcauuaguuaaguaccucugaaggauauauuccaagaggaacuauuuagcgaaaggauuugcuuauuuauaacuuugaugagauagagccaaauucaccucacaaagaacuguuuuaauuuguacuccuaacaaaaauauaaaaguucauuuuuucaugacuucaagaacacuggaaaaacaucuuuuugaaaaaaaaaggagagcgacuuuucuugggccaaucuaacauguaguaagauaauuucauuugaauuugugugauaucauccuucacacauucaauggucacguuaucguauaugaauauuuuuguucucucuucuaccagguuguuugcuauuauuuucuaauaauuaaauauuaguuuuauuuuauguuggaaauuuuuuuccaaaccaucacuuucuuuugucuaacggugucuuacuaugacuguuguauguauaugugcauacaucucucaauaucacagacaaaucuaucaguuuuuucccuugugaccuuuggcuuuuaugucaugcuuaaggaaaaugcuccaaaaauacugcagaagugauuuccuacucauuauugguacuuuuauaguuuuccucaaauguauaacuaacuuuuucuaauauucgucacugaagaguuuauccuuuccccauugguaugaaauacgguuuuguaacauucuaaauucucagagguauaugggucuuuuaagguacucucuucugaaugauuuuugauuauuuaacuuuuuuuuuuuuucuuuuuuugagacggagucucgcugucaccuaggcuggagugcaguggcgcgaucuuggcucacugcaaccuccgccuccuggguucaagcaauucucugccucagccuccugaguagcugggauuauaggcgcccaccuguauuuuuaguagagaugggguuucaccaucuuggccaggcuggucuugaacuccugaccccgugauccacacaccgcggccucccaaagugcugggauuacaggcguaagccaccgcgcucagcaauuauuuaacuuuuaaagguaucacugucucuaggccaucuguucugucacagugguauaucugauaguucucaccaguauuaauuuaauuaucacaguuuaaaggcauaaauuuugcucuugaaaauaacacuuguaaauggauggcuacacuaagaauauuugaugcaguauuaucuuaaauagcaaaacacuaggaccaauagaaaagguuaucaauagugauuucacauauuaugugauuaacguuuuauaauaaaauauauauauuuaaaacucacacugacuuucugaucuacuuuuauucauggaucucacaaauggccagcccaauuuuucaguuaaucaucauugcauauuguauacuuuguagacauaucauucagacugggcucauucccuccuucuaaguucuacccauccucuguggcucagguccagguccucuuccucugugaggcuuuuuuuucucuauuucuggucacccugacccuugcuuucucugagucccuguuggcuuaacaguccaccccuuaccuuuggccccuaaucauucucuaaauggucucauguaaagguauucugugccuaccgaucuaaugcaucucuuccaggagggcagugcccuccuccgaaaccuacuuuucagaagagagaaaaaaaaggaaauuacagugacuccauauguagcugucaaaaggcugaaaaaccuucaaauccuacuucaucucuccacacaagcaaugggccauuugggaaucagacugcaaaugcuaacaucuuuuguguaugcaugugucagaaaagagugugaguaacauuuuguuggaauaaaccuuuaaaugcacauauaccauaucaguuacauucauaucaauuuucucuucuggaucuugaaacauuuccauuacauguaauagauuuuuuuuuuuuaagucugagacaaaggaggaaugauacaaaagcuguuagcagacugaauauucagugaaaagauuugcuuauuuauaaauuugguuugaacugcuagcuaaaauuauagcuccuggaaauucccucauaaauaaauaugaucaauauauuugaaaccuuucuagauuguuaagacaagccagaagucauaauuucggaauucaguucuagugguaacugcugcuucuggaaaaugaggagagaaaccaacgguauuaauuauuauuuuuuuuuuacacaauuccaaaaagaaauauauccacugcuuuuagaaguagguguaaauguguagauaaaacaugagauuaucaggacuaacagaaccauaauuauuauuaaagcaaauacuuacaugugccaugcacuguccugguacuuuacauguaauccucucaacaauccuaugaaguaggaacuauuauuaucaccucuguuucauauacgaggaacuuagguauaaagugaguaaauaucuugcccaagaucacauaguuaaguggcagagccaggauuuaaauucaggaaguauuugcucuuaaccacuaaacuaugcugcauauaggaugcuccaaggaaaaauguaaucuauggaacuguggaacuacuacaggagauugacuguaguaucuuuuaucaagggauguaagauuacaaagcccucuguugcuuaugcacuuucuauacuggaacuaucaauggacuuagcuccacccuucccuucucagaauuuagacuacuuucccagauaggagcuuauuaauuuucaaaauauuccuggacaguuaggaagguuaugugguauuauccuguuugagaacugaggacagaagggaggcacuuacccaagauucuguaaucagggaagguucugcaaucaggaucagaucuccugauccucacuauacagcaaacuuagcuuuucugauggugaccuagaaggucaaacaaaaggacaagaaagaacauaaaauaaaaagauaugagauauggcuuucuucuacaucagccaaugcaauuucaucacacacaaaggacaccaaagcugauaaauaauguacaaguguuucuuuuuccuuucuuguggccacauuuucaaauuuaauuuauuguacauuuguauaauuucugacaaauuuguuuuuuaacuuuccuuaaauauaauuucaaauggaugaaauaaaaaagaaauaguauuauaaaccuacacgaauccaucauccagcuuucaacaauuaccaacugaaggccaucuuguuucaucuauaaccccacccacugcucccccccacccccgacuuuuucaagcucaccggaauaucugacuucuguauuuuauuauagaaaaauuuaaacguauaccaaggaaagcagauuaauauacgcaacccacugccuaucacucagcaaaaaaauauuauuaauuuagggccaauuuuguuucaucuauaccccuccccauuucccccuaccgcugagauuauuuugaagcaaauccuagucauuaauguauuuagaagccaaucccagacauuauuuaauccguaaauauuuucguaugucucuacaaaaaaggacaauuugaaaacauaaucacaauacuacugugacgccuaaaaaaacugacaucaauucccuaaaaaacaucaaauaucgaauccgugucccaauuuucccgaugcgucuuaaacauauuuuuacaguugguguguucgauucaggauccaaacaaggccuacucaucgcaugugguucaucuccagcucgcucucguucuccaucucuuucuuucuugcacuccccccccccccaccuuuuauuuaacuuuucaauauaggaaaauuacaaucucugcuauuuugaggcaauucccaaauaacaaauuauuucauugguaaaaauugguauaucuauuuuaucuuuaauuuauucuaggaaagaaguugauggcagaaagggcacuacaauuagcgaauuuauauaauuuauaauuuuucucauucuauuacgcguauuauuuaucuccauaacaauagcuaauaucuucaggggccaggcuucacauuacgugccuuauacgcacuauuauacaguacacgucucugagguagauacuauuauuaucaccauuuuacaaacauggaaaccgagacacagaaagaacaggagccuugcccaagcugggcguuggcgagcaggaaucugaauccagcucugaccgauugugaaggcacuagguaaucccgucuauacccgacgaaaaaaggaaaucaucgacccuuucuccccacccccaccccgaaaccugaaacgagaauccagaucuucccagcagccgacgugugaucacugccguuccuccaaccgccauaguaaagccagguuucucuggcaacugauauccauaggcagacacgucacccuggaggagggcguaugcccuucagccaaucacaaucgucuugucuaaguuuuagaauguuccauaaucaaaugauuggacaaccacccccacgucagcaaugacacuucgccgcaguaaaggcgggugcuagcaaccugcuucuucacuguuaaggucuacagcaaaccaauccucuuccuccguuaguacgaguuccggccaaugacguucgcccucuuagguuuuuuuuuuuagcccgcccuccaaaagcgugacagccguugggucauaagucuacagggcagaauguucacguggccuauuucacgacccagaguuccucugaccagaggguuuuuuuuuuuccuuuuccuuuuuuuuuuuuuuccugcagggaggcauuauggguuugugguuuuuuuccccccccacugggagaggaagugucuacguggccugcggaaauaggauaggcggaaaugagcuaagguucccgcgaguggggaagcgcgaggucaaaucuggggccacgcccccaguccuguggcgcaacuccccgaacacggaaaaaaaaggcgcaguggggguucugcuguguuugcaagugagggucgugagugcaacgggcgcaaggcauuaaggccaguguguuagugcgcgggcaggcucgcguggugcugggguugcugugugagcggcccucguggcucgggaggugcuguguuugcgcaggcgugcgccccuggcgucgggacuggugagagccacggcgggcgcgcgcgcgugcgugauggugggggcggugcagggagggguuugcuacugcgcgcagguuguuaucuauuucuguguuauauuugaaaauguucuaaugaaaaggaaaauaaauaauuaaggaaaggcgacaauaacagauaaaggggcacugucagaaauauuuuggcuuuccguacugauuuaauuacuuuaaaaauacacuuccuacguuuuccuccgugccaaaauccuaucguaaaccacagcccuccaaugauucagagccaaacccuuccaucgccgcauuagcaacuccaaagggaggcuucuuucaaguucucuaguaucguccucccuccccuccuccacaccuacccccucccuucaagguugcgugcaguucucuuggcacaaauacaauuuuccugugagaauaucuaucuacgacagccuuccccuccguuagggacuccggauuucuguggcgacugaggcgcucuuaccuuugcguccugaucuccaagcaagcacacugaccuucuucaggcaaauacgcacuguuaauuuuccagaaaguucugugaguaagguuuauaccucucgagucugccacuagaugccgccaaaucccagcaaaggauuggcuguuuggucccugggauucugggauuuuguuucccuccccccuccccuuucugauuugcugaacgguaauaucuauaggcaucauggauaucguucauuccuaggaaaaaauaaaaucaacuucuguaaauagcacuaguaggcaggggacugugacccaagauccaaauaauuuugcucauuucuuuccuuuucuccuuggguuaaaaaaaaaaaaaggccccucuccaucccucuuuucuuuuguccuugccuuguuuaaucaaagaguuaaugaaugacgcaagcacugaugcugaagauccuaacccuuuuuccucaccuuuucaaaugcucgcaacucacccaaacugaaaauacagauagcuguuccgucaguaaagauagauaagaacucaucaguaaaaccuggacccugguauugaaaacugauuuuccuuuucucuugaaauuuguaucagauauguguuuuugcacccuauuuucuguagugguauug

SEQ ID NO: 19178 - RNA, 105658 nt, Homo sapiens
uaggauaggcggaaaugagcuaagguucccgcgaguggggaagcgcgaggucaaaucuggggccacgcccccaguccuguggcgcaacuccccgaacacggaaaaaaaaggcgcaguggggguucugcuguguuugcaagugagggucgugagugcaacgggcgcaaggcauuaaggccaguguguuagugcgcgggcaggcucgcguggugcugggguugcugugugagcggcccucguggcucgggaggugcuguguuugcgcaggcgugcgccccuggcgucgggacuggugagagccacggcgggcgcgcgcgcgugcgugauggugggggcggugcagggagggguuugcuacugcgcgcagguuguuaucuauuucuguguuauauuugaaaauguucuaaugaaaaggaaaauaaauaauuaaggaaaggcgacaauaacagauaaaggggcacugucagaaauauuuuggcuuuccguacugauuuaauuacuuuaaaaauacacuuccuacguuuuccuccgugccaaaauccuaucguaaaccacagcccuccaaugauucagagccaaacccuuccaucgccgcauuagcaacuccaaagggaggcuucuuucaaguucucuaguaucguccucccuccccuccuccacaccuacccccucccuucaagguugcgugcaguucucuuggcacaaauacaauuuuccugugagaauaucuaucuacgacagccuuccccuccguuagggacuccggauuucuguggcgacugaggcgcucuuaccuuugcguccugaucuccaagcaagcacacugaccuucuucaggcaaauacgcacuguuaauuuuccagaaaguucugugaguaagguuuauaccucucgagucugccacuagaugccgccaaaucccagcaaaggauuggcuguuuggucccugggauucugggauuuuguuucccuccccccuccccuuucugauuugcugaacgguaauaucuauaggcaucauggauaucguucauuccuaggaaaaaauaaaaucaacuucuguaaauagcacuaguaggcaggggacugugacccaagauccaaauaauuuugcucauuucuuuccuuuucuccuuggguuaaaaaaaaaaaaaggccccucuccaucccucuuuucuuuuguccuugccuuguuuaaucaaagaguuaaugaaugacgcaagcacugaugcugaagauccuaacccuuuuuccucaccuuuucaaaugcucgcaacucacccaaacugaaaauacagauagcuguuccgucaguaaagauagauaagaacucaucaguaaaaccuggacccugguauugaaaacugauuuuccuuuucucuugaaauuuguaucagauauguguuuuugcacccuauuuucuguagugguauugguaaacuuuauugugucuuuggaguaagagaaagagaccuaauuguaaaccucauuccaccacuuacuagucucaguacccugggcaaaugauuuauguuuugugauccucaguuuuuuuguaugcuuucuauauuuuagaugcuguguuauaucguucacguugauuuuuuuauucaucaccaaguccuuauuagaugagcacuacuggaucaaagucaaacaacaaaaaucauaccccuuucaauuaucuaucuuauauacuuguacaccacacaggagggauuuuuuuagagcagugguucccaagguguguuuccuggauguaccagaaacaucagcgucaccugaaaaguugucagaaauucggauucucaggucccaccucaaacuuaaugaaucagaaguucgcagggugggguuuaguaaucuguguuauuacaaacuaucccagugauuccagcacacacugaaguuugagagccacugcuuuggagaguagaaaugcaaugcauauuuuuguacacaccacuagagggugcuacagaauguaaagcaaaauaauaaaugaugcacaguauauguuuucagacacccucuauauuaucaguccuauuuuacagauuaaaaacuaauguguagauaugucaaauuauuuucuuaguguacgcaacaaguaugggaaccaggauuugaacuucaccugccucuagcccaagccccuaauaguacucuguuguuuaaccaugaugacuugucuuuccaagccucaaaauacauuagaaauaucuuguucccugcuuuggcuaauguugacuggagugucaagaagagugcaggaaagcaaaccaaguaaguggaaauauuucgauguuucauucucauacccuuccucaucuccauucuauaauagcauaucacaucaaggcuucuaaauguuuucuuucuuguuuuuuaauuccccaaauaauguucucuuuacucugcaguugccuuuuuuauuuaugucuaaaucucuuuuuuuuuuuaacggaauuucucucugucgcccaggcuggagugaaguggcgcgaucucagcucacugcaaucucagcucacugcaaucuccgcccuccccuccacccaaccccaacccugguucaagcaauucucccgccucagccucccgaguagcugggauuacaggcaugugccaccacgcccggcuaauuuuucuauuuuuaguagagaugggguuucaccauguuggccaggcuggucucaaacuccugaccucaggugauccacccgccucgccucccaaagugcugggauuacaggugugagccacugcacccagccauaugucuaaaucucuucuauguguguugaaguuaucaggguggugaggaaacaguuauugaaaaccuguuaugggccacacacucuauacacccauuaaucucaacaauaggccugcaaauugggugauaucaucauuauuuuauagauaaugaaagugaauucugcaguguguaauuacuuaucuuuggucauauaacuuguaaauaguggaaccuggauaauuccuggcauaucugcccauauuauuuuacuaagcuuucuacuuuuuggcuuugaagcugguuuaguuauuuacuuguuaagugacuuuaaguuauuuaacuuuucuaagccucagugucacauauuaaaugggaacaaauauuucuauuucauaaucuuagagccacacuauccaauacuguagccauuagucauaugugacuauuuaaauuuaaaugcaguaaaauuuaaaaauuuagauccucaguugcacuagucucauuccaggagcucgauagcuacuuacaguuaguggcuaccauauuagacagugcagauacagaacauuuccaccaccacagaaaguucuacuggacagugcugauuuagaggauauaagguauauaaaagggccuaacacggugcauaucucauggcagaugcccgagaaaagugaucucgucugcuuuuuucuuucagcaucagagcuagggguguucuccuguuuuauugauggaguugggagagggaaguaacuuacccaagguagugugauaggggauauaucuggcaccgggacccacaucuccuaacucuugcucuaacauucugucuaguauacccaucauuaugcuuuacucuacugagugagguuucaaggccaagcaugugaacagugugaauuaacuuuggaaucagggugguagcagaaaaaggcauaggaacugaaugucuccugugugccacauagcacugugcccagcuuuuuacaucugguaucuuagcaaauccucagugaagcccagagaauaaauaccccaaguugcucagcaaguaaauggcagaccaagcccaggcuuuuucccauuaugucaugcuacucccucaaaugugaauacuccccugccaccuccacuuacuaguggguccucagaaaaugggaauuacuccucuuuugaauguauagcugaaccgcugucuucacagucuguuucaacuggaauggaaaaauagcuuaggucaauguuuguuuggcuccaaggccagacagagaauauuuauggucccagccuucaaaggacaggcaaugcucugagaacccuguguuaauuuucaaggccaccauuagcucauaccuugcuuuugugcuaauuagaaaagcaugucaccuggggggcagagaaauuguagagaagggcccauuccaguggaacaaugagaaaaauaacuuuucuuucuguaggcuguugcaaccucaccagaacagcugaagaaugaauuucagccuggacucuaccuuauuaguugggcacccuuggggagggugcaaccugcccaacauuuucugcuggcccugucuuaccucaugacuaagagagccuuccuaggucuggaagguagcagucagucuguucuggaggguggagagagacaccaguguuuucccaugguuucuggguaguagauaaaauuggucuauucuaagguuaauuugauauuuuaaaauuuugauucugacuagcuuauuggauuuuuuugaauaauguuugauuaauguaaagguuaaaaauaaaaccuaauauuucagcuaagcaaaugguauuucuuuaauaaggacguauuucuaucuauuuauaccugccucauuccauaggaauuuuauaaagccaguccaggaauguagucugaaucaaucuaguuugcuagccugugagaccagggcaaagaugaaaauagucaugggaaaguuuuauccuuuuagggguaucugucuucuucuaguuccucucuccuccuuugacaaauccccaccccgagacugaccuacccauuugacagaaugagauuacuucuucaaaugacccaaaacacugagauccugaaccuaaucaauaauguccuuggaugaccuugggaugccagauucacacauaauuccuuguuguccccuuccugaguuaauaguuuagcauacaauuuaccaaaauuuguaguuuccugagccacagacuucacuuggaaugaucauauaaagucauccaugcuacauaccaacccacagaaaugaggaccgcuuuccuccaguguaugcugaguccuacaaucugagcacugcuucaagaggaugccuugagucauuuuuccagaguuaaauuugcuuaugcuucuaaccuccaccuacaguccccguuacacugggaaugauaaaaacuaugccuuuugaaaauauaagcugucauguuauuaaagaugacaaaccaguaguaguuaaagugcugcaucuaaauuguugaagcuuguuacgugggaguucauuagacuguuuuuccuacuuuuguguauuuuugaaguuuuccauaauaaaacauuuaaaaagacaaaaaauguuuuaaagugcuucaucaguccugaggaagagaacgcacauggguuucucuuuagaagaguacuuauuaaccaagggguuagguagaauguacacccuuuaguagagacauacccuguaaaaaucuggggaggggggcguuuuagauugaaaaagccucuuugccaaaaauucugguuaggucuucuagaagggaaauauccuucugccugcaaucccccuccaccaaaccccacaaguaagucuugcuguaaugaaccacuauuggugaaagaaguauaucauaucccuugggcgauugagaguggagggagcuugaaaaccauggaaacagaccucagcuaauuggcaaaaacuguuagccagcaggaagagaagcacaggcaaagggaguauuggggcaggagauggaacuuggaguguaauggggcuucauucucaccccaggugagugcuggagaggacaaagcugcuaaugacagaggacaccagggagcagaauauguggcaaagagguccuuacugaggaccucaggguauucuuggaaggcucugggccccaucugacuugcagguuuuuguuuuguuucuuuguuuuucguuuuugagacagaguuucacucuuaucgcccaggcuagagugcaguggcggaucucagcucacugcaaccuccaccuccuggguucaagcgauucuccuuccucagccucccaaguagcugggauuacaggcgccggccaccacgcccagcuaacuuuuuguauuuuuaguagagacgggguuucgccauguugggcaggcuggucuugaacuccugacuuaggugaucugcccgccuuggccucucaaagugcugggauuacaggcgugagcuaucaugcccagcugaccugcaguuuuuaaaacagugggguggaucccugucucucaccauacacaaaaaucaacaacaacaacaauaaaacaaugggaaagcugccugaaggcaaagaucacacacacacacacacacacacacacacacacacacacacacacacucuuucaaggacuuggaaccugacuguuccagguccaaccugaaccugcuuggaaaggcggguuccauagaguacccauugaaaacuaugugguuuuguucguucuuuguuguguuuucacuguguaacuaagcaaaugacgggguuuguacacugcugggagugagcagauaugguuggagagguggggcacuguuuagggcauggggaaaucagagcacauguucucucaagguccugagguugagauaaaaugguuugaaacuggggacagagaagggagcaagggcaguuccuaaaagguacaaagccgagauucaccccgcugcuuccaggccagaguucuggguaggacgucaaugagacccaggccgguacagccagcuuucaauagagcuggucugugaaacuuggccgagaggacagaggaagauugauguuugcuccagaguggggcugucagcugugcucaccaccucaccaugcucccagcuguaaacaaaaguccuggcccuucauggcacugcagagcaguccaggcuggcguaagucucugaggacagcuagaccauuuucucauccuggcugagaaccagaagacagaagaaacaauagaaggugguggguaggggugggcaggauugcaagggggugagaaucagugaccagagggaaggagcugucaauuucagaucuuagguuugugcauccaaguacuuaguacaaaucuuauagggaaagcagaccccuuuccuugucagcuucacagauaauagugaacuaccaaaggaggcuugcagggacucuagugccucauucauucauucauucuuucagugaauaccucaugugccugucacugggcuagauacucugggugaugccaaaguaauacaagacagcucguaaauucaaggaacuuacaagaaguuuguaaacguguaaccuuaagucacaauaccaauaguaagacuuuaaauccuaagugacagacauagaauaagaguuuagaaacgagaguagucauaucuggucaucaucagagaaaauggaguuugagagggcuauagaaagauagacacaauuuggccaagggaaaaaagauaccaggcauuccaggcuaggaccaaauuguuaguaacaaugaggccugccuucgcgaaggcagaaaguuaguaugacacagacucucuucagucuucaccccgucauguuccucaccacagcuaacccagucuucaaaacucacuuaaaugucacuuccucagggaggccuucccugaucuccagggccagauuaaguacucuugcuuuauguucccauagcacccauuacuuuccccuuucuaagacaccacuauuuucaccugaugaccuacucaugucucccuacaauuuguucuccacucugcagccggaguuuuuuugcaaaugcaaaucuguuacaucacuucccucuuggaaacucuccuaccucuaacaucuuccuucuccuuugccuuccugguccuucuugccucuuuccaucuuacuuuuccuucuggucacuucuuaaaugucucuaucuaaguuugucuccccugccagaaugucagcccucugagggcaggaguuauguuucuuccucaccauguaucuguguauuuagcacagugccuggcauauuguguuaggcacuccacaaaaauuugugaauaaauccaagggagauaaggcaauauuaguagccaacugaaggauuaaucuuacacuucugugcaaagggaaaucuuuaaaaguuuuuaaauagggguauaaaaaaaaucaugagagaacccugccuucugacaaaacaaacagaacaaagcaaaaaaugaucaaacaaaacccagagaacuccaaccucagcuuacccuaaacccggccucccaaugaucuuguagacucauguucucuuccuuucuguuucccccaccacugccuccuccaaaaacacaagaaaacuuacucauugauccuuccaaccagagaaauuuggcaguauggccaaauacacuuacuuccacauuuguaguuguucguugggcuagcauuuauugcccaccuccauuguuccaagugcugugcucauagcuacagauggagacuuuuuucuuaccucgauggugcucacaacugagugaaccccuuacacuuaccacucacuucgugacuucaaauuucuagugaagggcuuugcuuuaccugggcucagugauggagacuuuucaggguacuggagccugcaaaagaccucaauuucaggaccaucuguaaaacuggggacucagugagacucagaggauggauaaguauauccguuuacacuagacuguuaccuuucugugaggaggcuaaauggcaggguggugaauauccggaagggugguuaggcaucagccauuucuuaaccuuauuagguugggcuuacuaaggcaaacaggccaccaaggugcaccucuugagugaagcagcauggaaaaacucaaggaaugacaggagaaagaauuggauuucucauuaaaaauagaggcacugccuugcacuuugaggggggcugaaauaagaaugcaacuccaagaaaccuuccaaagauaaucagaggacacccacucacccugagguagcccuuaaugccaggguaugguuuuuucaucucagauucaguucccagcuaauuaggggguagcaaauuaagacaucagagagccagugcacguucaccccuucacaccccccacccccaaagaagggugaaggaaagaaauagauacuauuuuguagcugaaguccuaacuggauaucucuuggcugaagaauaacaucauacaugguaucagugacacuuuaaagauauagucauuaguuuugacccucucuuucccccuugaauccuuuacccuaaacaugaauccaccaccaggauguuagggagagagacuauauguagcagauggagacaaaugagauuaacuuccaugauucauuacuuuugccuguuagguagccuugggugaagacaguucauacaccuggaauuugacauccuaaugagaugggacaggaaggguuaacuccaaaaucagugaaguauauuucauaggagaauaacaacacauucacgagaaaccauauugucuccuuccuuaauagaccaaccugaagcuuaggccaaucaaaugaugauaacagguuguguuucugcuacgcaaagacuaaaagaaguguaagucuaagggauuaacaaauucacaaagaaacccuggugaaagaaauccugaauuucugcuauuuggagcuuggcaugaccauugcacaccuguaauaucauuguaacuguugccaagauuuuugcuauaucccguuucuguggggacugugaauaucuaauaugagugucgucaacagaugaacagggcagagguugggaacugaauguucaucacagaaacaguuuuuucccuugcagauuaccuuuggccuugaaucuguugcugucuacaagucagagccaucccagaagugagccucuggagcuaauaaaugaugacacacucuagucuuucccuuccuguucuauucuuuccuuucacagcuucaacuaaguugagaaaaaagggggacuacacugagggccugagcuuugcccaaucaagcccucaguauccccauguugucugaugagcagacuagacuaaaugaucugggaaggcccuucuagcucugcugugccagguucuaaaauucuuuuuuuuuuuuuuuuuuuuuugagacggagucucgcucugucacccaggcuggagugcaguggcgugaucuuggcucacugcaagcuccgccucccagguucaugucauucuccugccucagccucccaaguaccugggacuacaggcgcccgccaccacgcccagcuaauuuuuuguauuuuuaguggagaagggguuucaccguguuagccaggauggucucgaucuccugaccucgugauccaccugccucggccuuccaaagugcugggauuacaggcgugagccacugugcucagccgccaguuucuaaaauucuaagacauuguuaucuguugagccaguugucuuaugggaaaucccaugagacauuuguuuucuaaaagagccaacuguuuauuucucugcaugggcauauuggugagaguuaaaugcagucaggauagcaaauguguugcuguggccaauugucuuaagcauucuugcccuucugauggucagggcugucuuuguaacaaugauucucauugucugaaguaguuaaggauuagcauuaaacugaggacugauaagacugaggucauuagccaggcauuguuaguaaguaaaaggggagguagggugacaaguauucaggacuucuguagguugauaacuugaagaggggcuuagagucagaaagaugcccaauuguuagauuccuuugucaucauagcccuugacuuuagccuauucucaaaaaaugaucuuucuauaauauugccaaauaauacagcugaaacaucccuugaccuguuaaauggcuuaaauugaaaguuauagaugaugcaguuuugauuuucaaauuuuuuaaagaagcaguaaacucuucucauccucucuccucacuccaaagaaaauauuaugguaaagcaaguauauaaacugagaguggaguuaugcagauugaaacgucuguauauaugugugggggauggguauggcugccuguccuuccuucccuucccaugaaacccuaggacuccuugaaaaugacuuugaaaauccuuugccaaauagauaaauuauuguacuguacugagaaauagguaacuuuggguaagucccuuaaggucucucagccucauuuccucaccuguuacauggauaccugguuaucuuaccucaaguuugcuuugaggaugacauggcacuuaagagcuuugaaaaggggggaaaaaaaaaccacaaagauacuuguuaccuugauaguguaguacuucaugacacgacccuugcaaagaaaguauaguuagugagaacuagcacagcaauugggugguuaaaaauuuuuuugaacuacaguacucaugacuuuuaaaaacuuauauaguaaacacuaauucauuucuugcuaugagcuugguaugaggaauacaaagauaaauaccuuauaaucccugaccucaaacucauuuaucugugagggaaauagacaaaagaacaguaucuaaucuuacaaguacaaauauagagcuauguacagggcauuaucagauaaccuaaaucuaucuggauguuagggucauagcaguuugagaaugccucacagaaaacaugauaucuggcgagagccuugacagaugaauagaauaccucagguggucaagggaaggcguugaaaggcuaaggaacagcaugugcaaaggcacagagcauuagacaggauccggcuugcuggguucagggaucuguggguggaucagcaaggccaaauuaaggaugcauuuaguggagugaggggagugaugagagaagaggcuggagucacuggcaggagccagagaagaaaauuucugguaggccaacuuaagccacuugggcuuuuuccugaggcaauagggagccguugaaggauucaaagcaaggaagugucauaaauagacaguuuuagaaaggccaaauuggcaauaguguggaggauaggaaaccacacuggagucaaagauugaaccaagaugaagucagggaguauagagaaggaggcaggaguuucagaaauauuugaacgguaaacacagcaggacuugguaauugauuuuaucugagggcuguggaagaacuaguuuucaaggacgacucccaaguuucuggcuuagaugauucaucaagauuaggaaaguugaaggacagaguggcagagaaaguuugaaggagguugugaguuuuuuggcuuuuuuuuuuuuuuuuuuuuuugagacgaaguugcgaucuuguuccccaggcuggaguaugauggagcgaucuccgcucacugcaaccuccgccucccggguucaagugauucuccugccucagcccccugaguagcuguuacaggcgccugccaccacgccuggcuaauuuuuguauuuuaaguagagacgggguuuuaccauguuggccgggcuggucuagaacuccugaccucaggugauccgccuaccucggccucccaaagugcugggauuacaggcgugagccaccacgcccggccauuuuuuggcucuugagguacccaugggaugaagucagaaauguaagaaucaucagcacauagguuaucacaaccauggaaacagucaagaacagccaagcaguaggcguguggugaggagaagugaaaucaggagauuaaauccuggagaauaagaacacauaagaagguauggcagagggucaagagaagaaauuagagaaugaaguccaugagagaagagaaucucaaagaaggugugacaacucugacaaauguuacagagaaaucauggaagguuagggcagaaaaguguugacuugacauggcgauuaagaagguaguaugaggaggccgggcacgguggcucacgcuuguaaucccaguacuuugggaggccaaggcggauggaucacaaggucaggagaucgagaccauccaggcuaauacggugaaacccgucucuacuaaaaaaccccgucucuacuaaaaaauacaaaacauuagccaggugugguggugggcgccuguagucccagcuacucaggaggcugaggcaggagaauggcgugaacccaggagguggagcuugcagugagccgagaccgugccacugcacuccagccugggcaacagagcaagacuccgucucaaaaaaaaaaaaaaagaagguaguaugaggaauaugggaaaagcauuugagggguggguagggggaagaaggcggaagauagauuacaguguguuaagaaguaaaugguagaagugacaauguggaaauggcuaguaaggacauuucuuuuaagaaacuugggccgggugugguggcucacacuuguaaucccagcacuuugggaggcagaggcagguagaucacuugaggucaggaguucaagaccagccugaucaacauggcaaaaccccauuucuacuaaaaauacaaaaauuagccgggcaugguggcacacaccuguagucccagcuacuugggaggcugaggcaggagaaucucuugaaccugggaggcacaggcugcagugagcugagaucacgccacugcauuccagccugggcaacagagagacuccaucucaaaaaaaaaaaaaaaaaaaaaaaccaacaacaaagaaaaaagaaacuugguggugaauaaaaagagggcaauaggucaauuaggucaauggagagaaauucaagguccaauggagaguaguuugucuccuuauuuuuucuuuuagauggaagacucacuucuuccucuuuuucuuuuucuccucccccucucccuccuccuuuuccuucuuccuuuucuuccccgcaccugaaaaagcugaggcuaagagagauuaagccauuuuccaugguuguauaguuuuuaaacacguuuuaugccagcaggaagaaccuagugucaguugagaaacaaaauauaaagagaagugauuuuagcuugacccuuuuugugagcgugggcuuagcaagugagacucacagcauggaauuugaagagagauuaugaugauguagucuggucauguaaaagcuaacuuuaauugagcacuuacuauuugccaagcacugacuuaagcacuuuaccagccgggcgcgguggcucacgccuguaaucccagcacuuugggaggccgaggagguggaucacgaggucaggagaucgagaccauccuggcuaacacggugaaagcccgucuuuacuaaaaauacaaaaaaaauagcugggcgugguggcaggugccuguagucccagcuacucaggaggcugaggcaggagaauggcgcgaacccuggaggcggagcuuguagugagccgagaucgcgccacugcacuccagccugggcgacagagcgagacuccuucucaaaaaaacaaaacaaaacaaaacaaacaaacaaaaaagcacuuuaccugcauuaucucuugcuuucucucuuuuuuuuuuuuuuuuuuuuuuuuugagucagggucuugcucugucacucaggcuagaguacaguggugcaaucacagcucacuguaaccucaaacuccugggcucaagcaauccucccaccucagccucccaaguagcuaggacuacagaugugcaccaccaugcccagcuaauuuuuacauuuuuuuuguagagacaggaucucucuauguuccccaggcugguauugaacuccuagccucaagcaauucuccugcaucagucucucaaagugcugggauuacaggcgugagccacugugcccagacugcauuaucucauuuaauucccacaacaacccuaugagguagguauuguuauugcuuucauuuaacagaugcaaaagcugaagcacagaaaaauuugaugauuuacucaaggccacauaguuacugcaugcuggauauuucagagccuucaaaugucccuuuagaggaggaaacugagacugagggaggugaagucauuuguccaagaacccauaucuaguaagugcuggaauuguaauucaaacccaggcucugucugguaccaaagccaccaguaaucacuacacugucaugaauagaagcuauuaaaauaaagaauaugugugcauuuuucucgauccagcucuguaaggcuaaauguuccuugaauuuagaugaugguaagaauuuucccuauuccauaaaauugauagugagagcauguacuuccuugguaaugccccauacgguauagugcaaccaggauauuuguagaaagccucauggugaaagcagagacugagaaaaacagagcuacacaggcagagugacaauagcugaguucucaugugacuucuucagguggcucccugacauaagauuuacuucaucauccuuccaugaagagaaugcuuugugagggagaaagccccuggcucagaugcccuucuaggauuuccuaacaagcuguucugauaccaccagcccaaguucauagacuguacgcauuauccuaguugugaagucucaucauguagcgaagagugugagcugagaagaccagcuuaauugcuauccccucagagaugacuggcuuuccagugagaacaauguguggagcaugcagaggccaaaaucccugcuacuguacucacuagucacugccagggcuuuuaucgggugauugguuuuugaaauauagcuugauacuagucuucagauuuggaauauuacuaauguuuaaucagaacauuaucauuuuuuuucagagcaggaguggaaguuuauuaaaaagcuuuaaagcaggaaauaaagugcacuuugaagagauccaagugggcgacuugaagaacaagugccccguuuaaccaugauccuaggacuuuauaggcuggcccaccuccggugucuugcgccccuuucccaugauucuucccuuagggugggcugccugcaugcacagugcccuccuuacccucgggaagugagcaugugcaguguguuuaggaaguuguacgcuugagaacauugucauucuuaauucagggauacaauuuacaagguucugcugucuucuuagcuuugguucuguuacacccaaagagcaguuugugugugugguauguaugcaugcaugugugugugugugaacucuaucugguuuuauaaaaucucuuuuuggucuauuuuuucugugaccaauaaguucacagaaagagaaugaauguaguauacaguaaaccgaaugggaagucacacuaucauucuacauguaccuacugaguguugcuagguaccaggagcuaugugagcuaaaaaguuguaugauugucaggcaugguggcucacccauguaaucccagcacuuuggaaggccaagggggaaggaucccuugagcucaggaguucaagaccggccugggcaacagagugagacccugucucuacaaaaaaaaaaaagguguauaagacacaguccuugccgucaaagagcuuauucuacauuuccuccacugagcagaugauaaugcuaccuggcuuccuaauucccuagugguucccaugcuugguugauuuugucuuucauuagcagcacagccuaggaagaccauuaauccuaacauagugaaaucaaauuuaagauuuugauagcaagaaaugauaagauaauaauauuccauugagagugcagagaggcaagugggaacacacaggaagauucccaagaggugauauguucuggacaaaguugagauaguugcauggcccagugaaaagagaaaauaacuucaagagucaaauaaccuuucaacuagaagcaugcccauucuuuggugacagguagggaaaaaugcuuaugggagaaagcuaaaggaauaaauuuucuucacuaccuuucuuccauguagaaagcucuuuuugcuuugccugugaauucugggagaacaagaggcugugcuuguagaaugaggcaauaaaagaugacagaccagugguuuuccagagagcagagcaaaccaaagggaagauggagggacugauagccuuaacaacaacugaauaaauaaagcgcuuucccuggaaaaauauauguauaaaauauuuagcuggcauuaaauauuaaaaaugaauuaaugaaaacacccaaaacacuuuauuuauguaggaaguuuuuccucuuuaaaaaaugcuguucuaaaucucaacaucacuucagaugugaucuaggcagaagguaguguggucucuggagggguaaguacuauaagaaugaugauaaauggaagcaaccuccaagugagccuccugugaccuccugccaauucacugugguaagaaggguucaauuuuuauuguaugauugagagauugcuaggugacagaugcucccagugagacccaguauuucccagccccuguacauaugugggaagggugaggaaaaugaaagucaucugcaccugauucugacaccaugcaucucccuucccugcuugggggcuccaauggggaggaauagcaccuuccaccuggcauugccucugaguggcuuugugugcuccugugggcuauuauguugguugguacuuuggcuucuuuggcucccagcaccagcugaugcccugaucugagucccaguugggcaggcucuauugcucagugcuguagcugucuccagggcauuguucuugagacuuccaacagggcagauuugugcaguuggcccaucuggacaagaucuauaacaaguagagcucugugcaauaagcucaucuccauaguccacccuccccgcuacccccgccuucgggcugcagcagccugacaccccagccccuccauggagaguaucaaagagaugcucucugcuccuuucaaaggaguauugcuuguggccucucauugauuggcacuaccugggcagaaauaggaaaacagggguuuucugcccuucucaauucaaucugcucccuuaugccaguuauuuuguuuuaaaucugcuuggcaccagaguuauaauauugccaauaaaaauaauuucuagaccagcuacccuggucagcucagaaugcucuccucaaaacuaagagacagacaagaggaguaucucagugaacaggaaagagcagacaagugcaauaggaaaagggauaaagacaaaucaagcucuugguuugauuauaggauuagcuuuggccauuggauuuauugacuuucaauuuggaucaccauauggagggagggagggagggaaggaggaagagagagagaaaaggagagagaaagagagaagcagagagagagacuggacuuaugugcuuaauuauucuagguccagagaaaaggacaagaugucuaagagaucauuugaucacuucuuucuuccagugucagucccacacuuuaaucucuccuguuucaguuacucacaguuggucacuucaaaggucucagugugccaggcacaugcuuccccaugucccagugguaugucaggccugaagugggcucuuccacaccaacucucucuauucugacguuucugguagcuucaacugacugcuacaccuacucacugcuucuccuuguggagcaagaagggugaagaaacaacucugaauuauggcucuuuaacuucuacaacuucuacccugauguuggucaaaucaauguugaucuaguauaggggucuucuacgugccuaguuccuccccagcaaaccugaagcccauucuauccuuaacaagguugcagcggcaccuuuauuugcacaccaaaaggaggugaaagaccagguuggaaaugaagggcccuggaaaauagacuuuggugagaaagaagaaacaaaugaaagcccagccaacaaaagacacucugagaauaguuucucuauucuacuccuccuggguuccacuaccuuggaucucacuuuucucaaaaguuuucuagcaucauaaaguaaguuucuuaaagaacaaguauuuuucuuuuuuuacacuccccagcuguccaacagauccugccaucaugcuaguuaauuagggaacggaacgaauauuucugagaccagaauguucagguggaucuggaagguuagucuuuuugagaacccaaagucucugccccaauucugacaguaauuucugaaccagcuacccuggucagcucagaacgcucuccucaaaacuaagagacagacaagaggaguaucucagugaacaggaaagagcagacaagcgcaauaggaaaagggaugaagacaaaguguggggcuucccaagagacuugaacaccucucuguugggccauauagucgcuagcccagugcagccuaugacuguuccaacccucucgagagguggggaacuugcggcuuugccuuccucucacuucaaggaaaccugacuaggccccacagggcagcacuuguggauaggagaaacucaccauuugaaucugcagcaggagggacagaggacagaguaauggccaggcucugggugggagguggcagggggagaaguggugcagauuaagaugacaaaugccagaaucuagcagcaguguucugaauacucuccacuggaguauuggaaaacagggaggcuccagcaagggcagaaggucauccuggccccaggaauguggccaaaccuuagucucaugagaaaugggaaaguauggagaaaauauggacuaggguagauaagccaucuuuauaaguacagccaccauuggcaccaugcaauauaggcccacauagcuuugggacugguaguugaaguucugagugggagaucaggaaggaacuguccaaaccccuaauggagucuaacugagggagaaagcccacccaggaggaagcaggaggccagcagcaggacucuauagcucccacccuauucacagagccugguggauaucuucugaccauagcacuuuauagacaacccaguagaagauauugaagaugaggaaagugaaagggaagacagcccgggagauggugucaauucucuuggcucaguccacguagaguuuccgcgugguuucuccuucccuuagaagaggggcuggagguuggggacuauaaaugccagaaccuuccauuggaccuccaucucuugccugcaggcaguggcccaagccauagccacggaaauagaaacgacuuucuuggaugauaucuuccuccuggaauuacaaggaagaaacggcagaauuugaggucaaagcucaaaggcagagggauagagaacagaccacccaucaauaucucauagggaauguuaugcagacaaggugccuuggguacacaggcccauugcaugcuuuuuauggucacaacacuacucaugagauagauguaugcuaagcagcucuacgugcuauauauaguguaugucaugauuccauggcagauaggcucuaagcuacccauguaaaaugcaaaacaucauuuagaguuaucuaaaauccagugaagugccggccacugugagaggacaucucaaugucaaguuaucucugacugguaauaaacaaaacaacaaaacuauuagauagugaaguugagauauucagucuuaguaaacuugacuuuaaugacuuucaaaagcuucagaauucauuccccuuuugaaucguaucuuuuaaaauuuaucucaacuuaaaacugaaaauuccaaaaguuuuaaauaacccaaugaguuauccaaauuaggauaaacacaugcccagugagggguaaauuuuauauaagcacuaaguaaugcggcagacugccaaaaguccauuuuccaauaguuagcugacaaccuuuaguagcuaaacgcagcuaggagccaggaaguagggacagaaagauaaaguugagagagaaagagagcaagagagagcgagagagagagagagagagagagagagagaaccaaaaccucugagugucaauagagagagcuuuacuuauaugaggcccucaggcccccauucacagccuauuuagucuuauuuuauaugcaacccuaacaagccuaauuuuauuuacuucuaaaggacaggguugagaaaugcuuccuucaaagauggugguaauuucuuaaaguauucaugguuuuagagucaaaguuucagguaucuaagaaaucaccugaagugcaauggccucuuggaggacgaugcaaacugucaucucgguuuguccagaacggaagguguuccuaagacuugggucuuucagggcugaaacuggggaagugcaaggcaaaucaggaagagcuggucauccuguggcuaccugagguauuuauuauaaguuauaagaaaaaaauauguguauauuguauagguaugacauagauauauacaaaauguggauaaaguagauuuuaaacacucugucucucucaguuagagggacaccacagggucuuuaucgugggaccucugcagcuauggcaacacacugaaaaguggcuuugccaggcacgguggcucacaccuguaaucccaacacuuugagaggccgaagcuggcggaucacgaagucaggaguucgagaccagccugaccaauauggugaaaccucuucucuacuaaaaauacaaaaauuagucaggcgugguggcgggcaccuguaaucccagcuacucaguaggcugaggcaggagaaucgcuugaacccacgaggcggagguugcagugagcagagauugcgcuauugcacucuagccugggugacagagcgagacuccaucucaaaaaaaaaaaaagaaaaagaaaaaaaaaaagaaaaguggcuuuguguaugagauguugguguuguagguccuaguaacccuugauaaugacaugacuagaaacugaccugucaucauaaagacaggccuugguucaccucacauguacucuguaauucauuuuuacacuauucugacaaaggagguugugcuggacccauuuucgaggugaagaaccagaggcaaacaaaauauuuugcaauaauuuuaaaaugaggggaguaaguaaaaugguuuucuccuuugauuuccaguucagggucccucagaugacccuguugcccaguacucacccugauccccugagcccuacccuggcuagaggauguaagcaaaggauguuggcaaaaaagcucugagggggaaaguuggauccaacugcuauuucuguuucuauagaucuaauuauuuucccuuuucuccaaucauaauaaaucuaaagggaguuauuuggacacauuucccaggcuggaaaaagccauuucacacaggagagaaaauauggccaacagaguaagcuggucuuggcuuuuugugacuuuaacauacugcaccuguuguagcuggaggagcaaagaugaauggcuugaaauccagggguggggcauccugcauuuggguauucucuauuuaggccaaauucugagggguguuuguguguggggugugugugugugugugugugugcuggaaaggaacauuggagccuuaaauaccacuuuguggcuuacaugccuauuaaaauagaacuuuuuuuccccuggcuaucuauaggggagaaggacugagaagcuagagagggaagauaucucaaaaccacgcuaaggagggaaugcacaguguaggagguaaaguguggagaugggaaagagugauuuguauugaagugagaggggcuagaaaaaaagggauuagagaauggggaaugaagagggugcuggaggaugaagagaggugggcaggguucugggaccaagcccuugagaggacugggcaguauuuugaaauuucuuccaguuaucaaguuauucuauugaucauggcaaagcuuuugcucuguccaguuugaaagacaguccucuccaaucagccuguaaaaguuggugagcuggguuacaugacugcuguguccagagccuggugcuaaggccugcugaggagaugaaaaagagcuucccuuuccuggggaagcuuauggacuagccgggaagacaguguaggauugcauggguaaaaaguaaaccacuuuaggcagugacaugaaagggggccaccaugcuauggaguuguugguugaggagagaguugagaagaaaagaugugaauggcuggcugguuccuagaacacuccuaacugacucuuggcuaaggguucccuggagaucacauggauuuucucccugcccucucagacugaagaauucuuuuucccuagcuggagcaguagggcccggacagagguucuagaaauggaugaacucuccaacaauuuuuucagccugcuuggugccuccaaaauaccugcuacagguccugggauaacagugacuuuagaagacucaaaaaaggacaugacgaauggcacggguuugauuuucaguuuuauucacguuaauaauaauaauaauucacguuaaaaaaagccucagcccacuuuuaggcaggccccagaguccuaagcaaggcccaggcugcuguuguaacuuuguaauaauugagcacuggucaugacagacuccauuaugagcucaggaucagccuauauauaugagcaggaggggacaggcugcaggcaguugcggguugcaggaguucaggaaaggaggugggacuagagucaaccuggaauagcucuacaguaacaauggcagccuuuuuguugcugggacauccauacaggcaacuuagcuggugaaaggacucuggauugguuggcagucugcuuuuuuuuuuccaagguaggcauugagaaggcaccaagaucaaaacuccuauaaagauaagaucuugguaccugcaggcagauuuguucgacacagcuaaagaggggguggggacaguuagcuuagaaaauggaguguccuggccgggcgcgggggcucacgccuguaaucucagcacuuugcgaggccgaggcgggcggaucacgaggucaggauaucgagaccauccuggcuaacacggugaaacccugucucuacuaaaaauacagaaaauuagccgggcgugguggcgggcgccuguagucccagcuacucaggaggcugacgcaggagaauggcgugaacccgggaggcggagcuugcagugagcccagaucacgccacugcacuacagccugggcgacagagcgagacuccgucucaaaaaaaaaaaaaaaaagaaaaaagaaaauggaguguccuuuuuucuugcccuucugcuagguguauacacauauuuuucuaacccuugguauggguuaggaaaugcuuuuagguuucuugaagaaugaguccuacucgaggacauguaguuguggauuaguccacuagagggcguacugcccagggaccaacuaaaggacuaaaggguagggacugauaaauucaaaccacuagaugagacaggagcccugcccucagcagaaaggaaccuuagcaagggacaugaaaccaaggagguaguuugugagauauuuuuagugcggacauacgguaggggugccccuggagcagcugaggugggaggugguguguugaggagagaacauuccuugugcuaguguggcccagacaagcuagagucaggauuuuaagaguggguucacagcauuguuucccaucccccagaggucauuaugcucuugccucucuggcuuuagagccuccagauuagacagaaaacauggagucagagcugaagacagaccagaacucugugucucuaaugguuaagcaaccaguauguagcucaguuaagccuuucagcuuugcucauaauuggacacuugcuucugugaggcuggcccaggcaccucuguugucaugacaacuuaccuagcaccuauugucugggcaauuggggguaaacugccucuguugucaugacgacaagauuucuuuuauauuuccccaggugaucacuuuacuguagaagaaaugagguuaacagaaaagagugagggagaacaacaacucaagcccaacaacucuaaugcacccaaugaagaucaagaagaagaaauccaacagucagaacaggcaaguggugguuucucaauuccaacuuaguuauggggguccucuuauaaugcuccccuagaaagacaccaaugccugauuguugaauucuuaaccaccaauuaguguaugacaaccugggcuaccuuccucccgguugugggggagcaauuacuacucaaagcaaucucuuuuuauuuauuuauuuauuuacuuauuuuuugagauggagucucacucuguugcccaggcuggagugcaguggugugaucucagcucacugccagcuucaagugauucuccugccucagccuccugaguagcugggauuacaggugcccaccaccacaccggcuaauuuuuguauuuuuaguagagacaggguuucaccauguuggucaggcuggucucgaacuccuaaccuugugauccacccgccuuggccucccaaagugcugggauuacaggcgugagcccccgugccuggcaaagcaaucucuuauuagcuaacuugguaagguucuacuacuagcuaacauaucuucagugcuuauucuaugucaagcagugugcccaugcccuuaaucaaucuacuauacugacuuacagaaucaaagagauuaaaguaaucaaagagauuaaaaucaaagagauuaaaguaaucaaagagauuaaaguaaucaaagagauuaaaguacuuagcuuaacagugaccagcuuaguacuagaauccagguuucuuucuuucuuucuuucuuuuuuuuuuuugagaaggaguuuugcucuuguugaccaggcuggagugcaauggcucaaucucggcucaccgcaaacuccgccuccuggguucaagcgauucuccugccucagccucacaaguagcugggauuacaggcaugcgcuaccacgcccggcuaauuuuguauuuuuaguagagacagggcuucuccauguugaucaggcaggucucgaacucccgaccacaggugauccgcccaccucggccucccaaagugcugggauuacaggcgugagccacugcgcccuuaugaauccaggguuucugauugccuaucuaguccuugcagcccuggggugggucuugguuuguggggaggcggaguagggaggaaggaguccaaaggagaaaggcagugggccgcucccuaguuguacucaccaagcguuggcgccucugccuucuucgaagucguaugaauucuuuaugcugacgagaaacaaaauuuauggcagcauacuccagcaaggcagcgaacacaaagagcagacacacagccauccagaugucgauugccuucacguaggacaccuacaacauccagcgacagaacgaucaaccuucuugaaguccuuccguggccuacugaguggauuuucaaccccuaucgauugccugcucuuuuugagcuuuauccugaauuucuucugguguuuaaagaagccuuccaugacauaucccauugucugaaagcccagauggaaaagaucggacugcccaucauacuccaccucuucgcacucuccacccucuacuucuacaaguuuuuccuuccuacaauucuuucccuuucuuucuuuauucuucuuguacuucugcuucugcuuuuuauuauugucuucauucugaucuucuucugauucuuuuguuucaauaaacagcaaugagcaugaacacugcauuugucuucccucuguuaucuccuaggguccucacagccucagugguaauuggucaggcagcguucacaauuccgaugugagacacaugaggacacuuaaggcccagagcagauggucuuagccaagauuacccagugagaagguggcacuaggaccugaggguucugggcuuucaauucaguggcauugccauuuacuuaggcuguggucucacugacaaacuaggaguuccuuccuuucccuccuccaccccuguucuucccuugguccugugguuuuccuuguugcucuuuuggaaaggcucugcugaugaauuuagcucaguaguaagcuggggccucaucucucacccuggagagaacagggcagggauacugagggaacaccacccaccccuuuaaggaugcuucgcuaguugcaagaugugguuggcauccaccuauccaguccuuuguacucuccucucacugcuuuccuuggcagccucuaaguacuuuugucucccacuuucuggccucuuccaggcauugcagcuggauggggccaggagugggggacagagcucagguuuagaccuuuucaucuucucaaccaaauuaccugcuacuuaguuuugagcugcugagcuuaccacauagcgcaccccagcaagaacagaauuucggacaggccacuucuuucaucagccacugcuaugaugggaagugagggugcugcagaccccagguaaggagcaaguuucacuggauaaauaaauccucugcuucaaugauucuuaacuggggacaacuccgucccccaccagguacauuggguaauauuuggagacauuuuugguggcacaauuuugagggaggagguggcuacagacaucuaauggguacaggccagggaugcugcuaaacauccuacaguucacagcucccugccuggccuucaacacacagacacgcacacacacaagcacacauacagacacauacagacacacacagacacacauacagacaugcacacacacacaugcacacacacaacaaagaauuaucuggccccgaauggcaagagugcuaagggugaaaaacccugcucuaacucuuuuagggcaaugucacugagaugguggcaguggguuacuagacaacccugaugaagcauccuuuggugucucuacuuugccacuuacuaagagggcauccuauuucauucaccaucccucagucccacagugcucccaaggauaucaaauaccugcuauuaagaucaauaaugagguaauuacucauuauuauaaagagauggccaugaagguccuuagaccaucaaagaaaaagacacuuuaagcacuaggaagaaaguccuguuaaugauaagugugucaauaauacaucuuagaaaucucggccgggcgcuguggcucaugccuguaaucccagcacuuugggaguccaagaggcagaucacuugagcccagggguucaagaucagccuggccaacauagccaaacccugucucuacuaaaaacacaaaaaauuagcugggugugguggcgcaugcuuguaaucccagcuacuagggaggcugaggugggagaauugcuugaacccgggaggcagagguugcaaugagcugagaucgugucacugcacuccagccugggugacagagcaagacucugucuaaaaaacaaaaccaaacaaacaaacaaaaaaacaaaaacaaaaacucaggaaucuguccacucgcuauccuagcacaucugaaggguugcaaguuuucugaauggucuccuugcaucuacucuugccaccuccaaucuguucuccaaacaguagccagaguuguuuucaaaauguaaaucugauuauaucacuccccuuuaugauccuucagugguucuccauuacccuuacgauacagucuuugcuccccuuaucaugauaucuagccuuugccuaccuguucaguuucaucacaccccuuguaaucugcuguggugaacuauuucaguaguuucccaaagagccaaucuccucuaaccuuucucucauuuaccuggauaacuuuuacucauccuucagcucucauuuuagauaccacauccccugggaagccuucccuaaucaucccagucugugucgguuguccugcuguaugugcucagguuaccuacaacuucuuagcauccaucacauaccuggccauucccuccacuagacugugagcucuucgauggcauggacuguuucuaucucgaucacuguucugcuuccaaugccuagcugaguuucuggacuauaguaaauauuuuuuugaaugaaugaacagauagaugguuuagcaacaugugauguguauaucugcuggcuucugcuugcucucuacccuccuuaccacuaccugccccaauagcuguaggccauuuagaugauaggaucuagauagaaguggcuccuucccugcugcaacuuuaggucuaaucuccuagccucuggaauaaauuuccauuuaguccuuccauucugcuuugagcucccugcaguugaggggaucaaaguccuggcaaagagaugguaaucagugccuuugguggcaccauaaaggcaaaguaacaguuguuucuugggaacaugaggaauggccacuccaaucuaguucccuuacaaaguaagccccuaccacucucauucuggacacuagaguuguauuaggggugugagacuggugugacuuuuggaagccccuggccugaccucaugggcacccaccaaacuuaauguugcacaaacucaagagugagcagacagucccuggcuuacugagucccuugcucugaggggcugguuaaugaggcuauuuaguucagggugcaggccuggauauuuugcuuacuggccaaugaggccaugaagaacucauuaaaaucugacaagaagguaccaaaugcugcaaacaacccucaaacaaagacuuuuuuuuuuuuccaaauaaggaaacuaagugauuccugggagcagauggauuauguucacucacaggagggaaccagaaaaggaaguucucuuggcaagaauaaggcauaaauugcaguaccucccugcuuuagagaugaaucaccuugcauggcagaggcaauaaacuagggcaggguucuuaggucugaacuacuuuucugcuucuggucuccuuacaacaucauuaucaaaacacgaccaucacagccuggucuggccguguagcccuugccuaaguccagccugccucucagagccuugccaauaucccuguccaucuaggaaacacauuuacagaaaaugaucucuaacaacguuucccgggacaugugauucugaucugaguuuugucaccauuuaucccuauaggguuuuggaucaccucaaaggguuucugacaacucaaaaauaauuagggacaacaccagcugcuuuagccccagauucaucacucaguuuuuucaacguugacaccugauaauuauaacaauaguuaacauuuauugagcgguuauuaugugccaaacacuguccuguguguuaauacauuauauuuugcaauaacccuauggaacugguaauauucuuuuuuuuuuucucucucgagacagagucuugcucuguugcccaggcuggagugcaguggugcgaucucagcucacugcaaccucugccucccagguucaagugguucuucugucucagccucccgagagcugggauuauaggcacacgccaccauacccagcuaauuuuuuuguauucuuaguagagaugggguuucaccauguuggccaggcuggucucgaacucuuggccucgugauccgccugccuuagccucccaaagugcugggaucacaggccugagccacugcucccagcaggaacugguaauauucuuauucccauguuauaggcaagaugauugagagguuaaggaauuuaccuaagguaaauuauuaguagaugaugagccugggagacaaacccaaaucugucugaccccaaucuccuacuccuaaucacuagcuccccaacccccgccauguagcaaauucauaaauucaccauggaugucugaaauuaccugccguguaagcccgcaguaaaaagucuucuuaggaacaagcacugagagaugggagaucacagggccugguucccaacaaaucagugcaagagggaauauguucauuguaagauccacaaggaacuguguugcuuuugcuuccuguuauuuuuccaugacaaaguucaguggcugguacauaguacaugcucaauaaauauuuauugaaugaauaaauggccuuguucccugauucguucagagccuugcugacuguaaggacuuugaggugaccucuaaauucccuacaugaagacaugaggcagggagaaucugugcccagucccaucagcacaaaucuuccugcguaaucaaaacaucacugggcccagacaacuggaguucacugacuuuaauugcuauuuucuaccucaauuuucucaucccaaaagaaaggauaauaucucuagagcgcuuugugauaguuucuaauuucugauacaguaagaugacagaaauugguucaaaacucugauauuguuuugguuguuucuuauaaggcaugaucuuaagaagguuauuuuaccacucugggcuguauucuccucauuuguauuaugaggcaguaggacuuucuacuugcugaggaucuuuugaccuuggacaugcuaguauuuccugaagagagucaaaguaaggcacugucucuccucauucccuagccagauaguaucccuaaccccagccuccacauugucaacaauguuauuagcaguauauuacagggagagagaaugcaggacaccagcuuuugcccagugggucuucucaaccuuaaauccaagguaaauggugagcaggagggcacauugggaugaaugggaaaugggguacucuauggcaagcaaguucccuugcaugucucuucaccuuaggcaaagaggcccgggagccagagcucuggguggucauggugagcacgguggugaugcccaggcccacacgggcaggggcagcauccauguugauccagaaggagacccaggacaggaugacgaugaguaggcuggggauguacaucugaaucagauaguagcccaucugccguuccaggugaaacuuuaccucgaugcaggugaauuucccugcaaggagagaggugaggugucaggccccagguacccagccuguagcugagccugaggggauuaggacaggauuagggcagcccucuacugaccagccucugggcaccucagcugggcccaugaaugagccuuucauaauggccccagguaaugccagauguacguacuaaggaagcucucagagcgaccaucaaagacuuggccuuuggcucccagcacuuucauuuccagcggaaggccuuucacgugacugcacagcaagaggauaaggagcaggagggcuccagagucagacugccuggguuugaauccugaaccuuccacugugugacuuugggcaaaacacccaagcguuuugagcuucaguuuccuugccuguaaaacagaguagugauaccaacugcaucacugggcuauuggaaaaauuaaacaagauaauguauuugagguguuugacacauagguagcuguuacuauuguuaucauuauuaacaaaacaauuagcuuagacuccacuuagaucucaggggccaugcuugugcuugcuagugccccagaagcucucuagcaacaacaauucacugggauaaacacugcuugugucuuaagcaagugagaagagccggauagcaaacaucugaaaacagugcccaacagagaccagcuccagacagcggggagcagguucccauagagcaucaggcugcaacauucuauucuaccaacaaaaagugcauuggcccaggcacaccgaccaaugcuccaccuccuuugccagacuucacuuuacucugcuuuccagggcccuagggcuaagaaaauacuaacgcagagcuucucuuggaagcagaggcucaggauaauccaagcaagaaggagaagaugcauauauuguuauuuuauucuggccuaggucuagucuuaucaggccuacuuguuucuucaaagucagugauguugucaaugacugauuauggcuuugacacauuguaugaugcugugaccucuuacuguucccugaauccaccucacuucaucccacccugggauucuugccgugacaugccuuuauuagguaccuauacuuucuuuccuuucuuuccuucuucuucuucuuuuuuuugcaauagcaguuuuguuuuuaauuccaaaauuaaaacuuguuuaguauagaaaaaauaagaaguagagaaggaauaauaauauucauaagcuuacauuuaucaaacccuuacuaagggaccugacuuuaccucauuuaauccuauagcaacucuuuggggcaaguaaaauuauuaucucucauauuacagauaggaauacggaggcaugaagagauuaaauuauauuucucaagggcgcucaacuaguaaaugauggagccagaauccaaacucagcucuaucugccuccaaaguucuugcucuuaucuguuguaucacauuacuuuagagacauuuagugcuauuuccaccuaagguuuuuaaaugcaugcuuuugguuuguuucuuuuaccauaauauaaucauucuguauuuauaccuccgaaucuuaccuuuuuucacuccuacuuucccacauugauauaagcaccuuguaaccauuccuuuuaaugucugcauacuaguccaccaagcagacgcacauguaauuuucuuaaccucugcccuauugguggauauuuaaaacaguuccaaguuuuugcuaauauaaacagccacccaggagcccccuuggggucuaaggccaaugcaguauuuuggaauauuuccauauaauacauuucaaggaguaggauuccuggauaaauaaguagaaacacaauuuuagcuucuagacuaaaguuucucaaagcauguuugcuggaccaccugcaccacaauccucaggaugcuuguuaaaaugcagauuucuaggcaucacuccaaguacagguaaccauaaucagaaucucugagagguagagcccaggaggcaacauuuuaauagacuccccaggggaauauagugcacaccaaaguuugaaaaccacugaucuauauacaaauugccaacuuuuuuacuccaaaaaguuuauaucaauuuucauucccccuugcauuuucuaaauucaauggccuuuuccucuucccacuccccacacccccacauacaugcacacacauauucauggggcagcacccaaaacauaucagcccaccauggaagggacccgggaucuccccucuucaggcugcugccucuauuucagggucagagcuccgcgcagacaaauugucagggaaaauguggagccagcaacucuuacagaagcugcaggggggcagaugcucagccugggaaagcagcccuucuccacuucuuagcugacauuucacaccugggaaguuccugagagcuggcagugguagcgacagugggagguguggacuguaagcuggccacugcccucaggcuuguucccucuggguucagcauagucacucccuauuaccagauguggauuccccgcuuccacacaaaguugaccccaggaaaagugggaaacuguccacccacugucauuugcucugcagcaugcgacaggaacaagaacacagacuuuggaguuagaaggcuuggauuuaaauucuaaaucugccauuuacuagcugugcgacuuggacacuugauuuaacuaacuucuuagaaccucaguuuucccuuucugaaaaaugguauuuauaguugcugucacaaauaaauaaguuauaugaagcaccuggccccauaucugacauagauugaaccuucgauagaggccagcugccuuguccccuugccucacaucugaagguucuccuguggcucacagccaauaaagauccugguuuuuaccuguguuguagugcuugguacaacagccuagauccuucucaucccgcaagauaaacuggggcagagucagccccucagccacuuggacagcaggagcaucuuccagccacucaaacacgaggucuuucaugguguagccaacugaaagugacagagauggcagagggcugcagaguauggaugcuggguggggguagggguaggaucagaacaggcaggagagaacaggugaggaguaaggucugggguuuaggagcuucaugcucauuauggaaaggaaaacuuuucuggagaggacacuuggucaguugucucaugggcccauccugagugggcagguaaaucaggaagauuacagacuccucuccuacccuguucucaagcuugagaaaagcccaaagagaaauuauucugacagaccuagaaagcaggucaagaggguuggaaagaugucaaggaacacagcugggagccuccugccauaucucaagccgaggggaguaagcauguguaccgaacacaugucuuaagcugagcuagccucagagccaggacuucugccacaucaccucagggaggagacagcuauuuauauccugccagucaugcaugggacaaugugcauaccauagauccuagccagggccuugaguuggggcaaauuuaaagcuaaugucugaacaugucaaguuauucacacauacauagcaguucaugagggcucaugccacguauaugaccauauuugcacaugucagguagagaugggagcagaaacaccaaggcucacagacauccaguguugggccuugacccagaguagcucugugacuuuggguaagucgcuuccccuucuguaaaaugggaauuauaguagcugcucuccccacuauucagcguugccaugaagggauauugagagccuggaugugaaagugguuuaagaacucuaaagagcugaccacauaggacacauucuauucaucacaguuauuuuaugcuggaaacagccuuauaagccuucuucugugaacaucuaguggauggcuccagaucuaacagucucuccugacccaggagaugaggagggaguggaaauaagugaugacccaaccuugucauccuugguuccucugcacuuugggcagccccuccaggcuggcaccccugccacagaggagcccuuggcugaccucuucauucuaggcacugucuugugccuagaacugucaucuccuaccucucuacaaagguuaucuauguuuguggggaaucagggcuccacgagugcccccacccugcccacucuggcauuuuuauaggcaucuucaaugucuuaauucaagagagguaaagguggaacuacuucaggcacugugagaggggacauacguuugggcagagaagaugucgcucaaaucgccccccaaaacagcacaaacacauuugugcguaaggcugaugccuucccguuccccagccccauggaacagccagaucagcaaauaacguggggaugaaaaacacacugggcuagggguuagggaccccugguuucuagucucaucugugccaagaauuggcugggugugcuugaguaaguuccucccaacucugaguggcccuuuuccugucugugaugucaugaggucggguuaacuggcuguuauuccaggcucucugugacucuauauagacacuuacagcucucaagcugcaucgugcaggucuggauguccauggggaaguucuugagguccaucaggcaggacaaaaugagggucagccuaguggggacaguaagaaagaagugacaucggcuuacuggggcccaucacagugcaagggaacccuccucccaccccucagucuucauccaaauucuuccccuuaacgcaaacucuccuggcuauccacccggugcaccugaugcuguacagcacauucccauucuugaagaugcgcaguaacuuguuguccguggucaccucauggaaguuggccccuuucucauuagcaaagaagaggucuggcuuccagauagaguccagcauggagggaucgagguccagagagucaucaggauauucucgguaggacaggcgugggucauuccacuguugccgcaagaagacauucacccgguaguccugggagggugcagauaugggcccuucagaaacauugccauucccaggggcccagcaagccuguaggggcaggagggccaugaggaggaauguugggaacacaucucaggggcaguaggcauuuuucacuggagaaggaaccuuccuugggcugauauggcaaaagaugccagcuuguuaucuggugggcuccucccacucacacuaggcuggaaguggggagcagggagaucccuuaccauuguggucuuggugauggagcugaaacuguugaugaagauguugcaggucacguucacgggugggccugaggguagcaaagcacaggccauuggcagggcauuccaggaggcugggagcagcuuccagaacuccuucccugagcugcaggccagggcacugcugggagaaaucagugccagauacacaggcccauggacaauggggugaggaggcuccuucugagcuguuagaaccagccccagcccuggaccuccagccuccuuuccuuagggaaggcaauaggggcuggcuggcuagugugcugccaaaggugguggggagggaggaguuuuuauaggaugaagauuucuuaccuuuaaaauugggccgaauccuggcaucauauccagauguucgccccauaaguuugucuaggaaaucagagggggacaugggcugggaccccuugguuccagauuugacuuccucuuuugccaaggccacccuggacaggagagguaaaaaagucugaggccaguuaugugcugcacuuaucacagacucucaguuuccauaccccucaggcaggaggauagaagacaaugggucucugggugccauuugcaaaaugagaacaaaaacgccauaagucaacacggcagccugccaguuaguacuaguaaaguguuuucacagacaguaggucuucuuacccucccaauucucagugagaugggagugaggacuguuauucccauuuuacagaugagaaaacugaggcuucaaaaggaggacugacuuguucaaagucucagagcuagugacagggucaggacucaaacccuaggcugaggccucguccaguguucucuuucugaagguacuuggaaaacacucaaugagugaugucuugcgggaaaugauguggcuacuacaaaguuuugcccgucuagccuagucaaggaugggaagggcucaaggacaacuuguauuucugagaguuggcuucaguugcuugggcuuuaugcugggcugcucaggaaguaggacccagcuucugaagagggaguuuuggcuucuggugugugcuccaacaggaagcuauguuugagcuacguuuuaguuaaggaccaugccacugcaggcaggugaacuaguuuuggcaacuaugguggggaagcaggacucuagggaugggaaaaagccuccugguaggguagacaugcugaggucaacucccguauuuuccccgcuaacagcuugauuuugaggaaggagccagugugcuuuggcauagcuuagaagccagcccccuuuuccccuaacggguuucccucuaauagcagcaaagccccuuucauaugccuacuuaccaacuugccagcuaacagauaaacuagggacuaggagcuuagcaaagccuuggggacaggagcagugcucagggcugagcucagcuggacuccaggcugggccaggcaccuccugcucccuccugccugcugucauugcucuauagccgacuccaccacugucacugccgcugccgcacugugggacugggcagcaggguaacugcuguccugcuggggacuagucuucuucuagccagugggcuccucuuucccaguagauccauguacuauccagugaccgauagaauaauaaaaauagcuaaggccccaugcuaaaugcuuuacacacucugucuaguuuaguucucacauuaguccucucaacuaaguauuaugauuacccccauuauauaaaugagaagacugaggaucagcaaggugaggugaauucuucacgaucaugcagccagugagugguaaagccgggauucaaaucaagagcuacugacuucaaaacuagcucuaucuaucacaauacuauggugcaggcagcccagggugggcugccaaggagccaaaguaggggaaggucaguggcagccccaccuugaccgucuagaguccugccuccuugaaucuucuaaggaagaggaagcccuuacccuggggacagaggcaggcucugaaaauccaaggaggcuggugguggugcuggagcaagcagaagucugugacuucaccacaggauguccacgcuagccaggugcugcugcugcuucuggccaccugccaccugccugcugggaggccacaugguccugcacguggagaaacuggacccuccccgccguccucagccccacucucaggucaccucuccugcuaagccuagaccuaguauccugggacaggcuaugggcuuagcagucuugguccccagccccuguugcaguacccucuucuggggcuaacuugucugaggaccugagagcagagucaccgugugcagccacuccuuccucucuuucauuccuggaaaguccuaaacaccuucaggaccuaggaggauccagagcugacagucuuucucauguaaagucuugggguggcgcagggagagaagucuaacucuggugcuagguagcugagccacccugggcaggucauuccccaucucuaggccucaguuuccguauguacaacgaaggacuuggacuccagacucucuaagggcccguuuugcucuaacugccucugcuuuccaagccccagugggaaugcugcuacuggagcuugagcuuugaggcagccuccccuccuggagggccugcaaggcccaguguggugcccccuucugccugcauccuccugucaacuccagcugugcugccauucuacuuugagcugcuuuucacucuuuagaaguuuauugcccugcucugcaucccugccugccugccagccaaugugucugcaaacaguggggcaggaggcuuugcagacgcaagcagcccugcgauguuucuuggauuaacaggaggaggaggaggaguaugccgcagugguacugacccccuccaccuugggaggcacuccucuuacgaucaggucagcccaggcuacagccaucuuuccuguucagcucacccugccaaccuaggcuggcuccuggucuaaugagaaaggggcaauuggugggggaacauuuacagggagcccaaagccugucuuuccugcaagcccaggaagugacugcuacuuuuucccccucaaggaauagggagcaaccaagugagcacaggcagggugacugcagaaggccaaagaaugucuagcccagcuccauccugauguggucuuggggcaaaccccugcuaccugaagccucuugggcuggcaguugacagauguugccaucauuuuuagcgaucugagcaguguguggcccagaugauagggaaacaggguuagguggcugggcagacacccuccauucuggggcuuaguugccuagccccuacccaggccuaggaagcuuccaccugugcagaaacauucccagcaugaccggugccuugacaucucuaauaaaaagcucuugggguccuaacugggggaggucguguccuccccugaagcccuccagacugcgggcuuugugcaaacuuagaggaaagugugccagaugcccagguugcccaucccccuuggcuaguguuugcaugcaccuccuucucacccccacucagcucaccugaggaggaccugcccuggcaggguccagagaagaaggaaggagaggguugcaggaacaagaguugucauucugcggggaucuugaagcccuuucucagccuggcugccaaugugagaggggauaucccugcaggaacgccaaaaguacagagccuuucuccaaccugggcugcucgcaaaagagccugcuuucucuccucuucugccucuucuccucuggccugucuuuaccugccaggggccagaacuauuccccuggaaaugauccugacacagauaacccuacuggcuucugcuugggcucgccuugggcuccggagggccuuagccugccagcugggagcuggaaaagauucucucugggcagcaaucacucuccaaacccugaagagucuuggaggggagggaggagggagaccgguaggaagauguuuuccugccucccaccucccccuagaugcacccuccgaaagcaguaauuuaaaggcacagucggcagcagcuggagugggguucagagccugcccgugugccagggaggagcuugggcugccauggcuguuuggggagggccagagguguucuguccaaccucuaacuccccagcugcaggagggcauguaagcagcccugcuccccccgccccccaccucccacucccgaccagcuuuccuuucauccuggagccaagcuggagcccaacaguaaaguccuaaugauuguuaccagggggaaaaagaccugagaggguuuaggcagcgccaccagguauucucaagcugacagcuucagguuagagagaaggugaagaggcugagggcaggaauagcuuucccccaacucucuggacagagacacagaaggugcaugauacagaggaacuugggaacccuccucaagugcggucugccugcuugacagucugucugucccuucaucugucuaccugcccccaucccaccucgcccuuguaguuaguugugcagccauucccgugccugcuuuccucccucaggucgucucuugggguccucuauagcucucagaauuccuccucccagacacuccuuccccagccuggcucaugggaagggacagagaugcagagcaaggcugggacacaguaggcuuugcaggcuucagaggaauggcagcgggucaagagcagugaccuaguggcccucagcccuggauggaggacagaggcagaggggugggcuggccucuucccuugccuccugcacauuugcuuacagcaacaaggugcuuuggcagcuccauuuucuccugccugacucuuccucaaagguuccaguguguuaucuaaacaccucugagacuucuccccucccccauuuccucuugcucucucuucuuuuuuucacucuacuccucucuuccuccccccucccugaaauuuuccuucacggacccucuguccaucuccaucuccaaucuuccucgcaguuucuucucugcgucucacuuucugugccugucugccuugcuucuuucuuccucacuuccucuccauucccgguuuucucuuuccaccuccccuguaucuucacucucucacacucuccuccaaaacgacaacagugagaagccaagcguuuucauuucucccucagggggaacucucccgccagcucugcggaguucugauugcaugcuguggggaggggucugugccaccuucugagguucaauccuggagcugacuguggccuccucaaccuugccagagaggguuugaggggauuggaagcuccuccacauggccuauuggcuauauggaaggauuaauaaugagguagccgugaguggaaccugugcugcagcucccuuuuggcuguguuauuauuaaggaagagaaauuuucaaaccauaaaugaaaggguaagaagagaauuuuaaaugcacacuaaaauauagacaggggugcugggcuuuuggaguugggacugagaacauuacaagucucaaauaaugccuauauggucaguaaauguaaaauaaccuaaaacaucuuuagcugcccuuucaucugcucacccucccuccuuguuuccuuuaagcaucaugauccccacuccaugggcagaaacugagccuuacagaaccucccaggacagagcuccuugcugggggucuggcggggagggguguggcucuugucuccucuguguaacucacuuccuguggcaaaacucaacaugucacuucuccugcuucaacaguuccccauugcucucaggcugcagcccaagguuggucacucugcuugucccacugaugcaucuagaguuuccuguucugucucuccagcuuccugguguuuuuguauguuguucccuuuauccaaaguacucuucccuccacucuuacccuucuggacugagucucguugucauuuuguaaggaacacuucuggagcugcccccaugucccuuggguauaggauaggagacuguccaauguguucccacaggacccucaccuuugcagcacucugucacacugucacauuaccagauuacuugccugucuccccuacuaucgcaagcucccugaugagcagagacacaucauccaccaaauccccagcacacuauaggcaauuagugaacauuuguuaaaagaugcauccugggcaggaauauuuccucaagcucagugccucugcaucucucucugucaaacaagaaguuugacacacagagagaggccagcaugacguaaugauaauaaggaaaaaugagaaagcaguuuuuauucccuugucccuuaggucugcggccucacacucggucaucuggaauucuuagcuaauggaaggcauaggccccuggggaccugucuauugucucggucccaccuccugugugccagauuggaucucugagugcugagaucauagcaggaucagcuucaugagaggaaagaucccuucuugugagaggcuguagcuaugaccaaauguuuggcugacauggugaagagauacagcuuuccuagggugcuggaagcaggcucuugggguauagaagggagaaagggagguaaagaacuggguaagcugcacuaggcguucacaaacagcaggagaggugggaauuggaagaauucccuguaacaacaggaagcaacacuuuccaaagaugaccucagcauuuucugcugugggaagaguacaacguuguguugagccucaccccauaaccuuuuucucuucucaucacuaagcuauggaguauaugcaucaucauguuccaaaauguaucgcacccuuuuccuguuuugcaacuggcugccauacucacccgagaacuggcuuuauugcagugcugaaguuguauagaagcuacaauaggcaaaauguuuuucagaaugaaagauauuauuuugucaugaaaaaacuaccaaacugcuaaaaauggauuaagcacauuuucguaaguguuucauuccagaaaagagucugccacguuucaacccuaugcagggaaaauugcaacugugcccugcugauaagcaggcuuccugaaaccucagucugaggagcagcaggucugcauugggauggguauuguuugguaaauucagugacuucuagggcuacauuuuggggggcaaaguuggagaaccauuuggcauaccuuucuggacucaacuucaauuacccagaugguauggcccccggauugccuaucucacuuauugaaguagagagagagcugagagguaccuugaaaggcaggcuguguuccccaaucugaggaaacucucagagcuuuagcuacucuucagaagcacuaggcuaaguaguuggagggggguugaaaaaaagacagacaccuuuuuaaaaaucugcugacaaugaccguggcguuucaguuggaucucuaaggagcaagccugcaucuuuuugcugcgugugaauuuuucuuuucaggguuauuuucaacuaccaaagauaugacaauuuacuugaaagcggaggcucaacuucuggugcugaggagcacuggcaucagaggcaagaagcucuuccacccuugggaauuaaggggauggugcccagugugugggggcaguaguggugguggagguuucacaguccuagacucagguggaguaaggaagaacaaaauugcagauaugauagacacauucagugcucucuugacuuuuggacagugacugguucaagucugaugcuucaaagauuuggcuucauucuuuuguuuaauagaauauuucagguaugaguuuugcagacaaaaacgugaaguaugugaacuuggggaggccaguggagagguuaaccgaauuccucucagucuccaaagacaaaccagaugugagcaccaggauggcaccagugaacaauggcccugccucuguugcugggcucucuguuaagaauccagggaacaacagaguggugaagcuccagcuagggaagguguagugacuagcauccagauaugcaucauuucucuccuucugaauggaccuucagaaucguuacucaucacaucagccacuugagagcaauucacuagcugugcagaagaguuucauuaagguuuccacagaguuugcauugacuuuccuugucucuuggcucuuguaacucugcaacauucuuguuaggggaugauaggaccaugucaugccucuccucaaagguaaauugguuuuugcuugugaucauguucaugaauaucuuauuuuacucauuuggggauugugauaaugcaugcuauguaaggcaugaagcccuuacauaacauaaaagcaacagaacuuggaaaaaugaauauuuacuguguggaauggaucacacucccgcuaauucaugcaugcauucaacaaauauuuauugagugcaaaucauaugccagaugccagauauucuaggcucuggagauacaacagugaaaaaagcagauggaguccaugcccucauguagcuuagauucuagugggucacuaauguaauuccuucccaaagaaggcuucugccugagucaucagcaaugccccagggccugagugccucucacagcauaugaguagggcauuuauuauauggccuagaaaauagacuauuuuuuucagcaggcaguaaugagcuucauuuuuaucuaucccagaaucuuucugcuagucacaucacacaggucaucaccugcuagacacccuuucaagaagcuuauccuucaauaauccaacccuacagaacacgcaugcccaagaacccugaaaagauaaucucaugauuaucucaugaugcauacauauuugucugcaacuguuaauaagcaccuuccucacuagaagaguuaggcgagauuaacagcauccuuagcuguggugcuucucugagugguuuccaauuauuuaggauccuuccuuccuuccuucuucccccuucaaucuuuucacuuuaucuuuccuucagucuaucuuucugucuguucuccugucuuuucuucuguuuuucuuuuuugguuuuacuaugaauaaauuuaauguuuguuguaauaggacacuggacacuaaaguaaagaacaguuugguugauuacuacauagaauugugcacaaaucugaauuugcauuacuaacaccaaucacauaguuauaguuggcaaauguuauaugccaaaauuauaaauuuaacauuacaaaugauguacuagccuaaauuugcacuucuguaguguucauuaucugaguauacacgugugcaugcagacacacacacacacacagaacucuccuugauaaucugaagaugauaucccuguugcuaacaauuauuauccaagaguguguggccaaagaaauuggagugugaugacuaguccauuuuauccugaguacagguagaucuugucuuuguuuuguggcugaggucucuacauuuacugugcuaaugaagugcuucuagccagucacuugcccagaauaauuggaaucccuagguaagaugccaaauugagccacuucucuuuguacaagguaggggagguauucauuuugcagaguuaugucgcauauggccccaaaucacagauucuaaucaaugacaggcacuccuaaagagucaucucagauacuaaucagacaauaggcaacuccaaaccacauagcaggucacacacaugagcuuuugcugccacccacuccugcacugucagcaacaucaucgucagacacuaagagaguguugcuuugagaacucugacuuuucuuuccugcccauugucaguuucuuucuguaaccuuuacauugccuuucuaaccacacauuaaaucccacguguucuauaauccccucacuuuccacagcagugugcccacugcugagucaaaggcaggugcuguuucacaacugcaaauccaguacaaucagccucaauuaugggccaguuucaggaaagacaaauaggaugcugaggacuugacauuuucagacaagccauggcauagauccaggaagucugcucaguugcaucaccuuaagcaaaagcacuugggagaccaaauuauuuuccguguacagaaccagguauaugaaaugguaggauaaaguagaagaggacuauuuagaaaguucacugaguagggaugaacauuuuagcacugcagagaaacacccaggaggaaacuggaagugagggccagggagcucagcucauccugagcucuggagguagagaauuugaaguggcucuuuucugauggcucugauucuggcuaaauguuugcugagauucuguucaagauaaaguagcaaccagcagcagucagaagauucccagagaaggcuaaacuaaagagauaagccucagaccagagaccaaauccuggagcagcuguuaaucagugcuaagaagaccagggccuggggagucuuagcucauguuaauugcauuaauuaaauccugguguaggccgggcacgguggcucacgccuguaaucccagcacuuugggaagucgagacaggcggauuaucugaggucaggaguucgagaccagcuggucagcauggugaaaccacugucucuacuaaaaauacaaaaauuagcugggcgugguggcgggcgccuguaaucccagcuacucgggagacugagggaggagaaucgcuugaacccaggagguggagguugcagugagcugagaucgcaccauugcacugcagccugguugauaagagcaagacucugucucaaaauaauaauaauaauaauccuaguguagagcucaguucaccauagauucuaaugguuccauaggucccuccccauuucuuuaccccaaaaagauucuuuugacccuaugaagacuggaaagucauucuaguuacuaugaaagagaaguuucuggcccucauguguguccaaauuaucagagaucaggaaaauccuuuguuucaaguugauggaauacauaucaauuauucaaucaauuucagugucuuuaacuccuaguuugaaugugaucuacuauuaucggucuuucuuagauucauuuuacagaugggaaaaagaagacuaaaaacuauacaucucugucuucucugccucacauuuuauacuuucacucucauuccaacuccacuuucccaaacauaacuaauaccauguuugcaaguuggugaaaaucaagccaaccaaaaagauagacuggagcagaaauaaugcaaggcuucuuuuuguaguuaguguucugaaaauauuuagaugugugucucauguccaguuucauauucagucuuuggccucuccacugcucugcaucuacucagaccucuacucaccugcagguucagaguaucaucuuccagagaucaacugaagucuccugauacccaauaggaaucaaggucauucucuucaucugaagaauggggcaauaggaaguauagaaugaucuguucaugagccuugauucugccaugcagcucccuuugggcucagcagaugaguagagaguagagaaaggauaagcauccugcuuuccuaggaaucaaaggcccccuggagacucuuuuuuuuuuugagacagggucucauucugucacccaggcuggagcacagugguacagccacaggcucacuguagccuugaccuuccggacucaagcaauccucccacuucggcuucaagaguagcugggacuacaggugcauuccaccauaccuaaguuuuuauuguguagagaugggggucucacuuuauugccuagacuggucuugaaacuuggguucaagugauccuccugccucagccucccaaaaugcugggauuacaggugugagccacuguuccugaccuccuggagacuuuuguaggaagaaacuaaacuuucuccagccugcauuccacagagcuuggcgauggcauaggccuuuuucccaaagucaaacaaguucaucaucaagucaagagacaaagccacguaggccuaucccccaacuggcugcuccagucaaguaagaagaaacuggauccuuaaauauuaaguaacagugaguaguugugaucaauacuuccucccaaaugaaacuuugcugugacuuacggugaaguugucuccauccuaguaaggggaucauuucagccacuagacaaaucauggaugaaaugaauauggugguuuuuuuuuuuuuuaagggguuaaaucuucuuugcuccaccacuuccugacuccugccaccaacccucuucaacccugcccuauagcuuggccuagcacuaccaugagcagagauggaaguagccuugacuguaauuuucgacaauuuagaagugccuuguggcuucuauuuggugccugaaauauauugauuuggugaggaaagggaaaaagacugaaauucaaguggagauucuugcauggggcaaaggaacaagaagggcuagaaucccccauacuccccaacaucucaugcaaaaccaccaaguuauauaacguuagaaaugaccagauauuaaagaucuaauucagucuccucuuuuugaaggccacagaagggugaaaugacaggcucaaggugauccgugauuuggugcaggguuuagauuagaucucagaaacuuuggcuuccaggccagcugcccccgucacauuacugcuuucccccaaaagcucaaaccuguccucugcuuugugcuuugugacauuuccccuuggccucucuccacaaggcacccaugugcacuccuauacacagugcacugcaccguguagccaugaacucucccugacaggcacaggcccaggcaaucuggccuucccaaguugcagaaaauguucagcaguggggccaaggggguccuuuaauauuaagccaaaagucagcuaaaguauccacacacaaacuacuuccuccacuauuuacucaguaacucauucuccuucuuaaaucagagcugagagaauaaagaggauaagagaggagaaagcaagagagagaaauggaaauggccagauuuccuuaaaauuguuuguacucuccucccuuacccaaauaauuuauuuaaugucuguucuguggaaccaccuucccuugcaacccugggcauacauugucucaauauaauaauaauaauguugccucagcagugucugucuguaucuagagacuuugucagcccagaagauugguuuuggaaccaaauucuugcuuugcagagggcugggucucuuuuucuaccacaagaaguaaaccaucuggaaagaggaagcugcuuacucuaagagauaaguaggggcaugccaugggcagccuuggguuucccugcuuugagagagccaacccugagaguugguaggagccaagcaccuucaggcccaucucaccucugggaaaauucagcaccacccugcuuuguuucugguacaacuuucccauguagaagugauucugccucuaaaaaauuaaccccucuaugucaggcaucauguuagguguuuccauagccgugauuucugucaacucguaagcaucauuguccccagaaacaagcucagaaauggcaaguggagagacagacuucauagacaggauuccugacacucagcggucucuccacaacacaguuuccuauggauaggcugggcagagccuaacucaugggaaauacuugcuaaacguguguugcaugaaugaacaaaugagagacugugugaacgaacugaagagagaagaggcucagggugagagcuccuccacucccuuucugcuucacugcucccauggaccuaagcagaaggacauguguuuuuuuuacaggacaguuuuauugaccaggggcacccuucaaauaaugcugaugaaaggguuugccaggaccccauucccauucaaugaaugcagacaggaucuucuuuugaaaccucuucaugaaagggggcagacuuggcugucagacugccuagguuuaaauccugacacuacuacuaacuagcuccaugaccuuuuccaagugucauaaccagucuaagucuccguuucccuaugugugaagugaagucauaaauaauaccuacaaggccgaggcagggggaucacuugagaucgggagaucgagacaagccuggccaacauggugaaaccccaucucuacuaaaaauacaaaaauuagcaggauguggcagcuggugccuguagucucagcuacuugggaggcugaagcaggagaaucgcuugaacccgggaggcagagguuguagugagcuaagaucgggccacuguacuccagccugggugauggaucgagagucugucucaaucaaucaaucagucaauaaaaccuaugccaucagaauugucaugaagauuaaaugugacaauagauauaaagcucuaaaguagggucaggcauaugaucaacacucaaaaaaccccaacuguuacuauucuccaccuugcagccuuuguuucccuucaucugcucugugggcuaaaaugguuuuacuaaacuguguccccuagcucagggagaugggaugguggugguguggugagacaccagaagagagggcgugggauuucaagagagcaccauagagaacucacccaaugcaaagaccaacacuuacuaggccaucagaaccgcagcugauaaaauauccuggaagagggcuuagcucugggagaagagaggugguuggaaauauuugucuagggaagcagggacaggaauuguggggacagagaaaaaaaagagaucgaagggaaaggaaggaugggagacaggagaagaaaagguuugggagagacagggaggggcuaggaaagcccagaaggagcuaaauugcuacuggaacauuaagcacaaaugagggggaauaaaauuaacaucuuuauugaaaagaaaaacaaggaaguaagaaauaucccuguuuggggaaauauuguguagaauggagcaggugcugggggccuuuggaggcugguugccauggcgaugcuauaugucaucuuuucuauuacccugugaauauguuagcugauaguuucuuucugcuccaguuucuaagaccagggcuuagcccuugguaaagcuuugaucauucccaucucaaacacauugguuaugcugugggaccuacuggcuuauugucaugucuccuuuuugauaugacacuguccagaaacaaacaggagaaagcaugcaugcuggggaguuggagggagaagacucuucuguguaccucuugucacauggaugagaaggcaaguuuggcaggugggagcaccuuggcaguagggagacuggggagacuuuuagugacuccucccuuuucuaggugaauccagcuaggcacuucucuaggacacuagguuaaccagucauccucauuugccaaagauauuagggauccaauuaauaucaagacugaggauuuccugggacacagaauuuuuaaugcuaaaacugggagaguaccaggcaaaccaggaggguuggucuccuuaagaaaaaauccacuuagaaauuccaagcuggcugggcgcgguggcuuaagccuauaaucccagcacuuugggaggccgaggcggguggaucaccugaggucaggaguuugagaccagccugaccaacauggagaaaccccuucucuacuaaaaauacaaacaaacaaaacaaacacaauuagccggacgugguggcgcauggcaguaaucccagcuacuugggaggcugaggcagaagaaucucuugaaccugggaggcggagguuguggugagccgagauugcaccauugcacuccagccugggcaacaggagugaaacucugucuuaaaaaaaaaaaaaaaaaaagaaacuccaagcuaaagagagccuacacucuuccgagccugauauuagaaaaaacgacaugcagagaccagagauagcuuuugagagaaagucacuauuaaacccaggcuuguaaacaugggcggugguuuacuagcucaguuuuugccaccaacccauuuuccucauacuauguaguaugucaagagauucccggccaggcacggugggucaugccugcagucccagcacuucgggaggccaaggcagguggaucaccuaaggucaggaguuugagaccagccuggccaacauggugaaaccccaucccuacuaaaaauacaaaaauuagcugggcgugguggugcaugccuguagucccagcuacucgggaggcugaggcaggagaaucacuugaacccaguggggcagagguugcagugagccaaaauugcaccacugcacuccagccugggugacagacgagacucugccucaaaaaaaaaacaaaaaacaaaaagaaauucuccaagcuugagcaaccucuugggguccuuguuaaaaugcauucuugggccccaucauuacugcuugggccccaccauucuugggccccacuaugacugcucacuaaaaugcucucaggcgagugcagccuagguaucuguaucuuaucaaguuuuccuggugacucugauacacgucguaugugggcuaggcuuugggaaagcccaugugguggcagucagaguuugacaaguggaagccaauaagcauccagaccucagagagccucacuccucuaagacaaaaccguuuggaaaugaccugggccagggaaaggaacucaccuugcccuuccaccugcaccaacuucuccuucacucuuugccuguuugaugccuucucuuucuuucucaguguccagauuuaaacaucaucucuuuggcguucuuauuuauuuauguguuuuuugacauggagucuccuucugucacccaggcuggagugcaguggugcaccuuggcucacugcaaccucugccucccgggcucaagcaauucugccucaggcuccugaguagcuggguuuauaggcgccugccaccaggccuagcaaauuuuuguauuuuuguagagacgggguuuugccauguuggccaggcuggucuccaacuccugaccucaugugauccacccaccucaggcucccaaaaugcugggauuacaggcaugagcgaccucacccagcugccuuggaguuuuuuccuggccccuuacccaaucuuauuggugcucacaacaucuuggguuuuuaaaaaacucuauugugucucacauucaugugugugauucuucagagaugcuccuccuuaguagcuucuaagcuccacgagggugaggccugggccugauuuucucauugcugugcacccuacagcaccuagcuuagggccaggcacaggguaggugccagcuaaacauuuguaaaugaauacaugaaugaauaaauacaagaauggaugaggaggcacuggugccugcccuagcuuggacaacagugcugagugucaguugcuccaugggggcucaucuuagcugcucugguggcaagguuucuugcagcaucauugucuuagucagcuagggaggccauaaaaaaauaccacugacugggugacuaaaaaauaagcgaaauuuaguucucacaguucuggagguuggaaauccaagaccagggugccaagauggucaggaucugcugagggcccucuuucuagugaaggaaaucaaaauauuuuaccccaaaauauaauuuuuugacauauuuugaaaugacugcucagagggccugcaaacucaaguagccuugcaaagcugucuucuguaggggagauuugcauuuguagagaaaaccugcaucgcugcagccagacuuuccaaaggccuuuccuuuuugggaucuaggaacgauuaacugagauucugacaacuuuaaaggucugaaaggaacauuuaccaccuauucucugugagagcugcuacuugugagguuucauuuacauaacaagacugcauuugcuggccaggccuccucuucuuucucucauuaaccuguuuugccacuccaggcccccauucuuucuguaagagagagagagcgcgugcacccuagucucuuccucuuacuuuuauuuuauuauuuuuuugagauagugucucauucugucgcccaggcuggagugccguggugugaucacagcucacugcagucucaaccuuccuggcucaagcgauccucccaccucagccucccgaguagcugagacuacaggcacuugccaccacacccggcuaauuaaauuuuuuguuuuguuuucuuuuagggcuggggugucacuauguugcccaggcugcucuagaacuccugggcucaagugauccuccugccucugccuuccaaaguguugggauuacaggcaugaaccaccauggcuaguuuaaaugguuuuucagggucacauaucucggaagauaugugggauguaaacccagcagccuggccccagagcccauggucuucauggcagcagcaugugugccgccucucauguguacaagugaaugaagaaugaaagguaagcagcgcaccguggucauccccgcagccaggagccuccagaggugccauucagucucucaagucccuggguuuuggggacucccugucacaaccccuuugggguagccucccaccccugccacugcaucucuuccuccccuugucuucucucugucuaauugugagugcugcgcuaaguaggucacucccacugagggcuuuuuuuuuuuuuuuuuuugagacagagucuugcucuguugcucaggcuggagugcaguggccugaacucacugcaaccuccgccucccggagucaagugauuauccugccucagccuuucgaguagcugggacuacaggcgccugccaucaccuccugcuaauuuuuguauuuuuaguagagacgggguuucaccauauuggccaggcuggucucaaacuccugaccuugugauccgccugccuugggcucccaaagugcugggauuacaggcaugagccaccgcgcccggccucacccagggcuuuuaaugagaaguuuugccauaccaaggcagcaaagaugaauaauucagugaagaaggaauguuauucuuuuuuuuuuuuuuuuuuuuuugagacagaguuuuacucuugcugcccaggcuggaguguaauggcgcaaucuuggcucgccgcagucucugcucccagguucaagugauucucuugccucagccucccgaguagcugggauuacaggcaugagccuccaugcccggcuaauuuuguaucuuuaguagaggcuggguuucuccaaguuggucaggcuguucucgaacuccugaccucaggugguccgccugccucggccucccaaacuggugggauuacaggcaugagccaccacgcccugccuuuuuuuuuuuuuuuuuuuuuugagauggagucucgcucugucacccaggcuggagugcaguggcacgaucucagcucacugcaaccuccaccucacggauucaagugauucuccugccucagccucccgaguagcugggacuacaggcacccaccaccacgcccugcuaauuuuuguauuuuuaguagagacgggguuucaccaugugggccaggcuggucucgaacuccugaccucaggugauccacucgucucggccuccgaaagugcugggauuauaggcuugagccaucuugcccggcugggaauguuauucuuucacagaagagucccuugacagugggagaggcagggaaggacugcuuauuaugggaggagugggggcuggggugacagaaguagagagaggugaggaggaggaaagccccacaugaaucacuagcagaauucugagggauccuugucaaagccucuuugccauuuaggaguuaagccuacuuaggcuggugcaaaauccccaguaaucugauggcuuuugccccauaaagcagugaucucuuuaugaccaaugccuccuuccaaagagagguguuguuauaucuaggggugauggccuguuuucuuaauucauugaaauuucaaaaugauuaagacugcucaaaggggaaagaggacagauggaggggagugaugugcauucccaguccucauucaaugccuguugugggguggcagggggguugcuaauacuuagacagcaacuuucagaagauauaaaaagguuuuccugaugaugucuuucgaauucugacagaacauaugagaugcaagccuucuucucaauugucaguuagccauuugggacauagaacuggggcucuaguucccccuugucugaauaaaaugcagcagucuuuuuagauggaaucuuucuguguugcucuggcugaucucaaauuccugggcucaagauauccuccccucagccuccuagguagccaggaauacaggcauaggccaccagcaagcaguaaucuuuuugugggaguuggcaucugacacaaagcaagguuucuaaugcuuuaugugccaaaaggauccaguggcuuauacucuggugcucuagaauaagaagaguggauuuuagccccuguucuacuacuucuuggcugugugaccuuagacaauuuauaacacuucccugaucuucaguguccuuauuuaaaaacugaguagcuguaacaaaacucucucaugcuugcugugaagacuguaggaaauaaaaaaguauuuuuuuaaacggaaacuuuguacauauguaagggauauuuacaaguagaaaaggguacuuggcaacuucucucuacuuagcacacucucaccugagccccuuuggauaaacugauuugcuaggguugagaacaaaguauguagccauggaacuguuucugugcaaaccuaacuggcaugucagaaagccaaauagugaucuuagucucaauggcacuuuccuaucaccagaggcauagagaggcaaucuuuggaguccaagguaucugaguuugguacuagguucugccauuuauuaacuaugugggaaaauuaaucaacauucuugagccucaugauugucaucuguggaacagaauuaauaacaguuucugucccucaaaaauguccuaaguuuuaaauuagaauguccauauguaguccauagcacaggcucugucugacacaguagcuuuucaauaaauggaagcuuuagaugcugcuguuauuuuaagugagcgaaaaacucugagauuauacauauacuaagauucguuuaaaauuucuucacuauagucugggcaauauaaugagaccccaucuguacaaaaaaauuaaaaaaauuagccaggugugggggugagcaucugcagucccaccuaacuacuucggaggcugaggugggaggaucacuugagcagagaaggucaaggcugcaguaagccaugauugcaccacugcacuccccagccugagcgacacagucagacccugucucaaaaaaaaaaaaaaaaaaaaggaucuuuacugaaugccaaccaugugccaaggaauacuagagauacagugguagccaaauuaccugacuuucaacaagcauuugggaguaagugaaagcaagacucuauucuggcucagaaauuaauaugccuaagcuauuaaggucuuggaggcugaggcugaagcggagaugauuuuuuuuuagacucugggacucagguacucacuaaaggaaugggaaagugugcagauaguaucaggcacaggaggacauacagaggaagaaagauaguguuuuuagggagaaaguaguacuacuucccuuuguaauaggaaaaaccaaaccaaauaaggaaacaaaaugaacaaauaaccacucacuagcuguggacaggacaaaaacaccaaggggccucaccugaguccuuccuuuccaacauucugccuuuuccuugucaaagcaggaauuuaagaaaggaccuaagaauucauucauaccuccguguuguaggaccaaugugaauugccuggaaacuagccucaggagugauaucauagucaagucccaguucauugugggucaaggaaucuggcuccagccucaguuucuuaggaaagaagccagugggaguuacacagccucugauauaacuugaaaaacugcccaccuuggcagaugguuauccauccauggggcucagugaccugugaucagauugaaccaaaugagggcuguggcaauggugccuuugggaggcuuggugaggcagaguuggaggucagagaagcuaaguugcccugaaccuuuccugaggaaugugucuucuguuucuuuagagaguugcacucucaccaaugaccagcugccuucugggugaagugaaaguaaguacccugcugacuuugacuuucugucuccucuucuugccuuugguucaagacggagcaaaucacuuugugcugcaaagagcugacugacacccccacacacugcaucaucuugccuuuggggaauggggaagagagugggcaggguuggccuucaucaagaccguugaggguuaacacaaguuggcauuggaggcccuuaccaccuucccaagagagauccugagacaugcugccuaauggaaacuugccauuccucacuucagcauucccuuuccucucucuaccgcuuuccuccuucaacuuccacagcuccccaggaccaguuuaauuuguccaguauugaaaucaucccaggcaaagcagccagccuccucucuuuacuaacaacuggagugaggacugaggaggccuggaggcuuacugguugccaugguaagaaguaggcccugagaggauuaaugagcagagagcuggaguuuuuuuguuuguuaguuuugaugaguuuuguuugcuuuucuuccuccacccaccugccccccuguuccccucccaccuaccccuccagagucucaaaccacuaaagcagaaggagauuacuaggagcaaaaucagcuccugacgugggcuacacuaaauccaggcugcccugcugaggguaauugguguacacuuuguaauguagacucugggagagccaaguuuggaaggcaagauguaccaccuuuguggcauggcacagcauccugaggcagagggggccugcuaggggaggagggggcguugaagcucucugaagccuccacacuuuuuccuuucuggccaaauaggaaagucacaggcaaacuaaaagccaguuuaggcugagaaaggcagcuaaguccugaccuucugucuugugucugccacaccccaagaucccuuucuaccagaguccaggcacccgcuccacaaaaucuccuucaaucagcuuccucucuucccacuggugagcaagguagaucauauucauagagaagauaugagcuccugaaagggugugagguuauuauguuacaauuauuccuguuguuauuaguguuuuuguguuauuauuauuauuuuaaauuaguucccuucaauuuaauccauggcucugagaauggagacagcugauucagggagauuuuuuggacuggguaccugaacugcacuaaaaaaugaccuugcuuccuuauuaauuaguaaucuggggcugaggagcaauaagaaaggagaagggcaugggaaggaaacucugagcggaccagcaaggccagauaauggccaauggugaagucucagugucuccuaucuccucuuucauucuguggcaacugcauaaagcuaccuugauucgaggaucaucucacagugaaaauauccaauggugucccuguacuucuaguucaauccuuuuauccaucccagccuaggaauggguacccugcucccuuuuugacccuccaaacauguauucucaguuuccaagguuucuauuuauccucacuuagguauugcuuuauguauacucucaaaaccuuuucuucucuccauggguuuauuuucccagcaagauggcauauuuccugaaggcagguucugugucauaaacuccacuagaaucccgcuucuucagggcucugaauacgaugggaacuuggugaauguaucuugauuuacugcucaugaagcaagagccacaggaaagguccaugcuaugaauaacaggcauaaaauaggagaaauuggcuuauaacauagaaaaacaagauuaaaugcuuaugucaugccacguacguaauaaacauuagagguacugcacacuuaaacaugaaaggcaaaacuauacaacuauagaaauauuggagaggccgggcgcgguggcucacgccuguaaucccagcacuuugggacgccgaggcacgcggaucaguacgucaagaguccuacacgagccuggccaacguggagaaaccccgucucuacuaaauuuuugguagagacaggguuucuccauguuggucaggcugguuucgaacuccugaccucgugauccgccgcucggcucccaaagugcugggauuacaggcgugagccaccaugccuggccaacauuucuauaucccccuagaacuacucucacagguacacaaaguagcuugcaugaaauguuuguugcaauauuguaauacagagaaauugaaaacaaccuaaauguccaucaacagaggaauggauaaauaaaaugcaaaauaugcaaaucauggaauauuauauagugguuaaaaugaacauauuacuuucacaguuaucaacagaauuagcucucaauaauuauaauauuacaugaaacaaagaagcagagaagauguacagaacaauaccauuuauguaaaucaaacacacaagagugcauaucuggccgggugcaguggcucacgccuguaaucccagcacuuugggaggccaaggcggguggaucaccugaggucaggaguuugagaccagccuggccaacauggugaaacccugucucuauuaaaaauacaaaaaauuagccaugcauggugguggaugccuguaaucccagcuacucuggaggcuaagacaggagaaucgcuugaaccugggaggcggagguugcagugagccaagauugcaucauugcacugcagccugggcaacaagcgugaaauucugucucaaaaaaaagagugcauauccaucaugaaaggagaugggauugggaagggugauaaagagggaaauaaauaaaguaaaaauaaauaaaaauagaaauaaaaugauacaaagugggccaugcauaaacugaugaugauaauaugacucuaacaguauuccagucaaugaaauucuuugcaccugaagcacaucccuuacccugaaagaaaaaaaaaaagaaagaaaugagauaagguauaggaaagugcccaaagcagugucuggcaaccaauacuugcucagcaaaugcaaguuuccauuuuccugcuucacccuucuucuuccuugagagggaagugguagugagcagggaauacuaagagcccagaaacuaaacaucuguugucuuagucuguuuugugcugcuauaacagaaaaccaaagacuagguaauuuauaaagaacauaaauuuauuuccauaguucuagaagcuggagaguucaggaucaaggcgccaauagauuuggucucugguuccaagauggggccuugcuguguccccagcauugaaacggauaaggcagaaggacuugagagugaaccgacucccacaagcccuuuuuauaguugacauuaauccauucaugugguuggagccucccaaaaggcccauauuccaacacugucacuuuggagauuaauuuccagcauaugaauuuuaaggaacacaucgaguccauggcaccugaacauuuaaacguguccuuggaugucaauugguccaccuggaggaggugccccugcugaagggcaccaaaagugaaacaaaaacaccucauuggagaccagcaaggggccuccacauccugaauguuucucauugggaugugggcucccuuuguuccucuuaaucccaauuccaccaucuuugugcugagaacuugauccaaggagccuaaucaguaaggcugccagcuuggcaguccuguauuuaaugaaacuaaccucucuauucacucaaggaucauuaaaaagcuuuauuucuucuucugacagaugcaacacuacacuugcccagagauuccccuggcugcucugagaaaugggcagcauagcucaggaagcugagggccgagacaccugacagcugguuuaaggaaacugccaggccgggcaugguggcucacgccuguaaucccacuacuuugggaggcugaggcggguggauaccugagguuuggaauucgagaccagccagaccaauauggagaaaucccgucucuacuaaaaaauacagaauuauccgggcaugauggugcaugccuguaaucccagcuaccccggaggcugaggcgggagaauggcuugaacccgggaggcagagguugugguuagccgagauugcgcaguugcacuccagccugggcaacaagagcaaaacuccgucucaaaaaaaaaaaaaaagaaagaaaggaaagaaagaaagagagagaaagaaagacgggaagaaagagagagagagaaaagaaagaaagaaaaggaaagaaagaaaagaaagaaagagagaaagaaagaaaacuaccuuucuugaauagggacacagaauaugaacacaaaggcagggaugguguuugacugaguauacccagacacuuagcugaagggucucugguagggaaaugcucagacagccugcuuuuuaccuguuucagccuugauuucuacugaaggcugaucauuuuagcccaaccuagcuucagccugaagauggccaguucuagggauaguagccuuuagagaccuucugcuagagaagagaagagaagagaaaacaaugggcaaagccuugcucccaaggacaugguuuuaggaagagcaaucccugagacuugaguggugacaauggagacaaccacacaggaaugcaagucuccagucuggcucugaccuacuuuauugcuggggaauaacauucccuugcaguggucccaagacagaagcaggccaguuuucuacaaacuaagaaaaugguauagaugacaaaggaacagacaaauauauauggggucauaaaagggaaagacuucugcaaagagcacuugcuuaucauuuuuuuuucacuucuucugagccaagcuccugcuggcuaggauugucauugggccagugucaggaccugacauuaaccuugguuuuagcaauaccgagaaacaaggaggccugguccuaccaggccacaaagcugcuugacugucugccuaggggaaaaggaauucggccacaugguaagcaucccuauuugugugcacuugucuccucgccuucauuucgucuuuaucucuaccuccucccccaaccccaagcugugggguauuugguccuccuggcuccuuucucuacaucuguugucuaucugucuuuuuugccuccaagaucaggcaauugggauuugcugauuuaaaauuuguauuuaaagguuuugcaugcugccagcucaggaacacaaauggaguaccagugcgcucuggauacucuuucguccaauguccuuggugggaugagggagggaggcaggaggagcuagggccaggugauaagggaauauugcugguuaugugucccaaagcauacuucuucaacucuauuaccaacugccccuccccauccuccuggacuccugaagagagaggcacugagguuggggugggugcagagagaaaggaagaauuacuguguuauggagaacucacuacaugccuccaaccaugucaggaacucuacauauauugcuuuacuucgugcucacaacaggcugugagguuaguaauauuaucguucccuaguuuauaguugagaauacugagccccaaagaggauaagcaacuucccucagggucucacagacaguaauaauguugagccaagauucaaacccagguuuggcugacuagcuguaaugcccuuaacagcugcucuguuaagagcacuaguuaauguuccuggccaugucaccaauauaugcuauuuuauuuauuuauuuauuuauuuauuuuuugagacggaguuucccucuuguugcccaggcuggagugcaauggugcaaucucagcucacugcaaucuccaucuccuggguucaagugauucuccugccucagccucccgaguagcugggauuacaggcaugcaccaucacgcccagguaauuuuguauuuuuaguagagaugggguuucuccauguuggucaggcuggucucaaauuccugaccucaggugauccacccgccucagccucccaaagugcugggauuacaggcgugagccaccacaccuggcccaauauguacuauuagugaaaaaaucuguuugggccccagauuccucugguauaaaaugggaaugauggcccuuugccugacuacugggcuugcugugaaggucaaacugguuaaggcauauggaauaauaaagaaccauuucccuuugugugaggguagggaaucaaagccugaucuaugagcugggcugccuggguuccagucauggcuguguccuucccugguucuugaccuuggauaaaauuacuucagguuucugggccucaacuauaaacugaaggagguggccucaaagggcuccugcaggucuauggggcugugaucauuuccccucucugagucuuaggcugucugccugcugcuagagggagauggucccacucagccuucucccuucauucugcuuacaucgaauggaucugaaauaguuuggaaugaacaagaagcuagagucccaaaguccccaugccuucuucugucuucccucaccuucuaccaucacaguguuggucccagguauugcucucauucccaccuccuuguuauuaaugaggggagagacagggccuuaacgcaaucuccucauagcccagcauagcccuacucccaguguacccuucuaaagaaaaaguugugaaguuggcuucacuugugucaucugaugaugcucuuggggacuacggguagggccuaguccaaggcgugggccaugaagcaacucacaguaacagaggcuugauagucauuugcaauccuaaaaugcugcacuuccucccagucauaucuugaauuaaugaagagccauuuuauugggagucuacuauguacaaaguacucuguugggcacuaggaagggaacacucagacaagaagcuaacaggcuggugggugagauggauguguuuucuagcacauagagcacuucguguacuucacaagggcauacaggacuuuaucucaucagauuuucaaaacuucuaggagauauacaggacaguaccauccuuauuuuagugaacugagucgcauaaguacacgcgagccuguaaaaguaagaauaaaaauagaagaguaggugccaauugcagagaugucugaugaugugagguagacagguucuaaccacacaguacagugagcuuuugggagagaagcacuaugggaagaccuugcuuucauguuuagccagcuuauucuuggaaaacugaggggucaccaagacuauuuuuaugcagaggagucaaagccuaaggaacugaugaagacugaguucuguuuucagguagcccacugauugagaagauggagggguuucugcagaauaaucagggccaagagaaaaauugccacuaagccugccuuaggaagguuccagaauggagucuuagaacuugaucaagaagaguccaggaggcuguccacaaagcuuggcucacagaguuuugaaugagccuauccugcagcgcagcccgagguccucucagcaucugcccucucuggaggcacucucuaagcuccuggaguucugcagguaacccagcccccaaagcucuggcuucuuucaaaaacagagcuggagggcacaucugccaaacuccuucacugacaagcaaucucuucucuggcagcccugcucugcccuuccacuggaauaauugagcacagauguaugugcaugcgagugcaugcauaucuguguacuugggagaggugggggaugcagguguauugccuggggaggagaggauucucgcuguucuguuaucuuacuagcugcuuccagguauuugcuuuugcugcccucccuccuuuccuauccuggcccuccugcagauucauuggaggggcucucuccuugcucuaugcccuaaggcuacacugucccagagcccgacugcagcaaaacacuaaaaacccugcaggcaucaggaaccagguccugagugaaggacuaaaucuggaaguggagauucaggagaggggacucauguacaugucgugugccuagugguuaggagccugggaucagcacaugccuguaaucccagcuacuugggaggcugaggcaggagaauugcuugaacccaagaggcagagguuacagugagccgagaucgcgccacugcacuccagccugggugacagagcgagauuccgucucaaaaaaagaaaaaaaaaaaaaagaaccugggaucugaugacagauugucuagcuucauaauguuguuccguauucuaccaccaauguaaccucucugugccucaguugccuugccuauaaaauggagauaacaguaccuuccuuauaagaguguuucacagaaucaaugcauaauuaucuauaaagcaguuagaacagggcuggacauauaccaaguaaucaaaaacuauuagcuauuaguuucagucugucuucuaagauuuguuuccaacucccaagcugccagggacuccuauuaguugccugcccugaugagggugccugcccucuuuaaggcaggugccauggcaccuuguaaagguuucuuuccauggaacuugggcucagcccuagccaagugugaucagcucugaagccuuggagauuucuaggaagugcugcuugugcuggcuccaaugcugugauuccuucaggagcuuaaggcccaguagucuucuccacacagagggcagaaggaacuagauuuggggaagagguagaugccugaguagaaaaaaaacauaagcuguuauucuuaugcucuuacccaacaacauucaacauggaacacuucugugaccaaaugugugguguguuucccaauuucucacacaccaagcaagcaacucugcaggagacaccagcuggauguccuccgauucaauucugaugcuaccuaccuggagauagcgucagauccugcagguugagggcucaguccccaagccugucucccacuuccagugccaaucacaagccccagguuauuuugccucugcuucugacugacuggcuauaaaucgggguucccaugaacccuuccgcagguuugaucaguuugcuagagcagcucacagaacucagggaagcacuuacuuaauuuuaccaguuagaaaggagauuuuaaaggauacaaaugaauggccagaugaagagauacacagggugagagcuaaaguccugagcacaggagcuucugucucuguggaguugggauaugccauccuccuggugggcagauguucaaacuccauguauggcuauccacaggcuuuucaaacccugucuuucuggguuuuuaugaaggcuuuauuauguaggcuugauugauuaaaucauuggccaucagugauuaacuuaacuuucagcccuucuccccuccuaggaggcuggggguguggcugaacaucacaauccucuaauucugccuuggucuuuuuggugaucaacucccauccugaggcuaccuaccugcugccagccauaagucaacucauuagcauacaaaaaagcaucacuuugaagauuguaaagauuuuaggaauaguauagccaagaacagcaggaaaugccagaaaagggucagagagggagucuugucuugcaagggcugaggaaggcccuucuugcccucaacaagagcaugauccccacugacacccaccuaugcaguuugccaaagagguuaccucagaagguucaucagcccauggccuaaaggauuaagagaguuucaaaucgaugaaaacuccaguguagagaaaagaggaaaaauagcugugagcuccaggccaacuuuuggagaagcaaaaaauuaaaaauagcugagcuuuaaaucucuuuuuuuuuuauuuggugugguggggggugguuggagcuugaggagggcuggagcugagcaggaugcaagaaacauuuguucugcuugcuccaggaagaagugagugugugugaauucaauuuuuuggaucacugcccagaguggucacacaccaccacagaucaaggauccccuugccaccagaauucucuuugcacugagcaccucaccccuacucucugccugcagcuguugcaacuucuggucuuccugcuaguggcaaaucuguacgggucugcagcaaccucaauucucgacuccucagaagaaagaauucgauggagggucauaaggcaaagggaaagacugaggcaaguuuuagaggaggagugaaaguuucugaagaaguuuuaguguaggaacaaaaggauguaacguauacuuguaagaagaccaagcaggcgacuugagagguucaaaugcaugguuugaccuucgacuugggguuuuauauguuggcacgcuucuggggguuugcaucucuucucucuugauucuucccuuggggugggcuguccacaugugcacuggccugccagcauuugggaggggccguaugcacaguacguuuacugaaguuguaagcaugcucacaugaggcguucuuuccuuaucaguugaguguucuagaggaaggccauauaccaguuaaacucugccauuuugccucuuagugcacaugcuugaacccacuagcccagcuccugagaucuuaucaggaagcugcugaucaccaguuuuagguuuuucuaucuauugggagacauucccuggugccaacugcaaccaauuauuauuuuagagagacaguuuaacaaucaccugaccaucaccugauggucaccugacauuccuaguuuugggggagcccucuccugcccugcucaugucugacuaccuacuauaacauuuccagggccugggcaugccucuuugcaggauucaguggcaccagauuggcucacacuugaagaauacacaucugguccuugugcauucaacuggacacugguaguggagggaggcagcauaccccuggcccagcucagccacagcggucagcucagaggacuccagaggagguuggagcugagggcuugagucuggaagagggacauuacccaucccacaaagacuucuaaagagguccucaguagagaggaccucuuugaaacugccuuugcaaaaauuuuaacagugauaaaauuaugacagugaaagagaucuuaccuaaccaacuccaucuugccuuuaaccuccaaacugcccuugauuauuccugggugugggccaagcuaacuuugguagaaauuuauagauugaaugguaauagcccuucccaaaacuaaacugccuuuauaaaacuaauacaaggccacaaguuuaagauuaugaaaggggccugaauucugcuaagauacagguguagugaaaugauuaauagccauuguuccagagaucacaagauuugcaacauugccaauugcuccuguaaauaacaucacuauuguggaacuuaagauuggcuuuuuaagaugucuuuucagacuuuuacauuucugacaacugacuggaugacuccaccuggaacagcgacuccucuguggucccaagcagaaguggacucagcacauaaggaccauuuuccacagcccuaugauugucucuugaauauccauaucuguauucuuccuauucccauuuccucuuuuggcuauaagguuuacugcuaccaguuuuucaaaggggagggaguagcgggacaaaaaagcagguugauaacugccagaguucacacagaaccaaaccauccuugaaaaaccuuacccuucaaauuuucagggaggcugauuagacuaauaauaaaacuccagucuccuguuuagcuggcucugcauguauuaaacuuucucuauugcaauuccccugucuugauaaauuggcuguaucuagguagcaggcaagaagaaugccuugggugguguauuaguccauucucacacugcugugaggaaauaccugagacuggguaauuuauaaagaaaagaagcuuaauugacucacaguucugcauggcuagggaggccucaggaaacauacaaucaugguggaaggcaccacuucacagggaugcagaagagagaauaagugcaaacagaggaaaugccagaugauucuaaaaccauuagaucucaugagacucacuauuacaagaauugaaugaggcaaaccgcccccaugaucugauuaccuccaccuguuccugcccuugacacauggggauuauggagauuacaauucaaggugagauuuggauggggacacagagccaaaccauaucagguaguuauagcuucacuugggacuuugacauuugucugggauaggaugaggauggagcauggacuaguuccugagggugagauuagggaaaaugcugccaagaagacacuggccaggagggagccggaugcuaguaacugagacaagaagccugccaacucaagccagaccuugggcuauuggaaugugggaaggaauuaaagaacgaagauaacagcaauaucuauuggauuugauaaggauuaaugcaagugaagcacuuaguacagagccuagcacacaguaaguacuuaacuaauggcaucaagcugcaaacucuaucaucucugucuuuuagaggccauaaugcauguuagcauaguggagguuuuguaaagucucccaaguagcugagacuacaggcguaugccaccacgccuggcuaguuuuugcauauuuaguagagacgggguuucuucagguuggucaggcuggucuugaacucccgaccucaggugaucugcccacuuuggccuuccaaaguacugggauuacaggcaugagccacugugcccggccaaaaaaaaaucauuauuuuuuuuuuuccuugagacggagucucgcucuguaaccaaggcuggagugcaguggugugaucucggcucacugcaagcuccgccuccuggguucacgcuauucuccugccuuagccuccagaguagcugggacuacaggcgccugccaccaugcccggcuaauuuuuuuuguauuuuuuaguagagacgggguuucaccguguuaaccagaauggucuugaucuccugaccuugugauccgccccccucagccucccaaagugcugggauuacaggcguugagccaccgcgcccugccgaaaaaaaauuuuuuuuaagagucagugucucacucuauugcccaggugacagugcaguggcaugcuccuagcucauggcaguuuuaaacuccugggaucaagcaguccugcuucagacucuucaaguagcuaggacuagaagugcguaccaccaugccuggcuacagagacacuaaaacaaacaaacaaacaaacaaacaaaacaaaacaaaaacaaaaaacuuugguuaacccaggcuuccccaaauauauuugccugcagauuuuuuuuuuuuuuuuuuuuuuuuuuuuuuuuuuuuuuuuaacauuagaccuuucaccauccaguggagaugacaaucucuggucaugcuuugggaaacuccacucuccuuccagugaggggcucuaguaacauuugucacugccuuaaaaauguuucaauuugaugucaauuaauacuuuuuuuuuuuuuuuuuugagacaaggucugucucuguugcccaggcuggagugcaguggcaugaucucagcucacugcaaccuacaccuccugggcgcaagccauccucccccuuagccucccgaguagcugggacuacagguacgcaccaucauaccuggcaaauuuuuguauuuuuuguagagacaggguuuugccauguugcccaggcuggucuugaacuugugagcucaagcaauccacccaccuuggccucccaaagugcugggauuacaggcaugaaccacugggccuggcaauacuuucuuuccuauucauuagcuccuauuuggagaagaaguugagggagguucucuuuaaaaauagagacuguaucaucagggcugcuggggaaagggaaagagacauuguaucuuuguuggaauuugggcuuucuaagaggaggaguagaaacuaugcuggugguuauggugguugugggaugaacaacaggauggauguccagauggaccaagucagcccucuauuguaauuccuggaugaaagcuugaaggaccuaaucucaagaacaccaaugauccuacuguccuccuauauauaugaacagagaugggaggauguucucugguuauuuaauaaaggccagccacaaacaaggcaccauacuagguuucaugcgcguccaugugaaaucaccaaacaggcuuugugugagcaauaaagcuuuuuaaucaccugggugcaggcaggcugaauccgaaaagagucagauaagggagauagggguggggcuguuuuauaggauuuugguagguaguggaaaauuacagucaaaggggguuguucucuggcuggcuggggugggggucacaaggugcucagugggggagcuuuugagucaggaugagccaggagaaggaauuucacaagguaaugucaccaguuaaggcaggaacuggccauuuucacuucuuuugugauucuuuacuugcuucaggccaucuggauguauauaugcaggcuugggcucagagaucugacauuccugucuucuuauauugauaagaaaaauaaaauaaaauaguguugaaguguuggggcagcaauaacuuuuggggggugguauggagauauaaugggcgauguuucucagggcugcuucaagcgggauuaggggaggcgugggaaccuagagugggagagauuaagcugaaggaagauuuugugauaaggggugauauugugggguuguuagaagaaacacuuguuguauagaaugauuggugauggccugggugcgguuuuguaugaauugaaaaacuaaacggaagacacaagguccgaauaagaggagaaaaacagguauuaaaggacuaacaauugggaggacccaggacauccaauuagagagugcccaaggagguucagcauagcccugccaguaaagauuauuuauuuacuuuaagagggaguuaagaguggugggcgguuuggggauagcaccaggagauaucagcugugauggcuuggagaaacaguguaaaccggcaguguaaacaagagcagggcauguaugaguaguugagaacggugaauaggauuaugacuagacagaagauaguagggaugacaaguuuuuggggcacagcccaaguugggcuggugucuggaaugagacgggggccuaauaaaaaggagugucuauacaggagcucaaaugggcuguaaccuguagcauuccgaggacaggcccgaauuuugagaagggaaagugguaaaaguauugucuagucauuuuuuaguugguggcugagcuuggugaggugcguuuuuaaaagaccauuaguccauucuaccuuuucugaagauugaggaugguaagagguaugaggguuucacugaauaccaagagccugagaaacugcuugggugauuuaacuaguaaaggccgguccguuauuggacuguauagaggugggaaggccaaaccaaggaauuaugucuuacagaaaggaagaaaugaccgcaguagccuuuucagacccugugggaaaggccucuacccacccagaccaagagguauuuuaguuuccugacucgaggcaugugaguaaagucaauuugccaguccugggcaggggcaaauccccgagcuugauguguagggaagggagggggccugaacaaucccugaggaguaguagaauagcagauggaacacugagaagugauuuccuugaggauagauuuccacgguggaaaggaaaugagagguucuaagaggcgggcuaguggcuuguaaccuacauggaagaggcuaugaaaugacgacagaauagaaucggccugugaggcuggaaggagauauuuucuuuuuuuuucuuuuuguuuuuuuuuuuuuaaauaagagagauuuuauuuuauuuauuuauuuuuuugagacagagucuugcuccuguaacccaugcuggagugcaguggcaugaucuuggcucacugcaaccucagccuacugaguucaagggauucuccugucucagccuccugaguagcugggauuacaggcacccaccaggaaggagauauuuuccuugguucaagaaccauuugccuugugugggaagagauugauagguggaaguuucaguaggggaguagguaggagugaccgaugagaaggagaaaaacuggccuugagggacgaaguuguacucuagcugcuuuuuuagcuaccuuaucagcauaagcguugcccugagcgaugggaucugacgccuuuugacggcccuugcagugaaugacuccagcuuccuuuggaaguaaagcagccuugagaagaguuuuuauuaaagaggaauuaaugauggaggacccuugcguagugaggaaaccucuuucugcccuuauaacagcaugguggugcagaauauagaaggcauauuuagagucaguauaaauauugaugcguaguccuuuugcaagagugagggcucuaguuaaggcaaugaguucggcuugcugagagguaguggaggggggcagaaaguaugugcaucuggugugaggaagaaaauagauuuuggaaguuaugagaacuguagagagugaguugagcacaguuugugauuuugagggccucuaaaaguauuaaaacagaggcagcugccgcaugcagacaugagggcuaggcuaaaacaguaagcucaaguuguuuggauaaaaaggccacagggagcggucccaguccuuguguaagaauuucgaccacacagcccugcacuucggcuguguguaaugaaaaaggguugggaugagucagggagagcuaguguggaagcauucucuaaugcugucuucaaggaacggaaagaggagugggaaaaggauuuaggaucuauggcaucagcuagguuuucuuuugugaguuuacauaaugguuuuguuaggauggcaaaaccagguauccaaagguaaaaguauccaaccaugcccaggaaggaaaggaguuguuguuuuguagaagggguugggguuugagagaucaguuggacaggaucggcagggagagcaccuguguuuuuaugaagaauuaugccgagauagguaacagauuaagaaauucgggcuugacugaaguaaugggggcugucugugaagccuuguggcaguacagcccagguaauuugccgagccugauggugucagggucaguccaagugaaagcgaagacaggcugggaugaagggugcaaaggaauaguaaagaaagcauguuugccacacagaacagaauaauggguuguggagggagguauugaggauaggagaguauauggguuuggcaccaugggguggauaggcaagauaauuugguugauaaggugcagauccugaacuaaccuguaagacuugucugguuuuuggauagguaaaauggggggauuguaaggagaguuuauaggcuuuaaaaggccacacuguaacaggcaagugauaacaggcuuuacuccuuuuaaaggcugcugugggaugggauauuggcguugaguuggguaagggugauuagguuuuaauggaaugauaaggggugcaugaucggucaccauggauggaguagagguguccuauacuuguggauuaagguggugagauacaaggggaggaugugaaggaguguuugaacuggggaaaaggguggcaaugagguguggcuguagccuaggaauagucagggaagcagauaauuuaguuaaaaugucucagccuaauaagggaacugggcagguggggauaacuaaaaaggagugcauaaaagaauauuguccaaguuggcaccagaguuggggaguuuuaagagguuuagaagccuggccaucaauaaccauaacagucauggggcaagggaaauaggcccuugaaaagaagguaauguggaguggguagccuccguauugauuaagaaggggacggacuuacccuccacuguaagaguuacccaaagcguaugugaugguccaggaagcuucugaggugauugggcagcaucaaucuucagccgcuaagcugagaugaucugggaaggagucagucagagagcguugggccagaguuccaguggcucugggaguggcugccgggugaguuggagaguccaauuuccaguggguaccugcacagauggggcacagcuuaggaggaauccugggcugugggcauuccuuggcccaguggccagauuuccagcacuugaagcaaguuccugguggaggugguccuggaggaaugccuggccacugcgguuuauguguuuggaaguuccugugugcuggagauguggcugggguuucucccacacuggaggcaaggaauugcaacucagaaauauguugcuacuuggcugccucuacucuauuauuguacaccuugaaggugagguuaauuaaguccuguugugggguuugagggcuggaauuuaauuuuuggaguuuuauuuaauguugggagcggauuggguaauaacauguauauugagaauaagacggcccuugaccuuuuagggucuagggcuguaaagcgucucaggguugcugccagaugagccaugaacugggcuggguuuuuauauuugaugaaaaagagccuaaacgcuaacugauuuuggagagguuggauaaagaaaaaggagcauuaaccuugacuaugccuguaguuccagcuaccauuuuaagaggaaauugcugggcuggugggggagggcacauaacgaaacuguaagcuggacugggugugaggaggggaggugaucaaaagauuauagagugggggagcagagcugaggaagaauugggaccuggcuuggccuggugaggagcagccuggggaggagggcagaggucagauggguccauaaaaaaggaagauuggaaagacucagcaacacuugggguugggacugaggggacaggcaggagggaaagaaggaagauuugggaggagcugcauugggaacagagacuagggacggaccgauguguaaaagaaugccuguaugucaggcaccucagaccguuugcccauuuuaugacaagaauuaucuagaucuuguaggauggaaaaaucgaaagugccguuuucuugcuauuuggaaccacugucgaguuuguacugggguuaagcagcauugcagaagaaaauaaggcauuuagguuuuaggucaggugugaguugaagagguuuuaaguucuugagaacacaggcuaagggagaagaaggaggaauggaggguggaagccugccuauagugaaggaggcaaguccagagaaaagagaagguagagacauggagagaaggggugggggaugcuugccccccaggaaaguggagaagggguggggggugcuugccccccaggaaaguagagagaaaagagaggguagagacacagagagaaaggguggggggugcuugacccccaaaaaguggugcuugccacuaagggugaaggaucaaggcaggcguccccauggugaucagacaccucugaaaugugggugaauaaucaagcaggcguccccacaguaauuaaacaccaagggaagacuuucuuuccgaguccgugacuggagccggcguuuuggguucacggauaaaacgcaucuccucugucucuaccagaaaaggaaagaaacugaaaauaagagaagggagaaauugaaguguggcaccaagauugaaaggagaaagagguugagggauagugagagagguuggagaagagaguaaagagaggcugcuuaccggauauaaaauuggugagauguuccuugggcugguuggccugaggaccagagguuguagguggaucuuucucauggaguaaagagcaggaggacaggggauugaucuuccaagggaggucccccgauucgagucauggcaccaaauuucagaugcgucuguaugaagagaccaccaaacaggcuuugugugagcaauaaagcuuucuaaucaccuggcugccggcgggcuguguccgaaaagagagucagagaagggagacagggguggggcuguuuuacaggauuuggguagguaguggaaaauuacagucaaaggggguuguucucuggcuggcuggggugggggucacaaggugcucagugggggagcuuuugagccaggaugagccaggagaaggaauuucacaagguaaugucaccaguuaagggaggaaccagccauuuucacuucuuuugugauucuucacuugcuucaggccaucuggacguauacgugcaggcuugggcucagaggccuaacacuaggcuagggcuuuguggggagaggaugucuugugcuuauagcuccuacaugugggcucuguccagcacacaucucuaccccuagcagccacagugcccuugagggaagguucugaguacaaucucggacagcccauagcagccacugacucagcugauucucaggaaaaaggcacugaaucugacacaguuuggaaccuggcagccccuucucaaaacuccagacccuccuccuuggucccaucucauuagcuuccucgguuuccugccuggcccagggaaggagucacucucaugacacugugaaccaaaaguaucugagagagaucucaauaaauuuagaaaguuuauuuugccaaguuuaaguucgugccugugacacagccuuaggaguucugacaacauguuuucaaggugguuggggcacagcuugauuuuauacuacauuuuagggagacaugagauaucaaucaauauacguaagauguacauugguucaguccagaaaggccgggcuacucgaagucaaagaagggggcuucuaggucauagguagauaaaagaaaaaugguugcauucuuuugagucucugauuagucuuucacugaauacacaauuuacaugugagagguggauagaggaguaaucacuuaugccuuagucuggcuuugugaaucugcauuuuuacauaaacaauaaggcagaggacgugaucagauaugcauuugucucaggugagcggagcuauaacuuugaguucugucuguuuucugguaccuaugaagauaagcuaucaguuuacauugccagggugaaauuaaacagagcucuuuuaggguaaagaucuugaaucccacaagaaauuuccuugugacaaauuaugagggagguauguagcuuuuuaucuuuguagcuaucuuacuuaggaauaaaaugggaggcagguuugcuugacauaauucccagcuugacucuuccccgggcuuagugacuuugggguccugagauuuauuuuccuuucacaacaccuuagagcagcuuuagcucuacuuuuacugauacaagcuaccaacugcucagcaagccacccaaaaugaaugcauaauucaaaaaagggaaaaggcacacucccuuguuccccuaagacacauuucagauagcugucccuaagccccugcugcauaaaaugccuaaaacuuuguugcccuccuccuucccuacuuuguuccucuccuccuucccuuucucucaccuccccagcccuggagaccuucuugucuggucuuuauccuagagcugacaugccuaggucaaugaaugcuuacauuuuuuuuuuuuuuuuuuuugagacggagucuugcucugucgcccaggcuggagugcaguggugcgaucccagcucacugcaaagucugccucccagguucaagcaauucucugccucagccuccuaaguagcugggauuacaggcacccgccaccacgccuggcuaauuuuuguauuuuuaguagagaugggguuucaccauguuggccaggauggucucaaacuccugaccucgugauccacccgccucagccucccaaagugcugggauuacaggagugagccacugcccccgacccgaaugcuuacaguuuucaucuaaggucucuuaugccugugcuucaugcccacauccgccagcauaucuacccucugcccccaggaguauuucuuuuagcaucucaacacuuggucccacaugagaaggaaacaagagaaggcaggagacagucucaguaggggaggcugagguaagcuucccagaguagaagccauauguuauaccccuucugaaccccuuccugcuccucuuguguccagcacauggugggcaggaggcugauggcaguaagaauccacuccaucuuugcuggaugacugauggugauuuuccacugucagcacuaaacagucagaagcucugcagaggcagcuugggccccuuucuucacgcucucuugaaacuccugugcugagcuagcagcagccucaccauagccugccaaguucucagcucuguuagggccagccuggaagggaccugaagaaaaagauucugccuguuuuuguucugugcagauauggucggggugauucuaguaaccaggcacagcuccagacacacacacacacacacacacacacacacacacacacacacacacagaguuaaaugagcaacuauagugugccagguaaaugagagcaaaguggccagggauaaucauggaagggaugauaugccaauaugucaacuaauaguaagaugcagacuguuggaaaaugaaauuuucuuuagagaaauagccaggaauguaauagaaucccccuuuaagcacucuuuuaagggcaguguggcacacugcaaaaagcaaguccuaguucuuguaugguuucucagcugacuagcugaucagucuugggaauguuaaauucugagccucacuuuuauuaucuguaaaaugggggugaccaucauuucuuucuugugggauaaaagugagauaauaaauugcaguaagggagagugcacacuaugaggaaucggggaaccucaguaagacaguguuaggaaugacuuauaggauuuggauuuaagugauuuuggggagggucuaaggaaguggggcuuuacucuugauuggaugcugucaggaagcaggguaguucuauaauuggguauuucaauaagugcuaucuauaaggacggaugauuagagcaaagauaaagauguaauuaaagaagaagcagccauucauauuccccagaauagagggaaguuugaucacguuuaugguuuaaacacuguuuauguuuuaucuguguucagaucugauuacacagugguguuguuaugucuugauccaucauggucacggaguggccuugucugauguugauauucugugaaauuguuuagcaguagaacaguaagucccaacugauagggccaggccagguccuagcugacagggggcugcuuguuucuuucuuagugccucccuuauagccaagggccgacaaagucaagcugcagauaauuaaucaaugauauacagguuuucaccauugccaagauuuugcugaucaggagguuguuuagagaauguaaucugggccugcauggugacucacgccuguaaucccagcauuuuggaaggccgaggcgggcagauugcuugagcucaggaguuugagaccagccugggcaacaugacgaaaacucaucucuacaaaaauacaaaaaauuagccaagcgugguggcuugugccuguagucucagccacuugggaggcuggggugggaggaucacaugggauccguaggcagagguugcagugagcugagaucacgccacugcacuccagccuaggugacagagugagacccugucuuggggaaaaaaaaaaaagagguuguaauuuguaguaggacuagaauaagucuguucugcucauuauguugcaggaugagccuuuucagauucugagcccuuucagaauucucagaaaucuugaggaagacacuggacuucccugguaagggguaacauggaacuugaaccaauuauauuugaacuggaauggacaggaugacacucugcugacauuuggcuuacuugugcacuuagggcagggcaagcacagcauaggugcucaauguuaguuuugucugaauuuucauuuuguuaacgccuguaauauuccuuccagaggaggcuguaagcucucucagaacaaggguugcauccggaaaccaucucauuucucuguuuuccccucgaugucuggcaaagugcuagauacaggauaagaagagaaaagaaaagacaaaggucugcaacuaaguaauuuuuuuuuuuuuugagagagggucucacuuuuuugcccaggcuggagugcaguggcacaaugagggcucacugcaaccuugaccucucgggcucaagugauccucccacaucagcuucugaguagcugggacuacaggcaugcaccaugacgcccagcuaaucuuuaaauuuuuuguagagacgggggucucacuauguugcccagguuggucuugaacuccuggccucaagugauccuccucccuuaggcuucccaaaguguugggauuacaggugugagccacugugccugguggccucuaaguauuaacagggaauugccauuuacugugcuaugucccaggcugaggggggauaugaacccaauuuggcuaccuacaaagccuaaacuccuaaccauuauggauuauguauccugcuucaggacccaucucaucuugccuugccccagaugauccuccccagaacaaagcaugacuggggugcccagggcaggcucacaagaugaagagauugagggcugagaugcagagaagaagguguguccauagggaacaugauuuccugugugagauuucccuagccauucucguggcucacaccccaaaagccagcuugucuugccacagcagacugcccuugccuguagggcugccggauucacuaauaaaaauacaaggcauucaguuaaauuagacuuucagacaaacaaugagcaauuucucaguauaaguaugacccauccaguauuucggauauacuuaaaugauuauucauuguuuaucugaaagucaaauuuaauugaguugagcaucauguauuuuaucugacaacccuacuugccugggcgugauauuucaaagagcagaggaauggggggcuuuggggacuucccauuuagugauuucagcaaggggaaccuaacaccugcuuuuguuguuggcagcccuugaggcaacugcuucaagcacaaugcuuaaggcaguguuccagugcugguguaggcugaccaacuuguuuugguuuucccaggccguacccauuuuuagcacugaaagucccacaucuugggaucucuucguuccuggcaaaccgggaugauuggugauuggucacccuagugauagacauacccagaggugcugguggagauguuagaagacaacaaauacacaaagaaacugcuaggugugucucaaagagucucaacauuucuucaaagcacauauccuuggcuccauuuuaaagauaggcagguucaggggaaguauaggaauccuggaucugaaagguguugguucuagagaucacuaaaguucagccucuauuuuuuaaaugcuuaucaaacauuugcagagauacucugucaccccaucuggugauuauuauuauuauuguuauuauacuugagcauaggcacuaugguaagaauuuuauguucaguaucuuguguaaucuuuuuuuuuuuuuuuuuuugagaucugucggagcgcaguggcaccaucucgccucacuguaaccucugccuuccagguucaagcacuucuugugccucaaccucccgagcagcuggaauuacaggcaugcaccaccaugccuggcuaauuuuuauaguuuuaguagagacaggguuucaccauguugacuaguuacugacuaauuuggaaccccacugauccuacaaacugccggaaguuugccucugcccuggguuucaaauagcggccuccuacuuaaccugagaaguguagaagguugaaaacuugggcuacagcagcccgaagccuguccauccucccccagcccccggcuguuguugcucagggcaaaggcucucuauucacacauuuuuucacagcagaacaaccucccaagcaacuuccaagcaauaagagucuggagacaggcauucucuagagauggcucuggucuuugcuugcuaggugccauugggaaaauugucucaguaucccaucagucaaauugaacaaauaacauugguuccccagaaauaauacuaguuuuauuucuacuuugcucagaaaucacaucaaacaagcauccucccugcaggggcaacccugcaaaagcuggccaaguuuuuauguugguggagguggguucuguggacagcuuguuucuucacauugcuaguagcuauguggugcuccucaggcauucuuuagcugagauuuuucaugugauuauuuuggcuuccaggcuacucuuuacuccaucccaagccacgggcaucucccccucacaaauacaccccauggccugccccuauccauccucccauuguuccuugaaaccuucaggaaaggcagaagaucacccuccacucucuaccccugucugccagcucaaaguaugugacaucucuggcccucagcccucgguucucuuggccagaaaggcauagucuagccaaucggcaugaaguuggguguggaaaguucuagccacaguacauaggacauaauauacugccugccugccagccagccagucuucuaugccagggcuaggaaagcugccuuccaaaauuuggucugggaagacauuauccugggaaugagaagcaaagccucagcucuagaagcccaaauaauagcagaugacccaggcuuucacugguacgcgcuucucucuuccccuuuauguucuucucugugcucagggagaaguuggccacuagauugggcacuugaucccuuaucuaguuuuuccugggagaaauucacuggacuucucugaguuuuagaguucagucuacacaaugaagcaaggagaacccacuugaucuguggccuucaauaaucugauacuaugggaucauagagcagagaguggagguaauauucaaguguuuucgaguuauuugcaagaaagcugcacagucaaaccaagccaugaucaagggggcccagauucucugagguaccaucagaauugcaugaagcaaacuguuuacgaguuuuauacaauccugcauuguucccacaggcacccaguacaggcagcaggcugcaccaagaaggcuggcagugccucuugaggaaucccuuggcagugcaggagccuagcuggacucaagaauauuuugccaagggcacccagcagaaccaauggaagcagaaucacagaaauagguggggguauguagauaaaaaugggcucuggaggaccuggaagauacccuaugaggucuguagggagcccucaggaaaggucugcugacgagguacugaggcagagugucgggauguacagagcaaugagaacacacuagauucuagggaguugggaaccuuaaggcacugggaugagugagacacggucaccuggcugggucccuuuucuggcccugggcauaagaacaagcauaagaacaaggcgaagacagggaauguggagagagaaaaaggaaacagagacagacacauagagagaaacagagacagagacagguaacagagacaaagagauugagacuuggggagaggauagaaugaauauuaaggcaauggagauggaagaaaggagaagagaaauguguguuaagggaaugugguugauaaauugguaucuguggguuuauugggaacacauauuuucuuuccaguagaguugcuguccccagagcugcugcugagaacucaggggaagcuuugugagagggcucagucugagugauguccccuguguggagagcugucucaucuauucgagcugugaaggaucauuugccucauccucuaaaucugaacucccaaaguuugggcucacuccugccaucugaugagcugaggagacacauuuggcgauuucuugcucuugguccucccccuucuccagggccauuccgacagugaccauccagaaguuuauugcuggcucaauccuacaguugagcuuccaaagcaggcauagucuguggcuggcgagcagggcuggggagggcgaggggcucuaggacccuuuuccaucagucacauggccuuagucucgucugcucuggaaagcuacuauuauaccguuuugcaaggggcagcauuuccagagauccuuuuuucuuggggcugauacaagagcaaaggaucuagaguucuaguacucuaagcaagccucaaacggugcaggauuuggccccagugggcccacaggggcaucugccaaagacucguccauuuccuaacagcagagcccaagccaguaacauguccaaagucacagcccaaagagaaaacuguaagacacaaucuugccuuucucccaccccaggaagguacuagucucugcucaguaucucccuccucuucucuccucucccaaggcaaaaucacaggaaaaguuccaggagaccauaccuuccuucuccggagucuuccaacaggugccccucuuauuauaugccagccaguuguuuuaaaggccauccaugggaggacaccggccucuaggucaagggagcugugaagggagacaggacugacaaggagcccagacagacacuguuuaagauucaccuguucuagaaaaccuucccaggcugaucccaucuagcagugggcauuuaaauaccuucacagucuuuagaaauagcuuauugcuaaggcagguuuuauauaguauuucccuguuuuugcugcuuagccauuuuugucuuaccgcuucuuucucuguggcaaggacuauauuucguuucuucucuccacccucacugccaccugcugcuucacucuaacccacucccugccucuugucugccuggcuuaagcucucugaugaagauauuacacucucaggauagaauacugacuaccugauucccagaucguguucuugacuugucucgaagucgauuauccuucuuggaaaucacccacaucuucaacgcuggccuuuucuuuaaccuagucugugaacuugcauaggucuugcccacuucugggucuuuauuauuguagcuauaaaauuauuacaauucuagccucccccagccuaaucacaaucuguucaucgaauugacagccugcauuuugucuucaugcaguugaaacugagaaggauuuggaggaaauuaucuuaaaagacaauuuuuucuucucuauuguguucguagagcugggggugggggugggggaggaacgcuuauuuuccaaggaaucgggaggggaaagguggagagggccaagggcagcuaggagugauguggggagcuggagcagauucggaaggacuuugggagcuaauaucuagguuuuugacucugagccccuguuggggcucucacuucauggcuucucacgcuugugcugcauaucccacaccaauuagacccaaggaucaguuggaaguuuccaggacaucuucauuuuauuuccacccucaauccacauuuccagaugucucugcagcaaagcgaaauuccaggcaagccuuagggaaaaaaggaaaaacaaagaaaaugaaacaauuggcagugaaaggcagaaagagaagauggagcccuuagagaagggaguaucccugaguagguggggaaaaggggaggagaagggaggaggagaggaggaggaaagcaggccugucccuuuaaggggguuggcugucaaucagaaagcccuuuucauugcaggagaagaggacaaagauacucagagagaaaaaguaaaagaccgaagaaggaggcuggagagaccaggauccuuccagcugaacaaagucagccacaaagcagacuagccagccggcuacaauuggagucagagucccaaagacauggguaaguuucaaaaacuuuagcauugaagauucaagaggacacaggaauucacaagagaauuuccaacuuugggguucggggguuccaugguuuaaaugagucguguuuuggcacuuguuuucuuuuuaaauuccuuaacauucaguuagauuaacuccuucuccgcuguacuaagcaugaugcuuuauuaccaaagaauuccagcagcacguggagagucccacagaucucuggagagagugcccagcuggauggauguggucauguguccuccuacccccucacuucccucuaucuucucuuuucccuugguuccaaggcccuggcaacgguugggucagcuugcccuccugguucugcuggaggccacugagcacugucuagcccucagauguacaaaauaacugcuugcuugaugcaaacuuugaaccauguuuggcauuaauaggaagcuggggaucgggcaagcuggacucaggcuuggcuauggcugaggaggccauucucagguucaggaaaugaaaguaaaguccucaauggcuugaccaugggaaacagauauggguaggaguguguguguguaugugcauaugugcaugugugugcacauauaggguugaucauuucuagcaaauaucacagacacagcuuuccugaaggcucuuugcugugacaaggaggaugcugggacauuagggcucuugcuaaguuggcugaguauugagggcuuuucuagguuccgugaacaaagacagaagcuaugaaguucuggugguaguuucuacucagaguaaugugugcagagcacaagggucuuugucccuauuggacuccacagaguccuguagacauugcuaacauuuggcaaaacaaagauagcagcuuaaacacauccuaaaugaaaugagacucaguugccccauguauucccuaucaaauguagcauccaguagacaacauccacagagaucaauuugcaauuauacugagcugguucagccuuuagguuguuucaucaugaaacacagagagaacacuuugaagcauguguucagguaaaacaggagggagagcacuggacagggagucggaaaaaucagauucaaaucccagaucugcuacuuaugaacuaugugaccuuggacaggucacugaaucaccacuuccucaucuggaaaauggggacagcaauaacuacuuugucuacuuucaggguugugagaaucaaguaacaauaaugucaaaguccuuugaaaaugggcaagaucuauaacaacuguaaaucaugauaauaccuacuauuagacaauaauguguauacaggcgaacucuuccucuuuccagggugguuggguuuucuuugcgugcuugggucagaaucauuugaccaauuaugugugaccagaugagaggugaauguuggaggaacucaauuccugcccuggguaacaucaggaauccuaucuaaugucagccgagcugacuggauagguugugcauuaaaaacagagagggaguaaagaaggauguugaauauuacuuccucaggggaugaaaucccugaggaaaggcaggaacaaauaaagugaccacagggacaauugccuguuauggaggcugggugguuuccuccagaggaagagugccacagauaagggcacgauugaggaugcacauugggucccagguccuaaggguggacgauacuugggccagguacauaugauggagcagccacugaguuuucauuuauucaauaacagaguaucuaaaguacuuugaauuauagaucaucucuaacaagguacuggacugccacuacuucugauguggagugcacugcuguucaacaauugcaguaaacacauuguaucauggaauccgggauuggaaggaacuuuagaaguugucugagccaaccuucaaugcgggauucauuuuuacaacaaccaauuaaauguucguacagccucugcuuaaucaccuccaggaacagggaacuuacuacuucaaccauauagaaucccuuaggauuggaagcaaggaggaacacugauucaguagugucugcacaaaagauuuauggggaaaaugauagcucauuaauuuuugccuugauuuggaaggggaauguuccaagugagucuuugggauaaugauggaaccagaaaggagcaaaagagcaguagcugauuauucucugcucugaaacacaaugccauuauugaacagcaaaacauugucugcaagccuguugucgucugagaacaguggcuguuacccugguaaccagacugugaugccuccauccaaaaguggcuguuugccaagcaguguaguuuuggcuggcuugcaguaaguggguguagcccaggcaaaaaguguggcggcagagcggggguccaguuuuauaaaaugcccgaagacuaacugagucccaucaaaauggcaagaaugccccaagaauaccaggagccaaaaauaaaccagaucccagccagcauguucaccuagucuuccuggagacacugacuaaaauaaucaagugcagccuucucuaccucacuucucccuuuggccgugcagagccagaggaguucuuggaaagccaggcaguuugaaaggucuacccugcuuuagggggccuugggcuuggcucugagcuaggaaagccagaaguuuacuuaacaggcugacaacuggaacugcucucucagagcgaucugaguaauaacaaccucaacccugggaggugggugggaggggaaauauagucuccaaacccauuaagguagaacuccagccaguaacaucacuuucccccauugcuuuugucuaucguccugaagccuugaaagccauccccuggguacaggucuuugucuugaaagaaagcaacaguagaaaugccuucccugcccacagcacuucaggucuaaagaagaccaagugaggacagugacaugaucaggaagggucacagcagccaugguaggugaauggagcagcuuuuccuuccuuuccugcuuucagagccuacucagugccaaacuuacaucaaaagcucagcaaguacugauugauuaaucccucuugccuacggcaaaauggcccugagggcuaucucucagcucugcacuggccucugagcugucugccaggcagggcucuagaaaagagucccaaggaagagaauaagguuccccaaaucagcuucacacugcaacaaggagagaggaggaaauggugggagacugaccugaggaacaagguauggcuacuauugucucuaguaccaguuacuucccuuucaucuucccauucgugggcaagguggagacaaugugccaaggauaaguuuuaacaaucaaaguccuaccucagcuucccaaugcuugcacauaaauuggaauguguacaucauucauucugucucucucugugugugugugugugugugugugugugugcgcgucugaagaggaguggggaguauaggaaacaagauaguccagaugcuguugccgugguaauacuaaaucguguccaaagaggaggcugagauuccuuuuuaguuaaccuuguccacaugauuugacuauccagcaggcuuggauucccaggccccagagacuucgggacuguuuuccagcacuugaaugugguauauaagugcugauaucaaaagggauauguaggaaagacaagauuauaggcagggcauugucugaccaggacgaggcccgaagcaaaagucuuuguuugucucuggcaccucuugauaauuguuguuuuacuccuagaacccacccacugauccccauccaucccuaguaccagucacggcugcucuagcauuucggccuugucaacuacugcaggcccugaucaaggaggccucuguucaugggguaagguuaagggguggguucugggaggaggguaagacuguagugcagauucgagaccuagggagguggggccaguuucucacucaaugagccugccuguuguuuagcucuauuguauaggguucuucuaucucucccuuugucagcuggauucaagggacaggcugggaauugugcaggguacaauuggucucuuucuaccauuccuuucgaugaaagcccuuccucuccuuccuuugaugaguucccagauucacacugaauuuccaucauggagcugguccuugaggcgggcccagggcaugggaaaggagggagggaggguugggagcucuuggugccugcuuaaagagacagcaucaggaucaacacagucccuugaugaaccuggaucuguguaagucacauugguucuguugaucucugucagaccgcugugaagagcgcuggugagaagggcuuaaaguuggaguaucaacuaucacagauugauuagacuuguuuugggaguuuguauacaaauguagccaaccaugacaugaucuuuucccuuugcuuacauuuugcccacacaacuucguuauauccauuuuaacacuugcuuauagguagcuuuagauuuugauucacagacauauguuuguucaccccaacaggauuucaaguuuucuaaagaaagggacuggccuuuuaauucccuucuguuucuccuaaugucuaugucacugcuagugugcuuaauucuuguacugaauucacauaaacagaaaugaaagaaaaacacuggagggggucauuauuuuucucuaugaccuuucaucaaagucagguggcuuaaucugacugaguugcauugagaaauguuauuacuauaugguucuuuuaugccaacucucucaucucgcagucuguacuuagacuggaaaugugagaaugucucuugagagagccaaggaacuucuccccuagaaucucuuccagccuucuugaaucaaacucacacccuuucaaccaggagggguucugaaauggagagcuuuuggcuuuaggcuauuguucacacauacccaagggacauuucuuggacugugaaaaaucaaagggagcccaauggaucuuuucucagaaugcuuugauuguccaacuacuuugaugaaaaaauaauuucuugcaggcucugaguuuuucucaguuagaaucuaaaaucugauucuugcuuggacagacugacugagauucuucacuucugcugaacuuaaaugcccccaaagcaaacauuucaucuagguugugaagagaugaacaucugaugcuuaugcugauauuacugaauuguuuauagcuuaauagugauagauuuaucuaaagucauuuauuucagacuuuacauuagaaacucauuaaagccuacuucuuucuugucccuugcuuugagcuguaguggagcagaaaaggggaugcuaaguuauucaaguucuaagaaaauagaggaaaaauggauguaaaaagaaaggcuaugaucuggugacucagaauugcuccuaaggcuuagccauuuaucacccaguaagaacacaauccaugacacucucagguuauuuggaugaugauugagggaucagauacacucaagaggauguuucccucucaucuuugcaacccuagagguggcaucaccuaacgcuuaaaguggaguucucuuuuggcuagcaagaguucaaguuccuccaucccugaccauaccugcacaagcacuuagcccuucccagaugaaaaugcugggaugagugaguaggcccaagauggucacuugcuaggguggauggcucuucuuacccucggcuaaacaaacaguccugccauuguucccugagucugacccccuccccaccccccggcugcaggccccuguggaauaccaaucaggcuccugagaucucaggaaagaacaaggcuucuuuguccgggggagcuauggagggcucuguccaagcccugacccugugcuggggagaaagggaacaguggggucacugaccuucuucuccccccauccccaggcuucagagacuuucuuuacuagaaaagucuaagaguuuggggguggggaggaguuggauaggcagagaaggaaaauggcaguacuguuuacuucuaagcuccuuuucuugacuuauaggcugaaucuaguaucuuaaccuguugagaaagaggaagaucaauuucuggaauguuuucugagaacaacaaucgauuucaguuguuguguuuuucucugugguauacauguguguaugugcacauuuguacacaugcaugcaugugcgugugcacacacacagacacacccaugggccagcucugaaaagacacucuucccaagcacguuugcaaaguucaugcugaguaaacucagccuccacucacagcagcacagcuacagauugcuucuuauagaggccaaguuuccuggcagcaaugcuuuaguucuuggaaaaggaaguucugcuccaaauguuagcugcuuacuuuguuuggcuugggcuucugaggcucaucuuuggugugacacucuuugaaggccaagaaagggcugucauuucaggggaugguggguaauaggacucacuccuuuugugucucugagaacagaggcaaaugccucuaccucgauuuucccaugacagagauaauuugaucuuuccaaaucuguucacacugaugcaauucagccauguaaaucacuagguauucaugcucucugggcuaaaaacaaacuguaacuaauguuaacagaaucaggaaaaggaguccccuuucccugguacccuauagaaaagugaguguggcuuggagaaaugcuugaauacaaaaauccaagccuaaguaauuaauacaauuuauuuuuauuguacaagcugucacaaccugcuuauucaaaaauagcagcuucccaguacauuugcugaguauuugugugugugcauguguauacuguguuuauagauauauaaaaucaguggguauauauacauauauuuauauauauacauacauaugaauuaagacauuuuuucugaagagcuuaacauucucauuucuucuacauuuuagggaucuggccgagaggccagaggaagccauucuuuuccucaucuagucagucaucuacuuggcauuugcuaagguucacuccauaugacaucuuagagcaugggacuaguacuuggaacacagcugcuuucagagccugugacuucuugugugccucuccuguuucucagcaacacuggcauagggccugggauaccaggucuggggaucucagggacucuuagcacuuuaagacacauguguucccaggcccugguguguuccucuagugccagaaagauguuucaugcuuugcugacuuuguauaaagucuguuuguagcuguuuugacagaaucucagcguauaacugaggguggggacauuagccaagcugcauuauaggaggacaaaacugccauacaaaguguccaaaaucauuaagccugcauuuuuauuauugggaguaauaucaaaccuccuauuuuccaauuuucauuucuuguccugugcuagcuccauccuguuuggacugcuccucccauauguaaacuaagaagaaucaagcauucuuugcaacaaauacacacgaugcucaaaaauguccaggagcauccaauuuccaaaguuuccuccaccuggaaugcucuucaugcuaaaauccugucugacaauaccagcaucucuggccugcacucaucccuuccuggaacuccaagugcauuuacccucuguuaccacuuacuuggcugccugaauuguuaguugaaaauauuaggucuacuuagcuaauucuuccucaggaaauuaaagacucccauauggcagagucugugucuuuucucucuucauaucccguauaacacccagcauaaugcugggcauauagugaguauuccauaaauaguugaugaaugacuaaaauaagcaagcaaacaaacagacuagaacaauaagaaagaagggacugauuucauaaucucucuggcuugcuauuugaauugcugaauuauuauuauuuauuaaauauuuuuuaaauucuggcaauaaaagguaaggauuuauuuucuuucuuucuuuuuuuuuuucuugagacagagucucgcucuuacugcccaggcuggaguacaauggcgcaaucuuggcucacggcaaccuccgccuccuccuggguuuaacagauucuccugucucagccuccugaguagcugggauuacaggcauacgcccaugcccggcuaauuuuuguauuuuuaguagagacgggguuuugccauguuggccaggcuggucuugaacuccugaccucaugugauccaccugccucagccucccaaagugcugggauuacaggcaugagccaccgugcccggccaaagauuuauuuucaagaaugaaacaaaguaaggauucugggucaaucucacaugcugaaagccaaaaccucuagccgcuccugcuuuuugacuucggagugcccacuaucuccgagccugugagcacagggccuggcagagggguuugaguggcaugagcuaccuacuggaugugccugacuguuuccccuucuucuuccccaggcuuguuagagugcugugcaagaugucugguaggggcccccuuugcuucccugguggccacuggauuguguuucuuugggguggcacuguucuguggcuguggacaugaagcccucacuggcacagaaaagcuaauugagaccuauuucuccaaaaacuaccaagacuaugaguaucucaucaauguguaaguaccugcccucccacacagacccaucuuuuuuuucccucucuccauccuggagauagagaacucuucaguaccuuaguaacuagcaggggacugggguggagccagaccggauucccgagucuucccucugugcagaucucuccugcuccacauucgaagcccauucagaaaggaggggucugccugccugccugucagccccucccacccccgcccccuuguuuucuuacacguguucugacuucugcuaggugugguucauauugcccaaguuggagccuccagcguaguagguauggagaagccaagggaggcacuaagccucuccuguuccuagaacaaguuaggcuccuguuccuucacccaccuuucuucuugucuagcucccuacuccugugaguuagcaugucugaaggguggggcagggagaguaggucccugguucuccaggucccaggguaagcaagguguggcgggaggggcauauguuucuggucacauacacccugucuucacuuauuucaacaaagauaaggugaaagcaugcaggaggaaccuggugauuccucuagaaaaucccuagccuuguuaaggugcucgcucugguguauaccucacuuaugucgggaaagaagccaggucuucaauuaauaagauucccuggucucguuugucuaccuguuaaugcaggauccaugccuuccaguaugucaucuauggaacugccucuuucuucuuccuuuauggggcccuccugcuggcugagggcuucuacaccaccggcgcagucaggcagaucuuuggcgacuacaagaccaccaucugcggcaagggccugagcgcaacgguaacagggggccagaaggggagggguuccagaggccaacaucaagcucauucuuuggagcgggugugucauuguuugggaaaauggcuaggacaucccgacaaggugaucauccucaggauuuuguggcaauaacaaggggugggggaaaauugggcgcgagucuguggccucguccccacccaaggcuggguccucucuaggggccuggcauuugagugaggaagcgauggcugcagccgaacgagaaggucaggaagaacguggugcccagcuggcuuagccucaccuuucaaagguucccuaagcaaauuucuucucaaaacagaaagcaugaguuuugugggaugcuuuguacaaucagaccauuucuaagccaucuguugguaucccuuuguucccuuccuaguagguaccacaagaguggaucuaacuggacaagagucuaaaaugcugcucaugugauugagacuugggcaccugaucugagagggaggauggauaauaaaaauuaaauaauuaacuccaaggugaaauuuacaauguucugggauccugcacaguucgaggucccagagggaauuggaguagaucugcauguugaauguuuuauugccugaggguuauccaugcuuugagugaggugcacauuuguuuucagucucuggaguuaaagauccuuuggcggcugaacauguguggguuccagcaaugucuuuuuguggccagcaguuagcuuagaaagguuuuguaucugaaauuuuaaucuccuauuggcuuuguucaauggcuagggaacaaaaauguuccuauggcaaggaacauguucuaagcucagccuaaggcacaaaauggcacgacuuucuuucaagaucuguuuugauuucuuuacaccuuaucugcccaaaaacauccucugaagccucucuaacccagggauccuccucacucuuccccuacccauuccccccacccuccguuauacuggggccaguuaucuaguagauacugccaauuacccuuggcagaggugcccugcucacuaauuucauuugaaggagagcccuggaaccugguuuuaaugucuggcacacgccacuccaggaucucccaguuuguguuucuacaucugcaggcugaugcugauuucuaaccaccccaugucaaucauuuuaguuugugggcaucaccuaugcccugaccguuguguggcuccugguguuugccugcucugcugugccuguguacauuuacuucaacaccuggaccaccugccagucuauugccuuccccagcaagaccucugccaguauaggcagucucugugcugaugccagaauguauggugaguuaggguacgggugcuuuggcucuccuacccacuauggaagcacuauauauuugguuauuuucuuaguguaaggaggguggugauuaugagaaaaauauaagaugaugaaugauugggucuuaguuuauuaauccuucccuacugaaaccagagagguuucuuccccgggaagggaacuuggaaguggugggaguuuucuuggccauucacauuggccuacucuaguugacugcuguucacaaccccaaagcagcacauuucaauaacaaacacaagguuucaccacuguucaauaccaccuucucuuuuuuguaaaccuguagaaaagaggauccugauuguugguagaauccaacuuuacagccaggauaauuagagauggaagaagggcucugggggaaagucuccauguggccccguaacuccauaaagcuuacccugcuugcuuuuugugucuuacuuagguguucucccauggaaugcuuucccuggcaagguuuguggcuccaaccuucuguccaucugcaaaacagcugaggugaguggguuauuuggguuauuuuacaagggaguagcuaauaccauacaaauuacacccauggccuucaauuuuaaggacugaaaguuucccuuugcuggauuuugaauuagccgauugccuucuacaacauguuggcuaagugugccugagccaaugagcauagaagguaaaacaccuguuuucucuagaguugcauagaaagacuuccuuuccaacccuuccccucuuaaaagagaaguuuguagcuuuagguaaagauagagccuaauggcaaaaucccccacaugaaaauuuucauuccuuuaguuaaaaaccauaucaagaaaaugggcugugcacagaggcauucauagguuuuaugaaaacauuuucaauuuggaacuucuuuaucucaaaugagagguaaaauaaguacauuugaaagggaaagcacuguauugagaacagauauuauauacaaaugaggcaggggaauaaaaguaaauccgggggagacaggcaguaaauuauuucuuugacagcaaaauguugacuuuaaauuuugggccccugggcacaacuguagggaaccaguuaauuauuuuggaguacuguacuauuucaugacuauucugugaucuggguguuaaugggccaggugcuaugguguacacugaagacugggaggcccacauuuagggaagugaaaacuuaguuagagauguggaauuagcacacaagaaagauaucaacacauucagaaagcuguauucaugauuuacaguggagcauauuacugcuguugcaagaaacaguucuuccucuuucauuuuccugcaguuccaaaugaccuuccaccuguuuauugcugcauuugugggggcugcagcuacacugguuucccuggugaguugacuuugaaugaucuuggcaaguaaauaggccugagauaguguggguacagcuauucugaaaggcaagaagguagacugcuuccauccuugaaaugcuggagggaagcuucugggaagauagcaaaggguggaggcuccguacuucuacuugcauuggcaaggcagaaagacaucacaaauuagaugggaacaagaaaagugguaugaggaaagagguaagagauucauagacacgaaugauaauauuuaguauuuauagaacauguaauguugccaaguacuuugcagucauaaauuacgguuaauucucaauacauuuugaucagaucagugacaaaacacugaaacaucacgaaacaugacuugcuauagccuggaauucuauauacuaucaauaugaauccacuuuggauacucuccaguggauuuaguuacucauauggaaauacugggaggaccuccuaacauuauuagaauuguuaugauuauaauacaaugcuaugucccaggucuugcugauagugcuacagugcccugugaauguagugugcucauugugcagauuaaaaaccuaaggcacugaagggugaagugauuuaucugaaguuauuuuauaagcagugaucagacaagaugagcucacagaacuccuggccccuacugcugagguuuccauacagagucaaguaauuucucaccuuguaaaacgaauugauucauuaaccaggggagagcucuacugcaugauguggcugugugucuacagcaagcacccuaugacucuaagucacucggacauauugauguggcaaagccaaauauuguucacuucccugaggaaaacucagugcuagaucaaacagagguguggaauaaaucuuuaugauuugauucucugggccugggccaugagacccaugaugccucagagacaucggacuuccagucaaguguauauggagaaagccaagccugggauguacugcuuuuugcagagcauggguuuuucccuuauuuaguuaugauuuuauuucuacccuuccucauucccaaagggauuugaggagggagugcuuucuuuucuacucucauucacauucucucuucuguucccuacagcucaccuucaugauugcugccacuuacaacuuugccguccuuaaacucaugggccgaggcaccaaguucugaucccccguagaaaucccccuuucucuaauagcgaggcucuaaccacacagccuacaaugcugcgucucccaucuuaacucuuugccuuugccaccaacuggcccucuucuuacuugaugaguguaacaagaaaggagagucuugcagugauuaaggucucucuuuggacucuccccucuuauguaccucuuuuagucauuuugcuucauagcugguuccugcuagaaaugggaaaugccuaagaagaugacuucccaacugcaagucacaaaggaauggaggcucuaauugaauuuucaagcaucuccugaggaucagaaaguaauuucuucucaaaggguacuuccacugauggaaacaaaguggaaggaaagaugcucagguacagagaaggaaugucuuugguccucuugccaucuauaggggccaaauauauucucuuugguguacaaaauggaauucauucuggucucucuauuaccacugaagauagaagaaaaaagaaugucagaaaaacaauaagagcguuugcccaaaucugccuauugcagcugggagaagggggucaaagcaaggaucuuucacccacagaaagagagcacugaccccgauggcgauggacuacugaagcccuaacucagccaaccuuacuuacagcauaagggagcguagaaucuguguagacgaagggggcaucuggccuuacaccucguuagggaagagaaacaggguguugucagcaucuucucacucccuucuccuugauaacagcuaccaugacaacccugugguuuccaaggagcugagaauagaaggaaacuagcuuacaugagaacagacuggccugaggagcagcaguugcugguggcuaaugguguaaccugagauggcccucugguagacacaggauagauaacucuuuggauagcaugucuuuuuuucuguuaauuaguuguguacucuggccucugucauaucuucacaauggugcucauuucauggggguauuauccauucagucaucguaggugauuugaaggucuugauuuguuuuagaaugaugcacauuucauguauuccaguuuguuuauuacuuauuugggguugcaucagaaaugucuggagaauaauucuuugauuaugacuguuuuuuaaacuaggaaaauuggacauuaagcaucacaaaugauauuaaaaauuggcuaguugaaucuauugggauuuucuacaaguauucugccuuugcagaaacagauuuggugaauuugaaucucaauuugaguaaucugaucguucuuucuagcuaauggaaaaugauuuuacuuagcaauguuaucuugguguguuaagaguuagguuuaacauaaagguuauuuucuccugauauagaucacauaacagaaugcaccagucaucagcuauucaguugguaagcuuccaggaaaaaggacaggcagaaagaguuugagaccugaauagcucccagauuucagucuuuuccuguuuuuguuaacuuuggguuaaaaaaaaaaaaagucugauugguuuuaauugaaggaaagauuuguacuacaguucuuuuguuguaaagaguuguguuguucuuuucccccaaagugguuucagcaauauuuaaggagauguaagagcuuuacaaaaagacacuugauacuuguuuucaaaccaguauacaagauaagcuuccaggcugcauagaaggaggagagggaaaauguuuuguaagaaaccaaucaagauaaaggacagugaaguaauccguaccuuguguuuuguuuugauuuaauaacauaacaaauaaccaacccuucccugaaaaccucacaugcauacauacacauauauacacacacaaagagaguuaaucaacugaaaguguuuccuucauuucugauauagaauugcaauuuuaacacacauaaaggauaaacuuuuagaaacuuaucuuacaaaguguauuuuauaaaauuaaagaaaauaaaauuaagaauguucucaaucaaacaucguguccuuugagugaauuguucuauuugacuucacaauagaaacuuaauaaucguaccuuguucaaggagaucauucauuuuucagcucauccaagucauucucauaacauuucucugaaauaaauaguauaugaauagauuacuucuacuuuuauaguugaagacacuaagaaauagaagcaaaguaauuugcccaaagaaauccaguaaguacaugucugagcuug

SEQ ID NO: 19179 - RNA, 29433 nt, Homo sapiens
cagugggcggggcgggccuggccgggccgggcggcggcgcugcgcugacgggcugagucuggcggcggcggaagcugcagaggccaccggggcgcuaacuggguggccggugggccgcuguggccucgagcagccucuucgcgcggccccgcaccccggcaagcagcagcgggccgcgacgcccagccugccagugagcugcgacgggcacaccccggagcgucggcgacugcggacagguuagagugggggcaggggcgggcgcgggagcagcccagggccagagagggagcccgagccaggccaucuccaaccauguccgacgaggccucggccaucacuuccuacgagaaguuucuaacccccgaggagcccuucccacuccugggaccuccucgcggggugggcaccugcccgagcgaggagccgggcugccuggacaucagcgacuucggcugccagcuguccuccugccaucgcaccgacccgcuccaccgcuuccacaccaacagguacgaacugcaccugagggcagggguggauuuuccacuucuggucgccccccgcuccugauccuucgucccgggcugcgcuuccagucgcccccucccccaccugcuuucgaccagcgcucauucccggccuccuucccugcccccccucccuauuuucaccccugcccuccuauuuuccuuucgaccggcguuuuacucucuuuuccucauucauauucuggcuauagcgacuccucccuucccuaccuucucccucccuugcuucccuucccuccccccaucuguacccuacgaaucccaaacccccacccuugauuuuuagauacgccccuguuugcauccaucugcaaaaguuuaaccccuuccauuuccgguacgcuguagaggaauuuggauggcucaagaucaauccauagaucuuuugaaaaguggcguugaaagguggaacauuuaaagcuagaagcuucauuuucccuauuuuuaaucugucucacaguccuguuccccccgccgccaccaccccuaccccauuuuuuuuuuuaguugagcgcuaggaaacuagucgauucucucuuuuuuuccuccuccuuuauuaacuguuugccuuagcgcuuuaggcucugccaaaauugguaagcuuaaaucuggaggauuccuucauaugacauaucccuugguuuccuuccccuuugaagagacagaguaaggcuuaggauggacugacuuacacaaauuuauucagaggguguaucuccuccuaacugauuucaguagaagguaguguucuggagacuucucucaugcaagcauuuacguguuagaucaaaucuugggggguggguugaagacguucuagauacagccucaaguuuuaacauagguggauauuugagauacauauacaaagggcugggggggugugugguuaaggcucuaggagagggguucagcuauggaaaauacuggagauaaauuaagaaaucuaguucugacuucugauccaaguuuaugaugugaguuugaucaaauucuuccauauuuuaaugucuuuagcauauuucuccccucccuucccuuaaaucagucuguagauugaaugagcuucuaccagauacaaggaauguguaaaagauguuucuuacauaaaugaaaguuauagucuauggaaacaagguguuauaguuaaauaaucagaauaucaguauaacacaucucaaaaggaaguggcaguaaauuuauuaugacuacucuaaaucgucauugcaaaaaaugaagaaacaggcccagaaagaaaagauugaguucaaggucauaaaaccuagucaagcaaauccaagacuauuccuuugaagccaaugauuaaacuuggagcagaacuaauugauccaguguuacaaauagaacuuaugguuuccuagaccaacucacagaagccuauuuaaccccugaugucacuguaaugugaauguaacauauucaugaaaucaagugugcuuaggguuauuuauguugaaaaauaauguaaaagaauaccuuuguacauauuuggcauuuaaguuuugcagccuuggagcaagucacauacccaggaaaguuaaauaauuucagaaugauccugcugugaugaugagggcaagggagugagggcagaggcuguggguaaguacugccaaaacuggguagaggugauggggagugaaguuaugagaauaauauguuucuuacaacuuguucuguuccuuccuccuccccguuuuuuccuguguuuucuuucccuuaaagacuguggugaggucaggacuguuuuucaauggggcagugaggaggggagaaggagguucuuugcaagccccaguuuuuccaagucaagcauuuuuccuaguuacugcuugcuuuuuuuuuuuuuuuuuuuaacuucccucuccuacccuacuuuucgcaaggcuuggcaugguggcagggguucuaaugcucuguauccuuuucagcagagaguaggggaagcaaaauuagcgauauucacagcacaugauguuucuguccuaggcuaccuugccuuuuaaauguauuauccuucugcaauguucugcuuucuuaccccuccucaagauggugcuugagaggaccauaggcuuccagccauuucuuuucagggagaagcacacagcuaaaucauauaucgggcaaaguuuagggaguucuuuuauuuuggaguuguaugugucacuuuuuuccuucacaucacaucauuugucaauucaggcaacaacccaaaaaucagauuucaaauaguugagugcugaaauucugccuuggguuuagugauuguaaaacaaauuuucauuggaaguaggaagcuuguuaauugguagauauuugacuuaaccuuaauuuugcuuccuucuugguaccugauaagaaaaauguggagauuuuaaaaauaaugcacuugauaaggaccuuaugauuaugacaauuuugugccuacucauuuacuggauucugggcuauauuugcaauuuucauuaacaaagacagucacagcacuaacagucccugagguugaaugguugcaauauucagauuuuuuuuuuucuuuaaagacagaguccugcucugucauccaggcuagagugcaguugcacaaucuuggcuuagggcaaccuccgccuccuggguucgagcgauucuccugccucagccuucugaguagcugggacuauaggcguguaccacuaugccuggcuaauuuuuauauuuuuaguagagacaggguuucaccauguuggccaggcugaucuugaacuccagaccucaggugguccacccacguuggccucccaaagugcugggauuacaggugugagccaccgcgcccggcccaguauucaaauuaaagucauuugugauguagguugguaugucacuggucuagguucaguagaaaauacauuacauggacacagccaguuuccuaagcauucauaccuuaagaccuacauggauuggucuagaauuuuaggaaaauagaauaaauuucaauaagccaaaaaagugaaugaauuuuuuaaaaaugugaaaugucaguguggaacauauguaguguuuaagacauuuucuuugguuuugggggcagugauuuucugauguaaauggagguuuucucuuagcacuuccaaacuauugcauaaaucuuuuacucaguuaugugauuuuagagcuccguuuucaaucaccauuaaccagaaaaaccuaaagacuauugugugccuuugguaacacccauaguuuuccuaucuagauacagaauuagaggugcagaagagcuguggguugcaggugggagaaccauguuggaggaauuugguuuggggacuugcugagacaaguugaaaaugggggguuaggauuuggagaaauauccaagcuagaaauacagauuugggaguaaucaguagaaguccgugacgugauagaaguggaacuacagguuacaaagguugagagaguggaagguuuucaauaaauuuagcagggaaagaaaggagaaggggagauguugugagaauuugaaagggaaauaaagguuucuuuuuuucuuuuuuuaacuucauuuaguuuuucuuuuccaagaauagagauguuagcuccuuagaagcaggccacaggaaagggagaaauugaaaauauaaaagaaggugggaugagagauagacaugaugaacucagaaguccaaaugggaucauuagccuuagaaaugacauagaguguuuuuuacuuccaaggcaauaaagagggcaggaaagauggguaaugaacccaacacaauugggguagcuaggaggaaaguagggaacuuaaguggguagaagaagggguuguauauucucuaacuuggaaccuugguggccuguuggacuccagaauagcagcagaagucagguuggcuauauggggauucuggcagagagucaguggugaauacaaguacugauggggcacuguacccuaagaaugaauauauagcauagacuucaaaugaccuucaucagcuuggcagaacuucauucaacagugcucauuggcuggauucuuaucuucagaaguggcagucaggcccaccugagagaaaagggggugcagaggaauguguacaugguacacaugcuuuucuuaauuuuaacguuuaaauggcuguuuaccaaaauaccauugaaaguccuuagucuguauauucuugcugaaacaccuugcagagaaauguucuuggcuuuauuuuuuuuuuuaauuaaaauuugggcagcaagccuaguuauugaguuaaacaccguguuucacuggaauucuuuucaacgucuuucaagauuuuggagaaagucucuuuugagaguaauauuauggugauagcuagagucgaaguguuagguaacuuucucuuaguggaauauaauguaagggcuuguaaauuuaaauaguuuagugcugagcacacaauggacauucauuacaaguuugaaacugacagaacagucugaaagaaucacacuuaaauuuuuauuuaaaaacuuauuauagaaaacugagggcauauaaaaaacuauagaccacucaugauccuuuuccccaaagguaacaacuaucaacauuuugauguuucuuuuaaugugucuauguacagauauaauuuuuaaacaucaggaucaguuugugaccugcauauuugcuccuauauuguuggguguuuuccuuuugaauaaucugaaaauaugauuuuuagugauuauaaaaauaccauucagauauaucauuuaauccucauauuuuaggggcauuuauuuucccuuuuggacuauuacaaauaguauuguuuggacauauuuguacacacaucuuuuuuccaaauuucuguuuggggaagggaacacaauccuagaaggggaauuacugauuccaaaugaaugaaccuuuuuaaacgucuagauguacauaguacugccaaauugcuuuuaagaaagauuaugucaacuuagacugucacuggcaauggaugaaaguacuuccuacuuuguuuuuaucuauauugccuuaaaauuaugauuuuaaaaauuugcaaauuagaagauauaaaaauuuugccaggugcauugguucacaccuguaaucccagcgcuuuggaagaccaaggugggaggauugcuugagcccaggcauuugaaaccagcccggacaacgugaugaaacccuuucucuuccaaaaaaaaaaaaaaaaaagaaaugugaaaauuagccaggcguggugguaugugccuguagucccagcugcugggaaggcugaggugagaggaugaaucaagcccaggaggucaagccugcagugagccauggucgcaccacugcacuccagccuugguugacagagcaagacccugacucaaaaaaaaaaaaggaagauauaaaaaauguuacaaucuuuacuaguaaaaaauacuguuauucuauuuuaugaaugauuuguucaauuaugagcccgguuuacuugcugcugauaauuaaaaacaaaagacaaagacuucuaagaacauucagaaccuugugaugauuacaaaucugagaaacacauugacuuugcccaaagguaagagcacaaaaugaagcaaauuccugacuccuuuggcagugaucuaaugguuagauuacuaaauauggcaucuuuuuuuuuuuuuuaaggaaugucacuauuacucauggagagaaacacauuucuacagaauuuuuacaaacuaaaaagaaauucuaauuaaaaacaauuaucuaacaguuuuuccuagcaccgaacauaguacuugguacauagaagauacugacuaaauguuuguugaaugagugaaugaauaaagggaaaaaaaucacauguaauuugaagacacaagagaaaaauaguuugcucaggacauaauguagauaaggcuuacuguguccagaauguauuuuuguuuuguuuugagauaaggccuugcuguguugcucagauuagaguacaguggcaggaucagcuugcuauaaccacagacuccugggcuccagggauccuccugcuucagccucccgagaguagcugggaauacagacaugcaccaccuugcucagcacauuuuuuaacuuuuuguagagauacugucuugcuuuguuacccagacuggucucaaaccaggguaugauuccucuucauaacuuuuauugcaagaccugggauaauuugguuaauuaaaaauuuuucuaaaaugaggauacuguucaccuagcgagcaugugaugaaaguaauauuacaagauauucuaggauucuuagaugaauuuuauuuuuuuuacuaucuauaaaaauuuauugacaucuacuuucuauuuacugaauuauaauaguguguguguguuucaguguuuuaaaauggucuaccuucaaaagaaaagguaccauaaaguuuuucagguuguccaaauuuuguauguaaaucaagaacuucuaaaagauuagccauacaaaauggaggaaguuaaaaaaaaugaagugcguaauuuaagaaacaguagauuuaaugaaggaugagacacgaccuaauaauagguaaauaacagacuuuucauaaggaagucauuacuucaggagcuuguuaguacuggaaauacuaaauaauuaucuuaaggauuaauucucuaugcuacuggcaaagcaaugaagauuaucuuauuaauaguauaaaacuaguggaaauuuacaaaggaaaacagauugauagauuucaagaccaaaaaaagauccaaccaaaaaacccugcaauaaauacuguagacaaaauguuaauauccuuaauacauaaagaacucuuacaaaauuaguaaugaaaauauuagcacauaggaaaacaccauagcgaaauagcuaaugaauauuuaaaaauuugaucuugcugguaauuaaauaaauaaaacuugauauaaaaauguuucugugcuggugcaguggcucaugccuguaauuccagugguuugggaggcuggggcggacagauggcuugagcucaggaguuugagacgagccugggcaacauggcaaaaccccaucucuacaaaaaauacaauaauuaagugggcauguugcaccuguggucccagcuacuugggaggcugacaugggagaaucgcucgagccugggaguuggaggcugacaugggagaaucgcuugagccugggaguuugaggcugcagugagcuguguuugugccacuguacuccagccucaaugagagaagugagucccugucucaaaaaagcaagaaguuucuguccuauaagauagguaaaaaaauuuuuagcaauuuuagugcuguuaagauugugaugaaaugagcacuuuuauauacugcccuggggaguauaaauugaugcugccuuucagaaagguguugacuaaauugauccuuagaaauguucauauucuuugacucaguacuuaccuuucaagcaacuguauccugagauaauauauuuugauaaauaauuauaaacaaugcucaucucaguauuauuucuaauauuaaaaaauuagaaacagcuuauguaucauuggggaauaaaguuaaauaaauuaugauacauuuagccaauggaauauuauauaggcauuaaaauguuuucaaguaauauacuuaggaaaauguuuagcauauuaauguuaagugaaaaaagcaauauacuaaaauauauauacacagaaugguugcugauucuguaaaaaauauguaugcacauaaaaauaaacuaccaaaauauuauagauuaguuauugcuggauaauggaauuauugaucauuuuauuauucauuccuuucuuuccaacaucuuugcaaugagccuguacagcauuaauaugaaaaaguuacuuaaauauaacaaauacuucuugaacaucuaccuguguagaugcuuguuagugcuuuucucugcccugcaauggccccacucuuccuuuaacaauaauaauagcugucauauauugggcacuuuuuaugugugcuacaagugcuguguaugcauucucaugugaucaucacgauaccuccauugggacacagacuuggagagaguguuauuugcuuaaaaucaauuagcuaggaagugacagagcaagaauuugaacugucugauuccagagcuuacucauaaccacuaugcuguaugcuuuguuuauggaugaagauuuuacuuuaguccuaauuuaaauacuacuuucuuuuaaaauaguguacuacaaaaauuuucagacagcuacaaagguagagagaaaaguguaauggaccccauguuccugucacccagcuucaacauuuauucauauacggcaucaugcuucaucuguaccucuauccacuccccaaccccugccuuauuuugaggcaaauccuagacauguaucauucauaaauauuuuaguauauuuccuuaaaagguaggggcucuuuuaaaaauacaaaaaaccucacauuccuuauaaauguuauaaauauguccuguuaauuauaucuuaaaauuguauggauucuguaguucucuugauuucuuucguguuguguuuuugaagguggaaccuaacuucuuguggaacaaguguugccagcucagaaggcagugaggagcuguuuucaucugugucuguuggagaucaagaugauugcuauucccuguuagaugaucaggacuucacuucuuuugauuuauuuccugaggggagugucugcagugaugucucuucuucuauuagcacuuacugggauuggucagauagcgaguuugaauggcagguaaguuuuuuuguccuuuucuugacauuguuacuaccgaaguagaaguauaaacuuuucuuuugauauuuucaucucuacuucaaaguaaauuucucuaauguuuauccaguccuggagauucucugacauguuuuaagguuaagaauuggaugggauaucuuuauuuuugcuaauguaccuuuuugaugcuauagauauccuuuuguagauuuuuauguuauuuaauacuugcguaauauuaccauuauuauauauuaucgguaccuuucugugcaugaauccaagcaaaguuacacuuccuacccuauaauaaauagcuuuuguguccuuauaggacaaauaucagucacauuauguaccuaauaucauaaacuguuauuaccauaaauacaugauuuuugguucugucaucagaaauauauaauuucucauuuuguauucuguuuguauguagacauguuuuucgccugacacuuuuuucuuguggcauauauaccauguaaaauggcuuugugguaaauuguuugaaaauccugccuuauaauaagugcaguuugucagaaaauuuagauuguguuauuacaacauucauauucugauuguaaaaacaauaaaacauuuaaagacguuuucccugccuacagcaaagauuuuauucgcuagauaaacucgaaugucugcuacauuugaaagccaucugaauacuugaaguuuuauuccaaaagagggauugaauauuauaauuucaaacagcuuucaaauaauacagaauggcaucaaauuuaaaaaagucuccaagucccacucuacuaugguuaccacuguuaggagcuuaugcagauauaaguauguuugcauacuguuaaaaacauaugggauuauacuucauccacuguuuggcccuaugcuuuuuuucagcuaacacaucucauucuuuuccauaacuggaucauaauuuacuuaauccauuuccuaauuauggcuauuucgguugguuucaguuuuuuguuguuauaaacaaugcuacacugaaaagaugagauuuuuuuuuaagaaaaaaaguaauucacaacccuuccauuuuuguuuuucauauuauuuggauuaaaacauuuuuaaacuuuuuaaaaauuugagaugaaauucaccauuuucaucauuuugaaauguauaauucaguaguuauuaauauacucacaguuguucagccaucaccgcuaauuccagggcauuucugucaaccccaaaagaaauccuauacccauuagcacauagucccaauucuccccucccccuuaucaccuggcagcuacuaaucuaauuucucuauggauuugcuuuuguggauauuucauaucaauggaugaauauauggccuuuugugucuggcuucuuucacuuggaauaauguuuucaagguucauccauguuguaccauauaacaguacuucauuccuuucuauggcuaauauuccauuguguagauguacaguaccacauuuuguucauccacucauuaccugaugaacuuuuggguuguuucuacuuuuuggcuguuauaaauaauacugcugugaacauucagguucaaguuucuauguggauuuauauuuuuaauucucuugaauauaccccaaagaguggaauugcuggaucauaugaucacuugcuauuuaacuuuuugaggaacugccaacauguuuuccagagugacugcaccauuuuacuuuuccaccagcagcguaugaaaguucccauuucaccacauccuuguccacacuuggcguugucuuucuguuuguagccauccuacuggguauaaauugguauuucauuaugguuuugagcaucuuuucaugugcuuauuggccauuuguguguccucuuuggggaaauaucuauucagauaccuugcugcuuuuaaaauuguguuauuuuacuuuuuaugguugcguuguaagaguucuuucuauauucuggcuacuagacccuuaucagauauaugauuugcaaaaauguuuuuauucugcagguugucuuuuugcuuguuagcauuuguucacuugauaguguccuuugacaccaaaguuuuuaauuuugaugaagucuaauuuaucuuuuuuuuggcuguacuuaugaugucauauuuuaaaaaccacuguguaauccaagaugaggaagauuuucaccuguuuccuucccagacuuuuagaguuuuaguucuuacauguaggucuuugaccauuuugaguuacuuuuuguauaugauauguaagauaggaguccagauucauucuuucuuuuuuuuguuuuuuuuuguuuguuuguuuuuuugagacagagucccgcucagcucaguugcccaggcuggagugcagugacgcaaucucagcucacugcacccucugccuccugggcucaugccauucuccugccucagccuccugaguagcagggauuacaggcacccaccaccaaacccggcuaauuuuuguauuguuaguagagacgggguuucaccauguugaccaggcuggucuugaacuccugaccucaggcgaucugccugccucggccucccaaagugcuaggauuacaggugcauucuuuccuuuuuuaagaacagagucucacuauguuguccaugcuggucucgaauuuuugggcucaagcaauccucucaccucauccuccugaguaucugggacuacaggcaugcaccacugcaccuggcucgcaaauuuauuauuuugcauguagguauccaguugucccagcaccauuuguugaaaauauuauucuuuccucauugaaucaucuuggcacccuuucgaaaaugaauuaaucauagauguguggguuuauuuuuggacucuaaauuauauuccauugauguaugugucuguccuuaacgcuaguaccacacuguuuuaguuauuauagcuuuucaguaaguuuugaaauugagauguguuaguucucccacuuugcuguucauuauagagauuguuuaggcucacaucuguaaucccagcacuuugauaagccgagguggguagauagcuugagcccaggaguucgaaaccagccugggcaacaaggcaaaacccugugucuuuaaaaaaaaugcaaaaauuuaccaggcgugguggugugcaccuguggucucagcuacucaggaggcugagguuggaagaucgcuugagcccugaaggugcagguuacagugaggugagauugcgccauugcacucuagucugggcaacagagcuauuugggguccuugcaauuccauaugaauuuuaggaucagguugcccguuuuucaaaaaagaguaguugggauuuugguagagaucacauugaaucuguagauugcuuuggggaguauugccaucuuaacaauauuaaauauuccgauucauuaauaugagauggaauaucuuauuuauuuagggccucuuuauuucaaugauguuuuguaguuuucaaugucuaagucuuacacucucuugguugaauuuauuccuaaauauuguauucuuuuuggugcuguuauaaauaguauuguuuucuuaauuuuauuuucagauuguucauugcuaguguauguauagaaauacaguugguguuaguauauugauuuuguauccugccaacuuugcuaaaaucauguuagauuuaauaauuuuuucccauguguggauuauuuaucguuuucuauauuuaagaucaugucaucugugacuagagauaguuuuccuucuuuuuuccuaaucuggaugccuuuuaauucuugcuuaauugcccuagcuagaucuccuguacaguguugaauagaaguggugaaagugagcauccuugucuuuuuccuaaucuuaggggagagguucagucugcuucucgaugugguuuuuuaguauuuuguuaaggaauuuugcaucuauauucauaagggauauuggucugcaguuuucguucucaguugugucuuugucuagcuuugguguccagguaauacuggccucucauaaggagguaggaaguguuuccucuucugguuaaaauuuuuuaauaagauuuucucauuuaagauacaaacuuuuucaugauauugauaaugaauuuuuccuuuuuuuuuuuuuuuuuuugagacaaggccuggcucugucacccaggcuggagugcagugaugcaaaaaugggucacugcagaauugaccuccugggcucaagcaauccucuugccucagccuccucaguagcugggaccacaggugggcaccacaacaaccagcuauuuuuuuuuaauuuuuuuguagagacggggucucacuuugcugcccaggcuggucuugaauuccugggcucaagcgauccuuccacuuuggccucccaauguggugggaauacaggcaugagccacugugcucagccagugucucuuuuuuuuuuuuuuuuuuuuucucaguacagacuuuguauuuaaaaucagacuacaaggauucuuaguaaagcauaaaucagauaggaguccugauaauucuaagaaauauuucuucugcuuauuuuaugugauuuauuuagaguuaucauccauaauguugcaagguggcaggcauuuuuaaauuuuaauugcuggcuucuucacucauguuaugaguaguuaagaguggaaaaccauccccagccauucaccguuaauguacaugagugacuaugaugucagaacaaaaaucagaccugccuuaguaauguguuuucccacuugugaaauuggaauacggauacucuauuaccauggauaucugcuauuuaaauaugcugaaagauuuaaagugcugucuuguauuugugggauuuuguaaucaugagcaguaaauuauccaagaauauaauuacaaauuguauguuaggauuaauauggauuaaaaaucauuacuauaguuaaaaaauuuguauucuguuaugauuaaaaacuacaucuguuuaaaucuuucuuuuuaacagaugcuuuaguuacuacuaaaguaaauauaaaugauuuauggauucucugggaagaaaaaugcucacuacuuaauaagaugagauuuuaaccuuagaaugaauuagcaucuuugcauuuugcuuugcugauaauuuucuuugcuuucaguccuuuuguuauuaaggauauauuugaguagucuuaagagucugagaaauuauuucuauuguugaucaggaaagcuuagaaaauuuaaacagugaguaaucagcugucacacuugaaaccuagaggugcaaucugaaauuacauaucagcuguuacagaaaugagcuuacucauaaaauucugcugcauucugcagaaaauauggcagagauuuaagucucccuauguuucacaauuacugaucauaauauaaauaugccaaauauugcccaugaaaaauaugggcugagaguuauuaaguauuuauucugaaauauaguaucaguuauaaaauggaaaauugcuggucuaauaaauauacaggagcccauacaauucuccuguacaaccgcuagucuaaucccguaucuccaguugacuacuugacauuuccacuuagaugaccuuaauauuuaauacuaacccauuauuugaugcugagucuuugaugcaguguugcaacuuccaauuacaauguuuccauggaaaaaauagacucugcuuagugacaugucuuacaacuuacugaaaaauuacuauugucuguccaaaggacacuugugcuugcuucucccguuaucacuacaaacucuuuauaucccaaauugcauuccucucuuauuacaaacuuaccagacaggcaaaacuguucagcauaguugaaagcauuagauugguguccuacuuuggauucugccacuaguuguaugacccuccccagacaucauuuuuuucuuauauguaaaaugaggauguuggacuagaagaucuuuaacauccuuucaguuaccuugcuaugaaaauugaggucuuuaaguguaucacucugaguggguuguaugaccugaaaugucaccaauuuuuuucuggucucaacaugagacucuuuauuaccuuauccauucaguuaucaaacagcuuuguaauuuuuuuucuuuuuucuuuuuuuucuuuuuuuuuuuuuugagauguaaucuuacucugucguccacgcuggaggugcaguggugcgaucuuggcucacugcaaccucugccucauggguucaagcgaugcuccugccucagccucccgaauagcuuggacuacaggugcacgccaccacaccuggcuaauuuuuguauuuuuaauagagacagaguuucaccauauuggccagacuggucucgaacuccugaccucaugaucuguccgccucggccucccagagugcugggauuacaggugugagccacugcgcucggcuuuguaaauuuucauguuauauuuuuccuaucuauucccauuuuucuuuccauguuugcuuauuuucauccacgccuagauuacaagagcuuccuaucuaauuccaaucuuuccucacucuauuuuguccccauagugcuuuuuagcugaucuucccuaaagaccaguuucaucaaguuacuucuuagaaaauguuaucggccuacuucugcauaucauaugacgguuucugguucuucuguugagcuuucaaaucccuagcacugauuuucuguguuaaucauauugacauaugauuaaaugauacgauaucuagaauauaugucaccucauacuauguuuuuuuccaucuaugacuuuacuaaauuauucuccuuaccugaaugucuuuuccuuuucccccuaucauucugaaacacugccuugugaaauuaacccaggcacuuuagcaacaugugacauucucugagggauugugcugcuuuuuuaaggguccaaaaccauggcaagggauggaaaaagaaaaguauaucucuuuauugaguguugccugugugccaggcauguuaccacauuuaaaccacucaacaauccuucgagauugaugauauugaccacauuuuacuacuaacucugaggcucaaagaaacaaacuaaccuacacaaggucacacugcuagugagcaguggagcugggauuugaacucugggaucuuuuuacuuaucccugaaaaaaaaaugaccaagguaccauuaauuaccuuuuuuacaccccucccuccccaacaaacgcauaaagagaaguaaagguacaaauuuaagugccuggcagauauucuccaagauuuaggugaauuuuuuuuauuauauuuugaaaguauagguauuucaagaguucuuccguuuaccucauuuaucaaaggaacuugauguaggggaggccuuuugucugauaagaaguaucucuuuuuuuuuuuuaggggccacagggagauuucugaugugauuugaagucaaagagaaaauagcacgcauuuucuuuuuugcaauuaaaggcugaaaaagagaugguauucauaugugcauucagcaaucauccuuucauaacaccaccuagauaacaauuagggucaagggugaacaguucaagcaguguuaguuaaugagauuuuauguuuuguuuucuuuuguuuuuuuuuuugagauggucgcucugucucccacgcuggagugcaguggcacgaucucggcucacugcaaccuccaccuccuggguucaaacgauacuccuacuucagccuccugaguagcugggauuacaggugcgcaccaccacacccagcuaauuuuuguauuuuuaguagagacggaguuuugccauguuggccaggcuggucucgaacuccugaccucagaugauccacccaccuccgccucucaaagugcugggauuacgggcauaagccacugcgcccagccguuaaugagauuuuaaaagaaguuauacagauuguugguagucacuuauguacuuggacuugucaauaacugucauagugaaaaugugguuuuuaagaguaguagcuacuuauggggguguagaaagaauggccucucucuuagacaauuucauuuuaaacaucauagucaucuuuugcauagugauugacuccuaucuuugugguuucauguauuucuuugugauugauuccccagugccugccugcaguccauugcaacucucccaaacuuuaauccugcagcuucagcccacugcuagauauuuccauugaugaccugucaucugaaaccuagcauucaucaugugcuguguuguauaauuguaugucuguguuauuguauuacuuucccaaguaaaguuuuuguguaaggacuuaacacugcuuugaauccccuguaccuauuauacugcuguguacaaaguaggaguucaaauacaugugaucacaauagucuucaugacuaaaguagcucuucgcuuuuuugguaaccgcagaagccuagaaaucauccagaguucagauacaguugcaagcucuauagaaccaaaacacagcaaaaagguacuguuuuauaccuuguaaaaaugaagucaguauauuugaaaauugucauuugcuccuuguagaagaaaagacuuuaccuuuuugaugaaugacuuaaauauauuuauuuaaaauuaaauccauucuaacuuuuggagguaauggauauauuuauaaccuuggucauggcggugaccaugcauauacuugaguauaugcauaugugcaaaaguauacauaaauauauauaaaauuauagcauguauuuuugcuguuugucuuaaauugauuuucuguauguuaggcuugcuuuuauuccuccuuugucuacacuuugucuucuaugauuuuuuucuaauuuuucucuuguaauacuucugguucuuaaaguguuuuacuuuauuuuaacagcauauuuaaaauuauuuuauuauuuauuuauuuuuugagacugagucuuacucugucguccaggcugguaugcaguggcacaaacacgucucauugcagccucaaccucccagguucaagcgauccuuacaucucagaccacaggcaugugucaccacacccaacuaauuuuuuuuccuuucuuuuuuuuuuuaauagagaugaggucucgcuauguuggacaggcugcucuggaacuccugggcccaagcgauccucccaccucagccuugcaaaaugcuggaauuacaggcaugauaauuuuuuuuuuuuuuuuuuuuuuuuuagagagacggggucucgccacauugccuaggcuggucuugaacuccuaggcucaagcaguccuccugccucugccucacaaagugcugagauuacaggcgugagcuacuuugcccggccuuaauuuauuuuaauugucuugaggucacuaauacagacuugaggucaaagaccaagauguauuugucuuuauauugacaauauguuuagcacagucucuggcaaaaagccaguuaguggcacaucauucaggucuccccagauggagaccagugcuucuuuuucauuacaguguggaggcccuagucauauucucauuauacauuaaaaacuuuaaugaugauugacucuucgguuaccauuuuaauaagucuugauuaugagucuaagcuuuucaaaaacaucuuucauugaauaacuauaugcaaagaauauauauuuauauacuuauguugcugcuuuguauaaaauaggcauggaucagaauuaauguccucugauucuauauuugccauuagucuuuuuucuuuuuuuuucuuuugagauggagucugacuaucucccaggcuggaguagugcaguggcaccaucucggcucacugcaaccuccaccucccagguucaagcgauucuccugccucagugucccgaguaacuacaggcacaggccaccacacccagcuaauuuuuguauuuuuaguagagacaggguuucaccauguuggccaggcuggucucgaacuccugaccucaggugauccaccugccuuggccucccgaagugcugggauuacaggcaugagccaccacgccgggcugccauuagucuuauauuaaaggaagcccucuuagcacagccagcagcacgucagucucauaaacuaacuuuuaaucgauguggaaaauauauuguaguauuuaaaauguagucugaacaaauuuugcuuuccuuccccacacccuccuuauuuuuauaaaguuaccaggcagugacauugccagugggagugauguacuuucugaugucauacccaguauuccaaguucaccuugccugcuuccuaaaaagaaaaacaagcaccggaauuuagaugaacucccuuggagugcaaugacaaaugaugagcagguaaagaucuugacauucuuaauuaaaagcuuuuauguggagacuagguaaagcucaguuuauugccuguuuaaagcuacuggggaaauguggauugcuuaguaaaucugaauuugagcuuuaacgguuuuucagggaacaaauauaaccuuaagugcuucugcuauguaaacacauuauaauugacauaauaaaggaucagaaguuuuagcaaugaucuuauuguaauuuuuucaucacauagguggaauauauugaguaucugagucggaaagugaguacugagaugggucuucgggagcaacuugauauuauuaagaucauugauccuucugcucaaaucuccccuacagacagugaguuuauuauugaacuuaacugucucacagaugaaaaacugaagcagguauguaaagaaaauacagauuauuuaccuauuaaaaauaccaccaucuuauaaaauguagacuaaaauaaucauguguaaauacauagauaauuaaggccaaaaucacugcugcgaaagguaauauuagaaaaaaugauggcacauugauuuaagagguuuuauguacaucucaccugccaguaccuuucugggaucaaugugaaucuagaaccugcuuuucaguuguauaggauuugaaauuuaaugucaccauuuacggagugguuagguuaagguauagauuuauucuaacucaguuuacaggagacuaauugacaaucaaaauacuaauuaaugagagcuauucuuugauaaacagcugagggauuugaguaguuuuaugcaguaauaauugagccaggcuagggugaaaccuagugaauuuucccucugcuguucugaaauacgcaucucugguacucugguaucaucuucuuuuuuuuuuuuuuugagacagagucucacucuggagugcagugacgcgaucucggcucacugcaaccuccacugcccggguucaagugauucuccugccucagccucccaaguagcagggauuacaggcaccugccaacgcacccggcuaauuuuuguauuuuuaguagagaugggguuucaccaucuugaccaggcuggucuugaacuccugaccucgugacccaccugccucagccucccaaagugcugggauuacaggcgugagccgcugcaccuggccucugguaucuucuaaauacaauuuuugcuguucuuuuucugguacguagcugagugaauacuuacguucuuauguucuacuuuugauuuguuucuuuguuuugcauuuaucauuauuuaugaaaaauuucucuuauuucaguauuucucccagcagacauacuauaauuuucuacauuccagcaaauuuuucauuaguaugauaaauugaugucuugcauuugaagacagguauuguuggccccuagcuaagauuuaggaaacaaccuaaucuuagauaaaaucagcagcuuacuuaaauugucuuaaguggagacuuuuaacaaaugccuaaucucaucuauuuuauuuuauuguuaguuuguauuuugaaugccauuuuuuuacaguccuaaauuucugaaggcgaguagccuuccauuuacugauuauauuuuaugugcuuuuaaaauccagcucuauaacguguuuucuagcuuuuugagcauuuauuuucuaguacuuauuucuaaauuuagccuuucuauucuaccuuacguaugcaucugcagcacuuuugacagucuuuuagauuaaguacaauauuauuuuucccccagcauuuugaagguagaacaucaaggugcaacacuaaccaguuuguguuugugcaucccaaggucagaaacuauaucaaggaacauagcccucgccaacggccugcaagagaggccuggaagagaagcaacuuuaguugugcaagcaccaguggagugagcggugccagugccagcgccagcagcagcagugccagcauggucaguucugcaagcagcaguggguccaguguuggaaacucugcuucaaacuccagugccaacaugagucgagcacacagugacagcaaccugucugcaagugcagcagagcggauucgggauucaaaaguaaaacgucuaaucaauacaaaacuuuaccuuucaauauuaacauuaguacuccuucauauaaauuucuugaagaguuaaaaugauccugcugucuaguugccuguggguuuuggucuuaauugaacaagcaggaugcucugcuguugaacaaagcacucuaggcugagugcuuugaaaugcuguuuugacccacaaccauauugcauucaaucuuaccugauuuuuguguauguuuuaaguaagauaaauugguggaaauaaugaguuauucucaagauugcaauauugacugcaacucacuacugagcgaaucucacuacguugcugauguugcugucuauuagcuccuaagaauguuguguaugucuuuuguguguguuaaauguuuucuuaauguuuuaaucuuaaauguuucuucuuagcuaauuuaaaaaucuaauacuuucuauaauuucugucuacucuuuucacaguugagaaaguucuguauaauauugucgggcacuuaaaaaaaaaaagaagguauaaguauauuuagaaugguccuguggcuuagcaggggaguuugauuccuugcaauggcaagaaucuggagccaguuuaaagaugauaagagaaucucucuaacucuuuagugacccaguggugacuugaagauacacaaugauucuuucccugguucuuagggaaguagcagaaacauagccaguuuuguugcuaaggaauuucucuagauauguggucauuccuuuuuauuaucaguucaccggugacaaggaugggaguauccacugaguuucugauggauuuuuaagaugguauucgccuacuacaaaaaaggcaugauuuuuuuuuuaccugccauuguaagauugcuaguguuuuuggaugaaaggcaccugagaaucauaaguauuagagauuugggcaauguucuccacagguguauucaguauugucgccuaguauuaauuauguguucauuaugcauuuguaccaauguaccuuaauggaauuuaaaaaagaagucuuugaagugacuuuuuaucuaucacuagccaaaaugaucgucucaacucuuccuaaucagaagagucacuggucaaauaccacaaaauuggaaucuuaaucauuuuuaagccuaagccaguggcucacuuauuggaacaaggaucauacuacagaaggauuugaacagcucuuaaaguuagaaaauagagaauuugauccacaaaacauuuugggguggauaugccaaaaacuaaaccaaacugauuuagaaauuuuuauuuugacagaagcgauccaagcagcggaaguuacagcagaaggccuuccgcaagaggcagcugaaggagcagaggcaggcccggaaggagaggcucagugggcucuuccuuaacgaagaggugcuguccuugaaagugacugaggaagaccaugaagcagauguugauguuuugauguaauaagggugaauuuaucaacguucuuugugagcauuaaaauacuccauccuuauggguuuacaugcaucuugaccaaaauuuugguuagggcugugcugauguaccauuaauaauuuaagccagugguucuuggcaggugaucccaagaccugcagcuucagcaucacuugagaaguuguuaggaaugcauacuagugggccccgcccccagacauagugaaucagaaaccaacagggaggcgccuagcauuguuuuuuuaacaagugcuggguuauucugaugcacagucuaguuuaagaaccacuacuuuggguaaacguuuugacuguuuaaaguuuauggcggugaagugggcgucuucaaagacuaguacuuacacaguuuagaagauuucaagguacugcugacaguaguuuauuaugucaguauacauacauguguagagaucauaauuuaguucccuucuuaauguuacaauuucuuaguuuacuuuuccuaaagggccauagcauaauucuugauuccugguggaaaucuuuucugaggugugggggugggcaagguguggauugcuguuuacgauagugccuucauuaguuuuaguucugucuguuuucauucauuauugacucaaagguauuagaacaggcccuuaucuuuuuccuauuagauuuauuuuuguuuuuuacuuuauguaaguucagaauccuuuuuuaagugaugacuacugaugaaauaauguuacuaguagcugaauuuuagacuugaugcuauguugauuaauauuuaaauggugaaaguaauuaggcaaaauaagcaauucugcuuuucuguugcuuucagaauuuuuaggcuguaaaauugucucaggcaggaagucagucuauaucucucucaaguucuuauuguaggucauuuuuuuuucagcacagcucuaauuuuuaaauauuugguauaacagcuucuggcaugugaccuaguuaauguugaaaauuaacugaugaaaacccuuguagaucugcuaaacuucucuauaaauugcuagaaauauacagagcaaugagauauagaaaacaccuuagcuuguugguuauuaauagagcucuaauuuuaacugugaaaucauggaguuucuuuaaauguuuuccuagaguguuuguuaucaugaacauuagaaauagcauuauuccuuuucuucuaccacaugucuugaacauucacauggguuaaagaagauggaaacugauacuacugacaaucaagcugcuuucugacuuucauaauuuucuuuauauuguggauagcauuuugaaggugaccgugauucuguaggaagagcuguaaucaauauuuuucaaacucuaagaguacagagguuaguaagauuucuuuuuuuuuuacuuuuuguuacgucaaguagcuuauuaagaaaaagauucaugacuuaaauucuuaauucucaguugauacaaaggcuuauaaucauguguuuuaaaauuuugauuucauuuucguuccuugaagguuaaagaauggaaacuggggauaaaaauuaauacacugcagcuuugccaaggucugugauaugguuguaaccuuuuaaagacuacuaaagucauaauuugaaauuuuuacuaaaauaaaacauaugugucuaugguuuucaauuggaguagucuuucuuacuuucccccuuccccucuuugguucuccuaaccagcuuagaggacccaaagagagcuuagggauagacaccagaauacucuguggagguggaacaacuuaaccucacuguuuucccuuccaaguauaggaagagcaaauagagcauaguaacuguaucuaaauucucuaccugcucuuagcaaaagcaaaaucccacagaaugauugccugcugucuuuaccuauucuucaaggaaaacaggccacuuuuggagaccauagagcaccauuuaucugucaaauacuuggaaacuauuuacuuaacggucaucaguaaaaaacccuaaacaaggucaugauauaauuuaagaccaauuccccuacucucccaauaaucacauagucuuauuacuuucaauuuaacuugagucacuauuaagcaaguuuaccaaagugccacaaaguugauuuuuaacguuuguaaagguuugaauguuuauagaagugcaucaugaaauuuuguguaaauccagaugaacugucauuauaguacuauaaauuagagauaguccauaaaguuggguugaaggagauugaaaauauuuccuuugauuaaaagaaaauaauuaacuaacuugggcuugcuugugauugaagagggagauuagauaguccucuguccccccaaaaaagaaacuagcagagaaagacauaaaaagcucuuuggugucuguucaugugcuguacauuuuuuccguuuuaaugucuuguguagauaauucaaaguuugaacuauuucuuucuuggaauaaguaauaauuuauucaauaugguguaucucugaguucaauuuaaaacaauccaacucaguaauauuuauuuuuaaauacaaauccuaacuaaccaauuaauuaauaaaaaggcaagacuuacuugcuguaguauugguucucaucuguagagaacugacauuggagcaaauuuuaagucuccccuuugaaaauaagccuuguuaacugagggcguaauacauuucccacagauuuauccagaaacauuuuauuagagaucuuauaguaguaucucaguuccuacuacagcuuucuaaaggaugagacuugcauuuaacaaaaugacauauauaauauuuuucuauaguuuugcaacugaauuaaaggaaggugauguauuauaauguguagugagguauaaagggcuaguucauucucucccaacaagaacuuagaauaaaauaacacuuuuuuuucaugagacuuaccucauuuuuguuaggcuauggcaguuuuguccaguuccucugucccuugagugaauuagauauuggugaauuaaucucagaaacugaccuauaaaauaaugacucauuauagauugggugaacuucucauuuuauuuagcuuuuaaaagugcuaaauccucucauaaaggaaaaauuauaggaaacuauagcgguauccagauucugaugagcuuuaaaaauuauaaaauauagcaaaugucuucauauuuuagccagaaauauuaguacacaaccaauauagaagucuuguuuguuucuggguucuccagcagagacuuuuuguuuguggcuuacucuguauagccucaugugccuuaaagguggugaacucuaguuuuugucaauaucaggcuuuucaaaacucaaaaacaauccaaauguuguaauuuguuuugcauaaugcccauggaauuggauaucaguaagcaaagccauuaaaucgaaccaaucaaugcuaauagaguauaaaaacaaaaaccuucaaauuuuaaguuucauuuguguaacuuuauuuucggccuagcuagaucauugaagagccuugaaaguuaucuaaaguauggcuuaauguauuuuuuucccucugaaaaagaucauaugccaggauacuucuucaaaccagaucacuuuuaauaucuagaaagauaauuuucaagguauaggcaaaagcacuucaaggacagagauuauguagcaaguugauucucuaggaauucuuugaacucauuuguguaauagcuggaacacacuccucuucuuuccuuuaacaaaugaacuuuuagcacuucugucuucaaggaaaaacauuuguuuggaauugaaggguacucgcaguccguuuauaguuugggacaauuaauaggaaaauccccaguugcauucaaauaauaguguugauguugagggcacugacucauucagcaugucugaacuagaaguaaauuuaauucugaaaggacuguuaguuaggaaauaaguauuuguauacauauguacugugguaacuuuggauucauuuuaagucugauaaaguaagauaaacuuugucuuaaaaauaaaauuaugcuaagugaauaaaaacugagauauuuuaagcuaggcaucuuuguuagcauaguauccggaacauaacuacuuauaaugcuuaggucuuauuucuuuggaaaauaaguuacuuauuccagaagccuuagaaggaauucugaaaauucuucuaacuggccauuaagaguaaggaaguugaaugguacugcugaagaucugaguugacucacugaaauuuuauuuucuuauuuuuuuaacauuaaaauuauuucuuuuuggcucucccucuaguuauuuuuuaaauuaagguaauuacuguuuuaaccuagagcauauaauggcaaauuaaauuuuaauuugacacucauaccgaacucagaaaagcuuguuugaucuucucuaaauucuguauguaguacuuuuuuuaauugucacauuucuuuguuacaucuuuguguccaacaaaaccuguggaaaucuguguucauuuuuguggugagggaugggggugaaaaaggggagacuugcucuaauuaugcauauacauuugacuauguaaagguaguuguagacuauauguauaaauaacaaguuaacacuuaauauucuaaauuguucuaaggaacaguggccugaagccaugacuaguuuuguggagcugcuggcucuuuuaacaguagcugaccuauuggauuuaaacugagacugaaauugacauuugugguuagguuaucuagcugaggcuuuuaacaauggagcagauaaugucuguuccuguaguggauccauuuaauuuccuauuugaguacucucacuuaacaaguauuaucuauucugaaccuuuguguugggaauuuaaggacuauugucaaaggcuauuaaugguaaacaaguauaugcaaaacaauucacauauggguaaaaauuucaaauuguggguuuuuguuuuugcuuuuuaguuucaaagauuaguuauguagcagcaauaucauaaccaaagcaaguaggaaguugacugguuuggagaaucuucaaguaguuuuaaauacuguaauguaucagauuguuaaccaggauuuuuuuuuccuguauuacugcuaaauauauuacuauauuaaugcacuuuuguauauauaacugucuucuguacauucuguacuuacuacaguguauauaaagccuguuuucccugaagcugugagggaauaacaauaguuguaucauaagucguuucuauuuugaguuccuucuuguacuugaaaguaguucaguagugaaaucuaaaugaguguguaugguuguaauuaaaacuggcaauguggcagagcugucuuuugaaacugaauaccagaaugaaaaguguuguuuugguuaagaacucuuauaauauauuauuucuuuugauguacccugaguuguuacacagcccacucacugcugcuuacuacuuuauacuucugagucagcuccuuucaugcucuaucccagaauauuuaccaacagaggagaacugcucccuuuucuguuucucacaguuugguuauggcuuuauaaacuuuuauuuggugaaagccccagauacccaaaugucauuggcaaaacuuauuuuuuuuucuggacagaucagauuucuagagagagcagauuucuagagagauuagcauucauaguaagugaaaauugucuaauuuuuuuaauccaugcuauuacugggcaguaggucuaauuuuuuuugacaaaaaauagaucuauuuuccuuauauauugauuuagaaucuuaaguuagaauuuuauagaagaaaugucugagcaguucuauguauggaggagcaauucagcuuuucagcagcaacuuuaucuuuugccacuagagggagaucugugguugcuuucuccuuuggagaauagcugcuuugcuuuuauuuuuaauuucuaagguuggaauagaacuuauucucaaaauuccuuuaguguuauuaaauauuuucauuuauuagucaaagguaaguuaauuaagcuuguuuaaugaugccaaucuuaugcuuuucuguaaucuucaauuuuuaauaaaugugaguuagauacuaagugaaau

SEQ ID NO: 19180 - RNA, 6316 nt, Homo sapiens
ggaaagauguugcuuucugagagaugcagguggauucuugggcauuugcuguaaguacuuuuuuucucuuuggaaacuuugaacaucucuaucagcaagucagagucccaaauaaccaaguuggcaagucagagucccaaaccaaauuccuggcucuaggggugaaggucuaaguguggucaucuaauaauugacuuucuaccagccucagugacuuuuaaagaaagaggacucugaugaugauauggagauuggauagaguggugaacaaaggggguugguauggaggauauaggagauggugugaucuguuaggagcugauauaguagcucaggccaugaacugagaggcagaggcagcaggaaugaagagaagggagaaguuuugagaguuauuuaagaguuaguauucauaagacaucaugcuucauuagauauggggaaugagaauaaaaggaggcuaugauuauucccagguaucuggcuuaggugucucuauagacagugaugugauaaacugagauguggaaugaagaugagggagcaagcuuaagguguagggagaugauauguuuacaucuggcaacuuugagauuuucuuauugagacugaggucuguguggaccauccuggugguuauauccaaaagaaagcuggauaaauggcuaggagcucaggagagcaaucugagagagauacaguuucuagcaauugagugcggaggguaagaucacucaggaagaagauggaggguggaggaaggauccuuuuucugaguucauagaccucuuccuucuaagcacacauguccacuuucauuggauuuccacaccugacuucuuuacuccauuucuuugcacucuuucaggaucagagaaccuuacaccuuaucuuucuggcuuucuuuauaauaauuaaaaguaacaugcauagguguaagaauaauaguguuaagaugucuuacaacuuagaaaugacuguuuagauguuacuaagauuaauggugaaagaaauguaaaauuuagaaaauuauucuuucauuuucugguuguucgaaaauaccucuauggcuuccaugcauugcaaaaugcaugaauuucagcucaugaccuuguacguggcuccauaaaccaccacccauccauuccaacuaaucauauauuguacaaauuacuuucauuuugucuuuuagccaaauaagaugcgaguguucucucaucucauagauuuuaucuuaagaaaaugccagaugaaaaaaaaaaucuaaaauucuaaucuacaaugaauaauguauacagagggaguacuaguuuaaccuaagaauauccccucucuccaaaaggcugccucuaguucagaaaaaaagugauucaauuuccauaaauuuaauuuacucacagcguuuucauaauguugcuauaacaucugaaugacaguccauggcauuauuuccgugguugcagcaagccacuucuccuacucccuguccauauuagaugcaucuccuguuuuucaagggagagaaaccccugcucagccccugaugagcacaucaucaaauauuuacuauuguuuuauuaaucaaugugggugguuauuaugugucucuggcucagggaguguuucauccaacuaagcucccucagugguugucucacuucaucucuuauagauuaacuuccuuccaaaaugucaccauuccuguaucugguucucuugguacuugggcuucaugcuacaauccacugugcaucaccugaaggcaaaguaacagccugccauucaucccaaccaaaugccacucucuacaagaugucauccauuaaugcugacuuugcauucaaucuguaccggagguucacuguggagaccccagauaagaacaucuucuuuuccccugugagcauuucugcagcuuugguuaugcuuuccuuuggggccugcugcagcacccaaacugagauuguggagaccuugggguucaaccucacagacacuccaaugguagagauccagcauggcuuccagcaucugaucuguucacugaauuuuccaaagaaggaacuggaauugcagauaggaaaugcccucuucauuggcaagcaucugaaaccacuggcaaaguucuugaaugaugucaagacccucuaugagacugaagucuuuucuaccgacuucuccaacauuucugcagccaagcaggagauuaacagucauguggagaugcaaaccaaagggaaaguugugggucuaauucaagaccucaagccaaacaccaucauggucuuagugaacuauauucacuuuaaagguaagacuuucagaugucaauuuucagucuagggcucagauacuuggguggagugcugaggggagcucauggucucuuauuacuggcaucaguaggugucccucauaccacagugaucugcuccacuggacauagcugugaauaguauuggaucuuccaagauggacacacagcucugugaaugaguccaggaaauuucuagggagagcgcccuuucagagaggugggugacaaugguaugaacaucuugcucauaauuggcuaaagauucaugguuuccaaaagauuuggugaggugggacaagcuugcacuugucaaguagacauauuuguauguaaagccuacugugauucucacuugcuguacauacuuaggcauguuacauacauaauuuuaccauguauuaugcacucacuguguacuaaacaccaucugacaugugugguauacacacacugucucaaucaauacucauaaguguccaaguuuacacaguuaauaaguuuuagaacugauauuaccaacaaggucugugugagucuaaagcuggugcuuguagaaacaagaaucaugugacuauuuccuaaagguacugugcucaaaugauuucuccugguucuauaguauaugucagccacauuucuuggaggaguaaucaauugucggccacaaaccacacauagauagauuggcuaaaauugcagaacagaucuguuuucucacuucucccuaguguguuggaugucguuauaccuuuuuauggaagaggaaacuauggcucugaugggcuuagugugguauaguaguuuugaauacagacuguggagcccaacagcccuggguaugauuccuggcucugccaccuguuaacugggagaccaugacaaaugacuuucucugccugauccucagucacuuguaaaacugguugacuguagguaccuaacucuguggugaucuuaauuucuaaaugaaaucacuaauggaaaaggucuuguugguacugauaccgguuuaaaauaaacaccucucuuuucuuuguauuuuaagcccagugggcaaauccuuuugauccauccaagacagaagacaguuccagcuucuuaauagacaagaccaccacuguucaagugcccaugaugcaccagauggaacaauacuaucaccuaguggauauggaauugaacugcacaguucugcaaauggacuacagcaagaaugcucuggcacucuuuguucuucccaaggagggacagauggagucaguggaagcugccaugucaucuaaaacacugaagaaguggaaccgcuuacuacagaagggguaaaugccuuagaggauguguggguggaaggugggcauaaaagugcaggugagacagaguucagcagaaacccagaggcagaagaaucacccugaacuacccaacagcuauguaugaucacuagaauaugccaagaaaauacugucuaccaggcccuuggcugggcauucuacauacuucauaucauccaagcacaucaacaaaccuacaaaggaggcaguauaauuggcauuuuucaaauuaggaagucuggucuugaaagauaagaugagcuccccaaagucagccuauuaguaaauugauggcuuccuguagaccaacuagagcucaaagaacagguuggauuuugauguugaaaggugauugggcagccacucuguacuggaagugcaaggcagaaaacugugaagcuccugggugcuacccauuaaccuucaugccacuagcuccccaaccuuggucgucaccucagggauauuuucucuugauuauaaaggaguuacaucucccuacucccagugcuucaguccaacauuggcuguaccugagugcauuccuuucagaauaacuucugugaguuuggugccauguauugacuuacauaguaaugguuaucaauacucagggaagaagcagaguccaauauaauaccaucaugagagagagaaggagagaaucauaagcuugauauggugauugccauguguucccuuccucuuuucccacagauggguugacuuguuuguuccaaaguuuuccauuucugccacauaugaccuuggagccacacuuuugaagaugggcauucagcaugccuauucugaaaaugcugauuuuucuggacucacagaggacaauggucugaaacuuuccaauguaaguugauaaacuagaguucuuaaauguaugaacuggaagagcaauuaggagucaauugauucaacuuucuuauuuuaccaauuagcaaucugaugccuagagaggcggugugacuccuccuaagcuagaaucacuccagagucauucccauuacuccaaauaaguaauuguaucaguuucuuccauccuugaccuuuaugucccagaauuacucugauagaacagcuuaaugaucagaagugacucuggugagaugcaguucugaaggaggugugaggagggaaugcuuaagaggugacuccuggcggcagcaggccauagugaaugagguguuucccaauggcuagccguagaaucgccagagaaugauugacuacauuuagcagaggaaacuucauauucuagcaccaucaacauaguauagcaaaggggcggccccaccuuuccuuucccuuucuuacuucuagaccuucccaaagacuguuccuguuucuucagagacccgcaggauuuguucuccccacacaggcugcccauaaggcugugcugcacauuggugaaaagggaacugaagcugcagcugucccugaaguugaacuuucggaucagccugaaaacacuuuccuacacccuauuauccaaauugauagaucuuucauguuguugauuuuggagagaagcacaaggaguauucucuuucuagggaaaguugugaacccaacggaagcguaguugggaaaaaggccauuggcuaauugcacguguguauugcaaugggaaauaaauaaauaauauagccuggugugauugaugugagcuuggacuugcauucccuuaugaugggaugaagauugaacccuggcugaacuuuguuggcuguggaagaggccaauccuauggcagagcauucagaaugucaaugaguaauucauuauuauccaaagcauaggaaggcucuauguuuguauauuucucuuugucagaauaccccucaacucauuugcucuaauaaauuugacuggguugaaaaauuuucccuuuucugucuucuggggaauagcuaaaaagcaggucaggucuucguaucccaguacuccaauaagaucaauggacauaaaacaaugcagaugcauugucuuauaugugaacuucucaacccccuucccacugucccauuaguaggauucucugaguucuugccagaucugacacugguagguugaauaaaggaacucccacuauggggaugaguuacagacugagacaacugaacaaguuacugaacaagcaugggacaauacagcaagagauaaacuugccuguccaaccccaccuuccccccaagaaaacauacuuccaccuugccaauguauaagcugggaguggagaaagaaaguaauucauucaugucauaucucauagacccucuuuuucuguaucccaaucagacuccuuuccauauauagcaccccugucccacuuguuuaaguaggaaucuccuuuuuggcucuaauuucacugaauauugguacuuuuguauccccagauccuucaacaaccuucccucuaccuguacaugccaacucauuaccaccuaccaaacuagauuuuauuucagacacuauguauuuaaagcuugaguauaaauggcacagugagugguaaugauguaguaucugaaauucuagcccugagguaaaacacuucagugacaggaaaauaguaaaaaaaaugcauaaguacuguugcagauguuguacuuccauauugaaauaaauauuuauguuuagaaaagcaugu

SEQ ID NO: 19181 - RNA, 1034 nt, Homo sapiens
uugugcucuuacuggggcuggugguccaggggucuuacuccuuggaggccaugugggccaugagguccaccauccuguugcuguagccaaauucauugucauaccaggaaaugagcuugaaaaagugguuguugagggcaaugacagccccagcauugaagguggaagaguggguguugcuguugaagucggaggagaccaccuggugcucaguguagcccaggaugcccuugagggggcccuccgaugccugcuucaccaccuucuuggugucaucauauuuggcagguuuuuccagacggcaggucagguccaccacugacacggcaguggggacacagaaggccaugccagugagcuucccguucagcucagggaugaccuugcccauagccuucgcagugccaguagaggcagggaugauguucuggagagccccguggccaucacgccacaguuucccggaggggccauccacagucuucuggguggcagugauggcguggacuauggucaugaguccuuccacgauaccaaaguugucauggaugaccuuggccaggggugcuaagcaguugguggugcagaaggcacugccgacaaucuugagguuguugucauacuucucaugguucacacccaugacaaacauuggggcaucagcagagggggcagagaugaugacccuuuuggcuccccccugcaaaugaggcccagccuucuacaugguggugaagacgccaguggacuccaugacguacucagcgccagcaucgccccacuugauuuuggagggaucucgcuccuggaagauggugaugggauuuccauugaugacaagcuucccauucucagccuugacggugccauggaauuugcuauggguggagucauauuggaacauguaaaccauguaguucaggucaaugaaggggucauugauggcaacaauauccacuuuaccagaguuaaaagcagcccuggugaccaggcgcccaguacgaccaaaucuguugacuccgaccuucaccuuc

SEQ ID NO: 19182 - RNA, 2790 nt, Homo sapiens
gguucugggaaguaggagaccccacuggcuuugguccccuaagaauggacucugcugccugugcugcugcugccaccccuguuccagcccuggcuuuggcccuagcuccagaccuagcacaagccccacuggcacucccuggccuguuaagcccaucuugccuucucuccucuggacaagaaguaaaugggagugaaagguaaguugagcuuagccuuuggcaaccugaacuuaggcuugagagcuuccugagagaggaaggaaaaugagauguccagggcacccuguucucugugaaggggaaaagcaauggccucauagcccucccuccucaacucuagcuggaauaucucaucugacuuuucaccucacuaaucccgcuggguggcaagaggggacuuggggacagcuguugccaaagcugaaggugaagcagccagguccucauaggccagguggcugaguccccugagggggauggggaacugccaugaaaccugggcuuaacacaaucuagacuguggggguggggaguuuggggaaagaggaccaaagucuaaagaggcccuugacugggacauugucuuuuuccugaccacgccauaagauuuccauuugcuuuuuuccuaccucugcaaguccaguggggaagcaguggacccaggaacauuucuggcccucuucuucagcccaggaagaugguagagcucugaguucuacaucuuggagcaggaaguaggaggcaagauauuuuccaucuagcccccacucauuacuccaaacauuuagucuucaacaaacauuuacugaaacagcuacuguguaccagacauuguacuagguguugaggauucagauacgauugagcauaucuuugagcuuaagaagcccaaagacaaguaaauagacaauuacaaaacagcaugauaaaagcaauaauaacauugcugaagccgagaggagggacaucuguccuggaaugggcucaggagccuuaggaaaggcuuccuggagcagauggcaccugagccaagcuuuugggaggucucuuguuaucucagggagcccaccuuucagucucuuccucuacggauugaucucuccucuuugucccagaggaacuugucucuggaggcccuggcugucuuccacaaaugacuccccaaggcagaugaggaagcugguggauuuggugaguucgagcccuugugacguguguucacaugcagccacaugcauuaacagugaccaggucacuucccagagagccccugaccucaguccaaaggugcagaucugagauagcauccucacaguuuugccaacauuugauuccaacagagagcagauccaagcuuucuguggcaauuggaaagaugaggagaccaaagcucagagugggcaagggaucugggcaggccccacagccaguguguggcagugcuggugcuugaggccucgucuccuggcaccuuacuccagugcucucccacccacccgaucucccugaaucuuugcugcuccaguagaacacuguccccuggagagccuccaaacaggugcuggaacagaggcagggaagcaaacaacccgcaggacucugucugcuuguuuuucaaccagaaccaagagagaccccuuguugagggguggguauuggggguugcugggucccagagaugucuaaggucucuucaagaucauuuuaccugcagcuuucugaccucuaguacagaggaggaaguuaucuagccauguacuuugagccacaugcuagcuuuugcuuuggacaggcugcugguggggcaacggcugcugaggucaccaaggcugaauccaaguuccaucacccugucagguaagcuucuggcaugaagcuccaaacuugacauagauccauuagcucuuugaaucuucacaaaggucuugugaagcaggagaggggaggaauugcuaucuaugaucgcuguuucauaggagagaaaacuggagcccagagagguuaagggacuuugccaaggcugucuuuucuagaggcauuguuaacgaugcccaagaaugaucccccauggaugggucagugaaauaauccucaguggaaggagauggggccauagggcuggagaauucuuggcuagaagcuuucugggguagguagcagguggagucagagccauaagugacagaugcuggggcuggcccccgacccaaccacuauagguccauaaggguuuaccuuccugcguggggccacuuuguaacaaugcagaagguucuguuacaaaacuuucuuucuuccuuucccucugaccucauuguugcagccaagagaagggguuuaggggccagcuucuuucuuggcccuacuggccccucugcacauaugacaccuguuaggggccauguuucuucucuguccacaggcucuucuggccuaaaucccgcuccuucgacuaucuguacagugcuggggagauuuuacugcagaacuuuccuguccaggcaaccaucaaccuauacgaggacucagacagcgaagaagaagaggaagaugaagagcaggaggaugaagaagagaaguaggaggccaaugaaaaggggccagaagggugugugaggguaccaggguccauacccuacagcgccacagcucaucccccuuccucaccccuaaccuauccaaauggaggcagccagagucugauugggguucaguuugucuggcaaguuuucacagacaucaguuagccggaaguauuaguccagcagauagagcuuucuggacugaaa

SEQ ID NO: 19183 - RNA, 667 nt, Homo sapiens
uuuuuuuuuuuuacugugaauauauacuuuuuauuuagucauuuuuguuuacaauugaaacucugggaauucaaaauuaacauccuugcccgugagcuucuuauagacaccagaaaaaguuucaaccuuguguuccacauuguucugcugugcuuuguccaaaugagccuuuaugagccggcugccaucuaguuugacgcggauucucuugaccacaauuucgcuugggaagaccaaguccucgaggauggcaucgugcacagcugucagaguacggcuccugggacgcuuuugcuuauuuuuuguacggcuuuuucgaguuggcuuaggcagaauucuccucugagcgauaaagacgacaugcuucccacugaacuuuuucuccaauucgcguacuagccggacuuggauuuucuggaaagauuucaguugaggaacgggaacaaagauuaugauagcuuucugaccaccaccaacuucaauuuccuuagcugccguaauauucagcucccugagcugagccuugagguccgaguucaucuccagcuccagaagagccugggagaugccggacucgaacucguccggcuucucgccauugggcuucacaaucuuggcgcucgaacugaacauggcuuucuccugggagaacuugccgagcgccggc

SEQ ID NO: 19184 - RNA, 667 nt, Homo sapiens
gccggcgcucggcaaguucucccaggagaaagccauguucaguucgagcgccaagauugugaagcccaauggcgagaagccggacgaguucgaguccggcaucucccaggcucuucuggagcuggagaugaacucggaccucaaggcucagcucagggagcugaauauuacggcagcuaaggaaauugaaguuggugguggucagaaagcuaucauaaucuuuguucccguuccucaacugaaaucuuuccagaaaauccaaguccggcuaguacgcgaauuggagaaaaaguucagugggaagcaugucgucuuuaucgcucagaggagaauucugccuaagccaacucgaaaaagccguacaaaaaauaagcaaaagcgucccaggagccguacucugacagcugugcacgaugccauccucgaggacuuggucuucccaagcgaaauuguggucaagagaauccgcgucaaacuagauggcagccggcucauaaaggcucauuuggacaaagcacagcagaacaauguggaacacaagguugaaacuuuuucuggugucuauaagaagcucacgggcaaggauguuaauuuugaauucccagaguuucaauuguaaacaaaaaugacuaaauaaaaaguauauauucacaguaaaaaaaaaaaa

SEQ ID NO: 19185 - RNA, 2175 nt, Homo sapiens
ccuaaucgacuucuuccaugcgagacgcauccucaucacccucaagaggggggaucucaucaggaacugcaucacuggguuccucugcugccacuucaucuucaucaguaccuagaccuagcuugaucaugugguagaugugguuggagugggucuggggauccucaagggaaaagcccgaagauagcagggcgguuucaaacagcagcaccaccagguccuuaacugccuuaucauucuugucggccucagccuucugccgcagcgucuccaugaugggguggucgggguugaucuccaggugcuuuuuggccaucauauagcccaugguggaguugucccgaagugccugggcuuucaugaucugcuccauauuggcuguccagccguaggugcuggucacaaugcagcagggugaagacacaagucuauuggagauugucaccuucucaaccuucuuaucuaagauuucuuucaugagcuugcagagguucucaaacuuuuccuugcuuucuuccaucuucuucuucuccuccucauccucagguagcuccagacccuccuugguaacugagaccaggcuuuucccaucaaacuccuugagcugcugcacacaguacucgucaaugggcucagucauauauaccaccucgaagcccuguuuccgcacucgcuccacaaaagcagaguuggccaccugcucuuugcucucaccagugauguaauagguggacuucugugucuccuucaugugagaaacauacuacgacagagaugucaucucaucuccagacugggaggugugacagcgcagcagcucagacaggcgguggcgguuaguggagucuucguggauuccaagcuugagauuuuuagaaaaugccucauagaauuucuuauaaucuccuugucuucugccagcucagagaagagcucaaggcacuucuuaacaauguuuuugcgaaugacuuucaagauuuugcucugcuggagcauuucucgggagauguucaggggcagauccucagagucaaccacaccauggauaaaauugagauacucugguaucaacucaucacagcuguccaugaugaacacacggcggacauacaguuugauguuguucuuuuucuucuuguucucaaaaaggucaaagggagcccgacgaggacugaauagcaaugcccugaauuccaacugaccuucuacagaaaagugcuugacugccaaguggucuucccagucacuggugaggcucuuauagaauucuccauacuccucuugggugaugucaucaugguuucugguccaaauaggcuuggucuuguuuaguucuuccuagucaauguauuucucuuugaucuucuuaguuuucuucuucuuauccuuacugcugucauccuccucaucugaacccacaucuuugaucuugggcuuuucuucgucaucuuuaucuuccucuucuuucucaccuuucucuucuucugccucaucaucacuaauuuccuugucuuguuccuucuccaaauaaagggugaugggauagccuaugaacugagaaugcuucuucacuacuucuuugacccgccucucuucuaaguacucugucugaucuucuuuaagauggaggaucacuuugguaccccugccaaugggcucaccaugaucagcaugcacagugaaggaaccuccagcagaagacucccaagcauacuguucaucaucguugugcuuugugaucacaaccaguuucucugccaccagguaggcagaaaaaagccaacaccaaacugcccaaucauggagaugucugcaccagccugaagagccuccaugcaugcuuuaguaccagacuuggcaaugguucucaaauuauuuaugagaucagcuuuggucaugccaaugccugugucuaccaaagccaggguacguuccugaggguuggggaugaugucaauuuucagcucuuuaccacuguccaacuuugaagggucugucaggcucucauagcgaaucuuguccaaggcaucagaagcauuagagaucaacuccugaaggaaaaucuccucguuggaauagaagguauugaugaugagggauaugaguugggcaauuucugccugaaaggcaaaagucuccaccuccuccucuccauggugcacuuccucaggcauc

SEQ ID NO: 19186 - RNA, 1739 nt, Homo sapiens
uuuuuucauucaagagaauuaaauuguuuauugauuacacaugauaauggaugauacacaagcuucauucccaucuauaauuuuaucugguaccauuauucaauuuagauauauugcauaggaugugccaacaaucacuuuuauaaccauuccaugacuuuguuuggguaaucccuuuuaauggugaacuucaggucacaacaguaacuaucaguucaacuacaccaagguuuccgaagacaauggcuucuccacccaagcagguuguauauaaauuccaaauagaaccuggcaucacccugaaggaauucuaacuucacacuguuggggaaauuuaccaagauggcuucagaguagacuaacuuuacacagcacauuaaaaaaaaaaagacauuuauucagcgucacgaucagacuauuacauuuagcaaucaacagcaugggugcaaaaaaaaaaaaucuacauuaaaacgcuuuguuggaaugcuuuacacuuuccacagaacagaaacuaaaauaaccuguuauacaauuagucacaaacacaguccucgaguuuuuugcccauacacaugaguauuugucuaaaacaugucuucuuuguagcagcuaggcccugccaccacugugcuuggcugaguucacaaaucuguuguaaccuguggcuucccugucacuucucuggcucuccucuccugcuaagcuuuguuuccuaauuaaaaucuucugccacugacacagcuacugcugcugcuggaaccgccauagccaccuugguuucgugguuuugcaaaguacuggccuccaccgccauaggggccagaguuucugccuccaaaauuuccucccuucauggguccaaaauuugaagacugauuguuguaauugccaaaaucauuguagcuuccaccaccuccaaaauugcuuccaucauuaccaaauccauuagagccauccccacugccaccauaucuaccaccagcacggcugccaccaaagccaccacgaccacugaaguuuccuccaugaccgaaguugucauucccaccgaaaccaccuccacgaccaccaccaaaguuuccagaaccacuucgaccucuuuggcuggaugaagcacuagccaucucuugcuuugacagggcuuuucuaacuucacaguuguggccauucacaguaugguauuucugaaugacaaucuuauccacggagucauggucgucaaagguuacaaaggcaaagccccuuuucuugccacugccucggucagucaugauuucaaucacuucaauuuuuccauacuguucaaaauaaucucuuaggugauguucuucagugucuucuuuaaugccaccaacaaauaucuuuuucacaguuaagugggcaccuggucuuugagaaucuucucuggagacagcucucuuugguuccacaacucuuccauccaccuuguguggccuugcauucauagcugcauccaccuccuccacaguggcauaugugacaaacccaaagccccuggagcgcuugguguuuggaucucucauuaccacacaguccgugagcguuccccauugcucaaaauggcuccucaggcucucaucaguuguuucaaagcucaacccuccaaugaagagcuuccucagcuguucgggcucuuuaggagacucugacuuagacaugacggcagggugaagagagacuuuaacgaugcuucuucggcggcguccacgggcagaaag

SEQ ID NO: 19187 - RNA, 1595 nt, Homo sapiens
cuugcguuauuguuuaaacaaccuuuauuaccugccucugacauuccccaggguuacagagcagggggcaucugagccucaaguuccacggaugaagcagacacugcaauaacaacugaaucaauagaggagaggcauuuggaaguacuggggugauacacccaguaaugguaauccucagcagaagauggcauagcuaccaaaaaucaggcguuaccacugggaugaaaacuggggaggcaagaaaaucauacgguuggagucauagaucauuucccuccccguugagcacuccucccccuuccgucccccauuaaguucauucuaucccacagacugguccuaguguccugcuagcucccugcugaaagagagagggagggaaaagaugucugaggucucuucauuuccuuugucucugucccuaaggcaacuggaagcuggagcugcugcagucggccuggcaagcccguuggcucugcagagugagcagucccuggcagccccuggagcagcugccaguuagacggcccagaguucugauagaaugcauugcuucaguucagugccaaguguuggacguguuggauucaguucccagagggcuggagcgugcugucagggcugucugaagacaagagagcagaggcaguuuagugcaguuggaugugcgggguagggguggaggcgcaggggugaagagggagaaacuggcccgaauggguaagguggugcuucuccuuccagggccuuccagacaaggucuccuggccucucaccauuaucugggccucagaugaggcgaacccuggaagggaguuggggguggaaggugggaggcgcgcccagggaugagcgagaugaggagggcgcgaaccagcaaucuggggcugugguuuuagacccgcucagcgcccugggcgagggcaggcagccccucggaggcaagcuggcggcggcccucggccugggagcccgcggcagccucggcgucggcggucagggcgccucccggggcccauucgugcucggcgcaagccugggacggcucguccuuggccucgacgagcuuacgggagcggguguaggccaggaugaggccuccggccaagcaggcguagaagaucaugaugagcaggauguagagauaggcgucgucgcccuuggcgcuggucaccucgcggcccacgaaagggucaggcacgacccccaugcccaugcugggacgagggccagcgcccaagccgcuggcauuaccccgguggugcagcucgagcaacaggcggcucagaaggguucgcagccgcuggcucucgcugcaguucauggcuuucggggagugacacggcggcuccaggacgcugcugaccuuucccccugggcgaggggaagcgagcuagcgagcgggccggccggcgggcagggcucagcagcggaaacagcgguagcacccagcucuccggcgagcgcgcaguggcugggggcgccgacggcggggccuccuuauucccucacucccgccccuccuccccuuccccaccacgcccccuccggcccgcggccgccucuucccaggcucuggcugucucgcugcu

SEQ ID NO: 19188 - RNA, 278 nt, Homo sapiens
caugccucggaaaauugaggaaaucaaggauuuucugcucacaguccgaugaaaggaugccaaauccgucaagaucaagaaaaauaaggacaaugugaaguuuaaaguuugacacagcaaauaccuuuacacccuggucaucacugacaaagagaaggcagauaaacuguagucccugcccccugguuuggcagugaaggaacuaaaaugaaccagacacacugauuugugcuguauuaaaauacuaaaaauccuaaaaaaaaaaaaaaaaaaaaaaa

SEQ ID NO: 19189 - RNA, 903 nt, Homo sapiens
gcggggcugcuucgaccuggcacagaagcgcaucuucgggcucauggaaaaggacucguacccucgcuuucuccguucugaccucuaccuggaccuuauuaaccagaagaagaugagucccccgcuuuaggggccacuggagucgagcucagcguucacaccaggcgggcuggguccccugcccaccugccucccugcccccugugacggagggggcaagcaagcccccagaggcugugucucuggacagacggauagacauacggaagcgaggccuggaccaagagaggcccaggcuacuggaggaguagaaggaugggccccgugggguccccacugccccgguacgagggggcccaagacccuggcaggucaggggcccuggccaagccagaucuggagcugcugcucccugcugcggagaccgcggaggcuucgcguugaccaaguuccuuaaagaacuggcugauggggcaggagguccaggccugggcucucgggcccuccuagagggccauuggagcuugcagcucagacccccacuuugaguuuuauuuauuuaaauaguaguuggaugcuuggcacgucguccuguaauaggaaacccuugccucaucaguuuuccugauuuacaagugcaauauuuuagccaaugccuugggagaagcugccaugcaaagguggacaccauucuccagcuucaggggauaugcucgucccgggcaccgguggcaggcagcuggccuucuggacuaaggcagccuggggggacacugcagucuggcuacacacagagaucuggcacccccuggguggagugucccucgggggcuuugggaaagcauggcacccucagaccacacaguagccaaguucuggagcaaauaaaaggccuguguuauu

SEQ ID NO: 19190 - RNA, 182707 nt, Homo sapiens
uggcuuuuccacgcauagguuaggaagcaacugcucuggggagggggaaggggggaagagggggagggaaagaggucacgggaagccucccuuccucccacuggccuaccauugaaggccugucaggagaaaggagagaagugggagagggagaggguguggcagggguggucuguguggcaagagguagagagaaaauaguggaucagagcaggagggggaggagcagggaaaugaagcuccuguccuaggcacugaaguguggaguggggcuguggcuagaaaggggagagaagaugccuuucuggccuugcaugagucguggcagaaaggaggaaucgcgaagaggagccggccauacccagcacacaccccgaagccaagcugcucauuacuagaaaggcuuauucccccacaagaaguuagugcgggccagcuaagugccuacuaugugugcaguauagaaagaagugcccuggagaaccaggucgcgggaggcggagccagucaacagggcuucaccgagggggcgaauucuguacacgguugugaaggaggguggcugugcacgcgugcaggcuccgagugcagaagacgaggcaggccagggaggaggcggaaggaggcggagccugagccggaggagggaggaggagggaggaggaggagggagagccgaagccgcggagggugggaggugugaaugguggacgggugaggggagugccagaggcagaaaagggaaggaggcgaggaggaguagucguggcccgagggcgugugguggggcgagagcugaacuggacgggaggagggaggcaguggcgguggcagcggggagggggaggagagagggaggggaagaaggaggaagcgagcgcggcugcugcagggggaggaagacggggaggaggagccgugcgccgcggcggcggccgccaggggaaccgagcgcccggcgcggagagcgcgggagcggagcaguagcccgauccggggccgcgggccgagcugccggugagugaagccccgaggggcgcggcggccgguccccggggcugggcgggaggcgcgggagguugcggcgccggggaggagggaggggggccggcuuuaguccaggggccggcuuuaguccagcccccggcuggcccggccucccgccuucccucuggcuuccucccuccgcugccugcgcgaggggggcaggucccgggcgggccgcgggcuggggguggugcugcccggagggcgggcgucuagggccggaggguggagcuggggguucggggguguacccgggggcgggaggcuggacaaggacggcucuaaauuggcuggaggggcccgucggcggcgaaguugcuagcugggggcagagacggccacgcgguugcaggaguaagagaucccucuguggcgagugcgugagacgaggaguccggcgucccugccauccccgucgcccuccccgccugcucggccccgcuagcuccucuccuugccuccgcguguccccuagcucugaccccuuuuggcucccgguucgcugccgcagcacugccgggucuccuuggcccccgcccugacccuuucggccuccggcuuccccugaccccugcuugcuucgccacugccccguucccguuuucuucccucgcuaguuaccccucccgcuuccuaauucccggugcaauugccucuuugagaccucuuuuuuuuuuuuuuccucuccuuccuuuuagauuggccaacggcuccuuucaacccugccucguugguggccacuggagaagcgcggggggcucccccagacagccguggggacaaguuagagccagcacuuuaccccgggccuugcguguagcuuccccuccccuacucucggugcccuggugucuggagggggguugugggggugugcccgccuuacaugguccaccacccgggcaacccucugggcuuguguuccaucucacucuugcuuccuguacuguggucaaggggaaccacugcaucaugucccgguauagcuaccagagucuccuggacuggcucuaugggggcguggaccccaguuuugcaggcaaugggggccccgacugugcugccuuccucucuuggcagcagcggcugcuggaaaguguggugguccugacccuggcucuguuggagauccugguggcccugcggcacauccugaggcagacgaaggaggacgguagggguagcccuggcagccagccagagcaggugacccagcggccagaggaaggcaaggagagccugagcaagaaucugcucuuaguagcccugugccugaccuucgggguggaggugggcuuuaaguucgccaccaagaccgucaucuaccugcucaaccccugucaccuggucaccaugaugcaugugagucuguugacuuuuuccugggcauccuaagugauaagagucauuuaugugcucaggacacuccauaguguacagcaccucaucccggcgggcagggggaccuuuaaaaaugauuuuccaacgaguggcugccuuugugccgauuucagguuuggcuuucuuucaccuuugcacagugcgucagccccacaguggaggugaggaaccuugugccugaacccuaggaacgacuggcacucacccuggcugccccucccuuccagcccagcccaacccugccgugcccugggcuuucacaagcaggaauuccagccccagccaggugcccuuucugaaucacaucaguggaccaugacccagcucccuugccuucugugguaguuaauuucccaggggccuggugacacucuuuccuggagguggucgcauaaacuuucucaucuacacugugguacuuuggggaaauacuuuuacagguuucucuuaaugacucuuucauuugggaguguaugcucuuagagugaggucugccuuugcauuuugaggcauuggagcagcaccaagcuccuacuaaaugaguucugaagcagguccccaggcugacauguguacuuugggcuggugaucacuauggugagaggguauuucuuuuuuugcaaaccucuccauccuauuacugucauucugucuccuauggucauaguccaagggugcuuaggaagcugauuucuuuaccucaucgacuuccacccauuagcggugcuaaggaaaacaaaugggauugaaaaggcaaguugccagauacauaaaaauaaucugggugaggaccaagagugagacugucuguauucagccuguguggagagauguucuaaagcuauaaaaucauggaggaggaggaagaggagacugggagagcaaucagucuuuuuuagauuucaggcuguggaaaaccggguguguuuuauucaggggcaguuuugaaaccugucauuagcaucuuuacugccuuuauguuuguagaagguuauucuuuggagacuugugacagccuagcuuggggcaggagguugagauuauuaucuccauuuuacaggccuggagggguuuaggaauggcaggucauuugcuugcagccagaagaugaauuagugccuggguuagaaagcaaacucauccaccuugagguugcaagcugucaaccccaaagugaggguggcagugggugguggggcaguccugugggaagacucaggcagaugagcaccacacugucuacccauggcuuggauacuugcuugcacuguguuccuaggaacucauuugauugcaggcuucuggauguggugaaugaccccagccccuucccuucuugcagauaugguaagaagguauggauaacuuuggaauaaaguggcuguuuuugauuggguggcuguaagcaucggggcuggagugggcagcauuuuuuaagagagggcuucuugggaagugaugccauucacaggaaguccagggcugucccagcuagaccuucuguguaaauuugagccagucuucuuucuuucuuuuuuuaugaaugggcuuuuuguuaaugauaggaaacaacgcaucucagccgaugcugugugaggcugucgggacaggagugcuuuuuuaggauggcagguggugagggucaaagggugcaucuucuacaaaguggucuugaggccucuggcaaucacauaucuagaaggucgacaaaggacuaaauucagccugacuggagcugcggcugaugugaugacgucaagacuggcaacaccaugguuuuuagaagcaagauuuuuagaggcucucagaagacucuggagaccuagugcuagcauuaauucauuguaugacuuuggagaaaguacucuuccugggccucaguuugccuaccuugugaaaugaggcagaguugcccuccuagcucuugacagucuaugugauucuugucuccauaagucguagauggguaugcaacagagagcuauucugaaaugcuuuugaccuccuguguggaaaaaaaggaagcuaguuucuucucuguggaagucagguggccaguucccauucauuguuuucucccugugucuucccaguaaaguaaacucaacugggccaugcuugggaacucaugcagaggaugauggcacuuuaggacucugaagccuuaggaugggggcauggaacagagccaugccgaggaguucuugagcuccaucagaauuaugcuucuuugcccuuuuccccuaaaucacugcuuuguaucauuuaaauaguaaccccuggcauaccaggagaccuagccucugauuaauccaacuuucuauacccuccauauggcuuuuccugggaagcaggaauguauggauuuuuaaaaguugaugaguccuaaaaaaaaaaaaauuaacagcagaugguuggaaauaauuuucugucuugguugcagcaaugaccaaugauaguauguauacccagaauaccauaauaccuugcauuuaucuaacaauuacuguuuauaagauacuuucauauacauuguuacuuuuagcuuaggccuggagaaagggauguuaaaauguuuccugcaacaguguauauuccaaagaggagauacuauguacaaagaaauguuuggcaagugaacuagcugaauuaggcuauguuguaguggcaaauucuguggaauuuagaaguccuagcaaggaaagagagauauuagcugaagugaaagggauagcuuagcagagacaugucugauaugugucucucaacaggaugacucaguuuuggcuuuauaaaaaggccuucuuccucagagagucaguguaaguuuguaacaagggagguauugcuuuaggccaggaaauagauaaguuggagggaaauugguuagucuccgcaucucucauuuuucagucugcaacauauucauucccaaggccuuguuacacaggcucucaucauagccaugcugccuuugagugacugccaacuguaguagcauaaggaagggcaguacuuguguccaaguucuguuauugauuaauauucguccugucagauuucauuuuggccuugucugauuucucaaacguguccugggacuguagacugauacaggcauguaugguugaccuagcacugucucacagcuaagccuccagccagagauauuugaguguucucaagaucagcaagcaccaagguuaccacaugguugcuaaaccccuugcuaaauaucacuggugucuaucaauuauaccaauaaguauuucuucaagcauggccagucccuuuuugcuuaugauuuuggcagguaugggugacagggagugaauuuauggagugacuguacuguuuaccaaaaaucacccaguaaguuaguggcacagguggcuuuagaacugagcugccacagugggaaucuggcuuagcaggaagagauucucauagcuauuuaagucuuaaaaaucuacaguuucucagcagaaggguuaaaaugcuagauaguuugacugauuguuguaaagacugguggucuuaauuuaguggcccuuuacccuccuugaguccaguuauauuugucuuagaaacuuaagaaaaagaucccauuugggaugucuuguuuaauuguccaauuccuguugguucuguaugugucugugccaacaucuccugauuaggcacagaacuuaguggggugaagcauaugcaguuuaacccuccaugucuaugcgcauaaggcaggcuguauccaggcuggauauuuggcaaagaauaauuggugcuguugaccccuuagucccaagcuguugguuuuuagugaguaacacugaaucccauccuuuuuuagaguugcuguagcuauuugauuuuuugucuucuuuacaauauauuagaaaucuaacuucaaccaaauauggcuuacccgcuuuugguucacuguuugauuuucuuacuuccucucuccuugcuaaaaguguagaaugacacacacucagaaaguccugagcuuuuugugaaaccccuugcaacucacugaauacacacuguugcauuccgguuguuaugugaugaauuuguuuuagagaagaccugauggauuugagaaacuuggcuuucuguuuucccccuugacuucacaccagacacaccuccucauucuccaucuguugucuggagcacugauuaucauuccugcuuggaauugaaguugguggguaauggguacaauaagggauccagccaucugcugacagcuuaucagauggacugcguccugugucaucaguccagggggauacaaggggaugauguuuauaugggccucacuagugaggcaugacauuccuuuuuaguuuguuucuccccccaaggaaauuugcagagaauuuuuccaucuuucauuguuacagucauuggggguguccauauaaagagaggugcuguggauuggugaauuaaacaacccacaggcagccccaggauuuaaaauuaugaugcuaguuuugcucauggcuugcuacaggaaccucagcaaacuauuuaaccuuuuccuaucucagucuucucugugaaacgggccacauggaaaugaagcauuugaauucucugaauaauuauguggucacuuaaacagagaagcugggcaaagcuggucaaagauggcagaugaccaauacaguuucaacuucagacucagaaaccgacaaagcucaacuccuuauaccuuucuugauagcuucuagaaggcauuccucuaaucauuuuuguuacuuuucucuggauccuugccugugucuggauaccuuucugaugcauggcauauaaaacuggacacuaacucuuaccagagguccagccuacaccaagcagagaggaaguauuuuuuucccagucuuuucaugccuugcaccuguuaauacaacucagcuugcuuuuaaauaacaguauguugcuggccccuacucaguggaugauccacaagcucacagaauuuuuauuccuuugccacagaugggccaccuucuucucagucuuugugagacuuguuuuuaguuuccucccccucuguaaauacuccccugaagauucuccucuacgaaaccuuuccauaggagccugaccugacuccaguaacacuuuuuguccuuucccagccgucugaauacaugucagaauguugggcucuuuaaugaauaccuuuguaugcauguagguaaucugguguuuggccagaucauuuuuuuuuguuuguuuguuuuuuguuuuuuguuuuugcauguuucuuuaauguuucuccaccauuagugggaacacuuuuuuaaaguaaaggaguaguggauuuuuccuuuguaacuccuugcagagcugaauauaauacuguauaugcacauuaauuguuuaauguguaccuggauaauggugacugaaugauugauggaacugacuuuuugcuuuccuuuuuucuuucuccacugguggcccuauguuccuauuaagagaaucuuccagccaggcaugguggcacacgccuguaaucccagacuuugggaggcugaggcaggcagaucacgaggucaggagauugagaccaucuuggcuaacacggugaaacccucucucuacuaaaaauacaaaaaauuagccaggugugguggcacgcgccuguagucccagcuacucgggaggcugaggcaggagaaucgcuugaaccgaggaggcagagguugcagugagccgagaucccgccacugcacuccagccugggugacagagcaagacucugucucaaaaaaaaaaaaaaaaucuuucugccuguuuuuugaaauagccacaggagugaggcaaucucagcuccugcucacacaucuuuuuguagaauuuccaucacaaagaaugguuauuagaaucucuacucuuggcccaaagugucuguuugcuuuucucccaaucaggaaaucacacuguuggaucuugaucuuaaucucuuggacaugccaacuuucuugcuucuuaauaucauauaaauaaaaaauguuauuaagccagagacuuacuuuuccuuuuucuccccucuucucuuuuucaguggauaccucauuguuaugccucauugaaaugaagagcuagguuucucugcuucuccuggucuuucauauauuuuguuaaauugagaaugucuugucucacgugcuccucuccugccaggaacuggcugagugaaugcgaagagacucuggauguggaaagcggugauugucaaacuuuauuuguaaaagagucucuuggaagcuuguuauaaugcggauaccuuguucucuacauggugauucugagcaggucuagggugaggauuggaaucugcauuuauacucgcucuugggugauucuaaugcuggucagccuuggaccccacuuuuagagacauuaucuaguggcugaaguaauuaggugggaaguugguuucagugcccauccuaauugagcaugagucugggugaucugugggcaaggcauuaaguguucuggcaccaucucaauaccuguuaaauagugugauucagauuagaggaugagggccccaaguuauugugaagaggguuuuaagguagcuguagaguuccacuggcuuguuuggugacuguuaguuaugucaauggaguauuucaaccaggccaccuuuauuaccuuccagugauauauggaauauaucccuccaguccuucuauauccccccgcuuuccagucucuaagaucugcagggacuaacaagagggaauguugacacaugguuuguuguaugcuaacucucuguuugcaggacuguuguuuuagauguucgugggaguuuauucuuucuugcguucacucaacagauauuuaucgaaugccuauugugugccaaacauuggugccagguauuggagauucaaagagaaauaagaagcagucauuguugauguacuuucaaaaacaaaaccaaaaacaaaaaaaaaagaagaaguagccuuugccuucauuuuguucacaguuuugaugagauggacaaggaaauagaucaacuaaauuacaacauuacauguauaguaacagauuugaacaaagcauaggggacaggggucuuuuuuuuuccuaaugcaauuaaggaaagcuuccuagaagagguggcauuugagcuggcucauguuagcuccaugaaagcaaggacccuugguuuuuguucucuuagugccuagaacagggacuggcucuaguaggugcucaauaaauguauuugaaugcguaggaauucauugggugauggaggaaggaaagcaauucuaggcauaagaaacaauaagugcaaaggcuaugugcuaucuccccauuucuccuauuuaauaucuauucacuuacccaggguucaaguagacaggaagaggauggauguggagagcagugauuaucaaacuuuauuugugaaagaaucccuuggaagcuuguuauaauguagaugucuagcucucuucauagcaauucugagcaggucuaggaugaggaugggaaucugcauuuauaagaaacucccagaugauucuaaugccugugagccuuugaccucacuuugagagauccuaccauaaguucgcagaguugcuuccuccuucacagaaaagugucucaacuguaaccuggaauuauuugcuuauuauuaucagggguagaugucuuacuucucccuuggccaacuaagugaaacucuaggaaugcucugucauuucuaggcuguugauaaacgaccugcagaugcccuugaauccucgauaggggaugagauagaaaauuguguucucugugcugucccaaggagggcccacacugucaacaacagaggcacacaacauugggguaagugaacagacauuaaaugugagaaauaaggagauagcaggcaucccaccugcaaccaguagaugcuuuuuaguggcuuguggaugguugcugcucuaaaguccacagcagcacuaaugaaguguggugccaucuuucuaccuuucuuuuucauaucucuucuucccuguuuccaagucuguccaccugauccaccccacacaaguuccaaaacaauccuuucuauaauucaaaaugcccaucucaucagaggagaugauagccaugggggauuaggaagaaagcaguuuuauuucagagguucauacugaaaugugaguggacagacuccacugggcgucagggagaggaugaguuuuaaaaaagggccuuguuacccuaacauuauaucuaauugguagacugugucuaguguuuuuaagcagauguccuuucucaugugccuugcucagguuuuggccucuucucucccgcuaaagccccugaucaggagaacuggaguuauccaugccuugccacccuacaugcugacccccaggguuucauauuaauguaaaucucccuccacagugcuuggaugcagcaguuaaucugaaggccuggcgaggaccccucuucugggcaccagucaguccucuguguuuacucagcucuuuccuggcuacacagggcagcgcuugcacaucugucaguucaugggcaucaaggcacuuggaccuguuaccagcaugagauccugaagggaaggguuugggggaucucuugauugguuuugguucccgucuaguagcugcuggaggaaauggcagagggaggaaggauaauaugaguuuuauucugagcugggugguguugagggaagggaauggauugcaggagccaggaggucagacaggauuggccuguuuggcgaaaacagugcaagcucugcccuguggccauguguuuagguggguaggagagggaggagugagaucaucuggaggggaaaggaagcaugguaccauccuaauucuagcccagugccuucagucuccucauguccaucacaugccaguauugguauaaagucaggguguauuuugccugugaauugaauugucuuugccaaucgaccagcuguguuugcagaaagacucugacugacuguguucuggcuguugcuagcaaagagacauuucauucaggugcugauuaaauaaggugcagagccagauugcacauuaaggcccuuaacuauggcucugggaguccuggguaaacacuuauuagauguucugggcagagcacaaaaaggcugguagucagguguucucuucagaaaucagguugaaggaaaaugggguaaagagagacuucuauaaagaguuuugaucuucuuuucuuaacauuaaucagaucugaguggcugguguguacacaucagggccagauaaguuuccucauuggcauuuacuugccaaauucuugcugggacauuguaggcuuggacugggauacagcggggauccugacuuaaguagggcaguaggaaugcuucauuuuccuaaugcaaguucagcuugguggauagagccuuuggaccauauuuccuggguuuggguuugagcuccaucaccauguaaccuuaggcauguuacuuagcugcaucuguaaaaugggaauaauaauaggguuguugugaggguuaaauaaaauaauuuaaaucaaguauuuagcagaauuucuggcuuauugugugcacuaaauaaauguuagcaguuuuuaauaguaauaguauuacuuaacauuucaagaucauagugguguauuggguaagaguacaggcucuagggugguaaaagccuagauucaaauucuaccacuagcucuguaaccgugggcaaauuacuuaaccucucugagccuguguucccacauucauaaaaugauaugaucaaacuugaacauuaccagaguuguugugaggauuaagugagaaaaaugagaaaauauuaauaaagcauuuaagauaguaucuggcacauaagacacauucaauacauuuaaaugaugaugaugaugaugacgaugaugucggcaacuaagauggugagggugaugaugacagucaucaucauucucacuauggcugcugcuucgagccugggugccuguuguugcaauaagaugguagggauuugauacaggaaagcuuuuccaagaaaaucuucccuggcaucauaauuucaugcagugggcaaagguauugguuccaugaaguuagcacccauguaauaauuucugcgggacaggguuguuuggcuguuugaggcuuaaggacguguuuguggguaaugugaagguacuuuaaauuauccaguccuuucugggugacugggugauucuguuuaaaauggcaacucuucuuacaucucuaagauuuaaagaauuuagaagguggcucucauuguuaggaagcuuagcuuuccggggaccuauuggcuuaauuauuauugcucuuuaucaaugggcuggcuccauggugcaaacucucuugagauugguagucuaggaaaccagugaguuugugacagaaguaugaaaggagugagcuugggggaauggggugggcauagacuggugaauggguuuuuuuuuuugguuguuucuuuuuuuuuuuuuuuuuuuuuuuacuuuuucauuuauuucuuuugauuaaggggagugcaacuuucuccagugccaacuauuaccagagcuggguaacuguuggaagagaaagggccacccccagagcuccugggugaaaggcagguucaagugaacaaguaucuuagcugaaggagaagcacaguauaguggaaacugugcugcuuucaggagaagacuucacugugccuuggcuuuuugcaucagcaaauggacagaaaaaaaccaauuauucuuacaucuccgggauaugguaauccucucuccuuaagaccagcucuccuccuuuucaagacuuugcucuggggccucguuuucaagacugaggucuggggccuaagccaccaaucacuagagaaggauccccuuaagagcagccuucuggggccuagaccuugaucaugugauuucaggccuugggauguggggggugugcuguauccugccaaggccauuggaaggccucugggcauauucccaagcauuguggguaagaaggcuguuucuuagucuuggaggugggagaauugagaaagcuaaggucauguuuucuauaaccugguuccuggaagaggagcugguuuagagggcauuucuaaacaaacagcaacccaaauaaacagcagcgcuuggaaauuaguuaugaaaguucacacauucuaagaccuagggaagauuguaacaaaggguccucuucauaucagcacuuguucauuguugguuugcauuuguuaagaguuuccuuuuuuaaguuccaggaacuugagugugugugugugugugugugugugugugugcgcgccugucacuuuauucucugcacccugcaggaauguugcucagagucaugugcacaagugccucauuaucagcagcgcuuucacacuuggucccuugggcugccacugcuacuggcugcugcuucauguggguauuucuaccuauuuccuggagccccagccccacagggaauguuggcacccugaggaaagggaccgccucuacauuuggaucucccuucugcugcagggcagcugacuuuacucugcuuucaaguucaccuuuccucagaauagcccugcaagcuagcaccaagccaagguuauguuuccuugcuugcaugugggguuucuggccagucagccaagugaacugauugacccccagcccuguggggaauuucagggggguauugucuuggucaucggagucagggguggccuuuaggccaaggcugcauuagcuuuguggagaagaaugugaagcccgccgugucacagggucugcugaccggcuggguaguguuuggccauaucucacagccagugcuguguuugcucagauggacgcacauggaaaccaggcuaggaucaucuucccaaaugucuuacucccugcuuugggucuguccugaaaaacaauuugcaaaguacauuguggucugcaccuguuguuuuuucaucccccuuuuccacagucaguuugcagugaauggaggauuaauccuggcucuugccacuuguauuuucucuuucccuucuuuccuugacguuggguucuugcuuuucaguuauaacugucuguggacauuaaggacagcuggugccccugaucauuuaggaccucccuuaggccuuuaaaacgcuggaaauguguaacagggccggaugggcaaaaaagagucgaauuuaggagaaaacucacuauaauuucugguuaucuuuguacacucucagaaaagugaggagugguaguaauaacacuuguaacauuuuugaauacacguuaauuaugcuuuaggcauggugcuuagucuacugccuguguauuaccucauuugcagccuuccagaaagguuguuuuuuguuucauguaauuuuuuguuuuuuugaaacaacgucuugcucuguugcucaggcuggaguguagugguaugaauauggcucacugcagccuugaccccuugggcucaagcgauccucuugacucagccucccaaguagcuggaaccacaggcacgcaucaccacgcccagcuaauguuuuuguuuuuuguagagauggggucuugccauguugcuuaggcuggucuugaauuccugggcucaagcgauucuucugcaucagccucccaaagugcugggauuauaggagugagccaccacaccuggccuguuuuaucuaauucuucuuuucuuugcuucuagcugauuuccccuuugguagacuauaggcacuggauguucuagcuguacuuucucagguuguuaaaauggcagagugauaccaaaucagagcugaaagaaaccucugagaacaacuaauuuguuucuuuuucaucccuuguuuuccagaugagcaaacugagacccagagaggugaagugauuugcccaaagucacacagcuaaauagaagcagagcugagucuccugacucccauuucaauaucucucuauaauaccacacauggccuccuucuauccuuaaccuuccagcaugaaaggaacuagacuuuucuucuugcucacuauuagagaaauggaaaucuugugcuuuuugagcaucauuguuuauugccuucuugaaagugaggaucuccuggcugcaggccaccuccuuccuuucuuucuuucuuucuuucuuucuuucuuucuuucuuucucucucucucucucucuuucuuuccuucccucccucccucccucccucccucccucccucccucccuccuuccuuccuuccuuccuuccuuccuuccuuccuuccuuccuuccuuucuuucuuucauuuuuuuuuuuuuugagacggaguuucacucuuguugcccaggcuggaguacaauggcaugaucuuggcucaccgcaaucuccgccuccuggguucaagcgauucuccugccucagccucccgaguagcugggauuacaggcaugccccaccaugcccggcuaauuuuguauuuuuaguagagaugggguuuuucaauguuggucaggcuggucucgaacuccugaccucaggugaucugucugccuccaccucccaaagugcugggauuacaggcgugagccacugcgcccggccugcaggccaccucuuuaccuggcugguauagcaacuguuuuuuucaauuuacuuuccugcccuugcuuccugucuuccacagaggagucuggcccuggugucaccauuacuugcuguuugcccuggacagacaguucacagggaugugugugcucacugagccugcauguagagccaguauggguugcuugcagauguugguuguuuggaaaugggacccacucagcugcggauauaacugaggccaucauuuccugccuccaaauagaggccugcaucuaauccuaguaaacaguuguauggggcuccagggcaagggaucaaaauuagaaccuuagucuagcagaggugacaaaggccaaagaagaaaaacgucagaauaaucugucagcccaguaguagagguuaguucaucuugguugaguaguagaaacagcacuggauuaaggguuagccagaccuggguccugguuguagguucaucacuagcugguugacaaaacugaguaauuuuggccauucagguagccucucugugccucagucuucuuauauaauaagaaauagagugugguaguuaaaagugcaggcucuggagccagacuagucagguucaaaucccaguucugcugcuuucuagcugugcaacucugggaaaguuaauugacauaucuaggcaugguuuuugauuuguuuuguuuuauuuuguuugaggucuuccaaguucauuauuuuucuuguuuauugcuagaccaguauaccuaaagccucugggucuguuuucuuaucugcaaaauggggauuaauaguaguaucuacuuuaugggguucuuguaagaauuaaaugcaugacuacaugugaaguguuuagaauaguggugcauggcaaguguuuaauaaauaugaguauggcuguuaucaucuguaagacagagaugaucuuugcccuucuuaccuuauaggguaaauaugagaaucaagucaaauaagguaugugaaugugcugugaauauaugaaugugcugugaauauaagaaagugcuaucaaaaugagaacaaucaucaugucuugagagcaggaacauuuaaacauucccuaggccaccuguuucuagaaucagauauugauguuauuuccuugguagccuggcaaaagggagaaagguagguuuguauguaggguuauauaaaugcuggggccaucaagcaauguagauccugcuuuuuucuucccaguguacucaagagggcuugaaagccaugcauccuaaguaaagugguugggggauuuggaaugaaacaguaucaucugccaugauacuguuccuucaguacucuuaucuuauuuaacagcaucacaauccauccagugacccagguuaaaucccuagaaaccuugauacaucucaauuccacccucuuccuccuuuucaucaucauagucucagucaucuugauucugccuuucaugaucucuuccauuucucuuccuuuucuucuuugauuccccugcccugguucauguuguuguuuaucacugucaucaucaucaccugucuuguuagagcagccuugugauugaucuucucuccucuauccuuuacacuacucuauccuuuacucuaucuacuacucgacccuuuacacuacugccagaaugauacaaguaaaauacauguuggaucaugccauucccuuccuccaaaaccuuugauaacuccuuaaugccuucaucagggaugguaaacacauagaugcauacacuuuauauugucccuggccgacugugcuaaucaaucauaggcacgcuuucccagggagaguccaaguagauuuaaaaucuguuuagcauagcauucuagguagccacuuaucaaucagucagagcugguauuaauauauagacuagggauggcacauagauaaagccuguagagaaaucuuaaucuccuuaugauaggauucgguaucuucugugauuuuggucccaaccuuuuuuuucagccuuguuauuuaguauauucuuccauguguucucugauccagccaccagcaccaugcacuuccauucuucucugaguuuauacuuuguuuaugcugcacuguuagacagaaauauucuuucuuuucucuuccuguugaaaugcuaguuaucauucaaggcucagcccaaacacucccucuugugaagcugucuucaagccucuaagccggauuuagccucucuugucuauuuuagcauguuauucugccuuguauuauguaauuguuuguguaucuucccuacuccuuagauuguauguucccaaauguaaggucuauguuuuuauuaauuuuuguaucccccgcacagcuucugguacauucuagauuccuaauuuuuuaaaaauuaagucuaguccaaucccuuuguuuuccagaugaggaaacuguggcuuagaggaaaaggucauuaguucauuuugggauuuguugauuuucagauguuugagauguugaggauggauuguccagcaggcuauuaagauguggugaaggcuagaaauguugauuuaggagguauugccuucgagaagauaaaggaggagaagaggagagcaucaugcaagcuagagaagagaaagaagaaaaguauucuggggaaugucuccuuugggagcagaaagaagacucugacggagcagccauccaggaaguggaaugagauccaggagaggaaggaguuucagaaggcaggagcugguccucuaugucaugaaauguagagggugaggccaaggaggaccugagagaagguaauuagauuugguguuuacaggcuggucccuguggccagccaccccacccacuuuaaaauauuuacucuacaaauguuaaugugugaagaguugcaugccagaauauuuauggcaucaguguugguggauacagaacauugggaaacaacccauuaauagcagaaugguaaaucuggccagugaauaguauagcuuuuuaaaaggaggcugaugucugaauucacuuucaaaguuguucacaauguauugcuaaaauacaaaaauguugcagaaccauauguaugagagaaaccccuuuuucuaaaaaaaaaaaaaaaaaaaaaaaaaaagcccaagcagccucuuuauaugugcauguuuaugagcacauuuuaaaaaucuggaagaauguauacuaaauagcacuuacuccugagugauuagggaaagaggggaauucucauuuuuuaaugaccacauuucuguauuauuugaauuugguuuaaguguagauuccuuuaguaauuaagagaaauacuuauuuaaauaaagaaaggaugauuggcagccugugagaauagcuuuacuaaaaaagauucaauggacaaaggaagccaacucacgagagaacauuuggcaacugagaaaacaucauguguuuuggaggcugugccacaggugccuugcugucuguguggcuggugggggugaggcagggggcauggagagauuauggcuggaaugaggcaguuaccccauugccaggaaguucaguggaaagggaggggauaaguagaagaguagcuaaguggccaagaggcaggcaggggcugauuaagaaggaauuaaaaaagcaaaucuguguguguguguuuguaugugugugugugugucagacagucagauucagugcugagcugcagagggagaaggaaggggacacucauugcuaugaggaaacaucagugugaagcggggagcaggguaguugagaagggacaaauggaauaccaauuuuaguaguagggaagcuuccagaaaagcaugagaucucaggccaauuaagccucugauacauguaaugguuggggacuaggcuggacuagcuaaucgccuucucuaacgguagguuaagaaagcuccuuuuuguuuauguuuugguuacaaaaaauguuuuggcaguagcagacuuauuguacuggcucagagaauagucuggugagugacugaaauggaauuuuugugagcccuugaaggccuuuaagucaucuggaccugcuaaaguuugggacuagaaguggagauggagaacaguggaggucagaguccucaacccuggcugcaucucucagucaccuagggcagcagauaauaaaacacaaaccaaugccugcucccacacccuguucuuagauaauugauuacacuuggggccuggacauaggcauuuaagaaaaaacuccucaagugauucuaaucuguagccaggguuaggaaucaauaguugagaagacuggauuaaauguguucugagccuaaacugaccacuagaaauguguguguguguguguguguauugagugauaucucaauauaguuauuuccuccucuuuauucccaaagccuugggaguggacugcuuguaaaguguuggucccauagccugcuaguuaguuguuuacuugucaagagagaucuaagauguaagauucucaauaauaguaacuaccuuuauugggccuuuucagggauagguuuucagacuuacucugaaucauacagcuuguaggaugggugccagcacuaggacccauaucugccccuuuugagcagagugccuggcauauagguauuugaucauugucacaugaugugacaaggagcuuuguuucuuugugcaaugcuucuuuuuauuaaaaaacccagcggugguaaaaucugacguauuugaaaagucuggugggagagagguuugaggagaacugccuggcauucaaaaagcuuaugauauguuagauaguguguggugaaucuagaucacauaacauguauuaagcaauuacuccaggccuagucguacuagagagauacaaaaguauuagaugugguuucugcccccagggaacuuauuaucaaggcucauuaacagucugacuacuguauuuucagguggcaaguauguacagaauuuaugaccagaaaaugcuagagaucagagaggcuuucaaguuccugaaguucaagcccgucguuuugcagauagagaaagaagcccagagcagaaagcugcuugcugaaggucacaccacuugggaauggcagagccagggcugguguauauggccuuacccuuugagguccuauuacacucuguucugucgcccuugaaggacaggugaaccuaauggccuguguuaaaacuuuaacgauaugcuuuaugccuccaggccuccuuaugguuugggggaggggagguuaaauuuuagucuuucuuaaaaccuugagugggaagggccagcacugguuaccucuggcucaagcccaagaguucuaaagauggcuaauuuucccuuuacugagacaaccacugauucuagucuaauuagggcacuuuccuacuccuccuaagggucuuucccaagcucaguguguuuaugacuuuucuacuucaguuccucauuuuuuuuuuuccuuuuugugaaacucaccuuaaagacaagaggugccuguccuuaugggugggccugagaguuagaggaguggggccaguuccuagugauacuagcaucaggcugguucuuuuggccuuguccccugcuacuucccaagccagaaauuuagauccaaguuuggggcuuucucagaagguucagguauaauucaagguagagguauucuuccuuccagaccccucuccccacacaguuaguauuaggguauaauucuagucaccacuaacaucuauugaacgcuuaccaagugccaggcauccuguggaauagaugcuauuauuugcauucccauuuuauagauaagaaaaauaagggucagggagguuacguaacauacccaaggucacacagcuagaaagugaccaagcugguauggauguguagaucuggcugacucguuacuguuaggcuaauggagccuaacaugaaaauaaguuacuaauuauauuuuuguauugacgaagaaccauuugccaauuuucugcaagccaauuuaaagaacugguugaaagagaagcauccuaccuauaguucuguuccacugugggguggacuguaucaagaggcuugccagucaccugcauuugucaaguaagucccuucccuucucugagauucaguuucugccucuguaaaugagagggucagaccagaugguaucuaagaccuuuucuggcuucauuugcuacuuccugguagaauggaaaaauuguagaauuggaugaaggacacaaugcauuagaaacacaaauguggagagaauacauaguucaucacggauggguuaguuagccaguuacacacuguuucuguuuucccuugugaauuuauaaugaaacauuuuuuuuuucuuuucagugagcuucuugcuaacaucagaaaguacuagcuuuccuuuuuuguuguuugguucuuuuguuuguuggagacagggucuuguucuaucacucaggcuagaugcagugguguaauuacagcucaacuguaaccucgaacucuuggacucaagaguucuuccaccucagccucucgaguaacuaggaccacaggcacaugccaucgcaccuggcugauuuuuaaauuuuuuguagagacagggucucacuguguugcccaggcuggucucgaacuucuagccucacgugauccuccugccaaaguccugggauuacuguugugagccacugugccuguccucuagcuuucuuaaaggagcuguuauuuaauuucagggcuuguagucucuaaaacuguugguaaacguugaauaaaggcugaaggguaacagggcacuuaaauacgagaugccauguuuuauggcucugugugagaauuaguaaaauuuguguucuguuuuacaagagggccuugggagaugaugguuucuagaagagaagcaauugaaacaacagauuguacauguaacuuuuaucuccuugcaggguuuaagagcaggcagauacauaacuaggucuaguguaugguaucauucauuuaucugugugucgugaaaagaucuuguauucaggaacacuagguuaauaaucuacaaaaucuaauacuauuagaaugguaggcuugaucuuaaaauuuuuauguuguuguuauuguuggguguguguguguguguguguguguguguuggcauauguguucuugaacccaguggccuuuauuuuggaugguuuguauaucagcuugcaucagggaaggcucugagggcuuguccccaaagccaggcucuuuccuccucuccugcuggcucacguaugucuccagguucuuauaaggcagaauagacuagguacugcuauuagaaggaacaaaauuauuuaccuugggacaggaaggagaagcccuaacaggugggcucugauggcagugcugcuuggcauacagucagugcuacacaaauguuaagcauucugcucacugguccuaggucaaagcccuugggaugcucaucacuugugggcucagguaucagggcagcugaguuagaaagcccaacaauauugcuauacagagggaguuaaaaaccagauggcaucaaaacccaagcugcacacacaucuuguucuucagcugccaacucugcaccucaaucugauuuuaccuuauucucaccuaggucuggguaaguucauguaauugcauguuccugccaugaauauccugguuuucagaaaaagagugagugagaugaggccacaguguggcaguauuuguuuuguuuguuuguuuuuguuuuuaauguugcucagucaugccacgaaauggguaccuccuaaacacuaacuuggauacccugcugguuugcugccuuucaguuuucuauucacauaauuauuguuugcauucccauucuaauuuuggccucuggucucaguaagaaggagaauugaaauacucagugucacacucauuacacccacgacccucauucauuucacaaacuaaccuccuguauuucuucucuucuucuggcuuggcauagggcuuuugacuuagaucugagcucaaagcuaauuucuauuacucaugagcugugugccuuuaggcaagucacccaaucacugucauuauguuuuucauuuguaaaauggagcuaaaaauucuaucuaccucuucaaguuauuuagagaauuaugugaguuaauauuucuaaagcucugggaacacugugugguacauauuagguauucaaaaaauauuaguuacagucuuccuccuugcuccccaagaaauagagccaguaacaacaaccuuucuucuaauaccucaugaacuucuccuggcauuagcugucugaaggggcugagguuugccuuuucuuuugacgauggagauuagucauuagaaacucuggauuucauccucacaggaaacuugaaguuguugacuuuuguuccuuguuaaagaguugguacgacuggggcggaaaucuccagagaaaagggcguguuccucuacuaauuacucuguagacggcagagggugugugaguaaugagcuguaugcugggugugggaguucagugcccagccuucgggaaaacauggguagguuucauuggcucuuauagcaguuuguggcucccugacucuaucuacccuggagauguauuggaguccaauaguuagaaccucagagccguggguaauaggccuauuaccuacuucuucacaguaaugauaacagcucacauuuauuuugcccuuacuuugugccaggcauuguccuaagugccuuaugcgcaugaacucauuuaauccucacaagaauucuaaaagguagggugcagagcaacuaaauagcuugccuacagucacacagcuagugggguggagcucggauuagaaauuaggcaguucagagaccauaaacuuaaccaacugcuugguugagucucuaguccuuugguuuccuuuuuuaacuuaacauguuauaauuuuguaacugcuggucuuuagaaaugcagcugaucuuugugcaucauuuuuguauccagcaaccuugcuaaaugcuuuuaaguuaauuauaauuaauacaucugaggauucuuuggguucucuaucuuggcaaucguacauaaucugcaaauaaugagaacuuugucucuuccuuuguggccauuauuuuuuuuaauaucuuuuucucaacuuacuguuuuaguugagaccucccguauagugcuuaauacaagugacaauguugagcaacucuuaucuuguuuucugccuuaaaggauaugcuuucaguguuucaucauaaaguaugauccuuacuauaauuuuuuuguugguauuauuuauuagauuauagaaguucccuccuauucuaaguuugcuaagauuuuuuaaaaaucaugaauggauguugcauuuuaucagaagcuuuuucuucuguugagaugaucauauugcuuuuguucuuuagucuuucaguguggucaauuauacugauugauuuucuaauauuaaauugucucuguacuucccagaaucaagucaccuugaucaugauauauuaucuuuuuuauuguuccuggauaugguuugcuaguauuuuacaugguauucuuaaacacugugagugggcugggcgcaguggcucacaugccuguaauccuagcacuuugggaggccaaggcggguggaucaccugaggucaggaguucgagaccagccugaccaauauggugaaaccccaucucuacuaaaaauacaaaaauuagcugggcguggugguguguaccuguaguccuagcuacucgggaggcugagacaggagaauugcuugaauccgggagguggagauugcagugagccgaggucaugccacugcacuccagccugggcgacagagcaagacuccgucucaaaaaaaauaaaaauaaaaauaaauaaauaaauaaaauaaaauaaaucugugagugaaucuggcucuaguuuucacuuuucauacugccuuugucagguuuucuuauuaaguuugugcuagcuucauaaaauggauuggccaaugcugcuuccucuucuucuaagcuuuggaaaaguuugcaugagaucagagugauuuguuucuuaaagguuuguuagaacuugccuauaaaacuaucugggcuuugauauugucuuugugggaagauuauggacuacugauucaauuucuuuaaugguuauaggaauuuucagacauuguauuuuucuuuagucagugucuuuaauuuauguuuugcuaggaauuugaccauuuugucuaaauuuucaaauuuauugguuuaaaauuguuaauagcgucuuaacuauaaacacuacagauauuuaaaagauuucuuccuuuucucucauacuauuauuugcuacuaaaaaaucaaucucacuaguaguuuguaaguuuuauuuaucuuuuauaggaaauaauugagacuuuguugauggaacuguuacauguuuguuuucuauuuuguuaauugcugcuuauuuuaaaaaucuguuuucuccuucauauuuucuuuggaguuaugucucuuguucuuuuccuaacuuaggugggaugcuuagcuuauuuauuuuuagacuuucuuauuugacuauaugaauuaaaagguuaauaauuuuugcuaccuacuguuuagcuacauuccacuaauuuugauauaacauuuuguuauugcucaguuccaaguauuuuggaauuuccauugugcuuucuuaacucauggguuguuuagaaggauuaacaguuuuuuccuaaauguuuuaaaagucaucuuuuuguugcugauuucuaacuuaauaacauugugaucagagaaugugaucuguauguucuguuucuuugaauuuuguugagauuuguuuuguggcccaguaugauacaguguccacuagaucaaccuuguuaauuuugcugcucuucaaucaccuuaccuuauuuuuucucugcuuaaucuaucaguuacugggagauuuuuuaaaguuuaccaccacagagguagauuugucuauuucuucuuuuaguacuguuaaccuuuacuuuauauauuuuugagguuguguuauuagguauaguauguuaauuuuugcauuuauuguuacaucuauugaucaaaauguucaauauaggggucccguggcaacuuagaguguggauagaucuacaugcuauaaggguggcuugguaauggugaaagcaucccucugggugggcuggguaaauuggauuuucagcuccagggaagaaacacccuuaaaaucaaaauugcaccuucuugaagaguucuuaaauuugacauugccaaacaaaauuaacacccucauauccucaagugccagaggcuuuugucguuauugaaaacacucuuaaaagcugcauuccuucugggaugcaugagggguugggaaggaaagcuuuauuuuucaugggccuuacagacauuacuucugguuggucagacauguuucagacccuuggacuuucuucuucuuacugccuaguauuuucuaugagacuugagccaaauccuguuaccucucugccuuuuagguucaaugacugguucccuuuuccccugacagaagugagguguggagaaauugaaauaauaguugcauagggauucuaaauaauuuauuaguucccucacuugcucugcaggaaacaaaaauaaagucuauagaagacaguguucacgaggaucaagcaacagaaaugaugucagcuauucccccuuuuauuagauuuucgaauggaaucagacuaugugaagcuggaaggcauacagagagacaaauuacauuuggucacauaugggugggaauggaacuuuucaguccagcucuugagccuauguggugcugugaaaucuuauuuucaugcucuguuagggcagcagcuccugauucugauugcguuuccuaaauaagcacucugagcuaguccucuuugcuagcccuuccuugcuacucagagaguuucaaugaagggggagcaggugacccaguuagggucccuuguuucagguguucuuucauuugaauguaacaauacuucucugucucuuuuuuuaaaaaaaacuuuauuuuuugauuauagaaguagcauaugaucauaaauuaagaaauuagaaauauagaaauauagaaaacaaaagugaaaguuucugguaaucugucucccugaccuguucucuucucucccuuuuucucucucuuuuucucugucuguuuuuuuuuuuuuuuuuuuuuuuuuuuuugaggcugggucucacucugucacccaggcuggagugcaguggcaugaucauggcucacuguagccuugacuucccugggcucaggugauccuccugccuuagccucccgaguagcugagauuacagguacaugccaccacaccuggcuaauuuuuguauuuuuuguagagacaggguuucacugcguugccgaggcuaguuugaacuccugggcuuaagcaauccuuccaucucugccucccaaagugaugggauuaugggcaugagccaucgcauucggccucuuuuuuuuuuuuuuuaacauuuuuuuucguguuuuuaaauguggguuuuauuauuguucagaugugaaaaggccaacggaucaagagacaguugccauuuaaaagauaguacauucacugggugcaguggcucacaccuguaaucccagcacuuuuggaggccgaggcgggcagaucacaggauuuugagacuagccugaccaaaauggcgaaaccccaucucuacuaaaaauacaaaaauuagccaggugugguggugggcgccuguaaucccagauacuagggaggcugaggcaguagaauugcuugaacccaggggacggagguugcagugagcugagaucgcgccacugcacuccagccugggcgacagagcaagacucugucucaaaaaaaaaaaaaaagaaaaagaaaaaagaaaagguaguacauucuuuucaaaaggaacuauuaugauacauugugucuuauaauuuuuaaaaauuuuaaaauuuuuuauuauacuuucaguucugggauacaugugcagaacguguagguuuguuacauagguauacaugugccauggugguuugcugcacccaucaacccuuugucuacauuaaguauuucuccuaauguuaucccuccucuuccccugcaacugccgacaggccccggcaugugauguucccuucccugugcccauauguucucauuguuugacucccacuuaugagugagaacaugagguguucgguuuucuguuccuauguuaauuugcugagaaugaugguuuccagcuucauccaugucccuguaaaggacauuaacugauuguuuuuuauggcugcauaguauuccaugguguauaugugccacauuuucuuuauccagucuaucauugaugggcauuuggguuuuaacauuuuuuaaagaguugaggucucacucuaucacucaggcuugagugcagcagcacgaucagggcucacugcagccucaaacucuggugcucaagcuaucuacccacuucagcuuuccaaguagcugggacuacagaugcacaccacuauguccagcuaauguuuuauauauuuuuuaagagaugggggucucacuauguugcccaggcuggucucaaacuccuggccuuaagugauccuccugccucaaccucccaaagugcuagaauuacaggcaugagcugcagugcccuucccuaguccuccuuuuuauaauaauuuuaaaaagguuuuuuugcuuauuguuauuauuuuuaauuaauccauaauauuuuauauauuuuugaaguacagugugagauuuugauacacguauccauuaaccaaugucucccuaaucccuccuuucccccuaccuuuccccaccucuaguaacuacuacuguacucucuacuucuaugagaucaacuuuuuuaguccugcucuuuuuuuuucuuuuuauuauuauuauuauuaucauuauacuuuaaguuuuaggauacaugugcacaaugugcagguuuguuacauauauaaagaccucggcuaaugugaaagaauaucuccuucucacucucugaucuuuuccuuuaaauuugcauuucucacaaaaguguagugugaaaaaaaauccagcuugaugggggagagggcuccagauuuuacagaauauggcugcaugaaguaaaggucagggguugaaggaacuggaauuaaaaaugccaauuacucaucuuuauuuaaaaauggguaaauauaaggcagaaaauaauauuuuagguacacacauccugaucuagcuauguuuauguguguuggggugauggauggacaagagguauaguucaaaugagaucauuuuugugaaauggcuuuguaaacuguaacaugcccuauaaauaugagauuagcuuuaauacuggcccugacucuccaguguggcuuuguguguuugucuaaacacuuaguuaauaucugucagugguccauugcacaaggaacugacacaaugguauccugugccucuguuguuguuguuguuguuuuuuuuugcaguucuaaaagcuuaguuaauugccuucauuagcuuaauauauaccacgugaaaagcauagaaaagcagaacucaaaacucagagaauaaaggacagaacauaacuaacuacugaugugcaccuuaguuaccugaugcagggaauugaagcauauaagcuucaucuaguacuaccucaaauacaguaaaguggaugacagcacucgauaaacuguaaagcugaauaauaaugccaaggauuguugucaucaugacuacuuagauuggcugucacccagugacuuagcugugauaugcuuccaggcaguuccugagagguccugcaagccccuuuccuguacaggugcuagaaagugccauagaaauacagucuccugaugacuguaaaagccaggcagcuaaauuuaauaagacauuugucaaggagauggaagauuauggccaauuuugguagacagauaguugccggcuaaaacaaagcauguauugaacuguuuuggaguaggaagaagcauugcuaugacaacaaauuacuuauauuugauuuagaagaaggagagcaguguagcuuaaugguuuagaaagcucaugagaacaauuguuggcacggguuuauguuaaaauauaaaauguuaaguaggaucuguuaaauaauugagcaccucagugcauucugucucuucucucacugucucuaaccaauagaagacaauauaaauaaauucaaagaaaaaaaagcuagcagaauuacaugcaaauuguuccauuuuauaaggugcccaaaugaaauucacagccaaaauuugcuggaaugcaaaaaaugucguuucuuuacaggaaaaaaagaacccagagaccuauucacuguguuuucaugccauccaaaccugaugaugguaguuuggaguuucucauucuguaggugauuaaucuucuuugugauugguaguauguuuuauuugaaaagaaacuacacuucagaccauuucuauccuuuggcuguguucaugccugagagaaugaguaaacagucauuuguaugaacugguuauuuguaguuccccuggggaaguagguaucaggcagguagcaaaggcaucuagcaucuggaggaagcuuguggauauagaggcuuucucuuagaaagauagcucuuuccuuuuccuaaagguaaaaccaaacagauggcccauauucacuggggauaggucucagggucuucuucaucggguucugaggguggguagaucuaaggacuccuugagggcucuugaggcagagaaucagauacuuucuaaucucuccuuuuuugcuuuucccugauccccacuuuuacccaguaccaucuuccuguuuuccccuuauacuuccagaacaguacaguaaaguaggaaacagggaaaagcuuggaaaauggaggacugacuccaagaggacaggaauaacuacccucagcuuuuaaacugccucugcaggcaaaacucacaaauuuguauucccccccgccccaccgcccacccaacuucuuuggagggaaaaauuccauuggucauuaauacugggaggaggccaugucauagaguucauucagaggcggaagacugaaaauaauaagccagaucuuaggcuaaccuucuccuguaacagagaagugacccagaaucacagcuguuugaugaauaauagaauuugccuggcauauaguuuaaauuucaccuucuuaugugacuugguguucuguguuuuacuaguuggcaucaugucagaucauguucuacccuccucggaaacuucuagugcucucaguuacuuacaaaauaaaauccagaauuggugagcuguuccuuaaggcucuucaugauguggaaauagaccucuuagaaaaagguugcaaaagcaaugcauacucauuauagaaaauuuggaaacuaaagaauuuggcaaacuuuuucuguaaagggccagauaguaaauguuuuaggcuuugugaaccaugcugugucugccacaacuacucaacucugcuauugaagcacaaaagcagcuacagauaaugccaguaugugagugaauguguguggcaguguucuacuaaaacuauauacaaaucagucagugggccacguuugguucgcggguuauuguuugcugaacacugcuauagaaaauaaaacuaguucaaccauuguggaagucaguguggcgauuccucagggaucuagaacuagaaauaccauuugacccagccaucccauuacuggguauauacccaaaggacuauaaaucaugcugcuauaaagacacaugcacacguauguuuauugcggcacuauucacaauagcaaagacuuggaaccaacccaaauguccaacaaugauagacuggauuaagaaaauguggcacauauacaccauggaauacuauguagccauaaaaaaugaugaguucauguccuuuguagggacauggaugaaauuggaaaucaucauucucaguaaacuaucgcaagaacaaaaaaccaaacaccgcauauucucacucauuggugggaauugaacaaugagaacacaugaacacaggaaggggaacaucacacucuggggacuguugugggguggggggaggggggagggauagcauuaguagauauaccuaaugcuaaaugacgaguuaaugggugcagcacaccagcauggcacauguauacauauguaacuaacaugcacguugugcacauguacccuaaaacuuaaaguauaauaauaauaaaauaaaauuaaaaaaagaaaugaaaaaaauaaauaaaaaucacucauagucuugccacaaaaauguuaacauuuuugcuuauucuccuucuucucuucacauuauuuuacaugcuugugucuauacuguauauugccaauuuuauaccugauuuuuuucacuaagcauccucauaaacguuuccuguguuauuuaaaacuuguuggcauaacucuuaaugccuaugugguacuccauccuguauguaacuggaucauaauuuaccuagccauuuccuuuuuuuuuuuuuaggggggauggauucuugcucugucacccaggcuggagugcaguggcacgaucucagcucacugcaaccucugcuucccagguucaagcaauucuugugccucagccucccaaguagcugggacuacaggcuaccaucaccgcggccagcuaauuuuuguauuuuuuaguagagaugggguuuuaccauguuguccaggcuggucucgaacuccugaucucaagugauccgcccacuucggccucccaaugugcuccuauuuuuuuuuuuuugcaguuauaaacuuuaaaaaguuuacucuuguacaaaucuuuguguuucacauuauuuuguaggucacuuuccuugaaguggaguuaccaggacagggguauggauguuuuuaaggagcuuaauaucucuuuuuuuguuguuuuuuuuuaaaaaagguagugcuuauguacauuccuacuagcaguggggacagagagagccucuuccaacucauccucaccaacaucagauauugucacuaaagcaaaaucuuuuuuuuaaagcaaauuuuaaaaaaauggcaucuaaguuaauguguaauucuuuguuaaggugauuggagaaaaaguuucaaaugauuguugaaugaugaaugggaucacauaguucuucuuuggcucaguuuuucauaaauguaccuugggcccuaacuugcuucuccuuuuccucaugcaguuacccccuuucaucuuucuggcuccuucuguuaaaauucuacuuauucuuuagggcucaauccuaucuguauucauguaccugucuguggaguccucccuaguuccuccuacucgauaugaucucuugccuuugaaucccuguagcacuguguaccucucuugugguauuuaugucuuucugccccuuuuuuugguuaucucuguacuggcuuuaugccuauggcauggacacuggguaauguuaucuuugcauugacucccagagccuaguagagagcuuaguguacaaugggcugauuagccuaucagagcuauguugaaaggugccuaaggucugcugcagaugaccuuucaaaauauucgauguugcaauuaccugugauguuuacagaacggauugggaucacugauaagagaugcuuugcugguuacuuaagaugggcuguaucuauaaguccuagucacucuuuuuugugaaauuugaaucaucaaauuuuccaaguagugauaaaaaacaauuuuagcauauguuaggcuauucucuuguguaucugguagaaguuuaugugaugauggaaauguuuuauaucugcacugucugauaugguagucaguggccacauguggcuauugugcacuguauaugugguuacugcaaaugaggaacugauuuuuuuuuucauuuuacuaauuuuaaauacuuuaaauagccacauguagcuagugguaaccauaugggacagugcaggauaauguagaauauuuaaaguuauggucucuuuuuuauggccaaaagaagcuggguauguauagugacccacaguaacauugacauuguaguuuucuggaauuuuggagaggcagucuagacccugguagagccguagagagagagagagagaggggaagccauaaguuugguucaaaauggaaacugauuccagcgggagguguauguugugagaaaagggagaugaugccagauugguaggauaaaggcagaguacaauaagcuggaauaccuagaggagacauauggacaugauacgauuggugauagggaaccauuaaagauucaugaaaagaggagugauagaugagugugguguugcaaggucaccuuugccaggcguaugaagcugcugggaaaggaugugaguuauuggccccuccuucaguggauaggguugggcaguagugauucacaaacuccaucaaaacccagccacaucagaaaacacaaaugauuuauuuuugcauuagcuuccaguuauugugugccuuccugugguucagauauacaccaccauauauuguggagggcuuguagcuggggggcuguggagaauggccgccuaugugacaggaggcaggccagucaccucugcuuagccacaggcaaaauugccaucugugacccugguaccuugaaaggugugucuugaauggcucuuugacucuucagaaacaaucugggagcccauucauucuguucucacuugccugcuuccuuuaagggccgauagcaaauuucuaauuuuacuguuaggagaauauuuucaaucucauuuuuuaaccuuuaaauuaaguugaaccuuucaauuaaguugaauuaauauuucuucccacuaccuacuccuuacugcccucacuccguccuuuauuagauugcuuauauuuccauaacugcaucgugaccuuagcacauggacuuaaucauuaacuaucguauuccuaaagaacagccuuuggacucauuuuuuuuuuuuuuuuuuuuuuuugagacggagucucgcucugucgcccaggcuggagugcaguggcaggaucucggcucacugcaagcuccgccucccggguucacgccauucuccugccucagccucccaaguagcugggacuacaggcgcccgccacuacgcccggcuaauuuuuuguauuuuuaguagagaacgggguuucaccguuuuagccgggauggucucgaucuccugaccucgugauccgcccgccucggccucccaaagugcugggauuacaggcgugagccaccgcgcccggccuggacucauuuuuaagaaaaagaaaaacacuauuaaagggauucucucucuucucacacucucccacaugcccagcuaacccagccacccucauucucuacccuaccuguacucccacccuccaugcccacuuuggcucagggagaugguccagcugaggaacagccucccuuuugggaaaacaugcuccauuuaaaucauacguaguaagucuucagaaacccugacccuggaggggcuuugggacacaacugacaauuaaaucuccuggugucaggagaucuugcaacugagaacugagugccccuuccaccucacucauaauugacaggggccagugccuugugugggccucaccucaccuggcaucaccacuccucacccaaccuuaccucaccuuaccccaccuuaccccaccauaccucaccucaccuucucuccugcucuugagagacaacuagguaacugugaguagcacuucucccuuggcauagugaagcagcuuccucacugaugcucaauucaaggaaagagaaaaguucuugucuugaguuaccauggggcgggggggaaggggaauuuuuuuuaaaaaacuacuuugagcuucacacuuaagauuuuuacaaaaaucaauuauauuugguuucucuuuugaucaugaaggugguauaguuuaaggguugaggcauggauacuacuggaaucagacacuaguggacuagaauuuugguucuaucacuugcuagcuguuugaacuuggggaaguuucuuaauuucuuugaaccucaguuuacuugucuguaaaauggggauaauaaugcuugccuugcaugguuguuguaaagauuagagagugucuguacagcaugauuccugggacccaguaaggacucaauaaaagguaguuguuauuauuaaagcaggucauuuauguuuguaacaaccacaggguuaagcucauugucccaauauccuuuuaucucaucccucagcaugcuugcuuuugccuuccugaagcugaagauauuuauccucagggcaagagacauugggugugagggauuuaaggagacagauuuucuugacagagggauucuuaggucaagaugaguaaggaaaacucgagagcuggaugaguaaggaaaacucgagagcggccuuugccaaggaaaucuaaagcaauugccacccuguuggagagguuucuguccugucugaagguaggaaugggggauagauggaugaauggaugacagccuucugcuagccuuuugaagaguacauucccaggaaaauagccucuacuuucugcagugugggagugagggcgggggauggauauuguuuuugagugaaggaaaccuuguguuccauacuuaagcaucauguucccccacccugggaugcucuguuggccugauuuaaggaaagcuuuccaguugaucuuuuaaucuucagaaauaacaccagaaaucaguuaugccaucacuuuccuuauaaaacuaacuagcuuucauuuagcagauuuuguucuagggauucagugugucuggauauugaauuuuuguacugccggggcaagguuuucugagagugguauguuugauguguguggauaagggguuggggguggcucagagggugaggguguggagcauugucuucaaaaucccugagcaaggcugaggguguuuccaugucuacugcccuaaugaggauucuagcgaauaggggcagugcuggcucauucauagauauuaaaauaaaauguuaagugggcuuccuucuaagagucaacucuaaggcauucucuccaaauuuacuugucucuguugcuaucucuuuuguuagaaugagaagauacucuugaaaaacuguuuaugauacaaaucuauauguuaaauccuacuuuuagugcagagaggcagcuugcaaaaaguacauuccacggagagccuuuuagacaaacuccuuugguaaugugaauuguagccuuugaauuucuugguuguuaaaucuugauuuuuauguauagguuugcuucaagcaguuuaccuauuuuuuacauuuuaguagaacgacuggguauguuccuuuuauaaaauacucagggaaauggaaccagugucauggucucccuugaucuaaguucccagagacuuaagaccucagagcuguagcagcaacucagcgaguuccaucagcauaccgguucccagcagcuuuucuuuaucuguauuuuaaggaguuguauacagagucacuuuucaugaugacaagaugcaggguaauaugauuugaaaaaagaacugaaugaaucuuuuuuuuccccucuguauuuuaauggaggcaaacugaaugaauucuuuccuuagucucuucugcuggucuuugccuugguugaaaccuccuuuucccuuugcucagccacccucugggguuaccugcugcuugggcugaaguccuaaggcuuagcgacaaguaaccaugucauguugccucugaggcuagugggcacagcugaacacuaauauuugggcccuaacuuucagcuugauuugaagaaaugccacugcuaaaugucaucuuuuuuuguggaucccuauuugacugacucuuuggauaaaacaggugggcaggcaacaaauuaagugggaaauguuucugugaaacaaauccguuuaauaguguuaccucauaaauaaguaacaaacacaacucuacccccuaacccgcacuagcccauauagccagaauggaaaaguagauuguuucuuugucgcuucuguuaugguuuuacuuaaaugaauuaucagaucagaccccuguuuguacagaaguuucaaaaauguuuguuguaaauugaucugagccaauuugauuuuccacaguuaauuagauucuauucugguagguaucauuaaucuccaauagucagagguagguaagugcuauagguuuuucccccacaaccaguagauuacagugaaaggaauucugauuaaauucugccacguaacuuuauuaauaaucaggcacaagacaguuauacagccugaccuguacacccagagacauuccaguacuuuuuuugcaaaccaccauacugugugaaggguucaccggagauagaugugacgauauuuuagcaguaggacucagcuuaccuucuaauuagagggcacaucugaguccuccauuaagugucuggacauaagauuuguugggacuccugagccuaaggugucauuuuaaaggggugaagaauguugggcuaaccagagucuuauauccaauucaugcaaaagugggagcaacugaauauuucuaaaugauauaccuguccugaacacuagccaguuucccuaaugaaauauuucuaguauccauuguuguaacgaacaaacgaucagaaguacuucagagcugaggcauguaagugugacuuuuuuccccauuagaaaaaaguuaagguauauuuaacauacaguaaaauucacccuucuaaugguacaguucugugaguuuugacaaaugcauacaguucuaugaacacuccagucaagauagagaauauuuccaccacccccaaagauuccgcugugccuugauugugggauuuuuuaagagcagcuuuacugagauguaauucauauaccauaaaauucaccuacuuaaaguguguaauucagugguuuucauauacuacauuuaaaaaaauuaguuaaauauauacauauaacauacaaaauuugccauuuuaagcauauuuaaguguacacuucgguagcauuaauuucauuugggauguuaugcaaccaccacuccuauuucuagcacuuuuuuuuuuuuuuaaaucacaccaaacagcagcucuguacacauuaagcaauaacuuccaauucuuaccuuccccaggcccugguaaccacuguucuacuuucugucucuauaaaugugccuauucuaggaaccuguuaucgguggaaucauauaauauuuguccuuuuaugucuggcuuguuuuacuuagcaaaauguuuucaagguuguagcauguaucagaacuuuguuccuuuuuuaagggugaguaauauuauauuguauguauagaucacauuuuauuuaucugucaguggacauuuagguuguuucuaccuuuuggcuauugugaauaaugcugcagugaauguuagcauacaaguauuuguuugaguccuuguuuucaguucuuuuggguauguauauaccuaggaguggaauugcugggucauaugguaauucuauguuuagcuuuuugaggaacugccaaacuguuuuccacagcaacuggccacuuuacauucccaccaguaauguacaaggguuccaauuucuacauauccucaccagcacuuguuauuuucuauuuuuaaaauuauagccauccuagcaguaugaagugguauaucauugugguuuuguuuugcauuucccugaugacuaaugauguugaaguuuauuucaugugcuuauuagccauuuguauaucuucuuuggagaaauguuuguucaaguucuuugcccauuuuuugaaaaaacuggguuuuuguugcugaguugcaggaauucuugauuguaggcuuugauuagaaauuucaguugcuaacuaauaucaccccuggaguuuguauucucaauuaggggucuucagauguuaacaauggugugugguaaauguuuaaagcucugauuuauggcauuugccaauuuccauggucaauuccaagcuaccagucugaccccucacuaagguagcaaaggaguugggaagagauguacacaaucaacucuuucuagccagugcuauugggcuuccagcaugcaacagaauguuaacucaccacccuaugguguagaauaaaacuaacacagaggcauauuuaucacagugucuacacugaaacuauuuaaauuaaauuagacauaacuaaauaauuuucaauuacaacacuuuagcuccuucaauaaaagcaagaauaauuauuuguugagcacaucauaugcuagaugugcuccaaguauuaauagauauuauuaguaaauagaggaggaaauguagaauaaguuaguaguaggcugggacuugaagucagacuccaaagcccauguguuugaucucuuuacugcacugucuucuaucccauuaguggaauuuacuuacugaauguugacuacuauaaacagaguagacuacuuucuucuaaccccagggaugcuucuguguuacuuuguacccuccagccucucuaaauccuguucaaauuggaauugaaaacuaaagcuguggugguaccacauaucaaagaacuguaagggguuaaaaauauccuuuuccucguugcaaaaaaagcauguguuguaagaaaaauuuaagcaagcgagaaauggcaaaaauagaaagugaaagucccccauaaacccaucugccagagauaaucauuauuaacaacuagcauuuauucuuucagagcuuuuucuuuacacauuuuuuuuaaaauaacaaugggaugauuccuuauaaucugagucucuuuucacuugauaauauaguuaggcuauuuuccaugccaguguguauagcucuacuuuauucauuuuaacagcuuugcuucauucauuuuaacagcuacauaauaucccuugugugaaggaaauguaagggauuuugaagggcuauuuugaagaagugaugauagguggcacaugggacaaaaagguugaaaacuacuguuggguaccaacaauagaggcacuauacuuuccauuucuccccccagaggcuacuauaacuuaccugaaaccauaagacgaaaauccaugagcacugggaagaguuacaggaaaacucaaacuaagcuagucagggauaauugagagauaagacuacauaucaaauuccuucacaugucuuuagggcuuuacagcccuggucuuugaaacucuauuuggaaucuuucuuaaucuccaguaggcccugcuuugaguuugggaaacauuguuuuccaggaaauacaaccuuuuaauuuccccucaucuguuccucaucuugagagauggccaccaucauguuuucuugcugugauaaucugucagguuuuuuuuuuguuguuguuguuguuuguuuuugagacaaggucuuguucugucacccaggcuggagugcaguggcgugaucauagcucacugcaaccaugaacuccuaggcugaagcaauccucccaccacagccuccugaguagcggggacugccaccauuccuugcuuuuuuuuuuuuuuuuuuuuuuuuuuuuuacuuuuuuucuacagauggggucucacuauauugcccaggcuauuuuggaacuccugggcucacaugaucguccugccuuggccucccaaagugcuggacuuacaggcaugagcugacaugccuggccugauaugucaguuuucagugguugucaguguuucuuuguuuucuccucuguccuaggcacuugucacuaggaaagugccuaaugacuccaucagguguggcauuuauuauuguugcaacagggaauugauaagagaaaagaaggcuaucugggggaugaguuagccaagaaguggaagaagacagcuguuauuagguugcugucaaaauagcuugcuuuacucucuggcauguaucacuccagggaaugaaauaauccaagaaugauaagcucucaauugccaucuguugguuugugaugcugcuugccuuguucuaguuaacauugaacacugaccucacauggcacuuggagaaacuuagaggaggauaagaugaucauaggguguaaagcaaacugacugaacgcuugcagagagaugggcuaaaggccagugguaucaguuuaucaggauuugucugccuuacacucucuuauccuucccucuuuaccccagggagcuggcagaaugguguuuccucuguaauaugacauauuuagauucuuuuaccaguuuaaagaaguuaauuuaauggggguaaagggggcuaaguuuuuaggguuggggucagguacuauccuuuauaagaaagauuauggguguuugaagcucaugaauggacaugucauuaucuuucaaauuacaugcuaaggaucagguuuguaucguauguauuuuacuaugccuucugguccauaucucagacaaaccacucugugccagcugugcuaggugccagcagccaugaacugugccagagacccugccucccuggcuuagguugauuggacugaguggccaccugucaccaagacagcccaucugucaccuagcagguaacaugggcuugacgagcugagagcugggccuuuuguauuccucucuuaggaaauuagaauugggaagcugagagccuaaggcaguuuguaacggaaaagagccaaaagaugauggggaguggagcagucaugacaguucauguccuagcuaguuuuuugaagggacagaaaccaugagcaaacagagggaccuugcaagggaggaacagagaugccuugagagacagaagagcuguuuccuacagacaccaugaacccagaaccacuuuccaguucuccugaggcccagcuuuauccuacccuaggauucaaaugggauaccuguauucuuuccacaaaccucccuuuucuugagccagcuugaaugagacucuguuuucccacaauggaaauuaucagaccagaucuaggcuccuaccuuuacaaucgacuucuggguugagucaacaacaguugguuuacauuuaaggcugacaugaagugcugaagacuauucuagguauuacggggaacaguggaaaaacacagauaccugauuauuucugucaagcucagugcugacguuaugggcuuugaauccguguuccuggcaaacagugagaaugaaaagaggcagggauccugacuguucauuuaucacuucacagcucucaaccaacagggggccuucuuuauccuauuuaaccucucaguagaguauuugccuuuugcuuauuccucuuuccagucaacucuugauuauucauguaauagaggaaagcauuaaugugaaugauagaagacugccccaccuuggccucucuucucugccacagcagcauccagucacagaaauggaaacaacuagcaggagagguaaggaggcugaaaaaaggugggauggggccaagcaaauuaacauuguuucuucuacuuuuauaccuucuuucuguuaauaaaugcugccuguuugaguuucucuucuggugucacuaggagauugcuggaacagcaaugccauuugcuugauuuaagucaaaauaugggaucuuuuaaaaaacuaaaauagaguugggggcaauugacuaggcuguuaguuuccucucccaucuauuguacccccuuuugucagugccacccagcuuucuuguuggcugaguuuaauguugggccacuagcaaccauucuuuguucaggauuugggacucagcuagccaaaauauccacaauagcauuucucaaaguaugguucuugacccacuugcaucagagucaccaugugugcuuuuuaaaaaugcugauuccuuccaccuugaauccauugaaggaaaaaugcuaauuccugggcccuaucccagaacuauugaguccggauauuggagugggggacagaaauggcuuggcuuggaaauaugaauuuuaacucacccaccuccaggugauauuuaugugcucucaacuuugagaaaggcuacucuguaaaauggccugaggggauuuggaggguagcucugggaaauuaucaacccuucucuuucacucacuauuuguagagcaagugaguggguggggagaggaaaguggggcauuccaggugucagaagguauuuuucaaagugcagauaguuaaaggcugucuacugaaaggaaagugaagaaaaauagagaugccagcaugcuaaauuagaugacacuuaacacucaaacauuuguugaauuaaugccugaauaauuaagaguugauugggcagagacacaggaagauuguguuuaaguuacagacuuggcuugcauccguguuuccuucuaaagagaccaccuucuccauuucugcauugucuuucuuuagagugaaaauagcuagucauccccaacauauuugggguuuugugguaauuuaaauaucuaauaggcacugcauaaugccauucaaugguuguaccuaaauauaacccuacuaaucaaaaugaggauauuguguuuaagagucuggcuauauagucucuggucugauuauaguguugagucuuuuuucaaaaacugucucuauggaguaaagcaggguccuguguuucauugcuuuccagacauuccccaacaagugcugaauggauuuuguugcaaaaguuucuuuggaagucuauuuagaauucagauugcauuuucccaaggacacaauauucuucuugugguucagguucccagaccagcuggcaaaagccuauuuaaugugaaguagaguagaaguccaaccccaccagccccuuaccagaaugccuaaaaauauuuuugauggggaaaagccucaggguucagaccugugauccuaggcauacaucccagcuucauucucugagcagcaucauagggauuuauuguuggagggaacaauucaaacuccuuuucuaggucuccuaggcuuugugugagcugaccuuucugcucaucucuccaguaucauuucuuaccauguuuccucuggcacucuauacuauccaggcaaaaggaacuacuuuaaguucccugaacgcaucuuuguaaccucuauacuauccaggcaaaaggaacuacuuuaaguucccugaacgcaucuuuguaaccucugggucauuuaagccuuuagcuaugcucuucccucugccuggagccuucuccucuugccuaucccuucucacugguguuuuguguuacagcucucaaagcucugaucaucguuuuuauuauagagugauuuguaugcuuuaugucauuuaucuucccuucugccagacugaauacuccacagaaacaaagaccaugucuguguuacucacuguaguaugcccagcacuuagcauagugccuggcaaguaguagguucuuaauaaugauauggccgguaaaugaaugauguuguccagggguucccgcccucuuuuacagauguggacccugagauuuagaggggccaaguuuuuuuuuuuuuccaaguccauagcagcuguuuuggaauuagaacuuaggccuucugacuuccaggcaaugguauuuucuuccagagguauacauuucuguaaauaaagucugaaugcauuggaauaacuuacccuggggguuauuuguagcagucucaaaucauuugaucagggucacuacuggugauauauagagggaaauaggagagugaaguaaugcagaacauaccuucuguaauuuagauuuggaucauuuuugcugggccuggagaggaggagcuaggggaguacagcuuacccauggcgcugcuuacggaauuuagacauaagagauggcuguucauuauucugggauuccacaucuguacagaguguagaacauaacugaauacucaguagguauuucuugauuaugcgauuugcuaaaaucacucugcuaguguguuaaaaauaccauuuagaguuuucuauaccauuuaccauuuaauugauaagcaugugguuugauaaauguuguuguuauuauuguuauuagaaguaguuuuauguaguucuuauagagauauaagggccuuuagaucauuugauuuggggcccugccucagcuauuaaaaauugcauuguaccuuaaauaccuguugccuaauauuguuugccuucucauugugacucuuggggguuucugcugcucagaauagaauggaaucuuucauaagacuggauuaaagggcauacggccuaaugcagcagucucuaaccuuuuuggcaccagggacagguauugugaaagauaauuuuuccauggacugagguggggggugggggaggaugguuucaggaugaaacuguuccacuucagauuauuaggcauuagauucucauaaggagcaugcaaccuauauccaaagcaugcagccuagaucccucucaugcuccuaugagaauauaaugcugucacugaucugacaggagguggagcucaggugaugaugcucacucaucuggcacucacuuccugcuguguggcuugguuccuaacaggccauagauugguaccauucuguggucuggggguuggggaccccuggccuaauggaucaucuuaguaaaguucagaggcauuuaggaggaagacccaucugaugacaugcaaggaggaaauaucuguagaccccuggagaagagggaaagcagugcuuuuccauguguaagcuugggacugaggguuggauuuuugugguagguacaugacuggguggagaggaugacauuccucaguucuccauuuggcuuucaguaggacacacuucaggagucccacaucaggauggcuuuuuuucucccuguggcuaauuaaaaccaucguaagcccaaaagcuaaacucaaaggccuuugagagccuuccauugggcugcccaaaguccuuagaggcugguuggccaauguaaugaauaauaaaggaaauucauugaacaccguuaagaaaagauaaugcauguuuuccuucaaaccaucaaugcuuugccccgucacugauuugcuugugcgacccuucuuuuaugucacucugaauaaacuccccuuugucuuucugggccgagggaaccaaaugacuauagagggacucuuauuggagucacacauuucuuuccuccuugugacugccaaaccaccaaacucugggccauuugcaugugucuuaauuucuccucauaauguggcaaaacacguuuuggugcuagguacgauacaacccuuccuggagugaaccaaauguggaaagugcuguaauuugagggaguuuucagaaaagagccucuucugguacagaaaggcccuuuuuccuuuuuucuuucucuuuuuucauuuaugccucaucauauuuuguccacuuucagcucaucucaggcugaauuuucccuuugaugucugcuuuauagaauagcccuugccugagaaaagagaacaaaaggccaacucuguggcuuucaauuugcagcguccccagcccuuuuauccaucucagugcuucccugguugggaacaaaacccaagcuccagggucagagcacauacggaggaagaacccuuuuugaaaauccaagcacaugaggaauucauguuucauugucauccugcuuugcaauugggucagguacauauguggggaggagagagugggcuuggaagaaaaaaaauugguuuguuaccuccacaaaagcagacauucugauuuucccccagaaguuccauuaagaagaaagcaaguuuuuaaggguuuaauugcuaauucaggguugcuuucagccauuagggcaucuguaucaaggcgccuaguuugggagguggaacagaaguuugacgugcuaacauuugggaacuuucucagacaggaugucuuuguuaucuaauuucuuuccauuuuucaguaccugcuuucagauuucuacuuuuucucuucugcuuccuuugguuucaaaucacagaagaccuaucucuuugugcucccagcuuguugucuugguuacaggcuucuucagcuugccuuccuuugaggggaauauacaguguaaagaagauuuuuuaaaauggugacuaaggucccuuucucuaagguuacugggauauuaagcaguggguagaacagugacuuguaaacccggcuguacauugaaaucagcuggagcacuuuaaaauacugaugcccaggccccaggcccaaccaguugaguaggcaucuugaggaguaggccccaggaauuuuuuuuucuuuuaugaaacaauaaacugccuacgugagucuaaugugcauucaguauuuagaacugcuggguuuuacagcaaagccaaacaacuugguucuggcuguuugagccaggugaaggaaauagaaucaacuuuucuguaccuuaguuuuaccugccuagaacagagaagcacuaaagcuuaagaauuuaaagaggcuuacugugaccccccugucauuauuguugcauacaaaagagagguaacuuucuuucaaaaaaaaaaaaagaaagaaagaaagaaagaaagaaagaaaauccaguuauucagcuggcuuggcuucugggcuguaacaguggcuugaggauuaaaagaaaucuuuccaguugcuugaagaaggguuaucuguauggaggaacagcagcuucauucccagugugguuuggacagcgcauuccagguuuucaaaccugccucagcuuccagcugacucccuucucaugccccaggugguuagcagaguuaggcaccauacuuauauuuuuagugaaauugccuuuuaauaguauuuuccuaacauaaaagcaacagauguucaugauucaagcccggaacauuauaggaauaugacacauagcaaacaaaaguccccuagaagucggucucccagacauauccauuguaagcauguuuuuccuucugauuuuuaucucugcauaugcuaaacauuuuauauuuuuauucuaaaaaugggaucauucaacaauguuuguauuuuuuuuuccuuaauaucuuagccaucaguccauguuaguacauauaaaucaaccucauucuuaaggaccccugauucuuaggauuuuagucacacaagggcacaaucuccuuccgcuucccuccaagauuuugcuuuccuauggaaaggcuuggguuuuguuuguuucuuugggcuucaaauagagcaaauccauuauaucugguauauuuauguuugguuguuauuuaaaaauucauacaauuuuaaaggaauagaauagcauauaugauucccuccaaccucugaccccugauccacuaguucuucuccccagaaacaaacugccauuaccagauucuuggaaauccugagaauuacugcaugcauaaacaaggcuugaauauucuaaaauggcuuuugcuuagguaaccaagucuauccauauuguauggagacaucuuguuucauuuauucauucagcaaguaccugaugagcaucucauauguuccaggcacuguguuaaguucuggaccuacagugaggaccaucacacagcuccugcucuccagaagcuuauggucagcagggaagaucaacauuuaaugaaaacauagcuaaauauaaaugagaaauggugauauguguugugaaggaaaagaacagcauuuacaugcaucuguuuuuuuuuuuuuuuuuuuuuuugagacggagucuugcucugucgcauaggcuggagugcaguggcgccaucuuggcugacugcaccuuccgccuuccagguucaagcgauucuccugccucagccucccgaguagguggggcuacaggcaugcaccaccaugcccagcuaauuuuuuuguauuuuuaguagagacgggguuucaccauguuggccaggauggucuugaucuuuucaccucaugaucugcccaccuuggccucccaaagugcugggauuacaggcgugagccaccaugccuggccuacaugcaucauuuuuuaaaacagugauuaauggaguccccuuucccaauuuuuuaauacaaagguguggaugggagauuugcagcaaagauaggaaagcaaagauauaacccacaaucuuuacucuugccaacagcucuuaccuucuuucccaccaaaauuuuccuuugauaaaaugucuugcugagaguuaggcuaacucaccaaccagcuuuaauuuugguugacagggugccguagaagaccuuugcuagccagacugugagcuucuugcagacaggaauuauguccugcaucacugugugcucagaaccucaggaagaacaaacugauguaggcaccaggaaauaggugcuuuuauuacauucucauuuuaugccuuagaagcacugcaaaugguagguauucuuauuucuguuuuaaacaaugagaaaacugaggcuuaaggagguguaaaaaauacuuucuuuuaaaaaaaauacaccucucccccaccaucauaaaaaccccaacuuuggccauagaguucauuggugguggagcacugcaaacauuagcugucccauguggcuuugacucugacacaauugguccucuugcuucagggaacuggauaccauccaucccucccauggguuggccuaggcucuguuacuucagaguuuucuugacgaguuucaagguaaccaggucauccuguucuacauauuuuucugggauugaggucaaggagcagcaugauccucucuuaaaugggucagaggaggaggacuccuguggcucccugaaaggucaagccccuucaugcuaacuacaccgucuucccuucucuuccagcuuauguccugggcugggcucuggacagggagcagaggcagaugugcgcauguguucuggaggacuuuuauauguccgaugguguguuaggcacuauguggaguggaggcagagggaacuccagaaaagauaaauuaucuuaugguggagacaaaagguaguauuggcaacaaacaugaccucuggaaucagauaguuuuggguuccaggccugacucuuugacucacuuauuaguugugcgaccuuaggcaauuuauuuaaccuuucuguagcucaguuuccuuguaugcaaacaggaggaaaauaauaaucucuuacauaauaggauugcuaugaagaauauaugaacuaauauguguaagacauugacuguagugccaggcaccuaguaagcacucaguaaggaauaacuacugccauuauuguuguuacuaacaacaguaugagacuaauaagugauuaguguauaaguaccaacaaauaccaauggaguucagaaaaagaaugcuuaauuuuugugacuuauccaggaaaucucuagaggagacagaagaaguggaaugaaauauuccagguggagcaaauaugaaagugggaggcugaacugaacuggaguggggaacaaaaagaagaaacaaacgcaacaucuggcacccuugagcucuaccaccagcucaccuguugucacuaccaauauguccaguccuuuauggcucuccauuuuggagugcccugaauuacuggcugcaguuuugacuuggccagcuaguuggccagcugcucugacugagcuugagggugucugugccuugguggaguugacacggguccuaacucugcaacuugguuuguagguucaaagccuaauuuuuaucagcuuacccagggcuguugguuucuaguggauugggucacacuccccaacauuacaaaacacuucuuaauaaaucaccaggcugauaagucgauugaugaugagagagagaccuuuauagagaugagaacacuuguguguaucagcccuuucugauaucaagguaccugaagccaaauuaaacagggacuguuuuauaaccuaaaaucagaaccuaauggaguugaaaagucucaugagcgagaccauauaggcuuugguaguccauggaaaacuguaccuuuuugcaugucugucauagcuuuguagugugaccagaauguguguccuguucucucuccacugcuggagaaacaucaguaacaauuuuucucuuggauguuccuguuuucaauuccaugcaaaugcuguuugugugcuauggccaugcuauucucuugaauuucuuuuuucuugacaagauuuuugaguugccuacuucucagcgacaacauagugauucucucauugaguguucuuuuuggcuuuguucucaaacacuaggaauguuuccaagcagggccgccacgaauggcuaugcacugcacaacccuaggagagggugccauucacauagacuauaauugaauggcgccacuaggguugugcagugcacaaccuacacaacuguacucggcggcccuggcauaauguaaugucaguacuuucuucaucaagguaccaguuugggauuguccucaggguaagggggcugaagcagugagcugcugcugugaccaggaaaggaagaaagaaguaaaguuguggcuuugggagaauuaucuucucuguaaaugagagccaucauauaggagaacuacguaccuucguucuuucaguaaauaguuuuuuaagugccuacuaugugaggguugaagaacagggagggguuugcauaggagggagcauuugaacugggcuuugugaaagaaguagaauauuaacaugugaagaugagucaggaggagagaaucucagggggaaggaauagcgagaagaaagacagaugggagaccacaagggauauauggguaauggugcauaauucaucuugguuggauagaaaagcauguaaaagggaguagugagcaaugaugcuggucgggggucaaaugaugaugcaggaggggagggaguugaaugcccaauuaaggaauuuggacuuuuauuuaucaagcaauaaggagcuauccaaaguuuguuuuuuaaacagcuuuauuggguuauaaucauauaccauauaauucauucauuuaaaguguacaauugaauguuuuuaguauauucacauauaugugcaaccaccaccacagucaaauuuagaacauuuucaucauccaaaaaauaacuccauacgauuuagcucaccccccucccuaccuuucccccacucaccagcccuaagcaauuguuaaucuacuuucuguuucuauagauuuuaucuauucuggacauuucauagaaauugaguaauuauaauaugugaccuuuuuccacuggcuucuuucacuuaguauguuuucgagauucaucuguguuuagcauguaucaguacuucacuuauuuuuauggccaauuaauauuccauuuuaaggauaugccacauuuuauguauccauuugucuguuggugagcauuuggguuguuucugccuuuuggcuauuacagauaauacuucugugaacaucuguaaguuuucaggugcacauagguuuuuauuucccuuggacauagguuuucauuucccccagguauaggaguggaauugcugagucauaugauaacucuauguuuaaccucucaaggagcugccagacuguuucucuaaaauggcagcaucauuuuacaucccuaccgacaguauaaaaggguuccaauuucuccacauccucaugcacacuuguguuugccuuuuauauuuuggccaugcuaguggguaugaagugucaucucauuguggauuugauuugcauuucccugaugacuaaugauguugaacaucuuuucaugugcauguugaguacccguguguuuucuuuggagagaugucuguucaagguuauuuaucuuuuuauuguugaguuuuuuuaauacuuuagcuauuuuuaauguauauauuuaagguuuucaacuuaaugauuauauauauauauggaaaucaccacaaucaagauaacacaugcauuacaucauagaguuaucauuuauguguguaugcguguguguguguguuggaaauacuuaggaucuauucuuauagcaaauuuuaaguauacaguacaguauuuucaccuauagucgccaugcuguacauuagauauccaggacuuacuuguccuggaaaacuaaaacuuuguacuuuuugacuaacaucuuacuuucccagcaccagccccagcuaaccaucauuuuauacucagcuucuaugaguuagacuaauuuacauuucauauuuaugugacaucauaagauauuuuucuuucuggcucauuucacuuaacauaauguccuuuggguccuucuguguuacugcaaaugauaggauauccuucuuuuuaaaggcuggauaauauaccacauuuucuuuauucaugcauccaucgaugaacauuuaucuuguuucuauaucuuugcuauugugaauaacggugcaaggaauauaggagugcagauaucccuuugagaucuugauuucaacuguuggauaaguauuccagaagugggauugcugugucauagaauaggucuuuuuuuuuuuuuuuuuuugaaacuauacuauuuuugauaauggcucuauugaucuccaucagcaguuuuccaggguucuguuuucuccacacccuucccaauauugccaucuuuugcauuuuuuauaauagccauucugacaagggugacaugagaucucacugugguuuucauuugcauauccccaaugauuagugauguugagcaccuuuucauauaccuguuguccauuuguaugccuucuuuggaaaaaugucuauucagauccuuugcccauuuuaaaauuggguuauuuguauuucugcuauugaguuuaugaguucuuuacauauuuuaaauauugacaucaaauuugugguuugcaaauauuugcuauauagcuuuuuagguugauguaguccuaauuguuuuuguuuguuuguuuuuuacuuuucuugcacgugcuuuugaugucauauucaaaaaaucauugccaagaccaauuucaagaaguuuuuccuauguuuucuucuaggaguuuuaugguuucagauguuacauuuaagucuuaagcccauuuugaguugguuuuugugugugguguaagauaagagucugauuucauuacuuugcguguggauauccaguuaccccaacaucauuuguucaagcaagcaucuuuucccccauuguguauuuuugacccucuaagguucuuuauuccuuuucauccuuuuuuuucuuuuucucuucugaugagguaauuuuaaauaacuguucuucaaauuugcugguucuuucuucugcuugauaaaucuccuguuuuuaguugagucauuguauuccucagcuccagaauuuguuuggcuguuguuuacaguuucuaucuuuuuauuuaacuuuucauuuugaucauacauuguuuuccugauuucauugaguuguccaucuguuaauuuucuuuuuuauuguugagucuuaagagcuauuuauucugaauacuagacuccuauuagauacaugauuugcagauuuuuucucccauucuuuggguccccuccccuccccuccccuuucuuucuuuuuuuuuuuuuugagacagagucucacucugaugcccaggcuggagugugcaguggugugaucucagcucacugcaaccucugccucccugguucaagcacuucuccugccucagcaggagaaguaaucccaaguagcugggauuacaggcaugugaugugccacaacgccuggcuaauuuuuuuuuuuuuuaauuuuuaguagagacagaguuuugcugugugggccaggcuggucucaaacuccugaccucaagugaucugccugccucggccucccaaagugcugggauuacaggugugagccaccaugcucagucugggaugucuuuucacuuucuuaauagugucauuugaagcaugaaauauuuuaauuuuggugaaguacaguauauuuauuuuuucuuuuguugcuugugcuuuugguuacaucuuagagucuguuaccaaauccuaggucaugacauguaucccuaugcuuucuuuuacaaguuuuauaguuuuugcucuuacaguuaggucuuugauuuugagugaauuuuuguauauggguuaugagguagggguccaacuuaauucuuuugccuguggauaaccaguugucccagcaucauuuguugaagagacuguucuuucuaccauuggauggucuugauaccuuagucaaaaaucacuucugaggauuuauuucaguacucucaauucuauucuguuggucucugugucuuuccuuagguuaguaccacacugucuuuguuacuguugcuuugccauaaguugaaaucaggcuguguaaguccucccacuuuuucuuuucaagguugguuuggcuguuuggggucccuugcauuuccauaugaauuuuaaaaucagcgugucaguuucuacaaaaaaaaaugucagcugggauucugauacguacugugaugaaucugucauuuaaaacuuucaaggaggaguguaacaggaucagaaugcuauuuuaagaauaggaaccugacaauacuauauaaaauuagagcaagcuuguccagccuguggacugcauguagcccaagacagcuuugaaugcagcccaacacaaauucauaaauuuucuuaaaacauuaugagauuuuuuugcaauuauuuuaaaaagaucaucagcuaucauuaguguuaguguauuuuauguguagaccgagacaauucuucuuccaguguggcucagggaagccaaaagauuggacacccgugaauuagagugaugaaggaaaaacacuggauacuuggagaucagauaggaaacugcuguaguaguuuaagaaaaugauagggaccaaacuaggaaaagauagugaggguggauuucagauguauugaaaagguugggcugggugcaguggcucacacuaguaaucuuagugcuuugggaggcugaggugggaggaucacuugaagccaggagcuugagaccaaucuggguaacaaaaugagaccccauauguacaaaaaauaaaaaauaaaaauagcuaggugugguggcacaugccuguaguccuaacuacucaggaggcugaggugagaggauugcuugagccuaggaguuugaggcugcagugagccaugaucacaccaaugcacuccagacugggugacaaaccaagacccugucugaaaaaaaaaaaaaaaaaagaaaagaaaaagaaaaggucuaagugacaagacaggauuuggggacugaauacauguggggcugagaaaggugggggaucagggguaacucugaggugugaagagaggcuaauggauuagauuauaguaccuuuuaaaacuuuguauuauuuugaaaugacuuuugacuuacagaagaguuguaaagauauuacagagaauuccuguauauccuucacccagcuuccccuaauguuaacauuuuacauaacuaugguaaaauuauuaaaacugaaaaauuagcauuuauacaaugcaauaugaacuuaacuacagucuuuauuuggguuuuaccaguuuuuuucacaaaugucccuuuucuguugcaggaucuauuuaggauccuuaauugcauuuagauaugaucucucuuuagucuucucuaaucugugguaguuccuuagucuuugccuuucacaaccuugacuauuuugaagaguacuguucaguuuacucuguagaaugccccugauuuggguuuaucugauguuuuuucaugauuccauugagauuauacaauuugggcauccaauaaggacgaugcuaucaauagcucauacuuauuuuauucccuacagugugccaggcauuugaacuagguaccucaagcauuuaaauuuuacaguuacccuaugaaauaauacuauuguaauccucacuugacagauaagggaacugagccuaaaggguuaaguauucucuguaggcagcuggacaagggaaguugaguaauaugucagaauguuguuauugcaaacauggaauuaaaacaagugaaguuagaggaauugaaaauuuaauaugauuuguugcugaauuggcucauaguagggaugaauuuucuauugaaaucaggauaauuauagcuauuauguauugagugcuagcuaugugcuaggcauugugccaaaugcuuuucuugcuuuguuucauuuuguccucucccaaaccuugugagacauagauacuauuuuugucucuauuuuacagaugaaaauuccucuaaucucuugcccaaggccagagugcuggugaguggcagagccaccauguggauccaaguuugucuuaacucuaaagccuguauucuuuaaccacuuggcaaugcuaacuguccuccuuccaucuucuuaguagggaugaauuugccaaugggacuagaaaacaugauauuuaugggcuuggauguagacacugcuugguuguggacauuaccaaauacauguuugcaacucuccuuauuuuauaccucagugguuggucaaccccauucuuucuuuggguauauuucaagcagguuacaaucuggucuuucaagucugggauuuuaacgcuuaacucuuaguaggcacucuuauuucccuuuuauucaaauucuugagggaagcuucuuuauaaacuccuuagacugacaaaaauaguaaaaucucagaaauaggcaaaucaagggagauaaugaaaucaccagaaugggcguuuaaccguggaguguaagggaagcuuuccuggagaaaauaguuuaauuuugcauuugaaggguagauaagagccacaagaggaaaguuggaaaaaccaucuggaagagggaauaggauuagcaaaggcacaauuucuugauguuagagauuuaaauuuaaaaaauaaaauuaugaaaauguuaagaaaacaauaggugacucuguaaucccacuguuauaaaagauuuucaaagcgugauaucaaagacagaagccauaaagggaaugacaaauacaucugauuacauaaagauuuaaaaagcuuccauaaauaaaaaccuaucauaaacagagcugcaacaaugacagccugggaaaauuuuuugcaauaaauuucagucuauauuagcugucauuaauauauaaauagcucuuuacaacucaguugaaaagaacacaccagcugaaaaacagucaaagugcacagauggucacaucccaaaagaagaaauauggcuggccaauauaccuguuagaaaauaguuuaacauuucugguaaucugaggcaugcaaauuguguguguguguguguuuugccuguuaaacacgugauaauuaccaaaugauaaugaccuguuugucagguugcagcagaaaacagauccuuguauauugcuggagggaauagcaauuuaaauaauuuuucuggagggcaguuuagcauuaugggucaaaagccuucaaauggauauucccuuugaagaucuagacugucuucuaucaaugugggcuaaggaaauaguaaaggaacugaaaauuuagauguaauuuacaugugcaaccagaggauauugguugaguaaauuauugcauauccauauaauugaauaaaaugaagguauuggaaaaugagauaguagaaguguaguaauugacacaaauacguucaggguacagcuugacauaacgcgcaaggcugucaugcuggagagguaggcaggaucuagagcaaagaaggccuuguccgccauccgaagaaccuugagcuuuuuugguagguaguggcaagccauggaaggauuuaaaauggcagaucagaggggcauuuuagauagaucccucuuguagcagugugccuggaggcaggagaccaguaaggaaauuauugcagugguccugaaagagaugaugagggcccaaggguaugaaguagauggagucauaggaccaacuuugggcagcccagagaguuaaucuuccuuaugguggguaacagucauaagcacuuggccucagcgauccccagauagcuaugugccaucccaggaggugcugacaggagaacuggagcuuggggagauugugugcuaggccaaacaccacucuccuguaccucucucacucuguuucccuuucauuuaguuugcccauaucccuucauugcuuacccuggcuagccucucauuuaggauggccuguggucacuggcccuccuucccaauuacauuucucauaguacuaacacuugcuccaguguacaaaagcuaucuucuuuaagugcuaugaaaaugaggauuguugaauguaacacugggguggagcagaaguggaugggaggcugaacaaugguggcagugaacuuggggcugauaugacugggggaacaggaaugggaagcaggccagguguuggcugagagguucgguagagaaggugggaaccuggaaccagagagguucgcagguagaggaugaacugggauaacagcugaugccuagauuggaugcuuaggaaagaacuaaagguuaguacagggaucuuuccugaggaagcugagagagugugugguuuugaauggaaccguggauuuuuucugggaaaaccagccaaaaaagaccucaguuuuauaaggauugcaagugcccaccagaccuggggaugaggcaggugggagcuauaaugaaccugucuuugggacucugaaacucaucuauguaaaugcaauuugcuguccaguugaguuuguguuuugagaugucucacacuguagagaguagaucuuaugagcuggcugauggcacagguguggggcuguuggggugacucccugugugccauguggucaagggccagggcuagagucuaaagaaaaggagcucucaugagcccugguaugugucaggugugaaguggaaagugcauugaacugggaguuaagggaccugggcucucaucagaaagcuugucagaaccuuuuccccucaguuuccucaucucugaaaugggguuuaauaacaugguucugccugccucccaggugaugggaaaguggaagugcucuguagcacuucucuauaugcuaccugcucaugccuuuuguuucaggugcugagcugggcagaugucagcaugaaugcaaagugccaaguugguacugggguaugcucagauauauucucaucuuuguaccauccuuguuugaacuucuaagucucaucucuuccuauucuauuugcagccaaagugauaguuuagcuuuucaccuccuagucuaaaaaugcaugccaccaaaauuuucaggcaguuggaagccaagcaaagaagaaagcaaggauauucagaccaaggcugggggcccuugcaccucugaauuaaaauguuaguuccauguggcucuguuggcuaauguugaauaugaaugugacucuagcaugacagggugaagagguucaguaucagaaaucugagaaguugcuaaaggaggccaugaguuuucuggaaaugcaauaugaauaaucaggaauccccagauaacuguguaccaucauaggagguggaauguaauguaauaaauaaucuuucaaucagauacauuuaguuauaucaagucagcagauuugaaaaaggacccuagaggccaggcacagugauaaaccuguaaucccagcacuuugguaggcugaggcaggaggauugcuugaggacaggaguucgagaccagccagggcaacauagugagacucugucuccacaaaaaaauaaaaauaaaaauaaaaaauaaaaaaauuagccagauaugguggugcacaccuguagucccagcuacuugagaggcugagguaggagaauugcuucagcccaggaguuggaggguacagugagcuaugauugcaccacugcacuccagccuggauaacagagugagacuuucucaaaaaaaaaaaaaaaaaaaaaaaaagauaccuucuaugcugcuaugcugaugauagaaauaggcaagacagaaaagaugaaacgacuaaaguuagaaccaugacugauggaggauaacaggacaaccaacuggguugaaacuggaggcuuguucucuuuaauaguuuucugggcuucuagccuagggaaauuguggaucagaaccagccaaauggacuuauaagggaaauuuguccccgaaaaucagcuuaccuccucuugucuguggguauagaaaaguaagauuuaacuguggugcccaguguugcauuuuuacaucucuguuuagcauguuggaagugucuuggguauuccagaagcucaggaaggcugcuggcaugacucuggugacuccagaaguauugaggaccuuucuaaggugguuggggccccuuccucuucucuguguacuguagcuucugaguguagccuuugaugggccugaugcuggguaacuaugugcagccuccaacuuggucccuuaccuaaggugaguaacuuuacugcuggaucaaggguaaaaaauauuagcuuuguuuauuucuuggacugcuccugaggggugggauggggaguggggauaagucgauguuuggauaauugaaauuucaagucuguaauccuuauccaaaaccauuaagaucagauauauuucagaaaucagaauuuuuuuggauuucagagaggccguacagugcauguagagucuuuuacauacacucccagugggguuugaggcaguaccccgcaauuaaauacauuauuauuuuuaugggaaacauaugaauauucaccguaaguggaagaaauaaagucuauaaguagccuaaccucaauucaagucguauuuugcuguaacauuagcuuugaagaaaacaaacuuucaguuuuuagagcuuuuuggauuuugggauugccaacaaaagauuguggaccuguaauuaucaucggcuuuguauguuuaaugaaauugaucaagggaaaaggcacauucuugacagauauuuccuuugaugagguaucaugcaggugauggacuccugacuguguucuuuuuaagacccuuucucauuuucauucuucuuccucuucuuauuggcagggauucaugcaggugucuuuccuuauagugauuuuucuuauaauacccuuuucuucuaaauauggacuccgagagaacagaagaaccacauacuaaagaacauacaagugauaaagccaacaaguccauaaugcagauauccuauauuaauaagagcucucaacaauauagggacacaugucaacgauuucuaaaccacaccauuaagucacuacaggugaagaaacucuacaaacaugaguuucauuccuuugucaauccucaguucugcugaauguuuuugacuccuguaguaguucaguccaagggcaaaaauucagcaucucaggcuaccaggagugauugaaucuccugggacauuugugaaacaugaggauuucuggagucccauacuuggggaaucagaauucuuaaugggggaacccaggaauuuguauguuuuacaagcucugcauaggacuuuuuuguuccucuugauguuugagcaccacugcaugggggaaggucaaacugccacagcugcagguuuccaaaggcuguaaucugggcccaugccacaccagguaucagggaacugauuugucuguuaggacaagguucuuuuuguuugguuuuaccugggaggagaauggaagaguaaaaccaccuagacgugcuuagaaacaaaagaaucaaucaaagggaggcuuggaaccugcggguggcaguuugauaggguugccagcuaaaauaaauacaggacauauuuauacuaaaacuauucauuguuuaucugcaauucgaauguaacugggcauccuguauuuuuauuugcuaaauuuggcaauguugaguauugauaaacccaccuucuccccugggaggcaaaccagauggcauggugugugcguguuccaugcucagaaucuauuuuuaccugcccuggguuaaauuuaagacugacuacuugugucguauugaaacugaagcauugaaauauugagucuucucacccuccuucucccuuucucaugugugcgcacacacacacacacacacacacacgcaugcaugcaugcaagcacaaacauguaccuguugccuuuaaaaauuuuuauauuacauuauuguguuagaguuuugguuauuuuuuguuauuguuaaaguaacauugucucacucugucuggcauuuuuucuugcuaaccauucuuaauucuucuucaauugcagaucuuucuccuggccugcccuccaugucggggagcuaucgucgucuucaaguaagagaaaauuggcuuuugcucuguugcucuucagaguauuuuugucuguuugcuaacaagacugauaacacauugcugugaacaccuugggauuguaccauuuugucuuugcacuucccaaagggaugaaggucugugagggccuacugaaacagggaaauauuguuugugaagaccugguuuuugucaagccgucaaauccuuuuuagcaaauccuuccaguaggggauguauggccaaggcaugcucccuuggaagguugcugcccugcuaaaauuucucuugagagcaugcuaggggccagacagcuuccuuucucucaagaaucuuugcuuugugagccuacugcuccacugagcauaugguucuucacauugaagggcauuguucuuauguuuuuaugggguuuuccccccuaaagugcaaauuaaagugaggagaggaaaauguccacuauuacaaguucagacuuucauaaaaauagcaagcaucaaaucuauuaaaguauauugcaggcaaauaguguuucucugaaggcagguuuauuuaaaugaaauuaucaagaguccuggaacccucauuuuaaccgugaguugugaccaccucacuuaucaaaccuuuuauuagaguugcuaaugagaagccaaaucgacugaauuaauuucaucucuuuucuccuucccuggccccgauucuggagauguuccugagcagugaaauggcugcaagccagaggaagggaacaggaaauaaagagcccagcagauucuuggauaauugagaaugguguaaauggcuuucugauuuacuuaagucauuaaaguguuagguaggggaaaaaggaccccauuugcugcuucaaauagcucccugaaauagccacuuagucucuugccuuaggugaguaacuuucagcugcgugagggauaauggauccugauuucauguauuucuuacuugaacagcuccuaaaggaaagggguauuuaacccuguuuuccuuccuugauuuuccaaaaugagcucaauuauucaguguaauguuuuaaaaguaacauuuauugguucuauuucauuaugaaaguaacaauucucauuauggaaaacacagggacacauaaggaagaaacaucauccaucccaaauccaagcaccaagagauaauuuugcuuauuaccuuucuuuucuuaagaagcagagaucauauuguauauugagguguuuacuguaucuuuucuaaauuuaacuugguuuauugauacauucauauagguguguaaaucauaaauaugauugcuggauuuuuuuuuguagugguccuuucuuuucccuuuuuuucuucagcuccuaguucuaccuuuccacacuaucccuuuguauuaccaaaacaguauguaucuuuucacauuuuacuccaugugcauagauauacacaugcauacacacauacacacacaaguuuuggaauguuuuguuguuguucauuguuuguuuuacagaaauagaauauuauauauacuuuaauauaucuuuuucauucuacaauaucucauagaaaucuaucacagucuauugauguagcucuuauucuuuuauaauguuguaaaauauuccaugaaugcacaauaaguuauucagccauuccccuauuaaugaacauuuacuuucuuugcacauuucugccacuacauucaaugcuuaaaucaacaugauuuuguauauacccuuauauacuguugcuuucaguuuagauauagauguagguagagguauauagguauaugggaauguuuaaauauauauuuauguuaauagauaucgccauauugauuuauaaaaacaggcuguuaugcuacacuuuuugcuuuuguauguaauaugugagauuauuauuuucuucuuaucccuaucagcaacagguguuaaugguucuuuuguaauuuugacaaccuaauggaugcaguuucuuggcuacuagugaguuucaguauuaucucaauuuuuuguccaauuaaauuuguuccucgaguugucuauucauauuaucugcacauuuuccuauggguuguuuauauuuuucuaauuucuaagaccucuuuguauauuuuagauuuuagcccuuugucuaucaucauuguuacagauaccuuucccaaauauguuuauauugacuuuuuuuuuuuuuuuuaauuauuuuuuuaguagagaugggguuucaccauguuggccaggcuggucucgaacuacugaccucaagucaucugcccgccucggccucccaaagugcugggauuacagaugugagccacugcgcccagccuauacugacuuuguugauggaauauauuuccauauaauuguuugcauuuuuauauccaaauaugacucuuuucuuauauagcaucugaauuucaagucuugguuaagauaguuuucuugaagauagguagccaguuguauuggaauaauauauuaaaugaucccuauuuuacccugugaucucuuugcagcuauuaaauguuuuauaugcuaggaucuacuuauggauucucuauucuguuucuucuuuuugucuauuuguguacccaaaucucauauauuugauuacauuaggcuuuaaaaaauauuuuucuggggccgggcacgguggcucacgccuguaaucccagcacuuugggaggcugaggcggguggaucacuugaggucaggaguucgagacuagccuggcuaacauagugaaaccgcaucucuacuaaaaauacaaaaauuagccaggcaugguggcacaugccuguaaucccagcuacucaggaagcugaggcaggagaaucacuugaacccaggaggcggauguugcagugagccaggacugugccacugcacugcagccuggggaacagagugagacucugucucaaaaaaaacauaaaaaaaauucuuggcuauuuguugucacuuguucguacacacaaauuuuaagaucacuuauauucaccuaccucucucaaauacuaguggaauucuaauuagaauugccuuaaguauauauuucaguuuuuaaauuauauggcuccuuuuaucuaagaaaugguauuucuuuccaucuguucacgucuuauuguuucaguuagauuuaucuuuuucuucauaucugcucuaugccuuucuugaugcauuuauuccucaagaauuaacagcuuuucugccaggugcagugacucacgccuguaauccuagcacuuugggaugcuaaggugggcauacugcuugagcucaggaguuugagaccaucauggacaacaugaugaaaccucgucucuaaccccccaccaaaaaaaagaauuauaaaaagaauagaaaaagaauuaauagcauucccccucucccccaaccacgccguaaugaguggaauauuuuuccccuuucuauuccuaagugcuuuuugcuagaauaggaaaagauuguugauuuuuaaaaauaucuuauaucuggcuaucuuaccgaauucucuuguucuuguaaauuuuauuuuaguuuuaucucuucuuuuccuuaguuauaccaguuauuucauuuucuuguugcauuugcuagaaauucagaguuaaauaaaaauugugcugacgggcuacucuugccuaaaacugauuuuaaauggaaauauuuucuguacuccuccauauuugcuguugguguuuguuaauagucuauuauacuuaaguaguuuuuacauuuauguagagauuuuuaaauauuuauuuauuuauuuauuuauuuauuuauuuauuuagacagugucucacuuuguugcuaggauggucuugaucuccugacuugaagcaauucuccugccucggccucccaaagagcugggauuacaggugugagccacugugcccagccaagauuuuuuaaaagaaggaaugguagcuguauuuuaucuaaugcuuuuucuacaucuauuggucaugugggauuuuuucauuuaaauuuuugauauaauaaauuacauugauagauuuucugguuuugaacuacucuuacauuauugaaauacacccgcugaucauaguauauuauuauuuugauacauugcuggguucuauuugucaauauuuuauuuagaaucuugcuucaauauucccgagauuagagucauguuuuucuuaguguuuuuuucuucaaguuuaaggauugaggccaggugugguggcucaugcguauaaucccaacacuuugggaggcugagguagaaggauugcuugaggccaggaauucgggaccagccuggacaacauaccaggacuuugucucuacaaaaaaaaaaaaaaaaaaaaaaauuaaaauuaaaauuagcagggcaugguguugugugccuguagucccagcuacuugagagguugaggcaggaggaucacuugagcccaggaguucgaggcugcagugaacuaugauugugcugcugaacuccagcuugggcuacagagcaagacuccaucuuuuaaaaaaaacaaguuuaaggauuaaaguuaugguggcuauguaaaauauacugcagaauguuccuucuuuuucucuugucuggaauacuuuaacuaccguuagaaauuauguauccuggcugggcgugguggugggugccuguaaucccagcacuuugggaggcugagguggucagaccaccugaggucaggaguucaagaccagccuuaccaacauggugaaaccccuucucuacuaaaaaugcaaaaauuagcugggugugguggcaggugccuguaaucccagcuacucgagaggcugagggaggagaaucacuugaacuugggaggcggagguugcagugagaugagaucgcaccacugcacaccagccugggcgacagagacuccaucucaaaaaaaaaaaaaaaaaaaaagaaauuauguaucuuuuaaagguaagauaaucugugaagccaucuggucuuggugccauuuuucaauggguaaacccuuaaucaccuuucugauguguucugugguaaucuauucaaaucuuuuugggucaauuuuggucguuuguguuuugcugggaaauuauccauuucuucuaaauuuucaaauuuguugccaaauauuuaguugagcauguaguauccucuuauuuuauaauuuaaaaauaucuccuuaucuguagucauguauuuuuucuuggacuugaucuugucuguuuuuguguucucuccucuguauauuaaucagguuaguaagcacuuaucuguuuuugguugcuacauagaaccauguuuucaauuuauuuauucuuucuaccuuauuuauuuuuucuacuuaauuuucagcuuuuaucuucauuaauucccucuucuguuuuuuucuuaaucucucaagcacaaggacaaguauuuauuccuuuauuuauuuuuugucuuuuuuuuuuuccaauuuuucuucuagauccaaggguuacaugugcagguuuguuacaaggguauguugcacgaugcugagguuugggacaugauugaaccugucacucagguagugaugagcauaguacucaauagguaguuuuucagcccuugucauccuccuucccuccccucucuuguaguccccauuguuuguuguuuuuauuuuauuuuuauuuuuugacagguucucacucuggugcccaggcuggagugcaguguugagaacguggcucacuauagccucgaccucuugggcucaagugauccuccugccucagccucccaaguagcugggacuacaggcacuagcugugacaccuagcuagguaauuauuuuaguuuuuguagagauggggucuuucuguguugcccaggcuggucucaaacuccugggcucaagaaauucucccacuucagcgucccaaagagcugggauuacaggcaugagcuacuaugccuggcuuguuuuaacuaucuuuaugucuauguguaucuaauguuuagcuucuacucacaagugagaacaugugguauuugauuuucuguuucuguguucguuagcuuaggauaauggccucagcugcauccaugcugcugcaaagggcaugacuucauucuuuuuauggcugcauacuauuccaugguauacauguacuauauuuucuuuauccaguccaccauugaugggcaucuagauugauuccuugucuuuacuauugugaauagugcugcgaugaauauacggguacuuguaucuuuuugguagaaugauuuauuuuccuuugaguauauacccaguaaugggauugcuggguugagugguaguucugcuuuuaauucuuugagaacucuccaaccugcuuuccacaguggauaugaacuaauuuacauucccaucaacaguauauaugcauuccuuuuucucuacagccucaccagcaucuguuauuuuucaaauuuuuaauaauagccguucugauuggugugagaugauaugucauuuuguuguuguuguuguucuuugagacagaaucucgcuuuguugcccaggcuggaguacaguggccugaucucggcucacuguaaacucauccucccggguccaagugauucuccugcgucagccucccaaguagcugggacuacaggcacauguccccaugccuggcucauuuuuguauuuuuaguagagaugggguuuuaccauguuggccaggcuggucuugaacuccugaccucaggugaacugcccaccucagccucccaaaguggggggauuacaggagugagccaccacgcuugaccugauugugguuugauuugcauuucucuguuagugauaagagauuuuuucaugugcuuguuggcugcuuguaugccuucuuuugcgaagugucuguucacguccuuugcccacuuuuuagucagguuauuuguuuuuugcuuguugauuuguuuaaguuucuuauagauuuggguuauuagaucuuugucagaugcguaguuugugaauauuuuuucccauucuguauguugucuguuuacucugcugauaaguuucuuuugcugugcagaagcucuuuaguuuaauuaggucccacuugucaauuuuuguuuuuguuuuaguugcuuuugaggacuuagcuauaaauuccuugccauggccaaugucaagaagguauuuucuggguuuucuucuaggauuuuuacaguuugagagcuuacauuuaaauguuuaagucaucuugaguuaauuuuuguauaucaugauaggaaggagugcaguuucauucuugugcacguguauagccaguuuucucagcaccauuuauuuaauagggaguucuuuccccauuguuuacuucuguugacuuugcugaacaucacauaguuguagguguauggcuuuauaucuguguucucuauccuauuccuuuagucuuuguaucuguuuuuguaccacuaccaugcuguuuugguuacuguagccuuguaguauaguuugaagucagguaaugcgguaccucuggguuuguucuuuuuacucaggauugcuuuggcuauuugggcuguuuuuugguuaucuauggauuuuagaauaguuuuuucuaauucugugaagaaugacuuugguaguuugauaggaguagcauugaaucuguagauugcuucggguaguauggccauuugaacaauguugauuauucuaauccaugagaaucuaauacuuuuccauuuguuuguguuagcuaugauuucuuuuagcaggguuuuuuaguucuccucguaaagaucuuucaucuccuuggcuggauguauuccuaggcauuuuauguuuuuguagcuauuguaaaaugggauuacauucuugauuugauucucagcuugaauguuauugguguauagaaaugcuacugauuuuuuuauaugauuuuguauccugaaacuucacugaaguuguuuaucaguucuaggagccuuuuguuggagucuuuaggguuuucuagguauagaauuauaucgucagugaagagaagauaguuugaauucuucuuuccuauuuggaugccuuuuauuuauuccucuugccugauuucucuggcuaagccuuccaguacuauguugaauaggaauggugagagcgggcauccuugucuuguuccaguucucaaggggaaugcuuccagcuuuugcucauucaguaugauguuggcugugggguuuucuuagauuacucuuauuauuuugagguauauucuuucaauguuuagcuuguugaagguuuuuaucaugaagggaaguuggauuauauaaaaaaccuuuuuauuugacuauugagaugaucauaugguccuuguuuuaaauucuguuuaugugucgaaucacauuuauugauuugcauauguugaaccaacuuugcaucccagaaaugaagccuacuugauuuuggugaauuaacuauuugaugugcugcuggauucaguuugcuaguauuuuguugaggauuuuugcuucuauguucaucagggauauuggccuguaguuuucuuuuuucacugugucuuugacagauuuuguuaucaaggugaugcuggcuuuguagcaugauuuagggaggagucucuccuccuugauuuuuuuuuuuuuuuuuuuguaauaguaagauuggugccagcucuuucuuuuuuauccaucugauagaauuuagcucugaaucuaucugguccauggcuuuuuuugguugguagguuuucuuuuuuuacaauuacugauucaauuucagaacuuguuauuugcccaagguuuuaguuucuuccugauucauucuugggagguuguguguuuccaggaaucuauccauuuucucuagauuuucuaauuugugggcauagaaguguucauaguagucucugagguucuuucauauuucuuugggaucaguuguaaugucacauuugucaucucugauugugguuauuugggucuucucucuuuuuucuuuguugaucuagcuaucaauuuauagaucuuguuuauccuuucaaauaaccaaccuuuuuuuauugauccuugguauggauuuuuuuggguuucaguuucauucauuucugcucugguuuuaguuauaucuuuucuucuugcuuuggaguugguucuuguuuucuaguuccucuagacacaacuucagcuuguuaauuugaguucuuucuaacuucuugauguaggcauuuagcacuauaaauuuuccucuugauacuguuuuugcugcauccuauagauuuucauauguuguuucuauguuuucauuaaugucgaagaauuuuuugauuucugccuuaauuguaugguuuaucccaaaaucguucaggaacaaguuguuuaauuuccauguaauugggucuucuugguauugauuucuauuuuuauuccacuguggaacaagaguaugcuuggaaugauuucuagcuuuuugaauuuauugagacuuaacuuuauggccaaacauauguuugaucuuagaguauguuccgugugcagaugagaagaguguuuauucugugauuguuggguggaguguucuguagaugucuauuagguccaauugguuaacugucaaauuuaaguccagaauuucuuuguucauuuucugacuugaugaucugucuaacaccauaguggaguauugaaauccccauuauuauuguguggcuaucuaagucuuuuuguagguuucaaaguauguguuuuaugaauuugggugcuccaauguugggugcauauauauucaggauaguuaagucuccuuguugaauugaagccuuuaccauuauguaauacucuuauuuguccuuuuuuacuguuuuugguuuguagucuuuuuaucugguauaagaauuaucgaccccuguucuuuuuuguuuuucauuugcaugauagauuucucucuaucccauuacuuugagccugugggugucaucacaugugagaugcuucucuugaagacagcaggcaguuaggucuugguuguuuuuauccaucuugccacucugugcccuuucaguggacauuuagacuguuuacauucaacauuaauauugauauaugagguuuuguuccuuucaugauguuguuaauugguugcuuuguagucucgauuguguaguugcuuuuuggagucuaugggcuguguacuaaaauguguuuuugugguagcagauauuauucuuuuguucccauguuuagaacucccuuaaggagcucuuguaaggcugguuuagugguaacgaguucccuuagcauuugcuugucuagaaaagauuuuauuucuccuucucuuaugaagcuuaguuuggugggauaugaaauucuuguuuggaauuuauuuuuucuaaggaugcugaaaauaggcccccagucucuucuggcuugaaaggauucugcugagaagucugcuguuagccugacgggauucccuuuguaagugaucugacccuuuugucuagcugccuuuaagauuuuuucuuuuucauuguccuuggaaagucugauggcuaugugucuuguggauggucaucuuguauaguaucuugcaggaguucucugaauuucuguaauuugcauguugucuucucuaacaagauuggagaaauuuucaugaacuguauccucaaauauguuuuccaaguugcccacuguguuuccuucucucucaggaaugccagugagucuuagguuuggucuuauuacauaaucccauauaucuugaaacuuuugcucauuuuuaaaaauucuuuuuucuuuauucuugucugacuggguuaauuuguaggaccauucuuugaggucugaauuucuuuccucagcuuggucuagucuguuguuaaugcuuccaguuguauuugaaaacuuguguagugaaguuuuucaauuccaccaguucuguuuggcucuuucuuaaaaugucuauguugucuuuuaacucuuggaucauuuuacuggcuuucuucgauugaguuucaacuuucucuggagucucauugagcuucuugccauccagauucugaauucuguguauguccuuucagacauuucaaucugguuaggauccauugcuguggagcuagugugaucccucggaucaucacauuuuaaaauuaaacuuuagguugggcgcaguggcucacaccuuaaucccagcacuuugggaggccgaggcagguggaucaccugaggucaggaguuccagaccagccuggccaacauggugaaaccccaucucuacuaaaaauacaaaaaauuagcugggcauggugaugggcaccuguaauuccagcuacucaggaggcugaggcaggagaauugcuugaacccaggaggcggagguugcagugagccgagauugugccauugcacuccaaccuaggcaacaauagugaaacuuugucucaaaaaauaaaauuaaauuaaacuuuauacuuugagauaaguauauaauaugaggagauuucaaaaaguucacagaaaauggaauuaaagauaaagauaaaaauuauaaacuucauuucucaacagaagcuccgugaacgucaauuuaauucaucccuaaagaaugcaauuuaauucaucccugaagaacugaggguacugggaauguaacugucaauguauucuuuuuuacauuauuaacuaaagauaaaugagggccuuuaagauauauauuuuuuuaaguuuaagaaacaaaaagaagucagaaagagccaugucaggacuuugagaugauugccuaaugauuucccgucgaaacucucagagaauugcccuuguuugaugagaggaaugagcaggagcauuuuccuggucaagaaguauuccccggugaagcuuuccugggcaguuuuucacuaaagcuuuggcugacuuuaucaaaacacugucauaauaaguagguguuauuguccuuugacucucgaaaaaaucaacaagcaaaauguguugagcauccccaaaaccugcugccaugaccuuugcucuugaccaguccacuuuugcuuugaccggaccacuuucauugcuugguagacauugcuaugauuguacuuugucuucaggaucguguuccaucuccuguuauaauucuuugaagacaugcuucaggaucuuuaucccaccuguuuaaaauuuccauugaaagcucuguccucaucuucagcugaucugggugcaauuuugaaacccaucauggggaaaguuugcucaucuuuaauuuuucagucagaauuguguaagcugagccaauugagaugucugugguguuggcuaucguuucugcuauuaaucauuggucuucuucaauuaagaaaugaacaagauacgaauugauguagguagucugccacugcaggcuucaucaucaacaucucacccuuucuuaaaaugaugacacucuggggacugcugugggguagggggaggggggagggauagcauuaggagauauaccuaaugcuaaaugacgaguuaaugguugcagcacaccagcauggcacaugcauacauauguaacuaaccuacacauuguguacauguacccuaaaacuuaaaguauaauaauaauuaaaaaaaaugaguuauccuguaaacugcugauuucuucugggcauugucucuguaaacuuuuuauaaagcauaaaugauuucaccauccuuccacccaagcuucacuauaaauuugauguuuguucuugcuucaauuuuagcagaauuauuguuguucugguaggggcucuuuucaaacuggugucuuauccuucuuagugccucaaacuagauccuguucagacauguuagaauaaguuagcacgaguuuauuuuggugcugaaaauuugaaauccaugcauaguuuuuuguaauaauauguauuucccauuaacuuauugaagaccuguugucuauuaaguauaauaauguagaaaaaauaauauaggaaaaaacacaaagaaaucccauguaccuuuuaccuaauuuccuccacugguaaccucuggcaaaacuauaguacaguaucacugccaggauauuuucauugauacggucugauaaagcagaacaguccugucaccaugcagaucucuucugucauucuuuuauagccauacccaccaucuacauaucuaaaccccaucccugaucccuggcaaccaugaaucuauucuucauaucuauaauuuugcuauuuuaggaaucuuguguaaauauaguuauaccuuauauuaccuuugaggcugacuuuuuaaaaaucaccuagcauaauucccuggagaguuauccaacuuuuuauaauacacaacauuuuuuucuguuuucgagaccacguuuugcucuguugcccaggcuggagugcaguggugcauucacggcucacugcagccuuggccugcuugacuuaagugauccuuccacaucagccucucaaguagcugggaccacaggugugcaccacuaugccuagcuaauaauuuuuuuuuuuuuuuuuuuuuuuuuuuuguagagacggagucucauuauguuguucacacuggucugaaacuucuggccucaagugaugcuccugccucggccuccuaaagugcugagauuacaggaaugagccaacacgguggcugauacacaccaucuuuaaugggugcauauuauuccauuguguggaaauaccauguugaguuaaaaaucaguauuuuaaaaaguagagagcccuuaaaauacuuuaacuuuacauuaguauuguucuuuacuguuuaaaaguucuuugcuuuaaauuuucucaucuaaucuuuaaaauaguauugggggauagcgaauacauuauccauacuauaaauagagcaguaggggaccaagaaauauuauauaacuuggcuaagauuacuucguggcagagucaggauuccuauucuuucuucucuugccagugaucauaacauaaucagguuuacugugugccuaggcauggugggaaacacuuaacauugauuauuuuauuuaauccuucuaacaaaacugugugggaaguacuaauaguaguacugguacuauuaauaguaguuuggucaagagaacuggggcucagaaaguuuacaugacuggauguggcuugcaugugguacaugcaggauuugauccaaaguuucucucacuccagagcccaugcugcuaaucaugaccuuguguugcugaagugaauauuuucuacuaucccauuguuguuuaaauuguuaaaaguaugaaagcaucuuauuuaaaauucccuaugucucaguauacauggaugagcucuguugugaucuuuaugcccguguguucuuuggguuuguugacuagcaucauauaccuaucucucuugcuuucucuaugggcccuuugcugugccagccacacaugaguuuaccagcuucccagcuaaccaggggccagcauguucuuccuggaggcaugcccagccacuauaggaaagggguaugacgugugcagcaggcugcauguccugugcuuggcaaaggcuggcaacucccacugggguggagaagggacaggauucuccacaugguucccaugguacacuugacaagagggaaugauaguaccacaguguuaugucuggguccuggaaugcuucauuuauauguaccucaguugacaugugacuugcucaguccugcugcuauagccugcugcuggaagggcugccucaguggaaagcaugcauccaggguguggagccaaaauuagaagggccaaaauucuaccuggcccacuaccacagcaaccuugggcaucguuuucuuuugaucucuaguaucuccaacuccuagaauuccagccuggcagucuucugccucugaaggccucuuauccuuccuguucuuggcuccucuucucugugaaugcuuacauagcagcgucagaguuguuuguuguauugugucuguacaugcagugcuguucuguaucucuuugaaucugagccauuuucuuuugacucauuuggcugaugugaaugguacuuuccugaagagcuaucuaccagugccguugacauccaagccacagaauucuuuuccucacuucgguuugaauaaaaccaacauauccuuagggaugguuuugcacuuacuauccugcuacuaacuuggaaaaacguuacaugucucauucaucuuagggaaccgacccagucccaaaauaugaacuagccugccucaccaguuauuaacaaauaagauuuccuuuugaaaaccucagggauaggauaaaggacuguguugcaguguaaccagaccucccccucaccccccaguucccccaacacaucucacaucucacugguggcuucucuuuucuuuuucccuugccuuuugugucaguuuuuuuuucuuucaaauaucauuauggguaauuuggaacauauacauaauauggugguuacuuauaucuauuagcuauuuacauauuuuauucuguagauugucagcucauggucucugcugaauuuugauguacagguguuucccuuguugauuuguaugaguuuuacauauauaaagaguguuaaucuuuuaucacuuuugcaguaaauguuuuccccagauugucuucuaacuuuuuaaugaugcuuuugauaauagauuugguuuacauuuuuauuggucaaauugauugauuucuaaacccccuucagaucaugguaauuucuuccauugcuuuuacacuugaaaagacauuucccauucuaagguuagaaugggauuuaaaacaauccaguuuuaaaauaguuuuaaaaauauuuaacuugucaguccaucaaaaauucauuuugugacuaguaugaaguagaguauagcuuauauuuuccccuagagagucauuuauuugagcaccauucaucaaauaacuauuuuccuaugauuauugcuauuauacuuuuaucauacauaaauucuucuauaugcuaggauuuuuucagcuuguauuauucauugaucucucucuuggguuuuccaucaguuucauacccuuauauaugcaacagcugguaaaccagauuucuuuugcuuucucugcagccuagcgcauuacccacacuuuuuucuuagcuagucucaaccauuuuuucguccaaaugaacuuagaauguuucugucagguucuccucaaaauccuaccaggauuuugauuggaacuacuuuaaaccuaaaauuucauugacaucaucacaacacagagucugucauccaggaaaagacaugauauguuaauuuauuaauuuucuuuuauguuccuuaguugcucacaugcauguguguguaucucauauauuucucaucaagaucaucccuggauaguugauaguuuaugauauuuauuauauuuucaaacuaguuauuacugguagguaggaaaauuuuugauuuugugugucuaugcuuaauucuuauuucuaauaguuuuucaguugcuucucuuggauuauuuuugaaauuaaucacaccagcucccauaugauaacuuuauuuccuuuuaaagaacaaaacugcuguuuugcuuucaaaccugauuguauuggcuagaucuuuugggauaauguuaaauaauagcaguacuagcaggaguccuugucuugcuucugauuuuaauggaaauguuucuagugauucacuuaauagaaauguuucuaaugguucauauuaguuggcucugauguugucuguugguuuaaguuagauguuuuuuauaauauuagggaauuaccuuauucuuaaauuaucaaguccucacaaaaaucaagaauaguuggccaggugugguggcucacgccuguaaucccagcacuucaggaggcugaggcagaaggaucacuugacaucaggaguuugagaccagcuuggccaacauggugaaaucccaucucuacuaaaaauacuauauauauauaguauaguauauauauaguguauauauauauaguauaguauauauauauaguguauauauauauaguauaguauauauauauaguauauauauauauaguauaguauauauauauauagagagagagagagagagagagacaugguggugcaugccuguaaucccagcuacucgagaggcugugggaggagaaucgcuugaacccaggagguggagguugcagugagccgagauugugccacugcacucagccugguugacaaagucagaucugucuccaaaaauaaagaauaguuguugaguuuagcugauguuuucuaggaaucuauuaagagguucauuuguguuuucuacuuugaucuccccauuugguauauuauauuauagauuuccuaauaucaaucuuuguuagcuuucuaagauaaauuuuccuuuuccuuugcaugcuugggagagccucagauuuggcuuccauacuauuaauuugauugauuuugcucucugcugucuccaaugugaaauuuauuuauuuuuguuacaauguuaauuucucuguauuucuuucuagcucuguugagcuacuuacccuagguugucuuuccuucucaauguuuuauucuaguggcuuucuauaccuguuucauagaguccauguuuucuuucauucuauugaggauguaaacaguuuucuaaaauauuucuucugguuuauacacaaaauuaagacguuuuuguuuccucugaguugucagagugauaugcauuuuccuugugcugccagagguuuucauaugaacuuuuuuuuuuuuuuugguaaagcaacagggucuugcucuguugcccaggcuggagugcaguggcauguucauagcucauggaauccucaaacuccugggcucaaguguuccucucaccucugacuccaaaauagcugggacuacaggaaaacaccaccaugcuuggcuaauuaaaaaaaauauauauauauauauauuaaaacaggguuuugcgguguugcccagucuugaacuccuggccucaagugauacucccaccuuggcuucccaguguuaggaauaaaggcaugagccaccaugccuggucagguuuuuuguaugguuuaugaauauucaaaaaaggaucugucuuucaucaaauacaggguauguagauugccuuugacuauccucaagcucagauucucucucauauugguuagaacccuuuucagcuccauuguuggcaggcagguugauacacauagcuuuuaaccuguuucacagugucugucagcuacucaucuaguggguucugcuggacccauauggaaucgucuaccccuacuacaauguucucagaugcucugaaccagauaaacuaugugaaacaguacagccucccacauguguuacuaccugaguguuacuugugagggcucccacuccuagcacacagugugccaguaccaauucugccauuucugcccuuuugauuuuggggaauuagagucuccaugugaauguagaccaguuuugagaauugcugauuuccucugcaaguaguaaccacguaguccaaauggauguccgguuugccaguuucuagaugaacucuuggcuucuaagccaugaggcugacaguuguggaaggacucaauguuuccuaucuucuuuuagguuucugugggcugcugcaugaauuggccagauuguuuuuucucauuucaguauuaggcuuauuguuaauggagauuucucccagauccugguaauaaguuggccaucaguuuaaguuuucaguguuuggggaauuuuaucuuuuucuauaucuugauagguauuugagugggaaauugagagaggcuauguuagugauugcuagccaagugcuauuuuaaaguagaaauccaguguauauuuuagauuagagcagagauuggcaaccauuuccuguaaagggccagagaguaaauauuuuagacuuugcaagccauaugaucucuguguuuuaacuauuuaacuguuguuggagcaugaaagcaucacagaaaaaugcaaacaaauuagugugguuguguucaaauaaaacuuuauuuacauaaacaggaggaccagaugaaaaaguucuggagauagcuggcagucaugguuacacaacagugugaauguacuuaauggcacugaacuguacacuuaaaagcaguuaaguuggaaaaaauuuuauauauauauguauauauguguauauauguauauauguguauauauguauauauguguauauauauguauauauauauguguguguguauauauguguguguguguguauauauauaaaaucaugccaauaaagaagccaaaacagaaaaaccauauuuugcugacucugaguuuagaggaauuagaucuagcauaggcagagagagagaggaagaaauuacauauguacaguaggacagugacucuguuaauaagcuagaaggcagugggagacauuugaguauuuaagaggaauaccauaauggggauggugagaucuuggaaagcuacaauucauccuagugaugucaucuuaugaucuuuacagauggagauacacaagaguucacauucacauucuuugacauaaggaucagaguagggcuuuucuacuucucuagaggcuugagaaaccucugcagcugucagaaguguucauaucagaaacaaaagcuaaccagucauuucuuuuugcuuguaguacaaauggugacuagugaugcuucugguaguugaucugagcucuucccaggacuagaagauccuagcauuuuaguuauuaaccacagcacacuuacucaauaaaagagcagucaucagucugagucaacuguuuauacagccuccagccuaagauucuuccuuaucagcuagagaccugggcuuaagaauuucacaaugggcugggagccucuuagagaaacuagccuuuugagacuuucucugaguugggcucucuuguuuguuguuguuguuuuugaaacugucucacucuguugcccaggcuggagugcaguggcgugaucauggcucacuguagccucgaccucugaguugggauaucuugaaggaauacaugaaggaaaagggaacagagauuaagguuuuccaggcuuuggguuguaaucagacaguuuagcuguauucugaacacccagcacuuaaugugcuugguuauccauguguauguaucaagggugggggaacucauggagugagucacugagugguaugguuuaaauggcaggaaacucuucccucaccccgccuuggguaagaaaagggcauagcagagcgcugacacacaucccucugcuccagaaaguguacaguaccccucugcuccccacugaaacccuaaaguuguucaucuucaugugugccaggaaaggaguggaucugugaugcaaauaggauuauuuggucauaucugcugacucagucuaaagaagcuuuugaaggggaugagaugaaauuucaucuaugcugcagagagcaggaggugcauugcuggauggagagaggacuguaggcugcaugugagccaagguagacgagggaagcaugggggugggcaugaggaacuggggcagccugacacgugaucuuggcauugcaaaacugauauccuguuggccuuugggccacaugauaugaugacagugcaguauccccauggcccuuucuuuuucuagauuucauuuaugauacucucagauuuuuaaauagcaugacuuuccccagggagaaauucagaccucaggucucuaggacugcucugaggucaugagauagacucaguuugaaccuguugaguuuaaaugucuuggaaugauuuuagcaucucaguacccccuuucccagugcucaucuggucagcugcucuggaaccugagggauucuaaacugagacuuaguuuggggucauaugcaguuaaaaagggacagucuuuuggcaccuucaccucggagguggcugcuuuuuggcuuagcguuggacucaucacugaaaaagauaguugagagguuguuuuugaccugagcagccuuauuaagacucaguuauuggcaaaggagagaaggcucugcuuauaaauguugcagauuuaaaggggaaagaggaaaccacaguaaguaaagagcgauucagggagaccaguuucucuuuuuuauucagaaugcugcucagguaucugcuuuccuaggagccaccuuauugucagguucugccuucgguuuauguguauucuucccuuaauucuuagaagagggaagaugcuuugggguuguucacagguucccauucgacauaaaauagaagcugccuaccuuuacauauacucaguuuuaucuucuccaagucucccagaaguucucuuugaaaguuccuagagcagggacugcuuuuauuuuuuuuccuucuccuaggcuuuaagcauguauuuagauguaugucaccauuggguaaaagaaaggcuaaagauucagauaacuuuucccaucuguggaaacauggaaagcaguacucagcagaggaaugaggacugauuauuuugggccucuuuuuacuuuauccaagugaagaaucuacugugcuauauauuugucaaaagcaauuccaaagggcagggguugggggaaagcaguacggcauaauaagauuugggcaaguuagauaggagcugugcaguugguaaugaagaagcagaacuguuucuuucucauuauaaaaguaauccaugcuaauuguaaggaaaagaaauaaaauauuauagaaagcaauaaagaauacaauaauaauaacugauaauuccuguuaauauguugguauaauuucuucuuaguuuucuguagguauagauuucggcucacugcaaccucugccacccagguucaagcgauucuccugccucagcuucccgaguagcugagauuacaggcacugccaccacacccggcuaauuuuuguauuuuuaguagagacaggguuucaccauauuggucaggcuggucuugaacuccugaccucaugauccacccaccucagccucccaaagugcugggauuacaggcgugagccaccauuuuuagaaacaaaauaaagaucauucuacauaugauacuuuguaauauuuaaaauauaacgggauuguuuacccaucuaauuaaguauucuuaacaugauuucugauggcuacauaguauuccauuguuuggaugaacauaauauaauguauuuaaacacuguucuguucaauucagcauuugauuuaucggguagacauguuuugaagggaucuugaauaguacaguggaauuagaguuauaguugcgguucugcuuaauucuuagcucugugauccugagcauagauuaaagucuuagcuuccauuuccucauuuguaaaagaaugcuauuaauaguaaugacccuccugaguaaaaaugguuagaugacaugacccauguaaauuucuuagcaugaaaucuaacauauaccaggaacucaauaauuguuaguaguagcguauagcauuauccuugucuugacacuuugucaucuguguacucacuguuagaauuugggucucaaggaaagaaaauugcuuucauuuagauaaguaaaauuucagaaugaaaauugccuuuagauagguagccucuuuuaccaguugaguaccuuccagauaggggcauuugccaacuuccugaauuucacagggaaaaaaaaaauucugcagucucugugguugugcggccccauuugguucagaacaaggaagugggaaaccaccagcugcaaccagggaauuaucuuuguguccgcaggcaaagccagccaagccccccuguucuacuuaucuuuuuuuuuuucuuuacuugcuuguuuuuuauguucuuuuagucugaauuuuuuuuuuuuugagcagagucuugcucuguugcccaggcuagaguguaguggcacaaucucggcucacugcaaccucuaccuccuggguuccagcgauucuccuaccucggccuccugaguagcugggacuucaggcacaugccaccacacucggcuaauuuuuuguauuuauuuauuuuuuuaguagaggugggguuucaccauauuaaccaggauggucuugaucuccugacuuugugauccgccugucucagccucucaaaaugcugggauuacaggcgugagccacugcaccuggccuggaaauuuuuaaacauacggaaaagugaauagcgcaguacauagaauacuuguauagcuucugcuuagucucagcaguuguccuacuuucuuuauuuuuauuuuuuauuauacuuuaaguucuaggguacaugugcacaacaugcagguuuguuacauauguauacaugugccauguuggugugcugcacccauuaacuugucauuuacauuagguauaucuccuaaugcuaucccucccccagccccccaccccaugacaggcccggcgugugauguuccccuuccuguguccaaguguucucauuguucaauucccaccuaugaaugagaacaugcaguauuugguuuucuguccuugcgauaguuuguggagaaugaugguuuccagcuucauccaugucccuacaaaggacaugaacucauccuuuuuuauggcugcauaguauuccaugguguauaugugccacauuuucuuaauccagucuaucauugauggacauuuggguugguuccaagucuuugcuauugugaauagugccacaauaaacauacaugugcaugugucuuuauagcagcaugauuuauaauccuuuggguauacacccaguaaugggaugacuggcucaaaugguauuucuaguucuauauccuugaggaaucgccacacagucuuccgcaaugguugaacuaguuuacagucccaacaacaguguaaaaguguuccuauuucuccacauccucuccagcaccuguuguuuccugacuuuuuaaugaucgccauucuaacuggugugagaugguaucucacugugguuuugauuugcauuucucugauggccagggaugaugagcauuuuuucaugugucuuuuggcuacauaaaugucuucuuuugggaagugucuguucauauccuuugcccacuuuuugauggggcuguuugauuuuuucuuguaaauuuguuuaaguucuuuguagauucugcauauuagcccuuugucagauggguagauuguaaaaauuuucucccauuguguagguugccuguucauucugauguugguuucuuuugcugugcagaaacucuuuaguuuaauuagaucccauuugucaauuuugucuuuuguugccauugcuuuugguguuucagucaugaagucuuugcccaugccuauguccugaaugcuauugccuagguuuucuucuaggguuuuuaugguuucaggucuaacauuuaagucuuuaauccaucuugaauuaauuuuugcauaagguguaaggaagggauccaauuucagcuuucuacauaugguuagccaguuuucccagcaccauuuauuaaauagguaauccuuuccccauuucuuguuuuugucagguuugucagagaucagaugguuguagauguguggugcuauuucugagggcucuguucuguuccauugguccauaucucuguuuugguaccaguaccaugcuguuuugguuacugcagccuuguaguauaguuugaagucagauagcaugaugccuccagcuuuguucuuuuggcuuaggauugucuuggcaaugcaggcucuuuuuugguuccauaugaacuuuaaaguaguuuuuuccaauucugugaagaaagucauugguagcuugauggggauggcauugaaucuauaaauuaccuugggcaguauggccauuuucacaauaucgauacuuccuauccaugagcauggaauguucuuccauuuguuuguauccucuuuuauuucauugagcagugguuuguaguucuccuugaagagguccuucacaucccuuguaagguggauucguagguauuuuauucucuuugaagcaauugugaaugggaguucacucaugauuuggcucucuguuugucuguuauugguguauaagaaugcuugugauuuuugcacauugauuuuguauccugagacuuugcugaaguugcuugucagcuuaaagagauuuggggcugagaugaugggguuuucuaaauauacaaucaugucaucugcaaacagagacaauuugacuuccucuuuuccuaauugaauacccuuuauuucuuucucuugccugauugcccuggccagagcuuccaacacucuguugaauaguaguggugagagagggcaucccugucuugugccaguuuucaaagggaaugcuuccaguuuaugcucauucaguaugauauuggcuguggauuucucauaaauagcucuuauuauuuugagauaugucccaucaauaccuaguuuauugagaauuuuuagcaugaagggcuguugaauuuugucgaaggccuuuucugcaucuauugagauaaucgugugguuuuugucuuugauucuguuuauaugacggguuauguuuauugauuugcauguguugaagcagccuugcaucccagggaugaagccaacuugaucgugauggauaagcuuuuugauguguugcuggauucgguuugccaguauuuuauugaggauuuuugcaucgauguucaucagggauauuggucuaaaauucucuuuuuuuguugugucucugccaggcuuugguaucaggaugaugcuggccucauaaaauaaguuaggaaggauucccucuuuuucuauugauuggaauagccccucuuuguaccucugguagaauucggcugugaauucaucuggcccuggacuuuuuuuguuugauaggcuauuaauuauugccucaauuucagagccuguuauuguuauauucagggauucaacuucuuccugguuuacucuugggaggguguauguguccaggaauuuauccauuucuucuagauuuucuaguuuauuuguguagaggucuuuauaguauucucugauaguuuguauuucuguggaaucuguggugauauccccuuuaucauuuuuuauuguguauauuugauucuucucucuuuucuucuuuauuaggcuugauaguggucuaucaauuuuguugaucuuuucagaaaaccagcuccuggauucauugauuuuuuugaaggguguuuugugucuguaucuccuucaguucuccucugaucuuaguuauuucuugccuuccgcuagcuuuugaauguguuugcucuugcuucucuaguucuuuuaacugugauuuuaggugucaauuuuagaucuuuccugcuuucucuugugggcauuuagugcuauaaauuuuccucuauacucagcuuuaaaugugucccagagauucugguauguuaugucuuuguucucauugguuucaaagaacaucuuuauuucugccuucauuucguuauguacccaguagucauucaggagcagguuguucaguuuccauguaguugagugguuuugagugaguuucuuaauccugaguucuaguuugauugcacuguggucugagagacaguuuguuauaauuucuguucuuuuacauuugcugaggagugcuuuacuuccaacuauguggucaauuuuggaauaagugugaugugguguucagaagaauguauauucuguugauuugggguggagaguucuguagaugucuauuaaguccacuuggugcagagcugaguuuaauuccuggauauccuuaacuuucugucucauugaucugucuaauguugacaguggggaguuaaagucuccuauuauuauugugugggagucuaagucucuuuguaggucucuaaggacuugcuuuaugaaucugggugcuccuguagugggugcauauauauuuagaaugguuagcucuucuuguugaauugaucccuuuuccauuacuuaauggccuucuuugucucuugaucuuuguugguuuaaagucuguuuuaucagagaguaggauugcaaccccugcuuuuguuuucuauuugcuugguagaucuuccuccaucccuuuauuuugauccugugucugucucugcacaugagaugggucuccugaauacagcacacugaugggucuugacucuuuauccaauuugccagucugugucuuuuaauuggagcauuuggcccauuuacauuuaaggucaauaugguuaugugugaauuugauccugucauuaugauguuagcugguuauuuugcuuauuaguugaugcaguuucuuccuagcaucaaaggucuuuacaauuugguauguuuuugcaguggcugguaccgguuguuucuuuccauguuuaguguuucuuucaggagcucuuguaaggcaggccugguggugacaaaaucucucagcauuugcuugucuguaaaggauuuuauuucuccuucacuuaugaagcuuaguuuggcuggauaugaaauucuggguugaaaauucuuuucuuuaagaauguugaauauuggcccccauucucuucuggcuuguagaguuucugccgcaagaucugcuguuagucugauuggcuucccuuuguggguaacccgaccuuucucucuggcugcccuuaacauuuuuuccuucauuucaacuuuggugaaucugacaauuaugugucuuggauuugcucuucuugaggaguaucuuugcgguguucucuguauuuccugaauuugaauguuggccugccuugcuagguuggggaaguucuccuggauaauaugcugcagaguguuuuccaacuuggcuccauucuccccaucacuuucagguacaccaaucagacguagauuuggucuuuucacauagucccauauuucuuggaggcuuuguucguuucuuuuuauucuuuuuucucuaaacuucucuucucauugcauuucauucauuuggucuuuaaucacugauacccuuucuuccacuugauugaaucagcuacugaagcuugugcaugugucaccuaguucucaugucaugguuuucagcuccaucagguuauuuaaggucuucucuacacuguuuauucuaguuagccauucgucuaaucuuuuuucaagguuuuuagcuucuuugcgauggguucgaacauccucuuuagcuuggagaaguuuguuauuaccgaucgucugaagccuucugcucuaaacuuaucaaagucauucuccauccagcuuuguuccauugcuagcgaggagcuauguuccuuuggaggagaagaggcgcucugauguuuggaauuuucagcuuuucugcucugguuucuccccaucuuugugguuuuaucuaccuuuggucuuugaugaugaugacguacagaugggguuuugguguugauguccuuucuguuugucaguuuuccuucuaacagucaggacccucagcugcaggucuguuggaguuugcuggacguccacuccagaacccguuugccuggguaucaccagcggaggcugcagaacagcaaauauugcagaacagcagauguuccugccugauccuuccucuggaagcuuccucucagaggggcacccggccgaaugaggugucaguuggccccuacugagaggugccacccaguuaggcuacucgggggucagggacccacuugaggaggcagucuguccguucucagaucucaaacuccaugcugggagaaccacuacucucuuuaaagcugucagacagggacguuuaagucugcagaaguuucugcugccuuuuguucagcuaugcccuguccccagagguggagucuacagaggcaggcaggccuccuucagcugcagugggcuccacccaguucgagcuuccugccugcuuuauuuaccuacucaagccuuagcaauggcagaugccccuuccccagccuugcugccgccuugcaguucuaucucagacugcuuugcuagcagugagcaaggcucugugggcaugggacccuccgaggccaggugcgagauauaaucuccuggugcgccguuugcuaagaccauuggaaaagcgcaguauuagggugggagugucccaauuuuccauguacugucugucacggcuucccuuggcuaggaaagggaauuccccgaccccuuguucuucccgggugaggugaugcccugcccugcuucggcucaugcuucaugggcugcacccacuguccaacaauccccagugagaugaaccugguaccucaguuggaaaugcagaaaucaguggucuucugcguuacucaugcugggagcuguagaugggagcuguuccuauucagccaucuuggacgggcaaguguccuacuuucuuauaugugaauucugaaacgcaagguccuaacugcacucccugccacaagacagacaggauugcgcuacagcaccucacaaagugggaaaaaaauguauacacucuuagauccagggguuuauagaaacagaaagucagugcagaaggacucuggacuccgggaugguagaaauagauuuuauuuuuucagauggagucucacuuugugcccaggcuggagagcaguggcaugaucuuggcucacuucagccuccgccuccugaguagcugggauuacagacgcaugccaccaugaccagcuaauuuuuguauuuuuaguagagaugggauuucaucauguuggccaggcuggucucgaacuccugaccucaaaugaucugccugccuuggccucccaaagugcugagauuacaggcaugagccacuaugcccagccagaucuuuuguuuuuauaauacaaaucacagaaaguaaaucuuagugucuggcugaaggaaagaaguagauccagauguccaucaacaugacaauggguaacuaccuugugguauauucauaaaagugaauaauauucagcagugaaaaacagaugaaguagagcuacauguauaaacauggauaauuagaaguuaagugaaaaauguaauuugccuaauaaucuuucucuauacaauguaccauuuauuuaaggguauaaacaugaaacaacacuauaugugauuuguagauacauacaaacauaauaaauguauaaaaacgugggcaacaaggaagucaacuacuuuagaguagagguuccccuuguagaugguugggugagaugaaucguauucaggaaggguacauagaggacaacugaaucaauaauauucaaauuuauuaaagcuguaugguaggugcagaggugcuaauuuuuaaaauauuuuacuguauguuuaaaacuuuaaguguaaagaaaaaacuagggcagaaaaacguuguuuaaaaugcucagaauccuggaucacuuauuuugugagugugaaagcugagacugggagaguucaguguuuugcuucucauauacauuuuugaauuuuguucaauuaucauacagccaaauuggcuuuuuugggaauaaaguucuaugaaucuuaagacauguauagauuauuauaauuacuaccacagacaggguuuagaacugcuccaucacuucuaaaaacuucucauacucuuccuuuagugugacacccagauuucuaaacccuggcaaccacugaccagcucugcaaucacuguaguuuuguccuuuggagaaugucauacaaauggaaccuuacaguguguaaccuuuagagaguggguuuguuuacuuagcauaaugccuuugagauucaucugaguugauacauguaucaauuguuuauuccuuuuuauuucugagugguuuuccauggucuguagguaccacaguuuguuuauccauucagccauugaaggguaccuggacugcuuccagauuuugucuauuaugaauagaguugcuguaaacauugguguagaggguuccauguaaacauaaguuuucaucuuaguagggagccaggagcagaauuauugaguuguagggugaguacuaguguuuuuaacuuaugaaaguuuuuucuuuuucuuuuuuuauuaaaaaaaaccuuuauaagauaccaucaaauaguuuuccaaaucagugcuuuuacauuuacauuccuaccaacaguguaugaaaauuccgguuucugcacauugcuauugucuuuuuuguuguuguuguuauuauagcaauucagaugagaaguggcaucuuauuaucguuuuaguuugcauuucucuaaugguagggaacauuuuuaucugcuuauuugccgugaaaacaacaacauauucaauaacaacuucuuuuggugaagugucuguucacaguuuuuucagcccuuuuuuuuucuucuuuuuuuuuuuuugagagggagucucacucugccacccaggcgugaucuuggcucacugcaggcuccgccuccuggguucacgccauucugcugucucagccuuucacguagcugggacuacaaggcacccgccaccacacccggcuaauuuuuuuuuuuuuuuuuuuuuguauuuuuaguagagacgggguuucaucauguuagccaggauggucucgaucuccugaccuugugaucugcccaccuuggccucccaaagugcugggauuacaggcgugagccaccgcuccuggcugaguuguguguuuucuuauuguugaauuucaggauucuuuauauauucuggauaaaaguucuuuguuggauaugugauuugcaaauauuuuaucccauguuauauguuauauagcuuaucuuuucauugucuuaaagugucuuucacagaucaaaaguuuuucauuuugauuaaugucaguuuaucauuuuuuuuuucuuuuauguauuguguuuuuggugucaugucuaagaacuguuugcuuaacugaagaucacagauuuuuucauauauuuccuucuaagacuuauaguuuuauauuuucuauuuagauuuaugacuuagcuuuuauauaaguugugagguuuagguuaaguuuguuauuuuacauaugaauguccaauugcuucaaccgcauuuacacuauuuucaaaaaucaaaugauuauauuugugugggucaaauucuggacuauuauguuucauugauugaugugucuauucuugggcaauacugcauuguuucgguugcuuuaacuuuguaguaagccuuaaaaucaggcaaugugacuccuucauuaucugcuucuuuuacagaauuauuuuagcuauuccuguuucuuugaccuuccauauacacuuuagagucagucuaucuauaaaauauccuguugggauuuugaucagaauugcuuugacucuauagaucguuuuggugagaaaugacaucuuuccuauguugagccuuucaguccuuggacaagguaugucuuuccauuuauuuaggucuuuuauuuuaucagcauuuugccauucucagcauauggauccuuuaaauauuuuguuagauuuauacuuaagcauuucaguuuuuugaaacauuuuaagugguucuuucaaaaauguugcuuuucaauuguacacugcuacuguguagaagugauugauuuuuguguguugacuucgcauccugugaccuuuaaaaacuaauguauuuuuuaggagcuuuuuuguagauuccuugggauuuuccauacauauaaucacguccauugcaaauaaggacaguuuuacuucuuccuuuucgaucucuauuauuuuuguugccugauuuccucgcuaaaguugccagucuaauaguaguggugagaguggacauccuuguccuguuucuaauguugucggggggagcauuuagucuuucaccauuaaguauuagauuaggcauaguaauuuuaggugcccuuuaucaggcugaggaaguucccuacaucagguugaggaaguucccuacuauuccuaguuugaugauaauuuuuaucaugaauagauacugaauuuugacaaaauacccuuucuguaucaguugauaugaucacguacuuuuuagucuuuuuuagucuuuucagcacugauuuggugaauuauauuaauugaauuucaaauauugaacuaaccuuguguuaccaggagaaaacgcacuuggucauagaguauuauucuuucuuguuuuugagauggagucucgcucuguugcccaggcuggagugcaguggcacaaucucggcucacugcaagcucugccuccuggguucacaccauuccccugccucagccuccggaguagcugggacuacaggcgcccaccaccucgccuggcuaauuuuuguauuuuuuuuuuauuuuuauuuuuuuaguagagacgggguuucaccuuguuagccaggauggucucgaucuccugaccucgugauccgcccaccucagccucccaaaguguugggauuacaggugugagccaccgugccuggccaaguauuauucuuucuauacugcuacuuuagauuugcuaauauuuuacugaggauuuuugugucuguuguucaugaggaauauuggucugucuguccuuccuuccuuccuuccuuuucuuccugcuuccuucuucuucccucaucuucuucuuuuuccucuauuuucuucuucucuuccucuccuuccuccccacuacccaacuccucuaguuuugguaucuggguaauguagugauggaccauucuguuuaauugauugauguguucauucuuuccccucuucaacucaacaugagaaauguuuccuucucuuuuauuuucugaacaagauuguauaaauauuugguagaauuggucacugaaacugagucuggagauuucuuauucagaugauuuuaacuaugaauucaauuuauuuaauaguauuauucagguugucuuuuucaucuugggugaguuuuggaguuugugguuuuugaagaauauguccauuucaucuaaguggucaaauuuaugugcauagaguugguuggaguauucuuuuauaauuuuaauugcuaggguucuaauaucuucuuucauugcugauauuguuaacuuuuuuccuucucucuuuuuauccaugucauucuaccuagaaguuuauaaauuguauugacuuuuuucaaagacaaacuuuugguuuuauugauuuuuuuuuuuuuuuuugagacagugucucacucugucgcccaagcugaagugcaguggcaugcucauggcucacugcagccucgaccuccugggcucaagugauucucccaccucagccuuccaaguagcugggacuacauguuugcaccacuacauccagcuaauuuuuuaaauuuuuuuuguagagacaagguuucaccauguugcccgggcuggucuugaacuccugggcucaggugaucuccccgccuuggccucccaaagugcugggauuacaggcgcgaggcacugagcccugccucucuauuguuuuucuuuuccauuucauugaucucugcucuuuauuauuucauuuuuucugcuugccuuggguuuauuuugcucuuauuuuuuuuauucuuaagguggaagcuuagauugcuaauuugagaccauucuuuuugccuaauauaagaauuuccagcugggugcaguggcucaugccuguaauccuagcacuuugggaggccgagguggguggauugcuugaggccaggagaucaagaccagccuggccaacauggugaaaccccgucucuacaaaaaauacaaaaaaaaaaaaaaccaacacaccaaaaacugggcauaguggcaggcaccuauaaucuccuacuugggaggcugaggcaggagaaucacuugaaccugggaggcggacguuguagugagcccacauccggccacugcacucccguccuccagccugggugacagagugagacuguguuaaaaaaauuuuuuuccuguuacuagcauauuuuuguuguuguuguucaguucaaaauauuuuauaauuuccuuugagaauuccuaucuaugaauuugccuuuccagccauccagagaauuugucaucuguuccauaucuuuuuguucuugguuguuaucaaguacuaaauuaaaauagaauucaucucgugaaggaucauaauagcuucauuuguuaugaauaaugugauauucauuuacauugaucuguuaaggauaauacagccacuguauauugagugcuuauuauauucuaggcacuacauugaucacuuuacauggucuuauuuuauuaaauucucuaacccuuucaguagguacucuuauuaguucaauuaacaauugugaggcaauugacacauauuuuaagugauuugucuguagucacuuggccaguaaaugguagggaugggauggaauguagacuugauuccaaacccccuuaaccauuuuacuacauuuccucuaguuauuucacuucuugccuucucauaaaaauuguuagcuuuuugagggcagauacuguguccuacuuauacuuaucuucuuuucccuacaauaccugcaacaauguuaggcacacaguaauggauugacuaauguuuguggaacuaaauucaacaaaauuaacugaucuagaagagaaucaaaaccauggugcuugccauauugccucagauucuuaccagcuaagcagacucaguguagcauccuauacaaaaccaaaaaagcuuauaggaaauauuugugucaguaauaauggcuaucuuguguucuuuugugaugaucagucagauguggccacaagaguagacagaggagaggguaaggaaaaaacaaaguuuauuauauucacuggucccagagacaagaggcucaggauacuaggcaaggccacuugggaaagacauuaggguggucaggaggcaggagauaggagcaaggaggaaguuuuaguccacugccuuuauugggguuuccacagaaaaagcagggcagggcaggacagggugaauaguuaaggauuggcuaguuugaauaguuucagcaggccucuaagcuguagggcugcacccuaguugucuggugucuggcccuggggcaauuaaggaagaggaauauagccuccugggguauaaggggcagauagaggaggucuggcuuuggauugguuaguuugcauaucaaaggcauguuucugggugaguacuugcugucucuaagaauuggcuggaggaugggggucggggugggggcaggcugucucuagccagaaagguuuuuaaagauaccaaaauaucacaauauacagaaaauaaaauauaugcugcauaucaagcaauucaacuuuuucuuguaauaucaugacuuuucuuugcuucuugggagcacuuccagcaugacugguggcacuucaucuggauccccugguguuauucagggguuacaguaucacacuaaacaggauggaaaacaugagggaagggucgacccuugaacaacauggguuugagcuaugcagguccacuuagaagcagauuuuuucaauaaauauauuggaaaaagguuuggggguuuuugacaauuugaaaaaauuugcaggcaagucuuauagccuagaaguauugaaaaagauuaagaaaagguuaaguaugucaugaaugaauaaauacauguagacacuaguguauuuuauaguuuacuacucuaaaauauacacaaucuauuacaaaaaguuaaaauuuaucaaagcuuauguacacaaacacuuauagacuguacauugugccaucguaauugagagauguaaagauauaaagaugcacuauuaaaacauaacugcauaaaauuagcuguaguacauacuguacuccuguaauaauuuuauagcugccucuugcagugagcucagguguugugaguaucccuuagaaugcccugugccccugaucaucuccgaaugggcuguucuuucuccaguaaaugguugaucccaauaaaaaagugauccuugugguucucgcauuuuucaugguguuuagugcaauaccauaaauguugaauaacaccagaggacccauacaaagugcacuagucaugcugaagugcucccaagaaucagagaaaaguuaagacauuacaaggaaaaguugaauugcuugauaugcaccauagauugaggacugcagcugcaguuacccacuauuuuagacgacgauucaucuugugaacagaugaugcaaacuuaugguauugauaaauguaguacaguacucuaaauguauuuucucuuccucaugacuuucuuaauauuuucucuucucuguaagaauacaauauauaauacauauaacauacaaaauuuguguuaauugaucucaguaaggcuucuggucaacaguaagcuauugguaguuaacuuuagaggaguuaaaaguuauaggcagauuuuagacugcucagggagucagugccccuaaccuccacauuguucaaagaucagcuguauauacaauacaaagaccaauacucugagcugguaaggagguuuauaaguaugacuaaccaaauauaagucugccccaagcucugcuuuuugguucuggccuucagucuguccaucugcuuucucuggaccuccuucucauacuuugaauuuuuuaaguaguuugucccucauaugauuuuuuuucuauuccuuuuucccuuccuguccuuccuucacuccuuucccucccaccucccucccucccuuccucucucccuuccuuccuuccuuccauccaaccauccauccauccauccauccauccauccauccauccauccaucuauccaucuugaggcuuuaggugaguucuucaccauuuauuuaacaaauguuuuauaugagucuuacuauaugccaugcacauuuuaaugcauuuuuuaaauauaauucccauaacaauccuaugaauuggguacuauuaugguuccuauuguacagaugagggaacucccucacaggacuuucuaguggcccuauagccauuugccacacccauuacaaauuuuuguggcaggcuggagggggguauaaaguuaaaacaaaggccucugcuucugaguuggucagucauuuaccuguagagcugugcuuugucgguaaagggcaauguaguugugugaucaggauaguugccacagaacacacaagggguuuaggcaugaccuuccuugccccauuggcacgcaagaacuuuuuccuuccuggccugcagucugauacauacacacauagaaacacagacacacacacacacacacacacacacacacacacacacacagacacacacacagagagagagagagagaaugagagagagagagagagagagagagagagagagagagagagagaacauauguaacauucaugccauggauuuaaagcagaguacaauggcaaaaauacaaucuugaaacuuggcgacaucugagcgugacuucagccucugccacuuauugucuguuugaucuugggcagaucacuuaaucacuuggagcuuugguuuucuccacuaugaaaugaggaagaugauggugguuauaauaaaaacucugaugacugaaugagaugauauauuugaauccuuagcccagugauuugcacauagaaauguucaauacauguuagaaauguuugugauuauuaauaugcaaggcuucuuuauguauuaaagauaauucacccucuagcauauauauagcuuguauaaacugaauuuugagaacccagagcaaugcuugucuuuaucuagggacuuaacuguuuuggaucuugauguuaguuuuaucuucaucuuuggccguccguagguccugaucaguuccaucaaccucaagauuuaacuuuugguguccaaaugucuaauuggcccugugcaaaugcugacauuucuuuugagguccauggcaaagccuggcaccagaauccagcuuuuuuuuuuuuuuuuuugagaugcagucuugcuuugucacucaggccggagugcaauggcaugaucuuggcucacugcaaccucugccucccagguucaagugauucuccugccucagccuccugaguagcugggacuacagacgccugccaccaugcccagcuaauuuuuguauuuuuaguagagacgggguuucgccauguuggccaggcuggucuuggacuccugaccucaagugauccucccgccucagccucccaaagugcugggauuacaggugugagucaccacgcccagcccagaauccagcuuucaucuggacuguugaugugauuuuuuuuucccucucccagagugagucuuuauguuguggcugucacauaggagggcccaggggcaggguuaagccagauucuacuucacugaaggccuggaauggcuguuaauagcuccugcuauagacagugaggcuugagccagauuuuuuaguacuccauuugucagacacggggugccaccuugaaugacacugcugaaaaaggauugugguaaccuggccagccccagggagguuggagugacauugcguuggugugccucuucccuuuuauggaccaggccaagcccuauuaaccugaaggagugugauggccuuguuuagccaaacagccuuuuccacuuuagucauccuuugaaaucuuauuaagccaggggcagggaaggaagaaggaggcagacagacucuugaaacuaaaaggagggaaagaggaacauucuaaccuuccaccugaggucauacuuuggcaggaggaagggaccagggaauuuuauacaaggcagcaagagagauauaagaguuuggggucuggagucagauaaaccugguuuugaauucugacucuacucucuuaugugugguguugaccagaucaccucacuucucugaaacucguuuccuuaucaacaaaaugggaaaaguaauuguaccuaucucagaagauugguauaaaaauuaagcaagaaaguucauguaaagcaguuaaucagauacuugccuggaauauuauuauuuuucuucugguucuugauuaaggaugccuggaauauauuaagugcauaccaucgcuauucgcaaaguuuuggugacaaagaacaauaggaagaaacagccuaggggaagugaaaagcagucuugggguuucugugccauucuccggggucuccuuguaacaucuuucagucugucucccuucccuucuucccuuuuucccuucuucccuccccuccccuccccucccuuccccuccccaagucuugcucugucgcccaggcuguaguacaguagcaugaucucgguucacugcaaccuccgccuccugaguucaagcgauucuugugccucagccucccgaguagccgagguuacaggcgccugccaccaugccuggcuaauuuuuguauuuuuaguagagacgggguuuugccauauugucuaggguggucuugaacucccgaccucaggugaucugccagccucugccucccaaagugcugggauuauaggcaugagccaccgcacccagccacaucucuuagcguuacaaacacaucugugagugccaagagaagagguaaaguucuagagagucuucaacauguggacuguuuucccagccagggcauaggagguaugcugugugugugugugugugugugugugugugugugugugugugugugugugugugugugauugagauugacaucaacccccaucuaguguugaggucuaagaggcguguugccucgguggugguuguccaugacccaucaaaucaacguuucuucaagaggaacagacugucauucuuuucaucucucuuaguaguaaagaaccauuugccuuuaauaaugaaggaagcuacuuaaauccauccccagagcccucacaagcaggguuuguuccugaguuaauugugcuugacuuaugaaggguuucuaaugaguauguauuuuaacaagucuggcauugggauugggaaacaguaucauuaaccagugcuggagaccagugguuuucuucuucuuuuuucuuuuuguuuugcuuuuaagucacagagcccaauauguaaaugaaagccuggaaggcugcccacuuuugcuccugagggcauuucuaagaaaguggggaaauauaguuugcaaaacacugcaguuggcuuccuggguuguagcaaucuuuuucuguuuaggucucuguuuggggaaaaggauuauacaugacaguguaaauaagcagccauguuauaauaaauagguuucuacuguaauaacagaacacuuaccucccgcaguuccccuuuucuaaugccgcccaagcuguagcaguugaagccguugauugggacugacugaauguuuagggaacacagagcucauuauuuaauaaaguguuguaaccaaaguauguucaggaaguguucaggggauucugagccagugauggugcucuucagaacauuucaguuaauacaaaauaugccacuauuaauucauuuugugcaaacuccagugccauuuuccacagagagcaacuuguauacauaguucucuuccauaugccguggcuuaaccugaugugucuuuuuucucccuuuguaucagggucugaguaugaccugaacuuuaucuuucucccccucuaggcuacagaugcacauguugaauggagcucuucuggcauugcuguuuccugugguaaacacucggcugguaaguagccucuucuaggaauguaacagcaacaugcaaagcaguacuugccuauaugcccaugugauuuuaaaaauauacauauagcuggccaggcgcgguggcucacaccuguaaucccagcacuuugggaggccaaggcggguggaucacuugaggucaggaguuugagaccagucuggccgacauggugaagcccuaucucuacuaauaauacaaaaauuagccaagcauggugguauuugccugcaaucccagcuacucgggaggcuaaggcagaagaaucgcuugaaccuggguggcagagguugcagugagucaacauugugccacugcacuccagccugggcgacagagcgagacucggucucaaaacaauaaaaaaauaaaauaaccagggcagaccaaagccuauacaaacucuuggagagguuuaauggaaagaaagcagcuuucagguguucuaaggggcucucguuagauucaaccacauuggccuugaauaauuugcugugggagccucauaaccuguccacuucuccaaggacuuccuagggcaagaauuagauuccuuccccauccacccaaacccaugggccagucuggaccaaacagccccucauggcuagcagggagaaucccaugguugcagcgggcugggugauaaaccagcccagaaagaagcaggagcuacgagccauguccucagacucccaaaugugagacuguggaggcauuagcaggucacauugagaagcucagaaaaagaaaucacuuauaaaauuauuacuacugcuuucugacuuaaauuugccuuaaacauuaagaucauaguuuaaaucuuuaauugauaaucauuuuuggauagcauuuuacaguguacaagguuuuucgcauaacaguguuugagguagacagggcaagaauuauggccucuuguuuuacagaggaagaaaauuuuacucagggaguaaaauuccaaguggcaguuaggauuggagccuaagccucuugauccuaagaucacagcuaugcuuugcucccucuccacaaauauuccugucaucuccuccccacaaauauucauguauaccuuuaugauaguuacaauuuucaagaugcaugucauauaucaguagaaauuauagagaaaacauucaucuaaagcagcgauuuugaacccuaguauguuccaggcucaccuaauuagcuugauuuaaucauuucacaaugcaaacauacaucaaaacaucauacuguacguaccuuauaaguacccacaauuauuugucaguuaaaaauaaaauuaaaaacaaacacugaugcgcugccccacccuuggagaggaugaguucaugaucugugauaaagccugagcauuguguuuuaaaaaguuccccaggugauucuagcauggagugggaguugagaaccacugauuucaugcaaugauucugaaacguaauguucauagcaaucaacugaagggcuuguuaaacaugaggcuugucaggccccauccccagagggucugauugagagagucuacaaguaauggcagggacugaauguuuguaacaaguccccaagugaugccaaugcagggguccuuagaccauucuuggagaaucacugucccagguguucguaacucacaguuacuccaaguguguaacucaaagugugguccuaggaucagcaucacauggguguugcuuguuagacaugcagaauuucaggggccaccugcagaccaccugcaucagaaugugcauuuuaacaggacucccaagguagcuuauauggacuagaccuuuucugccaaggaccccaaagcaucuuacagauaaagcauuugagcucucgauggaggggaacaucuguguuggggagggcagggggcacagccucugucuuaauagucagggugcacuugguucaacauuccccugugagcugggaucaguaggcacaggccgcugacacaggcacuguugcccugccuucuacaucucccacagucugugacuugccugacuucaccugguggacuguagaaucagaacuccugacuuggucucagaguuagaugggguaauuccaaagaaugguaaaaauaaaccaaauugggaaacuuaacaaaaaacggugaauuucccauaccacagcauaaguccuuccugccucaggguuguggaacaggguuggagcagaaguuacuuccugcuuguggagguaaccugcuagggcagaaaaguagauccaaugcuaucuuaucaucucucugcucccccuuguaccuguuuucucaggagacugagaagucaggcagauagagagcugcuuucucaaauuucagcagcucuaucagaucccagaaaaggaaggugcaucagaaaaucucccccuaggcuaauagaguuagugauccugaauugggguguuuccagcccacaacucuggccaaacagcaccugcugagguggauagauauaguuccucuagacaggccaccuucagcucucuuucuaguaggaccuuucccccagugaaaaccaaauauccuucuucuugcaaagccauugaacauaaacagaaauuuugauucucauuguagaagcaugagaaugaaggccccaaaaugcuccauuacauaccugaaaucaguuagaaagcugguggugaaguuuucauucagucaauauuguuacacaaaagguacauaucucccugggucugcugaaguauccuuagucccuuuaucaauaacaguagcgguugcugggugcaguggcucacaccuguggucccagcuacucaggaggcugaggugggaguaucacuugaggccaggaguuugagaccaaccugagcaacacagugagaacucauuucuaauaaaaaauuuaaaaaucagcugagccugguggcucacaccuguaaucccagcacuuugggagguggaggcaagcagaucaugaggucaggagauugagggcagcaugaugaaaccccguguguacuaaaaauacaaaaauuagcugggcgugguggcauaugccuguaaucccagcuacuugggaggcugaggcaggagaaucacuugaacccaggagguggagauugcagugagccgagaucacgccacugcacuccagcauggcaacaaagugagacuccgccuccaaauaaauaaacaaauaaauagaaauuaacugggcaugguggugcaagccuguaguccaggcugcuugagacuuccgcccucccuucugaggugggaggauugcuuuauccuaggaguucaaggcuguagugauuuaugaucaugccauugcacaccagccuaggcaacagagugagacuccaucucuaaaaaaauaaaaaguaacaguagcagcacuaucagcugcugauucuugagugcuuacuaugugccacuguucuaagugcuuuacauggcuuagauuuauuuaaucguugcaauaaacuuaugaggcaagguacuguuauucccaagaucacagugcgccagcaagguuaguuucuucugaggccucucuuugguuugcagauggccacccucaugcugccucuucacuugguccuuucucuacacacacaucccuagugucucuuguuuagccaaauuuccucuuauaaggacacacaucugauugcauagagcccacuguaauggccuccuuugaaccuaaucaccucuuugaaggcccuuucugcagauacuguacagucacauucugaaguacugagaguuagggcuccaacauaugaauuuuggggggacacaauucagcucauagcacccauacuacccuacauagaaaccauuguuucuuccccucacccugcuuuccuuccucccucccuccccucugccuuuccuuccuccuuccuuuuccgccaucucauagcagaugugcugguguaucuguuacauuaacagcuaauacuuuccaaauaaaugugaggcuguagucaacuaacuuaucaaaaauguuuaaguaaccucuccugacauugaaacuucuuuguugggcugucucuuaacuagugauuccagccaaucuggucaaucuuugugcucuuuuucuaaagugaugcuuagaaaagcugggaaugucuccauuugccuauguauuugcaauugguuuaggucugguucuuuuagaugguugggaucccucuuggacuacucuggcuuuagggcuuuuugccuugcagccccuuaguugagcucagauugacuuaacaugagacacaugaggauuggcaacucuuucuuaaaccugaugauccaauuagguuguaagccagcuuuugacuuuugcccuuccuucuuggcccuuuaucuuuuuaauuauuuuauuuuuuugcucauuagcaguaaugaggaagcaagaaaaauaaaaugaacugauuaguguguguacugguaccauagacauacauauacucacauacacaaagacagagugacagggcauuggaaguaguugugacagucagcuaaaggauuuggggcccucagugaauuuccauguguucuacucugcccugugacuuacuggcaccaggauuugcaaaucagcuagagaaugccuaggcuucaguuucucuggguucuccaucuuuaaagcugaacccuaaaagaaggacuguguauuccaguggcccauauuacaaguaagugcucuuuacaccuaggauccuggaaaaaggucuuuuucuagauucagaugaauuauauuaaagggcaauuuccagugauaugcccuuuuguuucuuggagugaaggaggggaaguacaugaugaaccuauugauuauuagauuagcagggagcucaaagcuugucugaugucaucuuaucuuccagaggguaaauuuaggaggauaaaugacgaguuucaguagucaagguggguguccccagaacccauaucucuugacugagacuucagaauuauuuuucuauuccaugaaugaaauucagggagaguuugugugcuggugauagagucucuuccuugauaaaugcacaaacacacaauuuugcagacaauuucaggagggacacagacuacaacuuccucuccuagccccucuccccucuguaagcccaccuauucaucccauguuaaugucuuccugccuaggcuacaaauaguucauaguuuagggaauagaugugcugucuagugugugaguuccuuguuauagccgcuggccauuuguccugauggugauacuggguuccuuaucuauacccgugacuuugcaaagaauaucauccaauccaggauaaaccacuuucaggaaauuaaagccaaggaguggaagcuaaguaggguguccauggaaccugguuacagauuagauuuucaguuacaguacucacgugcaaagcuagugaucuggcccugaaaugagacacugggcccaugcugcaacuucagcgcucugcuuuucacccucuaacccccaugagaguuucuucugaaugcagaauguuguuagcaagggagacuggauacagaaaagaaagugaagauacuauaucagcccucuucccagaccaaaaacucuagccuggccugcauuuguguuuguacccaucugucuucuacuaggagaagcaugauaauuauucuuuucaucaagcuccuuucuucuucaaggccuaaagccucaaguacauuauuaucuuauuaucaaacuugcccauuauuauauauccauguugaucuauuauguuaguuccuuuuuacccccuuuacuaccacucuccuuuugcccaguucuuucugcucuguuggaugggaugguucuuuugaguauuccuaacuuucagacugaguggaagaagauaguaaugauucugucauuacuggggugucuagccuccauucacaaacacuauauugauguucuugggaugcagcuuuuccacugacacaccuuguacccaugugugcugcuggaaaaaccuuguugucaccaaugcagauaggcuugaaaaucucacucuuugcuaauuggcacaucgaaaugugcuaguugaccuagaaaaguuauuucugugacuggcaaauugggcuauuuuaaaaaguuauaguuuggauuuuggaccugaacugaggacagaaugucccuuuauuauccugaggguucuuaaagcguacaaagcuugguuucaaaagagguauuaauuuucuaaagaauugagugaggcacaauagugccucaaccuucugcaaaggccaguauguuucugaucagaugaaugcauugugucugaggaugugggggguauugagaugaguuugggauuccugguccaaaccaaauucuagggacuauccuagaauaugucaacuuaguagcuuuauuuuaagacuaagcuuugagggucuuaaauccuugaugaauccagccuagaucacaccagucaaaccacagauuuuuauugagcacuuuccuguguuaaguaucaugccaugugcugcagaagauacaaaaacaaccaguguacauuccugguccucaaagaacuugcaguuuaguuagaaagauaaaguauaaaugccugaaaaguuauggcaauauuaaaguugaaaacaugaaaaaggaaaaaucaugguugggcaugguggcucauaccuguaaucccaacauuuugggaggucaaggcaggaggauugcuugagcccaggaguuugagaccagccugagcaacauauaagacccugucuuuacaaaaaauaaaaaaauagcugggcgugguggcacauguuuauaauccaagcuacuugagacucaaggcugaggugggaagauggcuugagcccaggaggucgaggcgguggugagcuauggccaacacuacugcacuucagucugggugacagagcaagacccugucacaaauaaaaaaguaaaacuuacaaggcauucaggcuugacugcuaaauugcaguugcucuauguuucaagaaaugggaaaaagauuaauauuagcauucacugagcccauacuauuuuccagguaauuuacacauauauuauucaauucucauaagaaacccauuuuacauaugaggaaacugagguucagaucagauuaaacgacuugcucagaguuacaucauuuguaagugcuaaagcuaaaccugugcacuuuguaccuuaauacacagccuccuggaguaaguggucuggaaaggcuucaugaagaaauaaagccugagccaagccuugagggaugguuagaaugugcaugcaaauugcauaggaaggaggcuguucaagcuaagggaacacauggacauggaggcagaaaauagucaacuaaguauugagauucugaagagcagggugggagucagggauuccaguuguacacagagacauuaccacuuauuugcaaaucacaagaagacacuguuucugucaugucucuuaacccuuacaguauuuagauuuuguguacauuuccuaucuuuucaaccuccacaaauaagaauuucuuauguguggaugggacuuuggaaucagaauagcucuuuuacacauaucucacccuaguguaguuguuaaggggauuggcucagggaucagauucucuagguucauguucuggcugggccacucccuugugugugugugugugugugugugugugugcgcgugugcguguguguguguguggugugugugugugugugugugugugaaggggggcaggggugggagacagagaaaacacaaggagaacaaacuugugcaaguuacuuauccucuguggaccucaguucucucaucuauaaaaugggggugauaauagugccuauuucauaaagcuauugugaggauuaaguuaguugauguguguaaagcaaauagcauugcacuguuagccauuauuagucuuugauccucaccaaaacccugugaaguguguauuagcauguccauuuuacagacagagccuuagaaaguuuaaguaacuuguacaggggggcacacaggaagugacagaacuagcaugaaaacuuuggucuuucugauaccaaaggucaucauaccaaaggaagguuuggucuucuucucuccuaguuauuuagauugauuuuuaaguauucagccauaugaccgccuuuuggcaaauuuuauacaguaucgauuagcaauuugggggcuuaauuuuacuuuuaggauuuuuuuguuacagaaauaguagaugcucaugacuacaguagcaauaauauauuguauauuucaaaguagcuagaagagaggacuugaaauguuucuaacacauagaaaugauaaauacucaagggcauggauaccccaaauacccugacuugaucauugcacauucuaugcaugcaaaaaauacucaugugcacuccauaaaucuguaaaauauuauguaucaauaaaaggaaaaagauuuuuuuaaaaaugagauaugugaaauauagugaauuauuucagauaaguucuaggaagaaaaauaauacauggucauugaaaaguaacucagaggacuauaaagaaaaagcuaaucauuuuaccagcuuuuaguccuguugccucaaggguaaauuguguuaaaaguaucuuuuuacacuuauccuuugcuuguacauggagauuaaagauuuucauauuucuaggauuguugguuuauuuggguuccagcuucuuacacacuuggaauucuacaaauaccacuccaguauauuucuuucucuuuuuuuugaagucucagucugccacccaggcuggagugcaguggugugauuuuggcucacugcaaccuuugccucucagguucaagugauucuccugccucagccucccaaguagcuggggucacaggcaugcgccaccacgcccggcuaauuuuuguauuuuuagcagaggcggggucucaccauguuggccaagcuggucuugaauuccugaccucaaaugauccaccugccuuggccucccaaagugcugugauuacaggcguaagccaccaugccuggcccaguauauuucuuuguuuaacuuaaacacuagauaaucaguaaucucuucaggcauggacauaacucuuuucauccauaguuugguuggacuauauauucauauauuccuucuauucucuguggguaaggacagugucuuuuuucuuucaagugagcaguuuaauaggauaaaaauauugcggaccacugaccuacuucaaaccccucauguuacacaaaaaauagacacagagagauuuguuccaggguccacuguuagauaaugguaagcugaaguacagacuuagaauucccguuuguuuacuucaaauccaggacucuuuucugcuuugccauucucauuauucccgaguucugaagaccauaguuuccacagagugcaugugcaaguggauuaucgcuggacaccaaauuccaaauguucaaguacacaucauuucaguacacacacauguggcuaguguccuuuccaaccuuugccaaaguaccaccucacuuuaugaggcaaaauguguaauggagucaaaguccgaagaaccaagcaguagauuguagagcauggauagagaucaauaauaaauacuucaaaguucaaaaauggcgacauuugauucauugugaauugacuuguagaaagccccauuggagcugaggacaagugucuuuuguuuuguggcugccccuacauagccuuguacuuagcaccugguagauaucuauagauagaauaaaugaauucaucagccaaccugaaccucuauguugcuuagggaaauucuggggaucccucucacauauguccugggaucuugggugcaaagacagaggggugauagauaauauuuuuuuccaggagaauuuuuuuuucaaccaccuaaaauaaugccauuuucuugauuacaacaaaagacauauuuacuguugaaaauuugugaaauauagaaaaguauaaauuuuaaaaaaaucaucaccaaugcaaaggugauuauuuuucuggacacugaaaaaaaagguggcggcuuugugccuuuugucuuuauacauuuauguaucauuucuuuacagaagugauauauguucaaaacagaaaaaaauggaggccaggugcaguggcucccaccuguaaucccagcacuuugggagggcaaggcaggaggaucacuuaagcacaggaguuugacacaagccugggcaacauagcgagaccccauuucuuaaagaaaguaaggaagggaggggaggggagggaaaaauagaauaaaacaaaucauugagcaguaacaacuauuaacauuguuuguuacauauucuggaagucuuuuugucucuuuauagauguuaagaguuuauaguguaguggucaaaaguaccaauccuugaaccagcugguccaugguuuuauggcuggcucuucuaccugcagcugugugaccuuggguaagauaccuaaccuugcugaccuaauuuucuuaucuguaaaauggugcuugguugaacggagaugaugugugguaagcacuuagcccagggccuggcgcauaggagauaaccaauaaaugucagaugcuguuguuuuuacuacuauuacuacuauuauccuaaacacugaggaggugcaugcccuuguugauguuagucuuuagagcuuugaccccaacucccugagcuuuucaguggcgguaaugugaagggggcuuuguuucugcauuagccuugcugagugagauuaaaauucccaggcaggcuuuccuauccacauugaccaacacugccuuuguuuuucacauuuguuucagugacagccuguuugauuagggaacuggccaaucugcuuuucucccuccugacaggugaauugggcccacuccuuuuuggguuuucaaauaaaauguccagaccuuuuagguuugucaguaggcccaagcccuucagcccauuuagggaguggcagcagugagugccaggcagcagccuguuugccuccagagcuuacuaguuugccuuggcccuuguuugccuuggcccugucuuccuaaaaucacauuagaaggaacagcgucuggcagucuuacccaaugucuucugucuccaccuugagccacuacuucaagcaguguuucuuuaugcaauagaagccuuaucuagugagugcuuccacuccuuagucuguggaucagugguucucaacgcuggcugcacaauuaguauccccagagccacuuucaauacacacucauuuaaaaauuuuacaucauuuuauuuuuggcaccuaauaauugcacauauuuuggagguacauugugauauuuagauacagacagugugcgaagaucaaaucaaucuuguuagcauaucugucaccucaagcauuuaucauuucuuuguguugggaacauucaaauccucucuucuagcuauuggaaaauauacaauacauuauuguuaacuauagccacccuacauggcuauaggacauuauaacuuauuccuucgaucuagcuauaauuuuguaucuguuaaccaaccucccuaucuccacccuccccagccucuaguaaccaccauucuacuuucccuuucuaugacauuaacuuuguuagcucccacauauaagugagaacaugugguaguuaucuuucugcacauacucauuuuuuaaaagcacuccaggcaauuccaaugugugcaaccagggcagcucugcuguacaccuuguucuaguucugcccugccacuggcuggggcuuggggcuuugaaggauuuaauuucaccauauuaaguaucaguuuccacauuuuucaaaugggauuuguaaaauuuacccucucuaccuuucagacaaguuauaaagaaaagauaccaaaagauaacaaugaaaagauaacaaagagcuuuggaaaguuaaaagcacuacacaaaugagcacuugccuuguucucucuuugacuucagucacaauuuuuuguaaaggggguuuaauugacauauaauuuacaaaugaaaaguuuauccuuuucaaauauacaauucagugguuuuuaauauauucacagaguuguucaauuagcaccacagucuaauuuuagaacacuuucaucaccccgaaaagaaauugcauaaacauuagcaucauccccauuccuucuuuccuuguucuggacccaggaaaccacuaaucuacuuucugucuguauggauuugccuauucuggacauuucauguaaauguaaccauauaauauggcauuuugugacugacuucuuucacucagcagaauguuuucaggguucauccauguuguugcauguaucaguacuucauuccuuuuuacggcugaauaauauuccuuuguauuauauaucacauuuuguuuagccauuugucgguuaguguacauuuggguugguucuaccuuuuggcuauuguuaauaugcugcuaugaacauuuguauaaagcuaucuguuugucugcuuuggaguauguaccuagaaguagaauugcugggucaaaugauaacucaguguuuaaacuuuagaguaacugccagacuauuuuccaaaguggcuauaccauuuuauauguccaccagcaauguaugagcauuccaaguucucaacauccucacuaccacuuguuauugugucuuuuuuauuauagccauucuagagggugugaugucguagagguugaguauccguuauccaaaaugcuuagaacucgaaguguuucagauuuuggaaugcugcacuuuguacuuaccaguugagcaucccuagucugaaaaucugaagugcuugaaugagcauucuuuugagcaucucuuuaauacucaaauuugacccagccaucccguuacuggguauauacccaaaggacucuaaaucaugcugcuauaaagacacaugcacauguauguuuauugcggcacuauucacaauagcaaagacuuggaaccaacccaaauguccaacaaugauagacuggauuaagaaaauguggcacauauacaccauggaauacuaugcagccauaaaaaaugaugaguucauguccuuuguagggacauggaugaagcuggaaaucaucauucucaguaaacuaucgcaagaacaaaaaaccaaacaccgcauauucucacucauaggugggaauugaacaaugagaacacauggacacaggaaggggaacaucacacucuggggacuguugugggguugggggaggggggagggauagcuuuaggagauauaccuaaugcuaaaugacgaguuaaugggugcagcacaccagcauggcacauguauacauauguaaccugcacauugugcacauguacccuaaaacuuaaaguauaauaauaauaaaauaaaauaaaauaaaaaaauaaaauaucugauaaaaaaaguuucauauucaggaacauuucagauuucggauuuuugaaugcuauuucucugauaacuaaugauguugaacacuuuuucauguacuuacuagcuauuuguaugucuuuuuggagaaauaucuuuucagauccuuucccaaauuuuaauuggguuguuuucauuguucaguuauaauuguucuuucuggauauuaaacccuuaucugauauauaauuugaagcauuuucucccauucuguggguugucauugcauuugcuugauuguauccuuugaggcacaaaauauuuuaauuuugauaaagucuaauuucucuauuuuugauuuggcugcuugugcuuuugguaucacaucuaagaaacuguugucuaguccaagaucaugaagauauaugacuguuuucuucuaagaguuucauaguguuggcucuuacauuuaggucuaugauccauuuugaguuaaucuuuauguguagugugaggaagggguccaaauucauuuuuuucauguggauauccaguugucccagcaccauuuguugaaaagacucuucuauccauccccauugaaauaucuugguauccuuucuaaaaaucaaugaaaaauaaaugugaagguuuauuuuuagacccucaguucuaucucauuucucuauaugucuauccauaugccagcaccacacugucuugauugcuguagcuuuguagaaagcuuugaaacugagugugcauuguaacaagaucuucuggggauuagugugugugugugugaauguugaaaagggcuggaaagcaaaguugaaagaaagcaaaaugagcaauauaguguucagaugauaaggcccagggggauugacuagccugaggccacauagccagugauuggcagaucuugguucagcacucaggucuucugacuuccacaucagugcucuuuccaccuccccuguugcauaaguacugaaugagaugccuuugguuaauggacacucugagcaagagacuucaggguuauuuaagcaacugaacuuugcucaaucgccucaucuguacaacagaaauauuaccucuaucacuggcugggccugguggcucacgccuauaacugcaacacuuugggaggcucaggaggaaggaucacuugagccgaaguguugagaccagccugggcaacaaagugagacccugucuguacaaaaaauaaaauaauuagccagccaugguggcaugugccuguagucccagcuagucagaaggccgaugugggagggucacuugagcccaggaauuugagaccagacuggccaacauagugagaccggucucuaccaaaauuuuuuuuaaaaaauuagccaggcguggcgguaugugucuguagucucaccuacuugggaggcugaggcaggaggaucacuugagccuaacaguucaagguuaccaugagccaugaucaugccauacacuccagcgugggugacagagugagaaccuguaauaacaaauggaaggaaggaaggaaggaaggaaggaaggaaggaaggaaggaaggaaggaaggaaggcaggaaggcaggcaggcaggcaggcaggcaggaaggcaggaaggcaggcuggcuggacggaaagagggaagcagggagggagggagaaagguacaucauaguuauuaugaggauucaaugaaauaauccuuuguugggugccaacuggcaagaugaauucaguuuuccauugcauaaaaagaaucgggggguaggcagagcuccuccugaggcccaucucuuaccucaacagguggccugccaaccuccccuuaggucccacacgccuaggaccuugaguggagugaacugagacuuuagggcaaacugaggguuucuuuagaaaguccaaggaaagagugaucacuucugggucccgguacugcaugggugccaguugaggaagcuuuggugguaggauccggccagaggagcuaacgcaggaaaggaguuugggguggaaaaacuucguaagcuaggagguccuaugauguaguggauaagaacaggaguguauguauauaauuuuauauuguagaaaauugaaagcauacacaaaaguagaaaaaauguucccuaaugcaucugucacccaguuucaaugauugucaccacauagcccaucuuuuucuuuuuaacaauacaccucacuccaccacaaauccauuccacccccaacacaaacaccuaucccuggauuauuuggaagaaaaucucauguaauuuuaacuguaaguauuucauuaugcaugucugaaauguaaggacacaguaaaaaauaaacauuacaauaccauuaucauaccuauaauaacuagcaauaauuccuuaaaaucaucaaagauaccuagucagcagagcccaggcuuuuaaucuagccaaaucacuguuccagucuuccuucuacagcaucaauagccugucucagagccuguuuuacauuguaaaaugaggacggucauaacaauuccugaaucuuuaauaagguaaugcauguaaagugcuuaccacaaugccugauacaaaguaguaaaugcucaauaaagguuagcuaagauuauuuauuaauaauaauaggaaauauuugaguugcuauuaaggugcuuuugagaauggcuuugacuuagaaucaagaggcagauuuggagcccagcgaaaugauuguugcggggaggaauaacgacaaaaacaaaacaaaaaaacuuucaaaguggcugaaaagagagcaccgguaugaacugggaaguggagcugcagaugauggcguccugguaauuuuccuccacuguauguaguuuuuucccccugcaguuccccuggaggagagaggagaacuggcucggguggggguugcaaauacuagaaaguauucugggcaagaaggggcacugcaaucaaagggcugggggcccccagaguccuggcucaggagaugaagucucagguucccugggcucaugggccuaaagccccaccuuguggggaauggucugagugacucuguuucugugcacggaguuuggaggcaugaggcaggcucacuacaucguguuagaaacauucccauuguucaggaauggucuugcucucugcugccaguuccaggcaucagcugaaagcuuuuuaauaaaaauggaacucaaaggagacgugauaagguaccugauuuuaaccugaagugagagaacaccagauguuucauucugucugaggguuugagaggcaaagcaauuagcagcugcuacugauuuagcaacagacaccugcuaaaugaaaaucuguaaaaccggccaggcuuggcagcagaagcgcauacacugcuucucaggcauuucugggaauuguaaauuauguuggcucaaauggcagggcggggggcuuccagugaagcugaacaugcucaucuagaccaggaguguguuuuucuaagauggcaauaacuuagaaauggcuauuugguugguggauggagaggacgagaugagaacgaaucuuccagaagcugccugguucgucucugcugcuggcccagcucacaggugcccucugggagucauccuauagcugcccucuggggacagauagggcugacagaaggacgagggaauccugccaccccucuccuccugauccagagcacaucucucccugccaccaaaggcaguaagucucaaagcaggaggaacacccaccucuggacucacagcaucuccugcucugggacaguuacagacuguuggcuuuagcagugauuuggagaguuugugcuugcuuuggcugggaaagagacuuauccauagccuacugccuuucaggauucuuuucuaaggggauaucaaugccugcucuccacgucuauuuucucgaggcccacaguggagcacaaacaauggaaacauaggaauccaugcagagggcuuuagcgaucuccugggacacugcuucuguccugucuuuuagcccuuauaguuuauaguuuagauuuuacauguguuuccuaucuuuucaaccuuuucuaauaagaauuccuuacauguggaugggacuuggcaaccagcaaaucucaccuuaguguaguuguugaggauggguucagggauuuucuagaaaauaaaucuauuuucuagguuuauuuccuggcugggccacuccugugugugugugugugugugugugugugugugugugugugugugugugugugugguguuggugggaagaacauaagguucuucauggaguggguguucaauauaugacugauugaagagaaggucaauuuguaggucaacuagguggugcugaaagaauugagcaacucccauuugugccuuaugccacaugcacuguacauaacugugucuuggucuccaaacuaggccagaggucaacuguaacuugggccaaaggugccuucuguuuccaguuuugagcaagggaauggcagcucuccauauggagcagggaccagggggugcuguuggcagaugcauggugagagcuguccugaggaaguaccauccagagucucguccuagcaagguguuuuagugugguuaaagggucacuccuggccgggugugguggcucaugccuguaaucccagcacuuugagaggcugaggcgggcagaucaccugagguuggcaguucgagaccagccugaccaacauggagaaaccccgucuguacuaaaaauacaaaaauuagccgaguaugguggcucaugccuguaaucccagcuacucgggaggcugaggcaggagaaucucuugaaccugggaggcggagguuguggugagccaagaucgcaccauugcacuccagccugggcaacaagagcaaaacuccgucucaaacaaaacaaaacaaaacaaaacaaaacaaccacaacucaacuccugcuuccaaagauggaagugagagaagauucuuuuuccuuuaacugagugggcccuuaguugagauauacagacauguuuuaauuucacuaacucggccccacaguguaggagggggaaaggaacagcaaguaguccagguagaggaagagcuaggguccccacacucuagccagaauugggggagcuccaccuucucugaucaggggagagacaggauucccaucaccuccuuccaauaacuaaaauaaccacagcacaaauauguguccuguaucagcaagcugccauugaaagagggccauggacccugcguaugauagagcaugcuaggugcacucaugguccuuauaaaagcagccagguaugcaugggcugggcccugcaugcacaaguuacccauugguccacuaaacguauguuccuaaaacccauuauggucuuaagaauucagacuggcauggaugcaaaaauucagauaaccccuaaguaauaaaaguacuuauuuuucuuuagaaccuaagaccuauaagucucaacuaauuugaagaauacucuggugaccaaagggagaaugccucuucaaaagauugcuuuuauuuggagguugcaggccuugcauagggucguucccccagcccccggggacucuguuaaugaagggguuuggguagggcuugagccucugcuccuucaacauuucagcauacacacaaaagagccuacuucucagcacagaugugacuacuauguguccacuuggaugucacauuucagggaagguucauucauaauacagguaaaauguuacuauauuuuauccucuguuguugcuuugaaaagucaguggucagccuuuuuacuccuuugaaaguaaucuuuucaggucacuuuugagguuuuuuuguuucuuuuuguuugguguucugcaauuuugcuauauguuucaguauugauuuguucuuucuuauucuguuugggagccuuugggcuucugguguguggguauauaucauucaucagguuucagaacauucucagcuguuauaacuucaaacucugccucuguuccauucuauucuucugggaccacauuuuagagauauguuaguccaucuuacugugucuucuuaucucuuaaucuuucuuugauauuuucuaauuugucuuacuguauugcacuuuggcuaauuucuucagcuguauauuccaguuuauuauuuaucucuuuaguuaguucuauccauugaguuuuuauuucaguuauuauauuuuuaauuuuuuucaaacauacaaaacagucuguagguaauaauuuuauuaucugcagucuuuaaauuucuguuuucaggauuccuggcuuguuuccuuguguauuuaaguuuucuuuauuuuaaauauuauuauuuuuguugcuuuacuguaaguugcuuauuuuccuugggauuuuauuuauggguaguuuuugacuccugguuuccuguagaaaggaucugucuucauucuugcuaggcaccugagagcugccagucuggaaucaugcuaaaugaauucugaccucagguuuuuugauuacccaaguaguauacauucacuuuucaaauacacaugauggcuggcuugccguuccaaguuuuuauuggagauaaccuaguuccuuucccugcuacuccaacucaguguaaagauugagaguagauuuuccuuaucguccuagggggcaggaguaauuuguauuucuaguacacguuuacacugaaguguagcuuuuuggggucccagcuuuaugagaguuaucuccuaucagacucuuuuugggauaucuugaccuuugucccccaucccuuaugcccugugaagcuaugagaaaucaaagcucaaguucagcuggcuuagcaaaucuacuuugggugaaaauuggaugccguaucccacuuaugucucuggguucccacuuucacuuuuuuucuggcuagaaaauuccuuguguauuugacaguucauagauugaaaaauaaaacaauuuuaaaaauauuuuauccaggacuuuuggauguuuucagugguagauuuguuuaagaacuagcuuuuuauaugcucagaaaugaacaucuggaucuuguuuuccaacacuuuuauggcuguguccuuacuuucaggagcaaccaggaggacauucuaauucuauuccuugguugucagugcucuccugaaauaucucuaaauaaguugauaaauaccuacugugugucuaguauugugcuaaguucuaugaaauaucgggaagaccauguagcuucucauguagcuaacagaacauuggcaguaguggccuucagcccuuggaacacugauuuaaaccauauuuucauuuccaaacccuuuuaagcccuagaaauuagcauuuagaaugaugugguuguaagacuguaagguacauaaaggcagaggccauuuguaucuuguuuauaauaguuggcacauaguagaugcucaauaaauacugaaugaaugaguaucugggaggucauggaggcagauuccaaugcugaucaguucccauggcaauuuaauuagaaaauuccagauccaugcucacagguguggaggagaaagaauagcucaauagcaggaggucaaaccaucauguguuugggucauugguauaucaaguuucuaagucaaggguccacucucuaccauaaagggccucagggcacauguagguaguauaagucggugauuaagaacauggacucugaagucagacugcccauuuucauccuggcucuguaaguuacguugggucaguuacuuaaccucuuugugucucaguuuucuuagguucuaccuauagaguuguaggaauuagcuacuacauacuaaguauuaagacaaugccuggcagagaagugccauguacuaacaauuacuuauuauuucuauuauuauuaucuccguuguuguuuugaacaccagucacaucauaaaaaauacauucuccugggaguuauuugucauuucuauaugaaaauauucugaguuuucauacuuaccccuuaggauuuuggagccugcccuacuggaguauuucuccagguagggguugaauaccucuguaucuuuuuuuuuuuuuuuagggaaauauauuaaaauacaggaugcugggccccaucccaguugguccaaagaaauuucuuucucugaaacucugugaugaaaauaaagauucuacacauucucuguguguuggguuagccaggaacugcugcagguuuaaguuuaccauccuucagugcugauggaaaaucugggagcaggcuuggagccugagaagaaauagagaauuggagaguuaaacagaagagaagagaagaaagaaagaaauagaaagaagugaccagaguguacucaugucaggagguggucaaaucccauccaucucugguggccuccaggggauaugugacauuugcuuucccuugauuuagggauuuaugaaccuggcuccaacuuaaagcagaggucauggggauuguuagggggagauguuagaaguaacaggccagggaagccugccucacaaaugacugccaggcccacugguugccuuuaagcaaugacccccagggaguagauuaaccagauucccuucuuggcagaugguggggugggggguuaggcugagugcccuugagcuguuuugacuggccugaaagccaaauccagaugcuuuccugcuugccuuugcucuagugcuaguggaggguuggcauuuauaucagucaugccaucugaugcucaggucuuuuaaagacauuacaauauggguggaggguaacacagacuaccugugcggaugaagaacugggaguuuaguaccuuuccucucauaccuacugcucuacauggccuaaauuuucuggguggaaucuguaacccaggguagaggaaaaugauguguugguccugucauugguggaaaggggccucguugauccccuuguuccacuaccuaagcaggaauguuaggccugggcaagucagucugcaggcacaguuuggccuccacauacaagccaauuuucuuuugacuugcagcugcccugguuccucgguaggcuuuugaaccaucucuuugauuaauuagacuuuccucugaguucuuuggagagaucuguacaaauacuaacuuucccuuauugaguaaaaagucaaauaauguguucaggacuggacuucgaaguccugaaacaccaucuuguauacucaaaacaucuuucuuuuuuguguaugaaauucaaccuuugucucaguuugaagaagugauaaauaaauuugcauuuugugaauuuggagcucccugaguccauuuugauggcuagguaguaccuauauuauggcagcuagguagcguaaguccuuccguuuucauaguagacuuuauuucuuuuccaucagggagcagccugaaguauggaacagacaauaaugguuaagaugauggguucuugagccagguucccuggguucaaaugccggcugagccacuuaauaaacccaagaccauaggcaaauuauuucacugaaacccuaucccuuuuucuuuuaaaauggaccuuggauacacauaauuggaguaaucauauuucuaauccuugacucauuucaugcugcaccauucguccauguauagccugcuuuaauuuuauuuaugugugcauuuacuuuuuuauggauaauaugacaacugugagcccaacuuaagaauuagccacauugaugagaacucagucugccugugugcugcucccccaauccugcucucuaccucccucuccacccugaaggaaucgcuggccugaauuuugguuauuauucuuuuucucuuuuugaaguuuuaucucucucauaugcacagagauauuuauauucauauugauguagcuauggauauauagauauauacauguagauauaucuuccuaaauaagauauuacuugguuguuuuucuggcccucauaaaaaggguauuauguuuuagguaguuuucugguacuugcuuguuuuacucaucauuauauuaguaugauucauuccugccacagaguauaacuguaguuacaauuucacuguggcauaacauuucauguuaauauaccacaauguauuucuccagucuccuugagauggguuuuuggucauuuccaguauuuuacuaucaugaaaaauuccucuguuccucaguuuucucaucuucaaauuggggaauaaccauaggagcuaccacauaaggguguuaugaagauaaaaggaguuaaagugcuuagaacaagaccuugcucauagcauauuguugguccguguauugguuuguuagggcugcuaugacaaauaucacagacuggguggcuuaaaaaacagaaauuuauuuccucacaguucuggaggcuagaauucuaaacucaagguuuuggcaggguugguuucuucugagggccucucuuuuccacuggugaguggcuaucuucucccaaugucuuuguaggguuuuuuccucugugucugucuguguuguaaucucuucuucuuuauuguuuuuuucuuuuuaguuggagucuugcucugucacccaggcuggaguguaauggcacgaucuuagcucacagcaaccuccaccucccagguucaagcaauucuccugccucagccucccgaguagcugagauugcaggcaccugccaccacaccuggcuaauuuuuguacuuuuaguagagacaggguuucaccauauuggccagccuagucuugaacuccugaccucaggugauccacaugccucagccucccaaagugcugggauuacaggcaugagccaccgcgcccuggacuguaaucucuucuuaugaggacacuggucauauuggauuaggacccacccauaugaccucauuuuacccuaauuaccuuuuuuaaaggcacuaucuccaaauacauucacauacugagguauugagggugaggaauucaaugcaugaauuuggggagagacacaauucaggccauaagagucaguaaguauucauuaugaccaucauucucuucacccuccuccuuaucauuaaagcucaagaaaaugcagcagacuuaguuaugauauauccccuaggaacacuauuaugugaacuauuauuauuauccuuaggcagaccaaacaccagagcuuccuucccggccuuuucagaaaugacuuuggauacuuggauaccagcaacaaguacucaaaaaugguaaauugugguuucuuaagaugauaggcagcagcuccuuaagucaguuagaugugggaggaggagagugaggagguuucauuuccaucuugguuaaaagaaacagcuaagugagcucuuguagaguaucuaaugguauacagacucgaaauugccacuugguaaaguucuauggguuuuccugaaagaggcaggcagaucugguuuuucaaaccaggaaauacacuugcacaaguggcugugccaccagaacaaacagcaucuuuuaugggcucaaaguauuugacauuagggagcuggcuaggggaaggcaccugaugaccacaacucuguuccccugcucucucaagggcucuaagcacuaaggaggaagucaggaguagcccugauaggguuuggacuccaaaaggaaggaccagccagacacaguggcucacgccuguaaucgcagcacuuugggagacagaggcaggcagaucacuugaggccaggaguucgagacaagucuggccaacauggcaaaacucuguaucuacuaaaaauacacacacacacacaaaauagccaagcacaguggccugugccuguagucccagcuacucgggaggcugaggcaggagaaucucuugaacucaggaggcagagguugcaguaagccuagaucacaccacugcacgcuagccugaacaacagagcgagacucugucucaaaaaaaaaaaaaaaaaaaaaaaaaaggaccaguggcugcccccccgcuuaauuaugccccccugcccuuuccaugucagacgaugaaaauuagauggaauagcaugugccuggcagggcugugggcaucuguccuuacuggaggugaggugaggagugggaguagggucucgagggaaaaauacaaugagaacaagggauuugggggucuauggaugcccccuuuacacauuauuuucuuaacaggcugugauucuccaaaggagggaauucuuaaaaacuagaacaaauuaacacuaaucaucauuaauaauuuaaugcauccucuuggauaaggauuccuguaauguagagauguaaagaauguaacauaaaaguucccaccuccuacuccccagagagaauugcuguuaacaguuugguguacuuaucuuuuaacuuuuuucauccuuuaaaagaauuuagcuacaugauuaaaaaugaauacauucauuuguuauaaaaaauauauauauacaaguauacagagcccaaagucaagaucuucccuuuccuaucccagucucucuuccucaauccuguuuccuucuccaguuuggggaauaguaacugggugcuaucuuagauccauuuuauauacacccaaaaauacauauacaaacuuauuccuuuucuucuaaaaaaaaaaaggaucaugccuuauacaauauagacuugcucuauuuuaccuagaaaugguuguaccuccuuaacaacaacaacaaaaaagguggaguaauacaucuuccagaguguuuuuugaugacugucuuacugaugauggucauuuagguugcuuuuuuaaauuacaaauuuuuuguaauuauaaauaaugcugcagugaacaucuuuaugcauauauuuuugugcaugugggcaaguauugcuguuaguaccaauuccuagaagugaaauuacugagucaaacugaaugggcauuuuaaaguuuucauagauauugacaaauuguucuccagaaauaauguaucuuguuucuucuucgguguacuguaucuugggguuucaccauauuaguucauacuuuuaucauuuaaauuuaguuaaauauuuaaaaauuccuaaguuuuuacuauacaaauuuucaaacauauugaaaaguugaaauaguagcauagugaacaaugacuguacauccuccagcuagauucaacaauaucuaacauuucuccauauucacuuccuaucuaaauuugcugaaucauuucaaaguugcagacaucuugaugccucagucuaaguacuucagccugcagcuccuaagacuaaggacauucucucguauaacuacaauaccuuaccacaauuaagaaaauuaucaacauuucuauaauaccaucuaccuuauuuaaucagcuuacauuuaaauuuccuugauugucccaagaaugucuuuuaaaaaaaaaucaggauccagugaaguuucaaguauugcuuuugauuauuccaucucuuuacugguuuucauuuuuuuaaccuaagaacgguacccccuucuucauuuaugauacugaaauuuagggaguuauuuuguagaaugucccacauucuggauuugaauguuuccuuaaugacaccuucuuauuuuuaauggcaaugugguauucuguaccaugaauucaucgugguuuuuuuaacuaguccccuauugauggucauuuaggucguggcauuccuuuuguggcuccucucacaagugguauuucguccuaaggaguuuguggccccaguaggccacaguuaaagucuguggucaguuaaugaagauaaaguguuccaaaaccuaacuucgcuggcaggaacauuaucaagggcaguuguaaacugugaauugcauccuuuccccucuaaaggagauggauuaucuuuuuugauucccugauuuauuuugagaggcuguagucuagggcugagcugagaccaggguucugucuuuguaacuaccuauucucacuuggcaccugaucauuaaccauggacucuucugguaaggccaagucaccugagguauggugugagcucccuuaauuugcagugugcagcccucccucaagcaguuauucucacuucagccuguucuuccuuccucaucuccugggaucccaaagcuaauauuuccaucugugcuuuggguccuauucccucccaccugcuuccaguccucucgcugucuagugccuccugccccuuaugcuucuccagcaucucccuguccacuggcuccuuccuucagucuauacagaaucucuccuguucuuaacaguuauuucucaauauugauaccacccuuuaguuauaguuuucaucucucuccaggcauuuacucuucucaaaagauuacugaggaccagggguccaccaaauggggugcaagagauguuccauugggugugugaagaaaauguuagauuucuauucuaauaaaauuucauccuuuuaaauuuccauguuuguguguccugauguacauuuaggugugcauauuuuauaauuuacaguuauacauguauaucauuugccuuacuuucgauucuuaucauccucucuagcccccuucagauccacacccaccuacauucucaccgauuuaugagcuucucucccaggcagucacacuggcaucacaaauucagcauggccccagcuucuuuucuuguaccucaccuccuccaaucugcacccuagacuguaggucccaacauagggagaagccccaacaucccaccauccaucuaagccauagccugugagucaucuucaacuucuuaucuucucuuacuucugcacaauacccuguccagucaauuaauuaguccuggcaauucaacuuccuuaccuucucucaaaucugcccauccucucuucucucgcugugucugccuuuguuuaggcauugcuaucgccagccccuaacuggucccucugccucaaguagcaaacccugcacacaaccaccaaaaggagcucugcaaaacuacauaccaugcaugccucucacucacuuagaaaauucaaaccaaagccaauacaugaucuacagggccucccaugaucuuuuccugcacugauauucuugccuuaucuguuagccuccucaacuagacuaugaacuguuguagggcaggggucccuacccugcaagaugucuucauuauugccacauagcaagaggcaagcacauuaccugucaccuaggcgugccuuaauagguguuuuuggucaacaguaugaaagugagaauaggacuguuuuggguaagaacaggagaguggaguugaccuuccuuugagaaauaaagaaguuuccagugagaaacucuggccuauagauaggccaaaugaauggacugauguggggagcuaaaguuacccugguagucaucugauaaacauacuaaugugugacuuaggacugugggacaggcccaggugauaccaucucuucuugcuaaggcagaaugaugaaaugaaaccccagcuuuugaccuagaaagauguggcauuaagucuuacugccugggauggaaauucuggcuuuccugguuacuggcuggauugauguugaaaagggggauagugauuauaacagccagcauuuaaugaguacuuacuauaugccagcacugggccaaggauucuacagguauuauuucaccacaacuggaugaaguagauacuguuauucccauuuaugaauaagucaacugaggcucagcaaaauuaaaugauuugcccaaaguuguauagagaauaaaugauggagacagaauuucaaucucagcagccugacuccaggcuggagauaccgauugggagucaucaguauacagaugguaucuagagccaggaaccuggauaagauuaccuagugagugggaguagcuauagaagaggaacauggaauugguucuuggccccuguaguauuuagagaugagggacauaggggaaauucagcaaaggagauugagaaggaacgccauugagguagagaaagaacagagggugaugugcgagaaucccagcacagaaagucuauucaggaugagggaaugaucaacugcaucaaauacuguugauggaccaaguaagaugagaccugaaaauagaccaggacuaguauuucuaguugugcagguuguuaauugcauaauggagugagugguaucuagaaucucucugacacccuggcaugggguugagccuuggcagaagaaggagagccuauuucacauaaagacgccaugugggcuaacuuccauccuuguguugccuacuggaauuagaaacauggaggucauugguaaccucaacaaaagcaauuugagugaaaugguaggaaugaaaaugugauugaauuggauggaagaauacuucagaggaaaggcagugauggcgaugaguagagacaucucuggaggaguuuugcuguaaaguauaaaggaaagcagagaaauagagguggaagcuccauuacuaccacaaauggaagugaggucaagagcuuuuguuucuuuagaugaaagguauuuuagcauguuuguuuucugauagcaaugauccagugagaaaaacagacaauugcugguaugacauucuugaguaggugagaaaggauaggaucuaguacaggagugaugguacuagccuuagccagcagcacaggugcuuccugcauaguagcagaggaaaaagcagcuguggggaugggugcagggaggagggagguauggaggugggagcuuaugcauguuaucuucuaauggcucuccaugcccccucaccucacugaaauaggaaaccauuuccucagcugagagcgaggauggggaaggucugaggaaagcaggagaaguugugaaauaguggccugggagagaggagaguaaauggucuugggaauauagugagauuguagagcagcaugaaagucuggcacuaaguuuguugucaugaauguaaaggguuaauagcauggcuuuauauuuuucuccagacauguuugcuugcauggguuuagggaugugaagucagacaguuggauuuagccaggaaugugguauugcaagguaaguaggacaaaaagagagagugugucaggagaguugggaauguacugaaggaagugaugggccuugaacucaaugcuggugagcauagaagugaggacaugagguuggugagggggcaguaaaaaggugguaggaucaagacuguagguccuggugaagugggaaaauugugagaguagggauauuagagggagugaauuggccagacacaaggugguggcuggauaguagggugcaugacagagguuauggagagaucacagccauuaacaguaacuggugugaccaugugaaaaaggugugagguaaaauggagaggagaccuugaggagcauggagggcaaggcauugagaggccaggguguugcuaaauauugauaccgcagagauuuugacaaaggaauguuggaaaggcaucacagggaggggaaaggcaaaaccuucaaggacugaagaagggaggguauacauggagggggccguaaauccguaaaugacugcaacagaaaggaguagugggugccauagucucaggacaugagauucaaaucagcagagugguuagcaaggaggcagagagaauggucuggaagagacagcaauuuagaaacaucugugaggcacagagaggcacucccuuggcccaguuguguaagguuauaugagaagaaaaacccccacuacuugagagagcugucaggauagcagugucuucagagaggaagaacuaaguuuuucuuaaagaaaaaaggugaagggacugcucaggugacugauguaaacagggaaguaggggcguggugggaucaguggucuccauggcagaggacagugguguagcugucaggguuguagagugggaggaaggagguugagauucuuuccacgaacagaguccacgcaccuacuguuucagacagucuaaacucuagagcccuagagaacuuuaccacucuggucuuuugauucuaaaaaggauguugacuugugagaagguaguuaaugaccuguguugcuuaaagcauuuuuauuacuuuugacuuuaaauugcauugaugcaggacuuuuugucuauaaccucaggauuccuccagcugaaaaagaaccaggcuauguauauuagaguggaauuccagguaugaguucucuaguguguagaaaugaauuaaccaaguggaacucuuucuagggaaguauggcauuucacagauauuacuuguaaaauggggaaaagagggucaggggaggcucgcugagaaaguucccagaacucagcccagacucggugcucaguaaagaacugucuuagcugggcaucauggugcaugccuauagucccagcuacuugggagguuaaggcaggaggauugcuugagcccaggagcucagggcuguagcaugccaugauugugcaugagaauagccacuguacugcagccugggugacauaaugagacccuauuucuuuaaaaacaaaaacaaaaacuuuuuccuccauuauugauugcccuuucccccugucccugugccuauugcuguuucuuuggauguuauuuaauuucucugugccuuaguuuccuguaugucagaugcgcaugaucauagucccuacuucauaggaaaguuguaauaauuaaaugagauaacacuauguguauuaguccguuuucaugcugcugauaaagacauacacaagacuggguaacuuauaaagaaaaagagguuuaauggacucacaguuccauguagcuggggaggccucacaaucauggcagaaggugaaaagcacgucuuacaugguggcaggcaagagagaaugagagccaagugaaaggggaaaccccuuauaaaaccaucagaucucaugagacuuauucacuaccaccagaacaguauggaggaaaaugcccccaugauucaguuaucucccacugggucccucccacagcacgugggaauuaugggagguacaauucaagauaagauuuggguggggucacagccaaaacauaucaacguauagaaauauuuaacacaguacaugguacauaauauaaguacuuaaauaugauuugcuauuaaaugacaagugguaaguucuuggcucccauucaacucucuuauucuugccauuauguuucuucuuacuucacccccuuucucuuacaucuucuucccuuucucuccuucuuuuuccacacuuccuccuuaaccuauuuccucuuucccuccccuggcuuugguugcaguggcauaugcaccuaguucaguacucuuuguggcccccugaaguagagaagucuuagaguaggggugaggcagccaucagaggaaggaaacugcugguggggacagucucuuggccauuccaucugaagucuguaguguagccaugguggcugcagagaugcaaagggccagugacaagaggcucaggagcugggaggccuauguugcagggcaaguuuggcuacugugugauguguggcuggggcaccagacaguaggcagagcaugcuaugaagaugaggaucauuugaacaggaagggacugggcuaaaucaccauguggagggacgagugaggacaugugcauguccugccccugguccuguugcugauaccacuaugacuacucccauucauaaggguggcuccuccccacggggcaucuccugucagucggccuucugugggagggagcgagugagcaaaggauagcugagugugcuggcuaagacuauaaauucuagagccaaacugcuuggauuugaauccuggcucugucaccgaaugagaauguauccuugaguaaguuaucuaacuuuucugugccucagugucccaucucuaaaauggauauaauuggaacaauacaguucuuaugaggauuuguuuaaauuaacaguuuacaaagugauuuucauaguucauggcauaaaagaaguacgaugugaguuuuuguuauauuuuaaaaauuuuaaaaaucauacaacaaucuuagaagacuuacuuucauuuuaccgaugccaaaacggagguggagagguuaagggccuuggccaaggccacagagcuaccgagcagcagagucaaaucuagaacacagcuuugacauacuccaaaguccuagcuuguaacugcaaugcuuaacugccucccuggacauucagguggagacuuugcuuucuaggagagcugggaggcagggugaggcaggugggcaaugugagucaagguggguggucagcaguuggagucugagagguugggagaaguacugcuugaggacacaccugggacuaguggcugcaugcccuuggcccggcuccuugguuggggagagcagccuggcuucccaggcccauuucagggacaggucaagucccuuaggugcaugaaggugcugauuucagccagagagcuaagccuucuugggacuuuuuccuuccuucccuauuuuccaggugaccucagugaaguuaauaacccuuuugcaccucaguuuccucaucugucaauugaggauaauacuuuaccugucugcuuccuggguauuuugagacauugaguagauuguggaugugaaaucauuugaaaagcauaaagcaguaccuaaauuuaagauacuagagugaucucagaccacauuacugugaggguccaguguagaucucucaggccucuccauagcuaccuugugcugauaaugcccaguguccaauuucaugaccuuuuccagcuggggucuacagugauacuuggacucuuaccuccuuuucucaguuuuuacauuucccuuggugaguguaaaguaauaguugagcagcaugugggucccugggaaauuauuuuccguguggauuuuuauuuuuaagagccagagccaacgucuguguccagccuccacaguugucccagcucccauucugggagcucugccaucuucuugguuucagcccuuggcauaagacagaccugggcuccuguggcuggggagccuguaacugccuccucucauuagcagacagucuugguuaugugcuugcccuguggggaacagggaggcagcugacccuuuccccugggugccuuugucuguccuggcauacuuugggguguguguguguguguguguguguguguguacacguguguguguauguuagagauucuguaagcccaagaggcuaggccucuugucagcugccaaaguucuuuuuuccccagaauugaguuagccacccaacuguuuccauucucugcccgcugcgaagcucuacagcagggcugcuguggcaggucaaaacaugcucugcuuugagaauacagagauuccauuuugagagagaugggaaacaggagcgagugaguggguguguuggauguagggaaagugaggacauucuuuuugguaagcugugccaaaauuggcccagaagcuuggucuaaacucaaaaguagggcuaaugcugggcugacacccaaauauccaauggggaaaguuuauucuuggaucuagacccuaugagaccuagcaaucauuuuuuuuucucaucuggaauauggggauaauucuacuccauauauucuucaugucaaaugagaaauaaacuuguaaauagucuaccgucuagucuccaggagcaggaagugacauaagguugugauucuuaaaguauuuugcagaauacaaacuguuacuaaaaaaagaaucacuugcuaaauaaguuuggggaacacuggauaaacaauggcauguuuuuugucuguaggggccacucagguccuucauauuccaauaauacacaugggaaaccaccaaggggauauauuauauacuacaucuccuaaauuuuuaaccaaacuuucuuaguggagcauuuacaaguaccuucucuacaaaagacaucuaggaagauccugaucuagaucagaagaauauucauuuuguucuuuuuuuuuuccugcaauuguaaagagaagugaauuggugaaaugcaugggauugcugaaauauggguccugaacagcaggggaggucaacuuuggacucuguugaaaugaaugcuuccugcucuaaaacacuucucucccuccuauccucacagcuccccuuugaauuggagauuuacuacauucagcauguuaugcucuacgugguacccaucuaccugcuuuggaaaggagguaaggccagcaaaccacauuccuauguaacccccacaccuaaccucucccuucuguuuuugggagucacagccucuugggugcuucccaggaucuucagcugccgcuugacugaguuucuucaacauaauuuaugccgggcaccaggaaguggggagaugggaauggacgaggccugcaaggggucuggggacuuuuuagacccacccuucacugggugacuauggugcugcugacugucugucacagggccugggcuuuggguucuugaugguggcauuguguuugcauggagccccccacacugucaccuucuuguacuugugccuucccccugccucaaugugcagugugggauagaaggagagaguaaagcacucgguccccucaagaacaaaagaagauauuguaaggggcaagaaguccggggaccagggcaauuaugggauugaggggagaggcaggugaaagagugguggucacccauguaaaauaaaccacugaaaaccuucauuuggugaagagggagagaccaccaaccugguagaggcagccuggaaaggaagcugaucuauuuguaaccucucagugacccuuagauuaucccuucccucuauuguguaacagacaaaaggaaaggggugccuauccaucuaggcuuguugugagagccacuccuucucaguguucuuuacuuucugaaaggcccugugacuggaagucauccucuuuuaguuuuagccccagccucucuaucucaguugcugagacuuuucugcuccuaccucacuccaggcagcaaggguuucauuucuaccauacugaaaguggcaugaggccacaugggcccuugagcucacuggaagauagucugggaguucugcugggcacugcugcuucuuggcuuaugcguggaugcucuaaaucaggcauuccggcagaucuuaagaucuggugugagauagccccaaggacuggucaacccaggaacauauuacaggauggagucuacuuauaguccagagauuugccuccuaugccuugauuucuaucaguucuccauacuugccuaaauauucuuugagacugcuuuuacccugugcggccacuuggggucucacgaugucccaaaacacuuccuuuuaauuugcuguaaaagcacuauuuuccucacgaggcuuuaaggaaagucugaaguuccaauauccaggagacuugugccauuucucaggucuguccccuguggcacaggaaacagccucuuaauauuaagucucagaaauacacacauucugaauagaaccaggcagauagguguuccugggccucagaacccugcuacucaucguuccuggcuucugaggugugugauggaaguccuagccaaaucugcauggcuguuauuuaaacauauuuguacucuaaggucaccauaaaaaucugucagguagcuggguuagacuggucugacauggaaaauaccaaguagccaucuuuccucccuccaaaagaauaauccaggaagccacauccucaagacuuggcuaacucuaagauaauuguaucuccuuagagcagauccucccgauagcccaguucccuaaguggcgaggugagagauaguagggcuguaaugagagacaguaugcucuguuauugcuaauaaccaauagauacccuggugcagugaggguuuagcuugcagcaccaguggagugaucucaccaaacugacuuuuuacuccaggaccucaaugagagcaucuaccaccccgcagaaguugaugggccccaguaccuucuaucuggccaacuuugagcuauuuugagggcucaucucccaucucccuuuccagcucuuuacugccaucugcuguucacuuggggggaauuaugagcauugagagaaacaucuggauuucuucaccuuugaucccaagccuuggaccuaggccuugcagagggagaauggaucugaagcaagcugucagaagauuaguuuucuguaaaccaagaaagccgagagucuggggcuucuguucccuagaagucgcuuguaauuuuguagaaauaaauggcuuagcaauuuuuacccaguacaagacagcucuccuauagguaucucccaugcccaggaacccuguuuuccugaaaggcaagguccugcuugagcauauagugccucuuccuaugguuugggguggguggguagguggcgccuugugggaaacccacucaucccuuauuguugcagaccuuaugcacugucacaguacaugggaccucucucauccacacugcucuuuucuuccucuggccugucccuucauuucccuguuuccuuuccuucaaacuuguugccuguggcccucuggaacucuauuucuuuuuuuucuguguuacaguauuuuuaaauuuaauuuuuauuagauacugacaaauuaugcuuuuauauauguguaggguacaaggugaugcuacgcuauauguauacaaugcagaaugauugaaucaagcuaauuaacaaacuauauuucuuacaaaccacucccaaccccaccggcagcucugcauggggcacagagccuuccugucucuugccuacagcuuccucuaauggaggcugcucuuucugcccugccccauaugcugcagagcccccucugucucuucuagagcacuaucucaucuguacguuaggggaaaaaggcuuucucuuuuacuauucucucucuuuuuuuuucaucaccaccaucacuugaccucuuggucccuuccccuauauuccuagaagucacuggccuguagcucucaauauuuccauuauaauuugagccaacauccugagagacuucuuguaaggaccacccauccaccccagcuucucaagguuugggcuucuuaauugcagugaccucagcauucccuucuuuucagccaccaggaccuuguuuucccguaaagcuccucuaugugagaacguaacuccuguuauguucuuucuuugacccaaaucuccacuccuuuccucuucuuccuauucagcuuguaucuccaugaccuaucauugaaacuuucacuagcuccugaaagugucucaccucccuugucccuuccaacugggaucagugucccaugccuuuucagugugcccagucuuggccuacuggaggagcucuuucaagccauucugauuagggccaugaaaauuucaugaugucuauuauaauugugcucucaacaccauugcucaauuuauuuucugucuauggccagcuccuccacacauugcccucacaaguccugugcuaaaucuuuaccacccuccucaaauuuccugucuacucuguucaaaccuucuguucucuccacccucaauagauccccccucuccccacaaaugacugagaaaauugagguuuugggauggaaauuuccucaacacuucucucuaccucuacaagcuucuuuacccacauccaucccuaucuuccuccuucucauccuggaagaaaugguguucauucuguucuggccaauaauaucccugugcgauuagcucccaccccugcuaccaccucuggagccucauucuaucaauuaaucacuuauguaccuggauauucuuuuucuuucuuuuuuuuucuuuuuuuagacagggucucacuguaucacccaggcuggaguacaguggugcaaucacgacucauugcagccucaaccuccuggcuuacaugguccucccaccucagccuccuaaguagcugggacuacaggcacauacuaccacacccggcucauuuuuuuuuuuuuuuuuuuuuuuuguauuguguagagacaggguuuugccauguugcucaggcuggucuugaacucuugggcucaagugaucuucccacuucagccucccaaaguguugggauuacaggcaugagccacuguaccuggccauuagcugaauuuucaacccucucuucacugcuggcuuuucagccaauacagauguucaaaucuuucccauucuaagaaacuuucucgcaaucccauacaacucugucuucccucuucccuucacaccuaagcauccuaaaagaauaaucuaaacaacauuuucuaaaauuuaguucuuugggcaagacaauuuuugucuuauccacguaaccauguguguuauuauguauguaauacauguccuuaaaucuauugaguuuuuuuuuuuuaacuaaaauauauacgcuuucaagagaagccccauaauauccaugagauuguggcuuugauuuacugguuaucuauuuuaacacaguuuauauacaaaacuauuaaaaaugaaauguuuaucuguuugccaccugaaaucaccucauacauggugcauaacuuugggagacacuggggucugcccuugaguuuucuucucaauuacccuuuauuccucagaccauuuacucugauaucuaacccucuaccagacuuuucacagaaauggugcuucuaaagaucaccagcaacgucugucugaccaaaucuaaugaccaucucucagucuuuauccuacggaaugcuguugcauuggaugguauugaucacuccguuuuggauugcucugcuucggggcuuccaaaguuccucccuuuccuggcuuuccuaccucaccaaucaugucuucucaagucuccuucacagguuauuuuuucucacuccucugagauguugaguucuguucuaggcucacaucucauucuaauugucugguaugguuuugccugcuuucacgguuuaacuacuagucugucuaguuauggcugcuacaucacugucuacagcucagacuuacgagagucacauucauauaguuuacucaacuucucuaccuaaaugucucaagcauaugucaaacccaaccugucugugucaaacucauuaucuucccugucagcccuccugcucuucuugugguucgugccaaguagcagcauccaaucaccccagcuaaaaacugggaaucaucccugccuccuguaugcaaugcauccguucaucucacauauauuaacauaugccuucuuccugccaggauccagacugaccacuggggugcccugauaagcaaaaaucagacaccacccuguccuucauaacauuuauaagcuaguggggguggaguggggagauggauaugaaucaaauaucacaugaauuuauaguuaugacugagauaaguacucugaaagaaaggaacaugcucuuaugagaacuuagaacaaaacaagcugacugaguuuggggguuuggaggagaguucccugaggaaaugacauuuaaauagaaauccaaagggugaguuggagcuuauuaggcaaguacaggauuaggggaggugacuucuuguagaugggcaaaauggcauguacaacagcacuguggcaauggggagcacaaggggaguggaugacacugggccugaggggcaggcuggcgucauauaugaaggcuuugucacccauggucagggguuuggccuugauugccaaagcuaugggaagccugugaaaaugugaagaagggauauaacaucagcuugcuucaccaauugauucuucucugauuuaacuuauuugcacauuuuacacauuuuaauucaaaaaucuaaaauauaaaaagccauacugugaaaaauauauuucccgucccuucccuccauccauauaguucccugcuacaacuccacgaguaacuacuauuuuugguuuuuguauauccucccagaguuuguuuuuuugcauauacaaguaaauuuuaaaaauauuuucccccuucuucagacauucauccuaaaauagcaaauacacaaccauccuguuguuacuguuuugcuuagcaauauuucuuggagagcuuuccaugugagcccacaagaagcucccccuuucuuucuuuuuuuuuuauaguggcauaauauuacauuguguggaugauagaauacaguauaauaaaaauggcagagcuuugacauaagacaacuauaugccagauauugucacacacuuuucccaugcauuaacucauuuaauccuauaacaacucuguuaggaagguguuauuauuaucucccuuuuauggaagaggaaacugguacucaaauagcaagugacaguccccggauuugaagccaguaguaugguuccacgguucuugcuuuuaaucauaacacaaaguuacaacacuauaucauaauuuauuuuuuucagucugcuauugauggacauuuagguuguuucaaaucuuuugauaauguaaauaacacugcacugaaggaacugguaccuuugccauuuugcgugugugcaagaauaucuauaggauauauucccagaagugguaaugcugaaucacaguauaugcauuuguauuuuuguuggauauuuccaaauccaugaaaguuguaccaguuuaaauguuuacuagcaauguaugagagugucuguuucuacacaaccucaccaaauuggauuuuugcccaucugauggguuaaaaaaaaaagguauaucaguucgauuuuaauuuuaauuucacuuugagugaagccaagugucuuuuuacauauuuaaaauuggcauuuggcugggcaugguggcucaagccuguaaucccagcacuuugggagaccgagguggguggaucaccugaggucaugaguucgagaccagccuggccaacauggcgaaacccccucucuacuaaaaauacaaaaauuagccaagugugguggugcgcaugcccguauucccagguacucgggaagcugaggcaugagaaucgcuugaacccaggagguggagguugcagugagccgagauugugccacugcacuccagccugugcaacagagugagacucagucucaacaaaauaaaauaaaauaaaauuggcauuugauuuccucuuccuugaacuacaugcuccuaucacaugcucauuguucaauuguguuggccuuuuuacaaaauuugaauccuaagagcuuguuacauauaaauauuaacaguuuacccuuuaugauaugagcuacagauauuguccucaguuguguuuucuuuugacuuugcuaauguuuuauucuugccaugcaggauuuuaaaauuucuuuuucuucuucuuuuuuuuuucuuuucuuuucuuuuuuuuuuuuuugucugagacguagucucacucuguugccaggcuggagugcaguggcgugaucucagcucacugcagccuccgccucccggguucaagcgauucuccugccucagccucccaaguagcugggacuauaggcacgugccaccacgcccggcuaauuuuuguauuuuuaguagagacgggguuucaccauguuggccaggauggucuugaucucuugaccucgugaucugcccacuucggccucccaaagugcugggauuacaggcaugagucacccugcccagcugaauuuuuaccuuucuauguaauuuaucuuuuauggcaucugaauuuagagucaugguuagaaagcccuuuacuacuccaagguuauaaaaaauauauaucccauauuuucuucugguauguuuauaguuccuuuuauuauuauuuuuuacauuuaagucuuuuauucacuuggaauauauccugauauacagugcaagauaaagauccaacuuuauuuccagcuggcuucccauuuguccccacacuguuuauuaaauaguccaacaugauccaaucugcuuguggagaagaucauauuggcugcuguguggagaaaucacuggguccuccugcucuuaccuccuaaauaucucucagacucauccucuccuuaccaucucuaggaccaguaccuugggccaagccuugcacaucucuucccucaaugaugauaauuggcucugugugaucucucuccagccagccuccuuugcucccccuaagcccauuccuggagcuacuucuauagcucaaauaggaucauagcucuuugucauuuggaagcuuucaguggccccccaucuuccccagugcacaagaccguaugaccugauacccaaccccuucuccaaccucaugucuuuacacucccuucuuuauacuguacacuguggugauacccaaauccuugggguucccugaguauuuuauccaauuuucaugccucugugccuuugaaaaugcugugauuucugccaggaaugcucuucuccagcugugggccuagaaacauucauuugucaaaacucaugucaguaguuacuuucuccaagaagcccucuguaacuauucuaccccagcucccgccagcugccucuguuccucccauuuuugucauccucacaguauagucuuuacaugcuggucucccugaggacaggaauuuuucauuucuucuugguauguaggugaugaaugaaugaaugaaugaccuucuauucagggauguauuccuguacugcaaauugcacauaauuuauuauacaucuuacaagcuaauguuuacuaggcacuggguuuguuacaugugugaucuugaucucauuuaauucccacaguguccacuagacuuaugggaguacaucacgugaggcccaugaccuugaaugagaaaaauaaucacaucuuuauguccauuaacugcaacugaaauacagucaucucucgguauccauggggaauugguucuaggacuucccccaccacaaauaccaaaauccaaggaugcucaagucccuaauguaaaugacguaguauuugcaucuaaccuacacacauccuccuguauacuuuaaaggaagcuugucuaaccuguggccuaggauggauuugaauguggcccaacacaaauuuguaaacuuucuuaaaacauuauauuugaaaaaaauuuuuuuucagcucaucagcuaucaguaguguauuuuaugcguggcccaagacaauucuccuucccauguggcccagggaagccaaaaaauuggacaucccugcuuuaaaucaucucuagauuacucauaauaccuaauacaauguaaaugcuauauacauaguuguuauacuguuuuuuauuuguauuuuuuuuuacuauuguuauuuucauuuuuaaaaaauauuuuugaucugugguuggucaaauccacagaugcggaacuugcagauauggagggccgacuuugugguauauccuuuaguaaggaauguagauaacaaaccacaguuacauuagcagcacuuggcaugcuguuguuaauguaaauuacacuuauuuuccucuuauguuagaguuguugcagauaucucaaaaaaucauuggcauucaucauuaccucaaaauuuaaaaacagaugugccuuuuaaaagcauuuugauaacuauaguucaacaugauuauuuucuuuuauaauccuauauauucuauuucguauacuuaaauacuuuauucugagagagagccuuuacacuuccccagacugcccaaggagugcauaguaccaccaagguuaggagucccuuuacuagaguuuauuuuauuuuuauuuuuuugagacagauacucacugugucacccuggcuggagugcagugaccugaucuuggcucacugcaaccucugcuucucggguucaaucaauucucgcaccucagccuccagaauagcuagaaguacagucacaugcugccacgcccggcuaguuuuugcauuuuuuguagagauaggguuucaccauguuggccaggguggucuggaacuccuggccucaagugauccgccugccucugccucccaaagugcugggauuauaggcaugagccacugugccuggccugcacuagaguuuaaacugguguuugaaaccaggugggcagagaugccucuaugcugccuguccauggagucgcuggauucagacagacuguagguacaaauccuaguuaucccacuugcuaguuaguucuggcauuuggucgaguaccuugaccucucugugucuguuuucucacuugcaaaaugaggguaguaauaguaccuaccucauaggguguuaugaggauucacugagcugauacaugaagaguauacagaacaaugacuggcacauaguaaauacuauguauuggguuuguauaauuauuaauuacccacuguucugccuuguguuaauuauucaucuuucuuccaacuagacugccgucucuagaggucaggauugugccuugcuguguucuaaagccgcagaaccuugcaugaacugagagcaugcuugucaguggauguaacauuacugguccucccuccuuugagacacuuguuucuccuuugagcuccaggguaccucuuucuccugguucuccuacuucucugguucuuucuccuugggcucuuuugcucugccugccccauagauccugguguucuucaucaauagagauaacacaggcuugagaagcaguacagguacuucaaaaauaacaauuagacuccucauuucuguaccccuucucucauccugcuugucuuccuccucuguuuccugucuugguuaguggcucuacucuccauccacuaccaaagcaaaaaauguaggcaacauccuagaucucuuccucugcgucuucccauuuaccaaucaguucagaaguucugacaguuuaaauucucaaaauuguuugcaaauuuggcccuuccuccucauccucaccaccccuguccgacugugggcucucagccucuguuaccaggacuacuuugcuuccucucuccucucccugcccccugauuuccccuaccuccuacccaggcuauccucuauacagucuccagagugaccauuuuaaggaaagaggaaaucugaucugauuuugcucagcugcuuaaaaaucccauccaggaugaagaccaaacuucuuugcauagcauucaagaccauucacagucugauucuuguccaucucuuuggccucauuucucauugcuuagacuccgauucuaucacuuuaccuucugguuuuuauuuguuuuguuuuuuuagagauggggucuuacuauguuguccaggcuggagggcaguaaugcaaucauagcucacugcagccuggaucuccugggcucaagugauccuccugccucugcuucccaagcagcugagacugcagguacauaccacugugcccagcucauuacuuuacuuucugaauaaacuuaucugcugacagguuugcccagccuuccuugcuuuguguccaggcucauacuaucuauucuacuugaaaccuggcaaacuucguguguuccuuugcaaguuagcucaaggguacuaccuccucucuggaggugucucugacuuuccuaggcagccaagggcauguauuccuuaaugugccuuucuccuuguacuuuuauuauacuuuauuauaauaugcaguaaccaccauuucuaguugucuguauuuugccacuagguggcaguagucacaucuuuucgggagauuaagauaauuaauauuggauauugauuuauuuuauuuauuaaagauguugauuaauaauuguuguaauugaggugcuaugggaauaaggaugcggguaaaauccgugaggccccugaauuuuggccugagugacugggugggauagaguaucauuaacugagaagagggcgcagaaggaaggagcauguuuuagagagugucuuagucuuuuuggccugcuacaacaaaaaugcuaucaacugaguagcuuauaaacaauauaaauguauuucucgcaguucuggaggcugggaaguccagaucaagguaccagaagauucagugucugguaagggccuguuccuccuagauggggucuucucacuguguucucacacguggaaggggcaagcaggcuuccuugggcaucuuuuauaagggcacuaaucucauucaugagggauccacccucaugaccuaaucagcuccuaaaggcuccaccgcuuaauaccaucacauugaccauuagguuucaacaugaaucugaggagaggaacauaaacauucagaccauagcagcgaggaagaugauuuuacuugaguuugaggugcuuauaggcuaucuagguugagaugcccaggaagcauuaggauaaaauauucuggagcuguucaggggaaucuggacuagacacugacuuuaguaucagugguuauagaacuaguagaugaaaacauuggaaugaaugagcugguccaggguaacuauguagguagggauaaaauaggacuuagagaaagccuuggggaacaucaacuugcaaacaguagacagaagaagaagaguguaaggagauugcaggaaagaucagugauagaaggagaggcugguuguccugaaaacuaaggcaguagaaauuuuucccaaagugguauuagccaagccauguuggaucuaagagguacaguaaaaucagguccucagagaagugggaauuacagggaagaaguuaagggcauuaaggaaggagggguuaaggguguuacagagccaagggaggguguuucuccuccuccuuucucccccucccuuucucuccuuuucaccuccuuuucccuuucucucugccccagggcugagcauguucaaaugcuaaacugaagcccaguagagccagggaacauugaagguaccagagagaaaggggaguggaugaauuacaaguugaugacaacugcugagaaugacagggguuuggugguggauugagaaggguaaugacaagagaaauaagugcugugggaaauggaagaaggagauaagccuagacucucucaacacuguccaauagaauucucugugaugaugaauauauccuauaucuguucuauuccacaugguagccacuagcuacauuuggcuuuugaacaguugaaaugugccuggggggacugaagaguuggauuucucauucgauuuuaagguuaauuaauuugaauugaaauugauugguugguugauugauugauugauugauugaugagauggagucucauccugccguccaggcuggagugcaauggcgagaucuuggcucacugcaaccucgaccucccggguuuaagcgauucuccugccuuagccuccugaguagcuggaucuacaggcacaugccaccaugcuuggcuaauuuuuauauuuuuaguagagaugggguuucaccauguuggccaggcuggucucaaacuccugaccucaaaugauccacccacuucagccucccaaagugcugggauuacaggugagagcaacuuugccugaccugaauugaaauuuaaauggccauaugugguuaguggcuauuggacaacauagcucuagaagguuggugacuggcacuguggggcccuccugaaagaagaauccguggauuuuucuggcacugguuuguacgguuaccccauuugggguucagcagccuaaguggaggugcaggacaucuggcuggagggauccguccaauguugaggcuuuguaaguagggucaguauuguugaaaaucuagaaagugagggauguuugagggguucuggagaguuuugguaauccugcaacgcacuguauugcuuucagguuucugaccaaggacaggucacccaaggagcaauagcagaaugggagacagagcagcacuuuauuauuagcugagcaggcauccaguaucuuuagugcugggcgagagcuugcagcuuuguucucaacaucuaggugagcuucccacucuguaccuagagaauauaauguggcuagauguguagcacaggcccccccauacuuuccacccuaucaaaggcauugagaagcuagagaggaaagugaagaggccuggcuaugcagagagacagguucugcugagaugugcacgacgaaauacacaugcugcccauuacaaagcuagacuaccugguuucaaauacugguucuccuccuuacuagcugugugacuuuggccaaguucccuuaccuucuccaagcuucaguuuucucaucuguaaaauaaaaauaauaacaguacuuccucaugugguuguaauuagcauuaaaugacuuaauguauuaauauauaaagugcuuauaacagucccugucauguaauggugguauauaaguuguuugcuauuauuaguaugguuucagcuugccaauauacuguggcccugccuacuaaucuaauaaaaugugguuugagcaguuuuuuagguucucaccuuuaguaagccacccuuuggggaugaucuagugaggggauagauagaaguguggggagagggggaugaagaguucugcuucccaccagggaguugagagugcuggugucagaguucgaggccaugggguccaagcugguguggaagaaaggcuagaagagagcuggggaacaaggaggaauucuauggagggagguaaggagcaucaagggaucacaggucacgaggaggucuaggggcaugcgcauaguaggaauaaggauaugaaagcugaacugucgggagguuguggucagaugaucccagcagaggcggggcaguucaaagugaugacagaaggcagguugugguuagugcgguggaguagaccuguagaguugaggagguucaggaggccacgagguuaggguauuggaagaggugccugcauggauguuaaaaucacccagaaugccaucaggaaaagguauaaaagaaggugguaagcuaagugacacugaucugaggugaauucaaugaccuggaggccaacaacaggugacagugacaaagaggaggaacugaaucuugaaagagaacgagggaagaguaaacgucuagaagcaauaauggagggcuagaggaaucuucaacuucccuucccccacaaaaaauugcugcaggaauagaaggauuaaaaaagaacagccuucucagagcuguuaguggaagaaaucacacccucaguggacagccaggguuccuuagggugaggaggugaaagggacauucuggggaaagguggcagguauagacagauugguugaucauaaacaccccaggccaguggugguggugggcuuccagagguucuagugggauggguugggaggaagucagccacaaggugguuggaggaaagugcccacacagcuuuaggcccacagcuugguccugccuacagcuggugacacaacucaggaguuccccucucuucauccuugugauguguuucgauugguugguuguguuuguuuucauuucggcagcaguucuuaaccugggguucacaaauaggaucuuaagggguucauucacuugaauggggggaagucacaucuuuauuuucacugaccucuagcagaaauguagcacaugaacgcagacaacaagcaccagugguauuagcccuaccugugucuuuguugucaguagcaaucacagauggcuuccuaucacauuucaguaguagcggccaucucaggauaguguuuaugcucaucugcuuugaaagugaugguaguuauuaggccugcugcuagaucuugugauuaaauguauuuauaaagaaacauaauuaguauauuacaaaauuuuaaaaauauuuugguaacuguguuuuaauauaauugaauuccuuuggcuuuuauuuuaugcauuucaaacacuguucugagaaggaguccuuuggucuccccaggcugcuggggugcagggggugggguggagggccugcuucaagucugcugggaaaucccuuucuauuucacuagagggagcucuuguuucagaauugcugagcagugacccucaggcuugacacccaguaauaagguuguuuuuuuguuuuguuuuguuuuuuuguuuugagacagagucuugcuccgucacccaggcuggaauguaguggugugaucuuggcucacugcaaccuccaccuccuggguucaagggauucucaugccucagccuccugaauagcuaggauuacaggcaugcgucaccaugcccagcuaauuguuguaauuuuaggagaggugggguuucacuguguugccaaggcuggccuugaaucccgaagugcugggauuacaggcgugagccaccgugccugccugagaaggcuguuuugaaauacaggcaauucagauguuuuuggaggacauuucaagaaacugggguuaagaaccucaguguuguuuguucuaggcaggccaccucucucuugagugggcuuucagcucaucuucuggaggaugaggauuggaccuccugugcuaguuacuuucugggaccaguuaaagcggaaguacuuuggccaauggcagcucaaaaacuggccccaaggucaugcugacaucaguauccaggcugaguuuccuguuucuccuccauaccauugagcccauugccccucccaucuagcuaguguuaggauguuagagaaguuccccucuuccaugaggcuucccugcuccacuauacuggucagguaagggcaggugaaaguauaggaacucugguaaauccugaggcuccuaaaggguuaguggaugaggggggaccugagggauuugacugauuggcgaagggcugagccuugugcaacagguggguaggugaguuucugaagaccacuggauugucccugcugaggaagaagugauuggugcucaggaguccuuugugggagcaaaugguuaagucaaguguuuucugccuuaauuuucucaccuuccaggagacacugcuccucacaccuggccagacucuguccccuucacuggcagcuuuucccaggucucuugguucaucuuccagcuccaggauucccucuaagucaguguuucuccuauaugguuggaggacccaagcaucaggaucauccugaagcgcuuguuacuacaguggagauuccagggcccacucagacuuccuggauucaacucuauggggcagggcccaggaagcugcauuuuccacaacuucccuaggacaguuguuuucaaaguguggucccuggaauaguaguaucugccuaaccagggaaccuguuauuaauaaaaauucucagauuccagauuccaggccucacccuagaucuacuagaaacucuaaucagaaacucugaaguagggcccagcaagcuggauuuuaagaagcccuccuagagauucugauuuugacccacacucaaguuugaaagccacugcuguagcggauucugauacagaacgaguugaaaccuuguugccucagaugauccaagaguuggcucccccuugcguaaagcucagcagagacacagcuaaggucacacagcagcuugguaagaguagguaagaguagaagcugggaccuggguccuuggacuucagugcauauucugcuaggucagguccaccuguuggauucuuugccaauucagggcccucauccuguguacuacugucagggggcugccucucugauccucauggaugaaggugggucuuuaaauugccuuagccacaggcuggguggccagucagccccaacuaggcucuuccagggugaagcauggccuggguagacucuccagccucuuaggaugggagguugacaagauggaccuucccugugaacacuuaacccaggacauccuccacuuccaaguacaguaaacagaauagaggauagguuuuuuuggucaaaugccuggaugaggggaaaccugacuugagccuacacucaguggcuaagaauggggaaucaaauauucacgaucaucuugggguugugccaugcugagauaucuuuuaggcagccacagcuuacaaaggcuaaaaauggagguaucucauuuaaagaguaccaaagaugggaauacauuguugucaggaaccaaacuugucauucucuucccuauccccaaaccuguaccuucucugauguuccccauccuuuucagugauaccaucaccuauuuguuauccaggccaaaaaucuaaagccaaucauuggucuauauuccuaucccugcccccauccaaucagugaccacauccuauuaauuugaccuucugaucauuucucaaauuuauuuccacuacuccaacuuuaguucaggucagaucaucccugacuucguuuauugcaacagccaccuaacugguuucccagccucuagccucacccuguuuuguccucagggcacauaggaugaggccugagaauuggccauuggauuuagcaaugaaaaagucauuugugaccuuaaugggagcuguuuugauggagggagggaagccugauaagagugaguuuaagagagaacaguaagagagaggaauucuagguagggaguauaccagugcuguccaauaaaaacaugugaggcacauauguaauuucaaauguuccaguagucgcauuaaaagcagguaagagaaacaggugacauuaauuuuaauaauagaucuuacuuaacccaguauauccaguauuuuaucauuccaauauaaucaauauaaaaauuauuaccaggauauuuuccuggauuuccuuugaaauccagugcacauuuuauaauaacagcacaucucaaguucaaacuaaccacauuucaagugcccaccagcugcaugugacuaguaacuaccacauuggacagcacuggcauagacaauuauuucaaggaauuuagcuauaaaggggagcagaggagugagguaguggccagauggggaagugaggucaaguguugacuuguugguuuuagaacgggagcuauuaaaguacuuuccguuuauacacuaauggacuuaauccaguagagaggaagaaauuguugacauaagaugacgaaacagugacuggagugaugcuguugaguaggggagaggggauggaaucuggaugcaaguggaaaugcuggccuuggcuaggacacagggcaguucaucuguggugacagggagcaggggagugaaggaagaccauacugggcacugaugcagauagauggguaaaugugauuguggaagcuuauggaaguuuuugucugauucuuuuuuuccucugugaagugggaagcaagguuaauaucugagagugaaaaugggauagaaguauuaaagauucgagaagagagaaaauauuaauuuguggccuaggagcgugacagagugaauggacuggggaaauacaguaugauugccuggcaacaugaaagaugcacuugagguuugugaucacgaauuugaagugagaacagucagcgcuguuguuuuucucuaguacauucagcugugagggacaagcaaggcagaggaggagcuuuggauucaaccagggcuggguuuuuuuuccagcugaguaucauuccauaaugagaagaacaauggagucaaaggcguaugcaagggauaauuagaaucaugggccauggaauuuaaggacagaaaagggagccaugagggacaguaaaaagaugguaggaccaauggaucacagauuccaguggggucaaagaaguauuggggucaugguuaucgggagugagcuggaaagguagaaguggugguugaagugggaaugcuugacuuggagauuagggaggggcuacagauauacauaauuauaaggucucaggcacgaccaugauaaugaguggcugagaugugguagagagcagggucauugagaacaagaggccgaggaacugacagaccaggaugcuggaagguucaucuagaugcauguugaaauuaacaagaaaucugaugagugguagugagccagguacuaaaggaaugagggccaugacccauaugucuguagaugacugugaaagggaaggauagcgggugguacaguaugguagugguaggauuuuagugagaagggagggccacucgucuaggacuacaaugaaaagaaagaaguuauucacucuaccuacaugggccaaaggagaaaaaucagucacuacuuuagagggccacagaugaagcaggcaaggagagguagguuggguaacaacaaaagggugaagggaacauucagagaagagauugagaacauaggaauugagcuaaugauuuaucugugauuguugccuauccuguucccuuuuccuggaauuuccuuccuuaccuuguacacauagagaacucuucaucuuuccucauccagcucuugcauugcuacuuuccugaaacggcuauugcaaagauuacuaacuagugaucggcauguugccaaacccaguggaagugcuugccuuuacuguaccccuauagagaaguguguucccaguggaauuuucuguggugaugggaauacucuaucucugcacuguccaauaugguggccaccaggcacaugugacugcugaguauaugaaauguggcugaugugacugaggaaccaaaguuuuaauucugcuuaauuuuaauucauuuaaauguaauuagccacauguggcaaguggcuaccuuauuuauugguuggugcaaguaauagagcacuuaacauuauugauccuuuccuucuugaaacuugauguucuuuugacuuccagcacaccucucuccuagcuuuacgauugccucuuuaauuuugucuucauucuugacuucucauggaucuuucuccuucugcuagccacuuaacuguugcuauuuuccaggcuuccuccuucagccuuuuaucacauuuuguggacucuuucucauugaucuuauccauaccccaaguccuguuuccaggccaucucccucuccugagcacuagaccuggacauaacagccuauuggagacaucugcugguguaguggauaggcauucagugcuggcaugcuccaaccugagcucaucucuucucuaaauuaccuccucucaguuacugaagccauagaccuggaaguuagucuagaugucuccuuccugucugacaaauugccaaguccucuaugccacugcaguaccauuugaacuugucaucagucuugucccucuccaguccauuguccacauugcugcuagagcagucuagguagcugaaacauaaauuugaccuuuuuauucuccuuguuaaaaccuuuuaguggcuucucauuguauauaagauaaaggccaaguucccagcauggcaaacaaggcucuucaugacccagccucaccugcauguuuuuccagcuucaucuccugacaugugucccuucucacaaaguucucuccuuuccaguaacgcagaacuccuucuaauugcacacaaacagcaugcuguuucaugucuccacagcuuuucucaggcuauaaccucuccuuccuucaaggcccuacccuaaccccuucugguucugcaaagcucaccucaacugucaucuucuccagcuacuuuuccucagugucccuguuacuuaaugcacuuaccuaacuacaccauugcauuauucacuuguaaacgcagguaguucccaagaguggggaccaccaucuuugccuccuucuuuccacugucuggcauggagucuuacucccaauguggacucuguagauguugagugaauggguaccaugaauaagugagugaguugaaggaagcaggaagaagauuagagagugggaugucacacugcccagucucaucuccuuaguauaaguccuucaugggugggauuauaggaugagaaaaggggccccugggaggccuguggggaucagucuuggcugcugcuggugcaacugacuucuuucccaggacucauaaaacuugcuucuggcagaaauugauuuuagaaaaagcuauuaucuagguuuuccccuaccuuuacagcugacaugcuucucucuuccugggauauaagaugcuagcaaaaaaugucacauuuuuucuuaaaggagaaaaagguuuuguauguuuaauuuuuugaaagugcuuaaguuucuguuuucuuuuagaagaaaacugguuuuucacugggauuuucccaagggccacaugcagguauacagaaaagagaaugauauguguuugcauacaauuugcauauaucuguguagacuggaucaucuauucucagaguacuuucuuuuuuuauuuuuucaaaaaaauugaauacuugaucaacuuuucaaugaaaagaaucaguaacagugaaaggcaauggaagccauaguggaaguccuccuucauagagaagaucaccucuuuagaagaugccccaucaucuucuagucuuuuauaagauuuuggaugguuguggucgccaugauaaaaaauagcagcagccaucugcaugccaggauagcugucguauauacuuuuaucucucuuuuuccacucaccagcccuuagagguagauguuacccucagcccaccagcaggaaaacaggcuuagaggggcagcacaauuugcccaaggucacuccuauggguaguggcagagccaugauucaaacccaaggcuacauggccccaaggccuuuguuuuuaaacuacuaagcuguauuuucugccauuuguguacugccugguguuuugucuuuuguccuugccauuaccagccauagacagauacauaguuuggcugucauuugaaugguaguggacucuguugcacaauguugagguaccauaguuuauguaacuaucuccccacuugguuuguuuccaguuucucaguauuauagauagugcagguguaaauaucuuugcgcaaauuagggugguuuguuggaguuuuuagguauuugauggugguccgcaaaguaguauuuuugaggcaaagaguuauaauuuuaugauucuccagaaagucuauaccauucauucacccaagcagugauuacuuuuggagugcccacuguguaccaggugcuggacgugaagagguaauucagaaacagccccucucucagagaacuaacagucugguaugggauggaugaugcagcacagaaugaaugcuacuaaagucgggguuugggcaaggggcagugagagcacugagaaacaguguccccugguaguaucucugaguguuccuuucccucugcagcauggggcaagacgggaggagcaugauaacagggcuggcugcagagcugccuccuggcugaggacaccccccaccaacacccacgggcuuuccugccaccgccuguuggcucagucacugcugcccaucugccacuagggggcgccgagcagagaggauggagggagggggcacccgggacaacaggacugggggcuccagcagugggaggaguggcagccuaagcccuugucuguccuccaggccuccucuuccccuguaugcccaccgcagccagggugacaacacggugcccaguccacacucauucagcagacaggaaugugugcaugccuuaagggcauagcucugugcauuuucacgcaccaagcacugugcuagaugcuaggaaugcagaaguggccugacaugguccuugacccugagaugcacuuggucuagaggguuggacagacaagggaagagacaauccaacuugugugcuggaggccuucacaaguggcaacaggagcguugagcucccuagugaguccccuggcagugcgugagaguucauuucuccagugcuccgcucuuaugacuuuggcugugacauugcccaucuucuagccuggaauuucuccaucuauaaaauggagggaaugauaucuaugucugcaagggccuucugacucagaugugccaugagccuaaagcaagccugagcuucuuccacagaagagcccccagcccugguccccacuuuagucacugaagaaagucuccuuucucuucucgcccacaugcucuccuuacaugguuuuccuuggcauucugccucuggccuuuuccuucucucuuucuacguauguucccaugacuucaguuaccacugugugcugaugacaccuacaucuccaugcucgcccccauccucuccacugaguuugugacucauauaacaaugaaaauaaucagcauuugcuaaaucccagauacaauacuguaauuacgguauauuaucucaucucaucucuccaacaacauugugaauuaggcagugccaccccauuuuauaggugaguagaaccgaguucaagagaugcugagacuuucccaaggccccaaaguugauaagugauggggccaggauuugcaaaccucuaccuguugagcuccacugcccaugcucuuauccaucacacuauauguccuagaguacaggcagccgccaaagacccauuuccacuuggauauuccacauacaccucaauuucaugucuaaacuuggccucaucauuucccuucugucccaaucugccuuuuccucucuucuccauggcaauaaauggcaccaucaacccagugauaccccagccagaacacugggaguuuuccaagauccuuccucucccuuaccaacccccaucuccccaacaaucuucuccaaucuucuuccacaucauggugauuuuccccccacucuccuccagccucacugcuguugccuuccaaggccauucauccuguucucuuuuugggcuccuguagcaaucuucuuaccagccucccugccucgacucugucugcuugaguccauccccugcacaccagccagggugauccuuugcagacacacgugaucaccucaccuuacugcuucaaaacuucugcuuucugugacucuacagcagagcucaaagcuggccacccaugggcugaaauccauucagaagacauguuuugcuugguccaaaauguucuuaaaacauuuugaauuagucgccaacauuggaaaaucaggaaauuucacauaaaaguucauauauauuggcuucucuugcaaaagugaaaagaacugguaacucugggugcacaucccuucagggcaaugauuggauggagcugaguggugguugcccucuuuagaaggggugugggcuuuucaguuugacagucuccagcauccccuagugucucuuaggcccuggucgcaccccugcuuccaauuaucugccugagaguuggggcauuugaguucaugacccuggugcaugggaugaagcccaaagcccucagcauggcuucuaguguccuaugugucgcagccuggagcagaccagcccugcgaaccucugaggcuaguaccugcuaacugccccguuacacucuccccuguggccccauggaacccuuauccauaguucucugaauugccccacucuugucugucuccaugcaagcuugugcuuuggaauuccuaggccccuccuuaaguccuauuuguccuucugggcuuugcaccaguacuugcuguaccaagaagcauuccuugugccccuggcugaguuuuguuuucccauaacagguggcgcagaccucagucaucccaccagcuacccuguguuguaguuguugacugugagucugcaguugcagggaaccugccuucuuuaucuuccuguccucaaagcuuugcacaggacuuggaauacacaaggugccucauaacuguugaaugaauggaugaaucagugaaagacugauuugggaaaauaauagucuaggauaugaugucaacccuaauugcuugggguggggguuccaggucccuuucauucuucagcauuccccacucugaguucccacucagagugauacccacaacauccuauaaaccaugcccccauucuccaagauguggaauauauccaggccuacugggaugauacuuuuuagcaaugauagagggaaaauauaucauuuuugguaucccugggggagaguuggcacauucuucaguuauuugaauaauaauuaagauaaugccagcauuuaacacucacugagcacuuacauuguaccagacccugaacuaagagcucucaguauauuguuucauuuauuccuucaacacuaagaaguagguaguacuauuguccccauuuuacaggcaaguaaacugagauacaaggauuuuaaacaacuuuucacauggcccguaagcgguagagucaagauuugaacucaaaucuaacuucauaguuaacauucucaaccacuacaccauacuuccucaaugacauuucucuuuagaaacacgaggaaauaaaugugggaaugaaggguauacaauuauguguacaguaagauugcaaauacuaauuuagaaaagaaagaaaagaaaauccugaggcagagaaaaugaccaaagagacaaacucaugugaaaauuuucuuuaaugaauacauaccacuuuuaugauuaaaaaaagaguccucucuuuguagugacccuagaaauaaguggcaggacagagggcaggaaggggcuggguugaguacccagcuaaucaguggggcugucucuugaguaguugccagugaucaguaaaaggaacagucaucaggcagcagcugugaccucaguaccugcacccucaugguacaaaggugaagugggucacuauuccugccaucucaccaucuccccucuuccuccaggugcuuacacuccagagccccucagcaguuuccggugggcucuucucucaacuggccucauguucuuuuaucacuucagcgucuugcagauccucggccugguaaguuugguuauauccccuucuauccccucuguuugcaguucuccauaaaucuugguaauccugguuggugcugacguaucacuuuguuuugaaaaugcaagaugcuaaaggccaggaugucagauuguugugucuggauugcugauuuaugaucuacagccuuggccucuccaaagaguuuucugagucuuucaguaaugacuguuucuuucaucccuggggaggcaaggaugccuuucacucauggccacuugggucggaaacaaugagcugcaacuggaaagugguuuguuguggaccccauggggaggcaggacccuaacccugccccuuggccugggggagucuucugaccuuggguccauccugggcccauucauaggcccugaaggcugcacucuucccugagcuucauggccagugaagugugguguuggggaaauccuguggcauucugggguguuuagaacuuccuggagucaugaagaaugguuggaugguuggacucaguagcugaguuauccagagcccaaaauugcugaguguaagaguguauaucaguggcaaaaugaguaggaagagcucaggacuggggcugggggucaggagacccaaguucaaguccuggcucugccacugcucugaaugagucaccucacccuugagggcagagaguucuccaccucucuuugacaugguauaaaagccccaacuucccugagagguggugaggacuugucuuuaaugugaacaggcuugaagggcuuuggaaggcaggugccgcgaccguccccggggcaggugucgcaugucugguuuugugugcaaguggcaguaauguagcauuagccauguggagccucgcgugaccuagcaugacuagggcguguaacugauguccccaacaccuuuguagaagcagucacuuucucuuccucauucugguguauggcucugcucugguuugcugggggcuuagucugagcuccuugccaacagugugaaugcuuccugcgcucucaggaggaagccguacaaaguucacacccuuaccacuugcugcucuccacugggacccagauuccagaggcaucagugugcucaugucacccuacauaccaugcucaggcaacgccuccuacaaggagggcaacccucaccccauuccucaccauaaacccccauccaucuuucaugaguccauucagguaccacuucugucaugaaaucuucucugaggacucagcccccauauuguaugcuccucagaccuccucauaguguauaaagcugggugagcccugucugguuuggggucagauguaguaaaccuuugaccacccccacuugauugauugcaguuacguggaggcagggcccacgcugugggcuguacuuuuagccuguaacaccucuccggggucuaggcacauaguagaugcucaggaauggcaacaaguucugggcccaaacagaaggcaagaccgugagcaaaacugaauagcuuuuccacuagacggcccuccgccaucaccuccagaggccucuagcuugacucacucagaaaaccgaggggagagaagaaaucccuuuauaaacagguggggauuggucaaucccuccuugucuagucccccauuagguagagauggcugaacuggcagaagccagagaaagccuaaggauggugaacgcucacucuaccucccuugucccugcaggucaccgaagugaauuugaacaacaugcuguguccggccaucucagacccauucuacggccccugguaucgcaucugggccucgggacaccagacucucaugaccaugacccacgggaagcuggucauccuguucucauacauggcugggcccuuguguaaauaucugcuggauuugcuccggcuuccagccaagaaaauagacugaaggugcuuauuuuuuuuuuuuuuccucccugaggaagcaagucgugacuugacuuggagaacacccaguucuugauaaaaucaugggagagggcaguaggauguuugguguauuucuuuuuccuccuuucugucccuuucuucuaccacucuuccuuucccagcucuucccccuacgaugucuccuugagccugggguguagugcugggcgcuggauuuuccuccuucccuuuggcucucucucugcuccuaguggccuuacauggggagauugcagugagcggcucuuucacucugcuugucggugcuuuaacaacagcugguugaggagaaagggaacaacaaguaguaguucuuuuggcaucgaagcaaugagauuggguuguguuucauuucuccacugccagggaccuccaggcuuaugcuggcgucccauuuagucuccagcacagcccuuaccacgggggacugaggccuuguuucuauaccagcggcaagcccagagccgagggauuucacagcucguggucaagacagaaccagccagauucuggucacuggugucccaugacucaaaguaaacagccaaccagccacucccuccaggaugcugccuggggugggaggugagagcaccacccagcccaagggcuagauuccauugagaggguuggagaucuauugcaaugacaaauccaaagugaagagggucaagauauauacaguacuaggccagacccuguguaaguucugccugugagaguugagaacugaugcauaucccaaucagaagugagcacagaaaacugugauuugaaucauacacucuguuuuaggaaaauguugauaauagauaccauuuuaaucuugagugccccuuaaauguguucccucucccuuucccucuccccccaccccucccccuccccccucccucccucuuucccucucucaggcagcuucagggaagaaugagcuggaauuggcugguugguugguuuuugaguuuggagaauccucgcaucagggcccauuucuggaagauucuguagaucuguuucuugguuuuacagggccaguguuguuucccuagggccagauuucuucaguguauccacacucagugcugaauuguuuaaugugggggacaucacguccuccucauccugucuacccccaaaucccaugucuagguugaaagggggcugccaaagaauuaaguccucauggguggagguucaggugcuccacaaggaggagcuuuuguugaaggacuucagcucaguuaugcacggaccucaagcaggcaggaaguggcugggcauugcugacuccacauugacucccacuaggaacagauuugcuuaagaacagaaaagcucauuuggugauuuugucugaugagccucccuuccccugucccacucuaggcaacacaguugaccuagaccaguuccaguauuuccaguuugaccguguuugaccuacacugagcuucggugccucaguggucauaauuuuagcaaguggaccuauaggaagcaacccugggagggaccguccuucugcagaggccugcgggcauugaggcuaucaauccccagggcuuggggagcaggaggggagggcaccaagugcucuuacucuccugagcuccuuuugaugcguaagcuuuguuuuuggcccucuuugaaggcagggccaaacuuuucuuagugccucucaccuuaggguggcccuccagggaaggugcuccuugaauggcuggauuggcccugcccaccgucaaacugcuacauguaggaauagcugaugaggaaauacacaaggccucagugccccuuggccucuuuacaaaaggagaaguuggaaggggauugugggaggagccccugggggccuggucuguccuccaccagaacuuggaguugcugccagcagaggaucugugccucagcugaagacuagcuccggaaugucauaggggugugacuguguaggccuucuccuccuccucguuucuguggcauggcacagguugccugguugcucgagccuuccccauguugacauccuccacaagcuugccuuugcucugucuacagcuuaguaccccauucuggagggcacuuucuggugcuuggaaggagagaagaaagcaaaagccacaugccuggcauggccaagccagagacagauccaccugucagaggaaggaagaaguaaagggggcaugcagggcuuuugggggccagauuggcucagaaacauguaggucaaaagaauagagggggcccagucuauaggcuucacaaggagccauggccuguauuuggggcauuggggagcauaaggcaucugaacugguccagaucucacucuuaucuugggccaagccaacguggagagaagcaacccaaccagacucuuggcagccugccuuacaggguagcccaccuuauaggguagcccucauaucugcccugugccggcccucuacugccccagcuuugguacaggagugagggagaagcuggagcuugcacacccaguggccaguggggcugucuucccagcuccuccucagggcuuuccugucagugccaagccaguuccccagccagguuuccgugugccauuugccagcgugugggagcucugcgcgugugugaggguguuuguagaagagggcaguuuccuuucaaauggccuuaggaagggaaaagaguacucccuccagccccuagguagccuuggccagggaugugggccaagaacagucuguggagcuggccaacuuguggcauccacuccaaauagcagagacccagucacgccugcuucugguccucccugcccucaguauuugguuuuguacaccaaagaugaucuggcccaucuuccucccagaggcacaacaguaacauguuccucugucagccugugaaggcaugcaggguucugaagccacagacucagucuccccaagucagcaaucucuuucucucucucuccucaaacuucaucgcauucauagaagcugcuugcagggucgccgggcuaaccagggugaucggcgaacuuuaccguacaguaccucagucuagcugucagaucaccccuuuugcuguagccucuguugagguuuuuauauuugugaucauugguaauucaguguccuaugaagugggcacagcuccccacagagagcaaguugucagcaggucucugugcacugguauuggggcagggcagugcccuggggguaagcuagguggcucagggaguggcagaagggccauuuuucccucugccaaaaagacuuccuuggauuuguagauguugacccagaguccucuguccccuccugaagaggauuuucuuacugguuucuacugaaggggagguaggggaggaggaaaaaaggaccaugugugaugcuguuagacaagacacugacgcugauuauggagggucuccugcaggcccuugugggcuccuuggcaaggccccaggcugggaaggagcuccccccacugcccauccugcccgcuuuguggcggguagagucagugacagggaggcagcccuccuuuuguguauauagagugagcugauuugggcucaggaaaaccuagucgcuuguugcucucgucugugacauuuuuguacacugguuugcuacucauggcaagaaacagacaaagccccaugaaaaauaaaacaaaacaaaagucauuucaaacaaagcuguuguuuugaaaacucuugcuuucuuuugguguccauuuuguguucuauuuuaaagaaucuuucauuuauauugguguuauuguagugaagagaaugugauaggcugaucuguaaugguuucugucaggagcuuagcaaaugccucugccccucuuccccuaccccuguccuuccucaguucccagcugggauugcuaugcacugggcagacccgucacugucuccccugaacccccacacaguggcuucccuuagaaccagucuuuguacucucccuaaacagcagcaggcuuaggauuuuugucaggcugguucuugcgugcucugugcccccaccaguuugcucaccucuuggggcauuuuguaauguguuuucucugucuuguaaaaccuuuugauuguaccgaaaugguaucugcagucgccuuuggaaauaaauggucauuaauuuguguacuuagcauucugaauuuuagucucagguguuucuguuguugaagauccuugaaugaaaaggaacccucaccauggggcuuacuguuauaauguuucuucauuuacuguuauuaaaagauuuaugagaacccaggaguccuggccuugcuucccagaacccucucagaaggcccucugcuuugaaaaauagacaaaaggggccucuggcccuccguacuguggaagacccucaaaggacagcugggcuuucucagcacacuuuuguccugggagcugcguggcugguugcccuugaauucccacacauugccuacuucugccagggacccagcaggccauuugcucuuagcagagggcuugucugccgggcacguuugcugggcucucugguacccaaagugcauugggcuaggcuggaggacugagcuggagaaggcaaacacauucaggcccacucaaccuagauuuccugagggccagcucugcaccagcacuucucagcacaggccugcacccagcaugggucggaccaugaacaagauagccuuacccuuuggaagcagaccugcuuuuccaaggcuaccugcugagcagcccaugaugacugugauuggcccuuuuuacacaggacagaggcccuguucaggcuuucaccugggcugcuguuucuggagaggagagguagccagauagggagggguagcagaacugaaaggcacaggaagaaagggggccagauauggcgaaggggaaggacggaaagaggcugguggggaggaggugaggagaguugguucguguccuucccccauguguucuuuuucaggaagagagcugaaaaagacaaugaccuaggccauugccaucccuacccugggcagucuuuguacagcuagccagaccuggcagccagugcagguggaucuccucauuugccaguguuugggcacccaggcuaugaaugaggcagggucuugcaauuguggacuagaagauuagcagccuagaaaagucacuuaucuugcugccucagguucuuaaucagcaaaguaguagcuccaacugcacaccaggcauggagccaaaucccucccauuaccucuuagaauccccaucaaaguacaauuagcugacuggcaaugcuguccuuguacgguagggagaaagugagaacauggagguuuagucauaaauggaggagcuggaauuggaaacuaguuuuguuagaccccaaagcucacaugcucuccacucuccaccagcuuccacugccuuuccagugugcuggcacugcuggguagacccuugcccagggaccccugguccuuauagaaguggaaagagagccgggcagugguguggaagaugagagagaaaggggaggcccacgaguguagaaagcagaggaaucaaggccugucagcagcagccucaaagcagaccugaaaggcacaggaagaaagggggccaggugaaggggaaggauggaaagaggcugcggagaggaggugaggagaguugguuuguguccuuuccccauggguuccuuuuuaggaagagagcuaagaaagacgaugacauaggccauugccaucccuacccugggcagugcaucugccccuaccaccauguccauccccacccuagucuguauucccuccugcaggcaacagucuuuuccagugcagaucugcaucacuucccugggccacuggcucuagaauauaaagcccaggcucuuucauguagcauacaagcccugggcuuuguaagcaucuucaacuacaucuccuccaccccacacucccaaaagaagcaugcagagaaacacuucacuccagcgggaucguacuccccuuuggcaugccacgccauuucccagguccuugccauuuguuuccuuugugcuguuuucucagcuucccacucucccguuucauccuaaggccuccacucaaagguuagcuccucucugcagucuucccugagccccaggcuauguuaggugccaguccacuuugcuccuacagcaccugguacuaacucuggccaucauuugccucccucuuacgugauucauuacuggucucucucccucuguagacauuaagcuccuugagggccagguggggucugauucauccuccagccccuggcacaggacccauuccauggaaagugcuccgugaacaaggaucuuacaccugagugcuaaaauaugguaggaggcaccacuguucucugauggagaacccuaggcuacauaagccaugcccauccuaugaauucuccuggauggggcugggaugccuuuguuugcccaggcaccucaagcuucuugcugaggggccccauccuguuucucugcagggcucuauauaguugguguccuggauaaggaggcaguauugugagggaaaagcacuaagaccaacagcaacuguucaccugacucuuuccuggaccucugggcaagguguccaacugcuuuuccauauccuuuauagcucuucaucaccaccagggucaccccuuccuucccuggaggcacacagaguuggugucugcauggcaaaagccccaccagcccauggaaugugucauccaccccgcugagggguagggagcagcuugagaugguuacaaccugaucccccaaugagcuuuucccuuguccugguuugccagugccaguggaggaacagaaauacacagaugucagccugacaaaugcaaugguuuaaucaaaggaugugugguuugcuaaccuuggcaacaggcaaggccaauguagucuaaagucaaggacucuguuacugccugaacccccccgccccgcccacagucagcacucugccucgcaucugaauugcacaccugggaugucugagcugcugggcaaagggguuuaagagccagggaggcaguagggagaggcuucuccuguggcuaauggaugcccuccacagcugacuuccuaacuuucaauaacuccugcaucccagccagccgguaaucucugcauuucacacugaggcaggucuuugcaguggggguggaugcuuccuugacacaucugugcuaggaaacagggccaguagcaugagucacagagcuguucuccuguccaacaaccuauucucagccccaucacugcuccagccagcaggccucucugcucccuuccacacuucccuucuccauccaaggggcuugcccaggugaugccaaccugccacuguugucccuucucuauacucaggaggcucaugcuuuuuaguauugcauuuuuagaaagaccuugggcucucuaguauucuguccccugagaacagagggaucuuccugugcauuccaagacauacacucagauuucuagcgugucggcgcuaacaagauaccucuaguacaguggacugucgauuuuguugcucauuaauccccuggggagcuuuaaaaaucucaguccccaggccucacccaagcucauaauucaaagcaaacuucuuuugcuuucaaguuuccaggccgguucugagucaucucuuugaccugaccgucuauagcagugccuuuuuaaaaaaggaaauauuuaagauauaccaaaagguaucaagaauaauaccuaaauucagcuuaaaaaagaacauuaccaauacaguugaagcccccuugcuccagagguguacagauucuuccucagcaccucaggguugcuggagaggugccucagaagccaccucaggcagcgggggaugcaucggaguagaguggguggugcucuggccuuuucccuggcuucacccagaacaacuccaauuuuauucuguuuuguauauugagguuuuggaaauaacuuuguugggaaaaggaguuaaaaguuacuuauuuacaaccucaguaguuaugucucuauccuuucccuaaauaauaguuguuguccuguaguagucaaaccagcauuguagcaggacugagcaggcagggccugcucucccaguucuucccuuucaggucccgagugcccuuggcaaagucauaccuuuccugaacuccauuuguaaaauaguaguaaauauccuugucuagcuuaccccacaggacaucuaugaggaauccagugagaccagugggugugagagggcucuauaaaguucuguccaguggaagggguuccuauuuccagacaguuugguuacuaugcuuguucccagagcacagagguuagcugggguuuugacugcacucauacccacucugccuuaaugugcccugugugguugcggucugugguguguaugugaguggguguuuguguguaggacaggugauaccucaguuuauuucauggacucuaagacacauuuuuuucacauuuuaacaucacuaaaauuggaaugcaucuuaaaaucaguggcaugacaguuuaaucagcaccuuuuuuuuucagcaguauauaaaauaacagacaucuuauaaucuaaggcauauuagagucaaugaaauacuguaauuguuaacuuagacuccucuuccucuucucccaugaaagucaucuucuugcuagagaaaacccuuuuggaaaaauauacagacuuuuagcauacagccucauucuaacacuccucuuuuucuucccugccagcauccacccaggccaggcaaggcuucugcuucuugaccagaaggggacccacuuuguugagcucucucuugggacagaugguuugugggacaugagagggaagaggcagaguauaccugcauaagggagcccaccgugccaaaugacagggaaggagucagacaagcuaggccagccagccccaauagcucugguuucuuucuuuccccaacagcagccuggccagacaacucagccugcuucccuggggaacuccuagggcuagucauugccagaggugaggugagcuggcagaaguaggggugggggugugaagcccaauguguccugaacucccuggguugaugugaguggcugucuggcccaugcagaagaacacaaugauuucccuaccuccuccaacaagguggaagaagagucagguaguaagccuuucaaggaaaagcagcacuuuguccuagggcacccugagccaugggcauuucacugcaguuaggaauugccaccaacauccccucaguccuggcagucacucaaauuaagcucugcccuuguaaccuuuaggccaaccucuuccagaagggaagaggagugucugcauagugagaucuagggauacuuggucacaggaagccgcuuuuggacauuucucccccagagagcuuagcaagacaugaucagccuggauuacagcugcccucacguaacuggguuaaaguguuggccuacuuaggccccuccugcaguggcuuccuucaaagcugaugaggccgauuagggugcuauuucugagaucuagucguguacccagaagccugagggcgguccuccccugacuagaaagacaaugacuaaggcuggacagccaagggcagagucagauuugcccauaggagagcacugccgucagaacucauguaugcuuguaaaagaaccaaauaauaucaaggcuaagucccuggauuuugaacuucaaaaaccaaaccaaccaaucaguuuucagggauaggccuaguccuacaccuuugccaucuucagagcuaaagagagauagcagaucgucaaaauaaaaucuucaauuauaguuguagucacuagccgccacucaguagguucugugcauuugagauuguuaacuaaccucugagccucaguuugcucaucuacaaaauggcaauaaugauagcaucuaccucauaggcuauugugaggauugaauagaaaaggcacauaaggcacuuggcacaguaccuggcagcacauuuguuagauaccaccacuaccaucaccacaaccauuaccaccaccauugucaccaucaucauccucaucaagacaacagugaaugggaaaaagcucagucucuggagccugacaaacuuuuuuugaauccuggcuuugccacuucacagcuacguggccucagauaagugacaacuucuuugaacuugauucuuauucuguaaaaugggaaacucauaaggcuauugaaaaguguauaacaugguucuucacaguaagcacucaauaaauguuagcuauuaugauuauuaaaaaggagugaucaaggucagugguugccugguguuaggaggauacagagaugaaugggcuaagcacagaggguuucuagggcaaugagacuacuauucuguguaauacuauaaugguggauacauuucauuauauauuugucaaaacucauagaauauacaauaccaaaagugaacccuaauguaaacuuuggacuuuggaugauaaugauguaucaguguagguucaucaguuguaacaaaugugccacucugauacaggauguugauagugggguaggcugugugugugauggguguauaggaaauaugggggaacugucuauacauuuugcucaauuuugcugugaaccuaaaacuucucugaaaaauaaaguauauuuaaaaugaaaaggaaaaaaaugggagugaucauacuagauuguuauaaacuuaggauguuagcuauaauccccaugauaaccacuaagaaaauaacuaaaauagagagaagaggaaaugaagugggaaucaaaguggauauuaccaaaaaaaaauacaucaaacacgaaagaaggcaguauaggaggaacugaggaacaaaaaaagauauacagcacaaugg

SEQ ID NO: 19191 - RNA, 10444 nt, Homo sapiens
cagggacauggagggugccugugugugggagauguagcuucaggaaaggauugaccugaguuuagguaaugaccuacugugugacuaaaacugcuuuagagugauuaugggaagugcuucaaaguaauuucaggaugaguauuauagaugaaagaacauuagcugugugucauugaauaauuaucguugaaacuuagguucauuaugcuauuuuguuugaaauuuuugauaauaaaaacuaccuugguaaccugccaucuggagaggagauguuugcuuaugaaguuaguaugaguuuggguuuuuugaaauguugucuugaauccugaaaagaauuaaacuuauaagguuguagagaggcugucacauaagguccgccccuuaaaacaucuggaguuuuggggaaagcuauaggauggaaaauggguucuugaaauucuguaauuaauauuugcuagcuacacguaaaacuaguuuuaauaaacacaugacauuuauuuguaguggaaacuaauugagguaagugaaccaauucugguuuuauuguuucaguaauuguuuucccaauaaucaccacuuuuuuuuuuuuuuugagauggaguuucugucuugucgcccaggcuggagugcaauggugcgaucucggcucacugcaaccuucucaucccggguucaagugauucuucugccucagccuccggaguagcugggauuacaggcaugugccaccacacccgccuaauguuguauuuuugguagagacgggguuucuccauguuggucaggcuggucucaaacucccaaccucagaugauccgcccgccuuggccucccaaagugcugggauuauaggcaugagccaccgcgccuggccgaucaccaccacuuuugaguuuacuuuuuuucuuauggccgcuggugaggggggaucuuggaaacaagaaaaucugacuauuguuuaguauuuuuccugguaggugucucuugccacugaguagaccuuuuguaaaggggauggggucuuuacaaacaauauugagguuaaacugaaucaguucuuaugaauucagaccagucagugaauaaaaacguuaaaaucuguucuagccaaacauuauugguucauaguauugauuuauuaguguuauauggauggucaguccccucacauaauuagcaaaucuuucuugcagaacuuuuggcucuuuccagacuauauaauucagguuuuuccaaauuguuugcagaauuguugaaaaaauucuacccuaauacuagacuuaaaauaauguuuuauuuccuugcucugguauguuggcugccucaaagugaaaauuuuuaccuucauaaaaagcuauuuuauauucaguuguuuuguuuguuuuagcaguugaaguuuguuuugauuuucuuugauuccuuuuagcucugcuaaaauagcuucaacuacccaagaaguuuuuccuuuccugguuguuuugaaacauggcauaggauuuuguuaauuuaguucuuuuucuuuacucacugcuuauuuuuuuuccaacauuuucuuauaaaaaucuuuuaaacacagagcaguugaaggaauuguucaguuaacguguauauuuacuaccuaaguucuauacuuaacauuuuccuauacuugcuuuuucacauauccaucuauaaguccucauuuuugaugcauuucaaagaaaauugcaaacuuaaguacagauuaccuguaaacauuucaugcauauuguuaaccagaguucaauaguuguuaaagauuuuuuuucuuuugaggugaaguuuacaugcagugaaaugcacaaaucuuaaguguuggaugcagugagguuugacaaaucacauacuugugaaacccaagcccugaucaagauaacauuaucauccccaggaagucucuucaugcuucuucccagucaaaucuuucuaucccauuccccuggguaaccacucuugguucugaguuuuccccaauagauuaguuuucuguuuuucuaacuacauaaaugaaaguauaugcucucuuguguaaggcuucuuucagcauaagguauuugggauuuaucuauguuguauguaucaaaaauuuauugcugaauauuauuucauuguaugaauaugccauaguuuauccuuuugauggacaccugggccguuuccaguuuuuuuuacauauuauaaauaaagcuucuauggauauuuuucuguaaaucuuuuuaugagcacguuaucauuuaucuuggaauagaauuauugggucauaggugagaugcauguuuaguuuuuuuuauaagaaaccgcaggacauuuuucucaagugguuguaccauuuuaaacucccaucagcaauguaugacaguuccaguuucucauuaccaucagcauaugauggugucagugguuuuuauuuuagucauuuugguggauguguaguaagugguaucucauuguaguaagugguaucuaauuugcauuucccugauuguuuuucauaucaagcauuuuuaugugcuuguucauuuguauaccuuugugaaguguguucaaauaauuuguguuauugcauuauaggaguucuuuguauaugcugguugcaaaucuuugucagauauacuucuguuuuuuuuuuuauuauuauacuuuaaguucuaggguacaugugcacaacaugcaggcuuauuacauacguauacgugugccauguuggugugcugcacccauuaacucgucauuuacauuagguauaucuccuaaugcuaucccuccccccacccccaccccaugacaggccccagugugugauguuccccuuccuguguccauguguucucauuguucaauucccaccuaugagugagaacaugcgguauuugguuuuuuguccuugugauaguuugcugagaaugaugguuuccagcuucauccgugucccuacaaaggacaugaacucaucauuuuuuauggcugcauaguauuccaugguguauaugugccacauuuucuuaauccagucuaucauugauggacauuuggguugguuccaagucuuugcuauugugaauagugccacaauaaacauacgugugcaugugucuuuauagcagcaugauuuauaauccuuuggguauauacccaguaaugggauggcugggucaaaugguauuucuaguucuagauccuugaggaaucgccacacugucuuccacaaugguuaaacuaguuuacagucccaccaacaguguaaaagugcuccuauuucuccagcaccuguuguuuccugacuuuuuaaugauugccauucuaacuggugugagauguuaucucauuugugacuucugcuuauuuuaauuaugcuuaucuaaccaguguguaaauguuguacacucauuuaugcuuaaaauaauuaggccaggacuuacaggugaguuauuuagcugaaaguuaagcuuuucugauaugcuaaccagugcccugcugguguaaaaguuaaucaguaaaauaagacaaucaaacuucaggaaucugaauuaguagaaagcuaguugcugaaaagucuguuacuacaaaaaaagcugaaggagaaacgucaacugauucuggaauuauugcucagauguccucagaugacacugguuuaaucaugaccagcuuaaccuccauuuauaugucuucucacugucucacagauuccaacuguucuaugcaauauguaucauacuuuuaaguacucaaugaagaauaauuaauuuccaggauugggccucuaagguuuuucaauguuguaagcuauagcuuuaaaacuguauuggucucuuuacuucaucucauaguucuuauaaauuauuauuaaauucuuaaauacuagucagcuuuguuuaauggaagauauaaaaaucagaauauuuauucucauauacuuuucaaaauauauuggacuguggaggucucccauuaguguuucugcuaggcaaauuacauugugaagucuuuuguucauaaauguuaauaauagguggcuacgaaugauuacacugaaaaagggaggaacauaacaccuuaaaaucugaguugucacacauuucaggggaaaaaaguaaauacuuuauuuuguugauacugaagcuaaaaauacacaaaauuauuuuauuguacaagauucuuuuuaauacauuaagauugacacugugcacuuacagaaaguguuuaaauaaaagugauaguuauucaaagagauuuccacuuugaaaauagucuucaaagccagugucauuuacacagacacauuuggaauuuucccuuuucaugauuaugcucaagauguaucauuuuaaacugaaauuugacacacuuucuauauggugauaugugguuggggcugccaacuaggcuuagaaggugaauuacacauagcucguauucucuaguauucuccuuccugcuaccaaauguuaguuuguagcugcagacugcauucauuguuuugaguagaaagaaacucccaucccuaauuucaaccccauuuuugagaaauauggaauaaauagaauccugugaagaguuuaacuauuguucuguugaauaguaccucuggugugcauuccuauuauaagaaacaaacuaaaauguauuugcuugagaaggauguguuuauccuuaucugaaguguccuggggaaggucugugucuuuacuguugagauaagauacagcuuuacuuuuacuuuguuaagguaguaauuugaacacuuaauuuuaaaguuaauuuaucgaauugaauuuccuuuuacauuaaaccacagacuaauguguuaacccuuuggguuuagaggacucuucaugugcucacauaauauucauuuuggugucauuggucccacuuauccuguuaagacacuugagaauucuggcugcuucuccugcccacguacacuaagcacaguuaucacugauuuauuggacuacagguuacuuugccuuggauauuuaaacugauugcuuaauauguuuuacaaggagguccuacaagguguggccacaacaugaugaggcuauacuuuaaauaccaugacuagaucuuauacaggaaauacuuaaucugaauaugugacuuucaaaugaccugaacacauucagcuagcuagcugccaucuuccuauuagaguuucuuuccauugcuucugccaccguggguucuuaugaguccaaaauccuccccucuguucucuauggagguuagugguuuuucuuuacugucccucucccugauaacagccuagucaccagagccucugugcuauacaaugucauuucuuaaggaucaaauaaguuugaggagucaauucugaguuuauuuacagcauaagccauuggaacucaauguauuuuacuguuuaaacacaaaggguuaaucauuaugguuguucccaaaucagugaagcuucucuaucuaaauauauugcucuuuaaaguguucucuucaggaggcuaugugcuuauucauguaaggcuaccacugcuccaagcauaauugaaacuagauuccaggauacaaaggagaacaagcauucuugagggggugauggagauauucuauaacuugauuuuggcuggugcuuccagggguauauacaacucugaaaacucaccaauuuguacacuuuaaaugaaugcagguaauuguacauaaaucauuccucaauaaaguuaauuaggggaaaaaaacuagauucccaagaacaguuccaggucccuuacaaaucccacaagagacaaucucauuauuuuauaauugcaccuaucaaagugccuauuguguaguagcacuugaaaauguuuuuuguuuguucguuuguuuguuuuuaaccagagaaagugguacucaucuugacuaccacauguuuuaccaaguguggaucuaaaauuacuuuuggcaauuucuaaauuccuaaaaauuuaaucuuauaggaucaugauuuucuaccauugaggauauucagagauuguacuguggacuuugaaagucauuucaaaagcagaaguccaaaguggguagaguaauggcagcaucauuagaauauggguauggcuuuuuaaggugacuacuuuaaaggaccacguucauuugggugcauaaguucugguauguuuaugaaaauaucagucauuauccuauuuuauguuuauuccaaauuuaugaggcuaaaagaugacagcagauacauaaucuggcuuuuugccauagugcccuuccuuaccuuucauuucucuuucauguuguuuugacaaacccacuuuauuucuuagauaaaauuugaaggaagugaucuuuccaauuggcuaaaguguacauauuuaugaaagcccaucugugauauugcauuaugggugugguguguugaacuuauauuuacagugaucccaagguugagaacuuguuaacaucugaaauuuaacccaaauaugacccaaaauuugaaaaaugauuuaccgguaguucugcuuucauauauuguugcauuuuuugaauuucauuaaaggagaaaugaugaugcuaauguuuuaauuaaccauuuuaaauuauauuuuuaauucagguuauucaucucaauuuggccauccaaaaaacugacaauuuggugguuuagccccguguuuuaaaguguauauccucacucauccuuacuucaaaagcuuuuccaacugucucuuuacuacacuaucaccaucuaaguuucccaaucccagcaaaaauccaaagccuccuuucuuccuuccaagggucagcuuuaagaguuguguaagagcggagaacugucaagaggguuccuagguuggaaggcaauugguggcaaugaguauuuuggggauauauugaacuucugggaaaagauacaaaauggccaaucccagcuuaauuguacuuucaaauggcuggcuaccuuaggcuuaaauaaaaggcacacugccacauauucauucaagugccacuaaggacagugccuuuuguguguauguauguaagcuccugggauguuagguugccccaaaaccugcuaaagucaaagggcaaauaugcugaaaaauggugaaaaugaccuucacguugcaagucauucuaaccuacuucaguuagucuuuuuugguucuaucaagucacuggaguuauaaagaaaguucuuugagggggaggaggguaggacagauacaugcuacuuucagggauguaugacaguugauuucaaugaucaaaaguugugggcuguuuauguuccuacagaaauuguuugucauuuauuuguguaguaacaggaagccucuagagcuuucacaucuuuucacaucauauaagaaaacuagcuuuuuggcauaagggcauuccacuuaguuuuauguuuaaauauuauaauucuuaauauguauaugucucucagguaccacaaacauugaugguauaucuuuagaaaaagaaugaacacaacucagauccaguaaucaaguacaagauacaaauccacucaaguuggggauaacacaaauacugagccuaaagaugcuagagcacacuggcuugcugccucuaucauuccagcaguuaacucuguuucuuaaacauuacauuuucuaaaaguaaagcucucacaaagcacccacuaacaccuccucuggaucaccacacaaaagaugaaaauccuaggccacguaccagcauaugaaugaauauuaacaccucaaguaugcaccaaaucucagguauacaguaaaucugaaguaugcagacugacuuuauuuugccaaaaauguguauauuuaagucuuccagguaaguuauucugaccuaaaugcuuuuuuuuuuuuuaaacaaaaccaggaaccucaaaucuugauagcucucaauauaaaagugcuacagaagaugcugucauggcaguucauuuuggcaauuccucacagcucaggaaaugucucauugaaaaguuauucuugcuucccucucuucaaaaugaucuaguaauuaccuaaagggauaaagggccaagggcagaaccaucaaaugcuguuaaguuuuguuaugugugucuauguauauacacagacacguucucacuuuuacagacaucccucaaaaggcaaagcaagccaaaacccacaucuguuggaaaaaaaguuacuggaagguucauuggaaauauaaugguaacaauguuucucucugcugaaguaaagcucacauucauuugggguacucagaucccacugccgaguccuacaccaacaagguggauauuuggagcaauuaucuagauaaaguaagccaaagaaacaaucuaaaauauccuuaguuuugaggcaaagcugcagggauugaagguagggcugugaaguagguaugaagagguuauuuaaaugaucugaacacuuggaucaauuugcauugacuaugucuauaugagcaaucuuuugaaaacuugauuaccaagaaaauauacucaauuuuucuuagguaccuuuauuuauuuauuuuugagacagucucgcucugccgcccaggcuugagugcaguggugugaucucagugcacugcaaccucugccucccagguucaagugauucucaugccucagccucucaaguaguuggacuacaggcguguaccaccaugcccagcuaauuuuuguauuuuuaguagagauggguuucaccauguuggccaggcugaucucaaacuccuggacucaagugaaccacccauuuuggccucccaaagugcugggauuacaggagugggccaccaugcccagccucaauuuuucuaagguacuuuuaaacaaaggauuugcugccuaucuucaaguacuuuuuaccugaugauuuaacaaaccaaggucuggggcacuaaaacuauuagucaaaacaccacacgagauucacccaugauguaacaugaaugccaauggucauuuguauuuucaggcuaagguuuggccucauauuuaucucuaaaguucccacugagguuuucagaugagguuugcacugccauaagaacuauaaaguucuuuuuggaaaagguauuaagucauuugaaaaguggaggcguucguuuuuuaaaaaugauuuaaucaaauugcagacagguauuuacgacuuagcugaaauagccuaaguuaggucacaguggaaugaaaaaugauggaggcagaacagggaauuuuuuaauaucuccaugucaguagacagaagcguaacuugaagcauuuauaucucuguaaaguuuggcauuuuccgaaaaugauuuuaaauuuagucuuuccucuguauuucacuggacauaaagcuggaaguggagauauuucaacaauggucacuuucuaauauaauucaaauauuuucuuuguaauuuuuaccuuuauuauuagggagauuuuaugagaucaaauaaaugaauccaagguguccggaagugauaagccaacuguaauguagguggaacaugauauggauauuuuagauaaguaguaaaugauuuuuguauuauuuguguuugacuuugcaguacauuuuuaacuucacauuuaaauauguaagucugaaguuuuggaguucacagcauuuuuggcaaaugaacaaaagggugucuguaguggccacuucacaucuauauauaacauauaugcuuacuaauaaaugucuucuauaaucuagaagacuugaguuuauugaccagcucugugaccuugagcaagucauuguccuucucugggccucuuuauuuucuauuuguaaaauaugagguuggaauagaguagauccuuuauaaaguucucuuuuaguucuuuuuauguuuauaaauuuacucucaaguuggcuuauaacuccucuggggucagaggauauaccuaagcauuuucacuugaaauaccuuuuaugauacuugaucaagagaguaaggaagugaacaaaaucuuuuuccuuuccuacuuuguacugaauuagaguuaauaaaaauguuggugucaccaacauggaaguuagggcaauagcuguucagcuuuaacccccauccuaaaugaggcuucacuauagcuaguaaagucuuaagcccaagucacaacgauaacccugagaagaucugaaaaggaauguacucccgugacauaugacacugguucuuucaauaguagagauugauuuacacauauuaucucuuuagaacguaagugacagaagacuuuuggaauacaguuccaugucuggcuagccuguuuucugacaaguugauaaggucacugcuagaaaacuuauaaguuuucagaagugauauacauuucugagaaaaacauguuuuucuuuuuauaaaaugggguuauaugcuauuucuuuuggugcuguuaauaugaguuaggaauguagcccagguucuauuauua

SEQ ID NO: 19192 - RNA, 44304 nt, Homo sapiens
uuaaauagaugaagaacuuccugauuacauuauggugaugguggccaacaagaaaagucaggaccaaaugacagaggaucugucccuguuucuagggaacaacacaauucgauucaccguaugguauguuucugaauuuuugugccucagaccaaaguuuggcacaagccugaguugauauucuguccaaagagagguucuugacacuugaguuagguuuacuuuggagaggcaguuugugagugaugagagcacagccucuguauuaguccauuuucacagugcuaugaagaaauacccgagacuggguaauuucuaaaagaaagagguuuaauugacucagaguuccacauggcuggggaggccccaggaaggggaagcaagcaccuucuucacaagucgacaggaaagagaagagugaaggaggaacuuccagagacuuauauaaaaucaucagaucuugugagaacucacugucucuugagaacucgggaacucacugucucuugagaacucacuaucaugagaacaucaugggggaaaccacccccaugacccagucaccucccucccuugacagguggggauuacaauucaauauaagauuuggguggggacacagagccaaaccuuaucagccucugaagccagacagccaaaguugaauccuggcugugucuugccuugguuucucuagcuauaaaauggaaauaguacagccacuugcuuuauaaaauuauuauugaggaucaaaugggcuaauauguguaaaguacuuauaggugucccuagcauuuuccuaaggaauucuuaguauaugucggcuauacuuaauauguuucuuuuguaaacuucuauaucuuuuuuuuugagacagggucuugcucugucaccaggcuggagcacagugguacaaucauggcucgcugcagccucgaucuccugguuucaagugaucaucccauugcaguccccuccuuccugaacucccaugccugacuaauuuuuaaauuuuuuguucagacagggucuuaguauguugcccuggaugcucuugaacuccugggcucaagcaguccuccugccuuggccuucagaagucuugggguuauagguaugagccacugcaccuggccagcuucuguaucuuauaguuccuuuucccccaccaaaaccaguuacagauguuuuuuugaacuggguuggcuucuuacauugccuuuuacaaugaguuaccuuuagagggcaagguuuucuguuucucacuuuucuguuucuuacuuuuuaagcuuuuuguuaaacucacaccuucauuuugaguaauaauuguaguguaauguuacagcauauuuugagauuauaaguuuuuuuaaguuuggaauuuuaaaauaggcaacuuugcuuuuauacauaaauuacuguuauaugccuuuaguugagaauacugacuagaagaguaagauucaacuuaagaugcuagguccugguaccagguuugagguaaagugaggaugagggcuggaggauaaugauguagcugagaauagacagacgaaauacuuuauuaggcuucucaggcuaggaacuaccaguuaccgugaaaggugaugauguagcagaagugagcaaguggccugccgaauuugagugcaagaggaggcacugaguggggagaugagccugguuaaguucuugccuuuauaccaaaggucgucuucaagguguuuuugcccaaguaggcaacuguaugcuuaucaaccgucuugaaauucugcacagaauucucuggguuuauacauugcacaaauuugaagaacauuguauaguggucaucaguuguuaugauacacugcugccucacugugggugacccaacccauuuguuacaauuuguccccagagguuauucccucccagccccccacaaaaaaagacugugggucuuuugacugggaaaauuaccauuauugugaguacuauuuuuuuuucuaaagcgaccgaguagauccuuuucuccgauaacuugauagaauacuuagauuuuuaaaacagacuaccaaaugaauuuaaaaccaaauuaauucaacauucucaucuggccauaaauugaguucuuuaacauguagugaagcaaagggugauguccccauuuuggcacuuugcuuucuuaaguuaguguucauuaacaccagccccaaacagacuauugugauuauuuggagccuugaaguaauuguguccguggggacaguagcaugugacuaggguucucauugaaacaugagguuucuggcauauuuugagagguacugggaagggauguaaggcaaaguaccucauuuauaacuaccaaaacagguuauguuacaagcaagauuacagccuuacagcaucaguuuugaaaguaauagagugaaaugauauagcauaguuugagauuauaacuuguuuuaaccucucagaauuaaguuguccaagacaccaucuaguuuaagcaguuaauauaagcugcuuaaauggugguaauaauaagcaauauuacauguuuaugauacuuguuuuacuguaagcuacaguaaaucuuuaguacuuacaaacagggugacauauuuuguagacuaagacuggucagaugauauucuuucccauauuuuugcagaggcuagauguugaaaacagugaagaaaaaaauacaauuuuuuauugacuucuguaggauuuauacaaagcccuuuuuuaaaaaugugaaguuugaaaguucauaccauuuauucacuaaauacaguuuaucaguauuuaucucagcuaggugcgguggcucacgcccguaaucucaacacuuugggaggcugaggcaggugguucucucaaguccaggacuucaagaccagccuggacaacacagugaaaccccaucucuauuuaaaaauaauaaaaauauaaaaaaauuuaaaaaauuaucucugaauauaaugucauaaauuuagagugacaguugaaaugaaaucuuucuuaacagaagguuuauuuuuguuuuuuguuuuuuuccucaggcuucaugguguauuagauaaacuucgcucuguuacaacugguaagauucauaacuuuuuuuuuuaauuucugcuugcuauggcauaugauuuguuucuuucuaaagucauagugcuuugggaaaaacccaucaauuucaaaacgguucauuugaacuuuuuuagaaagcacauacuuuuaugaacuuaagagcaguaaauuuaacauaauucaaagauaauuuaagugugggagagggagcagugcacuuuauccgaaggaaauaauuacauauaugugcaaagauuuagccucaaggauauuucaguauuuuauaauugaaaacaauuuaaaaguucagucauaauaaacgaaauuguuguauuaccauguguggaauaauauuuaacuauuaaaaauaauguuguggaagaauaacagaauauacacgcauaagauacauguuuuaaaaaauguguauauaugcucuucccccgaaaaaucaccuuugagauaauuggugauuuuuauuauauuuuuaaaauuuucuacaauaaacauacugcuuuugaauuggugaugaggaaggaaacgacuuaaaguaauaaaaauagauggccgggcacgguggcucacgccuguaaucccagcauuuugggaggccaaggugggcggaucaugggcucaggagauggagaccaucuuggccaaccaacauggugaaucuccgucucuacuaaaaauacaaaaauuagccaggcaucguggcacaugccuguaaucccagcuacuugggaggccggggcaggagaaucgcuugaaccagggauuuggagguugcagggagccgagaacgcgccacugcccuccagccuggcgacagagcgagacuccaucucaaaaauaaauaaauaaauaaaaauaagaaauaaaaauagauuaaaaggacuguauuuuucuuuucagaacccucuagucugaagucuucugauaccaacaucuuugauaguaacgugccuucaaacaagagcaauuucagucggggagaugagaggaggcaugaagcugcagugccaccacuugccauuccuagcgcgagaccugaaaaaagagauuccagaguuucuacaaguucgcaggagucaaaaaccacaaaugucagguaagagucugguguagaccugcugggggcagauggcucuguguaugugacauuuauauuaguuuuuauaucuuucaguuugcuguucucagcaauuuuuagaaacaaugaagugaucgugaguaguuuuuugaauaaaauaauggauaagaucuaaguaugauuaucuuuuaucacaaauuuaguaaaucaaaguugaaagaaagugcaauuucaaagcaguuuugaauggaauauguaaagggaguauccucaguuuuuucauugaaauuuuucaaguaaacauucuuuaaagauuuggugauaauugcccuaauuuggcuguaauacauuuuguuguucuuuuaaauagacagacuuacgaugauggagcugcaacccgacuaaugucaacagugaaaccuuugagggagccagcacccucugaagaugugauugauauuaagccagaaccagaugaucucauugacgaagaccucaacuuugugcaggagaaucccuuaucucagaaaaaaccuacagugacacuuacauaugguucuucucgcccuucuauugaaauuuaucgaccaccugcaaguagaaaugcagauagugguguucauuuaaacagguugcaauuucaacagcagcagaauaguauucaugcugccaagcagcuugauaugcagaguaguuggguauaugaaacaggacguuugugugaaccagaggugcuuaacagcuuagaagaaacguauaguccguucuuuagaaacaacucggagaaaaugaguauggagguuuguauguacuuuuaaauucuggcuuaggcuaaaaaucggcaguucuugauaccaaauaauauaugaaguaacuaaacacauauuccaaggcugggcacaguggcucacaccuguaaucccaggacuuugggaggccgaggcggguggaucacgaggucaggagauugagaccauccuggcuaacacggugaaaccccgucucuacuaaaaauacaaaaaauuagccaggcaugguggcaggcgccuguagucccagcuacucgggaggcugaggcaggagaauggcgugaaccugggaggcggagcuugcacugagccaagaucgugccacugcacuccagccugggcaacagagcgagacuccgucucaaccaaaaaagaaaaaacaaaaaacaaaaaaaacacauauuccaaauuuauuuuauuuuauuuuacuuuuugagaaggaguuucacucuuguugcccaggcuggagugugauggcgcgaucucaacucacugcaaccuccaccuccuggguucaagcgauucuccugcuucagccucccgaguagcugguauuacccgccaccaugccuggcuaauuuuuuguauuuuuagcaaagacaggguuucaccguguuggccaggcuggucuugaaauccuggcccugugauccacccaccuugaucuuggcucacugcaaccugugcuucccagguucaagugauucuucugauucagccuccugaauagcugggauuacagguguguacuaccacgaccagcuaauuuuuguauuuuuaguagagaugguguuucaccauguuggaccaggcuggucuugaacuccugaccucaggugaucugcccuccuuggccucccaaaguguugggauuacaggcauguaccauggcgccuggccccaaguuuauuuuuaaauuguuuuaucugcuguuucucaugcuauaccagauuuucuuccccauggcuugcuccuagaguucuuuuguaucacaucuguauaccuuuuugggauuuccagcauuugagauauuaaucuuaaauuaauuugggggguuucaaucaauuuuagauuguucaugguaauugcuagugagcaaccaauuaacucuguuuuauuaguuuccucaauagcacuauaugcagcuguugauaaaauaaauguaaaguucuaauuuuuguuuuagcuaaagguugacuguuagggauaauauuuauauuuauaguauuuauuuauuuauuuauuuugauacggugucucacucugucgcccaggcuggagugcaguggcaugaucuuggcucccuacauccuccaccucccggguucaagugagucuucugccucagccucccgaguagcucggacuacaggcacaugccgccacgcucagcuaauuuuuguauuuuuauagagacaggguuucaccauauuggccaggcuggucucgaaauccugaccuugugauccgcccacuucggccuuccaaagugcuaggauuacagaugugagccaccacacccagccucauauuuauauuuuuacauaaaaccaagaaauacucugugaauuucucauauuacuguguacuguuuuuuucuuaaaauggaaacauuuugugguagaacucuuguuauuuucugagauuagguaagcauaaauuuuaucugauugcaggaugaaaacuuucggaagagaaaguugccugugguaaguucaguuguuaaaguaaaaaaauucaaucaugauggagaagaggaggaagaagaugaugauuacgggucucgaacaggaagcaucuccagcagugugucugugccugcaaagccugaaaggagguaccuugaacauggcuguaaauuaaucuuuaacugccuugguggagucuuccugauuuauugaagagaauaaucacgaaaauaauuuuuguuuguuuuuugagacggagucucgcucugucaaccaggcuggagugcagugccacgaucucggcucacugcaaccucugccucccagguucaagugauucuccugauugagccuccugaauagcugggauuauaggugugcacuaccaugaccagcuaauuuuuguauuuuuaguagagaugguguuucaccauguuggaccaggcuggucucgaacuccugaccucaggugaucugcccuccucagcuucccaaaguguugggauuacaggcaugagccaccgcaccugacauaaauauuuaauguaauaccguguaagacuuuuccauuggguuuugagaaacacguuaaugagagaaauugcuuaacauuggagaggauugcagagaauauugacuaauaugguggggugaggaggaacaacaucaauuaagauucagauuuauuauuuaaaaaaacuaaaaggggccuaggcaugguggcucaugccuguaccuagcacuuugggaggcugaggcaggaggauugcuugagaccaggaguucgagaccagccugggcgauguaaugagucuuugucucuuaaaaaaaauuaaaauaaauuaguuggucauuguggcaggcaccuguaguccuggacuggagagguggauguggaagcauugcuugagccuagaaguuuaaggcugcagugacaucacacuccauccugggugagagaguaagagucugucuaaaaaaaaaaauaagguuccaguguaguuggcauuuucuaaaaacugcagcuagucuguuuaaaaccuagagaagguugugguaaaggcauaauagauggcuggccugugaggaacugaaauuuaaaguuuaauaaaaauaccuuucuuaacucuuuuagaccuucucuuccaccuucuaaacaagcuaacaagaaucugauuuugaaggcuauaucugaagcucaagaauccguaacaaaaacaacuaacuacucuacagguaauuuaaauguauuauguuuacacuugguaagacauuucuguaauucuugaguaaggugaaaaugauugcuccuuaaauuguaaaauaaaggugccugucagaugucaagaccaagaugagguucccauauagaaaaauggcuuuaaaaggaaauugacaaguuugagaaacuucgccaacuguuauuggacuguaguuuuucaagcaccauauaaugccuuuuauaucuuuccaauguguguaaaauauauaguacguaaauauuuugaagagaauuuugaugaaguaggacuuucauauuaguagcauuagauucaacauuagauaugaauuuacgauguguaaaggggaguacaauuggacaaugauagguaucugaaguuauagaaauuuguuaaacaguaguauauaaacaagguugguuucuucccuuuuggcggaacucauuaguagaauauaaggcagagaauugacucauuugugauguuccugcuccaauucuaguggaaguacugaauaauuuuaugagagaauauaaaaguauuacguuuucaaaacaggagaugaaucagcuguaagcuggucuuacggaaagcugauucugaaaugcaaacaacugaugggugucauuuuguguugucaaauucuguacucucuggccgaccuguuguagccaauguguaaacuuguguuaagaagcugaugguaaugagcuacucuaaaaagauuuaaguuuugcuguggauuugguggguguacuuacagcauugcccugcuuauccacucucucgcuuuuuuuugugaccccccuuccuaaaaugagguaaacuguagccaucaguuuuuuuauuuguuuucuuuuuuugaggcgaagucuugcucuguugcccaggcuggagugcaguggugugaucuuggcuuacugcaaucucugccuccuggguccaagcgauucuccugccucagccucccaaguagcugggauuacaggcgcccacuaccaugccaggcuaauuuuuuuguauuuuuaguagaggcgggguuccaccauguuggccaggcuggucucguacuccugaccucaggugaucaccugccuccucggccucccaaaaugcugggauuacaagcgugagccaccgcgccuggcaccaucaguuuuugauccugauacuugucuguccucuugguucuccucaucccuaauuuaaccuugaacacaaaauucaacagguuuuggcauauagaauaaagauuaucaggcaaaggcgcacucuugaccuaaugauauaucuacauuucauuuccugaucuaucagcaauauuaauugucuagaaugaugagaaguuuagagaaguuccaugacuuugaaauuuucuuucuuuaccuagguuaucuaaauuacaauuugaaacucauauaagaucaugaagcuaagcuuaaauaaaccgcauuuuguugaaaaugaauacauauguacuauauuguauucaugguaugugguuguauggauauuguuuacauauguuuggauaaauagguucagguaucuaucucaguaacguaagaaaaaaugaaugguaucuauggauugaacuccucauauauauguucuuuucuuuucuuuuucuuuuuuuuuuggagacagagucucacucuguugcccaggcuggagugcacaguggugcaaucucggcucacugcaaccuccgccuuccggguuuaagcaauucuccugccucagccuccugaguaguugggauuacaggugugugccacuaugcccggcuaguguuuguauuuuuaguagaaacgagguuuuaccauguuggccaggcuggucucaaacuccugaccucaagugauccacccaccuugccucccaaagugcugagauuacaggcaugagccacugcgcccagccugaacucauauguccuaaaccaaaggaggcauuuauauuuaauaugacauagucacuguggaguuuugacguauuacugcauuuguauuucuaucuuuuuugcuuuuaugugaaaguuccacagaaacagacacuuccaguugcucccagaacucgaacuucucaagaagaauugcuagcagaagugguccagggacaaaguaggacccccagaauaaguccccccauuaaagaagaggaaacaaaaggagauucuguagaaaaaaaucaagguaauaacuuaaaugauguuucacucuuuacuacaguuuuuucaugaggcauugaauauuuuccaauggauuuuuaugaaauauuacacuaugaaaaaagugaugauuaagcccagaaauagaaugagaagaauaccaugaggaagguucauaccaacacuucagaaaaaaauuuuuuuuuuaaagagguagggucuugcuguguugcccaggcaguccucaaacuccugggcucaagcaguccuccugccucagcauccuuaguagcuggagguguguacaagugugugccacugcacccagcccuuucuagaaauuuuugaaagucuuuuuauuguggaaauuuuuaauauucucaaaaauggaaaggcuaguacagugaacucucaugaacccagucauuaagccuuaguuauuaucagaauuuugcuggucuuuagauagcuccuucuuaaagauauauuuauuucugcauucuuucuuuuucucuuuuuguugauccugcccguuuaccugaacuugaaauuuuaguuaccuuuaaaucucccgucucuuaagcauccugucucugaccucccauaugugucccagcaacccuaauuuauccccucgugccuaacauacuucaguuugcuuccagguuuuuuuuuuuuuuuuuuuuuuuugcuuuuuucucagcuuucucccccaauuccuauacaaucuuuugacuuugaaagugugucucucaucuucugacuccuuugugaaaguaucucuccccuccuccucauuacccagaacuaacgcuauuaguuuggacuuuuggugucuguuaucugaccccugggccugcacagcccuucuccaugacucuucagaccuuuugucucuuuugucgucaagaaggauucuuuuuucuucuguuucuuuuucuacuaagauuugaauuuuaagaccccaccaaaaaaaucuauaugcuuauuauguuauuucucacauacuuuucaagaaccuuggaauauauuuuuucauuucuucaaaacuguccuuuaaauuguuccagguuucaugaaaccuuaugauuucagaauugucaauucuguauuuguuuccucauugugucucuuuaaaaauuuuugacuguauuguucaguuugccaugacagcguuauauacuauucugauaauugauaggccugaggacaagaccuguuugguccccaaacagcagauagguaccaauuggaaaaugugaaugggccaaauugagaagaggagcugaaacugaggagggauuuugcucagugcaguggcagaugaggcugaucuaaaaggacugcaguggucuacucccuguggagucuguaguguguugcaccaagguuuucuucaaacacaggacucuacgugagagucuuggaguggaaucagauggagcagggaaacagacaauagagaaaaggaaagaaugucagauaaaaauaggagaggaaaacaauaggaaaucucaaagcaaggugccauauuuuuuaacaucacaaaaucaacagaagaagguuguugauucugaaguuagaauagcuauccaaagcaaacuuuccccuaaaaugaacaacagaaaaguaucaaggucaaguccugugccgaauuaaaagauaaaagggaauaaaagacaaaacagcauuguuucaaugaaagcaugcugaaagguauaccaaaaagaaauacaauuucaaagugagcuagaagacauuauuuaaauaauacaagacaaagccaagaaaaacauaaaacagaagaacuuugaggcugggugcaguggcucaugccuguaaucccaacacuuugggaggcugaggcaggaggaucacuugagacuagccugggcagcauagcaaaacccugucucgacaaaaaauaaaaauauuagcugggcaagguauacaccuguaguccugucuccuugggaggcugaagugggaggauugcuggagcccgggaggcugaggugggaggauugcuggagcccaggaggcugagguugcagugagccacgaucauaccauugcccuccagggaggcugaggugggaggauugcuggagcccaggaggcugagguugcagugagccaugaucaugccauugccaucuaguuugggcgauagagugagacugugucucaaaauaaaugaagacuaaauuagaaagaacucgaaagaauuagugcgucuuaauaaaauaaaacaugcguguaaucccagcaauuugggaggccaaggcgggaggaucacuugaggccaggaguugaagaucagccagggcaacauagcaaaaccuuauggcuacagaaaacagcaauuuaaaaauaaauaaaauuaaaacaucuucagagaaauugaagauaaaagacaagaacauuuuaaaagucuaaaagggcucaugagaaaguggcaaauauugauaauaggcaauagaaauacaguguuuuuauaguaggaaucuccaaagaaacaauauucagaggaacagagcaaacauuaacugucuuucaagaaaacuuucaugaagugaaaacauguuugaaacuguugucugaaaaauuguacaguauaccugagaauauuuacccagaaccauaacacuaagauguauuauauaauuaaugaaauuuuaaaaagaaaaaaaaugauuuggacauucaggcaaaaggggcacaugacuuagaagaaaaggaaagguagauuaucaucaaacuuuucaacagcaucacuuuugugcuggaagaaaauggacuagcauauuuaagauacuccagaaaagaaaaugugagccaagaauuuaauguccagcaaaagugaccuuuagaagugauccagcaccaacuguuaucuauaugcagaaauucagagacucauucccaugaacuuuucuuaggaaaucuaauggaggaugagcuucagacaaguaaaagccuguuguccugaauuuacauuggaaauguuucggaacucacaguguauuuuauauauaaauacauuuuuuucuaguucugucuacuagaaggcauagaaacauucaucaacccuuagcaucaucuguaguucccagauuguggucuuggaauacuuccuauuuaaaaaacuaggcuucuugggcugggugcaguugcucacgccuguaaucccagcacuuugggaagccgaggugggcagaucaccugaggucaggaguucaaaagcagccuggccaguguggugaaaccccaucucuacuaaaaauacaaaaaaauuagcuggguguuguggugugcgccuguaguccuagcuacucgggaggcugagccaggagaaucgcuuggauccgggaggcggagguugcagugagccaagauugugccaccguacuccagccugggcaacagagugagauuccgucucaagaaaaaauaaaaauaaaaaaacaaagaacuaggcuucuugagaaaugucuuuuuccaggucuggggcaggaaauguuaacaugauccuggaauggcucaacaucccagauagcaaagaagcugucaaugaaugguagaccacguccaaaggaugcaggcgccaacuuagagguuuccauuggccaaaaauggaauuauuugagauucaguagguguaaauaucgcggugaauuaaagcccauuuaaauccacaauuucauaaugacauuuuaaaaaaauaagcucuaacuagucaccuucuggaagguaguagauaaucauucauugucuugaaaacuggguaaauaaaauaauugaacauuuaugcugucuuuucugugagaacgauaccacuggguaaccccauaggacaggaguuggcaucuguuggaaccaaaccgugccuauucauguauguauuguccguggcuacuuucauacuacagccuuaguugaauaguugcaacagaccauauagcuugcauagccuaaaauagccuaaaagauuugccaaccucugauauaguagaugagagaaacauuuucuuuuaaaaugauuucagcugauaagagaacaagaugguaggauuagaguuaugcuuuuaagagugaaaaccaguuguuuugugccucuugauacaaaagaacagaacuuuugucuugccaaaaauguaaaccuaagucaucaagcucccaguccagcagucaguuugcaagaaguugcagaggccagaggaguauguugguugagcuucaccaugagugugcagccggaaaaauaguguuugggacacuguggguugaauagccugagaaauugagauuaaaaggcaaaucaaaggaaaauaaaaggagcaggauuaaauuguaguggcuagggauacccagugugugugaaauuauaaagaaccucuaggcguuaauauaaaaagcacauagugguugcuuuugaagaggaccgauaaagauggagcacacagagaggcuucugggguggcagaugacguucucucuuuugacuuggaugguagucagaaggguguuuugccuuacaaaaauucauuaagcuauauguuugugugguuuucuauacuguguuuuaaaaggggauaauugaaauggugucagguaccuuugcugaugaggaguuugguauuacuagauauauucacaagugugaagugauacugcaagcaacuguuaucuguuaaugugguuacucacuguuguacgguauaaucuggggcagguuuuuaaaauauaaacaugcacucguauuggcauaaguuguuaauuuuuuuucuucuuuuguuugagcagauagcauucucucauuucucuggugucuuuauuuuuacuagcgcacccaccucauaauauguguacuuuuugcuuuuugucuugccaucagucugucacuagaaguuuauuuugccgaucuuuucaaagacuuaacaacauuauucuggcuuuauugauuuuuuuuuuuuuuugguguuuuuguuuucuauuucauugacuugugcuuuuuuuuuauuuuuuuuuuuuaagaggcgaggucucacugucaccuaggcuagaguacaguggcacaauuguagcucacugcaaccucaaaugccugggcucaaaugauccucccaccucagggaccauaggcacacgccaccacgcccagcuaauguuuaaguuuuuuuguaaagauggagucucacuauguugcccaggcuggucuggaacuccugagcucaagcagcccucuugccucagccucccaaagugcuagguuuacaggugugagccacugcaccuggcccgacuucucuuuuaauuuauccuuccauauuuuaaaaauuauuuaccucaggcugucuucuucucaaauguaagcauuugagaagaauacauaugacagguuuuaauucaucauguuuucauuaucagagugucuuuaauuuccauuauaauuuucaucauugaaaguguguuuucuauacaguauuuggaagugguauguguuuuugucuuuuaauccuuuuuauuauagacaccugacuuaauugcauugugguuagauaauguaauuuuuacaaugcauaguuuuugaaaauuguuaacacuugcuuagugcauaaucaaguuuaugcaucuuccacaugcauuuuggaagaaaguggacuaauuauuggauggggaauuuuacauuuauucaguagauaaagcucuacuguuaacauuauucaaaucuugaccuugcugaguuuuugugcugcuugacuuaccacuugagaaaggguguugaaauugcccaacaugaugacagauuuaucuuaauuucucuuguacuuauaucaaguuuuugcuuuauuuuuaggcuguuauauacuauuaggugcauacauauuuaaauuuguuauaucuucucugcaaauugaaucccuuaucuugauuuaugacccucugcaaaaaagauguuuuuaucucaaagucaguuuugccugauauuaauauagccauuuaauuauauuugcuuuauauaucugguuucccugccuuuguuuucaguuuucucucucaugcuuuagguauauacaguugacccuugaaccagacaaguuugaacuguguggguccacucauacacuuauauguggauuuuugaaaauaaauauauuggaaauauuuuuugagauguggcaauuugaaaaaacuuguagauaaacuauauagccuagaaauagugacaaaauuaagaaaaauuuagguaugucaugaacacauaaaauauauguagcuacuagacuaacauuuacuaucuuaaaacauacacaucuauuaugaaguuuaauuuaucaaaauauaugcacacaaacacagacuuuacaugauaccgcuuguaguugagagaaauguaagcaaacauaaagaugcaguaauagcuacauaagauuuacuauaguacauacuguacuacuguaauaauuuuguaguuaccuccuguugcuuuaugguaagcuaagguguuuugaguguccacuuaaaaugcugugugaugcaaccaucucugcgacaguucagcucuccaguaaauugugaauugcagugaaaggugaucucgcaguucuugcauauuuuucaucauguuuagugcaauacuguaaaccuugaauaacaccaggggacccauaaugugcuacuggugaugcuggacaugcucccaagaaguagagaaaagucaugacauuacaagaaaccauugcucaguauguaccaaagauacauguuacaacuguggcugcaguuauucaccauuucuggauaaaugaauuuaacauaagaaccaugguuaaaaaaaaaagaaaaagaaaaaaauguaugaagcugccacugcagcuacguuggcaacaguaaguaguuaaauguuugggaagucaaaaguuguauguggguuuucaacuguuguugggggauugguucccuuagcccucauauuguuuaagggucaacuauauauuauaucuuaaauauuauaaagcuggauuuuguuuuuuaaucucaucugaguuugccuuuuauuggagaguuuagaccagucacauuuauuacaauuacugguauaguuggauuacuuucugucaucauugcugauuugcauuugccugcuuuucuguuuuuucucauguuuuuuaagguucauuaauuacuguuauuguugacaacccuaacccugguucuacaauuuuaaacuaguuuacuguuuaaaccuucccuuucuguucuuuuuuuuuuuuuuugagacggagucucacuuuguugccaggcuggaguguaguagcgcgaucucggcucaccgcaaccuccgacuccuugguucaagugauucuccugccucagccucccaaguagcugggauuauagacgcccaccacuacgcccagcuaauuuuuguauuuuuaauagagacgagguuucaccauauuggccaggauggucucaaucucuugaucucugauccccugaccuuguuaucugcccgcuucagccucccaaaguguugggauuauaggugugagccaccaugcuuggccucauuucuguucuuuuagucguuaccagugaaauuuuaccacacaaauuuaauuuaguauucuaaaaguuaauauccugaccccacucucaaacaguaaaaggacuuuugaauaccuaugaagagcuucagucuuuauccuccucauuuacuuguuuccaguguuucaauuugaucuuuuuuaaaaugcacaaguugggccgggugcgguggcucaugccuguaaucccagcacuuugggaggcugaggcggguggaucaccugaggucaggaguucgagaccagccugaccauauggugaaacccugucucuacuaaaaauagaaaaauuagccaggcaugguggcacacaccuguagucccagcuacucaggaggcugaggcagaagaaucgcuugaacccaggaggcagagguugcagugggcugagauugcgccgcugcacuccagccugagcgacaaagcgacacuccuuaucaaaaaaaauaaguaaaauaaaauacacaaguuggacaacauuuuuguaauuuuuuccaggcaauguuuuuugagguuuaccuccuguuuaucauuuuacuuauucuuaacaucucugaguguuauuuggggaucauuauuuuccaauauuuugaaguauuuuugaaguauuuuuuuggaaguuucacugaaacaugucuguuggcaauauauuuuccaagagucuauucaccugugaguguuuucuuucuuuguguucuugugcaguaguuuugcuggauacccaaaucuagguuguuaguuauuugcucuccacaccuuauauauauuauuaucccacugucuucugcuuuccauuguugaguggacuucuaucauucuaauugucugucguuccuuuguaggugaucuguccuuucucucuggcugcuuucaagaucuucucuuuguguuugauguucugcaguuucacuacgaugugucuaggcguggauuuccuuuuauuuuuccuguuugguauaauguauggaagcaucccauauauuugaaauaaaaugcauuaugaaauacaugcucaccauagaaaaucuggaaaaagaaagcauaucaauguaauaucuccugauagaugagaaaauaaucaaauaguauaaaaaagauuaaaaauaaaaagcaacauuccuuacuucauucuucucuauacuagucccacuccgcagaaucccccacuuuuaaaugcuucuguuucuuucuccguguuguaauaauaugcuuuauacuguuucuucauugaccaacuagauaguaccuguugauuucuugcuguaugucagguucuagcccauuuauacuuuucccuugcuuccaagcucauacagcaaaaucaauuuuuaauucauuuauugguuacuuuaguaauuuuaaguaguaacuuaaauauuucuugucugguuauauuucaguauauuuugacuucugaaagauauguauccuucaauuccuuuuuuuuuuuggagguagagucucacuuuugucacccaggcuggagugcaguggcguaauccuggcucacugcaaccucugccuccuggguuuaagugauucuccugccucagccuccuuaguagcuugggacuacaggcacacccugccacaccuggaauuuuuaauaaaauuuuuaguagagacagggucucaccaucaugcccaggcuggucucaaacuccugagcucaggcagucugcccaccuuguccucccaaagugcugggauuacaggcauaagccaccaugccaggccucucuuucaagucuuauauuuucuuucuugccgccaccuacauucuguccugccuccaccuucuaaauugucaccuguucuuuuauauugucaaagcugaucaaauuuacauuuuguucccuacuuuaguuaagacuuagucgauugacucuaaguugagaaacaguaagcauuuacacuguuaagacuauuuagucugggcaugguugguggcucacaccuguaaucccagcacuuuaggaggcugaggugggagauuugcuugagccuaggaauuugaggccagcgugggcaacauagcgagacccucaucuauauauauauuuuaauguuuuuuaauuagcugggugugaugaugugcaccuauagucauggcuacucuggagaauugcuugagcccaggaguucgagguuacagugagcugugauugugccagccugggugacagaccaagacccugucucuaaaaauaaaaaaaaaauuuuaaagacuauauaaauauuacaaggccaaauuuacauucuguuucuuguacaguuuugugugggaacucucuagaguuuuuuuaauuuuucccccuuuuuuguuucccuuagguucuucuuuuuucccuucuuucauugccuaccuguacuguagccuaaaagucuuaucacucugugcuuugaaaucuuuggguuucccacuuuuucuuagguaccuuccuccuggagccucucuccuccuuuucugaccucacugcuugcucuaggccugcucaaggccaucaucccgaggcgcccuccuccccugagucggcucugcaauuccugaauuccauuuugucuucucagugcauuucuccguuuuguaaucacgucacaaagaaacuccuuaagaaaguauagaagguaaauuuucugaguucuuggaaaucugaagcuauccuuguacuuguuugauacuuugacuagguacagaauuauagguugaagucauuuucuucagaacuuugaaggcauaguuucauuaucuugaggcuucaguguugaugcugagaacuugguugcccaucuuauuccauuguguaauaccugggauuuuuuucuccgggaacuuuuuuuuuucuauguuccuggugucugaaauuucacugugguaugucuagaugcuaguuagguacauuagguacccuuuuaauuugaaaauucauucucuuccgugugggaaauacucuugcauuauuuguuuuaaaauuugcuguccuuguuuucauuguucucugguggaaauucuguuaguuggaugauaagcccuuacuuuaaucugucaguuguauauuuuuucucucuugauuuuugacuugaucuuguuggucuacucuugaauacuugcuugacuugaucuuuagucuccuuacugaacauuuuaaaaauguaggcaagcauauuuuuuaauuuccacaaacuuuuucuuguucuauuuuucauaguaucuuacuuuguggauacagaaucaucucaacugucugaagauccuaauuaaagggauuuuuuuuuucuuuucaaggaauucacucuugucuucuaauuaauggagucagagucagauuuuaugcuuuuuuucuugcucuuucgauuauggaauuuuuuucaaaaacaucugcagauagugguuccuaguuuaaggaaagguagugcagaggcuuaccuagaauugugcugugggcugagcuuuucugcaggcagguuuagcuuucaaugaagcagacaaggagcugcaauuggccuugcaguuguagaggaauuucuugggggagcagguugguaugcuuacacuccuacugguugucuauuaaaaauauuaaaauuuugucuuuuaaaugucugucucuggcaguaccauucacaagccuucuucucugccuuacauccuucuugguuuuuacucauugcugcaaucucucacaguuggauggcccuuuguuucauccaaauucaaggcuugauauaucaucucugcacugugacucucacauuuuuauaucuccagccuggaccuugcccugaauuccucauuucuguccaaccacuuuauauuucuucuuggagguguaauaaaucauuucaaacuuguccaaagcucaacuaugaauuuuccucuccugucuguucuuccuguagucuuccucauuuuaguuuauuggugacuucaccuuuccaguuucugagacagaauccuguugccauucuuuuuuucucuccuucuccuuuccuuccucuucccucucuaccucugucucccuccuucccuuguuccaccugucagccucuaccuccagauuuauagaauucacuaccguuuaucacuucugccucuaccacccaucaaagucacugucuggccgggugcgguggcucaugccuguaaucccagcacuuugggaggccgaggcggguggaucauaugaggcuaggaguucgagaccugccuggccggcauagugaaaccccgucucuacuaaaaauacaaauauuagcugggcaugauggcacaugccuguagucccagcuacucaggaggcugagguacgagaauugguugaaccugggaggcggagguuacggugagccgagaucaugccacugcacucuagccuuggugacacagugacacucugucuccaaaaaaaaaaaggcaaaaaaaagucaccgucugugauuugccuugguuacuugauuauuggaauaguguguucuuacaaggugugccugcuuucaaacuugccuuccuucaguccaucccacacagcagcagcagugauccuuuacacuguaaauuagaucaugcuacuuugcagcuuagaaccccccaggggcucccugucacacuguaagucacaguguucugccuucucaucacccaccugccucccucugcucuggcuccccgugcuugcugcugcuccugcacacuggccugcuuguccuucaggacguuggaagagcugcgcgucucagaugcuuuugcccucuccugagaauguuuacuuuggauguucucauaucucauccaugugucaucuuugaggccuucucuggccccauccccacacucccucuuuucugaagcuuuauuuuuccccauaacguuugucaccaucaaauacauauuuuauguuuuuguaguuuagguauuuuuauccgaacguaggucuuuauguuuuaacgugaauuguuuucuuuuagcauguauuuuuuugggggucuugagagcuaccuccuuccccgucucaacagagucuguccuuuuugagcagggauuuauguguuuguucuguauggcuguuacugagugcccagagcagugucuggcauauaguagcaggagcucagucaguguuuguugucugaguaaaugucacuccugccuugcaucuaaccugcaguuuucacaggggcucauuugugguuuugccugcugugccuuacagccaguauuuguccauauauuuucuauuacccagagauuguugacaucucaucugcugcaccuuguaacccccaucucuaaaccagugaucuccaucauauuuuugaccugaaaauuuuuguacaguagccauuuuuaaguauguauaccaauauauguauuuuacuuacguacacaugcuguauugauaugaauauuagaaaacauaagaauagaaaucugccgggcuugguggcucacgccuguaaucccagcaauuugagaggcugagacgggcagaucauuaggucaggaguucgagaccagccuggccaacauggugaaccgccgucucuacuaaaaauacaaaaauuagccggguguggugaugggugccuguaaucccagcuacuugggaagcugaggcaggagaauugcuugaaccugggaggcggagguugcagugagccaagauugcgccacuccacuguagccugagcgacagggugagacuccaucucggaaaauaaaauaaaaaaagaacagaaacccaaagaucauaggguagagauguagauauuaaguucuuuaauucacuuuuauggacucuucagaaggagagauuauaauuguauaugcuugauacauuguguuggacuggaagcacugugaaagauucuuagucaaggggagauuuuacauucaaagaaaauggaaaaucccccugcuuugcucggagggaagaacugcacuuaaaaguuugauguguauuggugucgucuucuaggcauuucuuauaucugugaacaugugcacccuuuguauauaaaguggaauuacauguuuacuuacgcacacacacacauguacauauaaagcaggaauuauacuacccagaguucucugugacauuuuuguuccacuuaauguaucaugggagaguccuugaguguggaccuaggagccagacuaccgaaggugcagacccugcaguuuacuaguugauuuaaccuuucuguacccuaguuuccuaaucuauaaaugaagaauaacgguagcauuuacuucagaguucuugguaggaguaaauguuaaaauacauaagcuuucucugcugaugaauauuuacacuggagucuuaggaaggguccuugcuuauuuucuauucuaaaguugggcuggacauagugggccauaugggugccaucagaugggcucuuguuucucugugacccguucuguuagaccucuuuccugcuuuuuuccuugagguuguuuaucuguccucuagugaaccagcugguuugcagguggugcuuuucugagagugucuugcuguuaacaguuacuauggaugucauaugccagcugguucuguuaaaaaaaagucugugaauccaaagccuugaauuuugaacauuauuuucugucuggaauuuugaagaacugauucauaaaguggagaaaugaauaaagauuuuuauuuuacaaauuccagcacuuagcauuuucuuuauucuguuacugugacaucuauuugggaaaccaaagacuaccauucuuuauaaggauuccuuuuuuuuuuuuuuuuuuuuuuuuuuugagacagauucucacucugucacccaggcugcagugcaguggcgcagucucacucaccgcagccucugccuucccagguucaggugauucucaugccucagccucccgaguagcuggaauuacaggcauaugccaccacgccuggcuaauuuuuguauuuuuaguggagacaggguuuugccauguuggccaggcuggucuugaacuccugaccucaagugauccaccugccuuggccucccaaagugcuggaaugacaggugugggccucugugccaggccaggauucuucuuuuaagagacuauagugagcagcaucuaccaacuugcauccuuguauguugcauaucuuauuuguuugcuuggggaguaaaccaaaguaaaaacguccuuugucaaauuaaggaccuuacaagauuuucuguguuaauggauuggaagucuuuacuauucuuuuuuuuuuuuuuugagauggagucucccucugucgccuaggcuggagugcaguggcacgaucucugcuuauucagucucugccucccggguucaagcgauucuccugccucagccuccugaguagcugggauaacaggcgugcgccaccacaccuggcugauuuuuguauuuuuagcagagacgggauuucgccacauuggucaggcuggucucgaacuccugaccucauaauccacccaccuuggccucccaaaaugcugggauuacaggcaugagucaccacgcccagccuagaugucuuuacuauucuuaagauggcaguaguccccaaguugaucuauggauucaacucaaucccuguuuaaaccccaaauugcuuuuuuuuguagaaaucggcaggcugauccuaaaauucauauggaaauaaaaagggacugagaauagccaaaacuauugaaaaagaguaacguuggcaagguuauguugcuugauuucaaaacuuacuacaaagcuagaguaaugaagacugugugguacuggcauaaggaugaccauacagacccguggaccggaauugagaauccagaaauaaaugcauacuuucacaacccaucaauuuuuggcagcgguguuaagacaguuuauuggcaaaagaauagguuuuuccacaggugaugcugggacaacugaauauccacaugaaaagaaugaaguuggaaccuuaucuuaugucauaaacaaaaauaacucaaaauggaucaaaaaccuaaacuucaaaacucuuagggaaaaaaauagauaugucuuggauuccagaaugauuucuuaaauaugacaccaaaagcacaagcaaccaaaggaaaaaagauaacucggacuucaucaaaauuuaguauuuuuguguuucaaaagauacuaucaaaaaaaaaaaagacaacaaaaugggagagaauauuuaagaaacaccugucuaauaauggucuaguauuaagccaaggcugaguucuuauuuccccauccuuaaguuuacacgauacuauauuagugaaguugaauucugucauuaccacauguaucuugaaagaaguuuguguggaucacggguccaguuacuuucuccgcccuuucccuccagaggauuugucacucucaauaauguuauauacuaauuucaaggggaaauacaacucaaaacaaaucagaaaucugaagcuuaaaaauguuaugguuuagaugaugaaaagggaaaaguacauuuaauucauaucauauuuagauguaaagcacuuaauguuauauugcuuaaccuauaaaguagcgcuucagugcucucaucauaugaaguaaauaauagaaaauucuuugugugacacaugucuguuuucagccaaucagaaaccaggauuauuuuguauguaauaauaggguuuacuggaagaggagcuauacagaugguacuuagaggauguagggcccuacguauuagggcuucuuaguuguagcgaagagcaauuggucugguacguuuagcuuuuucacauuuaguuuugaauucugacucuagaaauguacaaccccaucuuuugaauuacagguuuuaagauguuauuugcucuuaauacgucuuaagguaacagccuugaucacugcuuuuacuuucgaugaaauaacuuaaugagcugugaagaaaaaauuaucagauuuuaagggagagaauuuuaugaaaaugucuuugagguuccugucaccuuuaugagaaugucuucaaaguuuccaucaccaccucuaccaauuuuucuuccaccggagccaguggacuuagguuccauaacaagcuccucuuguucacugaaugagcuagacaauauuucccaccuuuuaaggaaaauaucagcugauaucaaugaaauuaaaggaaugaaagcagcuauuuugacaguggaagcaaaucuuuuugaucuaaauguuagaguguccaagaaugaagcaaaaauuucaucuuuggagguuaaaaugaaugaauauucaacaacauaugaaugcaacagacaguuugaagaucaagaagaagauacugaaucacagucaagaacuacugauguaaaaauaaucggcuuccuuagaaacguugagaaagguaaacucuuaauauaugauauguucuagguacccauccuuugaucuguaucuuuccacguauguugacuguagcucugauguggagggagcaaguuacagagaacuugaauuuuucauggaccuuuaaugacaaauuuggauucugcuugauuuagcuuagcaaucuagaauugaucagaauuccauccucuuuaauggagcucucuaaaacgauguuuugaaaagacagaugaaccuagagcaaugaagcaaaacuugaaauguggaaguguggucuuucaugugucuugugaaauuauuuuaaaaugucucauucuuucaucauguacuguugaugugaaggagaccuguugcaguauuuggauggaaagagcauucuuccuguaacuuuucaccucaguuuuccaagcuucccacaggaaugcaacuugaccuaagugucaucuucguuacaguuccucagaauguguguuuuuuuaugguaauaauucuggaaggaauugacuuuuuugggacgcaccaguaaaauuucauauaacuuauguuuuaaaggaaacuaacugauacaauuucaaaucgaguauagguuuuaaaauuuaaaaacaccuuuuaaugaaauguggugcuuggugggagauggcccacuuaacaucuuugcacugaguaagcaaagccuguccuugugaagccaccuguaauggauauacccaaaaucagcaugugggcaucuuaguaagauuucaguauuugcaacccuaucaguuacaucccuuuguacacuguagugcaguaccuuauaaugagcaagugagugccugaugucugcuaagcgcugugggggcuacagaaaagugugacauucucccauccucaaggagcuuaacaucaaaucgaggauggaaaaaaaucaguucuuugucccuauuuugugcagucagacugcugggcauauuauuguuaggaauagugaaccuaauaggaauuaauguuaggagccuauuuuagaagaaauaaguaguugaacaucuuuucuuguggaagaggcaaagaauuauuaucaugcuuugcuaacauaggguguggauuguagagcugagugucuuauuguuuucuuugcaugcaucgaagcccagaguuugucuuuuaggaacucuuguuuagaugaugagaguguuuuguuuugcuauuucgauuaucuucaaaggucaugaguuagucgugaugguaagagcucaggugauggagggaggugcuugccaugcuuauugugcaguuggcuguuaugcgagcugcugggccacaaggugccuuuuccuggauuuuccacccguuugccaccuuuacuuuccccgcagaauucaaauucaggaaaacugauguccucauagagggagaaccaggaguguuuuaaauuggcauuugugguuuaacccugaguacagccuuuuuugucuuacaggauaugucuuuggucuauaaauacuauuaaauugaauuguugaagcuuuaaguuacuuuuaagacuucaaguuaagaacccagaaggauugauuuuugggaaccacaugcugguauugucuguguuguaagcuuagugaaguuuuaaaauuuauauucuaggaacucaacagaggcaauuauuaucccgacugcaaaucgacccaguaauggcagaaacucugcagaugagucaagguugguaauguuucaaguuguacuguaauccagccauuucaguugccauuuccauuucuuacaccccauuuaacguaucucggaucucuuagauccugcccuaagauguuauauuuagaucugugaaaauauuuuagggccaggagauaagaucugcauuucuuucauguuauauaguguuauaauuuuuugccucauuggaaaacuuuguuccuuucacaccauuccaagugugucccuagcacugucggcugucacucuccugcugucaggagugaccugcguuucugauuuacccucccacucuacccagcuuuugucauugccaugaguggcuuuuguauccuguuuuucaccugguuagccuuauccucuuguacuucauuuuggagucuuaucaccagggccacaccuggaacuuguuguucuaguguucuagagccacucuaguuugccugucuccuuuccucuccccacagacacacaugccaggggcuacuccaggacuggagcugacgccuucauuuuuauuaucucuguccucagugcccagccccugccagaugcauguucaaugucuuaaaaaugacugcaggauaaacacaggcaaccaugagagacccggaaucaucucaguccuucuguuuccccuaagucugucuuuugugggaagcucuggucccuagaccccucucagucaggacuccacagucagucacucuguuccccgacccucccccagcuuuccagcucagaaagugugcuuuuccucccuaagggucagccuccaccagaggccagaucccacuggguuggugagccacuggcaugucacccacuccuccaacuucauucucugccuccugucuucucucuguagagguguucagacauucucugcccgugauuuugcucucucaucucccagcaguccguccugcuuccuccacaggaguauuugaaaagguugacagccgagaucugugugugggauccacuucaucagcucuugugcauguuuucucuucugccuccuucagcuuuucauuguacccauggugcacgcaguuugaaauagcaaguaguucugugaggcuuaugaaugacugcaguccuuagcuccuaucacauuuuuuauucuaagaucccuuuguuucugcauauucuauuaauuuucuaaaaacauacugauuuuguguacacaauacucuuuguuauuucucuguggucugaaaggugguuuugacauuuuuccccucccugcuucgucuuguuuucucuaaguggucuguuuuggcugucuuuuaugcuggagguuccccucugaugucuggggauccuagguggucuuacauuuaagaguggagcacucagaaggucacugguauucuggguucaugaguuggggcauggggcacuuugacuuucuguuugaaacuagacccugugguggaaagugauuuguccugccugucugguuugugggcacccugaugucacugccuucaagacuuuccucucaggcuggucagcuucuccaaaacaaaguuuuucaaguaauagccugguagucagaguucugcgagcuuaaguggggaaagaaggcugggggaggcaccucaccauuaauuauuauguaauguuuauuuaacccucccccaaccauugucaguccaguacuucuuucaucauggcuggugucucuugguccagggacucuguucuuauccucugaagagucuaaagcuccacuuucuccaagggagaaugcaugcaguggguaaagauuuaucaggaaaucuaauugccuuuaaaaauuuuuaacaguguaccuucaggugauuuugucguagcaucuuucuggcagagacccuaaugcuucauccauaggccucuccgaagauuaucuacaggaaagcacaucaccagucaucccaggugucuucaguguagaggucgggauugguguggcaagcaucaaaaccaagaaaacaguggccaggugcaguggcucacgcccauaaucccagcacuuggggaagccaaggcaggcagaucacuucaggucaggaguuccagaccagccuggccaacauggcgaaacccaaucucuacuaaaaaauacaaaaauuagccaggcgugguggugcacaucuguaaucccagcuacuaaggaggcugaggcaggagccuugcuugaacccaggaggcggagguugcagugagcugagcucgcaccacugcacuccagccugggugacagagcaagacugucucaaacaaagaaaacagauacauggaauuagaguugaagaagaacuaacugcuucuuggacacaucuaauacaccucuuuuuugccugccauuucuuccauuucuuccuaagguccuuuuacugccaguuccugagccuuuggagaaucuuguggucugaauuggauugcuucauuauugccuuagaauucagcuuuuacagauccccugaguucuuaaucaucuguuuuccacuuugaaaauuucuuuuuacacuuauuuucuuugugaguuuaugcuuucaaaacaaaaacaaaacccuuauugacauuucugugggcuuucaggagggaacaaaaaguaaaugcauggggucagccuguggucucuacucagaagauguuacuuacucccccgucugucuggucuccaugugaccugggcugcuaacguuccgcuugcagagaggugugcgggagggaccggugcacgcuuuccucaacccuggagcauguuacacuuggguucccauacuuucuccaagcuuugaccuuucggcuuccaguucacucugucuuuauucuucucauucccuuucauucucaugugucagcgcaucuccuccauuccuccucaaaagguuagcuuugcucucucccaccuucagcauuauuuucaucucuucuguguucacccaaccuaugaacugguagaacuccuucgucucagaaagugcagaguggugggaaggagugaagcagccccugggccacuguugggacccaccuuugacaguugugagaccucggugaaucauuuaauaacuuggagcugcaaacagucaucuguaacaugggaggaaaccgacuuuguaggcuuugagugaggauucagugagagacggccacccugaauauguuaaacacuucugucaccuucgguuuugacucagcaucuuauuucuguccccccaccuacaggucaaaucugaauuuucuacuuccucuuaaacaugggagagucccacaaagacuuuaaaucuaacauggaaauguaucuuugccccuuuuaacuuugcucuuuuucuuuugcuaaguuucucaucccagcuuucucuuccgccugucucccuuuaccaucuguacugcccuugcuggggaaggcgggcacgccccuucccaggauggagcaugucuucucuuccugucaggugugugagaccaggacagacagcagagaaucuuuucauucagagccucacccucugucccgggcaacagcaggucgagaacucugguucuuccuuaacacuguuuuucuaaaaaccaguuugaucaggccacuuccuuccuuaggaaccucucuugauuucuuuucucuuuuuuuuuuuuuugguuugagauggagucucccucugucacucgugcuggagugcaguggcacaauccugcucauugcagccuugaccuccugggcccaagcacuucucccaccucagccucccaaguagcugggacugcgggcaugugcucccacgccuggcuaauuuuauuuauuuauuuauuuucugguugaugggaggucucacuauguugccuaggccggucucaaacuccugggcuuauggaauccuugugccuuggccucccagaauguugggauuacagacaugaaccgccacaccaggccacuugauuucuuacuaauuauagaccagaaucgagagucacugagacauagaagaaccuuuauuauaugugucagccuuccuugguauguacugcugagcccaccacacacacccuuccagccauuccacauucuaaccuuucucagaugccuucggccuugugaaagccccuuuccuucuacgugcguuuuccucugccugaagugcuguguucguuucuccgagucucucuccuuguuuauuccugcuuguuccuuuacugcugacuucagauguuccuccuugcuaagcuuuucguugguucuuggcuggagugggcuguucuguauucucagcaccuuguucacaucccuuuugggucaugcuauucugaaauuguauaugugucuguuuuucuuuuuuucuuuguguaucuagcucaguucucuuaguuguucaguaaauacucagugaaugaacauaaaugaauacccuguaaauuuuggucucuaagcuuuaaaagaaguguauuaacuucaguccguugauggcguauugauaggucagccauucuggguuguaggucuuggcauauuuuauaaaauaguagaugaugugagcuuaugguuauuugcauuaaaggccaguguuuuucuugauacauauguuuaaguguccauucaccuuucaguuaccuuuuaaaguaguccucgguuuauaaccaacuggaaauuauaccacuugaauucuuuuuaucaggacaugauucuaagugguacugugcgaagugaacaaaccagauuuuggaaaagugguucagcagucuguguauucuaauuauagggagcauuaggacucaaauucuccagguuuuuagaaaagauuuuuguacuuuaaggguauauuguuaauaucuguugagaugccucaccugagaaccuuucucugcugugguuagggaguguuaaucagaaucacuugugccgugcccuacgcgagaaggacuccuugaguucuuugaaaacauguuuggaauagaauuauagcccuguuuuccugaguggaaccaguugugauuuuccuuugaaauaauuugaauauauaaaagauugacauucuucucacauauauaauguugggaauguaagguauauucaaaaguaaacauuuguggccaauuuuuuuggcucagauuacuaugacauggaauccaugguccaugcagacacaagaucauuuauucugaagaagccaaagcugucugaggaaguaguaguggcaccaaaccaagagucggggaugaagacugcagauucccuucggguacuuucaggacaccuuaugcagacacgguagaugguuucuuuuucuuguguaguuaauuugugugauuagauaguaaagguuaaccauucguuugcagcuucccuccuccccgcccuaaccgcuagcguagagugcuuucauugauucaguagcuagcccaugaauaguuagccaaauucaguuuucaagaauuccaguucaucuuucuuguucagaaauccauuaaccuacaaauuacaacucaguguaugauuuaacucuauuaaagauucuuuucuuuaugcaaauucaggaaaugcaaguuuaaaagccagcugaccauaaucaggucagcucuaaagagaguuggcagaucagguuugggugauuuuucccuuagaaaauugacuguuucuauaaaagaagaaacauacagauaauuagcauaaaugcugcuggcccuuguguucugagcauugaugcuaauuuuuugguuuguuuccauguugacccuaugaagaucgaaugggugauggggucaggcuugaggggagauuguccuuaguaaguacaggcuggagggucacuggugaugccacugugacuguucauggccaucguguguuagcagagaacccaccagugcugcaccugguagcccuaccuagucuuuuuuuauugaaccaaacgcaaagccaagggagugauaguucugcugaagagcacuuuagggggcucagcguuuuguguuuguuucccuaauucuaugguauuuuuuaucugucuggcagagaucuuguacaaccagauaaaccugcaagucccaaguuuauagugacgcuggaugguguccccagccccccaggauacaugucagaucaagaggaggacaugugcuuugaaggaaugaaacccguaaaccaaacugcagccucaaacaagggacucagaggucuccuccacccacagcaguugcacuugcugagcaggcagcuugaggacccaaaugguagcuuuucuaacgguguguugagagcucagauuuucagggugcugucauugugaagggaaucuuugacuuguuucucuaccuugaaugaauauugguuaaaggccuugcuuuuauuuauauucaguaauggccuuuuuucuucuuucagacaaacccaccaaguacauuucagacucuuuuuccugugucuuuuucauaggugggcuguuacuccaguuugaaaacggaguucagccauggaaccugagagaccucuuccgcuuaugcuggcuaaaggaugaaccaccauucuuguugccuucuuuaccuuuguauuuucuucagaaacuguacugccacuuugcccuuuuaucagcaauagucucuugcaauuaacuugagagaaaaauuuagauuugaugcuauuucuaccucagugaaauuucuuugaaaggaguuucucaccuaaucuaucaagaucuuggaacuguuuaaauuaauguugaagaguaauauuuagcagaacucagaugaacucauuucagauagcaccauaguuuuuggcaggugacaguuucuuaucaccguuucuuucacuggguaucagugguagcugcaacgccacugaucauuuccauucaugauagagaaugguaauuauguuccuuauaucuucuaaaauauuuagaagcaccucuucauuggcaggagggauaauuacucaaucuuaaaagcguacagauucaaaggaaaaacaguaauggauuuugaaacauuuccuugaguaauccucuucuuggaagagauaugaaaauguauugaauaccuuucucgaucauuaaaaauagaauagacuucagagggaaaucauauguuaguggagcaauaacacuuagcuuuauuuuaauugguugcguuuccuacugugaaucaaugacguagugucgugguuuugauuaguggagggaguugaaaaucugacccuaucaacaggaagaaaaacuuaaaaaauaguaaaagcugcaguaggcagucccgauuuauugacucuguauguuuugucuaaagagaagacuccaguguuuucacuacucuugauuuucaauuugguaccuuaauuuuuuggucuauuaggaucugguuucauuuaaauguagguguccauaugaggcuuuaugggguauacauguagcagcagugacaccauaaauaauauguuaguaaaaauucuugccagugcuguggccauugugcugacagccaugaugaguggugagccuccuuucccauugcuuugacuggggacucaguguuucccugcugcucaaggaugaagcuuuguaagauuagcauagggguguggcuggagagacuccugcagaacaguucucaggagucucuagucucugcaccacuuccccugugagcagggaguuugaaacugcaauugcuucugguugguuuuauguuggguuguuucaaggaugcuaccaacaacaacaucuguuuuaaccugcugucuuuucacucacugucauauggcagcacagauuuuauagcuugcuuucuuuguuuuuuuuuuuuuugagauagagucucucugucccccaggcuggagugcaauggagccaucucagcucacugcaacuucugccuuccagguugaaagccauucuucugccucagucucccaaguagcugggauuacaggcaugcaccaucacaccuggcuaauuuuguaguuuaaguagagacgggguuuuaccauguuggucaggcuaaucuccaacuccugaccucaagugauccaccaaccucggccucccaaaguucugggauuacaggugugagccaccgugccuggccuauagcuuucaauaaaaggugaauuugccucuuaaaauuugaacagaaaguuuuaauaguuuacaaagucggugucagccagugaagacuaggggcaugaccuucguaugacuuaauguuuuuaaaagaaagauaaaguuucuuuguaagguauuauuguaauaaucacauuucuuuguaaaguauuauauuguuccugaguaucuagcuacuuugcuuuccagcuaggcuucucuuggguauucucuuaaucuuuuauuuguacuggguucuuguguauauauuauagucugcuguguguaauuuauuauaggaaaaggguaagacacauuuacuuugcggggaugacacaaaaaaccuguaaaaauuagagaaacuuccagucaucucacauuuucuuuggaaccgauuauucuuguaucuuagaacuaaaaugacuuauacuguuuuguuuuuagaaaggguaucccuccuguugcccaggcuggagugcauuggcacagucauggcucacugcagccuccaccucccaggcucaagugauucucccaccucagccuccugaguaguugguuacuacaggugcacaccaccaugccuggcuaauuuuuuguauuuuuuguagagaugggguuucaccauguugcccaggcuggucugaaacuccugagcucaagugaucugcccgccucggccucccaaagugcugggguuacaggcaugagccaccacauccuauuuaaagcuuaaauaggacuuuuacuauuuuuaaaguagcauagaaaacuguuuguaucaggcauagucauaauugcucuuugaugcugcuccuaucugggcugcaugacuacauuugugugccuuguucuccuguagugaggacagaaugugggucacuggaacaguaaguacucauagaacuagcugcugcugcuauuacgacugguugccuguuuugcauuuuuuccguuuaaucaucagacucuaaggaagacauuauuuucucuuuguauagaugaggaaacagaauuccaaaaaguuagcuaacauuugcacagagugucuggcugagcaacuaaguggcagagucagauuuuaacugaccucuggcaagaggacuagaggaauacaguugaagugauacuugcuuucaugaacaugaaugugaaccauaauacauaauacccaugaugcuauuuuguggggaguuuaaggugucucaguccagaaauuagcagcugauuauugccuguagcuguaauuuuacuuauucaguguuauuuaauaaauugccagcauuacaauuucgaugaaggcagauuuuuggcuuacugaaacaggauaaaaaucuggcaacaggggucccacuuugcccugucauaguaaucgaagcugugauuggauguggcacagggaguggaguggaugggugugcacuugcuuuccaggcugcugcuccccgucugucccuuauugcauuuaucaucuucagcccagucagucuugcuguuaggggaacugcccagucucuguaagugauggcauuugugaccccauuguagguaaaaauguuuuccccuuuuuagacauugcuggcugagcgcgguggcucaugccuauaaucccagcacuuugggaggccgagguggguggaucgcuuaaguccuggaguucaagaccagccugggcaacguggggaaacccuguagccaggcgugguggcacgugcuacuugguaggggcugaggugggaguaucacuugagccugggaggcagagguugcagugagccgagauuacaccacuggcacaccacuguacuccauccugggugacagagcaggacccugucguaaaaaaaaaaaaaaaaaaaaaaaguaaaagacauugcugaguuucgcaccuggacuuacagcucagcaggugggaauccuuuuguauuugggccacucaucaucuugcuggcgugugaggauucacaucuccuuaucaccuuaccuguuuucaguuuuuauuuaauuuuauuaguuccccacuugacguccuucucuauuuuuaauucagcuaugaauuaguauugagaauuagaauuuuuggugaaaaauuuggccguaguugcagagucacuguccucuuuccuuuucacagugagaacuguugucuucuuccuggcaaccuuuuauaggauucuauggccaguguuaaucccauaauuugagcucacuuauuuuauaugacuguacauuuaacagaagauucuaagacagguuugagggaaauauguuaaaggugcuguguacugaauugaucauaaugaaugaaauacuuuuauuuccuuucccuuuguagcugagaugagugaacugaguguggcacagaaaccagaaaaacuuuuggagcgcugcaaguacuggccugcuuguaaaaauggggaugagugugccuaccaucaccccaucucacccugcaagugaguaccauccccccaucucacccugcaagugaguaccauccccccaucucacccugcaaguaccaucccccaucucaccuggcaaguaccaucccaucucacccagcaaguaccaucccccacaucucaacccucaagugaguaccaucccaucucacccugcaaguaccaucccauuucacccugcaaguaccaucccccaucucacccugcaaguaccaucuccccaucucacccuguaacuaccaucccaucucacccugcaagugaguaccaucccugcauuucacccugcaaguaccaucucaucucacccugcaaguaccacccccucaucucacccugcaaguaucaucccccaucuagcccuguaagugcgaguaccaucccccaucuuacccugcaaguaccaucacccacuucacccugcaaguaccaucccccaccucagccugcaaguaccaucccccaccucagccugcaaguaccauccccuaucucacccugcaaguaccauccccaucucacccugcaaguaucaucccccaccucacccugcaaguaccaucccccaucucacccugcaauugaguaccaucccccaucucacccugcaaguaccaucccccaucucacccugcaagugaguaccaucccccaucucaccuugcaaguaccaucccccaucucacccugcaaguaccaucccccaucucacccugcaaguaucaucucacccugcaagugaguaccauccccccaucucauccugcaaguaccaucccccaucucacccugcaaguaccaucccccaucucacccugcaaguaccaucccccaucuuacccugcaagugaauaccauccccaucucacccugcaagugaauaccauccccaucucacccugcaagugaauaccaucccccaucucacccugcaagugaauaccauccccaucucauccugcaagugaauaccauccccaucucacccugcaagucauagccagcugauuuuggcuuucaguuuagugucuguaucuuacaccuuauuuuguuuuuguuuuucuguggacaaguuuuuaguuuuauaacuaaauggagugacaauuaccauggcccucuccagaguagcguauuucuuguucauguauguuuguugagaggcaagggugggggggcuuuguuugugccucggaccugugagauacugaaauaccugggguuccuuaagaauucuguacguuuaagcagauggguauaugguaacugccccaguuuguaugcauuuuggccacacgcaguauacacagauuuugaggaguugagggaaaaguuaguuauggguaaugaaaacauuuuggacuuggguuaaauuuuuccuuacaagcuggcuggcucaauguaaugagcuuuaugagauggcuuuuuggggcuucuuuuuuuugccggggguagguccuauggauggaaucuucauuuuuaauucuuuuaaggaaaugaugugggaauaauacagcuguacauauaaggagaguaugggaugagucuuuuuguaucacaaagccuugcauagaggauguguuuauuguauuaaugaguucacugcauaaaauauauaccuuuuuuauuaaguggugugauuuuuaucacaaaagcuugucuuucuugguggcuuggcuugaguuaaaagccuguguuuguguuaucccaagcuuuggaauaaaugauuguguccuauuuugauauauggucuuauuuuaaaauauucuuuuuguugcuguuuuuuuugcauuucucaaaacaaguagugauggggaguguaaagagcccuuauacacagaacuaauaaugcauugagaagauugaauaugaaauaugcuuuuuuuuuguuuuguagagccuuccccaauuguaaauuugcugaaaaauguuuguuuguucacccaaauuguaaauaugaugcaaaguguacuaaaccagauugucccuucacucaugugaguagaagaauuccaguacugucuccaaaaccaggugagugagugacugugcuacuacauuuggguaaaaaauauaaaauggcauuuugugacuguaaauggaauugaacaaacaaaagaugguuucagaaauaauuuuggcaggaucaguuaauccaaccagucuuuaaagagcaagugugccuaucuguaguauuccgaaguauuuugacuagugaauauauaaaccuuaccauucuaauuuaaaaaugguuuucacuuucaaaaaaaacaucaguagacugcauuaaaaauggguuuuccaaacagauuggagaucaguccugguuuuuauuuuguuagcaguugcaccaccagcaccaccuuccaguagucagcucugccguuacuucccugcuuguaagaagauggaaugucccuucuaucauccaaaaguaagaacuucuauuuucucaaaucaauuuagugacaacaucucaauuuccucauuuaacuucuuuuuugucagaguuacuacauuggugcaaaaguaauugcgauuuuugccaguaaaacuauuaaguuguuccucgucacugaaccuccaucuggccccuuaggccaaguggucugaaacuguucaauguuaguaucccaagcacucaguggggggaagcauaucuuugcuagucacauuuuccauuauucccugcauuuaaguauauggauggguuuuagcgggggcuggggggcaguuugaaccuaaugucagaacugagaugaagaaauccaguagguacugcuuaaaaccauccaaacuuguacugaugaugguugaugaaucuccagauguuuaguuggucaaaaugaauuaucuccuucuugccccgguagcuugaggaccauaugaaggccuucacuugcccccaucuguaacugggcguagaugaggguacucagugaagaguguaagggauaauuagaaguuuuugugguaugcuaaacuaccuuuugaaauuguacuugcugugauucuuugacuagaauuuugugucucaagguuaaguccauuuuucaaggcuucacuaguauuaaaaugguccuuauagauggaaucucuuacucuguuaaugguuagggugggcugguuauugucuccuaaguuguauguuggccaggugaggugggucaggccugcuauccuaguacuuugggagguagaggcagaaguggaaggaucguuugagcccgggaguuugaaaccagccuaggcaacauuuaagagaccccaucucuuaaaaaaaaaaaaaacaggcuugguagcacacgccuguagucccagcuacucgggagacugaggcaagaggucaugccacuucacuccagccugggugacagagugagacccugucucaaauaauaaaauaauguguuuacuuauauuagccuuguggauauuguugaagcucuguuaucucuauucagcauuguagguuuaacacucaauguacaagaccggacugcacauucuaccaucccaccauuaaugucccaccacgacaugccuugaaauggauucgaccucaaaccagguaaacauucaaauucguuuuucucaugucaguucaaauucuuuuuucuaauuugcaguuucuaaauuuauaagcacacaaaauuggaaacuagacuguuacuuugaauuuuuuucuuugcuguuuaauuauagaaggcuccuuuggcaaaauaauuuacuacaugggcuaaauuuuacauuauccagugguuacuuuuuuaaccuagauuaucuugcucuguugcccagguuggagugcagucacacuaucauagcucacugcagccucaaaccccuggguucaauccauccucccaccuguagcugagacuacaagcgugugccucuauaccuggcuaauuuuuuuuauuuuaaguagagauggggucuugaacuccugagcugaagcgauauccuuccaccguggccuuccaaaguaccaggauuacaggcaugagccaccacacccagccagauuuuaacuucucauuauauacuacgcaaacauauacuaaggccagcaggaguauauauauguguacuguacuugaauuucacauccauuuucuucgacauuagcaacugggagauacugaaaggaaguuucaaaauauuuuaguguggccagaaaauuuaauuacauaugguauuaucuuuuaucuaccugacauaauugaauuauuuuuaaaaaucugccauuuauauuguaaucuuaugaccaaauauuuauugcuuaaaacuagucaacuuuuuaaacugagauauaugguauauauggauacaaagcagauaauuaaaacaauuuuugguucuguucauucagcgaauagcacccaguccugccuggcagaagaucaugcaguuuggaaguuuucauguacugaugaaagauacucuacagaacuugucaaaucuuugaaacuuggaauauauugcuuucauaauaugaaguuuuauugccuaucuaucugaagugucuaauuuuucaaguuuguaaguuuauuaugugguuuuaacauuggguguuuuuguuuuguuuuuacuaugaaaagacagcuuaaggaagagcuaaauucuguuaaaauauuuggggcauguuugugcacugcuguugugaggaucagcauaugaaauugacaucaugguuagucaugguacugcagcuuagggggcuacacgguugcugugugaguggagagaugcagugaggcaguugucauuauucuaaaaauuguacuacuuucacuuuucccaaagauuauauaauguucauaauccaccaugaaaacagcauuggccaaagguacugaggcugcuuaaaauauucaauucugcuuuuuaauuuuuaagugaauuuaguuugaaaagcaugauuauacaggccucucaggcugagugcuacuuugguaaagu

SEQ ID NO: 19193 - RNA, 44304 nt, Homo sapiens
acuuuaccaaaguagcacucagccugagaggccuguauaaucaugcuuuucaaacuaaauucacuuaaaaauuaaaaagcagaauugaauauuuuaagcagccucaguaccuuuggccaaugcuguuuucaugguggauuaugaacauuauauaaucuuugggaaaagugaaaguaguacaauuuuuagaauaaugacaacugccucacugcaucucuccacucacacagcaaccguguagcccccuaagcugcaguaccaugacuaaccaugaugucaauuucauaugcugauccucacaacagcagugcacaaacaugccccaaauauuuuaacagaauuuagcucuuccuuaagcugucuuuucauaguaaaaacaaaacaaaaacacccaauguuaaaaccacauaauaaacuuacaaacuugaaaaauuagacacuucagauagauaggcaauaaaacuucauauuaugaaagcaauauauuccaaguuucaaagauuugacaaguucuguagaguaucuuucaucaguacaugaaaacuuccaaacugcaugaucuucugccaggcaggacugggugcuauucgcugaaugaacagaaccaaaaauuguuuuaauuaucugcuuuguauccauauauaccauauaucucaguuuaaaaaguugacuaguuuuaagcaauaaauauuuggucauaagauuacaauauaaauggcagauuuuuaaaaauaauucaauuaugucagguagauaaaagauaauaccauauguaauuaaauuuucuggccacacuaaaauauuuugaaacuuccuuucaguaucucccaguugcuaaugucgaagaaaauggaugugaaauucaaguacaguacacauauauauacuccugcuggccuuaguauauguuugcguaguauauaaugagaaguuaaaaucuggcugggugugguggcucaugccuguaauccugguacuuuggaaggccacgguggaaggauaucgcuucagcucaggaguucaagaccccaucucuacuuaaaauaaaaaaaauuagccagguauagaggcacacgcuuguagucucagcuacaggugggaggauggauugaacccagggguuugaggcugcagugagcuaugauagugugacugcacuccaaccugggcaacagagcaagauaaucuagguuaaaaaaguaaccacuggauaauguaaaauuuagcccauguaguaaauuauuuugccaaaggagccuucuauaauuaaacagcaaagaaaaaaauucaaaguaacagucuaguuuccaauuuugugugcuuauaaauuuagaaacugcaaauuagaaaaaagaauuugaacugacaugagaaaaacgaauuugaauguuuaccugguuugaggucgaauccauuucaaggcaugucguggugggacauuaauggugggaugguagaaugugcaguccggucuuguacauugaguguuaaaccuacaaugcugaauagagauaacagagcuucaacaauauccacaaggcuaauauaaguaaacacauuauuuuauuauuugagacagggucucacucugucacccaggcuggagugaaguggcaugaccucuugccucagucucccgaguagcugggacuacaggcgugugcuaccaagccuguuuuuuuuuuuuuuaagagauggggucucuuaaauguugccuaggcugguuucaaacucccgggcucaaacgauccuuccacuucugccucuaccucccaaaguacuaggauagcaggccugacccaccucaccuggccaacauacaacuuaggagacaauaaccagcccacccuaaccauuaacagaguaagagauuccaucuauaaggaccauuuuaauacuagugaagccuugaaaaauggacuuaaccuugagacacaaaauucuagucaaagaaucacagcaaguacaauuucaaaagguaguuuagcauaccacaaaaacuucuaauuaucccuuacacucuucacugaguacccucaucuacgcccaguuacagaugggggcaagugaaggccuucauaugguccucaagcuaccggggcaagaaggagauaauucauuuugaccaacuaaacaucuggagauucaucaaccaucaucaguacaaguuuggaugguuuuaagcaguaccuacuggauuucuucaucucaguucugacauuagguucaaacugccccccagcccccgcuaaaacccauccauauacuuaaaugcagggaauaauggaaaaugugacuagcaaagauaugcuuccccccacugagugcuugggauacuaacauugaacaguuucagaccacuuggccuaaggggccagauggagguucagugacgaggaacaacuuaauaguuuuacuggcaaaaaucgcaauuacuuuugcaccaauguaguaacucugacaaaaaagaaguuaaaugaggaaauugagauguugucacuaaauugauuugagaaaauagaaguucuuacuuuuggaugauagaagggacauuccaucuucuuacaagcagggaaguaacggcagagcugacuacuggaagguggugcugguggugcaacugcuaacaaaauaaaaaccaggacugaucuccaaucuguuuggaaaacccauuuuuaaugcagucuacugauguuuuuuuugaaagugaaaaccauuuuuaaauuagaaugguaagguuuauauauucacuagucaaaauacuucggaauacuacagauaggcacacuugcucuuuaaagacugguuggauuaacugauccugccaaaauuauuucugaaaccaucuuuuguuuguucaauuccauuuacagucacaaaaugccauuuuauauuuuuuacccaaauguaguagcacagucacucacucaccugguuuuggagacaguacuggaauucuucuacucacaugagugaagggacaaucugguuuaguacacuuugcaucauauuuacaauuugggugaacaaacaaacauuuuucagcaaauuuacaauuggggaaggcucuacaaaacaaaaaaaaagcauauuucauauucaaucuucucaaugcauuauuaguucuguguauaagggcucuuuacacuccccaucacuacuuguuuugagaaaugcaaaaaaaacagcaacaaaaagaauauuuuaaaauaagaccauauaucaaaauaggacacaaucauuuauuccaaagcuugggauaacacaaacacaggcuuuuaacucaagccaagccaccaagaaagacaagcuuuugugauaaaaaucacaccacuuaauaaaaaagguauauauuuuaugcagugaacucauuaauacaauaaacacauccucuaugcaaggcuuugugauacaaaaagacucaucccauacucuccuuauauguacagcuguauuauucccacaucauuuccuuaaaagaauuaaaaaugaagauuccauccauaggaccuacccccggcaaaaaaaagaagccccaaaaagccaucucauaaagcucauuacauugagccagccagcuuguaaggaaaaauuuaacccaaguccaaaauguuuucauuacccauaacuaacuuuucccucaacuccucaaaaucuguguauacugcguguggccaaaaugcauacaaacuggggcaguuaccauauacccaucugcuuaaacguacagaauucuuaaggaaccccagguauuucaguaucucacagguccgaggcacaaacaaagcccccccacccuugccucucaacaaacauacaugaacaagaaauacgcuacucuggagagggccaugguaauugucacuccauuuaguuauaaaacuaaaaacuuguccacagaaaaacaaaaacaaaauaagguguaagauacagacacuaaacugaaagccaaaaucagcuggcuaugacuugcagggugagauggggaugguauucacuugcaggaugagauggggaugguauucacuugcagggugagaugggggaugguauucacuugcagggugagauggggaugguauucacuugcagggugagauggggaugguauucacuugcaggguaagaugggggaugguacuugcagggugagaugggggaugguacuugcagggugagaugggggaugguacuugcaggaugagauggggggaugguacucacuugcagggugagaugauacuugcagggugagaugggggaugguacuugcagggugagaugggggaugguacuugcaaggugagaugggggaugguacucacuugcagggugagaugggggaugguacuugcagggugagaugggggaugguacucaauugcagggugagaugggggaugguacuugcagggugaggugggggaugauacuugcagggugagauggggaugguacuugcagggugagauaggggaugguacuugcaggcugaggugggggaugguacuugcaggcugaggugggggaugguacuugcagggugaagugggugaugguacuugcaggguaagaugggggaugguacucgcacuuacagggcuagaugggggaugauacuugcagggugagaugagggggugguacuugcagggugagaugagaugguacuugcagggugaaaugcagggaugguacucacuugcagggugagaugggaugguaguuacagggugagauggggagaugguacuugcagggugagaugggggaugguacuugcagggugaaaugggaugguacuugcagggugagaugggaugguacucacuugaggguugagaugugggggaugguacuugcugggugagaugggaugguacuugccaggugagaugggggaugguacuugcagggugagauggggggaugguacucacuugcagggugagauggggggaugguacucacuugcagggugagauggggugaugguaggcacacucauccccauuuuuacaagcaggccaguacuugcagcgcuccaaaaguuuuucugguuucugugccacacucaguucacucaucucagcuacaaagggaaaggaaauaaaaguauuucauucauuaugaucaauucaguacacagcaccuuuaacauauuucccucaaaccugucuuagaaucuucuguuaaauguacagucauauaaaauaagugagcucaaauuaugggauuaacacuggccauagaauccuauaaaagguugccaggaagaagacaacaguucucacugugaaaaggaaagaggacagugacucugcaacuacggccaaauuuuucaccaaaaauucuaauucucaauacuaauucauagcugaauuaaaaauagagaaggacgucaaguggggaacuaauaaaauuaaauaaaaacugaaaacagguaaggugauaaggagaugugaauccucacacgccagcaagaugaugaguggcccaaauacaaaaggauucccaccugcugagcuguaaguccaggugcgaaacucagcaaugucuuuuacuuuuuuuuuuuuuuuuuuuuuuuacgacaggguccugcucugucacccaggauggaguacaguggugugccagugguguaaucucggcucacugcaaccucugccucccaggcucaagugauacucccaccucagccccuaccaaguagcacgugccaccacgccuggcuacaggguuuccccacguugcccaggcuggucuugaacuccaggacuuaagcgauccacccaccucggccucccaaagugcugggauuauaggcaugagccaccgcgcucagccagcaaugucuaaaaaggggaaaacauuuuuaccuacaauggggucacaaaugccaucacuuacagagacugggcaguuccccuaacagcaagacugacugggcugaagaugauaaaugcaauaagggacagacggggagcagcagccuggaaagcaagugcacacccauccacuccacucccugugccacauccaaucacagcuucgauuacuaugacagggcaaagugggaccccuguugccagauuuuuauccuguuucaguaagccaaaaaucugccuucaucgaaauuguaaugcuggcaauuuauuaaauaacacugaauaaguaaaauuacagcuacaggcaauaaucagcugcuaauuucuggacugagacaccuuaaacuccccacaaaauagcaucauggguauuauguauuaugguucacauucauguucaugaaagcaaguaucacuucaacuguauuccucuaguccucuugccagaggucaguuaaaaucugacucugccacuuaguugcucagccagacacucugugcaaauguuagcuaacuuuuuggaauucuguuuccucaucuauacaaagagaaaauaaugucuuccuuagagucugaugauuaaacggaaaaaaugcaaaacaggcaaccagucguaauagcagcagcagcuaguucuaugaguacuuacuguuccagugacccacauucuguccucacuacaggagaacaaggcacacaaauguagucaugcagcccagauaggagcagcaucaaagagcaauuaugacuaugccugauacaaacaguuuucuaugcuacuuuaaaaauaguaaaaguccuauuuaagcuuuaaauaggaugugguggcucaugccuguaaccccagcacuuugggaggccgaggcgggcagaucacuugagcucaggaguuucagaccagccugggcaacauggugaaaccccaucucuacaaaaaauacaaaaaauuagccaggcaugguggugugcaccuguaguaaccaacuacucaggaggcugaggugggagaaucacuugagccugggagguggaggcugcagugagccaugacugugccaaugcacuccagccugggcaacaggagggauacccuuucuaaaaacaaaacaguauaagucauuuuaguucuaagauacaagaauaaucgguuccaaagaaaaugugagaugacuggaaguuucucuaauuuuuacagguuuuuugugucauccccgcaaaguaaaugugucuuacccuuuuccuauaauaaauuacacacagcagacuauaauauauacacaagaacccaguacaaauaaaagauuaagagaauacccaagagaagccuagcuggaaagcaaaguagcuagauacucaggaacaauauaauacuuuacaaagaaaugugauuauuacaauaauaccuuacaaagaaacuuuaucuuucuuuuaaaaacauuaagucauacgaaggucaugccccuagucuucacuggcugacaccgacuuuguaaacuauuaaaacuuucuguucaaauuuuaagaggcaaauucaccuuuuauugaaagcuauaggccaggcacgguggcucacaccuguaaucccagaacuuugggaggccgagguugguggaucacuugaggucaggaguuggagauuagccugaccaacaugguaaaaccccgucucuacuuaaacuacaaaauuagccaggugugauggugcaugccuguaaucccagcuacuugggagacugaggcagaagaauggcuuucaaccuggaaggcagaaguugcagugagcugagauggcuccauugcacuccagccugggggacagagagacucuaucucaaaaaaaaaaaaaacaaagaaagcaagcuauaaaaucugugcugccauaugacagugagugaaaagacagcagguuaaaacagauguuguuguugguagcauccuugaaacaacccaacauaaaaccaaccagaagcaauugcaguuucaaacucccugcucacaggggaaguggugcagagacuagagacuccugagaacuguucugcaggagucucuccagccacaccccuaugcuaaucuuacaaagcuucauccuugagcagcagggaaacacugaguccccagucaaagcaaugggaaaggaggcucaccacucaucauggcugucagcacaauggccacagcacuggcaagaauuuuuacuaacauauuauuuauggugucacugcugcuacauguauaccccauaaagccucauauggacaccuacauuuaaaugaaaccagauccuaauagaccaaaaaauuaagguaccaaauugaaaaucaagaguagugaaaacacuggagucuucucuuuagacaaaacauacagagucaauaaaucgggacugccuacugcagcuuuuacuauuuuuuaaguuuuucuuccuguugauagggucagauuuucaacucccuccacuaaucaaaaccacgacacuacgucauugauucacaguaggaaacgcaaccaauuaaaauaaagcuaaguguuauugcuccacuaacauaugauuucccucugaagucuauucuauuuuuaaugaucgagaaagguauucaauacauuuucauaucucuuccaagaagaggauuacucaaggaaauguuucaaaauccauuacuguuuuuccuuugaaucuguacgcuuuuaagauugaguaauuaucccuccugccaaugaagaggugcuucuaaauauuuuagaagauauaaggaacauaauuaccauucucuaucaugaauggaaaugaucaguggcguugcagcuaccacugauacccagugaaagaaacggugauaagaaacugucaccugccaaaaacuauggugcuaucugaaaugaguucaucugaguucugcuaaauauuacucuucaacauuaauuuaaacaguuccaagaucuugauagauuaggugagaaacuccuuucaaagaaauuucacugagguagaaauagcaucaaaucuaaauuuuucucucaaguuaauugcaagagacuauugcugauaaaagggcaaaguggcaguacaguuucugaagaaaauacaaagguaaagaaggcaacaagaauggugguucauccuuuagccagcauaagcggaagaggucucucagguuccauggcugaacuccguuuucaaacuggaguaacagcccaccuaugaaaaagacacaggaaaaagagucugaaauguacuugguggguuugucugaaagaagaaaaaaggccauuacugaauauaaauaaaagcaaggccuuuaaccaauauucauucaagguagagaaacaagucaaagauucccuucacaaugacagcacccugaaaaucugagcucucaacacaccguuagaaaagcuaccauuuggguccucaagcugccugcucagcaagugcaacugcuguggguggaggagaccucugagucccuuguuugaggcugcaguuugguuuacggguuucauuccuucaaagcacauguccuccucuugaucugacauguauccuggggggcuggggacaccauccagcgucacuauaaacuugggacuugcagguuuaucugguuguacaagaucucugccagacagauaaaaaauaccauagaauuagggaaacaaacacaaaacgcugagcccccuaaagugcucuucagcagaacuaucacucccuuggcuuugcguuugguucaauaaaaaaagacuagguagggcuaccaggugcagcacugguggguucucugcuaacacacgauggccaugaacagucacaguggcaucaccagugacccuccagccuguacuuacuaaggacaaucuccccucaagccugaccccaucacccauucgaucuucauagggucaacauggaaacaaaccaaaaaauuagcaucaaugcucagaacacaagggccagcagcauuuaugcuaauuaucuguauguuucuucuuuuauagaaacagucaauuuucuaagggaaaaaucacccaaaccugaucugccaacucucuuuagagcugaccugauuauggucagcuggcuuuuaaacuugcauuuccugaauuugcauaaagaaaagaaucuuuaauagaguuaaaucauacacugaguuguaauuuguagguuaauggauuucugaacaagaaagaugaacuggaauucuugaaaacugaauuuggcuaacuauucaugggcuagcuacugaaucaaugaaagcacucuacgcuagcgguuagggcggggaggagggaagcugcaaacgaaugguuaaccuuuacuaucuaaucacacaaauuaacuacacaagaaaaagaaaccaucuaccgugucugcauaagguguccugaaaguacccgaagggaaucugcagucuucauccccgacucuugguuuggugccacuacuacuuccucagacagcuuuggcuucuucagaauaaaugaucuugugucugcauggaccauggauuccaugucauaguaaucugagccaaaaaaauuggccacaaauguuuacuuuugaauauaccuuacauucccaacauuauauaugugagaagaaugucaaucuuuuauauauucaaauuauuucaaaggaaaaucacaacugguuccacucaggaaaacagggcuauaauucuauuccaaacauguuuucaaagaacucaaggaguccuucucgcguagggcacggcacaagugauucugauuaacacucccuaaccacagcagagaaagguucucaggugaggcaucucaacagauauuaacaauauacccuuaaaguacaaaaaucuuuucuaaaaaccuggagaauuugaguccuaaugcucccuauaauuagaauacacagacugcugaaccacuuuuccaaaaucugguuuguucacuucgcacaguaccacuuagaaucauguccugauaaaaagaauucaagugguauaauuuccaguugguuauaaaccgaggacuacuuuaaaagguaacugaaaggugaauggacacuuaaacauauguaucaagaaaaacacuggccuuuaaugcaaauaaccauaagcucacaucaucuacuauuuuauaaaauaugccaagaccuacaacccagaauggcugaccuaucaauacgccaucaacggacugaaguuaauacacuucuuuuaaagcuuagagaccaaaauuuacaggguauucauuuauguucauucacugaguauuuacugaacaacuaagagaacugagcuagauacacaaagaaaaaaagaaaaacagacacauauacaauuucagaauagcaugacccaaaagggaugugaacaaggugcugagaauacagaacagcccacuccagccaagaaccaacgaaaagcuuagcaaggaggaacaucugaagucagcaguaaaggaacaagcaggaauaaacaaggagagagacucggagaaacgaacacagcacuucaggcagaggaaaacgcacguagaaggaaaggggcuuucacaaggccgaaggcaucugagaaagguuagaauguggaauggcuggaaggguguguguggugggcucagcaguacauaccaaggaaggcugacacauauaauaaagguucuucuaugucucagugacucucgauucuggucuauaauuaguaagaaaucaaguggccugguguggcgguucaugucuguaaucccaacauucugggaggccaaggcacaaggauuccauaagcccaggaguuugagaccggccuaggcaacauagugagaccucccaucaaccagaaaauaaauaaauaaauaaaauuagccaggcgugggagcacaugcccgcagucccagcuacuugggaggcugaggugggagaagugcuugggcccaggaggucaaggcugcaaugagcaggauugugccacugcacuccagcacgagugacagagggagacuccaucucaaaccaaaaaaaaaaaaaagagaaaagaaaucaagagagguuccuaaggaaggaaguggccugaucaaacugguuuuuagaaaaacaguguuaaggaagaaccagaguucucgaccugcuguugcccgggacagagggugaggcucugaaugaaaagauucucugcugucuguccuggucucacacaccugacaggaagagaagacaugcuccauccugggaaggggcgugcccgccuuccccagcaagggcaguacagaugguaaagggagacaggcggaagagaaagcugggaugagaaacuuagcaaaagaaaaagagcaaaguuaaaaggggcaaagauacauuuccauguuagauuuaaagucuuugugggacucucccauguuuaagaggaaguagaaaauucagauuugaccuguagguggggggacagaaauaagaugcugagucaaaaccgaaggugacagaaguguuuaacauauucaggguggccgucucucacugaauccucacucaaagccuacaaagucgguuuccucccauguuacagaugacuguuugcagcuccaaguuauuaaaugauucaccgaggucucacaacugucaaaggugggucccaacaguggcccaggggcugcuucacuccuucccaccacucugcacuuucugagacgaaggaguucuaccaguucauagguugggugaacacagaagagaugaaaauaaugcugaaggugggagagagcaaagcuaaccuuuugaggaggaauggaggagaugcgcugacacaugagaaugaaagggaaugagaagaauaaagacagagugaacuggaagccgaaaggucaaagcuuggagaaaguaugggaacccaaguguaacaugcuccaggguugaggaaagcgugcaccggucccucccgcacaccucucugcaagcggaacguuagcagcccaggucacauggagaccagacagacgggggaguaaguaacaucuucugaguagagaccacaggcugaccccaugcauuuacuuuuuguucccuccugaaagcccacagaaaugucaauaaggguuuuguuuuuguuuugaaagcauaaacucacaaagaaaauaaguguaaaaagaaauuuucaaaguggaaaacagaugauuaagaacucaggggaucuguaaaagcugaauucuaaggcaauaaugaagcaauccaauucagaccacaagauucuccaaaggcucaggaacuggcaguaaaaggaccuuaggaagaaauggaagaaauggcaggcaaaaaagagguguauuagauguguccaagaagcaguuaguucuucuucaacucuaauuccauguaucuguuuucuuuguuugagacagucuugcucugucacccaggcuggagugcaguggugcgagcucagcucacugcaaccuccgccuccuggguucaagcaaggcuccugccucagccuccuuaguagcugggauuacagaugugcaccaccacgccuggcuaauuuuuguauuuuuuaguagagauuggguuucgccauguuggccaggcuggucuggaacuccugaccugaagugaucugccugccuuggcuuccccaagugcugggauuaugggcgugagccacugcaccuggccacuguuuucuugguuuugaugcuugccacaccaaucccgaccucuacacugaagacaccugggaugacuggugaugugcuuuccuguagauaaucuucggagaggccuauggaugaagcauuagggucucugccagaaagaugcuacgacaaaaucaccugaagguacacuguuaaaaauuuuuaaaggcaauuagauuuccugauaaaucuuuacccacugcaugcauucucccuuggagaaaguggagcuuuagacucuucagaggauaagaacagagucccuggaccaagagacaccagccaugaugaaagaaguacuggacugacaaugguugggggaggguuaaauaaacauuacauaauaauuaauggugaggugccucccccagccuucuuuccccacuuaagcucgcagaacucugacuaccaggcuauuacuugaaaaacuuuguuuuggagaagcugaccagccugagaggaaagucuugaaggcagugacaucagggugcccacaaaccagacaggcaggacaaaucacuuuccaccacagggucuaguuucaaacagaaagucaaagugccccaugccccaacucaugaacccagaauaccagugaccuucugagugcuccacucuuaaauguaagaccaccuaggauccccagacaucagaggggaaccuccagcauaaaagacagccaaaacagaccacuuagagaaaacaagacgaagcagggaggggaaaaaugucaaaaccaccuuucagaccacagagaaauaacaaagaguauuguguacacaaaaucaguauguuuuuagaaaauuaauagaauaugcagaaacaaagggaucuuagaauaaaaaaugugauaggagcuaaggacugcagucauucauaagccucacagaacuacuugcuauuucaaacugcgugcaccauggguacaaugaaaagcugaaggaggcagaagagaaaacaugcacaagagcugaugaaguggaucccacacacagaucucggcugucaaccuuuucaaauacuccuguggaggaagcaggacggacugcugggagaugagagagcaaaaucacgggcagagaaugucugaacaccucuacagagagaagacaggaggcagagaaugaaguuggaggagugggugacaugccaguggcucaccaacccagugggaucuggccucugguggaggcugacccuuagggaggaaaagcacacuuucugagcuggaaagcugggggagggucggggaacagagugacugacuguggaguccugacugagaggggucuagggaccagagcuucccacaaaagacagacuuaggggaaacagaaggacugagaugauuccgggucucucaugguugccuguguuuauccugcagucauuuuuaagacauugaacaugcaucuggcaggggcugggcacugaggacagagauaauaaaaaugaaggcgucagcuccaguccuggaguagccccuggcaugugugucuguggggagaggaaaggagacaggcaaacuagaguggcucuagaacacuagaacaacaaguuccagguguggcccuggugauaagacuccaaaaugaaguacaagaggauaaggcuaaccaggugaaaaacaggauacaaaagccacucauggcaaugacaaaagcuggguagagugggaggguaaaucagaaacgcaggucacuccugacagcaggagagugacagccgacagugcuagggacacacuuggaauggugugaaaggaacaaaguuuuccaaugaggcaaaaaauuauaacacuauauaacaugaaagaaaugcagaucuuaucuccuggcccuaaaauauuuucacagaucuaaauauaacaucuuagggcaggaucuaagagauccgagauacguuaaaugggguguaagaaauggaaauggcaacugaaauggcuggauuacaguacaacuugaaacauuaccaaccuugacucaucugcagaguuucugccauuacugggucgauuugcagucgggauaauaauugccucuguugaguuccuagaauauaaauuuuaaaacuucacuaagcuuacaacacagacaauaccagcaugugguucccaaaaaucaauccuucuggguucuuaacuugaagucuuaaaaguaacuuaaagcuucaacaauucaauuuaauaguauuuauagaccaaagacauauccuguaagacaaaaaaggcuguacucaggguuaaaccacaaaugccaauuuaaaacacuccugguucucccucuaugaggacaucaguuuuccugaauuugaauucugcggggaaaguaaagguggcaaacggguggaaaauccaggaaaaggcaccuuguggcccagcagcucgcauaacagccaacugcacaauaagcauggcaagcaccucccuccaucaccugagcucuuaccaucacgacuaacucaugaccuuugaagauaaucgaaauagcaaaacaaaacacucucaucaucuaaacaagaguuccuaaaagacaaacucugggcuucgaugcaugcaaagaaaacaauaagacacucagcucuacaauccacacccuauguuagcaaagcaugauaauaauucuuugccucuuccacaagaaaagauguucaacuacuuauuucuucuaaaauaggcuccuaacauuaauuccuauuagguucacuauuccuaacaauaauaugcccagcagucugacugcacaaaauagggacaaagaacugauuuuuuuccauccucgauuugauguuaagcuccuugaggaugggagaaugucacacuuuucuguagcccccacagcgcuuagcagacaucaggcacucacuugcucauuauaagguacugcacuacaguguacaaagggauguaacugauaggguugcaaauacugaaaucuuacuaagaugcccacaugcugauuuuggguauauccauuacagguggcuucacaaggacaggcuuugcuuacucagugcaaagauguuaagugggccaucucccaccaagcaccacauuucauuaaaagguguuuuuaaauuuuaaaaccuauacucgauuugaaauuguaucaguuaguuuccuuuaaaacauaaguuauaugaaauuuuacuggugcgucccaaaaaagucaauuccuuccagaauuauuaccauaaaaaaacacacauucugaggaacuguaacgaagaugacacuuaggucaaguugcauuccugugggaagcuuggaaaacugaggugaaaaguuacaggaagaaugcucuuuccauccaaauacugcaacaggucuccuucacaucaacaguacaugaugaaagaaugagacauuuuaaaauaauuucacaagacacaugaaagaccacacuuccacauuucaaguuuugcuucauugcucuagguucaucugucuuuucaaaacaucguuuuagagagcuccauuaaagaggauggaauucugaucaauucuagauugcuaagcuaaaucaagcagaauccaaauuugucauuaaagguccaugaaaaauucaaguucucuguaacuugcucccuccacaucagagcuacagucaacauacguggaaagauacagaucaaaggauggguaccuagaacauaucauauauuaagaguuuaccuuucucaacguuucuaaggaagccgauuauuuuuacaucaguaguucuugacugugauucaguaucuucuucuugaucuucaaacugucuguugcauucauauguuguugaauauucauucauuuuaaccuccaaagaugaaauuuuugcuucauucuuggacacucuaacauuuagaucaaaaagauuugcuuccacugucaaaauagcugcuuucauuccuuuaauuucauugauaucagcugauauuuuccuuaaaaggugggaaauauugucuagcucauucagugaacaagaggagcuuguuauggaaccuaaguccacuggcuccgguggaagaaaaauugguagagguggugauggaaacuuugaagacauucucauaaaggugacaggaaccucaaagacauuuucauaaaauucucucccuuaaaaucugauaauuuuuucuucacagcucauuaaguuauuucaucgaaaguaaaagcagugaucaaggcuguuaccuuaagacguauuaagagcaaauaacaucuuaaaaccuguaauucaaaagaugggguuguacauuucuagagucagaauucaaaacuaaaugugaaaaagcuaaacguaccagaccaauugcucuucgcuacaacuaagaagcccuaauacguagggcccuacauccucuaaguaccaucuguauagcuccucuuccaguaaacccuauuauuacauacaaaauaauccugguuucugauuggcugaaaacagacaugugucacacaaagaauuuucuauuauuuacuucauaugaugagagcacugaagcgcuacuuuauagguuaagcaauauaacauuaagugcuuuacaucuaaauaugauaugaauuaaauguacuuuucccuuuucaucaucuaaaccauaacauuuuuaagcuucagauuucugauuuguuuugaguuguauuuccccuugaaauuaguauauaacauuauugagagugacaaauccucuggagggaaagggcggagaaaguaacuggacccgugauccacacaaacuucuuucaagauacaugugguaaugacagaauucaacuucacuaauauaguaucguguaaacuuaaggauggggaaauaagaacucagccuuggcuuaauacuagaccauuauuagacagguguuucuuaaauauucucucccauuuuguugucuuuuuuuuuuuugauaguaucuuuugaaacacaaaaauacuaaauuuugaugaaguccgaguuaucuuuuuuccuuugguugcuugugcuuuuggugucauauuuaagaaaucauucuggaauccaagacauaucuauuuuuuucccuaagaguuuugaaguuuagguuuuugauccauuuugaguuauuuuuguuuaugacauaagauaagguuccaacuucauucuuuucauguggauauucaguugucccagcaucaccuguggaaaaaccuauucuuuugccaauaaacugucuuaacaccgcugccaaaaauugauggguugugaaaguaugcauuuauuucuggauucucaauuccgguccacgggucuguauggucauccuuaugccaguaccacacagucuucauuacucuagcuuuguaguaaguuuugaaaucaagcaacauaaccuugccaacguuacucuuuuucaauaguuuuggcuauucucagucccuuuuuauuuccauaugaauuuuaggaucagccugccgauuucuacaaaaaaaagcaauuugggguuuaaacagggauugaguugaauccauagaucaacuuggggacuacugccaucuuaagaauaguaaagacaucuaggcugggcguggugacucaugccuguaaucccagcauuuugggaggccaagguggguggauuaugaggucaggaguucgagaccagccugaccaauguggcgaaaucccgucucugcuaaaaauacaaaaaucagccaggugugguggcgcacgccuguuaucccagcuacucaggaggcugaggcaggagaaucgcuugaacccgggaggcagagacugaauaagcagagaucgugccacugcacuccagccuaggcgacagagggagacuccaucucaaaaaaaaaaaaaaagaauaguaaagacuuccaauccauuaacacagaaaaucuuguaagguccuuaauuugacaaaggacguuuuuacuuugguuuacuccccaagcaaacaaauaagauaugcaacauacaaggaugcaaguugguagaugcugcucacuauagucucuuaaaagaagaauccuggccuggcacagaggcccacaccugucauuccagcacuuugggaggccaaggcagguggaucacuugaggucaggaguucaagaccagccuggccaacauggcaaaacccugucuccacuaaaaauacaaaaauuagccaggcgugguggcauaugccuguaauuccagcuacucgggaggcugaggcaugagaaucaccugaaccugggaaggcagaggcugcggugagugagacugcgccacugcacugcagccugggugacagagugagaaucugucucaaaaaaaaaaaaaaaaaaaaaaaaaaaggaauccuuauaaagaaugguagucuuugguuucccaaauagaugucacaguaacagaauaaagaaaaugcuaagugcuggaauuuguaaaauaaaaaucuuuauucauuucuccacuuuaugaaucaguucuucaaaauuccagacagaaaauaauguucaaaauucaaggcuuuggauucacagacuuuuuuuuaacagaaccagcuggcauaugacauccauaguaacuguuaacagcaagacacucucagaaaagcaccaccugcaaaccagcugguucacuagaggacagauaaacaaccucaaggaaaaaagcaggaaagaggucuaacagaacgggucacagagaaacaagagcccaucugauggcacccauauggcccacuauguccagcccaacuuuagaauagaaaauaagcaaggacccuuccuaagacuccaguguaaauauucaucagcagagaaagcuuauguauuuuaacauuuacuccuaccaagaacucugaaguaaaugcuaccguuauucuucauuuauagauuaggaaacuaggguacagaaagguuaaaucaacuaguaaacugcagggucugcaccuucgguagucuggcuccuagguccacacucaaggacucucccaugauacauuaaguggaacaaaaaugucacagagaacucuggguaguauaauuccugcuuuauauguacaugugugugugugcguaaguaaacauguaauuccacuuuauauacaaagggugcacauguucacagauauaagaaaugccuagaagacgacaccaauacacaucaaacuuuuaagugcaguucuucccuccgagcaaagcagggggauuuuccauuuucuuugaauguaaaaucuccccuugacuaagaaucuuucacagugcuuccaguccaacacaauguaucaagcauauacaauuauaaucucuccuucugaagaguccauaaaagugaauuaaagaacuuaauaucuacaucucuacccuaugaucuuuggguuucuguucuuuuuuuauuuuauuuuccgagauggagucucacccugucgcucaggcuacaguggaguggcgcaaucuuggcucacugcaaccuccgccucccagguucaagcaauucuccugccucagcuucccaaguagcugggauuacaggcacccaucaccacacccggcuaauuuuuguauuuuuaguagagacggcgguucaccauguuggccaggcuggucucgaacuccugaccuaaugaucugcccgucucagccucucaaauugcugggauuacaggcgugagccaccaagcccggcagauuucuauucuuauguuuucuaauauucauaucaauacagcauguguacguaaguaaaauacauauauugguauacauacuuaaaaauggcuacuguacaaaaauuuucaggucaaaaauaugauggagaucacugguuuagagauggggguuacaaggugcagcagaugagaugucaacaaucucuggguaauagaaaauauauggacaaauacuggcuguaaggcacagcaggcaaaaccacaaaugagccccugugaaaacugcagguuagaugcaaggcaggagugacauuuacucagacaacaaacacugacugagcuccugcuacuauaugccagacacugcucugggcacucaguaacagccauacagaacaaacacauaaaucccugcucaaaaaggacagacucuguugagacggggaaggagguagcucucaagacccccaaaaaaauacaugcuaaaagaaaacaauucacguuaaaacauaaagaccuacguucggauaaaaauaccuaaacuacaaaaacauaaaauauguauuugauggugacaaacguuauggggaaaaauaaagcuucagaaaagagggaguguggggauggggccagagaaggccucaaagaugacacauggaugagauaugagaacauccaaaguaaacauucucaggagagggcaaaagcaucugagacgcgcagcucuuccaacguccugaaggacaagcaggccagugugcaggagcagcagcaagcacggggagccagagcagagggaggcaggugggugaugagaaggcagaacacugugacuuacagugugacagggagccccugggggguucuaagcugcaaaguagcaugaucuaauuuacaguguaaaggaucacugcugcugcugugugggauggacugaaggaaggcaaguuugaaagcaggcacaccuuguaagaacacacuauuccaauaaucaaguaaccaaggcaaaucacagacggugacuuuuuuuugccuuuuuuuuuuuggagacagagugucacugugucaccaaggcuagagugcaguggcaugaucucggcucaccguaaccuccgccucccagguucaaccaauucucguaccucagccuccugaguagcugggacuacaggcaugugccaucaugcccagcuaauauuuguauuuuuaguagagacgggguuucacuaugccggccaggcaggucucgaacuccuagccucauaugauccacccgccucggccucccaaagugcugggauuacaggcaugagccaccgcacccggccagacagugacuuugaugggugguagaggcagaagugauaaacgguagugaauucuauaaaucuggagguagaggcugacagguggaacaagggaaggagggagacagagguagagagggaagaggaaggaaaggagaaggagagaaaaaaagaauggcaacaggauucugucucagaaacuggaaaggugaagucaccaauaaacuaaaaugaggaagacuacaggaagaacagacaggagaggaaaauucauaguugagcuuuggacaaguuugaaaugauuuauuacaccuccaagaagaaauauaaagugguuggacagaaaugaggaauucagggcaagguccaggcuggagauauaaaaaugugagagucacagugcagagaugauauaucaagccuugaauuuggaugaaacaaagggccauccaacugugagagauugcagcaaugaguaaaaaccaagaaggauguaaggcagagaagaaggcuugugaaugguacugccagagacagacauuuaaaagacaaaauuuuaauauuuuuaauagacaaccaguaggaguguaagcauaccaaccugcucccccaagaaauuccucuacaacugcaaggccaauugcagcuccuugucugcuucauugaaagcuaaaccugccugcagaaaagcucagcccacagcacaauucuagguaagccucugcacuaccuuuccuuaaacuaggaaccacuaucugcagauguuuuugaaaaaaauuccauaaucgaaagagcaagaaaaaaagcauaaaaucugacucugacuccauuaauuagaagacaagagugaauuccuugaaaagaaaaaaaaaaucccuuuaauuaggaucuucagacaguugagaugauucuguauccacaaaguaagauacuaugaaaaauagaacaagaaaaaguuuguggaaauuaaaaaauaugcuugccuacauuuuuaaaauguucaguaaggagacuaaagaucaagucaagcaaguauucaagaguagaccaacaagaucaagucaaaaaucaagagagaaaaaauauacaacugacagauuaaaguaagggcuuaucauccaacuaacagaauuuccaccagagaacaaugaaaacaaggacagcaaauuuuaaaacaaauaaugcaagaguauuucccacacggaagagaaugaauuuucaaauuaaaaggguaccuaauguaccuaacuagcaucuagacauaccacagugaaauuucagacaccaggaacauagaaaaaaaaaaguucccggagaaaaaaaucccagguauuacacaauggaauaagaugggcaaccaaguucucagcaucaacacugaagccucaagauaaugaaacuaugccuucaaaguucugaagaaaaugacuucaaccuauaauucuguaccuagucaaaguaucaaacaaguacaaggauagcuucagauuuccaagaacucagaaaauuuaccuucuauacuuucuuaaggaguuucuuugugacgugauuacaaaacggagaaaugcacugagaagacaaaauggaauucaggaauugcagagccgacucaggggaggagggcgccucgggaugauggccuugagcaggccuagagcaagcagugaggucagaaaaggaggagagaggcuccaggaggaagguaccuaagaaaaagugggaaacccaaagauuucaaagcacagagugauaagacuuuuaggcuacaguacagguaggcaaugaaagaagggaaaaaagaagaaccuaagggaaacaaaaaagggggaaaaauuaaaaaaacucuagagaguucccacacaaaacuguacaagaaacagaauguaaauuuggccuuguaauauuuauauagucuuuaaaauuuuuuuuuuauuuuuagagacagggucuuggucugucacccaggcuggcacaaucacagcucacuguaaccucgaacuccugggcucaagcaauucuccagaguagccaugacuauaggugcacaucaucacacccagcuaauuaaaaaacauuaaaauauauauauagaugagggucucgcuauguugcccacgcuggccucaaauuccuaggcucaagcaaaucucccaccucagccuccuaaagugcugggauuacaggugugagccaccaaccaugcccagacuaaauagucuuaacaguguaaaugcuuacuguuucucaacuuagagucaaucgacuaagucuuaacuaaaguagggaacaaaauguaaauuugaucagcuuugacaauauaaaagaacaggugacaauuuagaagguggaggcaggacagaauguagguggcggcaagaaagaaaauauaagacuugaaagagaggccuggcaugguggcuuaugccuguaaucccagcacuuugggaggacaaggugggcagacugccugagcucaggaguuugagaccagccugggcaugauggugagacccugucucuacuaaaaauuuuauuaaaaauuccagguguggcagggugugccuguagucccaagcuacuaaggaggcugaggcaggagaaucacuuaaacccaggaggcagagguugcagugagccaggauuacgccacugcacuccagccugggugacaaaagugagacucuaccuccaaaaaaaaaaaggaauugaaggauacauaucuuucagaagucaaaauauacugaaauauaaccagacaagaaauauuuaaguuacuacuuaaaauuacuaaaguaaccaauaaaugaauuaaaaauugauuuugcuguaugagcuuggaagcaagggaaaaguauaaaugggcuagaaccugacauacagcaagaaaucaacagguacuaucuaguuggucaaugaagaaacaguauaaagcauauuauuacaacacggagaaagaaacagaagcauuuaaaagugggggauucugcggagugggacuaguauagagaagaaugaaguaaggaauguugcuuuuuauuuuuaaucuuuuuuauacuauuugauuauuuucucaucuaucaggagauauuacauugauaugcuuucuuuuuccagauuuucuauggugagcauguauuucauaaugcauuuuauuucaaauauaugggaugcuuccauacauuauaccaaacaggaaaaauaaaaggaaauccacgccuagacacaucguagugaaacugcagaacaucaaacacaaagagaagaucuugaaagcagccagagagaaaggacagaucaccuacaaaggaacgacagacaauuagaaugauagaaguccacucaacaauggaaagcagaagacagugggauaauaauauauauaagguguggagagcaaauaacuaacaaccuagauuuggguauccagcaaaacuacugcacaagaacacaaagaaagaaaacacucacaggugaauagacucuuggaaaauauauugccaacagacauguuucagugaaacuuccaaaaaaauacuucaaaaauacuucaaaauauuggaaaauaaugauccccaaauaacacucagagauguuaagaauaaguaaaaugauaaacaggagguaaaccucaaaaaacauugccuggaaaaaauuacaaaaauguuguccaacuuguguauuuuauuuuacuuauuuuuuuugauaaggagugucgcuuugucgcucaggcuggagugcagcggcgcaaucucagcccacugcaaccucugccuccuggguucaagcgauucuucugccucagccuccugaguagcugggacuacaggugugugccaccaugccuggcuaauuuuucuauuuuuaguagagacaggguuucaccauauggucaggcuggucucgaacuccugaccucaggugauccacccgccucagccucccaaagugcugggauuacaggcaugagccaccgcacccggcccaacuugugcauuuuaaaaaagaucaaauugaaacacuggaaacaaguaaaugaggaggauaaagacugaagcucuucauagguauucaaaaguccuuuuacuguuugagaguggggucaggauauuaacuuuuagaauacuaaauuaaauuugugugguaaaauuucacugguaacgacuaaaagaacagaaaugaggccaagcaugguggcucacaccuauaaucccaacacuuugggaggcugaagcgggcagauaacaaggucaggggaucagagaucaagagauugagaccauccuggccaauauggugaaaccucgucucuauuaaaaauacaaaaauuagcugggcguaguggugggcgucuauaaucccagcuacuugggaggcugaggcaggagaaucacuugaaccaaggagucggagguugcggugagccgagaucgcgcuacuacacuccagccuggcaacaaagugagacuccgucucaaaaaaaaaaaaaaagaacagaaagggaagguuuaaacaguaaacuaguuuaaaauuguagaaccaggguuaggguugucaacaauaacaguaauuaaugaaccuuaaaaaacaugagaaaaaacagaaaagcaggcaaaugcaaaucagcaaugaugacagaaaguaauccaacuauaccaguaauuguaauaaaugugacuggucuaaacucuccaauaaaaggcaaacucagaugagauuaaaaaacaaaauccagcuuuauaauauuuaagauauaauauauaguugacccuuaaacaauaugagggcuaagggaaccaaucccccaacaacaguugaaaacccacauacaacuuuugacuucccaaacauuuaacuacuuacuguugccaacguagcugcaguggcagcuucauacauuuuuuucuuuuucuuuuuuuuuuaaccaugguucuuauguuaaauucauuuauccagaaauggugaauaacugcagccacaguuguaacauguaucuuugguacauacugagcaaugguuucuuguaaugucaugacuuuucucuacuucuugggagcauguccagcaucaccaguagcacauuauggguccccugguguuauucaagguuuacaguauugcacuaaacaugaugaaaaauaugcaagaacugcgagaucaccuuucacugcaauucacaauuuacuggagagcugaacugucgcagagaugguugcaucacacagcauuuuaaguggacacucaaaacaccuuagcuuaccauaaagcaacaggagguaacuacaaaauuauuacaguaguacaguauguacuauaguaaaucuuauguagcuauuacugcaucuuuauguuugcuuacauuucucucaacuacaagcgguaucauguaaagucuguguuugugugcauauauuuugauaaauuaaacuucauaauagauguguauguuuuaagauaguaaauguuagucuaguagcuacauauauuuuauguguucaugacauaccuaaauuuuucuuaauuuugucacuauuucuaggcuauauaguuuaucuacaaguuuuuucaaauugccacaucucaaaaaauauuuccaauauauuuauuuucaaaaauccacauauaaguguaugaguggacccacacaguucaaacuugucugguucaagggucaacuguauauaccuaaagcaugagagagaaaacugaaaacaaaggcagggaaaccagauauauaaagcaaauauaauuaaauggcuauauuaauaucaggcaaaacugacuuugagauaaaaacaucuuuuuugcagagggucauaaaucaagauaagggauucaauuugcagagaagauauaacaaauuuaaauauguaugcaccuaauaguauauaacagccuaaaaauaaagcaaaaacuugauauaaguacaagagaaauuaagauaaaucugucaucauguugggcaauuucaacacccuuucucaagugguaagucaagcagcacaaaaacucagcaaggucaagauuugaauaauguuaacaguagagcuuuaucuacugaauaaauguaaaauuccccauccaauaauuaguccacuuucuuccaaaaugcauguggaagaugcauaaacuugauuaugcacuaagcaaguguuaacaauuuucaaaaacuaugcauuguaaaaauuacauuaucuaaccacaaugcaauuaagucaggugucuauaauaaaaaggauuaaaagacaaaaacacauaccacuuccaaauacuguauagaaaacacacuuucaaugaugaaaauuauaauggaaauuaaagacacucugauaaugaaaacaugaugaauuaaaaccugucauauguauucuucucaaaugcuuacauuugagaagaagacagccugagguaaauaauuuuuaaaauauggaaggauaaauuaaaagagaagucgggccaggugcaguggcucacaccuguaaaccuagcacuuugggaggcugaggcaagagggcugcuugagcucaggaguuccagaccagccugggcaacauagugagacuccaucuuuacaaaaaaacuuaaacauuagcugggcgugguggcgugugccuauggucccugaggugggaggaucauuugagcccaggcauuugagguugcagugagcuacaauugugccacuguacucuagccuaggugacagugagaccucgccucuuaaaaaaaaaaaauaaaaaaaaagcacaagucaaugaaauagaaaacaaaaacaccaaaaaaaaaaaaaaaucaauaaagccagaauaauguuguuaagucuuugaaaagaucggcaaaauaaacuucuagugacagacugauggcaagacaaaaagcaaaaaguacacauauuaugaggugggugcgcuaguaaaaauaaagacaccagagaaaugagagaaugcuaucugcucaaacaaaagaagaaaaaaaauuaacaacuuaugccaauacgagugcauguuuauauuuuaaaaaccugccccagauuauaccguacaacagugaguaaccacauuaacagauaacaguugcuugcaguaucacuucacacuugugaauauaucuaguaauaccaaacuccucaucagcaaagguaccugacaccauuucaauuauccccuuuuaaaacacaguauagaaaaccacacaaacauauagcuuaaugaauuuuuguaaggcaaaacacccuucugacuaccauccaagucaaaagagagaacgucaucugccaccccagaagccucucugugugcuccaucuuuaucgguccucuucaaaagcaaccacuaugugcuuuuuauauuaacgccuagagguucuuuauaauuucacacacacuggguaucccuagccacuacaauuuaauccugcuccuuuuauuuuccuuugauuugccuuuuaaucucaauuucucaggcuauucaacccacagugucccaaacacuauuuuuccggcugcacacucauggugaagcucaaccaacauacuccucuggccucugcaacuucuugcaaacugacugcuggacugggagcuugaugacuuagguuuacauuuuuggcaagacaaaaguucuguucuuuuguaucaagaggcacaaaacaacugguuuucacucuuaaaagcauaacucuaauccuaccaucuuguucucuuaucagcugaaaucauuuuaaaagaaaauguuucucucaucuacuauaucagagguuggcaaaucuuuuaggcuauuuuaggcuaugcaagcuauauggucuguugcaacuauucaacuaaggcuguaguaugaaaguagccacggacaauacauacaugaauaggcacgguuugguuccaacagaugccaacuccuguccuaugggguuacccagugguaucguucucacagaaaagacagcauaaauguucaauuauuuuauuuacccaguuuucaagacaaugaaugauuaucuacuaccuuccagaaggugacuaguuagagcuuauuuuuuuaaaaugucauuaugaaauuguggauuuaaaugggcuuuaauucaccgcgauauuuacaccuacugaaucucaaauaauuccauuuuuggccaauggaaaccucuaaguuggcgccugcauccuuuggacguggucuaccauucauugacagcuucuuugcuaucugggauguugagccauuccaggaucauguuaacauuuccugccccagaccuggaaaaagacauuucucaagaagccuaguucuuuguuuuuuuauuuuuauuuuuucuugagacggaaucucacucuguugcccaggcuggaguacgguggcacaaucuuggcucacugcaaccuccgccucccggauccaagcgauucuccuggcucagccucccgaguagcuaggacuacaggcgcacaccacaacacccagcuaauuuuuuuguauuuuuaguagagaugggguuucaccacacuggccaggcugcuuuugaacuccugaccucaggugaucugcccaccucggcuucccaaagugcugggauuacaggcgugagcaacugcacccagcccaagaagccuaguuuuuuaaauaggaaguauuccaagaccacaaucugggaacuacagaugaugcuaaggguugaugaauguuucuaugccuucuaguagacagaacuagaaaaaaauguauuuauauauaaaauacacugugaguuccgaaacauuuccaauguaaauucaggacaacaggcuuuuacuugucugaagcucauccuccauuagauuuccuaagaaaaguucaugggaaugagucucugaauuucugcauauagauaacaguuggugcuggaucacuucuaaaggucacuuuugcuggacauuaaauucuuggcucacauuuucuuuucuggaguaucuuaaauaugcuaguccauuuucuuccagcacaaaagugaugcuguugaaaaguuugaugauaaucuaccuuuccuuuucuucuaagucaugugccccuuuugccugaauguccaaaucauuuuuuuucuuuuuaaaauuucauuaauuauauaauacaucuuaguguuaugguucuggguaaauauucucagguauacuguacaauuuuucagacaacaguuucaaacauguuuucacuucaugaaaguuuucuugaaagacaguuaauguuugcucuguuccucugaauauuguuucuuuggagauuccuacuauaaaaacacuguauuucuauugccuauuaucaauauuugccacuuucucaugagcccuuuuagacuuuuaaaauguucuugucuuuuaucuucaauuucucugaagauguuuuaauuuuauuuauuuuuaaauugcuguuuucuguagccauaagguuuugcuauguugcccuggcugaucuucaacuccuggccucaagugauccucccgccuuggccucccaaauugcugggauuacacgcauguuuuauuuuauuaagacgcacuaauucuuucgaguucuuucuaauuuagucuucauuuauuuugagacacagucucacucuaucgcccaaacuagauggcaauggcaugaucauggcucacugcaaccucagccuccugggcuccagcaauccucccaccucagccucccuggagggcaaugguaugaucguggcucacugcaaccucagccuccugggcuccagcaauccucccaccucagccucccgggcuccagcaauccucccacuucagccucccaaggagacaggacuacagguguauaccuugcccagcuaauauuuuuauuuuuugucgagacaggguuuugcuaugcugcccaggcuagucucaagugauccuccugccucagccucccaaaguguugggauuacaggcaugagccacugcacccagccucaaaguucuucuguuuuauguuuuucuuggcuuugucuuguauuauuuaaauaaugucuucuagcucacuuugaaauuguauuucuuuuugguauaccuuucagcaugcuuucauugaaacaaugcuguuuugucuuuuauucccuuuuaucuuuuaauucggcacaggacuugaccuugauacuuuucuguuguucauuuuaggggaaaguuugcuuuggauagcuauucuaacuucagaaucaacaaccuucuucuguugauuuugugauguuaaaaaauauggcaccuugcuuugagauuuccuauuguuuuccucuccuauuuuuaucugacauucuuuccuuuucucuauugucuguuucccugcuccaucugauuccacuccaagacucucacguagaguccuguguuugaagaaaaccuuggugcaacacacuacagacuccacagggaguagaccacugcaguccuuuuagaucagccucaucugccacugcacugagcaaaaucccuccucaguuucagcuccucuucucaauuuggcccauucacauuuuccaauugguaccuaucugcuguuuggggaccaaacaggucuuguccucaggccuaucaauuaucagaauaguauauaacgcugucauggcaaacugaacaauacagucaaaaauuuuuaaagagacacaaugaggaaacaaauacagaauugacaauucugaaaucauaagguuucaugaaaccuggaacaauuuaaaggacaguuuugaagaaaugaaaaaauauauuccaagguucuugaaaaguaugugagaaauaacauaauaagcauauagauuuuuuugguggggucuuaaaauucaaaucuuaguagaaaaagaaacagaagaaaaaagaauccuucuugacgacaaaagagacaaaaggucugaagagucauggagaagggcugugcaggcccaggggucagauaacagacaccaaaaguccaaacuaauagcguuaguucuggguaaugaggaggaggggagagauacuuucacaaaggagucagaagaugagagacacacuuucaaagucaaaagauuguauaggaauugggggagaaagcugagaaaaaagcaaaaaaaaaaaaaaaaaaaaaaaaccuggaagcaaacugaaguauguuaggcacgaggggauaaauuaggguugcugggacacauaugggaggucagagacaggaugcuuaagagacgggagauuuaaagguaacuaaaauuucaaguucagguaaacgggcaggaucaacaaaaagagaaaaagaaagaaugcagaaauaaauauaucuuuaagaaggagcuaucuaaagaccagcaaaauucugauaauaacuaaggcuuaaugacuggguucaugagaguucacuguacuagccuuuccauuuuugagaauauuaaaaauuuccacaauaaaaagacuuucaaaaauuucuagaaagggcugggugcaguggcacacacuuguacacaccuccagcuacuaaggaugcugaggcaggaggacugcuugagcccaggaguuugaggacugccugggcaacacagcaagacccuaccucuuuaaaaaaaaaauuuuuuucugaaguguugguaugaaccuuccucaugguauucuucucauucuauuucugggcuuaaucaucacuuuuuucauaguguaauauuucauaaaaauccauuggaaaauauucaaugccucaugaaaaaacuguaguaaagagugaaacaucauuuaaguuauuaccuugauuuuuuucuacagaaucuccuuuuguuuccucuucuuuaauggggggacuuauucuggggguccuacuuugucccuggaccacuucugcuagcaauucuucuugagaaguucgaguucugggagcaacuggaagugucuguuucuguggaacuuucacauaaaagcaaaaaagauagaaauacaaaugcaguaauacgucaaaacuccacagugacuaugucauauuaaauauaaaugccuccuuugguuuaggacauaugaguucaggcugggcgcaguggcucaugccuguaaucucagcacuuugggaggcaagguggguggaucacuugaggucaggaguuugagaccagccuggccaacaugguaaaaccucguuucuacuaaaaauacaaacacuagccgggcauaguggcacacaccuguaaucccaacuacucaggaggcugaggcaggagaauugcuuaaacccggaaggcggagguugcagugagccgagauugcaccacugugcacuccagccugggcaacagagugagacucugucuccaaaaaaaaaagaaaaagaaaagaaaagaacauauauaugaggaguucaauccauagauaccauucauuuuuucuuacguuacugagauagauaccugaaccuauuuauccaaacauauguaaacaauauccauacaaccacauaccaugaauacaauauaguacauauguauucauuuucaacaaaaugcgguuuauuuaagcuuagcuucaugaucuuauaugaguuucaaauuguaauuuagauaaccuagguaaagaaagaaaauuucaaagucauggaacuucucuaaacuucucaucauucuagacaauuaauauugcugauagaucaggaaaugaaauguagauauaucauuaggucaagagugcgccuuugccugauaaucuuuauucuauaugccaaaaccuguugaauuuuguguucaagguuaaauuagggaugaggagaaccaagaggacagacaaguaucaggaucaaaaacugauggugccaggcgcgguggcucacgcuuguaaucccagcauuuugggaggccgaggaggcaggugaucaccugaggucaggaguacgagaccagccuggccaacaugguggaaccccgccucuacuaaaaauacaaaaaaauuagccuggcaugguagugggcgccuguaaucccagcuacuugggaggcugaggcaggagaaucgcuuggacccaggaggcagagauugcaguaagccaagaucacaccacugcacuccagccugggcaacagagcaagacuucgccucaaaaaaagaaaacaaauaaaaaaacugauggcuacaguuuaccucauuuuaggaaggggggucacaaaaaaaagcgagagaguggauaagcagggcaaugcuguaaguacacccaccaaauccacagcaaaacuuaaaucuuuuuagaguagcucauuaccaucagcuucuuaacacaaguuuacacauuggcuacaacaggucggccagagaguacagaauuugacaacacaaaaugacacccaucaguuguuugcauuucagaaucagcuuuccguaagaccagcuuacagcugauucaucuccuguuuugaaaacguaauacuuuuauauucucucauaaaauuauucaguacuuccacuagaauuggagcaggaacaucacaaaugagucaauucucugccuuauauucuacuaaugaguuccgccaaaagggaagaaaccaaccuuguuuauauacuacuguuuaacaaauuucuauaacuucagauaccuaucauuguccaauuguacuccccuuuacacaucguaaauucauaucuaauguugaaucuaaugcuacuaauaugaaaguccuacuucaucaaaauucucuucaaaauauuuacguacuauauauuuuacacacauuggaaagauauaaaaggcauuauauggugcuugaaaaacuacaguccaauaacaguuggcgaaguuucucaaacuugucaauuuccuuuuaaagccauuuuucuauaugggaaccucaucuuggucuugacaucugacaggcaccuuuauuuuacaauuuaaggagcaaucauuuucaccuuacucaagaauuacagaaaugucuuaccaaguguaaacauaauacauuuaaauuaccuguagaguaguuaguuguuuuuguuacggauucuugagcuucagauauagccuucaaaaucagauucuuguuagcuuguuuagaagguggaagagaaggucuaaaagaguuaagaaagguauuuuuauuaaacuuuaaauuucaguuccucacaggccagccaucuauuaugccuuuaccacaaccuucucuagguuuuaaacagacuagcugcaguuuuuagaaaaugccaacuacacuggaaccuuauuuuuuuuuuuagacagacucuuacucucucacccaggauggagugugaugucacugcagccuuaaacuucuaggcucaagcaaugcuuccacauccaccucuccaguccaggacuacaggugccugccacaaugaccaacuaauuuauuuuaauuuuuuuuaagagacaaagacucauuacaucgcccaggcuggucucgaacuccuggucucaagcaauccuccugccucagccucccaaagugcuagguacaggcaugagccaccaugccuaggccccuuuuaguuuuuuuaaauaauaaaucugaaucuuaauugauguuguuccuccucaccccaccauauuagucaauauucucugcaauccucuccaauguuaagcaauuucucucauuaacguguuucucaaaacccaauggaaaagucuuacacgguauuacauuaaauauuuaugucaggugcgguggcucaugccuguaaucccaacacuuugggaagcugaggagggcagaucaccugaggucaggaguucgagaccagccugguccaacauggugaaacaccaucucuacuaaaaauacaaaaauuagcuggucaugguagugcacaccuauaaucccagcuauucaggaggcucaaucaggagaaucacuugaaccugggaggcagagguugcagugagccgagaucguggcacugcacuccagccugguugacagagcgagacuccgucucaaaaaacaaacaaaaauuauuuucgugauuauucucuucaauaaaucaggaagacuccaccaaggcaguuaaagauuaauuuacagccauguucaagguaccuccuuucaggcuuugcaggcacagacacacugcuggagaugcuuccuguucgagacccguaaucaucaucuucuuccuccucuucuccaucaugauugaauuuuuuuacuuuaacaacugaacuuaccacaggcaacuuucucuuccgaaaguuuucauccugcaaucagauaaaauuuaugcuuaccuaaucucagaaaauaacaagaguucuaccacaaaauguuuccauuuuaagaaaaaaacaguacacaguaauaugagaaauucacagaguauuucuugguuuuauguaaaaauauaaauaugaggcugggugugguggcucacaucuguaauccuagcacuuuggaaggccgaagugggcggaucacaaggucaggauuucgagaccagccuggccaauauggugaaacccugucucuauaaaaauacaaaaauuagcugagcguggcggcaugugccuguaguccgagcuacucgggaggcugaggcagaagacucacuugaacccgggagguggaggauguagggagccaagaucaugccacugcacuccagccugggcgacagagugagacaccguaucaaaauaaauaaauaaauaaauacuauaaauauaaauauuaucccuaacagucaaccuuuagcuaaaacaaaaauuagaacuuuacauuuauuuuaucaacagcugcauauagugcuauugaggaaacuaauaaaacagaguuaauugguugcucacuagcaauuaccaugaacaaucuaaaauugauugaaaccccccaaauuaauuuaagauuaauaucucaaaugcuggaaaucccaaaaagguauacagaugugauacaaaagaacucuaggagcaagccauggggaagaaaaucugguauagcaugagaaacagcagauaaaacaauuuaaaaauaaacuuggggccaggcgccaugguacaugccuguaaucccaacacuuugggaggccaaggagggcagaucaccugaggucaggaguucaagaccagccugguccaacauggugaaacaccaucucuacuaaaaauacaaaaauuagcuggucgugguaguacacaccuguaaucccagcuauucaggaggcugaaucagaagaaucacuugaaccugggaagcacagguugcagugagccaagaucaagguggguggaucacagggccaggauuucaagaccagccuggccaacacggugaaacccugucuuugcuaaaaauacaaaaaauuagccaggcaugguggcggguaauaccagcuacucgggaggcugaagcaggagaaucgcuugaacccaggagguggagguugcagugaguugagaucgcgccaucacacuccagccugggcaacaagagugaaacuccuucucaaaaaguaaaauaaaauaaaauaaauuuggaauauguguuuuuuuuguuuuuuguuuuuucuuuuuugguugagacggagucucgcucuguugcccaggcuggagugcaguggcacgaucuuggcucagugcaagcuccgccucccagguucacgccauucuccugccucagccucccgaguagcugggacuacaggcgccugccaccaugccuggcuaauuuuuuguauuuuuaguagagacgggguuucaccguguuagccaggauggucucaaucuccugaccucgugauccacccgccucggccucccaaaguccugggauuacaggugugagccacugugcccagccuuggaauauguguuuaguuacuucauauauuauuugguaucaagaacugccgauuuuuagccuaagccagaauuuaaaaguacauacaaaccuccauacucauuuucuccgaguuguuucuaaagaacggacuauacguuucuucuaagcuguuaagcaccucugguucacacaaacguccuguuucauauacccaacuacucugcauaucaagcugcuuggcagcaugaauacuauucugcugcuguugaaauugcaaccuguuuaaaugaacaccacuaucugcauuucuacuugcagguggucgauaaauuucaauagaagggcgagaagaaccauauguaagugucacuguagguuuuuucugagauaagggauucuccugcacaaaguugaggucuucgucaaugagaucaucugguucuggcuuaauaucaaucacaucuucagagggugcuggcucccucaaagguuucacuguugacauuagucggguugcagcuccaucaucguaagucugucuauuuaaaagaacaacaaaauguauuacagccaaauuagggcaauuaucaccaaaucuuuaaagaauguuuacuugaaaaauuucaaugaaaaaacugaggauacucccuuuacauauuccauucaaaacugcuuugaaauugcacuuucuuucaacuuugauuuacuaaauuugugauaaaagauaaucauacuuagaucuuauccauuauuuuauucaaaaaacuacucacgaucacuucauuguuucuaaaaauugcugagaacagcaaacugaaagauauaaaaacuaauauaaaugucacauacacagagccaucugcccccagcaggucuacaccagacucuuaccugacauuugugguuuuugacuccugcgaacuuguagaaacucuggaaucucuuuuuucaggucucgcgcuaggaauggcaagugguggcacugcagcuucaugccuccucucaucuccccgacugaaauugcucuuguuugaaggcacguuacuaucaaagauguugguaucagaagacuucagacuagaggguucugaaaagaaaaauacaguccuuuuaaucuauuuuuauuucuuauuuuuauuuauuuauuuauuuuugagauggagucucgcucugucgccaggcuggagggcaguggcgcguucucggcucccugcaaccuccaaaucccugguucaagcgauucuccugccccggccucccaaguagcugggauuacaggcaugugccacgaugccuggcuaauuuuuguauuuuuaguagagacggagauucaccauguugguuggccaagauggucuccaucuccugagcccaugauccgcccaccuuggccucccaaaaugcugggauuacaggcgugagccaccgugcccggccaucuauuuuuauuacuuuaagucguuuccuuccucaucaccaauucaaaagcaguauguuuauuguagaaaauuuuaaaaauauaauaaaaaucaccaauuaucucaaaggugauuuuucgggggaagagcauauauacacauuuuuuaaaacauguaucuuaugcguguauauucuguuauucuuccacaacauuauuuuuaauaguuaaauauuauuccacacaugguaauacaacaauuucguuuauuaugacugaacuuuuaaauuguuuucaauuauaaaauacugaaauauccuugaggcuaaaucuuugcacauauauguaauuauuuccuucggauaaagugcacugcucccucucccacacuuaaauuaucuuugaauuauguuaaauuuacugcucuuaaguucauaaaaguaugugcuuucuaaaaaaguucaaaugaaccguuuugaaauugauggguuuuucccaaagcacuaugacuuuagaaagaaacaaaucauaugccauagcaagcagaaauuaaaaaaaaaaguuaugaaucuuaccaguuguaacagagcgaaguuuaucuaauacaccaugaagccugaggaaaaaaacaaaaaacaaaaauaaaccuucuguuaagaaagauuucauuucaacugucacucuaaauuuaugacauuauauucagagauaauuuuuuaaauuuuuuuauauuuuuauuauuuuuaaauagagaugggguuucacuguguuguccaggcuggucuugaaguccuggacuugagagaaccaccugccucagccucccaaaguguugagauuacgggcgugagccaccgcaccuagcugagauaaauacugauaaacuguauuuagugaauaaaugguaugaacuuucaaacuucacauuuuuaaaaaagggcuuuguauaaauccuacagaagucaauaaaaaauuguauuuuuuucuucacuguuuucaacaucuagccucugcaaaaauaugggaaagaauaucaucugaccagucuuagucuacaaaauaugucacccuguuuguaaguacuaaagauuuacuguagcuuacaguaaaacaaguaucauaaacauguaauauugcuuauuauuaccaccauuuaagcagcuuauauuaacugcuuaaacuagauggugucuuggacaacuuaauucugagagguuaaaacaaguuauaaucucaaacuaugcuauaucauuucacucuauuacuuucaaaacugaugcuguaaggcuguaaucuugcuuguaacauaaccuguuuugguaguuauaaaugagguacuuugccuuacaucccuucccaguaccucucaaaauaugccagaaaccucauguuucaaugagaacccuagucacaugcuacuguccccacggacacaauuacuucaaggcuccaaauaaucacaauagucuguuuggggcugguguuaaugaacacuaacuuaagaaagcaaagugccaaaauggggacaucacccuuugcuucacuacauguuaaagaacucaauuuauggccagaugagaauguugaauuaauuugguuuuaaauucauuugguagucuguuuuaaaaaucuaaguauucuaucaaguuaucggagaaaaggaucuacucggucgcuuuagaaaaaaaaauaguacucacaauaaugguaauuuucccagucaaaagacccacagucuuuuuuuguggggggcugggagggaauaaccucuggggacaaauuguaacaaauggguugggucacccacagugaggcagcaguguaucauaacaacugaugaccacuauacaauguucuucaaauuugugcaauguauaaacccagagaauucugugcagaauuucaagacgguugauaagcauacaguugccuacuugggcaaaaacaccuugaagacgaccuuugguauaaaggcaagaacuuaaccaggcucaucuccccacucagugccuccucuugcacucaaauucggcaggccacuugcucacuucugcuacaucaucaccuuucacgguaacugguaguuccuagccugagaagccuaauaaaguauuucgucugucuauucucagcuacaucauuauccuccagcccucauccucacuuuaccucaaaccugguaccaggaccuagcaucuuaaguugaaucuuacucuucuagucaguauucucaacuaaaggcauauaacaguaauuuauguauaaaagcaaaguugccuauuuuaaaauuccaaacuuaaaaaaacuuauaaucucaaaauaugcuguaacauuacacuacaauuauuacucaaaaugaaggugugaguuuaacaaaaagcuuaaaaaguaagaaacagaaaagugagaaacagaaaaccuugcccucuaaagguaacucauuguaaaaggcaauguaagaagccaacccaguucaaaaaaacaucuguaacugguuuuggugggggaaaaggaacuauaagauacagaagcuggccaggugcaguggcucauaccuauaaccccaagacuucugaaggccaaggcaggaggacugcuugagcccaggaguucaagagcauccagggcaacauacuaagacccugucugaacaaaaaauuuaaaaauuagucaggcaugggaguucaggaaggaggggacugcaaugggaugaucacuugaaaccaggagaucgaggcugcagcgagccaugauuguaccacugugcuccagccuggugacagagcaagacccugucucaaaaaaaaagauauagaaguuuacaaaagaaacauauuaaguauagccgacauauacuaagaauuccuuaggaaaaugcuagggacaccuauaaguacuuuacacauauuagcccauuugauccucaauaauaauuuuauaaagcaaguggcuguacuauuuccauuuuauagcuagagaaaccaaggcaagacacagccaggauucaacuuuggcugucuggcuucagaggcugauaagguuuggcucuguguccccacccaaaucuuauauugaauuguaauccccaccugucaagggagggaggugacugggucaugggggugguuucccccaugauguucucaugauagugaguucucaagagacagugaguucccgaguucucaagagacagugaguucucacaagaucugaugauuuuauauaagucucuggaaguuccuccuucacucuucucuuuccugucgacuugugaagaaggugcuugcuuccccuuccuggggccuccccagccauguggaacucugagucaauuaaaccucuuucuuuuagaaauuacccagucucggguauuucuucauagcacugugaaaauggacuaauacagaggcugugcucucaucacucacaaacugccucuccaaaguaaaccuaacucaagugucaagaaccucucuuuggacagaauaucaacucaggcuugugccaaacuuuggucugaggcacaaaaauucagaaacauaccauacggugaaucgaauuguguuguucccuagaaacagggacagauccucugucauuugguccugacuuuucuuguuggccaccaucaccauaauguaaucaggaaguucuucaucuauuuaa

SEQ ID NO: 19194 - RNA, 8387 nt, Homo sapiens
ggcugcggaaaggggcugggcuggguugggcugucugcagcucuaguccaggaggcugagacuucgagagggacuuagagaaggcagacgcaucccgaacucgcuggaggacaaggugaggggcguugauauugggguuuuauggaggucagacagugguuccagaccccucgaacccauagccaggcagaugagcaauucuuacugcaccacugcagcugaagcagaggugaccuggagugggguguaggcaaugaggacgacugagaaaguaguaggcuguacagacugggagcagagacuagcggagggaggaggggagaaaaacggggaaccaggaauguugggagggggacgaggaauacaaggagggaggggaacacugagggggagugaagauccagagaagagaaucggggaugcagagagggauuaaggaauacugaggggcagggugugcaaacguaacacggaggaggauguaagaaaugggaagaaggaauucuggaguaaauaggaaaugugagguaggaauagggaguagggagccaggcuaagggaauacggaggggggcauaaggaaugaggagcagggagcgggggaggggcagacaggcugggacggaggcccccuagggaggcggaaaggggcgggaccacuuccggccuagagaggggagggcagucuccgaguuucggaggggcuuggagugaguggacgcacucgggaauuguaggaggacgaggugagcagccgggucggcuuuuggaugagagccccgcuaggggucggccccacccucugggaucuggagaaaaccugccuuaaggaccggaucguaccggauccauccggcugggaagggaggggacuggacccgguuuggccgggcccaagauggaaucacuagcucaguauuuauuugaggaggggguguaauagggaaggggcggaaccaagaugcgccuguuuggaggggggcguguuaggaagaagggcggggccaagagacacuggacucuguagggcgugaguaggggaggggccggguccaccagacacugcgacaauuuuggaggaaggcuuguugggcagggggcgggaccgaaugguacugcggaccuggagaggggcguguguuggggcagagugccagacugagaccacgaccauugcgcaugcgcacuauguuucgcuagaaaggggcguguugagaagggccagcacugagaagagccagcugcugaaugcgcaugugcacgguggacaucaaagaaagggcucgugcugggaaagcgggcggggcugagagcggcccugcagccgacgcgcaugcgcucuaucgaccugcggcuggguggggggugcacugggaaaaggggcgggguccucagagcugccgcgcuggcacaucuuccuggagaaggggagggugcggcugcagagaauugagacuuagaagcuuugaauuccuguaucugagaacggagucguugggggugguggaggggguuggaauuggggaccuacggaaggugaggaucagccuccaggcacaacaggggagaggacguucagugggcuucaacuugacccaggccuucuccccuucaggcucagcucuugccaggccaaauugagacaugucugacacaagcgagaguggugcaggucuaacucgcuuccagguaaggccucuuucuguccuuuccccagcugcuuuuccucuccagcccuuguugcugcccccaagucccuuggcucuuccccucccauccuuguccuucuccaccuacuuuccugccugggugucccccugcccaguggagggagggagagaaggugggcgggccccucuucugccaucaguucuugcucagaggaaagggaggccuuguugggcugagguggucagagcacaccgcagguaggagucaguacaggucagagaaguguggccuuggaauuuuggagccauuugcuuaguugggggugaggagaaggucuaugaacuucccugcuuccucuugcaggcugaagcuucagaaaaggacaguagcucgaugaugcagacucuguugacagugacccagaauguggaggucccagagacaccgaaggccucaaaggcacuggaggucucagaggaugugaaggucucaaaagccucuggggucucaaaggccacagaggucucaaagaccccagaggcucgggaggcaccugccacccaggccucaucuacuacucagcugacugauacccagguucuggcagcugaaaacaagagucuagcagcugacaccaagaaacagaaugcugacccgcaggcugugacaaugccugccacugagaccaaaaaggucagccauguggcugauacaaaggucaauacaaaggcucaggagacugaggcugcacccucucaggccccagcagaugaaccugagccugagagugcagcugcccagucucaggagaaucaggauacucggcccaaggucaaagccaagaaagcccgaaagguaagaccucugcagucaccacccuugguuuucuacuccucucucaguugauucauuuguucuacaaacauuuagaaagaucccugugcucaucagggcuguggggggcacugagaguaaugugauguaauuccugucuucagagagcuugcagacugauggggaggugcaaucugaauguaaugcaguuuauguuuacauaguagcugcccuguauuaggccuugagcuaagcacauuuaugcagguuaucucauuaaaucuugaaaguaauucucauagccccaauuuuauggagaaggaagcugaguuccagagaggugaagcggcuugucuaggaugguucaagcagagccaguagugggcacagaaagagaagaagacucagccuccacccacccuugguuugcuccuggccugcuaggcagaugaaacaccugcuuggaagucagugagaaacaaauccaggguucagcauggccaacaucuauugagucaggcuguuacuacaggggugggauuagcgggugcuuccuggaagagauagggagaggaaaaggaccacuugcuucaucuggugacguugagcuuccucucuguugaugcaggugaagcaucuggauggggaagaggauggcagcagugaucagagucaggcuucuggaaccacagguggccgaagggucucaaaggcccuaauggccucaauggcccgcagggcuucaaggggucccauagccuuuugggcccgcagggcaucaaggacucgguuggcugcuugggcccggagagccuugcucucccugagaucaccuaaagcccguaggggcaaggcucgccguagagcugccaagcuccagucaucccaagagccugaagcaccaccaccucgggauguggcccuuuugcaagggaggguaagaacucugucguuuuuauucugccuuuucuacugccuuggcuguccuuuucuuugccaucgucucaaguuuucugcaaacuuguuuuggucuuuccaucuuuuucuacucugccaggcaaaugauuuggugaaguaccuuuuggcuaaagaccagacgaagauucccaucaagcgcucggguaaaguccuaccaauccucccucugcccugagcucugcccuccauugcccuuacaccauugugcuggggauauccccugcucuuaugcuuaugucucuguccucccaaaguucugauuuggcagugcuagcaucucuguugauaagcacagaaccggguuaugccacccuuggugugguuggcaaagagucuauagcuugggcaucagggccaccuggcaucucuucagucaggugcucacaacacucuccccuugcagacaugcugaaggacaucaucaaagaauacacugauguguaccccgaaaucauugaacgagcaggcuauuccuuggagaaggugaaggggcagcccugggggaugggcacaguggggaagccuugaauugaacaaaaauguacaagucccuucucgggaaccaaagagaccugcuaauccagcuccaucgcuaugcugaggggcagacaguggccuagggagggguguagauuagcgaugggucacacagcaagucaaugguaaaagugcagcuaggacccaagacacccaacuuaauccuggcuucuguccguccauggcagcuccugccauguauuugagauuucaccucucccuuucauuccccauucucugucucccuagagucccacucaccacaaagaugaugaugacaauaguacauuugcagcguguuuaccgggugccaggcacuuagcuauguacuuugugcguauuaucucacugauuucucacacaugcgaaacuccuagguacauagggagcugcagcaugccccggaagcugaauuuugucaucucacaagcuguucuccccauccacagguauuugggauucaauugaaggaaauugauaagaaugaccacuuguacauucuucucagcaccuuagagcccacugaugcaggcauacugggaacguaagcugggaaagggcugagguguggggggcuucugcuuuggccaugugcugcuacuccuccuuuguccuacuucccccauccucuuagagagucaggaaagacagggucucaaaagccccgucccaguuccuaugcauaguuggagcccugcuuacagugguggcaccugauuaugauugacuggaggguguaggagccuggagugggacauuccugcugucagguuugcugucucuguagaagcuucccaggaaagcaggccugucguugcuugccucuuccuacugggugccuggccuggcuuuggcagagugguucucaaggagggcuuccugguguggguggaucaggaugcaugaagcgcaggagugucaguggggcugaagguucugggacagaaagaagggacucacauugacugagugcuuguguuguaccagguuggcagccauucuuccaucuucuuggaaacccagggaagggaaaauaugauuuuuucuauuuuacugaagaguagacugaggcuugcaagucuaagugccuugccaaggguggcauagagcuggaagcagagacuggguagaauucuguaucugaggaaucugggagaggcuagccuagugaguuggcuggugugucuguugcagauggcugcugaacauaaaccucucuguccuguuauuucucuaggacuaaggacucacccaagcugggucugcucauggugcuucuuagcaucaucuucaugaauggaaaucgguccagugagggugaguggcugggcuugcagcugaauggguggcuguggucuagauuccauguguucaauuucugucccugucuccucuugccuccccucgcagcugucaucugggaggugcugcgcaaguuggggcugcgcccuggguaugauugggcucucucagcgcuugcuguccguguuguccuuuggcaagagaggacgguccuaggauugcaucagucugguggucugguggagcggguggggugcuggacuggguagagggcccaggguucugaccuggguggaugaugggugaaugguccugaacucucugcucccucucucagugucucuugggcuucuauggagcuucccucuugugcuggaaaccucuuuuccaucuuggaaaugccucugcccacaucugggaagugccauagccuugagugaauuuauuuguuuauuuauuuuucuuuuucuucucucaggauacaucauucacucuuuggggacgugaagaagcucaucacugaugaguuugugaagcagaaguaaguaucucugucugguguucaugugucccaugcauuuggccuauuucagaacugagugauaaagccguggugcauggaugcaugugucuauguguguauguauuugcauauuugcauguaugcaggugggauuauuccuugggcggugaugggaaacaggagcagcacauguuuccugaucuguuacauauaccucaacauuugucuugagaccaguucugcaagggagggauuaucauuaccaucauuguacguaugcagaaacugagguuuagagaggugaagucauuuggucaggguuacacagguagcaaguagaagaguuauguuuagaacuuggcuccaaagccuuaguucuuuuuauucugcuaacuagagcuucauagaaauuaauuuccguaaagaaaugacauagaaugguagcuucaggcaaccagguaccaugcuggggaguugacuuguacaucucauuucauuuucauaacuacccugcagcugucaucccauccccguuuuacaguugagggaccuggggcuccgagaagggagaucugagcauggcccacagcugguaugggccuggagcccaguccucuugaauuucuggccaaagcucaccuauccuugguccuuggaggacaugcaaacacucacacagccacacgcaugugcacacagaaacacacacaaagggucaggaauucagcaugugugaagcaugcugcuauuggcuguucuuccucuguagucuuucuggucauuuucugugguggaccuuucugggcuuggccaggcugaggccaagacacuugcaguggggugugcucagagcagggggcccaaagaauggcuccucuguuuacaacacacccaacaggaaucuggggucauugugaugagggcgucaaacuuguggcuucccuaugaacaaacgucccccaacaccucuauguggcuucugggcaagaccagugggacagggcucaauauuggaagaaagacuguaguaauuaguggaugauguugccaucuggagccuguccagucuaugcauggguaggccaugaauggucuuagaaauaaaggcuuugaaccucucuuuccaagguaccuggacuaugccagaguccccaauagcaaucccccugaauaugaguucuucuggggccugcgcucuuacuaugagaccagcaagaugaaaguccucaaguuugccugcaagguaauuggagagcuccuugagcuuggcaagucaagagcauggggugccccuggcuggggcaggcugugugcagagcagccugcaguucaaaucugaauguuuuggugcuucuguuaauugucaaaacacuguaacaggcacuuuaucugaaucauuuaagccuuacaaccugauaugucauugcccuguuacagaugagaaaaccgaggcccagaaagguugguaggugacauguccaaagucauggggcuaggaagugucagagcagggauggaauauuaggugcauaauuacugguaauacuguauuauuacuauuaucuuuuuauacuaagcauguagcauagugccuagcauaaagguagaugcuuaauccucuuaugcuccuucugaugguuauuuacauaguaauacuguauuauuacuauggcuuaaucccucuaugcuccuucugaugguuauuuuuguuucagguacaaaagaaggaucccaaggaaugggcagcucaguaccgagaggcgauggaagcggauuugaaggcugcagcugaggcugcagcugaagccaaggcuagggccgagauuagagcucgaaugggcauugggcucggcucggagaaugcugccgggcccugcaacugggacgaagcugauaucggacccugggccaaagcccggauccaggcgggagcagaagcuaaagccaaagcccaagagaguggcagugccagcacuggugccaguaccaguaccaauaacagugccagugccagugccagcaccagugguggcuucagugcuggugccagccugaccgccacucucacauuugggcucuucgcuggccuugguggagcuggugccagcaccaguggcagcucuggugccugugguuucuccuacaagugagauuuuagguaucugccuugguuucaguggggacaucuggggcuuauggggcugggaugaggagcuggaugauucuaggaaggcccaaguuggagaaugauguggagagugugccaagacacugcuuuuggcauuuuauuccuuucuguuugcuggaugucaauugacccuuuuauuuucucuuacuuguguuuucagauauuguuaauccugccagucuuucucuucaagccagggugcauccucagaaaccuacucaacacagcacucuaggcagccacuaucaaucaauugaaguugacacucugcauuaaaucuauuugccauuucugaguuuauugcuuuuuuuggcgggcugucacauuuugguaucacauuuaaaaaucagugag

SEQ ID NO: 19195 - RNA, 8285 nt, Homo sapiens
ugggccgccgggacgucacguggacuggggccggauaauggcgggcgcugcagaagaugcgcgagcucuuuuccgggcuggggucugcgcggcccuggaggccuggccggccuugcaggucaguggggccagggccagggcaaggucaagguuagggcccggggcagaacaggaguugguugggcuaggugccugaggcuuggcuaggcggcauaagaggaguuggcugggcggcguaagcggccuccaggcuacuccaggucugcucccaagcugacuuggugggcuuggaccuguguuuacagaucgcuguggagaauggcuucgggggugugcacagccaggagaaggccaaguggcuggggggugcaguggaggauuacuucaugcgcaauggugagugaaugugaggcgccgcgacccgccuguguggggguguggagaggaggagccccaucccgcagagccugcauuuccucucgagcaguuguggauugguaccuaaaggugagguggaaugaauucagcuuuuagaaucagaauccuggauuccagugcuuuacgggcuguaccacugacucgugggauuacucuggacaaggcaguuuaccucccugagacucaguuuccuaguuucuaaaaugcguauaaaaguauccaccagagcgcuguacaguagaaauauuaugcuagucacauauaauuuaaaauuuuuuaguagccacuuuaauaaagcaaaaagcagaugaaaucaauguuaguaaacucgguguguaugaaauauuucaacauguagucaguauaaaacauugagauauuuuacauuuuuuaguauuaaguuuucaaaaucugguauuuuacaguuuuagcacauuucgauuuggccuagccauauuucaagugcucaguaaccaccuguggcuguuuggacagcaaagaucuacacuguaggcucgucuugagggauauacaagaacaagaggcccaguagagggccuguugcauaguaugguuuuuaaaaaaaucuucauucaauuucuagcuuuggagaugacauuaggcagagucaucucucucaagaaaguauacuauccauugaggauccacacacguaaauaguuacaacauugauagauuuucugauaaagaggagcucagggugcaugggguaacaggauggggagacagcuucuuaguggagguggugaauugggcugggucuuagugagaaggaguuaacuaggugggggaagcagagagagcaacacucaaguucuguggcaugaggguauaauguguuauauuuggaaaguagcagggagcucaguauuggaguaugggcgugugugcgugggggguggaggagugguagagaaugaagcuggggugugggaagcccccuugaaaagcauaagacauggaagcccuuaugugccuuugauuuuaucauuuaggccaguguuugccaaaauucaugcuaacuaguucuguuagauguucagugaagaagcuucuccaguuaccuuauguaagaaaaacucuuguucugcucccacugaaaagucuuaacacucaugaacauauuaaaggcuuggguaagaauaagaaccacuaaaaaaccuguuugcuuuuguuucucauuagcuuucuauggauagugucccuuaagacccagcagaacagauauuucucaaaggcaaacugugaaacacugcaguggcugguaaaaauucgugggcagguucuagggugagaaauaggaugggauuugcuggcuagaaaguucaggaaauaaucaguaugaagcauaaccuggagagggaaagacugaugagaacgcuguuuuugucuagaaacugaugaggccugaaguaggacaguggcaacaggcauggaaaagaagggguggaauagggccuuggagauugguuggcuguagacagggagggaaaaagaggcaaguuccugguuugaguugauggguggauuaggugucuuuucucggaguagaggaacccuggaggaugcgaagcagguuuaaagaguaaggugaugagucuggcuuuagauauggaagaucugcggcaucugugaaacguccaggcacagaguagucucaguuggagauaaauucgggggauauuaaguuugagugguagggaaagccaagaguguggaugagcucucccagagaaagcacauagaggggagagggcuaggagcuuugugggagacuuucuugaguuacugucuaauucagaaaaaguagagcauaggcccauagguaacugaagcccagagaggaagguggcucagucagagucacacaguaggaugucagugucaaggcuaugaugauuucaucauuggaauuacuauguccauuucuucuuaacuaucccauuggucuguggcuucuuuuaucaguggaaccacaguugugaagguucucuucacuucaaaaacuucagcuuuugcaugauagaaauuaacauggaucauggaucuucacugugcuaggcauuguguuggaugguuccucauaacagaccuuugaggaggccaccauuagccccacuuuacagaugagaaaacugaggcucagaaagaaguagcuugcucaaggucucauagaggggaggcuaguuagaauaguccagaugaaagagggugaguguagggcugggaguuguggaaagaggccuugguaggauggaagagauuggaaaugagguauuaauauuuagugguucuuuaaaaaauuauguuaaaaccuggaaugcagaacacuuuagcagauaaaaggcaggauggaagagauuggaaaugagguauuuuuagugguucuuaaaaaauuguuaaaaccuggaaugcagaacacuuuagcagauaaaaggcucacugugccuuuacccacccaguugcagauccaccaaguagauauugaagagcagugggcaggggugaugaaguuggcuggucuuugacccaagggcccuguccuuuucuacuuagcugacuuggagcuagaugagguggaagacuuccuuggagagcuguugaccaacgaguuugauacaguuguggaagacgggagucugccccaggugagcuuaucacgggcacaacugcagucucccuaccuguagucuuucuucuccccagcugucuguuuugggccaagacucuugacuaugacucuguugccuagaggaaaaaguguagccuuuccaaacccugccuuuucuuuauuucuauacaucauucccauccaggccuguuccucagccccaucccaagggcaggucaggccaguccagguccauuuucacccccgcucugguuaccauugcuccccaauaagauuaccuucccuuuuacaucuuauuucuuucaaagcccaguucuagaggauucccugcuaguuaggcucucuuuugaugcuuuaggccuucauuugagcccuucauaugugguugcuucauugguuaauuccuuggggaggaaagagcucuguucucuucuggaaaaauccaaccuacuccccacuguugcuucaaacacgugcuguuuguauaguagauaucuggaaaauccaaacugguugaauauuuucuugguaggugagccagcaacugcagaccauguuccaccacuuccagaggggugauggggcugcucugagggagauggccuccugcaucacucagagaaaaugcaaggucacagccacugcacuuaagacagcuagagagacugaugaggaugaagaugauguggacaguguggaagagauggaggugaagugggugcccccuggguugggggauacagauguuuucaauuuucuggaagagcagcuagauucacagggaagugauaaggggaugguggugguuggugguaguaguauuauccagagagggcagggaacuuuccuaaaguuacacagccaauccuggaaaagcuggagcagagccugggucuccaguggucaguguauucagcucucuuuuaaaucuccccuccaggucacagcuacgaaugauggggcugcuacagauggggucugcccccagccugaacccucugauccagacgcucagacuauuaaggaagaggauauaguggaagauggcuggaccauuguccggagaaaaaaaugaguggggaugauuggaaauggcuuugggcccuuauuugcuguucuaagaguugucuguagggguuuuuuuuuugaggauugcagaccuguggacugguuaccccaucuccacccucuccccuguuccucugucuggcucccuccagggcaaggaaaaccuaggguccuuggucuuggggguggggggaccuuuuccagcauauuccccugggccuuuaguuaacauccgagugacgaagccggguuccccaguacagugucuuuugggugcggucauugugaggaaggggaugagugaguguggguguggcuggaggaggagcuagaugccgguggacagugggcagguggauuuggggaggagaggaucagcagcagcagcaguacucagugauagggggcuggcugggucaggaauggugagaugaacaugcaaguggaagagagaauaguugaaaaugugaaugaaaguagcucuggagccucucccuuaccccaccccacacacacgcaacagcucuguaccccugcccagaacuuggaaccucccaggaaugcugccuuccuucagcccagccuccaguccuggguucccucaggaauucgaagaccuuggcuagguggugagcuuggaagagcugggcuuuguuuucugucuccucuaaccucuuuccuuacuccuuaucccaucccauuugaguucaggggugaggcuuaagaucuuaauaaauaauaccuuacugcuuaaucuguggcuugaccugugaguaguagccuuagaaucagccuucugggagcucagcuucagaguuuacaagggagcaguuucugggcccacccuagcagccugguacuuuggacaaccaaacagaugaacgaacggagcacagcagugcuaugaaaguuacuguaagccugaaauaaacuguauuuuucuuaaaaaaaaaaaaacacacaaaaaaacacaaaaaacugaguauccauuguccuccccccuguuucccuguccugcccgcuggcccugccaugggucuggacgauaaaauacuggguagccuuggggccggguagaagcuguaagccaugggagaggcaggagaggucuaguugccaccccacguggaguuguacgugugaagacacuggcugaggaggcagggcugggucggggccccagggucaguggcagagcuggcacuugaauccaggucuccuaccucuggugcuuuguggggaacuggguggaggcaggaucugugguaggguauugagggaugagggagaaaaacgaccuaauucagguaggacuggcaacggcucccacccucccuggggacagggauuaauaaaaauugacaucacuguaggaauauauuuuuuaaaagcccacguuuugugaaaagaugaauuaaaaaacccaagacccagcauucgggauugaaagugcccgugaugggaguucaaguauugacugagcugggagggaaggggcuagagcccccaaucagacaugggcaacuagaguguggggugggggcucccaguuugucccaaacccucuaggucuugucucgggucuggggggauucgggggguucagcaguggcuccuaaagcagccaccggugccuccuccaucucccuguccucagacagugugggccccgggcagaacguguccccucggcccgcccggccaagcacagccauccagcgucgcuguaguuccucugucucagggcugaaguaccagcugagguggcucugggugaucuugaagacaugccuucugucaggccgcuccccugccucgggcggucccaccucgaagccaaugaggggcaggcugcgcugggcuuucacauccuggcgggaggagggacagagcuggggccaccuuggggcuagaccuuucccccgccccagcuucuaacugguuuugcauaugcucugucuucaguccccuacucaggaacuccccuacucaggaaccuuccguggcuccaguguuaucaacaggaacaugucagaacuggggcuaaaaugcaggcugguuuaaauaccugucuccccccacccccgccucuucucacaaaacugcugggcuagucucuuuagcauaccaaauaauguuuucaggccuuugucuaugcuauugccccuaucugcauacuuuuuuuuuuuuuuuuuuuugagacagagucuugcccuguugcccaggcuggagugcaguggcaugaacuuggcucacugcaaccucuaccucccagguucaagcaauucuccugccucagcuuccugaguagcugggacuacaggcacacgucaccacgccaggcuaauuuuuguauuuuuaguagagacgggguuucaccauguuggccaggcuggucuugaacuccugaucucaggugagccaccugccucggccucucagagugcugggauuacaggcgugagccacugcgcucggucccaucugcauacucuuacccacuccaaauuggaccuagcaguuccccaucucuacuccuuccaggaagccaggcccacaacucauccugguuuucccuacauaccacaaccacuccuugucucuagccagucuuugucucucaaggguugggguucugauuuccucuuagagauaggcucaccuuaucuuccaaggcucaccuuaucuuccaaggccaaggagaggucaaggacuggaucuggcuuugccagguggcugaaaggacccgaaggaguaggaugcauaccugaggggcuccguagauauacagcaccaaggguucauuuucagggaccacgaaccaugccuugugccauccuuugccacccuucuccauguagugcaggaagcugcagaugacgcuguucucugcagccacugaggccuguuucuguggccagagacaccgggcaucaauguugacagaaggccuagccuggcuccuccuagcuuuaauaccuccucaguguagggacugcuauuccuaucucagaugaagacgcucaagcucagguggcaggagugauuuguccagugccacccagugaaucagcuagagcugagauucaaagcuagguucgucugccucauuugggcaacggcugcugccucuacaggccaguggaaggagugugcggaucucaggcauucuuucuucagucagagcauucauuccucaagccauucacacauuuaggccucaugcuuuuuucugucuuucaucacauccauuuccuacacucauugagagguaaucuagcauugugguuuuaaggggguaugugggugguuaaugaagucuggcuuagaaucccagcucuagaugaaaauguauugacuuggagagcaaagagagcugaugugagaauuaaaugaauuaauauaugcaaagugcuuagaauaguuccuggcacagaguaaguacucuuuuaaguguuaaauaaauaccuagauuuguuuuuaaaaaaaucuccaaaauguguguuugugcauauaugccuagaaagauaggauaagcccucacaaugguaacuuuuggguagaagggauacgguauuuuauuauuuuuuguuuauauuggucuacuuauccuacuuuguaauaacaaaagacaauuuuuaaauuuuuuuuuuuuuuuugagacggaguuuugcuguuguugcccaggcuggaguacaauggcgcgaucuuggcucaccgcaaccucugcuucccagguucaagcgauuugccugccucagcccucccaaguagcugggauugcaggcgugcgccaccaugccuggcuaauuuuguguuuuuaguagagaugggguuucuccacauuggucaggcugguccugaacucccgaccuccggugauucacccgccucagccucccaaagugcugggauuacaggcaugagccacugugcccagccaauuuuuuaauuuuaaaaaaauccagugcugccacucauuugcuguguaauuugggcaaaugaccccucugggccucaguuuccucguuuguaaaauaaagagaacaauagcaugggcagauuaguuacuguggggauuaaaugucuaaguacuuaaagaugacugucuuucauucacucuugc

SEQ ID NO: 19196 - RNA, 158 nt, Homo sapiens
cuuauagacccagcuugguucuucuccaaugucuccuuuuggaguuguaccugauuuuauuuccaguuuucauccgaauccacuggggaaugggacgauuuugcuuuuguuucuuggccaggaaucgcuuaauccugaaagucuugugagaagacaug

SEQ ID NO: 19197 - RNA, 158 nt, Homo sapiens
caugucuucucacaagacuuucaggauuaagcgauuccuggccaagaaacaaaagcaaaaucgucccauuccccaguggauucggaugaaaacuggaaauaaaaucagguacaacuccaaaaggagacauuggagaagaaccaagcugggucuauaag

SEQ ID NO: 19198 - RNA, 154636 nt, Homo sapiens
aguuugagcugagccgaagcgaggaggcuuucgacugagggcuagcgaggggagcacggcuggagcagggcuggagcagggcuggagcagggcuggagcagggcugaagcagggccgcggaccccgcacgcuccugcgggccccgcggagccauugcggccgaggugagcgucuaucccugggcuggagggcgagcucuguacgcgcggccguucucgguuucucgcggguggcaguggcgagguuggggggggaguucccacgggacccugcgcggaggcgcggagguggcggccuuggggagccugcgggaaaggcugcuggaggggcauggcggccugccccaacccucccugaaccccgccuccucuccccucccccaggccucggcaggcgccagcggagagcuagccgcaucuucgggggcagcccggcagcugccggcggcgcggcgagagagcggcugacagaggggaugcgagguaccggcauuagccauggccaaguggcccuaaagagagaguagaggccgggccuucagcguuucucacugguucgaggaaggcggccucagaggagagggaaggugaggggcgggcaggcaggcuucgcggguaacuacuaggcguugcauauauauguuuugauaucuaaaugguacuacacacacacacacauucauuucgacuaacugcuuguuuaaaaaucugagaauaugucuuguagaucuucuuauauccgggaauccaaauuuauguuggguuuuaaacagcugcauuguaugauuguacuacaguuuauuuaaccauuucccgauugauauacauuagcuuguuucucuguugggggagggaggggacuauuacaagcaaugccauaaugaauggguuuguguauauguaucaugccauguaugaguauuucuguaggagaaauucuuagaagaguaaccgcugggucaggguguauaugcauuuugaauuuugauagauuuguccaaauugccuucccaaaagccuguacuaauuuacacucuuuaauguugugcgagagugccuauuuuuccacaguuaugccaacacguauuaucaaucuuuguaauuuuagccaauuuaaagggcaaaaaaaucguaugucauuguuuucauuugcauuucccugauuacuggcgaaauugaucauauuuuuguuuguaaauaggcaaauaucaauaguuuauauaggcaguuuuccuaucuauaagcaauaagcauuuugaaauuuuaauaauaaaaaaccuguucgcaauagcaagagaaacgaauaaaaauaccuagaaguaaacuauaaaacuuuauugacgaauaccauaaaagaacaucugcaugaaaagagaaggaauacuaugcuucugaauaagaaggcucaauauuuuagugauguccauuuuuccuauauugguuuauacaguugaugcaauuucaauaaauauaccaaguuuuuuuggaacuuacuaugauucuaaaguucauccgggggaaaaaaauggcuaagaauaacugaaaaaaaauauuuuaaaacguaaguaaagauagggauauuuguacuacuggcuauuaaaauguacucuaaaggaacuauuuaaauuagaacggacagaacaaugcauuagaauggaaaagcccacaaaucaagccagauuggaucccaagauuuauuggagaaacacuguuggcuagacguggaaaaacugccauauuaaaagcuucaggcauuuccccccauccccgaagcuugaauauuccuuugagggcagacuccuuuguuuggagaaaaccacuuuauuggaucuuuuugguuaugccaagguaaagcuucaguaguuaaaauugguggcuuuggaacuagaacuaaugauauggccuuuaguuagauuaagauggauucagguuagccugcagugcggcgagggaaggagucuggauaauguagguuuaaaaauuuuuuucccuaucuaaugggcaaaaaauguuaugucauuguuuucauuugcauuugugugcuuacugugagauugaacgucuuuuaaauguuaguccaggauaauauguuauuccuggagacagguaacaaugggggacucuuugcuccgcuuccagaauggaguuuggcuaauugguacagccuugcccggaagcgugagaauaaacagguugacuuuuuaaauuuuccucaagcacuaggcucuagacaccuagaucgggggcggaggcaguuuucaggacauggccgagauuuggcgcugagcugugucaucgcgagguuuggcagccagcuccgcagugggucggaaaccucgugguaggcgagaucccugcaggacgggaggguuccucccuucccccgaaaaacucccagucauuuucaugaagcuccgccuuucuccuuuuuaggagugugcaccaggucucgcgauaucucauguuuccuaaaggcgaggcgcgggcggcauccugcggugaauuaagaaggucucgccgaggcuaaagcguaauaucgcgauaguucucaacgcaugcgggagccggccgugguagguuggcuccgccccucacugcuucguuagguugugcgucauuugcuuuucgcuucgcguagggugaagcuguagcuacuucggcuuuggugggagggaggaggggucuggaaagggcugggcucaggcuuuucccguccgguagagguucucgcgggaucgcgcggaggcggcgguggcucgguuacugacugcaguagccgcggaggcggcggcaaggucuucggcucgugccguucuaagccggagaauucucgcgggagcaggguuacguccucgugggauucguuggcgguggcugagguagcucgcggguggggggugggggggcagugacuagggucgguccgccugcuguuaagauggcggcggaggcugaugucuguccggccaggacccagcacagagguguuggcuaucugccuuuaugacgccucugaggugcccagcguuaaggaggugacgauuggcgaaacgccggggugccgguaaacuagaccugaggcgaagaccaccucguuucuuguccguugaggcgacaccauuuccugggccucggccgcgugugggcccgccuuugccccaccgaucggucaacgccuccguugucgccgccgcagugggcggauugggaagggugggaggggagucuggaguucgcuggggagugggguuggggguuaaauugaacggugggaaagaggagcaaccaaugaagaguggccccuuuccccuaccuuuucugccggccaaccuccguucucagcaccuccgacgacccggaugaauacccugguuuuucucgagguggggucaucuucgccaacucucgcgguuuuagagcuaaggcuuaggguucaagcaguagugucacugguguacuccuccuccucuccccacaccccuccuaauucugucgucccaucuaaucuucaucuacguggauaguugaggcugguauuuaagggaggggggagucaaagcuuuucccugugacuccuuccccaguucuaaauucgaguuuagccuaaguccucuagcccgcucugucucccccuuccauugguccccuuggcgcaggcguugaauagagcuuauccuguugccugcauuuacuccaucuuuguggauggugccauaguagccuuccauuuccuuaagucuucauguuuguaugacucugauccggauuucuuagcucugcaugcugcuaaaccacuauuaagcgaaacuaugaacgggucgguguuuggauauugcaguuuaaguggccuuuucguuuacggccauuagccuugccuuccucauuccucccccucagaaggcuguagaggauaacucuccaguaaacccgcuuucugucuucccugccucuuccauuuccccugcaagccugggaaccgccccuuuucccugccuugcucugaguuucuggagccucuuggucuguggacaucuauuuuugcugcugagcaccucuuaccugcuucucacuucuuaaucuuucuaucccccacuccccauacuccuuuuccaggagcugaaucccuuagaaggaagauaacccuccucucaggcuccacuacauuuuaccccuuccauuuacuagaaaacagcauugauuguccugccccccagucugcccuguucuuuauuuccucuuccccccaugccaccguuacuauaggcaguuaauucccuaucauuuguuucuccuuuguagauuacauguucagcauuguuuucuuuuagccccaguguugcauagauugaggagauaccaacauuccccagucauaggcggcggucugguauggugaaauuaauaguguguguuuuggguguguuuuggguucacauugaaccuugugaccuugggcaaauuuucagauucucaguucaucuauauaaugggaauaguugugcuuacauuagaggauuguugcuagaauuaguuaaaauaaaauaaaauaaaauguuuagcucaugguaggcacauaauaaauuaggauuacuuuuugguguaagaaugcauugguagauguaccugugucauaugcuaauuuuaugaccugggaaagaguaagagauuuuuguuucuuuaacuguacauucuugguguauuucuaggccagaucuauaacguuuauauuuuuuuuccucauaggccaaacuuuuuaucuccagugguucaugauguuugaacgugauucccacucuuuguuuccuucuaauggucuaggaauuucagugcguaaucacuauccuggaaugaccaccagccauaauguuccugucaagaaccacacccaaguguucuaccuuuuggaaggggugccucaugcccugccuacucauuucuuccacuccuucaaaggcagucuguccugucauucacucuacaaaaguaauuuggugucaugcauuucacagugguaaaaggaacuucuguuagcuaguuuugaaguauucaugcuacuuuucaccucccucauuuguuugguuccucagaucaguguggggaucugcuauuuggcaucuucuuaccugagcaagauaauuccuguccgagagagaaagaucauuuggaauacccagcuucuuuuccauagcaaauuacugcuggcucuuuaauacacuacuuccuguuguguuauugccauuuuauauuuucuaacguacuuauuaaacagaugugacuauuugacuuggagaaaguuuuccuuacuuuuuuuuuuuuuuuuuuaagauggagucuugcucucgccaggcuggagugcaguggcgcgaucucggcucacugcaaccuccgccuccuggguucaagcgauuuaccugccucagccucccgaguagcugggacuacaggcgcgcgccaccaugcccagcuaauuuuuguauuuuuaguaaagacggaguuucaccacguuggccaggauggucucgaucuccugaccucgugauccgcccgccucggccucccaaagugcugagauuacaggcuuccuuacuguuaauauauugauuagaccaauauuaaaguguagcauuuuacaauuuuuuuuuuaacuaauucuagcaacaacccuuuaauacaagcacaacuauccccauuauuuuacuucggcugggugaugggaauugaaguagaaacguggugaaaaguuuacuaggauuuaaaauuuacaggagguaaccaucccacaauuagcuguauguggacucuaguuucgaacuucagggucugcuuuauuuaauuugaagugcuuuguagguaauaaaauuuucuuccauuuucauuggagggcaggaaaucacuuucuguuuugagauuuugcauuggugcauuuuaccguggguuaagcagugaucacaaauuuauuaaaccucaauuucaauuugacccuuauugagcaauagaauaaaucugggaaugauaaucuaggugugaccuaaaaguuuaacuuauucuagguagaucucugagaagagaggaaggagugacaauaccaaauaaaaacuuugucuaagguucaauggcaaaguucaaccugaguugccaggauguuuaucguuugucucccaauauggccaaaaagcauguaugaaggugaagaauaauuuuuauauguacaguuguuguuuuuuuucacagaaacaaugaaacaaauacguccuuaguguuuauauugaggguauaaacuugucuaaaaaauaaacugucuucuauaauuucauuuggguugagaacucaguuuucaggaauguugucuaagcguuagaaguauuagaguuguugguucugaauuccucaguuacuucucaaagcagguccuaaaaaaugcaaauagauauguaaggacuauugcuuuagaaauaauaacuaguuauguuugaacauaauagaaugguuaacccuccucacacacccuaauaaauguguuguguaucucacuccucucccccaacuuuuuuuuuguagguccuccagcagccugaccugaguggguuagugauccagagaaaccagcaggccaacuuggucaggaagguucgggaagcuguuggagcaguguggggaauuucccaccaggaugaguaugauuggcugugauuuuagguuaguuuuuguaaaucuugugggaaguauuuguauuuuacuuccuggaauggagauaguagggguggauguauucccauucuguaauggagcuacuuugguuucuuccauucucuggaucugaugugguacugguugcuucuuuuuuuaaaguggagcucauuacugaauuaaagggaauuguuuaaaugaaugaugucuguacaugauuuuuuaaaucacccuaggcaucguucaaaaaauaaaauugcaagucauuaugucuaaccaguucuuauuaaaguuacgaaaaauuucaaacaugcaaacauugaauaguauaauaauccccccacuuacccaucaccagcuuuaauaguaucaacuugcacauucuauuucaucuauacuucuguuuguuugguuuuuuuuaauuuuuuuaaauugagaugggguuucaucguguugccuagacuggucacaaacuccugggcucaagccauccucccuucuuggccucccaaaguguugggauuacaggcgugagccaccaggcccagccuguuucaucuauacuucuaaccacugccccccucaauggauuauauuggaauaaaucccugucauauuuauuuguaaaauacuuguuuguauuucuaaaaggcaagggcucuuuaaauauaagaucaaaacuauuaucacaacugaaaaaauuaacagauauuuaaaaauaucaaauauaaaauguucagauuucugauuuuuuuuuaagcuuuguuuuuuuucuuuuacaguuuguuugaaucaggauccugagaaagcacauuuauugcaaagcauugauacagcuguuaaaucuauuuuaaucugcagguucugucuuuuguuuuuuuuuucuuccaauuuauuuguugaagaaauuguccuauauauaguuucccgccccccauauuuggggauuacagcccaguaguggugucuaacccauucuugcucaauuaaagacccuggaggacccauuauaauggaacaauggcuauaaucuccuguauccuaguuggaguugauagugcugucauaggcacuauccuaaaauaacuagucauggauuccuuuuucuguggcaaagucugauuugauaccugacuucaguuccaugucuuggccuugcucauugcuccacaugaaaaguaggccuccugguggaagaagcuaguguuuccuaaugaccugauugugccuuugggguuuuucaugcaugguuucaauuuccuuaggugauuuaguuauuuuuauacuacuuuauaauguugcuuuuuauucuuuugauguuagugucucagcuguucugacccauaacuucuaagcuauuaagaccuaauaaugaguuccuggcugucauacaguucuugaaauggcaauacuaaaacaguuuuugagagcuucuacuuacauguugauuuucagcuauuauacacaaccuuaguuuuccuacugugauuuuucauuucauuucaucugaaauuuauguuuccuuagcauaaaguccuuuaaggacuuuuaggcugcuuuaugaugaucucacuaucuauaagguugauauucauaaguacuugggcuuuugguguuuugcuguauuauucguuguuuccucaacgacugguuacuagauguuuauauauguuaaugucaggaauaacucaacuuuuaagucguuugauguuucauaggugguguuguuaaaacuugauguacuuguugaccagcuuggucuucuggauauagaaauccuuucagguagugaagaaguggcucuaugaguaaaacaacuguagguuuuguuugggcuguuaaccugagcauuuucaacuuuuaaguucucuuuaaaaguuuuuagucauuuggcuuuaaaaauuacaguugguggcauagaaugaucccauaaugugauuuuacagaaaguuggaauguuuuaauuuauuaugaauguaccauuacguggagauugggauuguagaucugauucagucuggauugcugauugaacuagaugaauguuaaaauucuucaacucugagauucugaugguauaaucuuagguauugaaagacagcaguuuuuccuuucaguagucauuaaguaaauggugacuaaaaguagggagaugaauuauucuggaaugaccuuucacuauaaccauuuagauuuaaaagauugaugagucugaggauacugucaugaauuuauguaccaccuuuagcacaauccagguuuuagguccuugugauuagauaucagagauaauugccccagaagugcguggguauauuacauuugguggcuguuaauguuuuggaaugauuuuggaagauuacuuuggguacauuauuugcuaugauuauuuucuuauauuccugucuauuuuauagugaggcauguuucuccuggucuuugcuuuuuuuuuuuuuuuuuuuaaacuuccaauauucuuuauuacggcauucugacaauugaguucuuacagguggaaagaccuuucagcacagcgauuaagaacauggacucuggagcuagauucacagaguucaaguucugacucccauuucuuaccaggugugucauguugugcaaauuacuuaacugcuuugugccacacgguccuucaucuguaaaaugaugauaauacugccugccuuauagaguucugaagaaauuuagcugaguuaaugcauauaaagugcuuagaacaaugguucugaaacuuuagggaacaucagaaucaccuagaggacuuccuaaaagauuggcugguccccacucccagaguuucugauucuguagaucuaggaggggccccagauuuugcauuucugauaaguucccaggugauacuucucuauuuccugcaaauuggcagcuggauccagagacuugauaaauuucagguucguucccuuuggcaaauauauugcgggggggugggguggggggguguucauucacaacauugauuauguuacgaugacuugaauuuuuuggauccauuaauuuguuggggggcuacaaaauggugacguucugaugcuaucauuuuguuuucaucuguuagcuggaauaauuuuguuuccccucaucuuuuauuugguuacucagcaauauaguuuauauaggaagagcaggauaaauacucaauuuuuuaaaacauugcuuucaagaugaugaauugguccccugucaucuucaaaagguuacacauauaaguguauauauaacuaugcauccauagauguaaacauuugauggguuucaauacauugcaguucugauccuuagcgaaguucaaauugcccuucuuguggcuaguggaacucucuuaaaguuggcuccugauucuuacugacaugcucucuaguagucuuugauagcuuccuugcuaucugguaugucaagauguuuccaggcgcauucuugugcauuucugccccagaccuggaauuagcuaaugggauuaagauaaaaggugaagucaaaagaaauucuguuuuugccaaggguagcuuggaacuuucuaucaaguuccacuuuucucuuuccacuuaaccucccuagccugccucuucauucuucucuaccuuuuuauuagaguuaagguggaaagguuugagaagccuugauaaucauaggaagaucauggagcccaggcaguuccggauuuggggccuggccacuuacuaggucugucaguuugggcaaguuaaccuauaucaguuaugauguggggaaauaccuuauucauaugguuauuggaauuaaagagaaaauguaagguguuaguacaugguaggugaucaguagaugguaauuuauuuaauguacuauuuuacuuaacuccuucaacagcucagaggugggcagucaggguggugaaaauaauggccauuuaacaaaaugugucuggacccuuuaggucugugugggaucaucaguggugaggcaggauaggguuuguucuugaguuauuuugggucugagacuuuggccagugauaacugaauguuccauagaguaguuuuucacuuuggaacuccuuaggagucacauuuauacccucugaagggucuuagcuaguucuguaauguguauuacauugguuaccuugaucucucuccgucuauacuggccccuccuauucaagguguucaagguucuguuguaaccuuaguaaccuauaauaaguauuccuaauagucaucaguaucaccacuguuaacacauuugggcagcaccaugcauggcaggucagcaaacagguaaaucuuauuuuuuuaaacauuacacauaauaucuaaaguauaguauguggcauguaauaagugcugcugaauaaauggaagucauuguucaguuuuuagcuuaauauaucuuuuuuuuucuuuuaacauaacauuuacugaauguugcuaaguauaaggaguaagggacauaaaaugaaugagacuuggucucugcccuugagaaacucacagucgaguuaaggacugugaaaucauguuuaaaguuccuuagccuuuuccuuugugucaucauuucuuccccugcacugucuaugcaugauauagccuguccauuguuucucacagcuuuccuaauucugugugccuccccagccuuugagacugcugauaugugagaaagccaacaauugucuucuauuaauacaggguaauaucaagaaaaaccuuugggccaauauuggauuucagaguggcaugugcaguugacauuacaauaccaguuuauggucuuuagaugggccuguacaccugggcuccagccucuuuccugugccuuuaaacugccuuacuuccaucuuuccuccccuauacccuacccuuaauguacuugguacauaaaaauagaggcucccauacccagguagugaucaaguacaauguaaagaaacagcuguacuucauauaaacuaggauucgagugggccuaggguauaucacuaaauuuccauucuuaucuauaaaacaguaaucggaaagccuauuucauagguugcugugagcauuaaagcgagaugauguauuuuuaaaugcuuguaaaguacgaagauaaggucauuauaauuuauauaaaauacuuaguagcuauguuacuuggggcaaauuaccucaucacugagccaguuuccucauccuuuaaaugaagauggugauauucauuuaacaaauauuuauugaggacguagucauugcagcuacauccugggaauacaaagauaagugacuggagaauguaggacaguguggucuaggggaaggagacuugcaaaucacacaaaagggucaguaugguaauaugaggaaugaacaaaaugugcuauagcaguuuacaagaaggcaucagagaaugucacagaguuuuguuaggguuaagcaagauaaaugaaaaguacuucaugaauucaaaaaugcuauacaaauaaguuaguuaaacguaccccaaaugaaucaauagucucaaaccauuauuguuucauuucuucacaagacuuacucuuuagaugcauuuauuucuuugagcuagauuuuaugaccuccuuaaggguaaccuguaguagaguauccugaaaguuaaugcuuuugucuaaaaggauuuuuuucauccauuuuaucauuuucuaguuuuuaaucacugaauucaggaaaaacuagaaaaugugugcauauuuggggagaggauauacauaauuccaccacaauguuuagucacuguuaacauuuugguguauucacaucuuaaugauaaggguaguguuuaaggaauaagaaaagaaaucuaguaggaaauuuuaaggauaggcauuucccagaauaggaaacuaaaaacguccacuaacaagaaaugguacucaaacuaauaaucagaaaugcaaauuuaaauaaggucauuuuuagucauuagauugauaaaaaauaauuugauaauaucaagucaucguaaaagguauaaggaagagucuggccuuauaauacugccuacaaguggcguaaauugauacagcuauuuuggaggcaauuuuggcaaguugcaagagaguacauacuaugugaugcuauuuauguuuuaaaaaaaaccauggcaaacugacaacuuuauuugggaggagggaucauggggaacuuuaccuuuuucuguaauaugugcauuucuacuucugaaaaauauacugagaaguacagagaauaauacaacaaucccugucccuacccccacuccagaauugaucauuuuuaacauuuauuuuugccuuacauuuuuuuguggaguuggaaguaacacaaguugagugucccuaauccaaaauucaaaaugccccaaaaugaguuucaacacgaugccacaaguggaaaauucuacgccuaaguacuuaacacuuuguuucaugagcagaauuauuaaaaauauuguauaggguacaacgaacauuauuugggugaugguuacacuaaaugucuagacuucacuacugcacaauauacccauguaacagaacuguacuugugccaccuaaauuuauacgagaaauuguguaaaauuaccuucaggcuguauguauaagguguguauggaacaugaauggauuucauguuuaaacuugagccgcauccucaagaugucucaugauguauaggcagauauucaagaaucugaaaucugaaauccugcuggucccaagcacuggauaggagauacuuaaccuguauagguaaacaggagauacuuuuuuaauacccagcauucccuuccccccuuacaaucaguacaaugaauugcuugaauuuuucuacugugagaaugguauaaauuaugaauguaaguaaaaguucaaaaccgaugugguggccacacaaaaaccuauuauuaaauaauauuaaauuuguacaguauuuuagaguuuguaagaagcauucugauuuuaguaagaaugcuuugggaauagaacuuuuuuucguuugcucauuuucuuguuaacucuuguuugaaaacguuuuccugaauuuguuuuuaaguaaucuucaugacuguagaauuauacauggcuuauuguugaaaaauacagauaaacagacaaauuuccgcaaaccccaaacucacagauaaaauacucuuaacauuuugguaugcaguaucuucuucgaaggcuuuucuuaacugcucuguagccauauuauauauuuuuucagaaaugcucuuuuuaaaauguaauucauuaccucccuuccagcuuucaauuuuguaugaaaaauuucaaacaaaaaugcugaaaacauagcacaaugaacaucuguauaccaucagcuggauccaacaauuaaguauuugccauauuagauuuauauguacagauguguguuuaauuuuucucaacauuagaaguaaggaugacacuuuauccuuaaaucuuucagcugcaugucuuaagaaugaggacaucucagccgggcgcaguggcucacaccuguaaucugagcacuuugggaggccaagguggguggaucauuugaggucaggaguucgagaccagccuggccaacauggugaaacccugccucuacuaaaaauaaaaaaauuagcugggugugguggcaccuguagucccagcuacucgggaggcugaggcaggagaaucacuugaacccaggaggcggagguugcagugagcugagaucacgccacugcauuccagccugggcgacagagugagacucugucucaaaaaaaaaaaaaaaaguaaggacaucuacaaaaccacaauaccauuaucacgccuagggaguuuauuuuuucuuaauauuaucuaauauccgguucauauucacauuuucucaguuguccccaaacugucuuuuuuuccaagcuguuuucuccaaacuaguguagaaaugguauuuuuaacuuugcucuucccacauauugaccccuguuucaugucuuugucauuauguauacuucuguagcauuuuuaauggcuacauuguauucuauuguaugcagaauuuauuuaaccaguuugcuuuguucacaccuuuugcuguguucauacuuuucccucagguguccccaaacugucuuuuuucaagcuguuuucuccaaacuaguauagaaaugguauuguuaaauuugcucuucccacguauugacccguuccaugucucugucauuauguauacuucuguagcuuuuuuuuuuuuuuuuuuuuuuuuugagacggagucucgcugucgcccaggucggagugcaguggcgcgaucucggcucacugcaggcuccgccccccgggguucacgccauucuccugccucagccuuuugaguagcugggacuacaggugccugccaccucgcccggcuaauuuuuuuuuguauuuuuaguagagacgggguuucaccguguuagccaggauggucucgaucuccugaccucgugauccgcccgccucggccucccaaaguacugggauuacaggcgugagccacugugcccagcuucuguagcauuuuuaauggcuacauuguauuuuauuguaugcagaauuuauuuaaccaguuugcuguguucacacuuuuccagucccaguuucucaugauuuuaaguaaugccuccuaacauacagguaauucagcauucaguaaauaagugucgaaugaaagaagcauagguacauccuaauagauaaauauuuaugagauccauauuuaauauuuuuaauuuuuuauuuccauagguuuuuggggaacaggugauauuugguuacaugaguaaguuccuuaguggugauuugugagauuuuggugcacccaucacuggagcaguauacacugaacccaauuuauagucuuuuaucccucaccccuuucccauccuuucccccugaguccccaaaguccauugcgugacauccauauuuauauccuuaagaaauuucuacaaccggaauguaaaaauguaaggcuuuuaauacucauugcuaaauuggccuuuagaaaggcuaaccuugcauuuuucacugugauauguuuaguauaugauccaucaugauuuacaauauuguagcacaucaggauaagccuugauaaaucagaagaguauaaaucuggauauagccaguaucguuguagauggcucacugcauauauacacguauauacauauacguacguacacguauauacauagacauauacauaucugcugccauauuuuuccaggggcuaguuugacucuucuacuuuggagggcuuugcaguuuguuaacccaaucuggaguccaggccccggcuucuuacauuucuuuaaauaucuuggugagaccagccuuaaaaggaaguauagucuggagagaugcagacaucacuagaagauauccuuuuacguagagaauuuuagauuuuugcuuuuaaaaaguaaagacaggcugcuuuuaugggugaauucagaucucucccucuagcaaauuaccaacagcuuuaaaaggguagucuucauguccaacagaaaagcuggaugauacccuauauuuccuauuauccauaucaaacuccuuauuuuauaggcccaguuguaggaguaauaacauauccaugguaacauggcuggauaguggugaaauugagcaucaaacccagguuaccuaguccaguauuguuuucacuauguuuuaucucuccuuaaaacugaacuuuauuucuaaaugugccaucuggugucaucuguagaaauacaaaguaagugguccucuuccuaugagaaaguuacuccccaaauaggggaauuuuaaaguagaaagucaacgugagaaaggcaaaaauccaaagaaagcucaguuucuuugcccuuuuaaccguaguuacuacuuucugacaugagaucaacuuggagcucuuucauggaacaguucgauuuggccauguguuuucaugcauuuauggaugcuauaaaucaguagaugagacugaauuuccugcuuguaaaacuuuuucaaauuaaagggcugcuuucuaaguccaucuuauuuucccuuccuuuuuucaacuguuuuaaacuauaacauguuugcuauuuuuaaaaagauugaaacaaaauaauaguuuacaccuuuuagcauuauaguuaaguauuacuguguuaaguauauacuuauguuaaguauuuuuauacuauguuaagcuuuuuaugcugaaguaauggugugaaguagguguguacuuuuauuuucauccaaaugguuagccaguagcuccuguuuuucuuccuggcaaagucuauuugaucuuuaaaaauauucuuagcuuaaaagugaauuauuugcagaaguguaguuuuauuuuuuaaaaaccuaggaauuuguggcaaguagaaaacuagcaugguuacuuuuagcuguuuaguuuuugaaaauaauucagauuguucauguuuaauauuuaacauuugucuuagacugaaggcaaaguacuacagauagugcuuuaagggaucuuaguuauuguacuuccauuuuacaucauguuggaagcccagaaugucauaaggucuuaaagccaguugguggcugagaacuagaguaccuuugcauacuucacuuucauuucuagcaagcaucuuucauguaauagauauguuuuaaagcaguagauuguucagaauugucugguuuauuuaagaacauuugaaauaacuaugugucaggcuguguggagcaccauaaaauuuacucagacagccauuuuuuucuauauguugggacaccuuuguuuuuaaaggcuuuguuuuacaacuuucuuaucagugaacuaauuugagccucauaacaaaccugugaaguuggaauucuuuucaacauccuggaaagaguuugcugccagguugauaauugcuauaaauaacuugcucuuuuaaaccaugcaaaagaaucuuugucuccauuccuuccaaauucauuugaaccagcucaaaacaguugagacccaguuaaaauuuuugauuaaguggcauggccugcacauuauuuaguagacuguuuaccuuuugcagaacuguauaauuugagaaugaaacuggagccucccaaucucauugucaucaaaguagaguuuaaguuguugguugucugcaguuauggcuaacaguauggagauuaguauauacuguauguucuccuucauaugcagguaauguguagaaagauugagaaggccagcucuuuugcauaugaucagauuuauauaucuguauuucugucuuaucaaucuguagaauaccuagcauaagguuucugccuuuagauuaaucuggagccaaaagaaauagaacaaauagcaauacggcuuacucuuugcugggcacaauccuaugagauagacuuguuuauuuuacagaggugacuggacucagagauguauggcaacuugucuaagaucacacaccuaguaaauggaauuuaggcccagaucugucuguuucccaggcuuuuccauuaugcuguuguccuuuacuucauuuuuacuuuucuuccagugguagucuucagccucuacuuuuuuuuuuuuuuuuuugagauggagucuuacuuugucacucaggcuggagggcaguggcaugaucucgacucacugcaaccuccaccucccgaguucaagcgauucuucugccucggccucccgaguagcugggacuacaggugugugccaccacgcccagcuaauuuuuguauuuuuaguagagacgggguuucaccauguuggccaggcuggucuugaacuccugaugucaugauccacccaccucagccucccaaagugcuaggauuauaggggugagccaccgcgcccggccggggagguuugaucuuuagagaugcugcuuguuucucugcaaacccaaggacaugagagaauuggagcugaauaaugcaaaagggguggaauucuguuucuuugguaucugguaccaucuuuauuguauuugacaguagucuaucauguggcuuugggaaaaaaauaccauauaccuguguuucauaaaugaaagggaaauacaagggaaaacauugucauggcuagauagacagugucuuaacuuucuuuagggcauugguuccuaauguucuucaggucauagauccuuuuaagaagccaaugaaagcuguugaccgucuucugggaaaaagaccaacauauguaaaauuucccacagaauuucaggguuuuuguaguggucauccuucaguauaggaugaggaauucuaaagauuccucuacacuuguuuuucucuauaugucauuaagaugucuaaauugcuauguuguuuguucuuguauuucuuaguacaggcguccccgacuuaaugaugguucaacuuaggauuuuuugacuuuacgauggugugaaagcgaaacacauuuaguagaaagcauacuugaguacccacauaaccauuuuguuuuccacuuucagucgauauuaaguuacaugagacauugaacauuuauuauaaaacgggcuuuguguuagaugauuuugcccaacuauaggcucuaauguaaauauugcaagcauguuuaagguaggcuaggcuaugauguuuggucgguuggguacaguaagugcauuuuugacuuagauauuuccaguuuacaauggguuuacugggauauaaucccaucauauguugaagagcaacuguauauauuuuucuagacuuauuuuucuacacaguggucaaggguaagcuuggcuaacugugucacuuuugcuuaaagauauacucuguauuaugcaaauuuaauuuaucuucuguauugaucuuauaauugguuguguuuucagccuuugggcaugaggaaguuguaauucucuuuuuuuguguauugacuucguugccuuuauauuacgauugcuucuaaucuauuuuauuucugauuuuuuuccuuauuuucuacauuucuguacaccuggcuaucugaguauucaucucaaugcccugcauauaguauguuuauaauuguugaauggaaagaugaagguuaaaugaaucuaaauuguuuuuuucaguucaccaagaguuuaaugugacuuggauuuuuuuuaguuuuguuaagcauuuacuggauaguuauucauuuauuaaucugcuauuaauaaaugacaguucauaugcugguacaggaaugcaaagauaaauaugauacagucccacucuugcagaacucagcaagcauaguggggagacugucagguaaguaaagaggugugcugauugaggaucaauaugcaggauauaguuggggcuaaauaaagcauguggggagcugagggaaauauuauguaauaucauagcacugguaagagagguaagcagggaccagguccuagaggucuuggaugcugguuuaaauaaggaguuuguacuugauguagguagguuuugaguuuuagggagauugcucuggcaacaauguggaggauagaauggauggauccagcaggaaaaagucucacuuuaaaauaacuucaauuuaugagacuuuucaaaacauauacaaaaauagaaaaaagcauaaugaacacccauguaacugucacccagcuugaacagugaucaacacagggcuauuguucuauuuauaccccgcuccuccccucuauuuuuauuaaagcaaguuccuaagucacagaauggcaaagcauauauugaauaauaaucuaaugccauggcucucaaggcuggccugugcugccaaaucaccuguacagcuugaaaaaaauaauccccacuucagaccuacugaauuagauagcuuugaaaugccuguguggucaggcauuuuuaguuuucaaaauaagucucgggugaaguaaguuauuuuuaagauaauuuuaaaauaacuucugacaaaugaaaauacuuuccugaacucauugaaugcugccuguggcccuucugggugaaauucaccuauucgauacaggcaggcuuuucuuauaaauuuuuauuuauuuuuuguagagacggaggucucacucuguggcccaggcuggucucgggaaaacuccuggccucaagugauccucccaccucaggcuuauccucccaccucaggcuuccaaagugcugggauuacaggcaugcagccagaaacugacaauucuuaagguguagacuaggaauauuccagaguaccaauuuaaaauguguagacaaggagucuguuccucuccugcuuaauuugcuuaacuuacacuuaggcauugcuguuuuuauuuuuuguugagaauaccaagaagggcuccuuagcaugcugucauuuccucuguauugguaaaauugauaaucugcaacuuuggugagccauguuugguugccuaguucuucugaugccaguuucucuaaguaauugggaguauccgggaaggauaacucccagaucugcagcuuccccagacuguuugaauagaggauguggcaggagauguguucucagauacuauucucacguucaaagucaacauuggagguuucagauuccucuuucuuaguaucccucccugcccauauuuuccuugcuuaagcauaacugcagugcagagaaacacccagagccagcauaaacucuuaaucugagguauaguguguuuucagauuuuaaaugagagacuccuucaagguauuucugcaaauaauuuccagauuugucuugggugaguaaaggcuauuuuucaguugcuuuauuaugacacuuuacugucagugcccaguaaaaccuaggucagcaguucucagggcacuugagagucauguuuuauguggcuaaggauagggagacuggugucuguaggagaggggcguagcaaggugggcugugcauauagacauuaugugcaauguagaguuguggaacagauuuggguuugaauccacguuuuaccacuuaauagguauguggccacucucaguaaacugggcacagucuucaucuccaaggauuaaagauaaugcacaauagguauagaguaaguguuagcuauuuuuuuaugaucauaaauguuuuucacaauauuuguugaguggauauuaauguauuaauagauaaucagaaacuagauaggauggaaaggccugacaauuaugugguguccccuuuaacaaaucauaaucagugacaccuauuccucuauaaucaaauagugaauagcaggcuggauuucaagaugcaucuuacugcuuguugacaugaagaaugcucagggcagcucucaccugaauuuacuuucagagacuauaaggcaaaaggaaaucguugcaaggcaaaaaauaaaguauuuugcuuugugguacuuuggaguuuaguuuucucuaagcauuuuuuguuuaagaacugccguaaugcuuccaugauuucuauggggauuuuaggcucauuuugauucauccccacucccguacuuacgugcaacaucucuuaccugcuaauaaucaaccaaagugccuccugugugccaagcuccaaacaccagaagauguagggaagaagcuccuagaguaggcagcagcuaaucuaaggcauuuguuuagaugguguucuuaaucuggugcauguccuuuggcucaggggccaguguuuucuuccuuaaggaaaauuuuaggccuggcacaguggcuaacgccuguaaucucagcacuuugggaggcugaggccaggaggauuguuuuaacucaggacuucgagaccacccuggacaacauggcgaaaacccugucuguacaagaaauauaaaaauuagccaggcgugguagagugugccuguggucccagcuacucuggaggcugaggugagaggauugcuugagccugggagguugaggcugcagugagccaagaucaugccgcugcacuccagccuaggugacagaaugagacccuguuucuuuaaaaaaacaaauuacaaaaggaaaucugauuauaaauggauccaugauuuauaggaaauuuggaaggauuagaaaagcaugaagcauaaauaaaacuauguguuacccugccagcuagaggcaaccauuaaaggccaacuacuaauaauguguauuucuucccuucccagguuuuuuuuuuuuuuuaacuuucccacccuguggcagacauuuucucauaaauagggaagugauagguacagaguacaauguaaucacauauggugggauauccagucaagauuugagggguucgggagaagauuguccaaauucuggauaucauucuguucaaaccugcauaagugcuuauuauauuacagugaaauagaggcuaaaugguccccuacccccaauuuucaaagggauucuuacaguuacuccgucuuuucaagacaguuugcagccacuugagaacauaagcuagugucuuuauuuaccuuuuccucuacauuucagugaccccauaauucucugcuuccauuuacagccuauauauauauuuuuucccccgagauggaguuucacucuuguugcccagacuggagugcaauggugcaaucucggcucacugcaaccuccgccucccggguuuaagcgauucuccugccucagccuccgaaguagcugggauuacagacaugcgccaccacacccggcuaauuuuuuuguauuuaguagagacgggguuucaccauguuggucaggcuggucucaaacuccugaccuugggugauccacccgccucggccucccagagugcugggauuacaggcgugagcuacugccccuggcccaacauuuucagaagagguuuuuacacauaccauuuaugcuuucucacuuuccauugauucccugacucuagucuggcuuccauucccuccaucccacugaaacaauugcuugucaaauugucucuauuaccaauuucaguggacauaccucauuuugacauuugaugcaguugaucacucuugccaucuuucgucucucgugauagcauaauuagcuaguuuugcucuuuccucacuagccucuccauugcuggguuuuccuucuuuccuuaccuuuacacuuuuauuguauuguauuuuuuuugguagagaugggguuucaccauguugcccaggcuggucucguuuaaggaaucugcccucagccucccaaagugcuaagauuauaggcuugagccauuguacccggccccuucuuugccuuaccuuuaaaugcuagagcaaauaacucaguugcgggccuccuccuuuccuucuuuguaagcagucaucuccagacccauggcuucaaguaauauaugugugcugacaaucacagauuuuauucuuaaugcauacgucuuuccugaacuccauucuacaaauauuugcauaccuaucauguggaagauaccgugcuagguacugagagcuuaacaucuuagaaaaucaaaccaguaauuacaguugauacuuguuaugaaggaaauuggaaauaaacugggugcuauaauagaaaaauuacagugggaccaacuugagguggguugucauggaaagccucucugggucuuaguuuaaaugucaguuccucaaauggaacuaguugugggaaaggagggguggcaaaaacauuccagcggcgaacuuagaaauuagaguguuccaagaacuaaauggaaagaauaauuacacaguugaggaaacaagcauagagagguggauuugucugcgguuaugcagugaguaagugauauagcagggauucuagcccagguuuucugagucuguauucugaucuagugcuucucaaacuuuguuauauggaucaccuaaggaucuuguuaaaaugcggguucugacuccucauaucuagguggggccugaaauucugcaacuuuuaauaacucccaggugaugucagugcugcugauccuuggaccacacuugauuaguaaggcuagucuuucacuacauccaacugcucuugagccagauuugggaacuacagguguccugugcccuuaaacugauucaguauugaaagucauuauuuuuaaauauuaucaacuggaggugauuacuauagaauaugagucacgcuuugaguggcuucccucaggauauuuuaguuguguacacuuguucugcagguaaacuguacaaaaccaagauucaaaccucagggguguaaggaaagguugggggaauaaggaagugaaaaaaaauauuagauaaaaguauugaaguaaugguaauagauauggauggugauucauaguaauucacuuguuuucuuuuaaguuggcuaucuuucuaaccuaaguuuaggaagcaauguuuauuauauauagagauugcuuggugcccugaguucugguucugacccaacaaaggcaguaggccauuucuaggaauuuguuucaaacuaacuuauuuuuauggaaggauuuuuuuuuaaauguaauaggguuuucaccugauuaacuucuaagagguagaacucauuccccaguuacuguuccuuucauuagugaaauuacagcaucucagcuucucaucuugggcccuaguuuccucucuuggaguaauuuuuucaaacaaauaggauucagcagucuagaagaaucugucacaaauuuuuauucuuaucugccaauauuuuguaguaauaaaacugguuuuaaaaaaaggugaggcugggugccguggcucacgccuguaaucccagcacuuugggaagccgaggcgggcggaucacaacgucaggagaucgagaccauccuggcuaacacagugaaacucugucucuacuaaaaauacaaaaaauuagcugggugugguggcgggcgccuguagucccagcuacucgggaggcugaggcaggagaauggcgugaacccgggaggcggagcuugcagugagccgagauugcgccacugcacuccagccugggcgacagagcaagacuccaucucaaaaaaaaaaaaaaaaaagugaaucgcauguuauuaaagcauggacuugguagucagaccuggauuuagaucuuggugcuaacauuuacugaccaagaaagguacuuuuuuucucucuuacuucaguuuucuaucuguaaauagaggcaaaacuugacuugaguggugaggacuguaugaaaaaauaucauaugaauucccuagguagcaugucucaaacuguauucuuuggaauacuucaauuggacuuugaguagaugccacuugagaaaaugguucugugcgcuaauaagccuccuuuaccuaagaugucuuagagccauuaauaaugucaauuagcuaugugacugcccuaguggaagagaaauucugucuauaacauuucccaaauuacaggauucuugucucccuuuauagagcaagacauucuaacacacuuuggggaacuccagucucaguauugucuggcuuguaauggacacucaguauacuaacguuccccccucccacuguugaaaccaguuuuagaaauaugagaacacaacaacuucuaaauuuuuaaaguugaugucucauggacagugaugucuugguuuuuuaaacuacaaauguuucuugcaguagaauuauagacaccaagguaggacugcacuuguuaugggaacauuugugugugugcauucauauuggcucuguuauuuuauugggugcaucaaaugcuuacacuugggacuuagagucuagcgccacucaugcaaauaaccugagaugauuuagaauuaugccaccagcauaguuucuaggcauccagagucuuguguuggcagcagaaguaccccaagcuaagcuguuuccguggggggucuggcuguaguuccaggcucccuagcuuccuugguuccucuuaguuuucugcacguggagcucuagccuucugucaguucugugagcuaucagauacucuccaguaaauuacuuggcugcauuaauuauccagucuuucuguaguuacagacacuugacuaguauaguacacuaggucaaaacagcauuagagcaaguugcuuauuuguuugaagauucaucagugacucaucugcauuaaaaaaguaaaaugguugugauuugcuuauuucagugcauaaguuacucugugcucuuguuuuggaggauuguuuuuuuaaaauagacuuuauuuuuagaguaguuuuacauucccagcaaaaucgagcagaagguacagaaauuucccauauacugccugccuccacacaggcauagccucccuuguuaucaacaucucccacuagagugguacacuuguuacaauugauuaaucuacauugauacaucauuaucacucaaaggccauaguuaacauuaggguuuacucaugguguauacuuuugggguuuagacacauaauaacauguguccaccauuguaguaucauacagaguaguuucacuggccaaaaaauccucugcgcuccaccucuucauucuucccuccccacuaacccuccucaaccacugaucuuuuuacugucucuauaguuuuuucuuuucuagaaugucaugugguuggaaucauacaguauguagccuuuuuguacugauuucuuucacuuacuaauaugcauuuagguuuccuccauguuuguucauggcuugauagcucguuucuuuuuaguacugaauaauacuccauugucuggauguaccacaguuuauccauucaccuaccaaaggacauugugguuucuuccaaguuuugacaauagugaaugaagguacuauaaacauccaugugcagguuuuuguguggacauaaguuuucaacuccuuuggguaaauaccagggaguauugauugcugggucaugugguaagaguaguuuuguaagaaauugcugaacugacuuccaaaguggcuguacuauuuugcauucccaccagcaaugaaugaauguuccacuugcuccacauccucacaagcauuugguguugucaguguucuggguuuuggccguagugauauaucaucaugguuuuaauuugcauuuccaugaugccguaugauguggaguaucuuuucauauguuuauuugccaucugucugucuguggugagguguauguuaaggucuuuggcccauuggcccauuuuuaaaucagcuuguuuucuuacuguugaguuuuaagaguucuuuguguaucuuggguaacaguccuuuguaugucuuuugcaaauauuuucugucagucuggcuuguccacuuauucuuuugacagugucuuuuacagagcagaauauuuuacauuuaggucugugauccauuuugacuuaauuuuugugaaacauguaauuucgguuuagauuuuuuuuuucgcauguauguaucgaguuguuccagcaccauuuguugaaaaaacuaucuuuuguccauuauauugacuuugcuucuuugucaaagaucaucgguugacaauauuuaugugggucuacuucugggcucccuaauucuguuccauugauuuguucauucuuuuaccgguacaguacucuuacuuacuguugucuuaugauaagacuugauuuuggguaauguaggucuucugacuuuguucuucuccuuugauauuguguuggcuaucguggaucuuuugccucuucauauaaauuuuagaaucaguuugucaguauucauauaacuuguugaaauuuuaauuggaguugcauugaaucuguggaguuggaaaugacuuaacauuuuggcaguauugaaucuuccuauccauggacuuggaauaucucuccauuuaauuguucuuugauuucuuucaucagaauuuuauagucuuccuuguauagaccuuauacauauuuuguuagauuuauaucuaaguuuuucaguuuuggggugcuaauauaaauguuuuuuauuucaaauucugcuuguucguugcugguauauaggaaagcaauugacuuuuuuuuuuuuuuuuuuuuuuugagacggagucuugcuuugucgccccaggcuggagugcaguggcgccaucucagcucacugcaagcucagccucccaggcucaugccauucuccugccucagccucccgaguaguugggacuacaggcgcccgccaccacgccuggcuaauuuuuuguguuuuuaguagagacgggguuucaccguguuagccaggauggucucgaucuccugaccuugugauccgcccgccucagccucccaaagugcugggauugcagaccugagccaccgugccuggccagcaauugacuuuuguauauuaaccuuauauccugcaaacuuggugcaauugcuuguuaguuccaggguguuuuuccuuauuucagauuuucugcauguaugaucaugucaucucugacaaaaagacaguucuguaucuuccuucccaaucuuuauaauuuuuauuuccuuuacugcuuuagcuaggacuuucaauacaguguuggaaagcagugguaagagaggacaucuuuuucuuuuuugagacggagucucacucugucgcccaggcuggaaugcaguggcgcgaucucagcucacugcgaucucugccuccuggauucaagcaauucuccugccucagccuccugaguagcugggauuaagggguuuugccauguuggccaggcuggucuugaacuccuuaccucaaaugaucugcccaccuaggccucccaaaguguugggauuacaggcaugagccacugcgccuggccuuuuuuguuugugauuauuuaagggggaaugcuccuaguuccugaccauuaagauauuaguuguagcuuuuuuuguagauauuuuaaucaauuugaagaaguucucuauuccuaguuuacugagauuguuugacuuuucacuguugaauuuugagaguucuuuauguauuuuagauacuauauaugguuugcaaauauuuucuccuaguaaauuuuauuguccuauauuuaagugauucauuuugaguuaauuuuuuauauaaagugugaggcuuaggucgaaguucaucuuuuuugccugugcaugucugcuuucucuggcaccauuuguugauaaaacuaucuuuccuugacugaauuguuuuuuuuuuuaaccuuugucaaaaaucaguugggcauauuuguaugagucuauuucuggguucucuauucugcucuauugauacuuguauauauaucaguacuacuugaugucuguagcuauauaguaagucuuaaaaguggguaggguaauucaauuccucccucuuuuauuuuuuuccaaaauuguuucagccauuguuguucuuauacaacauauacacuuuagaauaaucucagcuuauuuacaaaaaaacaucuugcugggauuugaauaggaauuauauuaaaccuauauaacaauuuuaggagauuugacaucuuuacuagagucuuagaucucuccauguauuuagagcuuugauuuuuuuuuuuuuuuuuuuuuuuuugagacuggagucucgcucugucacccaggcuggagugcaguggcacuaucucggcucacugcaagcucugccucccggguucaugccauucuccugccucagccuccugaguagcugggacuacaggugcucgccaccacgccuggcuaauuuauuuuuuuuuauuuugagauggagucucgcucugucgccaggcuggagugcaacgguacaaucuaggcucacugcaaccuccgccuccuaguuucaagcaauucuucugccucagccucccaaguagcugggauuacaggcuuguccuuccacgcccggcuacuuuuuuuguauuuuuaguagagacgggguuuuaccguguuagccaggauggucuccaucuccugaccucaugauccgcccgccucagccucccaaagugcugggauuacaggugugagccacugcgccugccuggccuuuguuuuuuuaagauggagucucgcucuguugcccaggcuggagugcagugagccacugcgcccauccucugggaggcuuuuaaaauagauuucuuggguuuucuauguggaugauccuuugacaucugcaaauagggaccauuuuuauuuuuucuuuucuuaucugugugccuguuauuucuuuuucuuacuguauuauauuggcuagaacuuucagcaguauguugaauaaaagucaugauaacagacaucuuugccuuguuccuaaucuuagagggaaagcaucaguuauuugaguuguauugaggcuggcugcuacgucuugcagcaggggcaguuuaauagccucccugcaaaugacugaagcgacaauagugugacagccacuugcguaagacguuuaugagaaaaggggaggaaaaaagccuugagaguaagcguacaaauagcucagcuuauaguuuccaccacauggacaggauuguugccagaauccuguuggcuucauuugagauauuuugagguuguuggcaucaggcauuuuguucauuuuguauugauacugagauaacuuuuuaaaaaguaaucuggaauuacacacccuaaauaucaaccauagaaaacauuuuuucuucuuaaggaauggucucugcagaaauguuuuagaacguauucugaauuuuucacaaacucuuccuugaaugccugcugauugaauggauacaggucguacaggcaaauacacgcuauuuccauaguacugaguauauuggacuaaaucuaggcaaaaagcugccuaaaauuuauacuguaauuggucagcuuuauauuauggcagccuucucgggggaggaacauugauuucuagugacugccacugaguuaaauacauuguuaauagcagaaucuuuuguguguaaagagccugcaacccacuucuaccucugugcaugugucuuaguugcuaacaggagaaacuuauuucuucuugugcuuuggaggacuugucugccaucaaagaucuagggauuauacaguggaucugaucaggcuguugucugcuuuugagccuuccaaauuacauggcuuaauaaaaugauuguuuucugugcucagaauauuucuguugugauccuuauacuucauuuucuaguugaaaaaaguguuguuuugccuuugcucuuaugauacaacuaauacauuuuuauugguaggaacaguaaaaggugcauagguaaaacagucauacuuaauccuuuugguuaacaaugaauuaauauucugaugccuagcaccucuaagcuguuuucuuuagacauaaguuuuauaccguauguucuguguuguaaucuuuuuauuucaucaugaacaucuuuguguauuacauaguuugcaauauuuuuaacaguugugugacauuccauuuuaaaccagucguauuuuggacauuugaucuuuuuuuuagccuugugauggaacaguaggucuuuuucagucuuuuacuauuauacauggucaugcaguauggauucuugugguuaaauauuuguguacaucuuuacgacuuucuuuggauuaauuccuagaaauggaaguuaucaggaaacugcagggcuauggugaauuuuuccauccugagauguguugcaaacauuguacacucuuauuuucaauuaagaguuugagaugcuuguaaaagagaaaaaauuuucauuuugaccugauuugguuucagucuugugcaacauagggaugugggccaguuugaucuggagagauucuuuaccucucucuaccugauagcugugccucugaguuggcauagcaucauaacuccaguguuuuuacuuuaagcauuuugcauugcucuucauucuguauugucuguguccaagcuuguagagcucaagauuguagcuuuaaguucucacuucuuuugggauuuucuuuuuucagaucguaaagcugaaaauugaaaucaugaaaguagacaggacuaaacugaagaagacaccuacugaggcuguaaguauccaaaaguuuacuuugcuuauuuuuucuucauuaaaaaauaaaaaaauauuugugaacaguucauccaugcucuucaaaucucaucacccauauauacaaaaggcaguaaaacaacaacuugucuagaaacaguaagauuuucuuuugaacuucccuggaucaaaaaaauggauagccaagagaccaguggaaagugaacaccgaucaguuaguucuucguagcugugugugccugaagucagcucucaggcugcugugcaauuccuuccuaugcagaaaggaugugugguauaauggaaagagcagauauggguucagauuuuuaauguacuucugggaucuugcaauuuuguuuuuuagaaaaugaaagugguaacaucuuucuuacuaguuuuuuuguuaaggccaguguuuuagcuugucuuuauuacugauucuuaaucacacaauucagcuuaacuuguguauuggguggucauaucaauuaacccuuugucgacaguagaaaucccagcuuuaaucuaguaauauuccaccagcuagcuugaacugcuuucuaagguugaggaagugguauugcauugugauaguccuguugaccccuugugcuuaguucagagagcacaagcuuugaaauuagaccuagguuugaaucuuaccagacuuuuguggcugagagguuauuaacuugccugguuuccacagcugcaaaauggggcugaaaauuuuuuccuucuugaugugaggcaauugcuuagcauaguaucuggcacauaaguuaguucauaucguaaauacaagccacuugguuuucaaaaaauguaaaaguaccuggcaaguaucaccaaaagauaacaauaacauuuugcugcauuucuuccaguuuuuuuuguuuguuuguuuguuuugagacaggguuuugcucugucacacaggcuggagugcaguggcacgaucacagcucacugcagccuugaccucccagcucaagcgaugcucccaccucagcuuccugaguagcugggaccauaggugcaugccaccaugccuggcuaauuuuuuauuuuguguagagacaggaucuugccuuguugcccaggcuucuuccagucuuuuaaaaaauuauuacaugugcacacacaauuauccugcccuuuucauuuagcauuguacuaaugaguaugagcagcacuuucuucauauacccuugucaguauuacagauugucuuuuaaauuuuuguuaauuucauaaguggggaagaaaguauuucacuguucuauaucaguuaucuucuugugccauucauuuuguaucugacauuggaauaucaguguuucucuuacugaaugccauauauauugaacguacucauuuucauaucuguuggaaauaucuucauuugcuuuugauuuuguuuuugauguguuuuggcaucuagaaguuuugacaacuguguacuugaaugucuuuuacugaaggacaaaaagaaaacuugcuuaagaaacuauaauuuaaaaauuuaaaguggaaccaauguaagaaucuacugcuacgagaauagaagaccuagaaaagugauccuaguguauauaagaacuagauauaugguaauagagggauuauaaauuggaaagaagggacaguauuaggaaaccaugcuagaaugauuaucuuguagagcaugugggacuauuauauugcgauaaauuuuagauaaaccaaaagucaaauguuuuuaaaagaaauaagcuauaggagaaguagaacauguaggugaauguuuacuuugucuuaagugggcauggucuuuccaagcauuaaaacaaaggaaaaaaaccauaauggaaauguuaaauacuguauccaaaauuaaaaagacaugacaauagccauccuaauaggugugaaguaauaucucauugugguuuugauuugcauucccuugauuuccuugauagggagcaccuuuuuauauauuuuaaaacuauuuguauguaaauagacaucuggauaaaugucuauucaagacccuugcccguuuuuaaauuguguuauuugggauuuuuuugcuauugaguugcaggaguuccuuauauauuuuggaaauuaaucccuggaagacauuaggcaaagugaaauaagucagccgcagagggacaaauagugcaugaauccucuuauaugaggcaucuaaaauagucaaagguguaaagguaggcaguagaaugauaguuaccaggaaauggugggagagagaagggggaguugcugcucaguggguauaaaauuauaccaggcaaguucguuccagagaucugcuguagaacaacauagugccuauaguuaacagucagguauugaguauagucugcccuccguguguggguuccacauuugcagauggaaccaacuggauaguaaauauuugggggaaaaaacaauaaaaaagaacaauacaaaaguaaaaauagaaauuuugaagcaaugcaguguaacagcuauuuacaucgaauucaguauuguaauacuagagaugguuuaaaguauauaggaggauguguauagguuauauacaaauaccauugccauuuuauacaaaggaugagcagcauagauuuugguauucauggggguccuagaaucaauccccaguggauacagagggacuacucuacuuaaaaauuuguuacgaggguagaucucacguuaaguauucuuaccacacacaaucaugcacacacacguagggacacaaggaaacuuggaggugauggauauguuuauuaccuggauuguggugauggcaacgugaguguauacauacauccaaacucacccaguuguaugcaugaauuacgugcaguuuuuuuguauaccauuuaccccuuaauaagcucagguggggugggggagggggaagacacaugacaagcuggggaaaauauuuguaacccaguguaguuaauauuuucaguagcuaaaucaggagaaaugaauaucccaaugacaaaaugggcauagggcauuuaagaaaagaacaaacccaguaaacguccagcaagauucaacuuagcggguaauuggagaaaugcaaauuaaaaaacaauuuuuaaccuaguggauuguaagggguugcucuuggagucauauacugauuucuggcucuuauuuccuaguuacuagcaaguuacuuagcauaaacuccuagaaguggaauuuuuaugucacugguuauggacauuuuuaagacuugaguugucuauuuuccuugagcagcauacaugauugcccccauuucccauacuguggucaaugcuagguacuauuaugaaaggcuuuuauugaucacuuuguguaucaguagcugugcaaaggauuuuuuccccagauuugguaucuauugaaauaaaucacuguaaacccuggcaauuguuauugagcuaucgaacuggcaaaugcuuucuuauaucuuaacguugugcuugcugcuuucuccugcaaaaugcaagggaccuugauagucugauaaaacagagaccauaguacugguacauuaaauugaugccauuaugcuaacuggaucuugugagcagaaaacacaagcacaccuuagaugccucagacauauuugugccagagagucagaaacaaaccuuguggaagcuugagggccuuuucacauuaggaaaguuucuaguggccccaggguuugggaaauauugggauaucccuucuaaagugagagggaaguugcuguaccuuguaccacacacugugaagaaagaggaacaaugugugaugcguuuggauuuuggagccaacauauugguuggucacauuuaggcaugcuauuuugaccuauuuacuggauaaccucuaacacauuuaguggggaaccacuaaaguguuaguaagguuuggaucuagaaaagacucugcaaaagguccaggcuaugauacaaguugcccuaucacuuggacauuaugaccuaguagacccaggugacugacuuaggugucagcuaaagaugccauguugugcuuuuggcaagccccaauagaauuacaaguaagaccccuagauucuuggcugugcuguccucugccaccagcuauucuacauucacaaaagcagcuucuggcuugcuacugggccuugguaaagacugaaugccugguuaugggacauaccaaauuauuacaggauccaaauguucaucaugaacugcaucuuaccuacacaucguaaaauuggauuuguacagcugcauuccauuagaaauagaaguaacacguuugaugcuggacccaaguagguccagcaggcacaagugaacugcauaagcaggugguucaaauuuccauguuaucuauuucugcugcuucacugccucucccucaacuuacaucuuagaggagaagaggaaaaagugcaggccugguuuauggaaggauuuugugccaaggauuuuacauauauuuaauuaccaugaacauuugagguagaucuuaauaaugcuuagagggagaaaagguuuggacuuagcuuaaagaaaccccuguuagguuccauguuguuucagaugccgaaaauacguuucucccaguuugaaucucacgacagcauugcuggauauauagguacauguuaguuuauuuugcagaagaggaugcugagauucaaagagguagcuuaccaacuaccugauuccaagggucauacucuuuuuaauaguaugcugucucugaauauuuaagcuccuguaaugggagauaaguauuuuauguauguggcagacguuugaguuucauauuugugagguagcuauuaggucuguuuuucugauaagagagcuguggcuuagagguuagacuugcucaugaucaaacagcuuaguaaacaugaaguuaaaaagugaauccagacuuguuugguuccagaccucugguccauucccaggaugcuguacugccuuuauggaguuaaagaacaaguguaauaaucacuucucccagcugccauucauuaacggaaggcuucucucucccagccccuaucccuuucccuccuuccacuuucagaaacuugacuauaaaugcucaauccacuccuuguuaccugacaaauggacccauucaucaguagaagagagcagaaauguauggaaauaggaaccccaagaaagaauggaguccuaguuuuacgaaguucggaagcuguuuaccaucuuacaagugaaggauuuuauguaacagaaaaauauagcuagugcuaaucuucaccuuuaauugugaauucacuaggacuuuucagucucugauucaauauaaccuaccaggcauucugguuaacuuucagaccaugguauagauuccuuaauuguuuuuuuuuuuuuuuuuagauguuuaacuuauuauuguuuuuguugucagcaccuuuccaaauaguuugucugcaucuaccuuuauccaaauccaagguggguuuuuguuuuguuuuuuguuuuuuuuuguuuuuuuuuguuuuuuaagcccagguggauuguugggggaauaaaagcauuuucucaugagguuuccauuuuaaucccaagagauugucuggcacaucucguuuucuuaaguaguaaauccuagcaaaaggaaaauugcugugugagcuuaaggguuccuuuucugauucuccuuauuugcaacucccucauuccaaaacaucuuuugugaauacuuuucuuuucucagccugcagacugcagagccuuaauagacaaacucaaaguuuguaaugaugagcaacuucucuuggaacugcagcagaucaaaacauggaacauuggaaagguaugugaagucaagcucccaaaagacaggacucaccauacuaauacaucauuuuguaugcucugauauggaauaagaaaccacaaugggauagccucauucagcaauuaauaagcaucuagcaugugccaugugccuaacacagcuuuaaaccaguggcaaggaaaauuuugcuggcugaggauggagaauugauuucacaggugaugcuuaagaaucucaaucacagaauuccugugguuugacaauauaaguuugagauaauuucuggauuuuuaguuuagaagaauuuuuauuagauaacucuaaaaaugaauuuuucugauaaaauggauucuggcaaggauaguucucuugucuucguagaucuuagaauguaaccggaguucuccaucuaaagaccuagcucuagggguuuuauggugucuauugguguuagcacauauaucuagauggguaugacaaugaacuacagcacuuuuagcucagaguaugaucuuucucauaugggcaagggugggacgugaacuugucuaggugucaugcucagcaaucucuuguaacaaagcucaguuagaaagcacccaugcggcgcuucuaccuuauucuuacauccucuuuuuccuccccucuccagugcgaguuauaucacuggguggaccuguuggaccgcuucgauggaauacuggcagaugcuggacagacaguggagaauaugucauggaugcucguaugugauaggccagaaagagagcaacugaaaaugcuucucuuggcuguguugaacuucacagccuugcucauugaguacagcuuuucccggcaucuguacaguuccauagagguaggggagguuaaagccuguguacccuguucuugacuagaauuguguacauccagaaauaaggaaauugcuauuucuauugcuucuuuccuuuucauuguggagcucuggguuuuucauugucaaagauaauaguagaauguuucuuggauauagauacuauccuucauaggguugaugggaagauucuguacuaucaccuuugcuuugccuuuucaagauucaagaaaugaaugagaaauguuauauauguauuaaaguauuuaaggaaauuugcaugaauugauuuuugcccuagguuguuagagcagccccacauuacuuuuaaauuccuagaaauaguuugauuuucucaucacauuaauguacuuacuacuccucuaaguguuagugugcugcuuuaaagucucucuguacucugccacacccaucccaaaauauauauucauagcauccuuuguguccuugaagaguaagguaggugcagcaaucagugagcuuuuuaauugguuaaaaaucacuguaagaagaaauuauuuucuuuuuauagaagcccaacuuuagacuuuuuaucaucauuaguuaggugcccuguuaauuuuagguguguuuuccuacgucuucaguagagaaacagaaucagaacaaacaacuuaaaagaaaauggcuuaggaaaagaagugggauaacugaacuaaaggccuaacauacagagcuuuaagugggagguaaauaggcagucuguugaagaugaaauagauaugcugcccauggaaguccaugaccuucgguauaauuggcaacuggaaaugccuugguucauuucuagcuauauuacauacugauuuuaauucugaccaacugcuucaauguauuggugaauuuuaauuguauuuaaaagccaaaguaaggccaggugcaguggcucaugucuguaauccugacacuuugggagguugaggcgggaagaucacuugagcccagggguucaagaccagucugggcaacauagugagaccccaucgcuacaaaaaauacaaaaauuagcggggcgugguggugcgugccuguaguccuagcuacucgggagacuucggugagaggauugcuugaacccaggaggucaaggcugcagggagcuaugaucaugccuuugcacuccagccugggcaacagagagaccccgucuccaaacagcaacaacaacaaaauccagaguagucacucagguuccuuaugagcauauacuguacuguaacacuuauauguuauauaauugccacgagcuguuaucgauaucuuuagcuucuauaugaaggacccuguuuuaauuaauuucaauuuuauguuugucauaaaggauacagaagagaacauaaaauaucuuucuuucacaauacuuuuaguccaguuagagacuuaauguucuucuugagucccacauguguauuugucucuuuuccuuccugugggaaaaccugcgcaauuuugaaccacuauuuacguuuuuuacuuuuauugcacuuuauagcuaacugccagauuuuaagcuccuuggggauaagguugcauguuguagauuaucaaauacauauauauauauauauauauauauauauauuuuuuuuuuuuuuuuuucuuuuuuugagacagagucucccucuguugcccaggcuggagugcaguggcgugaucucggcucacugcaagcuccgccucccggguucacaccauucuccugccucagccucccgaguacaaauacuuauauauuuuuuguauuguugugacuaaacuucuugauagcuuuguaaauguugacaaguacauuuuguuuuguuuucaaggccaguugugccugauaccuugagcuuugcccuuuuuugucccuuuagcauuugacaacuuuauuggcuuccucugauaugcaaguggugcuggcaguccucaaucuccuauauguauuuagcaaaagaucaaacuacaucacucgucugggaucugacaagaggaccccgcugcuaacucggcuacaacauuuggcagaggugagucuugggugaagaguuggaggggugcaaaaauuggagcauaugguuccuuucaacagguguuucuuggaguguuaaaauauauuagaaucccuaaguuaacuucacuggccuaauugaguuagaacuauuggugcccuguuuuaaaaccuaaguauucucaguuauuaaguaauuuugaaggaauucuuuaaucucugcucaccaaacaaaaucucucuguucaaaaguggcaauuucacuucugaaaggaaaguucaaaauuagauucaauucugugugagaaggaaguauaaugcaauaauaagaucuagauuugaguccuggcccugcuuacuagcgccgacacugguuuccucuucugggaauuuaacauaucuacuucaggguugauuuagaaugaaaugaauugugggguacucagugcugugaucaguaagucguagugauuguaauugaagccagaagcucucauauaaaaguucagcucuaccaaacuauuguccaguguucccagaggcaacuucuuaauacauacuuagcuuugagagguaacccacuguuggaaagcuuucuuagaagaaaaguguuauggcuggcuuuuuaaaagcauauuuaaugcuuaccucaaaguaauucaaguuuucaggcuaauucaggugccaugauuacuuauaaauuaguuuuguauaauuauaaauauaacauguauucugaaaauucuaggaaaauguagacaaaaugucaaucaccuauaauucaucccuaugagaccucccuuaaaguuggagcauuuuuuucuugcauuuggaaacacauguauacaugcaugugaccuguuuucuuaagauacuguaaauauuuccucuuacuauuaaaaaccacaaggagguuuaacauuggauucccaaguccacaguuaaaaggaaaaaggaacuauuacucaauagaugcuuccaaagcacucgauaaaauuuaucucauuaacaaaagcuucauauaaacuuuaagaaaacuagaguuaccuaccagaagucauaaugggggagcugaggcauuuccauuggauucaaaagucacacaaaaaugucagacauuaacuucugucauuuacauuuguaguacagaugcuaaccaacagaaaagaaagaagcgaagaauacauauuaaaagaaaaaauuugggcugggcaugauggcuuaugccuguuauuacuggcacuuggggaggcugaggcaggcaaaucgcuugagcccaggaguuugagaccagccugggcaacauggcgaaaucccgucucugcaaaaaguacaaaaauccgccaggugugguggcacaccccuguggucccaguuacuugggaggcugagguaagaggaucacuugagccugggaggugaaggcugcaaugagccaggaucgugcuacugcauucuagccugggcaacagagugagaccgagacucugucucuaaaaaagaaaagagaauauuuguuacuauuuguauguaggugaugagucucuuuguuucuuggggagauaauguaaaauuauuauaacuaguaaaagcacagugagguagccaagagaucaauauacagaaacagauagcucuuccauguauuaauagcaaccaauuagaaaaugauuggugaggccaggcgugguggcucacgccuguaaucccaacacuuuggggggccgaggcaggcagaucaccugaggucaggaguuugagaccagcccggccaacauggugaaaccccaucucuacuaaaacaauacaaaaauuagcuggacgugguggugggcacuuguaauccuagcuacucaggacgguaaggcaggagaaucgcuugaacccgggaggcggaagcugcagugagccuagauugugccacugcauuccaggcugugugacaagagcaagacucuaucucaaaaaaaaaaagaaaaugauuggugaaaagaccccauucacaguauaagcaaauauucugucuguaaaauaagucauauuggcuaaaacuguaaauuuaagagcaguuaauguaggagguuguguuguaauaacaaugguggggaaagaauucuuaaaauccccauggcauaaaccugaaaguaaaauuuugaauauuguauuuaaaaauauacuucccaacaaaaaacacauagcuccaggcuacuccuuaggcccuuacacuagaauauaaaucaacacacugcuuccuucaucaagaaaaaugucaguuguacuaaauaguauaguuaccaauguaguuaaauaacauucugguacaaccucauuuugucauggaccaauaaaacuugcaaacaauugguguaauagcaagcagcuggucugcauacaaaauuaggcagcacuuuguacaacagaaguuaacagacccaugguagauuaaaaauguuuaacaguguuuuaaaacugaaaagggacugcuaauguagaauauccaaggaacucuuccagaucaacaaggaugagcaaaggauauggauaggcaauuuauagaacaggaaauucaugugaguagaugcccauacucaguaauuagagaaauaaaaauaaaacaagguacagcuuuguaagcaucagauuugcagaaauuagaaaacuauauaaugguaaguccuggcagguaugugaagcaaugggaacccucauacauuguucauaggaguguagacugguucucauggguauauauuucaaaggugagaucgcaucauuuccauaaacgugaucucugucagaguauugcaucaucauuugugguagugaggaguuggaagcaaccuugguauccaucauuaguagauacucaaauaaguaaaauguggcacaugcacacuauggaguauguagcaguuagaaacaguggaccaaauaauacagcaacauugauggcuucuaaacauagugguuagugcauaaaaaaguaaaagcaacaguuuucauugcucaguaccauuucugaaacuuaaaaagauguacacaaugcaacauauaguuucaagaaagaaaaauuaacagacaucaaaaguuauaccuuugauagaagggaaucugaaugggcaauaaugggacagauacaugaacaaguacaguagucuccccuuauccgagguuucgauugccaugguuucaguuacuugcaguauaauacaauaagauauauuaagagagaagccacauucacauaacuuguauuauaguauauauuaaacuuuaucaucaguauguauguauagggaaaaaauguguguguguguggguguauuauauaggguuugccacuaccuguauuuucggguauccacuaggggucuuggaauguaucccuauggauaagggaaaauaaaucuuaccagcaguauuuaagaucuguuagaccaacacuaaaccuuuacuuacagauuuaaaagauggucuaaauagagacaaguaacauuuuuuaaaugggaagacuuaauguaguagaagcccuuuaaugaaauuaggaccaaugauugguaguuuaauuauuuuaaaaaucuuguuaaagcaggaaauguuuaaaaagugauugauacauaugauuuuuuaaaaacuaaaauaauucccuuucccaucuuaugugggccauaagacuuaguaagaagcagucuguuuucugacauaaacuacaacuauaaucugugauuacuuuaugguguugcaccgauugaagaaaaggagccugcauacaggauucuaaauuuuuuagaguuuaccccugaaucucuucauaauuugacacuuuuuauuuuagcaucuugccuuuuagaugaauauuuugcaaaauauucgacuuaguuuuugugaaauaauucccuuucucauuuaaaucagucaaauugauuaaguggaagucuguuaauagcaucaacugagacacagaaauaaaugagaaaacacugauaaugaaucagggugaguugcuguaucagauaauaucauaaagcuauagugguuuuauuauaaagccaaguuuuuaucauaaggcuuuuuaugauuaagccaagucuugcaguuggcacaggaauagacaauacaucugcaaaaugaaagaguauaccuuauguugcuuagaacagugggacaguaggcuguuuugaggggaaaauguguuuagaacuuuucuucacacuugacauaaauccuaggaacguauuuagagguaaauacaggugacuuuuaagaucuuugauaagaguuugcuaagaaaguuaacagaccuagaagucauuaaaaauacagcuuugaucauguuaauuugguuauuuguauaggaccacaauagcaucugacagaauucacaucacccuacuuuuaggcugauacaaacacacuaauauuucauacuuuaauuaaauguucugacaauuuaaguagaaguuaaaaugcaaacuguuuuugguauaaguggcucacauauauaaaguaucggguauguuucuuuguuuuguuuuuuagguaauucagauccaguuguuguucuuccuuuggaugauuuuaccacagaaaggacugcuuaaaugauugcuuuuuugucccuuugcauuuuugacacuuuuuaccuuugagaggcuugcuacuuuuugcucugaauugaucuaaagagauuguagauuggagguuaauuucuaguccuggagaauuuggaaucuugacaggugcaguacauugcagccuuugguaauagauugauguguuuggugcuuugcaauaaaagauuuuuacagguuuuugagguuuagagauaauuagguauuuaguaaugguaccuccaauacuaauaucccucauuaaaauuuaaaaauuucauguuucucuaaaauguaaaauuucucuaaaaacuugacuuguucaugugggcuucuuuuauuuauguauuuauuuuuuuugagacagagucucacuccauuacccaggcuggagugcaguugcacgauaucagcucacugcauccuccgcuucccaggcucaauugauccucccaccucagccucccuaguagcugagacuacaggcaugcaccaccacacccggcuaauuuuuuauauuuuuuguagagaugggguuucgccauguugcccaugcuggucuccaacuccugagcucaggcgauccacucgccuuggccucccaaagugcugggauuacaggcgugagccacugccuguccuugugggcuucuuuaacaaugcucauagaaaucuugguucaugucuuuucagucuuuucaggcaacuuccuuugcaacaaacacauucacuugcauguguauaagaaccuggauuuggaugugaaaccuacuuuugccaacaaauauuaaccuguuucugugucuguaaauuggggguuacaauaucuaccucauaguuuuuuuaggaucagaguaaaggaagucauaaauaaaaccuguaggguuaaugccaucauguuggaaguacuuaauaaacagcugucauuuguagauggaugucaaccagagaaacuacaugccauucuuuuguauuugcuuucuuuuaaaauguuacacaugcauuauuuuauaagugcaugcauauugucacaugauuauuuucaguacagccuuuucccucuugguucaccuccccauaaccucaaauguauucuucucuauauauuaucuucauauuauauugacuguugaggguguuuuuguccuucaguuacaaaugcaggauaccuuacauccuuguuuucuuauuucagaccuuguucaaaaaucacuuuaaagucaccuguauaacuauaggguucuuuugauggcugcauaguauuccaugcuuuggauguaccauauuuuacucaaguucccuauugaugcauacuuauauuuguuaugaaugaugcuacauuaagcaaucuuauauaugaauuuaguuacugauacauuuaauaugauauuauaagagaugauauggagaucauaagauagagucccagaaaucucagugugacuuuauuggcacuucacugaucaguaaugauuuugagcaucuuuaugcuuggccauuaggauuuguucuugugaaagguuuuaucuuuuguccauuuuuccauuugguuacuuuuuccuacucuguaaaaccauauuggagauauuaguccuuugucaucuuaaaaguauuuuuuccccuaaucuucauguauauugucuuuguuuauuguguuuuguaugugauguuuucaaaaaugguucagucaaugcuuuuauauaaaagauugaauaucguguuuuggucuuuaugaaaagugacuuuggauauggugucuuuccucauaguaguuuuuaaugacuaggucaacccagugaugugggcuaauugugaaugugaacagugauuaguuaacuacagauguagggaaaauucuccagaaagacuuguugaaucaguugaaagccaguuggcuggcuuuugugaaggucugguauacucuaggucuaguaaacuugaggaugcaucagaaucacuuuauuaaaaaauauauuagucuuccucaccuccaucccaccuaacuccugaguugcugauucauuaggcuuggagugggccucagaauuugcauugcuauaaaguucccagguaauauuaauacuaaccugcugguccagggagaaccacuggccuagucuauuuuauuaaguuacaaacuuuuaucaaauucuuauaauuccaucuuagagagcaucaagccuuuuuccugaugucugaauauuuagcaaauccugucuagugugagguaguguuguauaugccucuguggcauaaugaauauaguuauuuauggguuaucuacuuaagggcuaggauguuacaguaacacuaccagauaggugaauacugugaggcucagaaguuacuuauguauuuuuuuuuuguuuuuuguuuuuuugagacggagucucgcucugucccccaggcuggagugcaguggcgcgaucuuggcucacugccagcuccaccuccuggguucaugccauucuccugucucagccucccaaguagcugggacuacaggcgcccgucaccaugcccggcuaauuuuuuuguauuuuuaguggagaugggguuucaccauuauuuuuggacaaaggcccugggcucuuugcuucugcuaaaaugugaagaauaauaucuguucuuccugucuuaggcauuuggggauucuuugagcauggucauguucguuuuuuuaaauaaaaacaagcuuacuuaguacuugagaaagcaagauaaauagauaauaaauuaauaauaauaagggcaaagaacuaguguuauucugaauaguacugacuaaaaaguacccuagaaucuuaacauuuaauauguugauuuuguuggcagcgaaacaaacuugucuuccugauaaaaauaggugcuugguguuuuauguaugcaacaaaauuuaucauaauuguguaucuacucauuuugguauauuuucuuagucuuuaucugaugaauauuucuucacaagaaacauuucuuuauauuucauauaauguuacuaguucauaaauauaacaacagcacagacuuucgugagucacguuugaguuggcaggguuuuuuaaggaucucagcuuaccaaaacuuucuaauuaaaggugcuuguuuuuuaucaaguugcaaaaguuggcaagaaggauuuuguggugacacuaauaaaaguauucugaaacaauuaguuggaauaacagaagaaacaaaaggaaaauaauuguguagauacacagccuuucaagcuuauucugccuugcagauucagacuuuugguuugacuuaccugucuguucucuguagcaucaagccuuuauacccucauccuuacuuuaugguuuucagcaaauugcaugugucuucgucuucacuagauguccugggaagagccaagaaaauauugaaaauguaaugaaguacuuauuagguauuaaaccauuuuauaaagcuauaguaauuuaaauagugugguaauuaagaguggaauugaccaaucaguagguuccagaagcagauccaauguguaagaaucgaauuuaugguuaagauggcauuucagauuagcagaaaaagaauggauuauucaaauaagaugguguuguaaaaacuggcuuacucuuugggaggcaauuaagguagauucuaccucaucaaaguaaaauuaagauguaauaaaaagcugaaauguuaaaaacaugaaguuauacaagcauugaaagaaaguauaacugcaugguuguaugcugcuugaaguggcaagauauuuucaagaaugagacuaaugccaugaaagaagaaauugauuccauuacaguaugauuuuauaccuucugucugugaauauuuuagguacugucaauugugccaucuaugguuaucucaauuuacuucacaguuuucuucuuacuuagguaauuuccaguauuuuucugugguaaauaaugcuacagugaauaucuuuaauacgugacuauuuggccauauuuagcaccagguguuuguuaccuuuuuuggggucucacucuguugcccaggcuggagugcaguggugcaauuucagcucacugcaaccucugccucccggguucaggccauccucccaccucagccucccuaguagcugggaccacaggcaugcaccacaugccuggcuaauuuuguauuuuuaguagagacgggguuucaccauguugggcaagcuggugucgaacuccugaccucaggugaucugcccgccucgggcucccacuggcugagugcugggauuacaggcaugagccaccgcaccuggccgucuguuaaacaucuuaaugaaugucgaaccuuguauuuuacagauucuugucucauugccuuaaacuucccuaguuguuuuaaacuucugauuauuuuuuagaguucugauagacuugaauuccgacagucaguuuauucacuguuuuugugaaggugugggcuuaugggguuccccauucugccauuuucacugacagcauuccuaguagaacagucuguuuuuaaccagcugggagugggggauauacauaucuguguccaggcagacuuucucacuuagguuuucacuagagaaguaagcccuaaugcccuaagguauccauuauuaauguagcaaagagacuucucucuugugcaucuaagguggugcuaguuauguaccauuauuuggagaauaaaaugaucauucaccauguucuguguuucauauaugauaccuggauugagaaaugcugccaguagaucaaguguaguuugagaaagcuuauuucucacaggauagucagaugauguuuuauuuauucauuuauuuauuuacagguuuagaaauagcauucuauaguauguaccuuugugacuggcaucuucagugguuuacacuguuuguuuuugagacuucuuuggcaaguagugauauaauagcauuuaacaaagaggaaacacuuagauguagagagagagccauguuaguucaugguggcagcccagauccgaggugauugggacccacacuagacaggaauaaaaugaagacauagaauauaaguagcauuuugugcuucaaucaugccagacuuaaaaauaugauaaugcuuggcugggcaagguggcucacagcuguaaucccagcacuuugggaggccaaggcagaaggaucacuugaggccaggaauuugagaccagccugggcaacauggcaaggcuccuacaaacauuuuuaaaauguagccuggcgugguggcagcauaugccuguaguccuagcuguguggcaggcugaggcaggaggauccuuugaccccaggaauuugaggcuguggugaguugugauugugccacugcacuccacuccagccuaggcaacagagggagaccuugucuaucucucacacucucuucauauauagcuacauauauauaauuuuuauuuuuauaaauuuuauauaaaauuuauauaauuuacauauuuauaauuuuuuaaaaauauacaaaauaucuuuuuauaugaaauguuuuauauuuguaauauaaaaaucucuucaguuugacauaacaaauuaauaaauuuguuucaaauaauaucucauuucuuucacuucgucaauuguuugccugaacuauaugccuugccccaugaggcagggagauauauauuuuuuacauauauaaauacauauuuuauguaauauauguaaaauaauuaugaaugauuuaaaaauaaaaauacguuaaugcucuuaauguuaaagugauauuuuaaaggcuguuaagaugcaggcuaguuaguaagugagacuauguggcugaaguuuuguauuuagaagccaguugagccacuccccccauuaucucaggagcuuguugaugagguuuuagauuugaguggcaaaguacaguaguaauaaauaagguagaaucugcuuuguaacucagcucaugucaaaaagagaggaacuggaaagcaugauuuccucccuagugcuuuccucccuagugcggaaggugaguaggcagagccucaggcaaggccugauaggacaggagggaccugucagcacacgugacuacagggguauggaauauaauggcuggcaguugcugcuugaguucuuccuaggagcauccucacugaacagugaaauugaucucauugaagaaaucaccuuuaggcagaccaucuugccuugauucuuaaguucuuauuucuguucguuuuuuccucuuguuugacuuucacauuggaugucuucucaacauuauguuccaagcagccacacacucuuaaauauauauauguauguguauauacauagagagaaagagagauaaggucucacucuguugccuaggcuggagugcaguggcgcaaagucaccauaagcacugucuuaacacuaucuuuuuccuuuuucaagagcugggguggaaaggagaauggcuuuggacuugcagaauguugcagagacuugcauaugaugguaaguaacucuuugggauaugggugucuuuugacagagcuguggccucucugugaaccuuacuuuacaaugaauugugguauaugaagugacgccuucacaucgagaccuuugaggaaccuaagaucaguucagacauagcugaaccacgucuauaggaagcagucuagcagugcuugggcucuugaugugcuggugguagauaaaaaaaucugagaaauagaguguguguucauacccaguucuugaguagguagcuguauuuguugaauuaauuuuaaugugauuuuuuuuaaaucccagaaaguauguucgcuugcauucucacacuggaacuauuguaucagaacucuggacaguguggugugauuuaggaauggcugcuuggagagcaguucuaccauuagguuuauugagaacuuauaauguuuuaugugcuuuccuuguuuaucucucugccuuucacccauguuuaaguuaugagcucaggccauccuccuuucugcuuugauauguugcuguggagcuacaaaacacaauuugauuuucaauaauuauuuugcaucuggaagcaacuauauuuuccacgugggauuugucuugucaguuugucguguuuagcacaaauggcugcagugaaauuuaguguauuuaucuuagcaagccuuuuuuuccuaaagagaauggcucuuuucuggucucagaaaaccacagauuagaucaaguuacuuucccacguuagcuggcauacuuuucuuuagugauuauuuuaugaagagauauugggugauacaguaggugaguguugucuguuuaauaaucaaaacuacauaaaucuugaaguauauucagaguuuggaauucuaauuaugacaacauaaagguuaacguguacuuuaaaaggaaguaauacauauacauguuaaaaaauucagaguauaaagagguaugcagugguaacuucuuaauuuuccagaggcaaccacugcaaguggugucuuucagugagacauuuuagugggcauucugcugucaucuuaauuuuguucaucauguugcuuuucuagaguuaaagagaauguuuugucagggucugguuuauguugucuugguaucuaccugugcagaaaacauaccaugagaagugguguagaaugguauagaaggaaaguguuugaagaauuaugaagauaugccuaugaggcauacuuugaauuaaauauuucagaaggcugaugauagguacaagguuuuucguaggaauguucuuuuccauucuuuagcugguuucugggcccugguauuuguucuccauccuuucuuggauucuuauucauuacugcuuggcagucuugccccucuuuucccccuugggaauagccacagucaaaauugaucucuuaaagggaaacuggaaauuuauaaguaugaaaugcagaagguuugggagcucugggcucuguccuuuugauucuguuugaaaagucucauccuaucugagcucugcucuaagacaaacaguuaaaggcacuguagguacugaauguacugcuuauucuucugccacaauaaguugaacaaguggcuaggacuuugagggaagaugugggggauaauguuuauaaucaguugaaacucaaugucugauucuuugaugugcuuuauacacagaaauauccacccagugcaacuacacuacacuuugaauucuaugcagauccuggggccgaggucaaaauugagaaaagggugagucugauucagauuuguucugacaaagucuacaauuuacuguaacugggauugccucuucuagaacuccucaguuaaaugaauaaaugguuuugagcuacacugcugcccucgcaaacuauaaauauaccuagcagcuccucaggaguguuaauugcauccccaacucugauaggguugggucuuauguugggagcugccaaaagaugcaagucccauccauuaugaggcacugcuaugaccuaugugcuuuucccacagucucugagaauuccaacauguaguauaguaguuuggauggugauggcucagguuucucuaauuaggaagccugcaaaagucuuuauguauuguggauaguguccugcuuaaauuaucuggucauuuuguauuguuugaggagguacuaaagaguuugguuuagaaguagcuuagugaaaauacaauuucucuucuaccuauacuauucaauaaauaaauaaucuuucuagcuuaauugccuugaaagcaacucuaauacauauucagagagaaaauauuuucaugaauuuggucuuugcuauuaauacugcuauggauauuaagucaguggaggguuaaaaaaggacaaagaagaauaugaaaugugccuggcuaugugcauuauaguuugauacuacugguuuuaaaggagcuuuccuaagaauauucuacauauaagauggauguuuuggaagauucucaauuuaccuugauuuuaagagcauucacuuaggcuucagccuauuaggugacaucuugguuuucagacagcccuuuggagcucuauggaaggggaagcuagaguguucagugacuccuuacagcucucuugucuuuuuuaauuuuagacaacuaguaacacacuacauuauauucacauagagcaacuugacaagguaagaggaaucuuugacucuuggcucguuucuuaauguuugguucacuuuuuguuccuaacuauaucuuuuuuuuuaauguagauuucagaaagcccuucugaaaucauggaaucucuuaccaaaauguacagcauuccuaaggauaagcagguaugauguggcuuuaaaacauccacaggaugugguuguuaucuaaauagauuaaugauauguacuggggugggagauugcauagcagaaagaaugucagcuuuggagucagaccaugggcaaauuguuagcuucucugagccuuaguuuccuugucuuuuaugagguuaacacuuaauaacuuccuaggccuuaugagaguuugaggaaaacauaaacuaccucaccgugagcagguaauaaguggugguagcuuucugaacacuucggauaucaaaggagaaaacguuuaguuguguuguuuuuugaguuagcccucauaaagaauauucaccuuuuucauugauguuuuuaaaauguaugucuuaucucucuacagaugcuguuauuuacacacauacgacuggcccauggcuuuucuaaucacaggaagcgauugcaggcaguucaggccagacugcaugcaauaucuauauuagguaagagaagaauacuuuaauuaccaggccguauuagacaguuugggccugauuuccuuugaacuucauucaucuuuguugcuaugaguccuauuauaguuaccuagguagcaacuuaaauacuuccaccccucccaguguucacuguauuuauucauuauccuugagcuccuuaauguuggacgagaaagaggguaugaugauguugauugacaugucaccuggguuuauucuugguauucgucucuuuuuuuuuuuuuuuaauagauaugcuuguagcuaucguucacugucccccuacucuuucucuugccauugugucuuccuccucucucauccuuucagggauaucauuuugaauuaagucacaaaauauucaguagucaauacugugcauuuaacuucuuuuacuguggcacaguaaaauggaaaacacgugguuuuguaaucaguccuguacucugucccugauucuguagauuauuagccacacuuauccucucagccucagcuuauucguuuaauauugagguacucaccguagaggcuggucuaaagauuaaaugaaaaccuagaaagcaaucuagcacagaacaagcacauagaagauauaaaaugguaaccauugcuguuauuauugauguucauuauguuaugacuugccuucucuuaaacuaugaguuucuuggcgugaaauucuugcucuuuuauguguacucauaucuagcaugauuucuggcauguuagugggugcucaggaaaucuuuguugaaaacuaaaugaauaugccuaaaucccauuaguuuaugcuucaggguacuguguccgguauuaaccucaucguggaauucauugaaugugaauuacacacauucugaaguuuuacuacagugucacacaaauuucugacuuacucugcaaugguccauaaauucuguucuuuacaaguguuuacaguaaaagcagaagcauaggaagaggcuaaaauggaaaucuuauauugaaggcauaguggaguuacaucaaguaguaauguuaugaaaaauuaacucagagcuuuuccuauuuccauccccaaaauucuuucucaagacuaauaauaccuuuaguaguggaaucugucaauucagugucuguuuagagauuaucaguuguauuugauccaguccuucagaauuuaauuuggugaugauucugcccuccauugcugguugggaauggaauucuuccccagaaccuauagauaccaaaaaguuuguuauugggcaguggcuugaccacugccuucuugccuaaaguguuuguuucuccuuuugcaguguauuccaaugccuugcaggaaucagcaaacaguaucuuguauaauggcuugauagaggaguugguagauguccuucagauaacggauaagcagcuuaugguaaguauuuuacagguugaguaacccuuagcuguaacacuugggaccagaaguauuuuggauuugagacuuuuuuggggggggaggggauauuugcauauacauaaugagacaucuugggcaugggacccaaguuuaaacacgaaauucauugauguuucguauacacauuauauacguagucuuaaggcaauuguauacaauauuucaaauaauuuugugcauuuuaacugugaccugucacaugagaucagguguggaauuuuccacuucuggcaugcagguauucccaaaguuuuggauuugggaauauuucagauuuuugaaucagggauccugcauuaauguucucuguauaucaggcuuauacuuguuugccuuuugguuuuucccagaggguuagaaagaacucccaguacuucccucuuuggguauuaaacugcaaaacuaacaaauacuagauuuucauuguugcucucaacagaccuccauccccucaagcaguuaccaguagaaugacuuauauuuuaaaguuuggauauuagcaacuggaacuugguucagucaucuuauuauauuugacacauuauguguuuaccuucuaauuuaauaggagauuaaagcagcuucuuuacgaacauuaacaucaauuguccacuuggagagaacucccaaacucagcaguauuauugacuguacuggaacugccuccuaccauggauuuuugccagugcuuguaaggaacuguauccaggccaugauugguaaguuuugauggugauuaucuuaggcaagaagaaacauuugcccucugccuuugucuuuuuaauauccugccugcuuaacagcaauuuugagcuuguuuuuguucucccucuccccaccucccuuguagauccuuccauggauccauacccucaccaguuugccacugcucucuucucuuuuuuauaccaucuggccagcuacgaugcugguggugaagccuuggucuccuguggaaugauggaagccuuauugaaggugcuguacuuuuuuuuuuuuuuuuuuuaaacuacauggggaaaucaacuaaggguguagagaugcaaguuugggguguuucacagugagggcaaauaauauaagaaagcuuauccagaaaaaguuauacuuaaguagaaggccaguuuggcuuucuaguuaucuaauuaacaauguuuaagagcagcuacuuccauuauugagacuuuuaucauaguguagaauggucaggaggucauggguucugguuaaaacauugccacauguuaucaugccuuuacacaaccauagggaaaauauaugucaggguacuuuguaaguuguguuguaguaguaauagccuuuacuaugugcagggcaaugagcaccagcuuuuuucucccuaaauaucuuacuuaauccugcaaaguaauugauguccccauuaccucagagguugagucgcagaagucauagaacugucauuuggcaggcaccaaaaauaaaacacauguuuucccccauacugugcugccuuacugaggccccagacuacauguauacaaaagcaugcaauuuuuacaacuuugugucuuuauaguucauuguuuuugccucuuuuucuccgugauaggucauaaaguuucuuggcgaugaacaggaccagauaacauuugucaccagagccgucagagugguugaccuuaucaccaaccuggauauggcagcuuuucaaucccauaguggacuuucuaucuucauuuauagacuugagguauuauuauacaaggaaugcuuugcacagaauuuaauacucagagcugaaccuaaggauuguccugauaacccuaaagagcgaucuuacagucucuucuguuucuagaaaucaacuguguaucugcuugcaguguuuuuccauuauaauaguuuuuaaucccugaaaaaauauauauauauauauauacuugauuuucuuauaaccuuucucuugauuguagcaugaaguagauuugugccgaaaagaauguccguuugugaucaagccaaagauccagagacccaauacuacacaagaaggagaggaaauggaaacugauauggaugguaauuaacaguuauuaagucaguauuuuugugcuugagauuuuuugucaucccaccccaguuuucauucuuccucauaaauuccaaaguacacaauuaacuugaguauauacuuucagcaacaaaaauuuuuuuucuauguaagugauuugcaaauuuguuuuucacaaagauaauaagaaaagaaagguacuaguucuuuggaguagagauggcagguaaagcagaugcuauagcugugguguuaaucuguuuuauuucaucacguaauuuucuuauguauuucuuauugucuuauuucuacuaaaauucaagcuccaugggaucaggauauugucuuuuucacugccgcagugccugauaacauccuagguguuagaaauaugcuugguagagagagagagacuaaaaugggaccuuuuaaaacuuuaccuauuuugagaagagaaaggagagguaaaaagguuguuggguaggcaacaacauccguuaggcuggcacaucacuugagcccagggguucgaggccagccugggcaacauggcaaaaaucuugucuuuacgaaaaauacaaaacuuagccgggugggguggcaugcaccuguggucccggcuacuugggaggcugaguugagaggaucaucugagccugggaguuugaggcugcagugauuucaaaauguaaauaguauuuuaucacugauggagccuuaauacauuuuauaaacuguagucaaugauuguguaucuuauacucaguuauucaaguguauaaaguaaaaaugaaugcucacuuaccuaccauagcuacuaguuucggugcggaucuuuccaggcuuuuuuaugcauauucaaauacauguugauguuaaguauguauguaguauuuuagaaugggaagaugagaucauaaacauacuguucaucuugcauugcucauucaguguuucauagacauucuuccagaucggaauauugaguauuaaucuuuucaugcuuuuuauauuuauuaauuacucuuuugaaaagcuguaccuauuuguauacuaccaacuaguaguauaugaaauugcacauuuuacuuaccacucucccccucuuccccaauuugguaggugagaaauauugaaggacuucuguaggauuguuaauuuacacacacacacacacacacacacacacacacacacguguauguauguacguauuaauacaugcaacuagugauauauuuucauuuugggguucaguauuccugaucuucauuuuuauauucauuucacauuaauggaagaaauuuucucaaacaaaauuuuucuuuuugugguaccuuuuauucuaguaaguuucuuuaucauaacuuguacuuuaguugcagauguggcuauggaaagcaguccaggcucauccaucucuauggagcacaggcuggauguugaauuaagggcaucagguuccagcagcagcacuaacaucucuucuggccccagcccuggucccagucccggcaccggccccggccccggccccggccccggccccggcccuggccccggccccggccccgguccuggucccggcccuggccccggcccuggcccuggcccccguccuggugcguacacacauagaugugcagucuuucagagugguagaguuauuaaacuauugaagaaggcggcuuuaggcagaacuuaaaugguacauuuggagguuagcaucccaugacuauucaugcuccuucaccauucugguguuccauuuucuuauauuaacaugucuuucauagcauuuuauacuuuuccaacaauuugcacauugauuaucaaaacagccauguuggagggcagauaauauccaaaaugggaacugagugagguaaaaaaaaaguugaaccuuuuuacuuuguaauuuuucuuuuuuacuuuagacuuuuaguauugguaaaauuaaaaguauuaguaauuuuuccaauuucaaagcuuaauuaaguauucuuccuaacauucagagaccucacuucgaaugucuucuaauuuuauuauaguguauuuggaucucuuaaaauuuuguuuuaugugcuugaucauugugguuuaauggcgaacucagcauaauucuuuugucuuucuucauugccaggaguccaguguauuccacaacgagcagcacuucugaaauccauguugaauuuccucaagaaggccauccaagacccugcuuucucagauggcauacgacaugguauuugauuccagauaacuuuuuuuggaggauauuuuacucucucaaagauugguucuuuucauacuauucuggcaccuguuguuuuacaaggcagucuuugguaaaggccaugccauuuucaauagcuuuuaguuguuuugugucacuuuuccuagauguaaguguugcuuagcuauuuucauaaugauuuacccuuuuuuuccccuuuuccagcuuucgacucugugcuuaauuccgucuuauuaccccuuucugacucuuaaguguuuguguucuuucuuuuuuuaacccauguuagaaagccuauugcauggacaaauaauaaaauaggaggagacaacugggggccauuagauuagaauuaacacaggcuuugaggaccacagugugauaauacauaacauaucacucaauuauccccacuccucacaccuuuccagacuauucguauucuccauaauguucacuuuucuuuuagugauggaugguucucugccuaccucccugaaacacaucaucagcaaugcagaauacuauggcccaucacucuuccuccuagguaaguggaguugauaguugguuauaacaauuugggauaaccuggcagagcucucucucucuguauuuacuuacuuacuuauuuacuuauuuauuuuugagacagagucucacucuauugcccaggcuggaauguaguggcgcaaucuuggcucacuacaaccucugccucccggguuaaagcgagucuccugccucagccucccgaguagcugggauuagaggugccugccaccaugccuggcuaauuuuuguauuuuuaguagacaaauaugaauaguaaaauccugcaaggauauaaaacacagagaggccgggcauggaagcuccugccuguaaucccagcacuuugggaggccgaggcggguagaucaccugagguaaugaguuugagaccagccuggccaacauggcaaaaccccaucucuacugucuaccuggacaguagacaaaugucaauaguaaaauccugcaaggauauaaaacagagaggccggguagauaucugucuuauuggugaugaaauaaaggucagaauucaguuuuaaguaaauaccuauuuucugggugcugaauauaccuucgauaaguaguacauuuguaguaaguaacauuaucauacauuuuguuuaucugugcuagaauucuuaaaacgcuaaaggaauuuaguaggagacguggaaauagggaaagucuccuuguaguagcaagcauuguguuuuacaguuugggguguuggggagacuaguuuuggcuacuacaacuuagauacuuccuugcccccuugcugaagaaauuuaggauuuuuguauauuaaccuuguaucuuuuaaucuugcacaguucacuuauuaguacauacuuguuuuguuuucuuagaauauucuacauaaucuugucaucugcaaaugcauuuuuacuuuguuuauggucuuugugccuuuuuuuuugucuuaugacauuagcaaagauuucugauacagugcuggauagaaauaagaaugggccucuuugcuuuguuccugaauuuagagggaaaagcauuuaauauuucaccauuaagaaugaaguuagcagagguuuuguguugaagguuuugucaauuuugucagguugaggaagucuucuugugguguagcaacucuaccaugcuauggaaaagcucucugcuaagguuauguucagauggcaaaauucagacaauaguucuuugggguuuuuuuguuuuuuuuuaagauuuguuuuacgguggggacgucucaaggccaggggcagggagaaugcccgucuucugggagaaaguccagaacagagagaaagagaaaaggauacacaggcauuuuucuauaaaugggaagcuuagaagaaggagcaauugccauugacagggauauuguuuaaaagagggaggcagcaagaggauauagugcuuaggugcugggauaguggugaggagcaggugagcccuaugaggaugaugccagaagugagggacacgggcaggaaaugagacuuagagcacuaaaucaaaggucagugaagguccaacuuccuucccuaugguuuucuuaauucaucccucacauuuaaauuagcauagcaaccucccaguuuucccauaaaauacacuuguacuugagagagaacaaauuugcaaagcgaaaccuaaauaauuagacuagccauuguuauuuuagcuccccaaaugauaguacagagccuuucacuccagguggaaggagauggcccaggaaagacaucagggaguucugagaaccucuuggaguauuuuaauaauauaauuggcaguuuggguuuauuuuuguugaacuauucuggauaccuuuucuuuauuaaugaucaugcaacaggaagucccuuuaaggcacaagcacuaucuugaaaugccaguagguaguuucaugccagucuguuaucaacuaucauaguaacuaaacugcuuugucccucauugagggcuucuuaggccugaacuguuugguuaauguggucugucaggaguuacaacaugucucgguaaccucuaugaguugagucuguguuacagaauuggaaauaccuaaacuugugcccguuacaccaaagauucugaugaggcccagaauagguaaaaagugcuccuuuuuguggcaagacuugauaaaacagcuagacuuucuaguugaauuugaggugcccugggcacuaaauguccauaguacauaggucagcuuguauggguagaagggaacaggaucgcugaauaaaauguauaacccugcugagcaggaguuguaacacagaagaaucaguagcccaagagguuggaaguuggaguuucuagggggcaaacuuauaucaggguggacauucucaacaggggggcaucauuguauguacuaucaguugguggcagaggcugggaaagacaugaaauccuuaagggggaaguuuaauauggaagcacccagugaggucacgauguccugcuuauaauuucacacucaaacccacuaaauauucugacuccuucucccucacguguccgaccucuggcucuucuaugccacuuuuagccaccuguauuucauuuguaguaucccauuuaacuuccccaacuccccucucuucuuucucaccuccugccuuaccccucauguuaucuguucgggucuguuuguagccuaugcuaaugucaucaugcuuaugauugaccacuuaaccagagaguguagcaaguugucaauaugaguauugaaauccuccaagggagcaagauauaguuguaugaguaguugccugggcuaggguaucuguuaguauugcuggagguuuaguauguagguggcauucucuguuacuaauacauagauacaaucuaucagguugagugaggggaagcaggaaauauagguagugacuggaauagugaaauuagaguguaaauagugaaaguggagugugggcugucaaagaguugauggggcaguggaguuaugaugaguuaugugggggcaguuacaagggcaguuaccaucuugaggguguuagcgucaaggcugggacugucaguuguacugaaaucaucaucuaggaugcuuugguaugcuggauggauagaagcccuaggcucgcacuugagaaauuauuauaaaaguaacucaguaucccuuugccuacaagaguuuuagaauaauuucagauagggaagcuaugcacugauuaccccuaaacaagugggaucacagcaugggcaaaaaggagcccaagaaguuuggcauugagcugggguaguaguaucccagacccagaccaugagccaaaugagguauagacaggccaacuagagccagaauauuccacaaagauauuuucaggccuguggugcguagacuuuuggcaugccgaagugccaguuuauuaugggaaucacaggcauugccaucccauauccugcaauagucucccauucaauaccucuguaauaaggugguuccagaacuggcuuccugucuaagaauguugguacuaggaacuaacuuaagauuuuucuuuccucuuuggaagaaccauacaguuguguaugucaacccaggcagagagacuaagaccuucauuuccuaugaagagggaucuccaguuagcaguccuuuaaaaccaucauauuaggaaaggacuuuggcagagaccuucugcauagucuuagagggugagggcccucaauuuucugugggucccauccuguuaccuacuuucaaccuaggcuccuguccaccguggaucgcaccaauaucaaaugaggaggugucguuaagugagggggauucuguuuggguauuauagacucauagauggaaaguaucucauuuugaggcuagaaaggggacaaaggaagcacuaauuguguuuuuucagaugucauacaacuaaggcaaucggcaaaagagagaucaauuuaagagaccauuguccauuuaguaaguuuaagagagcauugaacaagccauuaugccucuauuaggccugcuuucugugaacaguacaacagaugggccaggcacuggcucacaccuguaaucccagcauuuugggaugcugagacaggcagauugcuugagccuugagcccaggaguuugagaccagccugggcaacauggugaaauccugucucuacaacaaauaaaaauguuugcagggcaugcuggugcgcuacucaggaagcugaggugggaggaucacuuaaguacuggagguugaggcuguagugagcuauaauugcaccccugcacucuagccuggggaacagagugagaccuugucucaaaaaaaaaaaaaaaagacaaauggaagcuccaaggugaugccuuguuugaaaaggcccaugcccagacugaaugagcgguaacguacguacccuggucagagucgguguuaccagaagcccaaagggaacuaacugagggcuauaauaguggugguguuggcaguaguugggcaggaaggauaagccaagaaugggucuguauaacaaucaguugugagggcauagcgauuugugccagcagauuggggcaguggcccaauaaaauugauuugccagugagaaaaggaguguuuaccucugguauggugagcccccacuggugaugaugccgauggcacgacagggcacaaagaacauauugggaggcuaggguuugaguagggcuaguggcauggggaugcaauggcauuugggcccagggacugugaugaccuucugccuuccuuuacucucuucucuguaaccuugacuuuccaaacucuguuggauucauuuucaguucuauugaaguacaucuguggguaauuuuuaaggugucagacuucucuuucagaaguugguggcuguuuucuucauuguauucuaaugcuacauuauuguagauaaccauggugucacacugguucuuguucuuaucuguauauaguuccugcuucugccuuuuuuuuuuuuuuuuuuuuucuucuauuucucugauuccuuuuaacuuucuccuggaaacccuaauuaccuuuuuuccauuucuuaguugcuugguuccacacacagcugguugcucugugcguguauauacccuuuaauucuaauucuugguuaucaguguuuuuguauaggggucccagugcauagugucguugcgacuucuugauaaaauaacagguuugaugucuuaguaauugcuuguagaacacuaauuuuaguuuuuaaauacucaauuuuaguaacucuauagaauucauacauuucuacaaauguaagucaaucgaggggagugucauaccaauaggaaccccaaaaaggacuuaaauuuuucagaaguuuauagcccaugaggaaucccaaaggccauugaaaacuguugguccccgguaacugcuauauaucugccauuccccuagcauuugggauaaaggagagaugcuguauucaccaucuugaauagaaaauccucugguuucuuuuagaucuuaggcaucaccauaaacaaguuuguucuguauacaugguuuauggguguuguauguauauuccucuucaucagguuuuuuaauuaaaguuauuguaguuauuguagucuuaugaguugggaagcuuugucuuaauuauuccuagaagguuuaauaaaacuauuggcuuggugccucucuauuaccuggauuuuuuuuuuuuuuccccuuuuaaaaauucuggaacgggcacgguggcucacgccuauaaucccaguacuuugggagacugaggcgggcagaucaccugagguuaggaguucgagaccagccuggccaaucugguaaaaaccccaucucuacuaaaaauggaaaaaucagccaggcguguugggugccuguaaucccaacuacuugggaggcugaggcagaagaauugcuugaacccaggagguggaggcugcagugagccgagauugcaccacuguacuccagccugggcgacagagugagacuccgucuaaaaaaaaaaaaaaaaaagaaaauucuuacuggucuagucugcuuugcugucacuuccugagauuugauuuuuaugacauuuucuuauuaaacuauacauuucacuuguuggcauauaguuuguagaauauauuuuucuguaucuaguuaaaucuccuuucucauucauaacguauauuacugcucuuuuuucuaauuuauauuauuucacuuguuggcauacacuuuguagaauaaauuuuuuuuuucuguaucuaguuaaaucuccuuucucauuccuaauguauauuacugcucuuguuucuaauuuauauuauugcucuauuuucuauagguuuauaagcuuuuccagugucuucacaaagcuagauauuggcuucguuuauccuuuuugcuuucguuuucacugaauucuuuuuucuguuaauucuucauagcuuguuugguuacuuuuuaauaaauacuuuaaugcuguacuauuuccucuugaguagaguuuuucccauguuccagaagcuuugguaguuauuacugcacauuuuaaaauauuauaaugucaaaaacugaucagauuaauauucaaggacucuugcauugcuggugauaguuuaaaauuguugaauaaccuuuguaugaggcaguuuaucuauuuucaucaguaaagcuugcauuugcuuuaacccagcaagcccacaucauagauuuuuuuuccuguuaaaagcagacaaaaacggauauauguuuagguuuaucauuuucacaauugaggacugguuuuuauacaugugguacaugcauuuaguggaauaguaggcagccauucaaaaugaaugggucguugugucgggagaggacauuauacgguaugacaguugugggggaaaagcaaaauauauaaaacaguguaaccucauuuauguaaaaauaugcccauaaaaauccuguaaguguagucacuagauucuuuauaguauugaaucucugauggagcaguauuaggaucuuuaauuucauaguaagcacaaggguuuaaauugcuagacauugaguauguauuuuuuuuuaagcuuuugguguuuuguuuucaguuucugugaggaaucucucaguuuuccauauuuucucaucuuuuuuuagcuacugaaguggugacuguguuuguauuucaagaaccaucacugcucuccucacuccaggacaauggauugacagaugucaugcugcaugcacugcuuaucaaagauguaagucuuuucugcuacucuguaaagaaugucuuagggcgugaaaauccuaucucuucuguguguaguguugaaucuaauugggaccugguugucaaaauuccuucuaucucagcuugauacccauggccggauuuuccuagcaucuacacucuuuuagaugcauucaagcucacuuuguuuucucuuuagguuccugcuacccgugaaguccuuggcucccucccaaauguauucagugcacucuguuugaaugcccgaggucuucagucuuuuguucagugucagccuuuugaacgccucuucaaaguucuucugucuccagauuaccucccagccaugcggaggaggagaaguucugauccccuugguaaguuguuaagauuuauuuuauaguagaaaauugauuuaguuugcaaggaaacucuuccuugaucaucucucucaucguuuuacugguuaggugugcuaaguuuaaugggaauuaucaucauacauucuauuauacuucagaaggaauacuucagcuucucugcucauaauauuuccaugcuucucaacaguucaccauuguacuuucaugguacugguagaaaauagguauuaagaagcagugguagauuuccagguucaccaucuggucugcagcaaugagaaauauggaguccugagguguucaucugguaaucuaguguucugauguccaacucucuaagauaacgacacauggauauuuuuuuuuuacucaguauacuugagaccagauaauugagagauuauuagcaaaaagguagggcuccagaaagauuacaguuuucaaaaaugugcuuuguacuuuucaaccaccacuguagcauuuagacacuaucauucuuaacuggagcagccagaggguuaaugguuuguacaucuuucuucucucucacucuguaauacuaguuuagaucuugacagcaaagauugccagaguagagugcagcacacauaguuacuuuaaaauaguuuacuaaacugauuccuuccuuuucccuagugauuuggggggauaggggcuggguguaaauucauuaaagaaguuguggcauuagaaaaucacaaccaaaaaaaaaaaauaggaaaaaaauaucacaacagccuggccuggcacaguggcacacaccuaccauuuugggaggccaaggugggcagaucacuugagcucaggaguuugagaccagccugggcaacauggccaaaccccaucucuaccaaaaaaaaaauuucuccagucacggaggcgcacaccuguagucccagcuacuuggagggcugaggugggaggaucgcuugaguccaggagaucgugacacugcacuccagucugggugacauaaagucuuuaaaggaaagaaaaucauaaccaggcucaguuucuucuuuccacuuuauauguugguacagaaaagagcccaagcucuauuuucuucagucuuucuaauucuaacaguucauuuuuugccuuaaggggauacugcauccaaccuggggagugcugucgaugagcucaugagacaucagcccacccuuaaaacagaugcaacgacugccaucaucaagguagaaagugauaaggaugugaccaugagcaugagagagcagagaaggggaagguuuuagaagauuggccuacuagaggucauuaggauucuugggcuauagcuguaagagcauuaugucugccucauuguuuccauguccuuagguugguccuuuauaaaaagauguugucauuuuaguucaucuuagaaagaagucucuguuaaaauuuuuuuagccugggugcaguggcucacgccuguaauccuggcacuuugggaggcugaggcugguggaucgcuugaggccaggaguuugagaccagccuggacaacauggugaagccccguuucuaugaaaaauacaaaaguuagccggguuugguggcgugugccuguagucccagcuacucuggaggcugaggcaggagaaucacuugaacucgggaggcggagguuguagugagccaagaucaugccacugcaagacucugucuccaaaaaaaaaaaaaguauuuuagauugagaauuguuuuccuuaaaaauuuuuuuccauuuaauguaaccuguauauaaugauuucuuuuauauauuauauggacaagcagacauggcuuagauuaaguuuguaaagcauauuacccuuucuagucuccguuuguugaucccuguggcugccccccacccccgccuuauuagcucugccaguuuccuuuuagaauuguuguugaaauugguauauaaguuccuggugcuuggugaauugggacagggagucagguucgucagucacuuauacagccgugugacgcucaacaaauuauuuaaguuugcagcacuucuauucccuuguuuauaaaauguaauuaaugaccauauucugggaauuauguauauaacauguauacaaaguguuugggcaaauacacaacacauagaaaacgcucuaaauauguuagcugucuccuccuccccauuccaugauuacuaauaaguaaucuuauuuccugugccuuucaguuacuugaagaaaucuguaaucuuggaagggaccccaaauacaucugucagaagccaucaauccagaaggcagauggcacugccacugcuccucccccaaggucuaaucaugccgcagaagaagccucuagugaggaugaggaggaagaggaaguacaggccaugcagagcuuuaauucuacccagcaaaaugaaacugagccuaaucagcaguaaguguuuacagaacagaucaucuagccauauaaucgugggcauguuaucaccucucuaagucuuaaugaacacuuucaucuauaaaaagcaagagaguuguauuagaucauuuuaaaguucuaaccgguucuaagaauguauuaguuuuuccuuuuuugacccuugugugucauuugugcuuugguauuuaauuguauugguugccuuaggaagugaucuuuuuuuaaaaaaauuaauuaauuuuuaauuuuuauugauuuuuuugagagagaguuuugcucucguugcccaugcuggagugcaaugauguggucucggcucauugcaaccuccaccuccugggcucaagcaguucuccugccucagccucccaaguagcugggauuacagacaccuaccaccacacuuggcuaauuuuuguauuuuuaguagagaugggguuucaccauguugaccaggcuaaucucaaacucccgacgucaggugaucuacccaccucggcuucccaaaguguuaggauuacaggcgugagcuaccgcauccggccaggaagugcucauucuuaaaagcuguugaugaaauugaaucagaauuugguccaucaaguuaauggacuuugcacagagaccuuauuuucccuuuguugauuugauauuccacaucgacugcuugauuuuuuucaggcacgugugaaaaacaauguacuuuugaagccugucuccuaagaaguccuuaaggggugugugaagauuuguuguugcuuguuguuuuuuuauuuuuguucauuuuguuacuaucuguucguuccagauuaauuaguagaaggcuuuggaauuuacuauaugacuguaaauagucaagaauugacugcuuagauggaagcagggaguuugcuuaaaggcuuagugauugguaggggguaguccaccaggcucuuugagcaguauucacauaccagggaugaacuguaacuguauaccuguaacuuuuagucaccugcaugcugaaaaugggauugaucuuucuggacaguccugcacucccucauauaauaaguggucuuuuaguguguagguaagucauucugagaaaagcuugagcauuuuaggcacagcuaugaaugcauuugagcugguccugaauggcaccuugggacuuaaaauuuaagguggaguugacaacaggagcaaaggccuagaauccgaaacugguauguccucuuggaacucuaaauagugaugagccugugggugucaaguguuuuaaggagaggcauuaacuacuaaguauauugcuuuguugaacagauaccuuacccugucugagaaggcaaaccuaucuucauucuagcaguaucuuuuguucucuuuuaaauguucuuuuucuagaagaggaggacacccuggaaaaaagcacgacuuuuuuuuguagacgagucuuagugcuuccuuugucacacccuugaaugucagugacccuacuggagugugggguuccuuuuccuggcuacaaauaaggaaaaauuuuaagguguaggugguggugguuuuaauucaagcucauauauauucaucugcaugugacgucccuaccuggauauuuuccagaugccuuacaucugaugugcccagauuucaagcugacacaguuaaucagcacacuacccucauuugcuuacccuccuuuccuuucuugggcuaucauguaucacuguguucuauccacagccauccccauucccacaucaccuccuuuuacauccaccagauuucuguaaggcuaguucaaaugucuuauucuugaaggagguagguugguugguugguugguugguuuuuuaccuccaaaugagaacucaaucuuguguucucccaacaguuuuguuaaaauuauucauacauguuaaugguuuuccucacucaccuauaagcuccucaagagcaagacauugccucauucaccaguguaucccuaucacuuuguauauaguagguagucaguagguuuguuuauugaaaugaauaaagagccuuaaaugaaggauuccugaagucuuaaaugcuuagagagcuaggccuaaugagacaugaaugaaaaugaagagaaauuagaaauauaaacccaguagcauuaauauucuaccacagugauaguuauauguaacuucuaagaugcagaggacucuaguaguuacuguaccccaguaucaguaguuuucuacauucuggaugcucaucacugccucauuuggauaauccaggagucucacagauguugacacauacauuuuuucacuuuugccaucuucagaggccuagauugggucacuaaguaaauuauuagggaaggaagaaaaagcaagagacugucuaaacuuagcuucauuuugaaaaccacaauauauuaacagcaaaaguucuuuuuaucuucuaucccaggcaauuguuauaggggaauuguguacuuucucacaauauggugaaagggcuuagaaagauuuggaauaugugucacccuucuccccagaagucuugcccaucccuuccuccauauccauaguucuuccgaauuucuguuucccaugcucucauuuguuuuccaaugccuuauacacacauaaaaugauuaacuuuuaucuuuauuuuauuuuauuuauuuauuuuuuuuuuuuugagacagagucucacuacaucacccaggcuggagugcagaggcacgagcucagcucacugcaaccuccgccucccgaguucaagcaguucucgguccuuagccuccugaguagcugggauuacagacacgugccaccaugccuugcuaauuuuuguauuuuuaguagagaugggguuuugccauguuggccucaaacuccuggccucaugugauccacccacuucggccucccaaaguguugggauuacaggugugcaccgccgcaccuggccaauuuaucagcaguuuaaauucagguaugauuuccauacagauuuuacauuuccaguuucccugcccaaaauugagacuguuacucaucuuacuucugucaucauauuauuaugucuauuccagaauauguuuaaauaaaaugaccauauaaagucuuauguguauauuauaucugacguauauaccuucuuguaucuagcuucuuuguuugauguguuuuggagguucauccauguuauugcaucugucagcaacuuguuacuuuucauugcugaguaguauucuguuaugugauaauuguauagugauuauccauuuuccuguugauggacuuggguuucugaguuuuuuccaggcuuagacacuacccuuucuuuuuuuuuuuuuuuuuuuuuacaaaaucagcagcuaguauuugcaaaugguguuuguauuuacucuugaaauacaugguuuugugcuggagauuuggaguaaggaaacuuaggcacuauagucuacgccagguacguggggugccuuucuacacucagacucacucaccacaaguaguucuaaauaccugucuuuugcccccuuucuucugccuucugaauuguuugaucucagaaaaucugauauugcuggggaugaauauacuuagcaguuaaguaaccaggguuuguaguuggugcaucacgguucacuuugugguugauugcauuagugugccuagcuuaccacccaccacucaugagcagcuugaaagaaauggacuauauaaagucuuugucaucuuuagaacuugaauagcaauugucuggaauuuaaaggcaaugagugcagagacgcaguuguucccugaaauguggcccacugggagggcuccuuugucagagucagcugucuccucaaaagcuggaggaagcaccugaccauccccccaucccaaaaaaccccauauacaucauacuaugacacuaaauugauauccuccuuuacuuuugaugggggcaugagcuggggcuccaccaccauaaauacugaaaauugaccagaguuugggaauguguguauguuuggggaaagggagagagacaggaaguuuagaaggacuuuucuugaaaucaguugguaaguugaguccuguuggaaagaguugaucauuuugauuauuccuguauggcuucuugggccugagagccaaaagaugaggggaaggagaaaagugguuacugaacaaauuuauuccugaaauuauauuaagaaccacuauugguuugcuuucucucuguucuucuccccaguuuccauguagcaaaugaagggggcauauaggucucauuugauuuuacuacuuaggcucuuugccauuauaucuggcuucuucaaaggguugggugucucugggcgggauccacaccugcacuccuuaucgauagagguggaucuauauagguaauugauauaaguaacauggaaugcugcagugguucugaggaggaacuuaaagaaagguuuguggucuucucauggaaucauuucagucuugccuuauagguauacucccuuucuacaaaguucuuccccacauuuuucauugaggagguucacaacauccuacccaaaccugguucuggguauuuuugucacugaagucauucauaaugccucuccacucucuuuuccuguucuauauucugcugccaaauguucuugugccuggcaaaucuuuguuuacauuuugucuugcucaaagaugagaacuacuagcuucuugccaacuuucuugucuucuuccucuaccucucccucugucucugccccaucccgcucuccugcacccugugcccaaaucuguuucaagggccuguguccaaaauacuccauuuucuaaaguauuuguuccuuccugggguuuaucuuagagguauauuuugauucaucacaauauacuauauguguaguuuuuugcauugagcugcauuuucugcagcuguggcauguuguagccuucucaucugcugugcaauauugaagcaacugaaaagacaaaagaccugaucaguuuuuugauaguucaggaacugucaugcugcaaauaccaauuguuagggaagggagaccucagguguaugaaucuuugaacuaaauuaaauuguauuuccuacucuccauaacuuuaaacgugaugcaaaaacaucguaugauguuuaaguguuucuuugucuagccucuuucuucaagcaaauguugagucuuuuaauugaacuuauuuuuaguguucucauguggauaaauuucccuaacaguaguuugccaaagauaggauagcuucucuugugauguauacuaauguugaguuuuuaaaggcuugguuguccccuuuaugcuuucaaccuuggucaggcuuggaaagguagauucaggauugauuucagcuguuuuuuuccugcgguauaugagucuaaaggcucaucucuaccccauaagccugggaagcaaaggcugcagugagccaugauugugccacugcacuccagccugggugacagcaagacccugucucaaaaaaauaagcaaauaaauaaauaaauagaaaaaggccuagaauuuuauacagugccuccuccucuguucucuuaauauugguauugugaauuucuguguaacucacucuuuucuccccuaacaggguuguugguacagaggaacguauuccuauuccccucauggauuacauccuuaaugugguaagauucaacacagggcaaacugaguaaagauguauaugugcuuuucuggaaaauguguuucguuaucagaguccaguaauuaccguauucauuuuaauuggaauccaauuaagaggggaaagaugugccacccuuuuguuuuuguucuagacugguuugccagaaauuagccaacacaagccccauuauuuuguauuccagauuuuuuuguucacuguuaccauucuccauuagaauccagacaggaaucuguaacagguuuuguuuugccagucuaguacaggcugaucaucccaaauccaaaaugcuccaaaauuugaaccuuuuugaguaccaacauaacacugaagggaaaugcucacuggagcauuuucagccuguacuguauaaugcaaauauucaaaaauaaaaaucugaaacacucauggugcccaagcauuucgaauaugaaauauacaaccuguaauauguuuuccaaauguguccaacauauauuuucccccuuuuuucccauuacuuccuggguaucucaccaaaaaagugaagaguuugaauuuucccagaauuguuuaccaauaagggagagaccucuuagcauuuguuucagccuacuaaucacuuccaagacuuccagagauaguuugucuugugccuguguguuuauugcccacauuuuacuuuuuuacucuuaaaaaaauucuuuguuugaaacaaacucuuccagaguucaguguuucauuugcauuaugcguuucauuugcauuauaagcacauuugggggaaauuuuccaugauguuugccugcaggagagagguaggcaaggagcacuaaauagcaaauuaagagauuaaacaugauuguaccacuaauucauaauguggcccugagcaagucacuuaacuucucuguuaucucgaaauaucugauucuuggugugcuugaaaauggagauugggcagaaauuguagauauucuuuacuuccuggauguuuuagaauccguaucauacaucugguuuaucugagguuuugauacucuauagaaaacacuaauaucaugacuagaaggcuaccccauccuuauuccaggcuggccauuuaguuccaccugucaggcucuaacuucuuuaaaaaauuuuuauuaccuagaugaaauuuguggaaucuauucugagcaacaauacaacagaugaccacugccaggaauuugugaaucagaaaggacuguugccuuugguuaccauuuugggucuucccaaucugcccauugacuuucccacaucugcugccugucaggcuguugcaggugucugcaaauccauauugguaagaagcaucuggccaaauguuuucauuucuuucuggaaaucaauuuugcgauacuucuguauauauguuuuuacuauggucucccuucaacuaaaaaauaaugaauaaauuuguguuauguuguauaagugaauuuugugacuaauauauagugugccauguuauuucucauugaaaagucaaaguauuuuuucuuuguucaucgguuggguauguaguucuacaucauuagaguuuauuggagggaaaaguguaucuccaagaaagcuuuucuaguuggguuuuauuaguaccucucccuucuuuguuauaggugcauuuuaaacacauuuuauguuuaugguuauguuuaaccauguauuuuccuccccuuucaagcuugguagucauguauuuuaagcauaauugacauguaguucauugccgauacuuaauuccccccuuuucaagcccgauagucauguauuuuaagcauaauugacaugguaguucauugcucauauuuugccaaaaaugaagcuucuuuauuuuuucauagugguaaacuacacauaacaugaaauguaucaucuuaaccauuuugaaguguagaguucaguaguguuauguguauucauauugaugugcagccaaucuccagaacucuuuucaucuugcaaaaaugaaauucugccauugaacuucucauccuccccucuccccagaccuuggcaacuaccauucuauuuuuugucucuaaauuugacuacucuagguaccuuauauaagugggaucauaaaauauuuuguaugugcgaccggcuuuuuucacuuagcauaaugcccucaagguucaaccauuauguagcaugugucauaauuuccuucccuuguaaggccuaauaauauuccauuguguguauauaccacauuuuguuuauccauucaucuguugauugacacuuggguugcuuucuccuuuuggcuguugugaauaauaaugaugcugugaacauggauguacauguaacucuuugagacucuacuuuuaauucuaauuuucccacauccuagccaauacuuauuuucuguuuuuugauaauagccauucugguggguaggaaguguaucucauuuuguuuuucacuggcauuucccuaaugcauagugauaaugaacaucuuuucaugugcuuguuauccauguauauaucuucuuuguagaaaugucuauucaaauucauuguucuuuuuuaaucguguuauuuguuuuguugaguuguaagaguuguguauucuuguacacguauuaauaccugauacuaauuucuucucagguauaugauuugcauauauuuuuccuguucugugaguugccuuuucuugguugucuuuggauucacaaacauuuuuaaucuugauaaaguucagcuucucuuuuuuuguuuuuguugccuguguaaacaccuguguuuuuggugucguguccacaaaaccauugccaaauccgauguuuugcagcuuucccacuguggcuucuucuaggaguuuuauaacuuagcucuuauauucaggucuuuaauccauuuugauuagauuuuuuauaugguaaaagucuguccuuuccuauugcauggucuugguaccuuugucaaaaaucauuugaccauauauaugugaagauuuaauucugggcucucuauucuauuccauuggucuuuacgucugucuuuaugccaguaucacaguuuugaucacuguaacuuuguaauagaaaucaaaaagagugagaccuccaaaaauuuuuccccaacuuguuuuggcuauuuggggucccuuaagauuucauauaaauuuuagaagggauuuuucuauuucugcaaaaccaaaacaaaaaacagcauuggaauuuugauagugauugcauuaaaucugugaaacuccuuuguuagcugggcugcagagugauaaguaauuccugcugaaugagaaauccauuugcuuacagacuuggaaagauccauaauugugacgugacuucauuuaguuuauuuuguuuuacucuuugaaauauugaauuaaaugcucuucaucacagagaggggaaaauauccuauaagaugcuguggaaggauagauagauuuauuuaaagccauaggaaggcacaugauuucuccuaucuuugcauggcaagugaugguguuuuauugucagauuuuucuccagacuugagaggaaaucacaagggucguauaauccuuggguugucugauaaaaacaaauugccuaccugauuccuaucucagaauaaucgcuuuuguuuuaagaagaaaagaacaguguaauagugacucacuuccaugcuuuggaacuuugccuaacauuguuuccuaucgagcaaaauuuggaauuaauccuauaguguagaauccuugccguaacaguauucaguuugaccaucauaagcuuuuaaguguuauuggcucaccaaguuugaaaguaguguguugcucuagaaagagauguuaagguauguuguaccugacuucauauuuggguuccaccauuuaccaggugagagaccauggccauauccaaaaucugagaggcuuccauuuaauugucacuuccauugugacuauuaaaagacaugaugaauuugaaguucauuguauauuaacacuuuaauuauucuuccuguuucagacacugucacaugaacccaaaguccuucaagagggucuccuucaguuggacuccauccucuccucccuggagcccuuacaccgccccauugaauccccugggggcucaguguuguugcgagaacuggcuugcgcaggcaauguugcugaugcuacccucucagcccaggccacaccucugcugcaugcacucacugcugcccaugccuacaucaugauguuuguucauacuugcagaguuggacagguaaaaauaaccuuaggggugaacauauuaauuuaaaggcagugaaauaucuagggcauacaccuagcaggguuacuaugcuugaaaggaggucugccugagguagcagcuaaaagaacaguccaauuuaggaugagauuuuuuugacugucaaaaaguugagugacuauauaacuuauuaugugaugaaguggacuuucuugagagcgaaacauguuauuacagacaaacaucaauuggguauucaucuggccuuaguacuuucuaaucuuuccaccaguccuuauaggucugauaaugggauggcauagguaggacauuuuaccaaagaacauuuaaaucaauaguaauuaacaaauuacuaaaaauuuucuacauaucaaacguuugaccuguaauccauaauccauaguuccagaaagaaggcauuuuguguauguccucacaguuuuacuacauuuauuccucagauaauugauucuaaagauuuaugguaucaacauuaaacaaaacaggguucaacagcccuguuuuaugcuauugagcaggaguguguucucuguuaauugugaaucaaucaaaucugaaguuuaaaaaagcacaaguauaaaggauuuagaaaauuaaauuacuuaacaaagcuuagggauugauuuuuaugacuucuuuauuaaaugaaauaaaaugaaaaugaaacauucaaggaauuaaauaaaucuagguacuuacugaaguaaagaaauugaauggaaauaauaauaccccuaccaaauaauuuagaaaguaguuaaugaaccuguaaaaccauuucuuugauucagaaaaaaagaguagccucugaugccuuucuuucacuuuauaaaaaacaaugagaacggauguuguggaaauaguuuguaaauauuguaagaggauaccuuguggaacugucgucuugaguguggacauuuugaugagguggauaacucugagaauagcaaugaagaaaaaucccuuacccuuauaaaacuguugaaggucaauuuuuuuuuuuaaguauaauuguucagagaacaucccaaaggugaaauucuuguuaugauugcagagugaaauucguuccaucuccguaaaccaguggggcucucaauugggucugaguguuuugagcaagcugagccaguuauacuguucccuggugugggaaagcacuguccuccucucucuguguaccccaaacagguaagagaauggcucucucucuuauuacuuuguuaucuaaguucggugagccuggaggauugcuuugguuggggauaggaggguauggaagagaguucagaggccuccuuguccuucccucuucccagccuaggaacuugaugacaaaugcuuugucgucaugguagauguuuaaaauguguuccuguuauuagccagauacaaaaaauugaguuguggcuggacacgguggcucacgccuguaaucucagcacuuugggaggccaagguaggcaaaucaagaggucagguguucgagaccagccuggccaacauggugaaaccccaucucuacuaaaaauacaaaaaauuagcugggcguaauggcgggcgccuguaaucccagcuauuugggaggcugaggcaggagaauugcuugaaccccggagguggagguugcagugagcccaagaucaugccacugcacuccagcccaggcgaaagagugagacugggucuccaaaaaaaaaaaaagaaaaaaaaaagaauuggaaagcuuguggggugcuaccucaggaauuauagaugcuuuauuacauucaguuuaaccugccugcuauaggagggauagugucagccaagcaaauuagagaccauuuacaauauaagaggugaauuaucaguauauauauauauauauuucuuuugcucagcauuucucuuuuugcagccuaccaucugggugugaauuuggccaggcagauaugcagaaacugguuccaaaggaugagaaggcagguacgacccagggcggaaaaagaucagguaacucuaagaaacuaaaauguuagucauuacuucuaaguuuuguuccuacgucuuuauagguuuauuaugaaaauuuuuaguuaguucuaucauccauagucuaguuuucauccucucacuaauuuuuagucauuucuuccauaaaaacauauauacauaaugguaaaauuuagaaaauguaguugaaagaauuacccguauuucugccaccaaaaaaaaaaaaaaaacauuuuggaagugucugcccgucuuuuuucucugaauacauuugccagugucuuagauaaaaacauuucguagaucucuuucuucacuuaauguuagguaccauauaaagguacacgaauuaacuauucccuguuaaguuucuaauaugcuauuuuuaaaaaaugaacauuuuuguaucuacuuuucuacaaauguaaaauugauuccuagaaauuacuguaucagaggguauuaacaaauacuuuuuaauguggcuacuagaaaauuuaaauuauauauguguuucauguuauauuucuaucgacagugcuguuuuauaaagaagauugcuuuuauauuaucucaugauaaaaauuccaaauuuuggccgggcucgguggcucacgccuguaauccuagcacuuugggaggcugaggcggguggaucaccugaggucaggaguucagaccagccugacgaacauggagaaacccugucucuacugaaaacacaaaaaauuagccgggcgugguggcacauaccuauaaucccagcuacucgggaggcugaggcaggagaaucgcuugaaccugggagguggagguugcagugagccgaaaucgcgccauugcacuccagccugggcaacaagagcgaaacaccgccucaggaaaaaaaaaaaaaaaaauuccaaauuucaguaaguagaaaucauacacaauuuucugacucuaaugcuacaaaccuaaaaugaauacaagcaacuuuuccagaauguuuuuucucugguguucaguaucaaugaggaaauaaaaaaggauaaacuauuaagaaagcaaugaagauaauucuguguauaaaaaugcaucaggccaggcacaguggcucacgucucuaaucccaacacuuugggaggcugaggcaggugaaucguuugagcccaggaguucgagacccgcuugggcaacaugacgaaacucuaucucuacaaaaaaaauacaaaaauuagccggccauggugguacaugccuguagucccagcuacuagggaggcugaggugggaggaucgcuugagcccaggaaguugaggcuauggugagccaugaguauaccccugcacucaagccuagaugacagagcgagacccugucuccaaaaaaaaaaaaagguaucaggcuuaaaacuuguacagaaauuacuagaaagggaaauuucuaaggaacuaauaaagcugacauaggcuuagaaccaacaaacaaggacuuacauaugacagcugguuauugugagggaugggauaacauuaauaaacuauaaagaaaccugacaaaaugagaauuucaaauuuagucaaaacauacuaaauuuaacucagggaaagaauaaauugacuaagaacugagaaugaaauuagauucacugucaaagaauugccucucuaacagauauauuuuuucuagcaauuuaacacauuuaacaaaaacgacucagcuucuccacaguuuuucuggaauguuaagagaacaacuuggugacuuguuuuauaaguuugcauaaagcucauucuuagaucuaagagcaagcauauaccaaagaaaaagacacaugucacauucauauacauaauucuuaaaugcuaggaaauaaaauuguccagugguaaucugugaugucuaguuugaacuuaacaagcuauaacauucuaguagggcauccacauugacagcauuggguacugugcacacuguaguccaugugaaugguacccccuggguugggcugugccuacaacagucuuccaagguagcccuggguuaauacuauucauaugcugucauuugaagaugucagcauuagguacuuagaacuccagaggagcauaucaguaaaauauuugggucguguuuuuguuuuucaaauuuaggaagccaugggaauugaaagaguaacaaaaaccauagguaaucuugucaguacuucucaaggaaccagguaaauguuggcucuacauuguccuauugcuccccucuuauacaucuguagauggggaacaggauggagcagcuggaaguauggaugcuucuacccagggcuuauuagaaggcauugggcuagauggugacacauuggcucccauggagacagaugaaccuacugcuucagacucuaagggcaaaucuaaaaucacaccagcaauggcugccagaauuaagcaaaucaagccuuuguuaucaggugagucauucuccuuucuccuaccuuuucuggcuuucagucccuuagucuugaaacagauugaguuggaaaggcuauguuguuucaccuaaggaaguuuaaaacuucugugacucauuuuuaaguguccuuuguugaguggcugcuaugugacaggcuuuguacuagcugcuacggauacagacaugacagaaucccuuccugagagccauaucuacuacccucccuucuuuaauuucuuccuccuacuuacucuucaacuauugcauauuguugcugcuccuuccauuucacugagaugucucagcaaggcaucuacaacguccuuguccuaagucccuucucacuugucugcagcaugguaguugacccaccaucuccaucuagaaauauucuuccuuuggugcuuguguuauuaagcuaucuugauucucggauaacuaucuggcucuuccaccuagucuucucuuuuuguguuccuugaacauaacuggcaagagacauagucugauagguguuuuauauuaaagucacuuuggcagcuuuauugagacuguauuggcagcauacaaaacugcauuaaugauuugcacuggucuguuugcccuuuuuuuuccccuuuaauguaauaccaauguuugggaaccuauuuguguguucguaaauugucgucacuuucuggcaccuuaauauagaggaaaauggagaccuaacuuagaggaaucuggggcccuucguaaaagcaaacagaaaauggccuuugguguuuccauuuguuaccucaaauucccauugcauuuuacauuuuacuuuuaauuaguuuaauucuccauuuauuuuaauuugaaagucuaccaacauuaccuucaaaggaaaauugaccaagcaagaagauguucauauuucucucuccuugcuuugucauauuucuuugaucuuggagcauucagagguuucugugugaacccaguccauauacuguuucucuuugguuacuggccuuuugccauccucuugucuuuggacuaccuuuaagcacuuugcuaucuguucaccugaaagcaguggugagaaaguguaaacccaaugauuggauucauuagguuuucaaagucuggguauacccauaucuguagacuauucccuaauuaggauaaagaaaucuuaauuuggauguaauaggaagaagaaaggacuguuuuccuuguuccuauacuguauacauuugagcuuauuacuaaauuuuagcaggauauguaaccuaggcucaaguagagccuauuuuuacacacugaguuuauaugugcauguauauccugaaaagacauagauuuaacccuugagcaacauggggguugaggcaacuccuccacacagucagaaauccauguauaacguuugacuccccaaaaacuuaacuacuaauagcuaucuauugaccagaagccuuaccaguaacauaaacagucgauggacacacguuuuguauauguauuauauccuguauucuuaaaguaagcuagauaaaggaaaauguuaaaaucuucagagaaaaauauauuuacuauucauuaagaggaucaucauagaggucuucaucuggguggucuucacauugaguagcugaggaggaggaaggaaguggggggauguuggucuugcugucucugagauagcagaggcagaacaggucaaggagguagaaggaaaggcagguaugcaugguguaacuuuguggaaauacacaguacuuucuuucugacuugguugcuuuuucauuucucuaaaaaugugucuguacaauaccaauuuuucuuccaccguuugcuuuaguuucggugcccauaucauaguaagguccacaucauaaaaagucaaaaguauucuuuaguaaucagaacccucugccagauugucuuaugucacuuugguuccuggcacugcuucuacaucuucuuccucaucaucugguaucgguucagaagcacucaucucuaucaagacgucuucuguuacuugcucuggugugguguuuauuagcucuugaauuucacugagauucauauccugaaauucuucacccaugaccuuuuuuuugcuauauccacaaacucgugauuuccuugauuggcgcugucauaaauccuguuaaguucugcacaauaucaggacaguuuucuccaacaggaauuuauuucaggcuugauggcuuuuucugugacaaugauggcaucuucagugguguaauccuuccagacuuucgugauguucccucugucaggguucucuuccacagcauuaacaauccuuuccuuagaguacuguguguaauagccuuaaagccccuuaugacucucugaucuagaggcugaauuagagaugugguuuuggggggcaaguagaccacuucagugccuuuuguguugaauucauggggcucugggucaccagaggcauugucuaaugucaaaagaacuuuaaaaggcacucccuuacuagcaagguacuucugacuucagagacaaaacaucaauggaaccaauccagaaaaggggucuuguugcccaggccuucuuguacaaccaaaagaccagcagcugguaguuuaucuuucuccuucaaggcucggaaguuaggagcuauauagguaagggcaguccugauuauaaacccaguagcauuugcacaaaauagaggagugagucugucccuuccugccuuaaauccuucugcucacuucuauuccuuacuaauaaacguccuuuguggccuuuuuuuuuuuuuccuucaaaguagggcacuuuugucuguaugaaaaacccuuucaggcagauacccuuucucaaugauguucuuaguggugucugggaacuuaucuguugccuguugguugguugucagaagcugcuucuccuauuaucuugacauucuuuaagccaaaucucuuucuaaaauuaucaaauuauccuuuacuggcuuuacauucuccagcuuuagauccuucacuuuccuuuugcuuuaaguuuucauauagugaguucauuauuuucuugaauugcauuagaaucuauagauuugucuuuauuauggcaauccuguacccacauaaacgugcauuuucaauaugaaauaaaaagauuucacaaaagugcaagguuuucaagccugcugguguagcugcagcaacagcuucacuaauuuccuuuuguuuguuuuacaauggucuuuacacugaauucauuuuuccugaaguggugggcaaucugcaauccauaucaaauaauucaacuuuuucuugaagugucaugacuuuucccugcuucuugggagcacuuccaacgucacuagugacacuucauauggggucauagagugacccagguuuauuccagguuuucaguauugcgguaaacaugaaaaacaaugcgagaaccaugagagaucacuacacaauuuacuggagagaugaacuguucauguagaagugcuuagccucacacaguguuuuaagcagauuguggcaacacuugagcucaccacaguaucagcaggucguggcuacaaaauuauuacagaguauaauauguacuaaauuuuauccaguuacucaauacugcuuauuuacugcaaauggcaccguguauaaguguaugugcauaagugugauaaauauuaaauuuuuauaauuuguguauauuuuaugguaguaaaugauaaaauagacuaguaucuacauauauuuuaugcguuuaugacauaccuaacuuuuuguuaauuuuucaauauuuugaggcuacauguuucaucugagaguuuuuucaaauugucaccaaucuccaaaauuuucaguauaucuauugaaaaaaaauucacacauaaguaggcaucuauaguugaaaaccuguguugaucaagcgucagcuguacuuugauucagaccuagcccuucuugucucuggaucaugaaauaacguuucaugaaaaaacgugaaauaacguuuauuuuuaaaaugcuauggcaacauuuucauuuaugauuuuaaaaguauauuucauuguagaaauauaaaaacacaugaaauauuuaaagagaagcuggaaagcacucaguuuuuuguguuuucuuuuacauauguuuauauuuguaugcugccuuuuccuuguugaauuauauauugaaaagcauccuaugaaauggaaaauuugagauguccauaaucugcccaauuccuuaagaagcuacuuguaaaaauuuuccugcuuuuccuaguuuauuuuuuccucugggacuacauauuuuuuguugugaucagacuauguauauugucagugaucuuuucuuaucuaaguggcuaaucauuuuuggcauuuuaaaaguuuucuguaggcauuuuaagugacuuuaucauccacuagauaucauuuaacuuaaauaugguuucaauuuauguuccucuagcaguaugagugcuuauuugucuuuuacauuugguaucuguugagugccacauaucugucuccuaccgucaaaaguggcauuuguuccuugugggacuuccuuuuuggauuauugaauguagaacaaauccaaguguuaacuagggguuguaggaggaaguggugagucauaaaaauauguuaaugguaauaugucuguuguaauuaaaccauucugagaauacuguacagucuuauucugauuucuggguuucagcuuccuccagauuaggccgagcacuugcugagcuauuuggacuucuuguuaaacuuugugugggaucuccuguccgccagagaaggagccaucaugcugccagcaccacuacagcaccgacaccugccgcgcgaucaacagccucagcucucacuaagcucuugacuaagggguuaucuuggcagcccccaccauauacaccuacuccccgauucaggugaaguucagcuugagauucagggacuagaaaguuacaauaaaaaauauguaaguuguuccuauacuacuuaaaauggagugugagccacugaauuugagaauuuggaggucccuuguuuacucuagaaaaugaaguguaaguuacuuguuuugguuguaccuaguacagaacauggguaauauuuuaaguauuuacagucaaacugcauuucaguggucuuauauagguaguaucccuuauccaaaaugcuuggggccagaaaguguuuugaauuuuggaauuuuuuggguuuuggaauauuugcggaauacuuaucaguugagcaucucuaaucugaaaugcucccaugaacauguacuuugagcgucacgucagcaaucagaaguuucagauuuuggaacauuuugaauuuucugauagggauacucauccuguauucuuuaguaggugggaggugucacuucaguguguaaauuuuacucuugccuuuuacaugaauuuccuauugcuucugucucugcuuuacagaagguuaaaguuuugccuuuuuuuccacuuucaggcugacauucuucaucuguucaguugguuucacauccccaaugcuguuugaugagaggaaguaucccuaccaccucaugcugcaaaaauuucucugcuccggaggccacaaugcucuuuuugaguaaggaucaaguugcuucacagaggagcauuucuuggaguuugaucuuugcugugugccuucccagcccacugcuuuuaaguacccuaucuuguaacagugggauauauagaaauagcuauugguuguauccuucaguguucugggaaguaaccauguuugucuccauuuaccuuggaggguaggauuuagccuccccuagaguuguguuuguaagggucucugcuuuuucucauguggcuuccaguuccaaguauggguuuuuaaaauagguuugucuuuuucuguuguuucucugaauauaauuuuucugcuauucuuggucagaugauuucaagaugaguuucacugguuuagguuuuuuuguguuuuuuuuguuuuguuuuguuuuuuguuuuuuuugagauggagucuggcucugucgcccaggcuggagugcaguggcgcaaacucaacucacugcaagguccgccucccggguucaugccauucuccugucucagccucccgaguagcugggacuacaggcgcccgccaccacguccagcuaauuuuuguauauuuaguagagacgagguuucacuguguuagccaggauggucucgaucuccugacuucgugauccacccgccucagccucccaaagugcugggauuacaggcgugagccaccgcgcccagcugguuuagguuuuuaagacucuaaaaaguaacggaggagaggcggaacaaaagaaaaaaauaguauagcugaaaacuguuggacagauuagacguaauagcucuaagaagagggacguguagggccaauauagagauuggggaccuuuuagauguaaaccccccuugccaggguaaaauacuaauauucugucuacuuuuccuuauuugaauuuagaacuuucaacugggcucuguccaugggagguaaaguuccuguuucugagggauuggaacacucagacuugccugauggcacaggagaauuccuagaugccuggcuuaugcugguggagaagauggugaaucccaccacggugcuugaaucuccacauucgcugccugccaaauugccuggagguguccagaacuuuccccaguucagugcacugcgcuuccuugugguaacucagaaagugaguauucaguauucuaaaaucaaaaggaauuucucaugcuaagucguucccacucuauuuuguccugcuuaaugaaauaacaugcuuauuuaagaaccacuggauccaacucccagauagggcugccuuacguaagggaauauagaccauuugagaauuuuccgugauaaacauuugagcuguaaauuucagauugguacuugcauuaggccguucuugcauugcuauaaagaaauaccugagacuggguaauuuauaaagaaaagauauuuaaguggcccacaguucugcaagcuuuggaagcauggugcuagcaucugcugggcuucuagggaggccucaggaaguucacagucauggcggaagguuaagugggagcuugcaugucacauggcaggagccaggagguggagggggugguacacacuaacucacuaucaugaagacaacacuaaacaaugagggauccacccccaugacccaaacaccuccagcauuggggauuacaauucagcaugagauuugggcagagcaaauauuccaaacuguaucacugcuuaagguugaguaaaaugccucuucucugugccuccuuagaccuccucauguuggccaauuauuuuguugcugguacuaguuguggaaggacuguuccauaggucuuuaacuuaauccuucugagcuuugaauugaagcaaaaugauuuucacacacuuuucaaauuacuuacaggcagccuuuacuugcaucaaaaacuuauggaaccggaaaccccugaagguauaugguggacgaauggcugaaucgaugcuggccauucuaugccacauccuccgaggagaaccugugauucgagagagacuaagcaaggagaaggaggggucucgaggagaagaggauacagggcaagaggaagguggcucccgccgggaaccucaagucaaccagcaacaacugcaacagguaggguacuggccucacacuccaggguccagacuuugcacccaauggagugugaugcuuacggauuuucuaagcucacauaccacugagucccuggucacauuaaccaggagacaguuuagauuuccuccuucucuuaguauuuauuuuuuuucuccugaggaaaacuggaguauaguccugaugcucugcacagguaauacuccuuucaagcauguugaugaguauucucaguagccuccugcugccucaguggaggcaaacuguccucaguuacuuucugguuaaccuguaaagagaauggauauugugaaccagauuuauucuccaacaagagcuuucugaaaccuuagucaccuacaaaacuuuuguuuucacuugcaaauaaaauguauaaggggcauuuuaaaaauugggaggccagaaagaggagaggggaaaggcauguaaaguccugccacuuccaucucaaagagcauuuuaagauuuucuuccuggaguuuguauguaugugugucagcuuuuaugucuggaguccuguucaaaucugucuacuauauacacuugucccguuuuuuaucauuaaaguaauaaauacucucauuaccaaauuuggaaaauacaagacuuuuaaaaggcauucguaauuuuaucacacaagauagucauugucuccuuuuucagucagucuugugccuaauuuuuacgucguuaacaucaaauaauacauauacuuguauugcuguuaucaagaacuuuuuuuuacuaauuggucauucuuuuauuguuggaugcuaauuuucuuacaguuugauguuuuaacacuguguuguauaguuuccuuacguaccaauccuuacauacaucucaugauuauugccugguaguagauuaacuaggucaguuuuucaggcacuugcucuguuaccaguuuguuuuccagaaaguugggaccaauuuauacuucuuuguaugagucucaaucuuuuaauuauaauaacccuguuaaucauaauaaccaugcaucccccccuaacuuucuuagaggaugaaaucgagaaucuucuuggcuccuuacccaauguguagcuuagaaugcuauagaagcaccaaacagaaaggauuguucauuuuaccuaauugcccuagcucauaaaugcucucagcccagaugaaguuagaaaaaguuauuuccaucuugaaaagguuccuuccuuuuaaaaauguauuuggauuuccguuaugugauucugagcccuugcauucuuuauguagcucauggacaugggcuucacaagggaacaugcaauggaggcacuguugaacaccagcaccauggagcaggccacagaguaccuuuuaacccacccuccuccaaucaugggaggaguuguucggguaaguuggcucagaagcagugauuuuccaggauauugguuugacugcugaaguccuuuuuccccuuauuauucugucauuggucuuccuuucuauaaacugcuucucauuuucagacauguccaugccaguauuuucuuuucauaauaacagaaguuuucugucccccagcaauacaaauuacuauacuuuguuugcacaagaacccccagucacaaaacaauagaagaggcacacuuuucuaagauguagaauagaugaucacacuguaagccuccuuccuauacuuaguuuuacgugugauuuuccucaucuguucuuguuuguaguaaccacauaagccugauaggguuugacuuauacaagagcagcauuuugaggcccuuccucucucuuuagcuugagcacaagaugucugauugccugugaguugcaguggucuuguuggguuucuuuguuuugaguguguauccuuacuggauauucucuuaacacucuaggaucucagcaugucugaagaggaccagaugaugagagcaauugcuaugucucugggacaggauauuccaauggaucaaagggcagagucaccugagguaacuauggaacacugcauccuaaagggcuuggcacaugaaucuuaguauucugugaacauucugcuaguauugcaaacuaauugauagaauucaaaucuaaaggaagacaugagaagaguacuaauucaucccagcuuugccauccauuauugagcuaccuuguauugaccugaagcuuuaagggaggcauaugaagcguuaaucuuuauugucaaauaagagacccaauguguacucaguagugccauuaggccgaacuuggcuguauauuucuaggugacaguuacuuuaauuuucccugcuggcacagaauauagaacagugucuagaaaugauuuugcgggagguaguauagaaugcuacaagugacuugacagugaaaguuguuugaagcaucccucccuucuaccuucccugucuugccuuaaacuuuguggcugccacauccuggaugaaaguaucaaccgcuugaggagaagguugaggguaaucauaugguagagcaaaaacauucucagagucucucuuaucuuuccuccuucaccucuccuguguauuauucacacuuccuucccugcuuccaggaaguugcuugccggaaggaggaagaggaacggaaagcucgggaaaagcaggaggaggaagaggcuaaaugucuagagaaguuccaggaugcugacccguuggaacaagaugagcuccacacuuucacagauacuauguugccaggcugcuuccaccuucuugaugagcugccagacacaguauaccgugugugugaccugaucaugacagcaaucaaacguaauggagcagauuaucgugacaugauucugaagcaaguagucaaucaggugagcucucaaggggucagaagaggggaguaugugaagugguuugccugccugugucaaaaccugauuucugaaaaaucagcauauuuucauucuaccugauauggguauauucucuauuuggauucuuucgaucugguaauccugaaacaguguguuaacuacaucgcacacacaaaaaugucuuuagaagggaaaaacaaagcucuccuuuucuacuuuucucuuaaaaugucuaaaaugugccucacccuugagucagguucguccccuggacuaauacugaauaaauguuuuuuccuauguaacagccgcuugaacaacugaguccccauccugaugaauacuugugaccugauauuuguccucuuuuucuuuucucucauuaugaaauuaugcuaauuauagaagugggauaagaaaggaauuaccuuaaauccccacacccagauagccaguuaacauuucgauuguauuuaaguuacuggaaucuuguuuuauguaauguuucauucuagaagcagggaaagaaauuaaaaaagggaaaacuuuuuucugggcuuuguaaaauagaacuuuaaugcacaagaacacaaguaaaggaaaacuggauaaaacauuuuuucacagaaaguuuuagugucuauuuuuuaacaauaauucugagagagagagauaaaaugaaagauugcugauggaaguauaaguugauagaaccuuuuugggguugacuguaugcaccaggaaguuuuaaaauacucauuuccuuuaacuuagauuuuaggcugcuuauagucuagccuaauaaaguaauuguuuaguggugauccuuuaguagcauacaucuuuugauauagauucuaaaucccuaugguaaauauguuagauuuaccuaccuuucuuuagugaauguguuggaggcagagggaguauuuuaaaagguugagaauauuuucagaaaccucaucuugcucugcgguuccgugacuuaacccuuuuuuugcuuuucuaggugugggaagcugcugauguauugaucaaagcugcucuuccccugacaacaagugacacaaaaaccgugucagaguggauaagucagauggccacacugccccaggccuccaauuuggcuacuagaaucuugcuuuuaacgcuacuuuuugagguaagauuuagaucuuuggggccuuguaauucauucaugaaagaauuaucaaacacuuaacauauaugaggcauugaagacgauaaagcgaagaauaaggcaugaguccugcauuucaugagcccaguuucugauaggcugaaaugcauauaauuacguauaaaauacagcauucuguguuagaaugauaacaguuuuaucuggguuuaggaaagucauaugcaucacuuuggauucaugugagaagggcuucugagaacaagcauuaauugaauugagucagaauugugaggugguaguuuaaaaaaaaaguauuuaaauuacuaacagagcuuggucauagaauauuuuuugcucuucugaggaaaccuaacuggcagccacauaguagaguaggguaugcaaauuggauguggucaauauugagguaauagacauuagaugaaaucagauuccucucucuuuuccuugccuauuuagucagcagauuauuugaggcaagagagugguuugggcaagaccugauccaaccaacguaggaacuaggaggcaauugaccuuggacaaaugacuucauuuguggcucauuaucuuuaaaaccugaacuuaaugaacugaacccuuuacauacagcaaacucaggggauaaauccaauauaagagucaaacuguguaacagcugucuuggggguuuccuuuaucauggaagugauaacucuuacuguagcacuuuguaaauagauacuugugggaaagguuucagaguacuaaagagagaaucauucauggacccccaucuaaaacaaaucacaaguaacagucuuguauuuucuuuuaguguuuuuuccuguucauuuaagcaauugggauaagacuguauagaaaguuuuauauucuuuuuguuaaguauuaugacuauuuucccauuugcuauauacauuaguccaucuuuugaauguucucuaauuuauuuaaauaauuaccuauccuuggacauuuacuuccagugauuuccuguuaaaaguaacacuuugguguagccccaguaagacgaaccauuaacuguguuuaauuauuccauuuuccuugaaagauuauaaaauuucucuguaaaucuaaagcuuuacaacuucaacauagacugcacaaccuuggugauaaaccauuuccauauuaagcauauacauuagugccaggcacuggguacuuuauauuaauauauauaaaaccucaaucaucacaauuauucugcagguaaaaauuauuuccucugacccaugaggaaaccaaagccuagaaaauuuaacacaucuuagauuacacaacugguaaaugguaagagguaaaauuugaacucaaccaauucuauuauuauuuacccuuauguuccccuccccuaucccaugcuaaucuuuguuacugaguagaaauugguaucugguuguuguuguuuuuucccuuugaucuaucaggaguugaagcuaccuugugcuugggugguugaaucaaguggcauccuuaauguccuaaucaaacucuuggaagugguucagcccugccuccaggcagccaaggagcagaaggaaguccagaccccaaagugaguaacccuauaucuacccuaguuucguuucuauuucccugggacaugggccugaaucaggcacucuucuggggcauguauggggcaaauuugugguacuucuguaguuuuaaaauuauaaaggaagcaucugaugaaauuaagauauauuuucccaauuugugcagguuucuugcuuucccaaaacagaucauuuuucuuuuuuagguggaucacaccaguguugcuccugauugauuucuaugaaaagacagccaucuccucaaaaaggagagcccagaugacuaagguguguaauguaguauguaugacugcaggacgguuuagcuuccugaggcaagaguagaccagaagagaauaugagagaguagugaagaauauagaagucucugaccaauguauaaaucucuuaagggauuuucauagcuagguuucucuucugaauaauuuacucuggaaguaaauuuugaaggagugugcuaucuccagaggaggagcggcuuuucuguuauguaagggacugaguauacagcaauccuaccaaaaagcaaacacuccuuagaugaagauuauugugccacaucaucucacuaccuucuuggaaacagaauuuuuguuucaguacaucucaggugaacauuccccuuuuagggaaaaucaguagaaacaaaaggaaaguagaaaauggcaagauaaggggcuguagauaguuuuuuugucuaggaaaaguaucuuaguccguuuugcuguugcuauaacguaauaccacggacuaauuuauaaaccauaggcugggcacuguaggcucacgucuguaaucccagcacuuugggaggcugagacagguagauuacuugaguucaggaguucaagaccagcuugggcaacacauggugaaaccccaucucuccaaaaaauacaaaaauuaaccaggcauaguggugugugccuauggucccagcuacucagguggcugagguggggagaucacuugagccugggaggcagagguugcagugaaccgagccggcaucgcgucacugcacuccagccuaggugacagagucagacccugucuccaaaaaaaauauuuaauauaaacuguacaaguuuauuuggcucauaguucuagaggcugaucuaagggaccacaucuggugacagccuuagugcugcauccuucuauugcagaagguggaagagcaagagguguccaaacucgcuuuuauaaccaacccagucacaauaacuaacccaguccguggauaaugacauuaauccauucaugaggggcggaguccccaugaccuaauauuaucuuuuauuaggccccaccucccagcacuguuaaauuagggauuaaguuuucaacaccugaacuuuagaagacauguuuuuaagcguguagcagagagacuaaggaaugugagaguaaaugcauaugaaaaauguucuuuugguuuuuaaaauuuauuguccaguauauuucuuuuuccugggugaguuuuagcagugaacacugaugaaguuacuauuucuucuaaucaaccuugaaagaaauacaaagaaacuuuguacuuuuauguuuaguaccugcaauccaacagcaacaacuggcgcugguuugaugaucgcucugggcguugguguaguuacagugcaagcaacaauagcacuauugauucugccuggaaaucuggagagacaagcgugcgauucacugcaggccgaagaagauacacgguccaauucacuacaauggugcagguacaugcucacucaccaagcuugucuaacccguggaccacaggccacauauggcucaggaugucuuugaaugcagcccaacaccacacauugagguuuuuuugucguuguucuuuuuagcuuaucaaauaucguuaguguaguuuauguguggcccaagacaauucuucuuccagugugguccagggaagccaaaagauuggacaccccuacuguaaacuuuaucaaaaagagggguauguguuuugguuuucuucuuucugaaccagcauuccuaacguguuaggaggaggagaguuaccauuaccuaauuaaguauagauuucagaaaaucgagucuuccuaaggucauugauuagaccuugggucuguagcaauuugauacuaucccucuuagaaaugauuuuaaguguuuagucaagggcuagggagugguuagggaugguauuugcucuguuggaaggucuacaguucauuauaaggccuuguguaugccacuugccuucuggggacuuucagguuuuuucucuguaaaugauaaaggugggauaaauugccagaguuccuuccuguuguagcauuuuaccugggagaugucccuccccucccccaccuuuauaauucauuuuugguagagguuuuuuuaaugucuguuugaauuccuagguuaaugaggaaacagggaaccgacgcccugugaugcugacucuccucaggguaccucggcugaauaaaaauucaaaaaacagcaauggacaggaacuagagaagacgcuggaagaaagcaaagaaauggauaucaaacguaaagaaaauaaaggcaaugguauguaccaagaguguuuuaccuaaagcuaaugugccuuuguggcuuaaggucuggccaauuucauugugaguuauuuucaucagcuugauuaacagauuaaagauacguaggccucccuuaugcuuuuucaucugaucuuaaaauugguauuuggcaugcuucucuuaauaggacccaagugcuuggccaauuacuuaggagggaggcgugggaggaaauaaacaucaaguuaaacugucuaaaacuguuauuuucccauuuuauagauaccccuuuggcccuagagaguacaaacacugaaaaggagacaagccuggaggaaacaaaaaucggggagauccugauccagggcuugacagaagauauggugacuguuuuaauccgggccugcgugagcaugcugggagucccuguggacccagauacuuugcaugccacccuucgucucugucugaggcucacccgggaccacaaauaugccaugauguuugcagaacugaagaguacccgcaugaucuugaauuugacccagagcucaggcuucaauggguuuacuccccuggucacccuucucuuaagacacaucauugaggaccccuguacccuucgucauaccauggaaaaggugaguguguuuuguaucagauucugguuuagcuuuacaucauaccuauguucuccuuggucugagaacaaauagacuucugguucuucuuaggguauauagcuagauauguauacuguauacuccacccaacagaauuuuccaacucuaugcuugggagcuugcuuagguaugguaggaugauccuauugcuagaaaguccucuccagcaaucugguuuucuuuuuuuucuuuuuuucuuuuuuuuuuuuuaaucuagguuucauuaaccaagccaaaaaccguuaguaaagaacugggauaccuucccccaaguucauaccuucagaaucauuccuuuguaggaguaccucucggguguucagccaagagacuauucucaaaacacuguauuuuggaauauaaaaguauaguuaaagcuuuuugaauguuuguaaucugccaggcacugugauagacacuuaacaaauauccauugugcagaucagaaaacagguuauuauauuuuaggaaacuuacaaaccaguggaagaaauagcaacguacuuauaaaaaauaaaaacauuuguaaaguuaagacaauagucugggugugguggcucaugccucuaaucccagcacuuugggaggcagguaaaucaccugagguuagaaguucaagacuaggugggugugguggcaugcaccuguaaucccagcuacuugggaggcagagguugcagugagccgagauggugccauugcuccccagccugggugacagagcgagacucugucucaaaagaaaaaaaaaaagaagacaacaguggaggguugaggggcaaauguccuaguagugaggcuuuuccuccucaguacuuaauacaaaauccuuucuucugcugauucuuugucaucaauaaugacuguuaauagacuuugcuuccguuuuccucucuugggacauuguuucccacauuuauaagcaguguugcaauaugcguuuuugugccuaacuuuguucauguuuaagaucguuacuuagagauuuuuaguaauuggaucaaaaggcauuacaaguauuuuuuaacuugcuugccagaaaagugguaucaguuuuuguauaucugaguauacauuuuagauucuucagacaguucuuuacacagccugcuugauuucaccucacaugugccaaaucaagagaaagagagcuguuaaagguagcuuguauggugauccacaguccaggagauaacccagcagggaaggaacaacuauauacaacuaaauucugauuuuagaaacuugaaaugcuugaaacgcuuucuauaaagaaauguuuaaaaguuacaaguucaaagugcuaggagaaaguguagguccucauuggaugagggaaaacuuuuaaaguuuuaacuuuagguaaauuauaguuggggugugggaaacaaaggaacaucagugacagucuuaacguaucaagauggcaaaauguaaagucuugguacuauucauugcuaguacagguguggaaaaccaggcauacucuuaacuuucgguaggaguggaaauugguguagccacaugggagggcaauuugguacucuuggucuaagauauccuuugaccuagaaauucuauggcuaagaauuuaucugauaacuaacaucaaguauaccaagaugcauauauaagaguguucacuguggaauugcuuguaauaucaagaaacuagaggucuaauguccagcaguugggggcuggauaaauuauggcuuauccuuaauauugaaauuaaacuuuucuguguuuauuaaauggaaauuauuuuauaauuacagccagacaggcaagauacagaggguauaaugugcuaaagggcaugauugauuugguuuaaaaaaaaaaaauuaagauaccaaaagauguuuuucauugugagcauguaguuugugaaauaacagauaauggaaaauaauacaauugaguuauuuucuucgugcuuucauggauuuuuccauuauuaacaagcaauuuuaugagaagagcagaagcauagcuauauguaagcccuguguuaucaaggcaaacaauauauaaauaguucaguaucuccaguggcuaucauuaucucagacugaugguugacuuugaggcauaaagaaaauauuuaauuguguuccuguacacuaaguggauuacaguguuacauguuuuugaaccauucugguuuaaaauugugacagcauuuggagaggcucaggagcugacauuuuaauguggaaguuaugugggguuuauagucuugacacaucucccaguuucuauaaagaucacaugcagucuggucuaauaauugauaguuuugagacaugcugcaacuuuuuuauaagccagguuuuuugaaucaagaagggaugggacgggacuuaaaaauaaaaugucauucuccccaaaaucaaaagcuuuuagucuugguaacucuugacugcaguuguauuuuuagaaaguaguguuuaaucgacaguguuucuuucucucuuuacuagguuguucgcucagcagcuacaaguggagcugguagcacuaccucugguguugugucuggcagccucggcucucgggagaucaacuacauccuucguguccuugggccagccgcaugccgcaauccagacauauucacagaaguggccaacugcuguauccgcaucgcccuuccugccccucgaggcucaggaacugguaaguuucgcuugcuccuggccuuugauauuaaguuuguggccugguauaaauccagaaauuuauuuaugaggaggucuguaacuugaagagccuccuuaggcaaguauuaggacauuugcuggcuaauugauuguuugggucaauuuauuagguacuucaguagcuucucugggccuugcccuguuguaaucccugccagagacacugaggacucauucauucuaguccuucacuucaaagagcucauuuugguggggcaguaggcuuuacauauaguuaaugguuuacaaaucaagugauaauuaaggguuaaauggauguaugucucguguaacacagugcgaaauagacgucaucuguguauuccugccaagaaauguuugaccuguauuuaauuaugaggaaacaauuagauaaauacaaauugugagauguucuauauaagacaacuggccuagacucuucaaaaauauuaauguuaugaaagaaaaaauacaggaucauuucuuauagagaaaaguagacuagagagauaaucaccaccagccuugguugggcuguggauccagauaaaagauuuggagaaauuugagugcuauguauuagguaauguaauuguaucuguuaaauuugggggguauuauaaugguauugcaguucuguauaaaaauacccuugaucuccccucugcugacuuuuuugguaauaaaaaagaaaauauauguccuugaucuuaggagcuacaaguagauguauuuaggaguagucacuugguaauucuggaugaaaaguauauagauguuuauuauacuauucgaacuuuucuguagguuuguuggauuuguuuuuuuauuuuauuuuuuuuuuuuaauuuuuuuuuuuuauugaucauucuuggguguuucucgcagagggggauuuggcagggucauaggacaauaguggagggaaggucagcagauaaacaagugaacaaaggucucugguuuuccuaggcagaggacccugcggccuuccgcaguguuugugucccuggguacuugagauuagggaguggugaugacucuuaacgagcaugcugccuucaagcaucuguuuaacaaagcacaucuugcaccgcccuuaauccauuuaacccugaguggacacagcacauguuucagagagcacaggguuggggauaaggucacagaucaacaggaucccaaggcagaagaauuuuucuuaguacagaacaaaaugaaaagucucccaugucuacuuccauccacacagacccggcaaccauccgauuucucaauuucuuccccacccuucccgccuuucuauuccacaaaaccgccauugucaucauggcccauccccaaugagccacugggcacaccucccagacggggucguggccgggcagaggggcuccccacuucccaguaggggcggccgggcagaagugccccucaccucccggauggggcggcuggccgggcggggggcugacccccccaccacccucccggacggggcggcuggccaggcagaggggcuccucacuucccaguaggggcggccgggcagaggcgccccucaccuccuggauagggcggcuggccgggcgggggcugaccccccccaccucccucccggacggggcggcuggccgggcagagggguccucacuucccaguaggggcggccgggcagaggcgccccucaccucccagacggggcggcuggccgggcggagggcugacccccccaccucccucccggacggggcggcuggccgacccccccccccgccucccucccggacggggcggcuggccgggcagaggggcuccucacuucccaguaggggcggccgggcagaggcgccccucaccucccggacggggcggcuggccaggcggggggcugauccccccaccucccucccggacggggcggcuggccgggcggggggcugaccccccaccucccucccggacugggcggcuggccgggcggggggcugacccccccccaccucccucccagacggggcggcuggccgggcagagggguccucacuucccaguaggggcggccgggcagaggcgccccucaccucccggacggggcggcuggccaggcggggggcugauccccccaccucccucccggauggggcggcuggccgggcggggggcugacucccccaccucccucccggacggggcggcuggccgggcagggggcugacccccccuccccccucccggacggggcggcuggccgggcggggggcugaccccccaccucccucccggacugggcggcuggccgggccgggggcugacccccccaccucccuccuggacggggcgacuggccgggcagaggggcuccucacuucccaguaggggcggccgggcagaggagccccucaccucccggacggggcggcuggccgggcggggggcugacccccccccaccucccucccagacgggguggcugccgggcggagacgcuccucacuucccagacgggguggcugccggacggaggggcuccucacuucucagacggggcggcggccgggcagagacgcuccucaccucccagacaggguugcggcccagcagaggcgcuccucacaucccagacagggcggcggggcagaggugcuccccacaucucagacgaugggcggccgggcagagaugcuccucacuuccuagaugggauggcggcggggaagaggcgcuccucccuuccuagaugggauggcggccgggcagagacgcuccucacuuuccagacugggcagccaggcagaggggcuccucacaucccagacgaugggcggccaggcagagacgcuccucacuucccagacgggguggcggccgggcagaggcugcaaucucggcacuuugggaggccaaggcaggcggcugggagguggagguuguagcgagccgagaucacgccacugcacuccagccugggcaccauugagcacugagugaacgagacuccgucugcaaucccggcgccucgggaggccgaggcuggcggaucacucgcgguuaggagcuggagaccagcccggccaacacagcaaaaccccgucuccaccaaaaaaaaaaaacgaaaaccagucaggcguggcggcgcgcgccugcaaucgcaggcacucggcaggcugaggcaggagaaucaggcagggagguugcagugagccgagauggcagcaguaccguccagcuuuggcucggcaucagagggagaccauggaaggagaccguggggagagggagggagagggagagggagagggagaggagggagaggagggagagggaguuuuuuuuuuuuuuuuuuuaauaaaacguugggaaggggaugaaauuauuuuggaaguuccagcuaugugccugccccugugcugggcauuucucaguuauauccucauuuaauccucaacauaaauuuggagagugagaaaauugagguuuguugaauuaacaacuggauuucaaaaccaguuuucucuaacucaagccuuuacuauuugguacugcuauauuaaauccuguggaauuuaaggaaaguauaaaccagguuuuauaguagaguacuugaacauuaauugaaaauggucuccuaucucaagccuucuauaucauacaugcccccuucugagucuuuauuaguaaccuaguuuagguacugcuucaugauugacugguuuuucucucucauuuuggcuuagcuucagaugaugaauuugagaaucuuagaauuaaaggcccuaaugcuguacagcuggugaagaccaccccuuugaagcccucaccucugccugucaucccugauacuaucaaggaagugaucuaugauaugcugaaugcucuggcugcauaccaugcuccagaggaagguauguggcuagccuaccucaggaggcugggcacuagaggauauguuacuuugccugggucauuucagccaacucauggcuuagugagcacucacuaugugcccauacucuggggcucaagaugaauaagauacccauugcaugucugugaagaagcuaauagucauauaguaugacauaccaggauggugguaaguccuuagggugaggcaccuuaccuagugagggugcacagguaagaaaauuucuuuguguacaugauuucuaaaaugaaccuugaauggaugagauugccagaguucuguuauaugagaauacacaccauacgggggaagaaugaacaaagauuuagaaggagauaauagcauucugugagagguugaaaauaagacaccaggaagucucuaauguuuucauacucaagcaaaaccuuuuuauugucugaagagcuggaggcaauauuaggaggugugucugaguuuccuaacuguugagaccaccacacccauccaccuuuauuccuaguuaaggugcaucuuauaagcauuaggaaagucaugauugauuugcuuggaacauagguuuccauuauaguaagguccuucuggauuuuauucaggacauacuuauuugauagguccacagaauugccaaaaauugaugaaugcugccuuuaauaagcaaaagaaaucugagucuugaccuuggugcuuuucaucuguacagaacccugauccauauagaauuccuugguucuccuaucaccccagaaucuuuacccuaucucuuaucaccuccccgaaauaguuuagcuauauagcuguggcaaccauuuauugacccaccacugcaugagcaauagugccagguauguucacuuaagguuuguaguuacagcuuaggaaagugagacuaaguuaauugccuguggucacaagacuaguuuuuguaauuuuagggugaggcacucuaacauuaucuguaauagcaccauguaaacagucauagccacuugaugugaaauugaccaagacugacuagauaggccuuaacauuguccaauuguagaagagguuuauuuuguuuuugaugguuguuacuguuuuccuagcagauaaaucugauccuaaaccugggguuaugacccaagagguuggccagcuccugcaagacaugggugaugauguauaccagcaguaccggucacuuacgcgucagagcagugacuuugauacgcagucagguuuuuccauuaauguaagucaauuccaacagcguuuuaucuuucuucucauuuuucaaugccuguguggucucaguauuuagggcuauccccggggaauuucaaagauauuaauugugauguaucuguaaauuaucuguugccuguaaagacaaaauuggggugucccuggagacuuuuuuuucucuccuaggauuagaacuguucuuuaauuuuuuuucuuuucccuuuccuuccccgccucccccacagucucccagucacuguauuuauaauagccucccacagauuauaguauaaagguguaaggugguuaaaagguuggccaaagagaaucuguggcauucccagccagugcccugggaaggaguucugccauuugcagacgggugcuuuugaaauucauaauagcucaggaguuuucuucuucuucagagucaggucuuugcugcagauggugccuccacugagacuuccgcaucugggaccucccaaggagaggguaaugauuugcuuuucucacuaccauguucuuauuccuuaggaaaacaacuugaaaaaacuguagguguccugugcaggggguaggagaauacagacuuaauuauuacguuuacuggucuaagugaacuuucucaggugagcucaguguucuguaauaaagggucucuauaugcuaaaguuaauggaacuguaaguuaaccaaccuaguaaugguugcugugguaacauauuuuaguuuuacuuuuuaaaucacaccauaauuauuugggggguuucuaaaaacuggcuuauagagauuuuaugccagugauauuguucuagcuacaugcuuuacgugguggaugccugucuuccagcaauguuaacagagcccauugacuacucaccaugaacuagaaaaaugucccugggaguaagucuaaugagaccuuuaaagagcugcuucuccuuagauaggaaaggucuuugugauccaauuuaggagacauuuuguuuaaaaucauacuaguuccuggagauaaauuuaaaaggcuaacauuagugaaauaauugguuaacucauuuuacuggguuuacuggccauauguaguguauagcguggaugauggugcugauucaagggaagcauuacccacuauguggcagacuauauuggacaccaaaauggaucagauuuguucccuguacuuaaaguacuuuguccagugacugagaccugcaagaguuauaaugcaggauaacugccagaaugaaggcauacuuggauaagauauaauggacauguaaaguaucucacaguaugucuagaugagacaggaaagcauuuauggaggaggucagcauuugagcugaacuagauaaaagugugccaggcagacggaagaaagaaguaagggagcaagacaaguuugaagaacuguuaguagaguguuucuggaguauguaaaaggagggaaauggagggagaugcacaaauaguuggacaaagcaucccuguuguacuguaaccacauaaaucugagaccugaguuauccugguucucugcucuugcacugcagugucacgagagcauucaguuuguacagguggcuuaaaguggaggagaaauagcauucuuuuccaccuaagacuugauuuugccaguguuccaguguggaauugaaccaguguuugacuuuucucaacagcuucaacuccagaggagucucgagaugggaagaaagauaaagaaggggaccgggccucugaggaaggcaaacagaaaggcaagggcagcaaaccuuuaaugccuaccuccacuauccuucgucuucuggcagaguuggugagguccuauguugguauugcuacccugauugccaacuacagcuacacugugggccagucugaacugaucaaagagguaauauuuccaacuucuauuuaagauguuacacuguacuuccaucauuuggguaccgccugugucagacacugcugggaagcugugcaugcuaagugcuaacccaaguaaugagugagaagaggcaucuucagacaugcaaggccgggugcgguggcucacgccuguaaucccagcacuuugggaggcugaagcaggcggaucaccugagguuaggaguucgagaucagccuggccaacauggcaaaaccccaucucuacucaaaauacaaaaagaaauuagccaggcgugguggcgggcaccuguaauuccagcuauucgggaggcugaggcaagggaaucacuugaacccaggaggcagagauugcgggaaucacuugaacccaggaggcagagauugcgggaaucacuugaacccaggaggcaaagauugcagugagccaagaucgcaccaucguacaccugccugggugauaagagcaaaacucugucucaaaaaaaaccugaaagagcuaggccuuuuuucauuagguucacugagagagagaguuaaugagauuuguucuauugaaagucccuuuuuaugcauuguggagauugaagagggaagacuggagucagagagaacaguuaggaaucugauagaguaaucuaguaacguacgaucuuggugaaguuggaggaaaaugggugaguugaagaaauauuuuuaagguacaaauggacaagaauuggguuuggaagaugaaaaaggaaauuaagacucaaggauguuucuugauuuguggggguuuuuuuaauugcuuuuauggguuggcaucuaacaagaaaauagaaugggguggggaagguuugaagagaaaaugaggaguuuugagaaguaucugugggacaucuaaguaaaagugucuaaaggacaguugaauaaaccauauaaauaagaauauagguguucaucuuccagauguacucacacaugugcaaagacaccagaugugguagcaguauugguaauaaaaauaaaggaaaagccuuaaauguucauuaguagagcuguggaaaagaaugaaguguccugaugcagaauuauccucagguuagauuuuuuaagugaguggggcauuuugagaaacuguaucacauguucccgcauauguaaaaugggugcccaaauauuuuuucccguaagggugccuuguuuuguggaucacauuguaauuuuaugguuaguaaguggcaaaagggucugagagugaguaggggcacuaguguugccaucuuugaaagcaaccgccauuuuuaaagcuauucuuacuuuaauccaaguuuaauauacauagaaaaauacacaaaucuuaaauagucuguuuuuccuagguaaccacuagccaaguuaaauaaagcauuacaagcucccuagaagcugcccuccuuguucuuuagugcaucuccucccacccauuucaccuucacucaagauaaccauuaucuugaguucucgugccguaauuugguuuuguaguucauguaaauggaaucucauagaauguacucucuuuuuugccuggcuucuuuugcuuaacauacuugauucauuuugugugcaggugaaguuuauuuucaucuguauaaaauuccacuguggaauguaccauguaccaaaacaaauacaucuuuuacccauucuacugcuaauaaacauuuggguaauuuugccuuuggagcuaucacagauagugcugcuaugagcauucuuaugaauauauauaaguucgugaacuacccaauuucuguuggguaguauaugccuaagaguaagaauugcugagcucuagaguaugauaguuguucugcuaaugcuaaaaguuuuccagaguggccaggucaguuuauauuauuaccagcagcauaugggagaucaacaguugguguuuuuucauuuuacugauuuuaauggguuuguagugguauugcauuauaguuaaaauuuacauuucccuguugaccauuuuuuucaugucuuuauuggccauuuguucauucucuuuugggaaaugucuauucagcucuuuuacucuauuuuccuauugaguuuuuaaaauauauucuggacauaaguccuauaaauacauaaauaggcuuccuuuuuuuaagagucucacuuugucucccaggcuagaaugcagugguacaaucauagcucacugcagcuuugaacucccaggcucaagugauccucccaccuuagccucucaaguagcugggaccuauaggcacaugcuaccacgcccagcuaauuuuauuuuuugaggucuugcuauauugcccaggcuggucucaaacuucuggccucaagugauccucccgccucagccucccaaaaugcuaggauuacaggcaugagccaucacaccuagccaggcuuuauuccaaagcuuuaacucauuuaugccaguuguauucauaauuuauaauaguauuaccuguggguuaacauauuuaauuacaaauuuauuaaguaucugccuaauauguguccaguguccuaccaguacuggguacugguaagugcuuuauaaauacuauuguuaauccucaccuccacacugcaagguuguugauagugaucucuuuaauagaggagagaaggcucaaagagguaaguaacuugccugggaccauacuacagaguagcagagcuaaaauuggaagcuagggcuaugauuccaaagcuaaguccuuucuacgugguuauugagaaaauaguuuuaacuuuguauguauucacuacugggaaauuaauuguuauuucuaauuguuuuguuuugacaaggucacuuuauucaguuucucagacucucaaauuauucaaugcauuuucuuuauugagguaaaauuuauauaaagucaaccauuuuaaaguguacuguugaguggcauuuaguacauucgcaguguugugcaacugucaccuauguaguuccaaaaauguucaguguauuuucauccaaaauuugcuugaaugacaauagaauuuguuucuaagauaaggaauugucuaggcaggaauuguaguuagagaaaaaagaagagucugacuuaauuuccuuccucuauugagccuuuuucguuacuuuaaauaaccuugcauuaaauauuuuugcauauuaguuucugugacucugcugucucuugcucagcucuuaccagcuucuauuguagcacaggguccugggcacauuguaggugucaguaaauaauuucaauuuaauugaacacugaaggguuuauagcacuuaauuaagaaucaagguuugaauccucagcccuugauuaaauucuucugugcaagccacuucuuuagggggcuucagauuaccgcuuaucaaaugagaaaauacuuaucuauuuauagauuugcuguaaguaguucuauuaaauaucacaugugaaaauauuuuaagauaggugcaauagcacaugccuguagucucagcuacuuggaaggcugaggugugagaacacacacacaggaguuugagacuguggugugcgaugaucaugccugugaauagccacuguacucuggccugggcaauauagcaagaccucaucuucuuaaaaacauuuuaauaaaaauaaaguuuuuaaaaaauguuuuuaaaaauacaugacaucuacauaacaguguauaagcugugcagugggaaauggguggcauuuggaaguuuucuaaaaucuggguuugcuccuuacuugcuuguaucuuugagccuuggcuucuucaucuauaaaguggaccuaauaaucacucauugggugacuuaaggaaauacuauguguguguguaucuuugguccugugcaaaugauauggcauaauugugcuuguaaguaaaugucgugauucaugacuuuucaggacugcagugugcuagcuuuuguucuggaccaccugcucccacauacccagaaugcagaagacaaggacaccccugccuuggcccgccuguuccucgcaagccuggcugcugcagggaguggcacagaugcccagguggcccuagugaaugaaguaaaagcagcccuuggacgggcacuggcuauggcugagaguacagagaaacaugccagguaagauucauaccugucccagggcuaauagccaagaacauccccuuauucuucuucuuaguccaugggugguuuugcacuugaacaaaacuucuugucauacuggcaucauauacucucugguccgcucaaauaguucuggcgguuggaaauagccagagcacugauuaccauuagaguaaguggguaaaccuagagaaaacaaagggaaauguuaaguguacuuuuaaggucuucaaggaaguugagcagguuauuugaucuuauauuuuaaauuuuauuuaaaguaggggcugggcacgguggcucacgucuguaaucccagcgcuuugggaggccaaggccgguggauugccugagcccaggaguaggaguugaagaccagccuuggcaacauggcgaaacccugucucuacagaaaauuagcugggcguaguggcacgcucccguagucccagcuacucgggaggcugaggugggagugucacuucagcccaggaagguugcagugagccaagauugcgccacuguacuccacccugcuacagagugagacccugucuaaaaaagagaaaacgaaugcuaucaccuuagggaguguguucucaccuguuuguuuagauguuauuuccagaaggaaauacaaaaguuacaggaggguuaucugaggcuauuuugugaagacuuggccugagaaauggcuauauucauaugauagagaugucaaaacuucucucccaggcuucaggcagugauguguaucaucaguacuaucauggaguccugccccuccaccuccagcuucuacagcagugccacagcgaagacccagcacaauggcaugaacaacaucauucggcuuuuccugaagaagggacugguuaaugaccuggccagaguaccucacagcuuagaccuguccagguaaaaucaugccccagccccaggcuuuuccuucucuucagccucacuacacgaaugauguggagguagcugguguagugggaaaacuuuggguacaagugggagacccaagucuuucuuauuguggcuuuuagcacuugucuuucuuaaagccuugguucuuacuugcuauaaacucaagaguugaacuauaauagugauuuuuuuuucaagcuuccccccacuuuaaaaauuaccacuuauuagaagauuauauguauauuauaagaaauacagaugaguaaaaauaagaaguagacacuguauuccuaccacccagauaccaugauuaccuuauugguuuauuauucaguguuuuucuuugcaugcauaaauaauguauucuuuacuaacaugauaugauacaugcuauuguguugggggaaauuuggggcauuuucguuuuuauuuucaguuacuggucacuuccuugcuaugaaaauaaguuucauccuaccuaaugcccaaauccauaauuaagcauuuuucuccaaaccagaauccaauuaaggacuuguauuacaucuggcuauguuuucugaaucucucuuauucuaaaacaauuuuuuuucauuauuucgaucuuuauuuuguuuuuguuguucaugauuccagcuuguugaagcgaccguguuuuugccuucuaaacuuggugcaguugcuuccuugcaguguaguuuaacuuaauccuuuacuuccugauauuuucuguaaacuucuaguuagaucuagaggcuuuagaggcuuauugaagcaguuuaaacauuuugggcugaaauguguagccuaggugauguauagcucauauuguaucgugggagacacaucucccaugauaauugucacuuuuuguucuuacuagaaagucaucucuguuguuauuuuggcacuuuacaaaugucuacacuaucaaucauauaccuaaauaauagccuuaacaucaguugauaauucuugccuggaucaauuaauuucuuugaggcuuaugaauaaaagcuuucuaauuucucauuucgaauacauuauuaacuggcauuuuucuguguuagccucacagggaaugucugguugugcuaaaauauaauuucuauuauaaaggcaguauaaaaacuuaauuucuuucuauuuacauuugagauucaaauguagguuuuuuucuggcuuucuauuuuuaagucguauuauggacucgacuuuucauguuuguuuuguuuugaaacuagugauugaauuuauuuggaucacugcagucacuuuuucaugcucaaauuauuacaccuuugaccuauguggccccuucaagaugacuaaauuguccuuuugcuacaaaccuaucaauuuuuugaaacauuuauaaaugucaaacucacaguacuguaaugaacaccaugugucuaccuagauuaaccacugcugaacauuuugcuuuauuucuucccuuccuguccuuucaggagcugaaucauuugaaauuaguugaaaacacuguaaaacuuuaccucuaaguacuugaucaucugucuccuaagaacaaauauuccuuuauauggguacaguuccauugucauauccaaaaaauuuaccaauaauauaauaauacuaaauuuauacaauuuuauauacacauacucccaguuauuucaauuaugucuuuauacucugagggagaguguuuugauccgggauucagugaguaucacauguugcauuugguugucacauuuuuuuuuuuuaugacauuuuccuguuuugaugaauccaggcuugaugucuuauagaacaucucacagucuacauugauguaauugcucccuuaaugguuagggucagguuaaacauuuuuggcaaaaauacuacaugggugauauuugcccuucucacaucacgucaggagacaggugaauaccacuuggucccaauacuugugaugcuaaauuugaucacagccgaggcugguggaucacuugagccuaggaguucgaggccaaccugggcaacauagugggacccugucucugcaaaaaaauacaauaauuagcuggacauguacgccuguagucccagcuuuuugggaggcugaggugggagggugguuucuguuagauuuccacuuuguaaugaauaauuccauuacuaucauuauucuuucugauacucagcugggccugugguaaugaucccauuaauuuuuuuuccccauuuuuguuguuauuuuuccucuuuauagaaacaggaucucacuauguugcucaggcuaggcucaagcaauccucccaucucagccucccacagugcugggauuacaggugugagccaucacgcccagcugucccauuaauuuuugaaagcuuuuuggcacaaugagauaucccaggcuuaccuuaucccuuccuugcccuauuccugggaucacuuguucugacgagucuugguuacuuuuagugugaugugauaucagagacugccaucuugguacuacuagugagcauauauauauauauauauauauauauauauacacacacacacacacauacauacauacauacauacauacauagacucacacauaaauacacacauaaagcagauaaaagcagagcugcucugguguuagugggcaccugguuggucucacacaccuuauuacacuuagaaaucauaccacaccuccaacugcagccccuauuguacuuuuauugaacucuaggaagcccuacagaguauaauuugaaauucacaggacuucaaacuguuaucagccgggcgaggagggcagguugccugagcucacgaguucgagaucagcaugagcaacauggcgaaaccccaucucuacaaaaaauagaaaaauuagcugggcaugguggcucacgccuguagucccagcgacuuggaaaccugaggugggaggaucacuugagccugggagguggagguuacagugagcugagauugugccaauguacuccagccugggugacacagcgagacccugucuccaaaaaaaaaaaaggaaaacuuuuaucauguuccuuccuuugagcuuuuaggguuuggggacuaaaugcuggugguuuaaaaaaaaaaauccugaguacauccgagaaguggcuugcuugcauguggucauccagaauacauucugauuuccagucaagaauuuguuacucaugugcuuuccauggccccaugaaauauggcauugauuuaacucuugcuuuuaggguggguuccuugaagacauuuaagucaaaauuuuuuuuuucuaaacaaaaguagaguguuaguuguacgaccuuaugccccuuuucucuuaguagauuccauuguaagaagcuuagugucauuuagaagauagacaccuaguauuucugugcucaguccaucucuuuaucuucccuuaucucagucccaacauggccaacacagucaaugcugcucugaagccuuuggaaacacuuucccggauugugaaccagcccaguagccuuuuuggcagcaagagugcuucuagcaagaacaagucugagcaggaugcccaaggagccucucaagauuccaguagcaaccagcaggacccagguagggaaucagagccaauggacuggagaggugggaguaguugcuuuaugggccugggaucacaacuguucuggcuuggugguguuucccugggaacuugcuggccuuccagagaucugucauaguggcgugggaaucugccccacaaagaauuccuucaaaaugcagccuuguuuggcuauccucacacguagccuugucuuuuccuuugucacccauucguuuauucucugagaacuuacaaacuugcccaaggaagggaccuuauugucuuugcgcuugccucauggugcccagcacauaggcacucuuugauuauuuugcugguugguugauuguuucaggcgagccuggggaagcagaagugcaggaggaggaucaugaugucacucagacagagguggcagauggggauaucauggauggggaggcugaaaccgacucaguggugauugcugggcagccugaggugcucaguucacaagagaugcagguagggaggcagaucacccagcauuucccuguugcggcgcugaaccaaacccuugccagguggugugggugggugaguacuuuagauccuugccucaaugcuggcugcuuugcagaggagcaugggugauaugcuuaguagaugcucaguaaauguguuuguacuguauuaaaagaggggugggggcagggccaggaugccauguacuaugaaaugauauagaucccaaccagaaaacuuaggcacaggugaaauguugaaguagaaagcugaccugagaccguugggccccgggucuuugauuuacuuuggcucuggucauuauuggaagcuccuuaacaccaccuuaugccuauagcaccagcucuugcuggggcauuaaaacagcagucuucuaaagacccuaaaggaaagcauuguaauuucuggagcugguagcauuggguaagaaauugggccugugguccuaagcugcuggcuuuaaagagaucuauuaugucuuccuggacaguauaaagacaacccaguaucagauaacugggauggacccauuugaaggauagucugguuguggauugguagcacgugguaguuucugugcuaauuagcaccgaaugugugguuucacguaacauccucugucacauguuauccuagaaauguaugcugcuuugcuggccuuuuuuaggguuucggugcuagcacaaugauagacuugugugcauccauauauauguucuauuucucuccagguugagaaugagcuggaggaccugauagaugaguugcuugagagggauggcggaucugggaacaguacaauuauaggugagagccccagaacugaguauagccucuuccuuugccucagucucucuugggaggacccuuuuucucaucaucugcuugcucagcucugccuaagggcucauagccagccuagaucgcugcuugucuugauguugacggucuuacagaugagaaauucacaagacgucuacaggccuguggcagucuaaaguguugccugugugggggagguggugggaguggccauugauacagaugauacaucaagcacaucaaaagaguguuuauucauggaggccuagaggaggcuguagggugagaaagcgcugccuuucaguucuucaaugaaguccaggggcuuucugccccugagucucaguaguguaaaaagaaugaucauucccugaggguggcccuuuauaaaucucagagggaaaauggcaaagguacccuacugucaccuggcucugaggguguauguguuacuuguuuuuacuuuguugaucaaggaaaucaaaggauaaauggaaguagacacguauucuuaaguuuuacaaagcuuuuuuauacccaguauccucugugguuucacaauuagugggauuggcagggcagaugugaucauccuguuuuacagaugaggaaacugagacucagacagguaaagugacuggccaagcucaccuagcuagcugacagcagacaauccaggucuucucccucauccaaaaaaaaguggauaucugcuagguguacauagcuacuuuagacgcacccagucuggaaagggaaguccucuguuguucagugaaggcucugcucuguaaccuucagugagcagaaguggagaggaugaaucacaagaggacgugcugauggaugaagcuccuuccaaccucagccaagcuuccaccuugcaggccaaccgagaaggugagagugccgaggccagaaaggccucccuucuugcccugcacgucugacagacacuacacuaggguuuuccuggaggcagcugcccacaugugcagaauaaggaagcaucugucugcaugcgcugacauacaccauccacuuuauccucagccaguuuuucaaauaacauguuacuacugcuugcccaaaguuugucacuucuuacuugguucgcuuucuucucacccaccugcuaucaucgcuccagguucccucuugccaacaggauauagucaauagcaaaguagggcugaaaaggcaagggggcaccagcagacuuggccaaguccuagaccauggcuccucaagcaccacccucuagccagccuccacauucagccacccugcucaguguguugaugcauugauuggcacucucaggaaaucgggucuggcucacuaagucuguacaucaccccagaucugguucuuccucucauagagucagauaucccaucaccuucccacucagccugcuggccugcacaguagccuguuuucuagcuacucaguuuaguccuccaaugugcucccuuuguuuuagauuccaugaauauccuggacccugaggaugaggaggagcacacucaggaagaggacagcaguggcaguaacgaggaugaggaugauagucaggaugaagaggaggaggaggaggaagaugaggaagaugaucaggugaggggggacugcguuuggguugguucagaugaccucuuccaugggaacauagagcugcagaaaaccaacagucuggguugcuagccucagcgucucccucccucaugugcacauguggccauggcaccaggcuucagaaaacccuuaccuccagcaauucuccaucuccuauuuucccuuaaggaggaugaugaaggugaagagggagaugaagacgaugacgacgauggcucugagauggaauuggaugaggauuauccugauaugaacgcuucucccuugguccgauuugagcgcuuugaccgggaggaugaucucaucauugaguuugacaacauguucuccagugcuaguaagauacaggggcucagcuggguuuuucucucuugauucuuauacccuucucuaggguaagccaagcaguggaccaaaccgauccgauacagacagcacuucuuuuccuaugcugacuuccuggggcaagggauaucugaauccaucugucucauuaguguauacuuaggagaaggaauagugagaggcugcuuuuguucccuucaccucaguaaauaggcagccauuuuagagccuggacaacuugaugauuugcuugauuaaaaaaaagaaagagaccaaggcugacugcaucaggcacccaugugcacaccacaguggcagggcaaucaauaauccuuauguccauaacacaagaucuugaggguuugaauggucaccuuugagcuuggcuuuggggagcagauuugaacauacucacucuauucauccaggaugcgucuuuucgggagaacgagugaaucucuuccucccccaucaccgugaaacuucccuuuuagcgucaaguuagaaucgaguucuuagaaucaagcugucuugauagggcaggucuugacaacuuaaaucacaagcaugauguagcagaaaacacugaacuguucuggucuguuuucuuggccaauuaaucucuuaccucuuugagccucaguuugucaccuguaaaugaaaaguucgagaaaaaaauggguuggauuagauaacuuugaagauaacaucuaugauuauuuugcauuuuugugauuuucaucaguuucccuuagaguugagccucuguccauucagcaaauugaacaauauuugaggagugccuacuguauccuagguacuagggauacagcaguaaagaagaaaacaguccucguuccucauaggagugguuuauuaggaaucauaacuaagcaggcauuacauugcacuauaguaagagagcacagagguaaagaguuaccuaacccaaucuguggaagucaggcuucacagagaaagugacaucuuaggccaagaagagaagagcagguaaagaagcgggagaggagucuucaaggugaagggagcagcauguaucugaggggccuagaagcaucacugugacuguaguguggaaaauggauugggagaagguacuauuuaggaggccguugcaguaucuaagugagagaugauggcauaagcuaugguagugucagugauuguagaugaguugugggaaugagggagaaaggacaaagcucagguuuccgugugaggaaguaaggcccaggagacaugauucugcuugaacaaacauggaagaaauuucuuuuugacacugacccuuuuacauauuguccuugcagcagacauccccccauccccaggaaauaucccuaccacccauccacugauggugcgccaugcagaccacaguucucugacacugggcaguggcucuucaacaacucgucucacccagggcaucgggcgcagucagaggacccuaaggcagcugacggccaauacuggccacaccauucauguucacuacccugggaaucgccagcccaacccuccucuuauacugcagaggugaguuacagagaucuguuggauucaucggagcucuuguaagaauuuucacugugcuuuagcauugucuuaaccuugggggaaauaguccaucacuuaauguucuugucauacacacaaauaagguauuuguuccauuucuuuguggauuacauguguagccuuuuggggagugcagccuuuuggggaauaccaaauuaugucaauaguucugcgcauguauuuagcaauuauuaagugucucaugccaagcacuuaacacuuuagauauagacgggacaagaucccugcccucaggcuuagaguuuagugagacaaacaaucuuaagaaguaaaagaaaggcauauaaguguuguaaugguugguguacagacgacagagaggguguaguggaggcaaugugaccugacgcagugccuggcacgugggagcuuauugacacccacuuggugccaggaacuauggaauaauauacaacuuaaguacaaaaccagggugguauucagaaaaauaacuuagacuugugugcacaucaucagguuuauaaucauguucugcauuuaauagaggaugcaugaagaggaucucaugguaacagguugcagggcaccucuggacuuaacagugaucaugguacccaccauuacccuacagguugcuuggucccucagcugcugcugacauccuucagcugagcagcagccuuccccuacaaagccggggucgggcccgccuccugguaggcaacgaugacguccacaucaucgcccguucugaugaugagcugcuggaugacuuuuuccaugaucagagcacagcuaccagccaagcaggcaaguuuguguggugaaagggaggguagaauuugucagauucuacuuuuucccugcugaggaaaagcaagacagugucugcccuauagaaaacccccauuuuauaggagccagaaccacucagugacuuagccaugggcaacaaaaacuuuauugucucuagguacuuguuauguucuaaacauugugauagaccuuggguccuuuuagggaaauacugcaauuuuuggaucgguggaucaguuaaugcuugacaaggccaagaaucucauuccccuuugcugucccuacaggaacccuguccagcauccccacagcccugacccgcuggacagaagaaugcaaaguucucgaugcugagagcaugcaugacuguguuucaggugcguggcagcuugguuaucagggcaauagugagccuuccagagcuagggcaaacguguggagaguuguuucccugguucucuguggcuacaagcucugccucuuggcuuccucccugaccccaccagagcagccuuugauuuuugccucuuugaaacagugguuaaaguguccauugucaaucaccuggaauuccugagggaugaggagcuggaagaaaggcgagagaagcgcaggaaacaacuggcugaggaagaaacaaagauaacugauaaaggcaaagaagauaaggagaacagggaucagagugcacaggugauucccaagggcugggaggauucaucuuugacugugucugccguaaugugguuuuggcauacacauggcaccaggaaucacugaagaauccuagaacguucacguugaaccugggaaauuuuuuauuucaaauucaccauacauugaccugguuuuuaggggaaagaauucaaaccuagaggggagauuucucaagugucaagggaaaaacuggagccagaagcagaauggcuucucacucaacagucacacugcauagucucuaccgccaaggacagcaucaagacaaggagaaaaaccuuaucuaaguccaugcucuuagucgcccacuuccauuucugucggugaacugccaguguggggaaucuuaccgagaugaccccauuccgucauuugaguaagaucagccuaggugucagaucagagaaaauguuuguacucugaaccccaucaccacaugucauuuuuucuagggcucacauguauaaaaucacuaauacaauuuugguuuagaaggaaguuaccuacuuuuuucugaaacuucugggaccucagacagagaucuuuuaaaugucugaguaaauguugauagaauuauacauuacaguguaucacuugauauaaaagggggaaaaacugauagaaauacaaagaaauaagacuugagagugaaagacuuuaguauacccuacucagcaguuaaggaaucagguagauuaaaaauaaggguagugaaguguucaguuaaaauaacaagguugaucuaacaaauaucuuuauauagaacuuuuuaccuaauacacacauuguuucaaacuugauauaggaugaaaaauaagugaaccuagccugugacugaaaagacuagaguggacaaaauaaaaaauaagccccaugaagggaaaaaauacauagaugaaaccaagaaauucuugcuagaaugaucaugaucgugcccaucccuaagggguuuuuauuauccuuuccuuccauauuuauuucccccucagccccaaacaauucuugaaccugaguauguauagagaaauuggucauauauuugcacagugaaaugaucaccuuccuuuggucacauggccaaagcauucuccauuagaucacugaacuccuagauggucuggguggaggauggugacuauuacaguugaccucuaucuuaggugcuugcaaagucccacauuggucuaucccuucuuuuugcaguguacugcaucuaagucaaaugacuccacugaacagaaucucucagguaacucuccuucccuuucucccuucuuacuaaucaauugguugcuucuuuauccugauaguuccgaguagcuggcccacauaggcugaagauggacacuggugcucugugggaugagguaguagauuguauaguuuuagggucauaccccaucuuggagauaacuauacagucuacugucuuucccacggugguacacuucuucuccgacuggcucuguucagguucuuguucugguuauuaucuacuuuguucuggcauggguaaugaggucaugugucuuguucauuuccugacugcaacucuguccucugaaacagcauguucauguacaucuuugaaguggcugguccuuugaugaccaccaugguguggcacuucaugagaauaacugaugacagugguucucaaaugccaguccucuguggaaacgaacaaaaucaaggagcuuuaaugccuuuuucauaaagcugaauuuauuccauuuaaaaggcuguuuuuguauuuagagaucauauuccuaauucugugguaccaaaauauuuuuauuaaaugauguugauuggauguuuuuucuuacauggcuaaacuaaaaguuggcaaccccuacauuagucucuacuuuuuguucuuuuuuuaauuaaauuuuauugguccauggaaucuaaaagucuaggaacauugucuuggauagugugcuguucaugaagguagcucucugggcuuagugguaugacugccguauguuuccuauucccucugaucuucuuaacaauggucaguagccauuuugugauucuaucaguugguucaugugauaucauaugucucccccacccauauuuccucagaacauucuucugccucccuacaccugucuccuuucgcacuugaguuggaaaaugauuguaccaaagccugcacaauauuuuuuaaagcagugaaguaggguagaugccuugguacccuuaaucuagcaaaagaucuuuaaaagagucugucaccauguaaaauggccuuuugccugcugcccuuauuagaggauucugcucaugccagggugagguaguaaguuguauuguugugggguagggauauuaggccccaauuagaagauaacuauacaacuuacuacuuucccugguguguggcauauucacacuuagucuuagcaguguugccuccaucagacaaaguuguagauguuccuuggauaauuuggacuggaagaaaagagacauggaaggggacagaugguguuuagggugaggcagaugucauuauaaagugacuugucuuucauuaauuggagcauauaauuauuuuaccuuugggcaugaacucauuuugcuauucuucaacuguguaaugauugcauuuuauuaguaauagaacaggaaugugugcaagggaauggaaagcauacuuuaagaauuuugggccaggcgcagugguucaugccuguaaucccagcauuuuugggaggccgaggcggguggaucaccugaggucaggaguucgagaccaaccuggccaacacggcgaaaccccgccucuacucaaaauacaaaaauuagccaggcuuggugacacucgccuguggucccagcuacucaggaggcugaggcaggagaauugcuugaacccaggaaguggaggcuucagugagcugagaacacgccacugcacuccagccugggcaacagagcaagacucugucucaggaaaaaaaaaaaaaaaaaaaagauuuugaagggcuggacgcaguggcucacgccuguaaucccagcacuuugggaggccgagguggguggauugcuagagcuuaggaguuugagaccagccugggcaacauggcaagacccugucucuacuaaauauacaaaaaauuagucagguaugguggcacaugccuauagucucagcuacuugggaggcugaggugggaagaucaccugagcccgggaggugaaggcugcagugagccaugauugugccacuacacuccagccugggcaacagugagacccugucuccaaaaaaaacaaauagaguuuugaacgaaauucugaccauuucuugcuccaaauagaugaagugggaggaucaauaggauuuugguaguuagauuuucuguguaccuauaggucagagacauuuagccucacccuauauggccugaaaucuucccccuuccaccugcagggcacagaaaggauuuuauucuuagaauccacagagucagagcuccaguucuugcauucuugggacagagauagcacugugccuuaaccuucauccuuaguauaccagaccagagauguuccuuggaguauuuuuguuguggggaugaucacuggcugggugggauacuuaucaggccacauuugcugauugggguggcuccccucaucauuggcugguugccccuuaaccacuauuauuguucuuuccgagaaagaugggacgccuaugccugacagcuacccaacaaccccaucuucaacugaugcagcuacaucugaguccaaggagacccuuggcacucugcaauccucacaacagcaaccaacacucccaaccccaccagcuuugggagagguuccucaggagcugcagucuccagcuggagaagggggcagcucuacacagcuauugaugccuguagagccagaggaauugggucccacaaggccaaguggggaagcagaaacaacucagauggaguuauccccagcucccacuauaagugaguagaauuucaacauuuggggaggaugaaacaagagggaagaaaggaugucuuuguagcuucucuuugcucuuuugcuugagagaaauaguaggaguucaacuucucaaauaauaagaucucgucuugcgcauucacuuucuuaagugaaguugagguccugaacuggugauaguugaaugucuaaugauauuggugaugauaccaacaguucauugaggcaauuacucuguuucugggcuaucaccccaggcuuauuauuuaaaaacaacucuccagcuggguaugaugacucauaaucccagcacuuugggaggcugaggcagggggaucauuugagcucaggaguuugagaccagccugggcaacauagaccccaucucuauuggggggaaaaaaaaacucuccaaaaucgaugguguuauuuacaugaguaaacugaaacucagaaaugaaauaauuagcccaagucacucuguaagugguugaacuagaauuaaaacccagaucugucugacuuuaaagauuacucucuccuuccacaguucccaggauggcaagcaugucaucccacacuuagagcucucccauucuccuggcagacacuguuuaucucaugacacuauuucucacugguuugaaauggggccugaaaagucuucucagcaguauuucaacaggauaaauugauaccugcuugccaucccugcucuauaccaucuugcuugugaaguucucuggagagacccuaaggugucaguuuuuucuuucaaggaaccuuguuuauuuuauuuuauuuuauuuuauuuauuuauuuuuugagaaaaagucucgcucugucacccaggcugcagugcagugguguggucuuggcucacugcaaccuccgccacccagguuggagugauuguccugccucagccucccaaguaacugggacuacaggugcacgccaccaugcccagcugauuuuuguauuuuuaguaaagaugagguuuugccauguuggccaggcuuaucuggaacuccugaccucaggugauccacccgccucggccucccaaagugcuuggauuacaggcaugagccacugcgcccuaccgaaaccuuguuuauuuagagaacuacagggauaugcacgugcaaguggugccugcagugaaucaaagugaaaaaaucccuuacccgggcugggcgcgguggcucacaccuguaauccaagcacuuugggaggccgaggcagguggaucaugaggucaggaauucaagaucagccuggccaagauggugaaaccccaucucuacuaaaaauacaaaaaacuggccgggcgugguagcaggugccuguaaucccagcuccucaggaggcugaggcagagaauugcuugaacccaggaggcggagauugcagugagccgagauugugccacuguacuccagccugggcaacagagugagacuccaucccccugccaaaaaaaaaucccuuaccugguuugccuagggaagauguuucacaggcaugccuggaacacaguaaauguucaagaauugauagaaagggcuucagcugaaccuuagaaaucucaaagugagauugagagggggacagcaagggagaagugagaagucugagcugagaugccccuaaggaagcagcccuaucaaagaccuuaucugucauuuugccccgguuccagauagaaaccuaaccucucccugcaacuucuuccuagccucacuuuccccagagagagcugaggauucugaugcacugacggcugucagcagucagcuagaaggcucuccuauggauacaagcagccuggcuuccuguaccuuagaggaggcugugggugacacuucagcagcuggcaguucugagcagcccagagcaggcagcuccacuccuggggaugccccaccagcuguggcggaagugcaaggcaggagugaugggucaggggaaucugcccagccaccugaggacagguaagcaugugugggcaaaagaaggguaggauauauuggagggucuuucaaagcacauuucauacucgucaacuaauggacaugcuuguuaugcuggggagauaaagcugguuucugugagaaagggguauuguagcaguguuuuauaaacgagaagacauaauacagacagcaaccugagcaugauuucccucagcuccccaccugcauccucugagagcucuuccaccagagauucugccguggccauuucuggagcagauucccgaggaauccuagaagagccguugccuucaacaagcagugaagaagaagauccccuugcgggugaguuccguguaugcccaggucauccugggauuguuuuggcuucuaguagcccuuggcauggaaaugcccaccagccaaacaguuccauuuagauggagggcauguaugugggaggacugacaauaagcgggggugcugguauggcauaaugaaacggguccagccuuaggagucaaacugaucuuggcucacucaaauucccccacucugccacuucuaccuuuuacaaccuagggucauuauuuaauuucugugaucaugaaugauaccgagggggugaugauaucugcgugguagguuauuuaugaaggguaaguaacagugcaugcagucuagcaaauaacaaaagcuguucugagcccagggaagguggggugggccuucucugugucccaugucuugcaagcagugaagacauauacacugguuucccucaaggagugacauggguuuauuuucuccaaguacauauuaggcaccaauagaggugugagaggcugggcgcgguggcucgugccuguaauccugaaaauuugggaagcagaggucagaggaucaccugaagccaagaguuuaagaccagccugggcaacauagggagaccccaucucuacaaaaauauauauguaaauuagccaggcauuuuggugcaugccuguaaucccagcuacucaagaugcugaggcaggaagacucgagcccaggagcucaacacugcagugaggcaaggguugcaccacuacacuccagccugggcaacagaccaagaccccgucucaagcaauuaauaaggcgugaaucccuuuacauguuauaucucccuucagguaucagucucccugaagguguggaccccucuuuucuggcugcccugccugaugacauccgucgggaaguucuacagaaccagcuaggcauucguccaccaacccggacugcccccuccacaaauagcucagcgccugcagugguggggaauccuggugugacugaagugagcccugaguuucuggcugcccugccuccagccauucaggaggaaguaugugagcgggaaggugguggggccaggcugccuggcaggagaaaugcccucauugacuuuuucugcuccauagguacuggcacagcagagagcugagcagcagcgacgagaacuagcacagaaugccagcucagacaccccuauggacccugugaccuucauccagacucugcccucagaccugcgccguaguguccuagaggauauggaggacaguguguuagcugugaugccaccugacauugcagcugaggcucaagcccugagacgagagcaagaagcccggcagcgacagcucaugcaugagcgucuguuugggcacaguagcaccuccgcacucucugcuauucuccgaagcccggguacagagggaggcaagugggagggcucuggaaagcuuuagccagaugaggcuauguuuucuuaccuuuguauuaccuauauccaguuuacacccucuccacaaucucaguuuucuuuuucuuuccuuccagcuuucaccagucgcuuaaguggcaaccgugggguccaguauacucgccuugcugugcagagagguggcaccuuccagaugggggguagcagcagccauaacagguaccuuugucuauuuuuaccuuaccauaucaccacucaagucuauuagcccagcucccuuaguuuuauagguggagaagcugaaauccugacaggcaggauggauggucucucuaagccauuuccuugaauaagugagagagccagaucuuuggacuccccauucagaaaacuacaccuuuugguuagucuugcuaccaaagaccacaaucgcaaaagcaggccggcagcaggugcuaacuaugguuuuaacaagaaggaacaccacuugucucccaugcaaguaguaaaacaacuaaccaccugccuugaguuuguaacaccuaggcuaaggaaguauagaggagugaguuagccaggcuaaaacagagugggccugacaugccaaaaugugaaaggagugauugguuccuacaaggccacaaacuccugguagucuagagaaggcagaaacuagcauugucuccuagacuuagguauggucagauuuuaccagucgauggaugauaccugggcuggaaucucugcugucuucucagucgccgugugauguagggcaagucacuuaaccuguuugagccucuuguuuaucaucucaaaaaugggugguucucggccaguugucguggcucacaccuauaaucccagcacuuugggaggcugaggcagguggaucacuugaguccaggaguucaagaccagccuaggcaacauggcaaacccaaucucuacuaaaaauacaaaaaguagucgggugugguggcgcgcacuaguaaucccagcuacucgggaggcugaggcacgagaaucacuugaauccuaggggguggagguugcagugagccgguaucacgccacugcacuccagccugggugacagagcgagacuccaucucaacaaaaagcugguggggguggggggcuucauucucuaagcuguacagcagcccugaaaggaugauguacagucauuguaaagugccugguacauaguagacaccuaagagggcagcuguuacuaugaagagcccuuggacuggacacccaccuuucucaagccuccuuggagauaccuagcucauuccccucccccauucuuaugccuaaucccagagcucuagccacugaaguguuacccaaaaaccauguucuguuuccaggccuucuggcaguaauguagauacucuccuccgccuccgaggacggcuccuucuggaccacgaagcccuuucuugucucuugguccuacuuuuuguggaugagccaaagcucaauacuagccgucuacaccgaguacugagaaaucucugcuaccaugcccagacccgccacugggucauccgcagucugcucuccaucuugcagcgcagcagugagagugagcuaugcauugaaacacccaaacucacuacaagugaggaaaagggcaaaaagucgagcaagagcugugggucaaguagccaugagaaccguccccuggaccugcuacacaagauggagucaaagagcuccaaccagcuuuccuggcucucaguauccauggaugcagcccuaggcugcaggacuaauauauuucagauccagcguucaggggggcguaaacauaccgagaagcaugcaagcgguggcuccaccguccacauccauccccaagcugcuccuguugucugcagacacguuuuggauacacucauucaauuggccaaggugaggguuucaaacccaacuccuggggauggaagaaggguggcagcaagagccugggugaaaguugaacacuaagcaggcuagcgugucuuuuugcucuuauuuuaaguguugagcccuguauuguuucuaggggauuguccuauauauuucugggguuuuuucuucauucuuuuccauuuuuauguaugucuuauuuagucaucaaaacaacugggcuguaugauuccuguuuuacagaugaagaaccugagauucagaacauuuuauucauuuugucuuaugauuagaaagugauggagcuggaccuagaauuuaguguucuuucaauaauaagcauugcugccaucuaucaaaggccugccuugugccaggcacugugcaaaauacaucaugucguuuaaucuccaacaacuuugcaaggaaguguaguuaucuccauuuuauaagugcgagacuaaagcucaggaaaaguuugcucgugagucuguauugcuacaaagcccucauucauuucucuaggcugcuuuacugucuguuggauaaaacucuuauaugacauaucccccaauauuuaccaaaauugucugaaggagucugggaaccaguugucuuuucccuaucaggaaggcucauccucugugaagacguccuagaccaagccuuguccuccuuuucccggcagguauuucccagccacuucacacagcagcggaccaaagaaacaaacugugagagugaucgggaaaggggcaauaaggccuguagcccaugcuccucacaguccuccagcaguggcauuugcacagacuucugggacuuauugguaaaacuggacaacaugaaugucagccggaaaggcaagaacuccgugaagucagugccagugagcgcuggcggugagggggaaaccucuccauacagccucgaggccucuccacuggggcagcucaugaacauguugucacacccagucauccgccggagcucucucuuaacugagaaacuccucagacuccuuucucucaucucaauugcucucccagaaaacaaggugucagaagcacaggcuaauucuggcagcggugcuuccuccaccaccacugccaccucaaccacaucuaccaccaccaccacugccgccuccaccacgcccacacccccuacugcacccaccccugucacuucugcuccagcccugguugcugccacggcuauuuccaccauugucguagcugcuucgaccacagugacuacccccacgacugcuaccacuacuguuucaaguaaguguggauguagacugggagcugugggguauauacuguggcacccacuucacccccuuuuccauccagauaguucucccucagugauagcaaucagcuugguuuguguuugugagaacagaauguguucauucucacccucaucugucccaguucucucacucugucucccuuccuccauccccgucucucugugucucucucuuucucucucuccccugccucucacacacacacucuuuugaaggucagcaggcauucacugaauguagcuucccuaggcuaggcaccagaaggaggaaagaaaguuaaguuccauccucagggaauucccagccuuuccaguuguguugagggagccaguucucaugggaaauaguucaagggcgggcaggauacagugugauucagaguaaccagaucaucccaggaaauaaagguaaugagcccugccacagauuaguaagaaagaauuaucugaagaaguagguuuuaaagaauagagugggccaugauggugggggaauaguuggaagaaaugccugggguuucuuuuucagcuuagaaguuacagucauaagaguccucuuugaguuuauggugagacgugauugugccacugcauucuagcuugggcaacagagcgagaccgugucuguaauaaaaaauaaaaagccuuuaucaucccaagucauuuagauuugccuuugguggguggguuuucuuuuucaguacuuucccauuuugaagcccugggcaauucagcgauuccuugauuuugucacuuagucccuggcuugugaguuucagagaggcuuacaguguucugucuguuuccucaaaguuucucccacuacuaagggcagcaaaucuccagcgaaggugagugaugggggcagcagcaguacagacuuuaagaugguguccucuggccucacugaaaaccagcuacagcucucuguagaggugaguccaagcucuucugaucugcuaagacuuggggagaaaggauaaacaggguagauaaugauuuuguucucaggcuggggcuuacuccuucugucuucuuuuucucagguguugacaucccacucuuguucugaggaaggcuuagaggaugcagccaacguacuacugcagcucucccggggggacucugggacccgggacacuguucucaagcugcuacugaauggagcccgccaucuggguuauacccuuuguaaacaaauagguaauagcagaaguaaagcauuuucucuuucugaagguuuccacuuaggugcuuccucuuucuggaauccuuuccugaauccccaagcugaaucagauaccuccauaucccuauaacacagccuccaugcucccucugucguaacacagauuacccuggguuaucaucuguuuuccucugcucaguuguuugaaagcaaggcuggguuugucuccucauccccgcugcccggcacacaguggugcuuaaugaagagaaaagagaacacaugggaacagcagcgccuccuuucuucuccaugcugggcacucguaagagccccauaagacagcugaggcagcuucaccccuucaaaguaugucccuacacugcauucagccucaggaauuacagagucagaauaguacucucugcuuuuguguaauuuugaggguauaaaaauucuaagaacaguuacaaauuaccucguuucuaucaucuuccucccuguuuuacugagaagaaagccaaaacccagggugauaaagugauuggaccaaggaguacagccagguuuucuuucaacauagagucugucuacccugucccacccucaucccaaucaugagucucccuagaucuuggcuacauacuuaguucucucucuccuucacccccaugucccuaagucuggggugauaggagaguugguuggccuguauaacucaggguguucuuugcugcaugaaaauuacaacguucuuccagaaagaauuuggccucugaccuuucucucuuggcugccaccaucuauuccacaccuaugggccaggcacugucuaggcacucuaccauauaauuaucucuuaauugucacagcaacguuaugagguuaggcaguaauauucccaucccaguauuaauauugguuagcaaauuggguaaggggucaagaaauuugccugaaaccaccacagaaccucaguaauuuugagagauauaugggauuucaaccauggucuguuuagcuccagaggagauacuguuucucuucuacaugaaacucauuucaugcagauucagcagaucccuguggccauagguaaauugguagucccaggugacgguucguggacacgcauaauaagcugaacagagcacgauuccagcucacucuagguucucugcagcugagcaaugaagaguggccuaagcaggugucuuagagagauuuggcuuuuagccacuuuaccaggggagucucugaacacuugcugacuccucugccugcucagguacccugcuggccgagcugcgggaauacaaccucgagcagcagcggcgagcccaaugugaaacccucucuccugauggccugccugaggagcagccacagaccaccaagcugaagggcaaaaugcagagcaggugggugguagccacccuuuggcugggggcuugaaucugggauauucuggaagauggcucuugcugguuuccuggucuuuuuuauuucucugggugauuuucguaucuuuccuauacacacuugacccauuuuuuucuacuuccuacuuggaagauuuccuucugaguuuccuuaccccucugguugacaccaggaagccuugcuugcuuuggguguuuauacuuugaugcugucaauauacgcaagccaccucuacacuauccagguuugacauggcugagaaugugguaauuguggcaucucagaagcgaccuuuggguggccgggagcuccagcugccuucuauguccauguugacauccaagacaucuacccagaaguucuucuugaggguacuacaggucaucauccagcuccgggacgacacgcgccgggcuaacaagaaagccaagcagacaggcaggcuagguauggaacuagaguguccaguugaggggaaggguugguggcgguaaagccagauuccuuggaggugcaggacuuaacggccugucuccuuccuguuugaccuuuccaaaaggaaaaugauuauccuuuuuucagaauguugauggcugcauucuacaucucauucaagcuaucugcguaggaaauucauuagggggagugggaauuaagggggaguggaaaucuggcagggaaguugggggccagccuuuugcugaacaagacuuaacucacuaggugcaucuccuuucugcuuccuuggucauuucuaacuaagccguggcuugacaaaucauuuucccuaccucuuuccuccugucccacagaacccucucgcacaaaaccauccgucugucuagcaucaugcccccugcccuuaucuguaaugguaaaucuuagcgccugaugaugagcacucugaagcuuccugagcuaaagcucaaaagaccucagcaagaugcccuguggcagcccaggagauaggagagagaauauugggcuuucccucuuccuauauuuuauaucuugccuuccucuuucucuuucucccagguuccuccgguuuaggcucagcuagcagcauccaggcagcuguucggcagcuggaggcugaggcugaugccauuauacaaaugguacgugagggucaaagggcgcggagacagcaacaagcagcaacgguuagcaugaugccuguggccccucauucauuugucucuccacucauccccccaccaugucaucagugggguuucauugccuuuaccuuguaugcuuuugcauuaaguuugcuauaugaaugcuucuggacaaaaggguuacuuucuguugguguuuuccuauuuguugauugguuuguugguuugauuugauuuaaagcuuggccaucauaccccacucccagcuauccagucaacaguggcgcuuuugcaaacugccugaugcuaaguguugucuggguucugagggguuauggggugaaguuuuuuuucagucccauggaacaaugcagguacaucagaaacaucucaggaauccuaccauugaaagucccccaagcuugguacauaucccacacagccacuucugucuguggcugcucccuccacccugcccucugccuuuauucuccauaaucccuuggcaccuaggcacucaggcacuuuuaggaggaaaccuucagguacuuaaguagccagcucaguguuggggucccggcauugaguggcugcaguaaaagccuggcaucacauguguaugcuguggcacucccucauuguuuuccuguccuugcaacauguaaguuaccuuuccaagauccaagaaagguauccuaagacccgauauuucuuugcguauaauuacuauuauacaguaugguuuuauugaguaggcagggaaaagccuugaacuuaggggcagugacuccaggaagguagaaagggaaaauaaagcuguuauucuggaguauuuuuucugccgagucucuuucccauuacacgaaaagaugucggcuuuuuaaauaaucccgcucaugagagguugcucuaauucuccuauuauuuccccuuuugugagcaaacagaaacaaagagcagaccuaccuuccacccaucugaauuuuuuauacacacacacacacacacacacacacacacacacacacacacacacaacagaagaagacuugaagucuauauacaggaggcuaguucugacuggucacaggucuggauuguagacuguaggaaauguaagcauccaaggagcuguugggaaaagcuuacaaaacacaguggagaaaagcagaagaguugggaaaggcauccuuuuguccuggauagcuacaguuuuccccacccaaauaugggaagcuucuuugcaagcucaauguaugagaaguggaagggccaaccucuagccugucucuaaggaaagcagaguugcacccuuaugugauuuuugucucccuuuuauccagucggagucuagccagucagaggcgucuguccggagggaggaaucacccauggauguggaccagccaucucccagugcucaagauacucaauccauuggucaguacuacuuccuguuuccagccgagcaaaagggauagccagucuucuggaaugucugcugaauccccugcucccagcauauauaagcccaguguuuucccauuuguuccaguaaacccugguuucuguaaaugaugacagguguuugacaaccaaggcacacuuuucuuuccuguaguaaaggaaagaaaauggugggauaucaugcauucagacagcauguuuuuaugggguuuucucuuguuguggugguuguuuuugagacagucucccucugucgccaggcuggaaugcaguggcacgaugucugcucacugcaaccucugccuccuggguucaagcaauucuccugucucagccucccaaguagcugggauuacaggcgcccaccaccacaccuggcuaguuuuuguauuuuuuuuaguagagacgaguuucgccauguuggccaggcuggucucaaacuccugaccucaggugauccaccugucuuggccucccagaguguuagaauuacaggcaugagccacugcgcccagcccagcauguguuuuaaaucuuuuguuuuauuauugaggcagggucuuucuccaucaccuaagcuaagauacaguaacauagucauagcucacugcaaccucaaacuucugagcucaaucgauccuccugccuuggcuaucugaguagcuggaacuguaagggacaggccaccaugcccagcuaauuuuuuuuaucuuuguagaaauggagucucacuauguugcccaggcuggucuugaacuccuggccucaagccauccucucacuucagucucccaugucuucuuucuuucuuuuuuguuuuuugacacagagucuagcucugucucccaggguggagugcaguggugcaaucucggcucacugcaaccuccgccuccuggauucaagugauucuccugccucagccucccaaguagcugggauuacaggcgccugccaccaugccuggcuaauuuuuuuuuuuguauuuuuaguagagacaggguuucgccacauuggccaggcugauuucaaacuccugaccucaagugauccaccugccucggccucccaaagugcugggauuacaggcaugagccacggccgaccagccuuagucucccguguuuuaaaucuuggcucccccauuuacugcuucugggaccugaggcaaaccucuuuguuagguuuccuuguuuaaaauaggaauguucaguuguuaggauuaaaugaguuaaaacauguauagugguuagagaagcacacgaugaaugcuauuguuagcagcauuucucaaagucagucauacauagaauacauuuuggcacccucauaacacauucccauggaauaguauucuuguaggacaaccauuguuauccuaccuuucaucaggauuuggggagauagauauuauuuucguguucuguauucaccuucuuuuaccuaaggucauaugauuugcaaguaccggagccaggauucaaaccuaaggcugucagaaccuugaagaauagucaggauuuggguaaaggaugaacagcaaaggucaggaagaaaccuaagcagggccagguguauggggaucagggguugaugagaaaacagucacuuacuccccacccagaagaugggguugugucuugcugcuuagcuacugagcagagguuagaauaagcccccagugaguaucaggaaaaguaccagccaugggauuccaucugucauaccauggcuucucaggguuuuaaacugccccaggacaagaugacuaauuuagaaggcauuagaaggccgggcgugguggcucacgccucuaaucccagcacuuugggaggccaaggcagguggaucacgaggucaggaguucaagaccagccugaccaacauggugaaaccaagucucuacuaaaaauacaaaaaucagccgggcaugguggcuugugccuguaauuccagcuacucaggaggcugaggcuggagaaucgcuugaacccaggaggcggagguugcagugagccaaggucgcaccacugcacugcagccugggcgacagaacgagacugucucagggaaaaaaaaaaaaaggcauuagacuuaagguuagaaagauuuaguuugauguccuggugcugucuuccucagaaaccaaaaugaggaaaagacagccuacuuuccaaggccagcugucagaauucaaugacaaaaguguccuaaaacauccuguguaaacuggaaggcaaccauccaaagcuccacuguuguuacauuacccugaaauaauccacagauucucuugaaacuagugaggcagugacuagacuagcacuaucuggaucugcaguagcaccuguggcuuuugagcaccuuaaauguggcuagcgcaacugaggaaccagauucauuauuuuauuuauucuguuuaauguaaaugccauccaaugcagguccuagaccuuguuucagauguugcucggugaguaccacucaguggccagugguccccucuacuuguucuguauauuaguuggugcguguggucuagaaagaucuaagcagaagggaaauuuugaagacuuucugacucucuucugugugcccuccagccuccgauggaaccccacagggggagaaggaaaaggaagaaagaccaccugaguuaccccugcucagcgagcagcugaguuuggacgagcugugggacaugcuuggggagugucuaaaggaacuagaggaaucccaugaccagcaugcggugcuaggugaguuguguccuaaaggcccaggucccaacccaguggucugcucuggggcccuuccugccagcuuguuuuucuuccuuccagguuacuccucucccucagugucucuguaaugagaauucaaaagagaaguguuuuuucucugacuucaguauaaaaaagauugaccuucucuuuuaauaguuggugucuuucacuuuauagacaaggggaaucuuuauaacugguuagcuaucccauuuuucuuuggcuucaaggaaguuccucugugacuugauucuaccauauuucccugcaaguucucauuguuucuuuuuuuuuuuuuuuuuuuuuuuuaaaucagaaaugaggucucacuauguugcccagacugaucucaaacugcugggcucaagcaauuuucccaccucggccucccaaagugcugggaucauaggugugagccaccacaccuagccuaguuuucacuauuucuucuuccuuauuuauuuuuauaauuuguuuaugauggcaaagagguuugcauguugaaguuugcagaguaaaauguuacuucuccaucauuccuaacccuagugcuacagccugcugucgaggccuucuuucugguccaugccacagagcgggagagcaagccuccuguccgagacacccgugagagccagcuggcacacaucaaggacgagccuccuccacucuccccugcccccuuaaccccagccacgccuuccucccuugacccauucuucucccgggagcccucaucuaugcacaucuccucaagccugcccccugacacacagaaguuccuucgcuuugcagguacagggaacuuuuaggcugccagguguagaaggcuucauuuuaaacaggauuguuucauacaguuaauccuuaguugaugagagagagagagagagagagagagagaguguguguguguguguguguguguguguacauacacacacccgugcacguaaacccugcaugguuucccuuggccucaggauacucagguuuagaauagaaaugcucagauucacguucacaccucaagggcuggcccuugguuuugacuaguccuuuuagagcccugaaauaaggaagaggaaggaagagagaguugcuagcugguuggcugucuuacagcuucuggggcagaugaugugcuuaauuccugcugucacuucuccccucagagacucaccgcacuguguuaaaccagauccuacggcaguccacgacccaccuugcugaugggccuuuugcuguccugguagacuacauucguguccucgacuuugaugucaagcgcaaguauguguccuggauauugggggguagagggguggugagaacuccccaaaugguaacucgccucugaaguuacucuugaggccacaaauuuccuuuggugacagcacuuggaauggugguggugaggagggaagagacagcuguagcauugauggccaucauaccuaaauacuccugggcuucuccaccccaucugcauuuuucaucagcaaaacagagucacaugauuuuugaaccacacaguuucuaaaguucuguuccauccguuggggguaguacaggaggcacagguggccauagaacacacacagcaggguuccaggggcuuccacaacacuccuggagucaucccuaugccucuccuucuccucgugcauguauacaugcuuaccugcuuguggcagaaaucacaugucacaaucuuugugggcccuuacucaguggagguaagaaaaauuuagaguugguaaugagugaucuaccucucccaacuacugggcauuucccaaacagguguggagcagagaucaaaguguuuggaggauagaaggagcaucauugugggucuucuuccuaaucacacaaacaaauuuguucugccacccuuaauccuaucuuccuuccuuuucuaccucccaagauauuuccgccaagagcuggagcguuuagaugaggggcuccggaaagaagacauggcugugcauguccgucgugaccauguguuugaagacuccuaucgugagcugcaucgcaaaucccccgaagaaaugaagaaucgauuguaagggcccaggaacggagaaaagauggcgggugggagguggggccuccugcacaguagcgauggcuugcucuagccucaaauuuagggaggugcugcccucccuaauaggaauuccccauaggaaucugguuuuagauaaucuuacugaguugucuccuaucuucugggccugcccugcuggcuggcccuuuagcuaagcuacccaacaauucccagacagacaggaaagucuuugguguuuauaaggauauaccugcuggcuuugcaaugagagcuuuaauauugcuauacuaggaaugaccauguaugaguggccuccaccaaacugguaacugcucacuggugauucugaagccaccuagaggagaucagcaguuuguaauacugagcguaggagcugaugagaugaaagaccuauuggaguuguuuaaugauuccuccccaucucuuguggugugggcucuccaacuguguaaucacaagaagucagggagucucccuagacagacuguaugccauguucuuccaccaccaaauaccuuuagagaauuuggacucugggcuuaucccucucuaauaccacuuuucuccccuccccacuucaccuaagcaaggccucauuuauuucucugauaccuuuccuauugguguuuucuggaauaucuguuaaccuugacuauuuugggacaucuccucugucaguggugcuuuuguuugcucccagaucuccaccccauuucugggcuguccuggcacucucuguuuaccucuucaucugacacugcacuccccagacacugcuucacagucucucacucacacaaaugacuggauguauccuggguuuucugcacagcucuuuucugcuucugcuuucuuaugcagguauauaguauuugaaggagaagaagggcaggaugcuggugggcuccugcgggagugguauaugaucaucucucgagagauguuuaacccuauguaugccuuguuccguaccucaccuggugaucgagucaccuacaccaucaauccaucuucccacugcaaccccaaccaccucagcuacuucaaguuugucggacgcauuguggccaaagcuguauaugacaaccgucuucuggagugcuacuuuacucgauccuuuuacaaacacaucuugggcaagucagucaggugaggaugaggcauaguccugggacugucuucaguccugggggucuggucuuuuugugucccauccuugugcuccuucuucccccccacucgcaaaccaugacccuguauaauuguguuuuucuagauauacagauauggagagugaagauuaccacuucuaccaaggucugguuuaucugcuggaaaaugaugucuccacacuaggcuaugaccucaccuucagcacugagguaggucaggaaauccuaaucacagcacaucccagccaaucuggaagauccauuccagguucaccuuagaacuagcacugcgugaccuucucauaguucuaaggaagcaucuugacuucuuaaagcuguagcagguguuugugagugacaucacaaacaggaaaaccagaauuugcaggccauuuccuaguuucaccuuuauuaaaaaaaaaaaaaaaaaaaaacuccaguacauaauuccucauucccaaggguaggucuuuguagaaaaaucguacaaauguaaguggggggaaaaugaaggcaguuaagguuacucuucuccuaaauucuuuuccuaagagauuacauuccguuacauauguuagccauucccuuuucccuuuuaccacugauaguugccuuacucucuucugccuuuuuuguaggucuuagagccaaagaguauuuuccucuuuccuacccaaagccuuucccuauaaggggaguugcgagcuaugaguaguagaaaaagucacuguuuuguauggacuugccucaucucucugccuaggacauggcaagggguuuaggguguguuccuagguaucuaaucccauccuagaugaagucugauauguaugauugguguuuugguuguucuagguccaagaguuuggaguuugugaaguucgugaccucaaacccaauggggccaacaucuugguaacagaggagaauaagaaggaguauguacaccugguaugccagaugagaaugacagguaggggaaauguuccuagaccucuaguugcucaauaugagaagaggucggacuugauucauuugauaggcauguuuuguuuuccucugcuaugacagagccacaaaugccuugcacaaaagacaaaacacuugaucaaaaauacuuaacuuugggcacgguggcucacaccuauaaucccagcacuuugggaggccaaggugggcggaucaguugaggugaggaguuugagaccagccuggccaacauggugaaaccccgucucuacuaaaauaaaaaauuagccaaguguggcagcgugcgccuguagucccagcuacucgggagacugagacagaagaauugcuugaacccgggagguggaguuugcagugagcugagaucgcaccacucuucuccagccugggcaacagagugagacuccaucucaaaaaaaaaaaacaaacccagcuuaacuucacuggacacaguggcucacauuuguaauccuagcacuuugggaggcugaggcaggaggauagcuugagcccaggggguugagacuagccugggcagaauuaaccaguugugguggugcaugccuguagucccagcuaacagugguagaugggagccagaugggggaucucugaccucuacgguugugugaguuuagaagucauuuggcuuuuugguuaucucaccaggagccauccgcaagcaguuggcggcuuucuuagaaggcuucuaugagaucauuccaaagcgccucauuuccaucuucacugagcaggaguuagagcugcuuauaucaggacugcccaccauugacaucgaugaucugaaauccaacacugaauaccacaaguaccaguccaacucuauucaggugagcugcugcuggcaucccuccucauaugguccucuuacccuaggcaacgcuaguuugugugauaccaaauaaaccaguaguacucuuagaggaaguugcauguagaagacagucuaccuauaucuaacucuuuguucuccugaagcauagcagacuucucuuggccgucuuaugaaugaaaggagcuaaagcucaucccacagaagggacuugccucagauaccaaguccaguccuguuuccuagauuccaucccccccacccugcuucuaggagcuuucuaccuaacacuggcuucaugggucccuuccuacagauccagugguucuggagagcauugcguucuuucgaucaagcugaccgugccaaguuccuccaguuugucacggguacuuccaagguaccccugcaaggcuuugcugcccucgaaggcaugaauggcauucagaaguuucagauccaucgagaugacagguccacagaucgccugccuucagcucacacaugguaaaaggaaggguuuguuucuccuuuucagugcuuagguugagcuugcauacuugauguuuucaggacccuacccaagauugggaacacaaauguggcugaguccuggaccuuggguaacucacaauuugguguuucuauggaggugauguuugagaugagaugugcuagacacagugggggcuggggagacacugucagguaaacagcaccacaagagagcaugguguauuccagggccagcgugacuggagcaaggaggaguugcagggagcaaaagucuaaagagcucagcagagguccgauuaccagugacucugaaaaccaccuucaaguuugcacuuuagccuaugggcgagugaggccaggguguuuaaggaggagugacagggucagauuuuugguuuuggugccugauggccaguuugggagccagauaaagggggacauacugggcugagacaagauugggagucaucaagaagcagggaguugguuucuucagggaggggaggggcuggugggcaccaugggaacacacagauuugguuaucugucaucccucaccacaaacugaucuuucuucuuuccuuaguuuuaaucagcuggaucugccugccuaugagagcuuugagaagcuccgccacaugcuacuguuggcuauccaggagugcucugaaggcuuugggcuggccuaauaaggcccugcccaacuccgugggguuuuuuuuaccauuguuggaccuggggaggggggaguuaaaaaaagaaccagaaagaaauugucaaaaaccaauaaaugaaauccaccaacucaccgugugugucccagcugccccaucuuccccagcgcauaccuguuccucuucucauucucuccccgccgccuguuuccucaccuucucuccccuuuccaugccguccaugauccccaccccauguguuuuaaaaaggcaguagccuuugcagggaccugucugucccaacuguuugaacagugugcuccucagauucuguguucagaaggauuugcugcauugagacuugaaaccuuuggauaggggaaaaaauuauauauauauauauuuuuuuguucuguuugcauuucuuaauuugugcuuggaauguguugaugugcacagcuaaugauucaaugcgagacaagauuggcgucuguguuguggagguuucaaauaaagagcacucuucauaacucacuuuucacaauggaguuuuuuucaaacuuaaaaaaaaaaacaaaaaacucuuaagcacaugcuaggcaucuggagaaaagauggauucuccaggaaaccaucccugcccuacccgcuugcccaccugccuccaccacuggugcaacuuccuccuucagagucaguuucugcagucaggagagaugagcaguucaccaggaauugggggugggggcaucuguuuuuuuuuuuuagaaugggagcugcacuuggggauggugaugguguuagagauugcagcccaggacaaagcaucaccuugcucaaggggaacaaacugcagcagguuguacaaaacauucagagagcucacuugacccaaccgaggguuuuacuuggugagccuuucuaguagucuugagucuggggcucaguuuuagauuuuuauuucauuaauguuuguuuauuucuaauaaauuuuaauaagcgaguaauuuaacuaggucgccagaagaccauuauuuuuguuugucuauuuuuguugucgucacucccucucucgucaucugucugccagucuguucacagaucaccuuguagucccuugugguuuuuacuccauccagugcuuaaagcugaucuaaggacuucgaugguuccagccuucaaagaaaaaauaauuuaauaaaaauuuaguuagaaaaaauaacc

SEQ ID NO: 19199 - RNA, 154636 nt, Homo sapiens
gguuauuuuuucuaacuaaauuuuuauuaaauuauuuuuucuuugaaggcuggaaccaucgaaguccuuagaucagcuuuaagcacuggauggaguaaaaaccacaagggacuacaaggugaucugugaacagacuggcagacagaugacgagagagggagugacgacaacaaaaauagacaaacaaaaauaauggucuucuggcgaccuaguuaaauuacucgcuuauuaaaauuuauuagaaauaaacaaacauuaaugaaauaaaaaucuaaaacugagccccagacucaagacuacuagaaaggcucaccaaguaaaacccucgguugggucaagugagcucucugaauguuuuguacaaccugcugcaguuuguuccccuugagcaaggugaugcuuuguccugggcugcaaucucuaacaccaucaccauccccaagugcagcucccauucuaaaaaaaaaaaacagaugcccccacccccaauuccuggugaacugcucaucucuccugacugcagaaacugacucugaaggaggaaguugcaccagugguggaggcaggugggcaagcggguagggcagggaugguuuccuggagaauccaucuuuucuccagaugccuagcaugugcuuaagaguuuuuuguuuuuuuuuuuaaguuugaaaaaaacuccauugugaaaagugaguuaugaagagugcucuuuauuugaaaccuccacaacacagacgccaaucuugucucgcauugaaucauuagcugugcacaucaacacauuccaagcacaaauuaagaaaugcaaacagaacaaaaaaauauauauauauauaauuuuuuccccuauccaaagguuucaagucucaaugcagcaaauccuucugaacacagaaucugaggagcacacuguucaaacaguugggacagacaggucccugcaaaggcuacugccuuuuuaaaacacaugggguggggaucauggacggcauggaaaggggagagaaggugaggaaacaggcggcggggagagaaugagaagaggaacagguaugcgcuggggaagauggggcagcugggacacacacggugaguugguggauuucauuuauugguuuuugacaauuucuuucugguucuuuuuuuaacuccccccuccccagguccaacaaugguaaaaaaaaccccacggaguugggcagggccuuauuaggccagcccaaagccuucagagcacuccuggauagccaacaguagcauguggcggagcuucucaaagcucucauaggcaggcagauccagcugauuaaaacuaaggaaagaagaaagaucaguuuguggugagggaugacagauaaccaaaucuguguguucccauggugcccaccagccccuccccucccugaagaaaccaacucccugcuucuugaugacucccaaucuugucucagcccaguaugucccccuuuaucuggcucccaaacuggccaucaggcaccaaaaccaaaaaucugacccugucacuccuccuuaaacacccuggccucacucgcccauaggcuaaagugcaaacuugaaggugguuuucagagucacugguaaucggaccucugcugagcucuuuagacuuuugcucccugcaacuccuccuugcuccagucacgcuggcccuggaauacaccaugcucucuuguggugcuguuuaccugacagugucuccccagcccccacugugucuagcacaucucaucucaaacaucaccuccauagaaacaccaaauugugaguuacccaagguccaggacucagccacauuuguguucccaaucuuggguaggguccugaaaacaucaaguaugcaagcucaaccuaagcacugaaaaggagaaacaaacccuuccuuuuaccaugugugagcugaaggcaggcgaucuguggaccugucaucucgauggaucugaaacuucugaaugccauucaugccuucgagggcagcaaagccuugcagggguaccuuggaaguacccgugacaaacuggaggaacuuggcacggucagcuugaucgaaagaacgcaaugcucuccagaaccacuggaucuguaggaagggacccaugaagccaguguuagguagaaagcuccuagaagcagggugggggggauggaaucuaggaaacaggacuggacuugguaucugaggcaagucccuucugugggaugagcuuuagcuccuuucauucauaagacggccaagagaagucugcuaugcuucaggagaacaaagaguuagauauagguagacugucuucuacaugcaacuuccucuaagaguacuacugguuuauuugguaucacacaaacuagcguugccuaggguaagaggaccauaugaggagggaugccagcagcagcucaccugaauagaguuggacugguacuugugguauucaguguuggauuucagaucaucgaugucaauggugggcaguccugauauaagcagcucuaacuccugcucagugaagauggaaaugaggcgcuuuggaaugaucucauagaagccuucuaagaaagccgccaacugcuugcggauggcuccuggugagauaaccaaaaagccaaaugacuucuaaacucacacaaccguagaggucagagaucccccaucuggcucccaucuaccacuguuagcugggacuacaggcaugcaccaccacaacugguuaauucugcccaggcuagucucaacccccugggcucaagcuauccuccugccucagccucccaaagugcuaggauuacaaaugugagccacuguguccagugaaguuaagcuggguuuguuuuuuuuuuuugagauggagucucacucuguugcccaggcuggagaagaguggugcgaucucagcucacugcaaacuccaccucccggguucaagcaauucuucugucucagucucccgaguagcugggacuacaggcgcacgcugccacacuuggcuaauuuuuuauuuuaguagagacgggguuucaccauguuggccaggcuggucucaaacuccucaccucaacugauccgcccaccuuggccucccaaagugcugggauuauaggugugagccaccgugcccaaaguuaaguauuuuugaucaaguguuuugucuuuugugcaaggcauuuguggcucugucauagcagaggaaaacaaaacaugccuaucaaaugaaucaaguccgaccucuucucauauugagcaacuagaggucuaggaacauuuccccuaccugucauucucaucuggcauaccagguguacauacuccuucuuauucuccucuguuaccaagauguuggccccauuggguuugaggucacgaacuucacaaacuccaaacucuuggaccuagaacaaccaaaacaccaaucauacauaucagacuucaucuaggaugggauuagauaccuaggaacacacccuaaaccccuugccauguccuaggcagagagaugaggcaaguccauacaaaacagugacuuuuucuacuacucauagcucgcaacuccccuuauagggaaaggcuuuggguaggaaagaggaaaauacucuuuggcucuaagaccuacaaaaaaggcagaagagaguaaggcaacuaucagugguaaaagggaaaagggaauggcuaacauauguaacggaauguaaucucuuaggaaaagaauuuaggagaagaguaaccuuaacugccuucauuuuccccccacuuacauuuguacgauuuuucuacaaagaccuacccuugggaaugaggaauuauguacuggaguuuuuuuuuuuuuuuuuuuuuaauaaaggugaaacuaggaaauggccugcaaauucugguuuuccuguuugugaugucacucacaaacaccugcuacagcuuuaagaagucaagaugcuuccuuagaacuaugagaaggucacgcagugcuaguucuaaggugaaccuggaauggaucuuccagauuggcugggaugugcugugauuaggauuuccugaccuaccucagugcugaaggugaggucauagccuaguguggagacaucauuuuccagcagauaaaccagaccuugguagaagugguaaucuucacucuccauaucuguauaucuagaaaaacacaauuauacagggucaugguuugcgagugggggggaagaaggagcacaaggaugggacacaaaaagaccagacccccaggacugaagacagucccaggacuaugccucauccucaccugacugacuugcccaagauguguuuguaaaaggaucgaguaaaguagcacuccagaagacgguugucauauacagcuuuggccacaaugcguccgacaaacuugaaguagcugaggugguugggguugcagugggaagauggauugaugguguaggugacucgaucaccaggugagguacggaacaaggcauacauaggguuaaacaucucucgagagaugaucauauaccacucccgcaggagcccaccagcauccugcccuucuucuccuucaaauacuauauaccugcauaagaaagcagaagcagaaaagagcugugcagaaaacccaggauacauccagucauuugugugagugagagacugugaagcagugucuggggagugcagugucagaugaagagguaaacagagagugccaggacagcccagaaaugggguggagaucugggagcaaacaaaagcaccacugacagaggagaugucccaaaauagucaagguuaacagauauuccagaaaacaccaauaggaaagguaucagagaaauaaaugaggccuugcuuaggugaaguggggaggggagaaaagugguauuagagagggauaagcccagaguccaaauucucuaaagguauuuggugguggaagaacauggcauacagucugucuagggagacucccugacuucuugugauuacacaguuggagagcccacaccacaagagauggggaggaaucauuaaacaacuccaauaggucuuucaucucaucagcuccuacgcucaguauuacaaacugcugaucuccucuagguggcuucagaaucaccagugagcaguuaccaguuugguggaggccacucauacauggucauuccuaguauagcaauauuaaagcucucauugcaaagccagcagguauauccuuauaaacaccaaagacuuuccugucugucugggaauuguuggguagcuuagcuaaagggccagccagcagggcaggcccagaagauaggagacaacucaguaagauuaucuaaaaccagauuccuauggggaauuccuauuagggagggcagcaccucccuaaauuugaggcuagagcaagccaucgcuacugugcaggaggccccaccucccacccgccaucuuuucuccguuccugggcccuuacaaucgauucuucauuucuucgggggauuugcgaugcagcucacgauaggagucuucaaacacauggucacgacggacaugcacagccaugucuucuuuccggagccccucaucuaaacgcuccagcucuuggcggaaauaucuugggagguagaaaaggaaggaagauaggauuaaggguggcagaacaaauuuguuugugugauuaggaagaagacccacaaugaugcuccuucuauccuccaaacacuuugaucucugcuccacaccuguuugggaaaugcccaguaguugggagagguagaucacucauuaccaacucuaaauuuuucuuaccuccacugaguaagggcccacaaagauugugacaugugauuucugccacaagcagguaagcauguauacaugcacgaggagaaggagaggcauagggaugacuccaggaguguuguggaagccccuggaacccugcuguguguguucuauggccaccugugccuccuguacuacccccaacggauggaacagaacuuuagaaacugugugguucaaaaaucaugugacucuguuuugcugaugaaaaaugcagaugggguggagaagcccaggaguauuuagguaugauggccaucaaugcuacagcugucucuucccuccucaccaccaccauuccaagugcugucaccaaaggaaauuuguggccucaagaguaacuucagaggcgaguuaccauuuggggaguucucaccaccccucuaccccccaauauccaggacacauacuugcgcuugacaucaaagucgaggacacgaauguagucuaccaggacagcaaaaggcccaucagcaaggugggucguggacugccguaggaucugguuuaacacagugcggugagucucugaggggagaagugacagcaggaauuaagcacaucaucugccccagaagcuguaagacagccaaccagcuagcaacucucucuuccuuccucuuccuuauuucagggcucuaaaaggacuagucaaaaccaagggccagcccuugaggugugaacgugaaucugagcauuucuauucuaaaccugaguauccugaggccaagggaaaccaugcaggguuuacgugcacggguguguguauguacacacacacacacacacacacacacacucucucucucucucucucucucucucucaucaacuaaggauuaacuguaugaaacaauccuguuuaaaaugaagccuucuacaccuggcagccuaaaaguucccuguaccugcaaagcgaaggaacuucugugugucagggggcaggcuugaggagaugugcauagaugagggcucccgggagaagaaugggucaagggaggaaggcguggcugggguuaagggggcaggggagaguggaggaggcucguccuugaugugugccagcuggcucucacgggugucucggacaggaggcuugcucucccgcucuguggcauggaccagaaagaaggccucgacagcaggcuguagcacuaggguuaggaaugauggagaaguaacauuuuacucugcaaacuucaacaugcaaaccucuuugccaucauaaacaaauuauaaaaauaaauaaggaagaagaaauagugaaaacuaggcuaggugugguggcucacaccuaugaucccagcacuuugggaggccgaggugggaaaauugcuugagcccagcaguuugagaucagucugggcaacauagugagaccucauuucugauuuaaaaaaaaaaaaaaaaaaaaaaaagaaacaaugagaacuugcagggaaauaugguagaaucaagucacagaggaacuuccuugaagccaaagaaaaaugggauagcuaaccaguuauaaagauuccccuugucuauaaagugaaagacaccaacuauuaaaagagaaggucaaucuuuuuuauacugaagucagagaaaaaacacuucucuuuugaauucucauuacagagacacugagggagaggaguaaccuggaaggaagaaaaacaagcuggcaggaagggccccagagcagaccacuggguugggaccugggccuuuaggacacaacucaccuagcaccgcaugcuggucaugggauuccucuaguuccuuuagacacuccccaagcaugucccacagcucguccaaacucagcugcucgcugagcagggguaacucagguggucuuucuuccuuuuccuucucccccugugggguuccaucggaggcuggagggcacacagaagagagucagaaagucuucaaaauuucccuucugcuuagaucuuucuagaccacacgcaccaacuaauauacagaacaaguagaggggaccacuggccacugagugguacucaccgagcaacaucugaaacaaggucuaggaccugcauuggauggcauuuacauuaaacagaauaaauaaaauaaugaaucugguuccucaguugcgcuagccacauuuaaggugcucaaaagccacaggugcuacugcagauccagauagugcuagucuagucacugccucacuaguuucaagagaaucuguggauuauuucaggguaauguaacaacaguggagcuuuggaugguugccuuccaguuuacacaggauguuuuaggacacuuuugucauugaauucugacagcuggccuuggaaaguaggcugucuuuuccucauuuugguuucugaggaagacagcaccaggacaucaaacuaaaucuuucuaaccuuaagucuaaugccuuuuuuuuuuuuucccugagacagucucguucugucgcccaggcugcagugcaguggugcgaccuuggcucacugcaaccuccgccuccuggguucaagcgauucuccagccucagccuccugaguagcuggaauuacaggcacaagccaccaugcccggcugauuuuuguauuuuuaguagagacuugguuucaccauguuggucaggcuggucuugaacuccugaccucgugauccaccugccuuggccucccaaagugcugggauuagaggcgugagccaccacgcccggccuucuaaugccuucuaaauuagucaucuuguccuggggcaguuuaaaacccugagaagccaugguaugacagauggaaucccauggcugguacuuuuccugauacucacugggggcuuauucuaaccucugcucaguagcuaagcagcaagacacaaccccaucuucuggguggggaguaagugacuguuuucucaucaaccccugauccccauacaccuggcccugcuuagguuucuuccugaccuuugcuguucauccuuuacccaaauccugacuauucuucaagguucugacagccuuagguuugaauccuggcuccgguacuugcaaaucauaugaccuuagguaaaagaaggugaauacagaacacgaaaauaauaucuaucuccccaaauccugaugaaagguaggauaacaaugguuguccuacaagaauacuauuccaugggaauguguuaugagggugccaaaauguauucuauguaugacugacuuugagaaaugcugcuaacaauagcauucaucgugugcuucucuaaccacuauacauguuuuaacucauuuaauccuaacaacugaacauuccuauuuuaaacaaggaaaccuaacaaagagguuugccucaggucccagaagcaguaaaugggggagccaagauuuaaaacacgggagacuaaggcuggucggccguggcucaugccuguaaucccagcacuuugggaggccgaggcagguggaucacuugaggucaggaguuugaaaucagccuggccaauguggcgaaacccugucucuacuaaaaauacaaaaaaaaaaauuagccaggcaugguggcaggcgccuguaaucccagcuacuugggaggcugaggcaggagaaucacuugaauccaggaggcggagguugcagugagccgagauugcaccacugcacuccacccugggagacagagcuagacucugugucaaaaaacaaaaaagaaagaaagaagacaugggagacugaagugagaggauggcuugaggccaggaguucaagaccagccugggcaacauagugagacuccauuucuacaaagauaaaaaaaauuagcugggcaugguggccugucccuuacaguuccagcuacucagauagccaaggcaggaggaucgauugagcucagaaguuugagguugcagugagcuaugacuauguuacuguaucuuagcuuaggugauggagaaagacccugccucaauaauaaaacaaaagauuuaaaacacaugcugggcugggcgcaguggcucaugccuguaauucuaacacucugggaggccaagacagguggaucaccugaggucaggaguuugagaccagccuggccaacauggcgaaacucgucucuacuaaaaaaaauacaaaaacuagccaggugugguggugggcgccuguaaucccagcuacuugggaggcugagacaggagaauugcuugaacccaggaggcagagguugcagugagcagacaucgugccacugcauuccagccuggcgacagagggagacugucucaaaaacaaccaccacaacaagagaaaaccccauaaaaacaugcugucugaaugcaugauaucccaccauuuucuuuccuuuacuacaggaaagaaaagugugccuugguugucaaacaccugucaucauuuacagaaaccaggguuuacuggaacaaaugggaaaacacugggcuuauauaugcugggagcaggggauucagcagacauuccagaagacuggcuaucccuuuugcucggcuggaaacaggaaguaguacugaccaauggauugaguaucuugagcacugggagauggcugguccacauccaugggugauuccucccuccggacagacgccucugacuggcuagacuccgacuggauaaaagggagacaaaaaucacauaagggugcaacucugcuuuccuuagagacaggcuagagguuggcccuuccacuucucauacauugagcuugcaaagaagcuucccauauuuggguggggaaaacuguagcuauccaggacaaaaggaugccuuucccaacucuucugcuuuucuccacuguguuuuguaagcuuuucccaacagcuccuuggaugcuuacauuuccuacagucuacaauccagaccugugaccagucagaacuagccuccuguauauagacuucaagucuucuucuguuguguguguguguguguguguguguguguguguguguguguguguguauaaaaaauucagauggguggaagguaggucugcucuuuguuucuguuugcucacaaaaggggaaauaauaggagaauuagagcaaccucucaugagcgggauuauuuaaaaagccgacaucuuuucguguaaugggaaagagacucggcagaaaaaauacuccagaauaacagcuuuauuuucccuuucuaccuuccuggagucacugccccuaaguucaaggcuuuucccugccuacucaauaaaaccauacuguauaauaguaauuauacgcaaagaaauaucgggucuuaggauaccuuucuuggaucuuggaaagguaacuuacauguugcaaggacaggaaaacaaugagggagugccacagcauacacaugugaugccaggcuuuuacugcagccacucaaugccgggaccccaacacugagcuggcuacuuaaguaccugaagguuuccuccuaaaagugccugagugccuaggugccaagggauuauggagaauaaaggcagagggcaggguggagggagcagccacagacagaaguggcugugugggauauguaccaagcuugggggacuuucaaugguaggauuccugagauguuucugauguaccugcauuguuccaugggacugaaaaaaaacuucaccccauaaccccucagaacccagacaacacuuagcaucaggcaguuugcaaaagcgccacuguugacuggauagcugggagugggguaugauggccaagcuuuaaaucaaaucaaaccaacaaaccaaucaacaaauaggaaaacaccaacagaaaguaacccuuuuguccagaagcauucauauagcaaacuuaaugcaaaagcauacaagguaaaggcaaugaaaccccacugaugacaugguggggggaugaguggagagacaaaugaaugaggggccacaggcaucaugcuaaccguugcugcuuguugcugucuccgcgcccuuugacccucacguaccauuuguauaauggcaucagccucagccuccagcugccgaacagcugccuggaugcugcuagcugagccuaaaccggaggaaccugggagaaagagaaagaggaaggcaagauauaaaauauaggaagagggaaagcccaauauucucucuccuaucuccugggcugccacagggcaucuugcugaggucuuuugagcuuuagcucaggaagcuucagagugcucaucaucaggcgcuaagauuuaccauuacagauaagggcagggggcaugaugcuagacagacggaugguuuugugcgagaggguucugugggacaggaggaaagagguagggaaaaugauuugucaagccacggcuuaguuagaaaugaccaaggaagcagaaaggagaugcaccuagugaguuaagucuuguucagcaaaaggcuggcccccaacuucccugccagauuuccacucccccuuaauucccacucccccuaaugaauuuccuacgcagauagcuugaaugagauguagaaugcagccaucaacauucugaaaaaaggauaaucauuuuccuuuuggaaaggucaaacaggaaggagacaggccguuaaguccugcaccuccaaggaaucuggcuuuaccgccaccaacccuuccccucaacuggacacucuaguuccauaccuagccugccugucugcuuggcuuucuuguuagcccggcgcgugucgucccggagcuggaugaugaccuguaguacccucaagaagaacuucuggguagaugucuuggaugucaacauggacauagaaggcagcuggagcucccggccacccaaaggucgcuucugagaugccacaauuaccacauucucagccaugucaaaccuggauaguguagagguggcuugcguauauugacagcaucaaaguauaaacacccaaagcaagcaaggcuuccuggugucaaccagagggguaaggaaacucagaaggaaaucuuccaaguaggaaguagaaaaaaaugggucaaguguguauaggaaagauacgaaaaucacccagagaaauaaaaaagaccaggaaaccagcaagagccaucuuccagaauaucccagauucaagcccccagccaaaggguggcuaccacccaccugcucugcauuuugcccuucagcuugguggucuguggcugcuccucaggcaggccaucaggagagaggguuucacauugggcucgccgcugcugcucgagguuguauucccgcagcucggccagcaggguaccugagcaggcagaggagucagcaaguguucagagacuccccugguaaaguggcuaaaagccaaaucucucuaagacaccugcuuaggccacucuucauugcucagcugcagagaaccuagagugagcuggaaucgugcucuguucagcuuauuaugcguguccacgaaccgucaccugggacuaccaauuuaccuauggccacagggaucugcugaaucugcaugaaaugaguuucauguagaagagaaacaguaucuccucuggagcuaaacagaccaugguugaaaucccauauaucucucaaaauuacugagguucuguggugguuucaggcaaauuucuugaccccuuacccaauuugcuaaccaauauuaauacugggaugggaauauuacugccuaaccucauaacguugcugugacaauuaagagauaauuauaugguagagugccuagacagugccuggcccauagguguggaauagaugguggcagccaagagagaaaggucagaggccaaauucuuucuggaagaacguuguaauuuucaugcagcaaagaacacccugaguuauacaggccaaccaacucuccuaucaccccagacuuagggacaugggggugaaggagagagagaacuaaguauguagccaagaucuagggagacucaugauugggaugagggugggacaggguagacagacucuauguugaaagaaaaccuggcuguacuccuugguccaaucacuuuaucacccuggguuuuggcuuucuucucaguaaaacagggaggaagaugauagaaacgagguaauuuguaacuguucuuagaauuuuuauacccucaaaauuacacaaaagcagagaguacuauucugacucuguaauuccugaggcugaaugcaguguagggacauacuuugaaggggugaagcugccucagcugucuuauggggcucuuacgagugcccagcauggagaagaaaggaggcgcugcuguucccauguguucucuuuucucuucauuaagcaccacugugugccgggcagcggggaugaggagacaaacccagccuugcuuucaaacaacugagcagaggaaaacagaugauaacccaggguaaucuguguuacgacagagggagcauggaggcuguguuauagggauauggagguaucugauucagcuuggggauucaggaaaggauuccagaaagaggaagcaccuaaguggaaaccuucagaaagagaaaaugcuuuacuucugcuauuaccuauuuguuuacaaaggguauaacccagauggcgggcuccauucaguagcagcuugagaacagugucccgggucccagaguccccccgggagagcugcaguaguacguuggcugcauccucuaagccuuccucagaacaagagugggaugucaacaccugagaaaaagaagacagaaggaguaagccccagccugagaacaaaaucauuaucuacccuguuuauccuuucuccccaagucuuagcagaucagaagagcuuggacucaccucuacagagagcuguagcugguuuucagugaggccagaggacaccaucuuaaagucuguacugcugcugcccccaucacucaccuucgcuggagauuugcugcccuuaguagugggagaaacuuugaggaaacagacagaacacuguaagccucucugaaacucacaagccagggacuaagugacaaaaucaaggaaucgcugaauugcccagggcuucaaaaugggaaaguacugaaaaagaaaacccacccaccaaaggcaaaucuaaaugacuugggaugauaaaggcuuuuuauuuuuuauuacagacacggucucgcucuguugcccaagcuagaaugcaguggcacaaucacgucucaccauaaacucaaagaggacucuuaugacuguaacuucuaagcugaaaaagaaaccccaggcauuucuuccaacuauucccccaccaucauggcccacucuauucuuuaaaaccuacuucuucagauaauucuuucuuacuaaucuguggcagggcucauuaccuuuauuuccugggaugaucugguuacucugaaucacacuguauccugcccgcccuugaacuauuucccaugagaacuggcucccucaacacaacuggaaaggcugggaauucccugaggauggaacuuaacuuucuuuccuccuucuggugccuagccuagggaagcuacauucagugaaugccugcugaccuucaaaagagugugugugugagaggcaggggagagagagaaagagagagacacagagagacggggauggaggaagggagacagagugagagaacugggacagaugagggugagaaugaacacauucuguucucacaaacacaaaccaagcugauugcuaucacugagggagaacuaucuggauggaaaagggggugaagugggugccacaguauauaccccacagcucccagucuacauccacacuuacuugaaacaguagugguagcagucguggggguagucacuguggucgaagcagcuacgacaaugguggaaauagccguggcagcaaccagggcuggagcagaagugacaggggugggugcaguagggggugugggcgugguggaggcggcaguggugguggugguagaugugguugagguggcaguggugguggaggaagcaccgcugccagaauuagccugugcuucugacaccuuguuuucugggagagcaauugagaugagagaaaggagucugaggaguuucucaguuaagagagagcuccggcggaugacugggugugacaacauguucaugagcugccccaguggagaggccucgaggcuguauggagagguuucccccucaccgccagcgcucacuggcacugacuucacggaguucuugccuuuccggcugacauucauguuguccaguuuuaccaauaagucccagaagucugugcaaaugccacugcuggaggacugugaggagcaugggcuacaggccuuauugccccuuucccgaucacucucacaguuuguuucuuugguccgcugcugugugaaguggcugggaaauaccugccgggaaaaggaggacaaggcuuggucuaggacgucuucacagaggaugagccuuccugauagggaaaagacaacugguucccagacuccuucagacaauuuugguaaauauugggggauaugucauauaagaguuuuauccaacagacaguaaagcagccuagagaaaugaaugagggcuuuguagcaauacagacucacgagcaaacuuuuccugagcuuuagucucgcacuuauaaaauggagauaacuacacuuccuugcaaaguuguuggagauuaaacgacaugauguauuuugcacagugccuggcacaaggcaggccuuugauagauggcagcaaugcuuauuauugaaagaacacuaaauucuagguccagcuccaucacuuucuaaucauaagacaaaaugaauaaaauguucugaaucucagguucuucaucuguaaaacaggaaucauacagcccaguuguuuugaugacuaaauaagacauacauaaaaauggaaaagaaugaagaaaaaaccccagaaauauauaggacaauccccuagaaacaauacagggcucaacacuuaaaauaagagcaaaaagacacgcuagccugcuuaguguucaacuuucacccaggcucuugcugccacccuucuuccauccccaggaguuggguuugaaacccucaccuuggccaauugaaugaguguauccaaaacgugucugcagacaacaggagcagcuuggggauggauguggacgguggagccaccgcuugcaugcuucucgguauguuuacgccccccugaacgcuggaucugaaauauauuaguccugcagccuagggcugcauccauggauacugagagccaggaaagcugguuggagcucuuugacuccaucuuguguagcagguccaggggacgguucucauggcuacuugacccacagcucuugcucgacuuuuugcccuuuuccucacuuguagugaguuuggguguuucaaugcauagcucacucucacugcugcgcugcaagauggagagcagacugcggaugacccaguggcgggucugggcaugguagcagagauuucucaguacucgguguagacggcuaguauugagcuuuggcucauccacaaaaaguaggaccaagagacaagaaagggcuucgugguccagaaggagccguccucggaggcggaggagaguaucuacauuacugccagaaggccuggaaacagaacaugguuuuuggguaacacuucaguggcuagagcucugggauuaggcauaagaaugggggaggggaaugagcuagguaucuccaaggaggcuugagaaagguggguguccaguccaagggcucuucauaguaacagcugcccucuuaggugucuacuauguaccaggcacuuuacaaugacuguacaucauccuuucagggcugcuguacagcuuagagaaugaagccccccacccccaccagcuuuuuguugagauggagucucgcucugucacccaggcuggagugcaguggcgugauaccggcucacugcaaccuccacccccuaggauucaagugauucucgugccucagccucccgaguagcugggauuacuagugcgcgccaccacacccgacuacuuuuuguauuuuuaguagagauuggguuugccauguugccuaggcuggucuugaacuccuggacucaagugauccaccugccucagccucccaaagugcugggauuauaggugugagccacgacaacuggccgagaaccacccauuuuugagaugauaaacaagaggcucaaacagguuaagugacuugcccuacaucacacggcgacugagaagacagcagagauuccagcccagguaucauccaucgacugguaaaaucugaccauaccuaagucuaggagacaaugcuaguuucugccuucucuagacuaccaggaguuuguggccuuguaggaaccaaucacuccuuucacauuuuggcaugucaggcccacucuguuuuagccuggcuaacucacuccucuauacuuccuuagccuagguguuacaaacucaaggcaggugguuaguuguuuuacuacuugcaugggagacaagugguguuccuucuuguuaaaaccauaguuagcaccugcugccggccugcuuuugcgauuguggucuuugguagcaagacuaaccaaaagguguaguuuucugaauggggaguccaaagaucuggcucucucacuuauucaaggaaauggcuuagagagaccauccauccugccugucaggauuucagcuucuccaccuauaaaacuaagggagcugggcuaauagacuugaguggugauaugguaagguaaaaauagacaaagguaccuguuauggcugcugcuaccccccaucuggaaggugccaccucucugcacagcaaggcgaguauacuggaccccacgguugccacuuaagcgacuggugaaagcuggaaggaaagaaaaagaaaacugagauuguggagaggguguaaacuggauauagguaauacaaagguaagaaaacauagccucaucuggcuaaagcuuuccagagcccucccacuugccucccucuguacccgggcuucggagaauagcagagagugcggaggugcuacugugcccaaacagacgcucaugcaugagcugucgcugccgggcuucuugcucucgucucagggcuugagccucagcugcaaugucagguggcaucacagcuaacacacuguccuccauauccucuaggacacuacggcgcaggucugagggcagagucuggaugaaggucacaggguccauaggggugucugagcuggcauucugugcuaguucucgucgcugcugcucagcucucugcugugccaguaccuauggagcagaaaaagucaaugagggcauuucuccugccaggcagccuggccccaccaccuucccgcucacauacuuccuccugaauggcuggaggcagggcagccagaaacucagggcucacuucagucacaccaggauuccccaccacugcaggcgcugagcuauuuguggagggggcaguccggguugguggacgaaugccuagcugguucuguagaacuucccgacggaugucaucaggcagggcagccagaaaagagggguccacaccuucagggagacugauaccugaagggagauauaacauguaaagggauucacgccuuauuaauugcuugagacggggucuuggucuguugcccaggcuggaguguaguggugcaacccuugccucacugcaguguugagcuccugggcucgagucuuccugccucagcaucuugaguagcugggauuacaggcaugcaccaaaaugccuggcuaauuuacauauauauuuuuguagagauggggucucccuauguugcccaggcuggucuuaaacucuuggcuucaggugauccucugaccucugcuucccaaauuuucaggauuacaggcacgagccaccgcgcccagccucucacaccucuauuggugccuaauauguacuuggagaaaauaaacccaugucacuccuugagggaaaccaguguauaugucuucacugcuugcaagacaugggacacagagaaggcccaccccaccuucccugggcucagaacagcuuuuguuauuugcuagacugcaugcacuguuacuuacccuucauaaauaaccuaccacgcagauaucaucacccccucgguaucauucaugaucacagaaauuaaauaaugacccuagguuguaaaagguagaaguggcagagugggggaauuugagugagccaagaucaguuugacuccuaaggcuggacccguuucauuaugccauaccagcacccccgcuuauugucaguccucccacauacaugcccuccaucuaaauggaacuguuuggcuggugggcauuuccaugccaagggcuacuagaagccaaaacaaucccaggaugaccugggcauacacggaacucacccgcaaggggaucuucuucuucacugcuuguugaaggcaacggcucuucuaggauuccucgggaaucugcuccagaaauggccacggcagaaucucugguggaagagcucucagaggaugcagguggggagcugagggaaaucaugcucagguugcugucuguauuaugucuucucguuuauaaaacacugcuacaauaccccuuucucacagaaaccagcuuuaucuccccagcauaacaagcauguccauuaguugacgaguaugaaaugugcuuugaaagacccuccaauauauccuacccuucuuuugcccacacaugcuuaccuguccucagguggcugggcagauuccccugacccaucacuccugccuugcacuuccgccacagcugguggggcauccccaggaguggagcugccugcucugggcugcucagaacugccagcugcugaagugucacccacagccuccucuaagguacaggaagccaggcugcuuguauccauaggagagccuucuagcugacugcugacagccgucagugcaucagaauccucagcucucucuggggaaagugaggcuaggaagaaguugcagggagagguuagguuucuaucuggaaccggggcaaaaugacagauaaggucuuugauagggcugcuuccuuaggggcaucucagcucagacuucucacuucucccuugcugucccccucucaaucucacuuugagauuucuaagguucagcugaagcccuuucuaucaauucuugaacauuuacuguguuccaggcaugccugugaaacaucuucccuaggcaaaccagguaagggauuuuuuuuuggcagggggauggagucucacucuguugcccaggcuggaguacaguggcacaaucucggcucacugcaaucuccgccuccuggguucaagcaauucucugccucagccuccugaggagcugggauuacaggcaccugcuaccacgcccggccaguuuuuuguauuuuuaguagagaugggguuucaccaucuuggccaggcugaucuugaauuccugaccucaugauccaccugccucggccucccaaagugcuuggauuacaggugugagccaccgcgcccagcccggguaagggauuuuuucacuuugauucacugcaggcaccacuugcacgugcauaucccuguaguucucuaaauaaacaagguuucgguagggcgcaguggcucaugccuguaauccaagcacuuugggaggccgaggcggguggaucaccugaggucaggaguuccagauaagccuggccaacauggcaaaaccucaucuuuacuaaaaauacaaaaaucagcugggcaugguggcgugcaccuguagucccaguuacuugggaggcugaggcaggacaaucacuccaaccuggguggcggagguugcagugagccaagaccacaccacugcacugcagccugggugacagagcgagacuuuuucucaaaaaauaaauaaauaaaauaaaauaaaauaaaauaaacaagguuccuugaaagaaaaaacugacaccuuagggucucuccagagaacuucacaagcaagaugguauagagcagggauggcaagcagguaucaauuuauccuguugaaauacugcugagaagacuuuucaggccccauuucaaaccagugagaaauagugucaugagauaaacagugucugccaggagaaugggagagcucuaagugugggaugacaugcuugccauccugggaacuguggaaggagagaguaaucuuuaaagucagacagaucuggguuuuaauucuaguucaaccacuuacagagugacuugggcuaauuauuucauuucugaguuucaguuuacucauguaaauaacaccaucgauuuuggagaguuuuuuuuuccccccaauagagauggggucuauguugcccaggcuggucucaaacuccugagcucaaaugaucccccugccucagccucccaaagugcugggauuaugagucaucauacccagcuggagaguuguuuuuaaauaauaagccuggggugauagcccagaaacagaguaauugccucaaugaacuguugguaucaucaccaauaucauuagacauucaacuaucaccaguucaggaccucaacuucacuuaagaaagugaaugcgcaagacgagaucuuauuauuugagaaguugaacuccuacuauuucucucaagcaaaagagcaaagagaagcuacaaagacauccuuucuucccucuuguuucauccuccccaaauguugaaauucuacucacuuauagugggagcuggggauaacuccaucugaguuguuucugcuuccccacuuggccuugugggacccaauuccucuggcucuacaggcaucaauagcuguguagagcugcccccuucuccagcuggagacugcagcuccugaggaaccucucccaaagcuggugggguugggaguguugguugcuguugugaggauugcagagugccaagggucuccuuggacucagauguagcugcaucaguugaagaugggguuguuggguagcugucaggcauaggcgucccaucuuucucggaaagaacaauaauagugguuaaggggcaaccagccaaugaugaggggagccaccccaaucagcaaauguggccugauaaguaucccacccagccagugaucauccccacaacaaaaauacuccaaggaacaucucuggucugguauacuaaggaugaagguuaaggcacagugcuaucucugucccaagaaugcaagaacuggagcucugacucuguggauucuaagaauaaaauccuuucugugcccugcagguggaagggggaagauuucaggccauauagggugaggcuaaaugucucugaccuauagguacacagaaaaucuaacuaccaaaauccuauugauccucccacuucaucuauuuggagcaagaaauggucagaauuucguucaaaacucuauuuguuuuuuuuggagacagggucucacuguugcccaggcuggaguguaguggcacaaucauggcucacugcagccuucaccucccgggcucaggugaucuucccaccucagccucccaaguagcugagacuauaggcaugugccaccauaccugacuaauuuuuuguauauuuaguagagacagggucuugccauguugcccaggcuggucucaaacuccuaagcucuagcaauccacccaccucggccucccaaagugcugggauuacaggcgugagccacugcguccagcccuucaaaaucuuuuuuuuuuuuuuuuuuuuccugagacagagucuugcucuguugcccaggcuggagugcaguggcguguucucagcucacugaagccuccacuuccuggguucaagcaauucuccugccucagccuccugaguagcugggaccacaggcgagugucaccaagccuggcuaauuuuuguauuuugaguagaggcgggguuucgccguguuggccagguuggucucgaacuccugaccucaggugauccacccgccucggccucccaaaaaugcugggauuacaggcaugaaccacugcgccuggcccaaaauucuuaaaguaugcuuuccauucccuugcacacauuccuguucuauuacuaauaaaaugcaaucauuacacaguugaagaauagcaaaaugaguucaugcccaaagguaaaauaauuauaugcuccaauuaaugaaagacaagucacuuuauaaugacaucugccucacccuaaacaccaucuguccccuuccaugucucuuuucuuccaguccaaauuauccaaggaacaucuacaacuuugucugauggaggcaacacugcuaagacuaagugugaauaugccacacaccagggaaaguaguaaguuguauaguuaucuucuaauuggggccuaauaucccuaccccacaacaauacaacuuacuaccucacccuggcaugagcagaauccucuaauaagggcagcaggcaaaaggccauuuuacauggugacagacucuuuuaaagaucuuuugcuagauuaaggguaccaaggcaucuacccuacuucacugcuuuaaaaaauauugugcaggcuuugguacaaucauuuuccaacucaagugcgaaaggagacagguguagggaggcagaagaauguucugaggaaauaugggugggggagacauaugauaucacaugaaccaacugauagaaucacaaaauggcuacugaccauuguuaagaagaucagagggaauaggaaacauacggcagucauaccacuaagcccagagagcuaccuucaugaacagcacacuauccaagacaauguuccuagacuuuuagauuccauggaccaauaaaauuuaauuaaaaaaagaacaaaaaguagagacuaauguagggguugccaacuuuuaguuuagccauguaagaaaaaacauccaaucaacaucauuuaauaaaaauauuuugguaccacagaauuaggaauaugaucucuaaauacaaaaacagccuuuuaaauggaauaaauucagcuuuaugaaaaaggcauuaaagcuccuugauuuuguucguuuccacagaggacuggcauuugagaaccacugucaucaguuauucucaugaagugccacaccaugguggucaucaaaggaccagccacuucaaagauguacaugaacaugcuguuucagaggacagaguugcagucaggaaaugaacaagacacaugaccucauuacccaugccagaacaaaguagauaauaaccagaacaagaaccugaacagagccagucggagaagaaguguaccaccgugggaaagacaguagacuguauaguuaucuccaagaugggguaugacccuaaaacuauacaaucuacuaccucaucccacagagcaccaguguccaucuucagccuaugugggccagcuacucggaacuaucaggauaaagaagcaaccaauugauuaguaagaagggagaaagggaaggagaguuaccugagagauucuguucaguggagucauuugacuuagaugcaguacacugcaaaaagaagggauagaccaaugugggacuuugcaagcaccuaagauagaggucaacuguaauagucaccauccuccacccagaccaucuaggaguucagugaucuaauggagaaugcuuuggccaugugaccaaaggaaggugaucauuucacugugcaaauauaugaccaauuucucuauacauacucagguucaagaauuguuuggggcugagggggaaauaaauauggaaggaaaggauaauaaaaaccccuuagggaugggcacgaucaugaucauucuagcaagaauuucuugguuucaucuauguauuuuuucccuucauggggcuuauuuuuuauuuuguccacucuagucuuuucagucacaggcuagguucacuuauuuuucauccuauaucaaguuugaaacaauguguguauuagguaaaaaguucuauauaaagauauuuguuagaucaaccuuguuauuuuaacugaacacuucacuacccuuauuuuuaaucuaccugauuccuuaacugcugaguaggguauacuaaagucuuucacucucaagucuuauuucuuuguauuucuaucaguuuuucccccuuuuauaucaagugauacacuguaauguauaauucuaucaacauuuacucagacauuuaaaagaucucugucugaggucccagaaguuucagaaaaaaguagguaacuuccuucuaaaccaaaauuguauuagugauuuuauacaugugagcccuagaaaaaaugacauguggugaugggguucagaguacaaacauuuucucugaucugacaccuaggcugaucuuacucaaaugacggaauggggucaucucgguaagauuccccacacuggcaguucaccgacagaaauggaagugggcgacuaagagcauggacuuagauaagguuuuucuccuugucuugaugcuguccuuggcgguagagacuaugcagugugacuguugagugagaagccauucugcuucuggcuccaguuuuucccuugacacuugagaaaucuccccucuagguuugaauucuuuccccuaaaaaccaggucaauguauggugaauuugaaauaaaaaauuucccagguucaacgugaacguucuaggauucuucagugauuccuggugccauguguaugccaaaaccacauuacggcagacacagucaaagaugaauccucccagcccuugggaaucaccugugcacucugaucccuguucuccuuaucuucuuugccuuuaucaguuaucuuuguuucuuccucagccaguuguuuccugcgcuucucucgccuuucuuccagcuccucaucccucaggaauuccaggugauugacaauggacacuuuaaccacuguuucaaagaggcaaaaaucaaaggcugcucugguggggucagggaggaagccaagaggcagagcuuguagccacagagaaccagggaaacaacucuccacacguuugcccuagcucuggaaggcucacuauugcccugauaaccaagcugccacgcaccugaaacacagucaugcaugcucucagcaucgagaacuuugcauucuucuguccagcgggucagggcuguggggaugcuggacaggguuccuguagggacagcaaaggggaaugagauucuuggccuugucaagcauuaacugauccaccgauccaaaaauugcaguauuucccuaaaaggacccaaggucuaucacaauguuuagaacauaacaaguaccuagagacaauaaaguuuuuguugcccauggcuaagucacugagugguucuggcuccuauaaaauggggguuuucuauagggcagacacugucuugcuuuuccucagcagggaaaaaguagaaucugacaaauucuacccucccuuucaccacacaaacuugccugcuuggcugguagcugugcucugaucauggaaaaagucauccagcagcucaucaucagaacgggcgaugauguggacgucaucguugccuaccaggaggcgggcccgaccccggcuuuguaggggaaggcugcugcucagcugaaggaugucagcagcagcugagggaccaagcaaccuguaggguaaugguggguaccaugaucacuguuaaguccagaggugcccugcaaccuguuaccaugagauccucuucaugcauccucuauuaaaugcagaacaugauuauaaaccugaugaugugcacacaagucuaaguuauuuuucugaauaccacccugguuuuguacuuaaguuguauauuauuccauaguuccuggcaccaagugggugucaauaagcucccacgugccaggcacugcgucaggucacauugccuccacuacacccucucugucgucuguacaccaaccauuacaacacuuauaugccuuucuuuuacuucuuaagauuguuugucucacuaaacucuaagccugagggcagggaucuugucccgucuauaucuaaaguguuaagugcuuggcaugagacacuuaauaauugcuaaauacaugcgcagaacuauugacauaauuugguauuccccaaaaggcugcacuccccaaaaggcuacacauguaauccacaaagaaauggaacaaauaccuuauuuguguguaugacaagaacauuaagugauggacuauuucccccaagguuaagacaaugcuaaagcacagugaaaauucuuacaagagcuccgaugaauccaacagaucucuguaacucaccucugcaguauaagaggaggguugggcuggcgauucccaggguagugaacaugaaugguguggccaguauuggccgucagcugccuuaggguccucugacugcgcccgaugcccugggugagacgaguuguugaagagccacugcccagugucagagaacuguggucugcauggcgcaccaucaguggaugggugguagggauauuuccuggggauggggggaugucugcugcaaggacaauauguaaaagggucagugucaaaaagaaauuucuuccauguuuguucaagcagaaucaugucuccugggccuuacuuccucacacggaaaccugagcuuuguccuuucucccucauucccacaacucaucuacaaucacugacacuaccauagcuuaugccaucaucucucacuuagauacugcaacggccuccuaaauaguaccuucucccaauccauuuuccacacuacagucacagugaugcuucuaggccccucagauacaugcugcucccuucaccuugaagacuccucucccgcuucuuuaccugcucuucucuucuuggccuaagaugucacuuucucugugaagccugacuuccacagauuggguuagguaacucuuuaccucugugcucucuuacuauagugcaauguaaugccugcuuaguuaugauuccuaauaaaccacuccuaugaggaacgaggacuguuuucuucuuuacugcuguaucccuaguaccuaggauacaguaggcacuccucaaauauuguucaauuugcugaauggacagaggcucaacucuaagggaaacugaugaaaaucacaaaaaugcaaaauaaucauagauguuaucuucaaaguuaucuaauccaacccauuuuuuucucgaacuuuucauuuacaggugacaaacugaggcucaaagagguaagagauuaauuggccaagaaaacagaccagaacaguucaguguuuucugcuacaucaugcuugugauuuaaguugucaagaccugcccuaucaagacagcuugauucuaagaacucgauucuaacuugacgcuaaaagggaaguuucacggugaugggggaggaagagauucacucguucucccgaaaagacgcauccuggaugaauagagugaguauguucaaaucugcuccccaaagccaagcucaaaggugaccauucaaacccucaagaucuuguguuauggacauaaggauuauugauugcccugccacuguggugugcacaugggugccugaugcagucagccuuggucucuuucuuuuuuuuaaucaagcaaaucaucaaguuguccaggcucuaaaauggcugccuauuuacugaggugaagggaacaaaagcagccucucacuauuccuucuccuaaguauacacuaaugagacagauggauucagauaucccuugccccaggaagucagcauaggaaaagaagugcugucuguaucggaucgguuugguccacugcuuggcuuacccuagagaaggguauaagaaucaagagagaaaaacccagcugagccccuguaucuuacuagcacuggagaacauguugucaaacucaaugaugagaucauccucccggucaaagcgcucaaaucggaccaagggagaagcguucauaucaggauaauccucauccaauuccaucucagagccaucgucgucaucgucuucaucucccucuucaccuucaucauccuccuuaagggaaaauaggagauggagaauugcuggagguaaggguuuucugaagccuggugccauggccacaugugcacaugagggagggagacgcugaggcuagcaacccagacuguugguuuucugcagcucuauguucccauggaagaggucaucugaaccaacccaaacgcaguccccccucaccugaucaucuuccucaucuuccuccuccuccuccucuucauccugacuaucauccucauccucguuacugccacugcuguccucuuccugagugugcuccuccucauccucaggguccaggauauucauggaaucuaaaacaaagggagcacauuggaggacuaaacugaguagcuagaaaacaggcuacugugcaggccagcaggcugagugggaaggugaugggauaucugacucuaugagaggaagaaccagaucuggggugauguacagacuuagugagccagacccgauuuccugagagugccaaucaaugcaucaacacacugagcaggguggcugaauguggaggcuggcuagaggguggugcuugaggagccauggucuaggacuuggccaagucugcuggugcccccuugccuuuucagcccuacuuugcuauugacuauauccuguuggcaagagggaaccuggagcgaugauagcaggugggugagaagaaagcgaaccaaguaagaagugacaaacuuugggcaagcaguaguaacauguuauuugaaaaacuggcugaggauaaaguggaugguguaugucagcgcaugcagacagaugcuuccuuauucugcacaugugggcagcugccuccaggaaaacccuaguguagugucugucagacgugcagggcaagaagggaggccuuucuggccucggcacucucaccuucucgguuggccugcaagguggaagcuuggcugagguuggaaggagcuucauccaucagcacguccucuugugauucauccucuccacuucugcucacugaagguuacagagcagagccuucacugaacaacagaggacuucccuuuccagacugggugcgucuaaaguagcuauguacaccuagcagauauccacuuuuuuuuggaugagggagaagaccuggauugucugcugucagcuagcuaggugagcuuggccagucacuuuaccugucugagucucaguuuccucaucuguaaaacaggaugaucacaucugcccugccaaucccacuaauugugaaaccacagaggauacuggguauaaaaaagcuuuguaaaacuuaagaauacgugucuacuuccauuuauccuuugauuuccuugaucaacaaaguaaaaacaaguaacacauacacccucagagccaggugacaguaggguaccuuugccauuuucccucugagauuuauaaagggccacccucagggaaugaucauucuuuuuacacuacugagacucaggggcagaaagccccuggacuucauugaagaacugaaaggcagcgcuuucucacccuacagccuccucuaggccuccaugaauaaacacucuuuugaugugcuugauguaucaucuguaucaauggccacucccaccaccucccccacacaggcaacacuuuagacugccacaggccuguagacgucuugugaauuucucaucuguaagaccgucaacaucaagacaagcagcgaucuaggcuggcuaugagcccuuaggcagagcugagcaagcagaugaugagaaaaaggguccucccaagagagacugaggcaaaggaagaggcuauacucaguucuggggcucucaccuauaauuguacuguucccagauccgccaucccucucaagcaacucaucuaucagguccuccagcucauucucaaccuggagagaaauagaacauauauauggaugcacacaagucuaucauugugcuagcaccgaaacccuaaaaaaggccagcaaagcagcauacauuucuaggauaacaugugacagaggauguuacgugaaaccacacauucggugcuaauuagcacagaaacuaccacgugcuaccaauccacaaccagacuauccuucaaauggguccaucccaguuaucugauacuggguugucuuuauacuguccaggaagacauaauagaucucuuuaaagccagcagcuuaggaccacaggcccaauuucuuacccaaugcuaccagcuccagaaauuacaaugcuuuccuuuagggucuuuagaagacugcuguuuuaaugccccagcaagagcuggugcuauaggcauaaggugguguuaaggagcuuccaauaaugaccagagccaaaguaaaucaaagacccggggcccaacggucucaggucagcuuucuacuucaacauuucaccugugccuaaguuuucugguugggaucuauaucauuucauaguacauggcauccuggcccugcccccaccccucuuuuaauacaguacaaacacauuuacugagcaucuacuaagcauaucacccaugcuccucugcaaagcagccagcauugaggcaaggaucuaaaguacucacccacccacaccaccuggcaaggguuugguucagcgccgcaacagggaaaugcugggugaucugccucccuaccugcaucucuugugaacugagcaccucaggcugcccagcaaucaccacugagucgguuucagccuccccauccaugauauccccaucugccaccucugucugagugacaucaugauccuccuccugcacuucugcuuccccaggcucgccugaaacaaucaaccaaccagcaaaauaaucaaagagugccuaugugcugggcaccaugaggcaagcgcaaagacaauaaggucccuuccuugggcaaguuuguaaguucucagagaauaaacgaaugggugacaaaggaaaagacaaggcuacgugugaggauagccaaacaaggcugcauuuugaaggaauucuuuguggggcagauucccacgccacuaugacagaucucuggaaggccagcaaguucccagggaaacaccaccaagccagaacaguugugaucccaggcccauaaagcaacuacucccaccucuccaguccauuggcucugauucccuaccuggguccugcugguugcuacuggaaucuugagaggcuccuugggcauccugcucagacuuguucuugcuagaagcacucuugcugccaaaaaggcuacugggcugguucacaauccgggaaaguguuuccaaaggcuucagagcagcauugacuguguuggccauguugggacugagauaagggaagauaaagagauggacugagcacagaaauacuaggugucuaucuucuaaaugacacuaagcuucuuacaauggaaucuacuaagagaaaaggggcauaaggucguacaacuaacacucuacuuuuguuuagaaaaaaaaaauuuugacuuaaaugucuucaaggaacccacccuaaaagcaagaguuaaaucaaugccauauuucauggggccauggaaagcacaugaguaacaaauucuugacuggaaaucagaauguauucuggaugaccacaugcaagcaagccacuucucggauguacucaggauuuuuuuuuuuaaaccaccagcauuuaguccccaaacccuaaaagcucaaaggaaggaacaugauaaaaguuuuccuuuuuuuuuuuuggagacagggucucgcugugucacccaggcuggaguacauuggcacaaucucagcucacuguaaccuccaccucccaggcucaagugauccucccaccucagguuuccaagucgcugggacuacaggcgugagccaccaugcccagcuaauuuuucuauuuuuuguagagaugggguuucgccauguugcucaugcugaucucgaacucgugagcucaggcaaccugcccuccucgcccggcugauaacaguuugaaguccugugaauuucaaauuauacucuguagggcuuccuagaguucaauaaaaguacaauaggggcugcaguuggaggugugguaugauuucuaaguguaauaaggugugugagaccaaccaggugcccacuaacaccagagcagcucugcuuuuaucugcuuuauguguguauuuaugugugagucuauguauguauguauguauguauguauguguguguguguguguauauauauauauauauauauauauauauaugcucacuaguaguaccaagauggcagucucugauaucacaucacacuaaaaguaaccaagacucgucagaacaagugaucccaggaauagggcaaggaagggauaagguaagccugggauaucucauugugccaaaaagcuuucaaaaauuaaugggacagcugggcgugauggcucacaccuguaaucccagcacugugggaggcugagaugggaggauugcuugagccuagccugagcaacauagugagauccuguuucuauaaagaggaaaaauaacaacaaaaauggggaaaaaaaauuaaugggaucauuaccacaggcccagcugaguaucagaaagaauaaugauaguaauggaauuauucauuacaaaguggaaaucuaacagaaaccacccucccaccucagccucccaaaaagcugggacuacaggcguacauguccagcuaauuauuguauuuuuuugcagagacagggucccacuauguugcccagguuggccucgaacuccuaggcucaagugauccaccagccucggcugugaucaaauuuagcaucacaaguauugggaccaagugguauucaccugucuccugacgugaugugagaagggcaaauaucacccauguaguauuuuugccaaaaauguuuaaccugacccuaaccauuaagggagcaauuacaucaauguagacugugagauguucuauaagacaucaagccuggauucaucaaaacaggaaaaugucauaaaaaaaaaaaaugugacaaccaaaugcaacaugugauacucacugaaucccggaucaaaacacucucccucagaguauaaagacauaauugaaauaacugggaguauguguauauaaaauuguauaaauuuaguauuauuauauuauugguaaauuuuuuggauaugacaauggaacuguacccauauaaaggaauauuuguucuuaggagacagaugaucaaguacuuagagguaaaguuuuacaguguuuucaacuaauuucaaaugauucagcuccugaaaggacaggaagggaagaaauaaagcaaaauguucagcagugguuaaucuagguagacacaugguguucauuacaguacugugaguuugacauuuauaaauguuucaaaaaauugauagguuuguagcaaaaggacaauuuagucaucuugaaggggccacauaggucaaagguguaauaauuugagcaugaaaaagugacugcagugauccaaauaaauucaaucacuaguuucaaaacaaaacaaacaugaaaagucgaguccauaauacgacuuaaaaauagaaagccagaaaaaaaccuacauuugaaucucaaauguaaauagaaagaaauuaaguuuuuauacugccuuuauaauagaaauuauauuuuagcacaaccagacauucccugugaggcuaacacagaaaaaugccaguuaauaauguauucgaaaugagaaauuagaaagcuuuuauucauaagccucaaagaaauuaauugauccaggcaagaauuaucaacugauguuaaggcuauuauuuagguauaugauugauaguguagacauuuguaaagugccaaaauaacaacagagaugacuuucuaguaagaacaaaaagugacaauuaucaugggagaugugucucccacgauacaauaugagcuauacaucaccuaggcuacacauuucagcccaaaauguuuaaacugcuucaauaagccucuaaagccucuagaucuaacuagaaguuuacagaaaauaucaggaaguaaaggauuaaguuaaacuacacugcaaggaagcaacugcaccaaguuuagaaggcaaaaacacggucgcuucaacaagcuggaaucaugaacaacaaaaacaaaauaaagaucgaaauaaugaaaaaaaauuguuuuagaauaagagagauucagaaaacauagccagauguaauacaaguccuuaauuggauucugguuuggagaaaaaugcuuaauuauggauuugggcauuagguaggaugaaacuuauuuucauagcaaggaagugaccaguaacugaaaauaaaaacgaaaaugccccaaauuucccccaacacaauagcauguaucauaucauguuaguaaagaauacauuauuuaugcaugcaaagaaaaacacugaauaauaaaccaauaagguaaucaugguaucugggugguaggaauacagugucuacuucuuauuuuuacucaucuguauuucuuauaauauacauauaaucuucuaauaagugguaauuuuuaaaguggggggaagcuugaaaaaaaaaucacuauuauaguucaacucuugaguuuauagcaaguaagaaccaaggcuuuaagaaagacaagugcuaaaagccacaauaagaaagacuugggucucccacuuguacccaaaguuuucccacuacaccagcuaccuccacaucauucguguagugaggcugaagagaaggaaaagccuggggcuggggcaugauuuuaccuggacaggucuaagcugugagguacucuggccaggucauuaaccagucccuucuucaggaaaagccgaaugauguuguucaugccauugugcugggucuucgcuguggcacugcuguagaagcuggagguggaggggcaggacuccaugauaguacugaugauacacaucacugccugaagccugggagagaaguuuugacaucucuaucauaugaauauagccauuucucaggccaagucuucacaaaauagccucagauaacccuccuguaacuuuuguauuuccuucuggaaauaacaucuaaacaaacaggugagaacacacucccuaaggugauagcauucguuuucucuuuuuuagacagggucucacucuguagcaggguggaguacaguggcgcaaucuuggcucacugcaaccuuccugggcugaagugacacucccaccucagccucccgaguagcugggacuacgggagcgugccacuacgcccagcuaauuuucuguagagacaggguuucgccauguugccaaggcuggucuucaacuccuacuccugggcucaggcaauccaccggccuuggccucccaaagcgcugggauuacagacgugagccaccgugcccagccccuacuuuaaauaaaauuuaaaauauaagaucaaauaaccugcucaacuuccuugaagaccuuaaaaguacacuuaacauuucccuuuguuuucucuagguuuacccacuuacucuaaugguaaucagugcucuggcuauuuccaaccgccagaacuauuugagcggaccagagaguauaugaugccaguaugacaagaaguuuuguucaagugcaaaaccacccauggacuaagaagaagaauaaggggauguucuuggcuauuagcccugggacagguaugaaucuuaccuggcauguuucucuguacucucagccauagccagugcccguccaagggcugcuuuuacuucauucacuagggccaccugggcaucugugccacucccugcagcagccaggcuugcgaggaacaggcgggccaaggcagggguguccuugucuucugcauucuggguaugugggagcaggugguccagaacaaaagcuagcacacugcaguccugaaaagucaugaaucacgacauuuacuuacaagcacaauuaugccauaucauuugcacaggaccaaagauacacacacacauaguauuuccuuaagucacccaaugagugauuauuagguccacuuuauagaugaagaagccaaggcucaaagauacaagcaaguaaggagcaaacccagauuuuagaaaacuuccaaaugccacccauuucccacugcacagcuuauacacuguuauguagaugucauguauuuuuaaaaacauuuuuuaaaaacuuuauuuuuauuaaaauguuuuuaagaagaugaggucuugcuauauugcccaggccagaguacaguggcuauucacaggcaugaucaucgcacaccacagucucaaacuccuguguguguguucucacaccucagccuuccaaguagcugagacuacaggcaugugcuauugcaccuaucuuaaaauauuuucacaugugauauuuaauagaacuacuuacagcaaaucuauaaauagauaaguauuuucucauuugauaagcgguaaucugaagcccccuaaagaaguggcuugcacagaagaauuuaaucaagggcugaggauucaaaccuugauucuuaauuaagugcuauaaacccuucaguguucaauuaaauugaaauuauuuacugacaccuacaaugugcccaggacccugugcuacaauagaagcugguaagagcugagcaagagacagcagagucacagaaacuaauaugcaaaaauauuuaaugcaagguuauuuaaaguaacgaaaaaggcucaauagaggaaggaaauuaagucagacucuucuuuuuucucuaacuacaauuccugccuagacaauuccuuaucuuagaaacaaauucuauugucauucaagcaaauuuuggaugaaaauacacugaacauuuuuggaacuacauaggugacaguugcacaacacugcgaauguacuaaaugccacucaacaguacacuuuaaaaugguugacuuuauauaaauuuuaccucaauaaagaaaaugcauugaauaauuugagagucugagaaacugaauaaagugaccuugucaaaacaaaacaauuagaaauaacaauuaauuucccaguagugaauacauacaaaguuaaaacuauuuucucaauaaccacguagaaaggacuuagcuuuggaaucauagcccuagcuuccaauuuuagcucugcuacucuguaguauggucccaggcaaguuacuuaccucuuugagccuucucuccucuauuaaagagaucacuaucaacaaccuugcaguguggaggugaggauuaacaauaguauuuauaaagcacuuaccaguacccaguacugguaggacacuggacacauauuaggcagauacuuaauaaauuuguaauuaaauauguuaacccacagguaauacuauuauaaauuaugaauacaacuggcauaaaugaguuaaagcuuuggaauaaagccuggcuaggugugauggcucaugccuguaauccuagcauuuugggaggcugaggcgggaggaucacuugaggccagaaguuugagaccagccugggcaauauagcaagaccucaaaaaauaaaauuagcugggcgugguagcaugugccuauaggucccagcuacuugagaggcuaaggugggaggaucacuugagccugggaguucaaagcugcagugagcuaugauuguaccacugcauucuagccugggagacaaagugagacucuuaaaaaaaggaagccuauuuauguauuuauaggacuuauguccagaauauauuuuaaaaacucaauaggaaaauagaguaaaagagcugaauagacauuucccaaaagagaaugaacaaauggccaauaaagacaugaaaaaaauggucaacagggaaauguaaauuuuaacuauaaugcaauaccacuacaaacccauuaaaaucaguaaaaugaaaaaacaccaacuguugaucucccauaugcugcugguaauaauauaaacugaccuggccacucuggaaaacuuuuagcauuagcagaacaacuaucauacucuagagcucagcaauucuuacucuuaggcauauacuacccaacagaaauuggguaguucacgaacuuauauauauucauaagaaugcucauagcagcacuaucugugauagcuccaaaggcaaaauuacccaaauguuuauuagcaguagaauggguaaaagauguauuuguuuugguacaugguacauuccacaguggaauuuuauacagaugaaaauaaacuucaccugcacacaaaaugaaucaaguauguuaagcaaaagaagccaggcaaaaaagagaguacauucuaugagauuccauuuacaugaacuacaaaaccaaauuacggcacgagaacucaagauaaugguuaucuugagugaaggugaaaugggugggaggagaugcacuaaagaacaaggagggcagcuucuagggagcuuguaaugcuuuauuuaacuuggcuagugguuaccuaggaaaaacagacuauuuaagauuuguguauuuuucuauguauauuaaacuuggauuaaaguaagaauagcuuuaaaaauggcgguugcuuucaaagauggcaacacuagugccccuacucacucucagacccuuuugccacuuacuaaccauaaaauuacaaugugauccacaaaacaaggcacccuuacgggaaaaaauauuugggcacccauuuuacauaugcgggaacaugugauacaguuucucaaaaugccccacucacuuaaaaaaucuaaccugaggauaauucugcaucaggacacuucauucuuuuccacagcucuacuaaugaacauuuaaggcuuuuccuuuauuuuuauuaccaauacugcuaccacaucuggugucuuugcacaugugugaguacaucuggaagaugaacaccuauauucuuauuuauaugguuuauucaacuguccuuuagacacuuuuacuuagaugucccacagauacuucucaaaacuccucauuuucucuucaaaccuuccccaccccauucuauuuucuuguuagaugccaacccauaaaagcaauuaaaaaaacccccacaaaucaagaaacauccuugagucuuaauuuccuuuuucaucuuccaaacccaauucuuguccauuuguaccuuaaaaauauuucuucaacucacccauuuuccuccaacuucaccaagaucguacguuacuagauuacucuaucagauuccuaacuguucucucugacuccagucuucccucuucaaucuccacaaugcauaaaaagggacuuucaauagaacaaaucucauuaacucucucucucagugaaccuaaugaaaaaaggccuagcucuuucagguuuuuuuugagacagaguuuugcucuuaucacccaggcagguguacgauggugcgaucuuggcucacugcaaucuuugccuccuggguucaagugauucccgcaaucucugccuccuggguucaagugauucccgcaaucucugccuccuggguucaagugauucccuugccucagccucccgaauagcuggaauuacaggugcccgccaccacgccuggcuaauuucuuuuuguauuuugaguagagaugggguuuugccauguuggccaggcugaucucgaacuccuaaccucaggugauccgccugcuucagccucccaaagugcugggauuacaggcgugagccaccgcacccggccuugcaugucugaagaugccucuucucacucauuacuuggguuagcacuuagcaugcacagcuucccagcagugucugacacaggcgguacccaaaugauggaaguacaguguaacaucuuaaauagaaguuggaaauauuaccucuuugaucaguucagacuggcccacaguguagcuguaguuggcaaucaggguagcaauaccaacauaggaccucaccaacucugccagaagacgaaggauaguggagguaggcauuaaagguuugcugcccuugccuuucuguuugccuuccucagaggcccgguccccuucuuuaucuuucuucccaucucgagacuccucuggaguugaagcuguugagaaaagucaaacacugguucaauuccacacuggaacacuggcaaaaucaagucuuagguggaaaagaaugcuauuucuccuccacuuuaagccaccuguacaaacugaaugcucucgugacacugcagugcaagagcagagaaccaggauaacucaggucucagauuuaugugguuacaguacaacagggaugcuuuguccaacuauuugugcaucucccuccauuucccuccuuuuacauacuccagaaacacucuacuaacaguucuucaaacuugucuugcucccuuacuucuuucuuccgucugccuggcacacuuuuaucuaguucagcucaaaugcugaccuccuccauaaaugcuuuccugucucaucuagacauacugugagauacuuuacauguccauuauaucuuauccaaguaugccuucauucuggcaguuauccugcauuauaacucuugcaggucucagucacuggacaaaguacuuuaaguacagggaacaaaucugauccauuuugguguccaauauagucugccacauaguggguaaugcuucccuugaaucagcaccaucauccacgcuauacacuacauauggccaguaaacccaguaaaaugaguuaaccaauuauuucacuaauguuagccuuuuaaauuuaucuccaggaacuaguaugauuuuaaacaaaaugucuccuaaauuggaucacaaagaccuuuccuaucuaaggagaagcagcucuuuaaaggucucauuagacuuacucccagggacauuuuucuaguucauggugaguagucaaugggcucuguuaacauugcuggaagacaggcauccaccacguaaagcauguagcuagaacaauaucacuggcauaaaaucucuauaagccaguuuuuagaaaccccccaaauaauuauggugugauuuaaaaaguaaaacuaaaauauguuaccacagcaaccauuacuagguugguuaacuuacaguuccauuaacuuuagcauauagagacccuuuauuacagaacacugagcucaccugagaaaguucacuuagaccaguaaacguaauaauuaagucuguauucuccuacccccugcacaggacaccuacaguuuuuucaaguuguuuuccuaaggaauaagaacaugguagugagaaaagcaaaucauuacccucuccuugggaggucccagaugcggaagucucaguggaggcaccaucugcagcaaagaccugacucugaagaagaagaaaacuccugagcuauuaugaauuucaaaagcacccgucugcaaauggcagaacuccuucccagggcacuggcugggaaugccacagauucucuuuggccaaccuuuuaaccaccuuacaccuuuauacuauaaucugugggaggcuauuauaaauacagugacugggagacugugggggaggcggggaaggaaagggaaaagaaaaaaaauuaaagaacaguucuaauccuaggagagaaaaaaaagucuccagggacaccccaauuuugucuuuacaggcaacagauaauuuacagauacaucacaauuaauaucuuugaaauuccccggggauagcccuaaauacugagaccacacaggcauugaaaaaugagaagaaagauaaaacgcuguuggaauugacuuacauuaauggaaaaaccugacugcguaucaaagucacugcucugacgcguaagugaccgguacugcugguauacaucaucacccaugucuugcaggagcuggccaaccucuugggucauaaccccagguuuaggaucagauuuaucugcuaggaaaacaguaacaaccaucaaaaacaaaauaaaccucuucuacaauuggacaauguuaaggccuaucuagucagucuuggucaauuucacaucaaguggcuaugacuguuuacauggugcuauuacagauaauguuagagugccucacccuaaaauuacaaaaacuagucuugugaccacaggcaauuaacuuagucucacuuuccuaagcuguaacuacaaaccuuaagugaacauaccuggcacuauugcucaugcaguggugggucaauaaaugguugccacagcuauauagcuaaacuauuucggggaggugauaagagauaggguaaagauucuggggugauaggagaaccaaggaauucuauauggaucaggguucuguacagaugaaaagcaccaaggucaagacucagauuucuuuugcuuauuaaaggcagcauucaucaauuuuuggcaauucuguggaccuaucaaauaaguauguccugaauaaaauccagaaggaccuuacuauaauggaaaccuauguuccaagcaaaucaaucaugacuuuccuaaugcuuauaagaugcaccuuaacuaggaauaaagguggaugggugugguggucucaacaguuaggaaacucagacacaccuccuaauauugccuccagcucuucagacaauaaaaagguuuugcuugaguaugaaaacauuagagacuuccuggugucuuauuuucaaccucucacagaaugcuauuaucuccuucuaaaucuuuguucauucuucccccguaugguguguauucucauauaacagaacucuggcaaucucauccauucaagguucauuuuagaaaucauguacacaaagaaauuuucuuaccugugcacccucacuagguaaggugccucacccuaaggacuuaccaccauccugguaugucauacuauaugacuauuagcuucuucacagacaugcaauggguaucuuauucaucuugagccccagaguaugggcacauagugagugcucacuaagccaugaguuggcugaaaugacccaggcaaaguaacauauccucuagugcccagccuccugagguaggcuagccacauaccuuccucuggagcaugguaugcagccagagcauucagcauaucauagaucacuuccuugauaguaucagggaugacaggcagaggugagggcuucaaagggguggucuucaccagcuguacagcauuagggccuuuaauucuaagauucucaaauucaucaucugaagcuaagccaaaaugagagagaaaaaccagucaaucaugaagcaguaccuaaacuagguuacuaauaaagacucagaagggggcauguaugauauagaaggcuugagauaggagaccauuuucaauuaauguucaaguacucuacuauaaaaccugguuuauacuuuccuuaaauuccacaggauuuaauauagcaguaccaaauaguaaaggcuugaguuagagaaaacugguuuugaaauccaguuguuaauucaacaaaccucaauuuucucacucuccaaauuuauguugaggauuaaaugaggauauaacugagaaaugcccagcacaggggcaggcacauagcuggaacuuccaaaauaauuucauccccuucccaacguuuuauuaaaaaaaaaaaaaaaaaaacucccucucccuccucucccuccucucccucucccucucccucucccucccucuccccacggucuccuuccauggucucccucugaugccgagccaaagcuggacgguacugcugccaucucggcucacugcaaccucccugccugauucuccugccucagccugccgagugccugcgauugcaggcgcgcgccgccacgccugacugguuuucguuuuuuuuuuuugguggagacgggguuuugcuguguuggccgggcuggucuccagcuccuaaccgcgagugauccgccagccucggccucccgaggcgccgggauugcagacggagucucguucacucagugcucaauggugcccaggcuggagugcaguggcgugaucucggcucgcuacaaccuccaccucccagccgccugccuuggccucccaaagugccgagauugcagccucugcccggccgccaccccgucugggaagugaggagcgucucugccuggccgcccaucgucugggaugugaggagccccucugccuggcugcccagucuggaaagugaggagcgucucugcccggccgccaucccaucuaggaagggaggagcgccucuuccccgccgccaucccaucuaggaagugaggagcaucucugcccggccgcccaucgucugagauguggggagcaccucugccccgccgcccugucugggaugugaggagcgccucugcugggccgcaacccugucugggaggugaggagcgucucugcccggccgccgccccgucugagaagugaggagccccuccguccggcagccaccccgucugggaagugaggagcgucuccgcccggcagccaccccgucugggagggaggugggggggggucagccccccgcccggccagccgccccguccgggaggugaggggcuccucugcccggccgccccuacugggaagugaggagccccucugcccggccagucgccccguccaggagggaggugggggggucagcccccggcccggccagccgcccaguccgggagggagguggggggucagccccccgcccggccagccgccccguccgggaggggggagggggggucagcccccugcccggccagccgccccguccgggagggaggugggggagucagccccccgcccggccagccgccccauccgggagggagguggggggaucagccccccgccuggccagccgccccguccgggaggugaggggcgccucugcccggccgccccuacugggaagugaggaccccucugcccggccagccgccccgucugggagggaggugggggggggucagccccccgcccggccagccgcccaguccgggagggagguggggggucagccccccgcccggccagccgccccguccgggagggagguggggggaucagccccccgccuggccagccgccccguccgggaggugaggggcgccucugcccggccgccccuacugggaagugaggagccccucugcccggccagccgccccguccgggagggaggcgggggggggggucggccagccgccccguccgggagggaggugggggggucagcccuccgcccggccagccgccccgucugggaggugaggggcgccucugcccggccgccccuacugggaagugaggaccccucugcccggccagccgccccguccgggagggagguggggggggucagcccccgcccggccagccgcccuauccaggaggugaggggcgccucugcccggccgccccuacugggaagugaggagccccucugccuggccagccgccccguccgggaggguggugggggggucagccccccgcccggccagccgccccauccgggaggugaggggcacuucugcccggccgccccuacugggaaguggggagccccucugcccggccacgaccccgucugggaggugugcccaguggcucauuggggaugggccaugaugacaauggcgguuuuguggaauagaaaggcgggaaggguggggaagaaauugagaaaucggaugguugccgggucuguguggauggaaguagacaugggagacuuuucauuuuguucuguacuaagaaaaauucuucugccuugggauccuguugaucugugaccuuauccccaacccugugcucucugaaacaugugcuguguccacucaggguuaaauggauuaagggcggugcaagaugugcuuuguuaaacagaugcuugaaggcagcaugcucguuaagagucaucaccacucccuaaucucaaguacccagggacacaaacacugcggaaggccgcaggguccucugccuaggaaaaccagagaccuuuguucacuuguuuaucugcugaccuucccuccacuauuguccuaugacccugccaaaucccccucugcgagaaacacccaagaaugaucaauaaaaaaaaaaaauuaaaaaaaaaaaauaaaauaaaaaaacaaauccaacaaaccuacagaaaaguucgaauaguauaauaaacaucuauauacuuuucauccagaauuaccaagugacuacuccuaaauacaucuacuuguagcuccuaagaucaaggacauauauuuucuuuuuuauuaccaaaaaagucagcagaggggagaucaaggguauuuuuauacagaacugcaauaccauuauaauaccccccaaauuuaacagauacaauuacauuaccuaauacauagcacucaaauuucuccaaaucuuuuaucuggauccacagcccaaccaaggcugguggugauuaucucucuagucuacuuuucucuauaagaaaugauccuguauuuuuucuuucauaacauuaauauuuuugaagagucuaggccaguugucuuauauagaacaucucacaauuuguauuuaucuaauuguuuccucauaauuaaauacaggucaaacauuucuuggcaggaauacacagaugacgucuauuucgcacuguguuacacgagacauacauccauuuaacccuuaauuaucacuugauuuguaaaccauuaacuauauguaaagccuacugccccaccaaaaugagcucuuugaagugaaggacuagaaugaaugaguccucagugucucuggcagggauuacaacagggcaaggcccagagaagcuacugaaguaccuaauaaauugacccaaacaaucaauuagccagcaaauguccuaauacuugccuaaggaggcucuucaaguuacagaccuccucauaaauaaauuucuggauuuauaccaggccacaaacuuaauaucaaaggccaggagcaagcgaaacuuaccaguuccugagccucgaggggcaggaagggcgaugcggauacagcaguuggccacuucugugaauaugucuggauugcggcaugcggcuggcccaaggacacgaaggauguaguugaucucccgagagccgaggcugccagacacaacaccagagguagugcuaccagcuccacuuguagcugcugagcgaacaaccuaguaaagagagaaagaaacacugucgauuaaacacuacuuucuaaaaauacaacugcagucaagaguuaccaagacuaaaagcuuuugauuuuggggagaaugacauuuuauuuuuaagucccgucccaucccuucuugauucaaaaaaccuggcuuauaaaaaaguugcagcaugucucaaaacuaucaauuauuagaccagacugcaugugaucuuuauagaaacugggagaugugucaagacuauaaaccccacauaacuuccacauuaaaaugucagcuccugagccucuccaaaugcugucacaauuuuaaaccagaaugguucaaaaacauguaacacuguaauccacuuaguguacaggaacacaauuaaauauuuucuuuaugccucaaagucaaccaucagucugagauaaugauagccacuggagauacugaacuauuuauauauuguuugccuugauaacacagggcuuacauauagcuaugcuucugcucuucucauaaaauugcuuguuaauaauggaaaaauccaugaaagcacgaagaaaauaacucaauuguauuauuuuccauuaucuguuauuucacaaacuacaugcucacaaugaaaaacaucuuuugguaucuuaauuuuuuuuuuuuaaaccaaaucaaucaugcccuuuagcacauuauacccucuguaucuugccugucuggcuguaauuauaaaauaauuuccauuuaauaaacacagaaaaguuuaauuucaauauuaaggauaagccauaauuuauccagcccccaacugcuggacauuagaccucuaguuucuugauauuacaagcaauuccacagugaacacucuuauauaugcaucuugguauacuugauguuaguuaucagauaaauucuuagccauagaauuucuaggucaaaggauaucuuagaccaagaguaccaaauugcccucccauguggcuacaccaauuuccacuccuaccgaaaguuaagaguaugccugguuuuccacaccuguacuagcaaugaauaguaccaagacuuuacauuuugccaucuugauacguuaagacugucacugauguuccuuuguuucccacaccccaacuauaauuuaccuaaaguuaaaacuuuaaaaguuuucccucauccaaugaggaccuacacuuucuccuagcacuuugaacuuguaacuuuuaaacauuucuuuauagaaagcguuucaagcauuucaaguuucuaaaaucagaauuuaguuguauauaguuguuccuucccugcuggguuaucuccuggacuguggaucaccauacaagcuaccuuuaacagcucucuuucucuugauuuggcacaugugaggugaaaucaagcaggcuguguaaagaacugucugaagaaucuaaaauguauacucagauauacaaaaacugauaccacuuuucuggcaagcaaguuaaaaaauacuuguaaugccuuuugauccaauuacuaaaaaucucuaaguaacgaucuuaaacaugaacaaaguuaggcacaaaaacgcauauugcaacacugcuuauaaaugugggaaacaaugucccaagagaggaaaacggaagcaaagucuauuaacagucauuauugaugacaaagaaucagcagaagaaaggauuuuguauuaaguacugaggaggaaaagccucacuacuaggacauuugccccucaacccuccacuguugucuucuuuuuuuuuuucuuuugagacagagucucgcucugucacccaggcuggggagcaauggcaccaucucggcucacugcaaccucugccucccaaguagcugggauuacaggugcaugccaccacacccaccuagucuugaacuucuaaccucaggugauuuaccugccucccaaagugcugggauuagaggcaugagccaccacacccagacuauugucuuaacuuuacaaauguuuuuauuuuuuauaaguacguugcuauuucuuccacugguuuguaaguuuccuaaaauauaauaaccuguuuucugaucugcacaauggauauuuguuaagugucuaucacagugccuggcagauuacaaacauucaaaaagcuuuaacuauacuuuuauauuccaaaauacaguguuuugagaauagucucuuggcugaacacccgagagguacuccuacaaaggaaugauucugaagguaugaacuugggggaagguaucccaguucuuuacuaacgguuuuuggcuugguuaaugaaaccuagauuaaaaaaaaaaaaagaaaaaaagaaaaaaaagaaaaccagauugcuggagaggacuuucuagcaauaggaucauccuaccauaccuaagcaagcucccaagcauagaguuggaaaauucuguuggguggaguauacaguauacauaucuagcuauauacccuaagaagaaccagaagucuauuuguucucagaccaaggagaacauagguaugauguaaagcuaaaccagaaucugauacaaaacacacucaccuuuuccaugguaugacgaaggguacagggguccucaaugaugugucuuaagagaagggugaccaggggaguaaacccauugaagccugagcucugggucaaauucaagaucaugcggguacucuucaguucugcaaacaucauggcauauuuguggucccgggugagccucagacagagacgaaggguggcaugcaaaguaucuggguccacagggacucccagcaugcucacgcaggcccggauuaaaacagucaccauaucuucugucaagcccuggaucaggaucuccccgauuuuuguuuccuccaggcuugucuccuuuucaguguuuguacucucuagggccaaagggguaucuauaaaaugggaaaauaacaguuuuagacaguuuaacuugauguuuauuuccucccacgccucccuccuaaguaauuggccaagcacuuggguccuauuaagagaagcaugccaaauaccaauuuuaagaucagaugaaaaagcauaagggaggccuacguaucuuuaaucuguuaaucaagcugaugaaaauaacucacaaugaaauuggccagaccuuaagccacaaaggcacauuagcuuuagguaaaacacucuugguacauaccauugccuuuauuuucuuuacguuugauauccauuucuuugcuuucuuccagcgucuucucuaguuccuguccauugcuguuuuuugaauuuuuauucagccgagguacccugaggagagucagcaucacagggcgucgguucccuguuuccucauuaaccuaggaauucaaacagacauuaaaaaaaccucuaccaaaaaugaauuauaaaggugggggaggggagggacaucucccagguaaaaugcuacaacaggaaggaacucuggcaauuuaucccaccuuuaucauuuacagagaaaaaaccugaaaguccccagaaggcaaguggcauacacaaggccuuauaaugaacuguagaccuuccaacagagcaaauaccaucccuaaccacucccuagcccuugacuaaacacuuaaaaucauuucuaagagggauaguaucaaauugcuacagacccaaggucuaaucaaugaccuuaggaagacucgauuuucugaaaucuauacuuaauuagguaaugguaacucuccuccuccuaacacguuaggaaugcugguucagaaagaagaaaaccaaaacacauaccccucuuuuugauaaaguuuacaguagggguguccaaucuuuuggcuucccuggaccacacuggaagaagaauugucuugggccacacauaaacuacacuaacgauauuugauaagcuaaaaagaacaacgacaaaaaaaccucaaugugugguguugggcugcauucaaagacauccugagccauauguggccugugguccacggguuagacaagcuuggugagugagcauguaccugcaccauuguagugaauuggaccguguaucuucuucggccugcagugaaucgcacgcuugucucuccagauuuccaggcagaaucaauagugcuauuguugcuugcacuguaacuacaccaacgcccagagcgaucaucaaaccagcgccaguuguugcuguuggauugcagguacuaaacauaaaaguacaaaguuucuuuguauuucuuucaagguugauuagaagaaauaguaacuucaucaguguucacugcuaaaacucacccaggaaaaagaaauauacuggacaauaaauuuuaaaaaccaaaagaacauuuuucauaugcauuuacucucacauuccuuagucucucugcuacacgcuuaaaaacaugucuucuaaaguucagguguugaaaacuuaaucccuaauuuaacagugcugggagguggggccuaauaaaagauaauauuaggucauggggacuccgccccucaugaauggauuaaugucauuauccacggacuggguuaguuauugugacuggguugguuauaaaagcgaguuuggacaccucuugcucuuccaccuucugcaauagaaggaugcagcacuaaggcugucaccagauguggucccuuagaucagccucuagaacuaugagccaaauaaacuuguacaguuuauauuaaauauuuuuuuuggagacagggucugacucugucaccuaggcuggagugcagugacgcgaugccggcucgguucacugcaaccucugccucccaggcucaagugaucuccccaccucagccaccugaguagcugggaccauaggcacacaccacuaugccugguuaauuuuuguauuuuuuggagagaugggguuucaccauguguugcccaagcuggucuugaacuccugaacucaaguaaucuaccugucucagccucccaaagugcugggauuacagacgugagccuacagugcccagccuaugguuuauaaauuaguccgugguauuacguuauagcaacagcaaaacggacuaagauacuuuuccuagacaaaaaaacuaucuacagccccuuaucuugccauuuucuacuuuccuuuuguuucuacugauuuucccuaaaaggggaauguucaccugagauguacugaaacaaaaauucuguuuccaagaagguagugagaugauguggcacaauaaucuucaucuaaggaguguuugcuuuuugguaggauugcuguauacucagucccuuacauaacagaaaagccgcuccuccucuggagauagcacacuccuucaaaauuuacuuccagaguaaauuauucagaagagaaaccuagcuaugaaaaucccuuaagagauuuauacauuggucagagacuucuauauucuucacuacucucucauauucucuucuggucuacucuugccucaggaagcuaaaccguccugcagucauacauacuacauuacacaccuuagucaucugggcucuccuuuuugaggagauggcugucuuuucauagaaaucaaucaggagcaacacuggugugauccaccuaaaaaagaaaaaugaucuguuuugggaaagcaagaaaccugcacaaauugggaaaauauaucuuaauuucaucagaugcuuccuuuauaauuuuaaaacuacagaaguaccacaaauuugccccauacaugccccagaagagugccugauucaggcccaugucccagggaaauagaaacgaaacuaggguagauauaggguuacucacuuuggggucuggacuuccuucugcuccuuggcugccuggaggcagggcugaaccacuuccaagaguuugauuaggacauuaaggaugccacuugauucaaccacccaagcacaagguagcuucaacuccugauagaucaaagggaaaaaacaacaacaaccagauaccaauuucuacucaguaacaaagauuagcaugggauaggggaggggaacauaaggguaaauaauaauagaauugguugaguucaaauuuuaccucuuaccauuuaccaguuguguaaucuaagauguguuaaauuuucuaggcuuugguuuccucaugggucagaggaaauaauuuuuaccugcagaauaauugugaugauugagguuuuauauauauuaauauaaaguacccagugccuggcacuaauguauaugcuuaauauggaaaugguuuaucaccaagguugugcagucuauguugaaguuguaaagcuuuagauuuacagagaaauuuuauaaucuuucaaggaaaauggaauaauuaaacacaguuaaugguucgucuuacuggggcuacaccaaaguguuacuuuuaacaggaaaucacuggaaguaaauguccaaggauagguaauuauuuaaauaaauuagagaacauucaaaagauggacuaauguauauagcaaaugggaaaauagucauaauacuuaacaaaaagaauauaaaacuuucuauacagucuuaucccaauugcuuaaaugaacaggaaaaaacacuaaaagaaaauacaagacuguuacuugugauuuguuuuagauggggguccaugaaugauucucucuuuaguacucugaaaccuuucccacaaguaucuauuuacaaagugcuacaguaagaguuaucacuuccaugauaaaggaaacccccaagacagcuguuacacaguuugacucuuauauuggauuuauccccugaguuugcuguauguaaaggguucaguucauuaaguucagguuuuaaagauaaugagccacaaaugaagucauuuguccaaggucaauugccuccuaguuccuacguugguuggaucaggucuugcccaaaccacucucuugccucaaauaaucugcugacuaaauaggcaaggaaaagagagaggaaucugauuucaucuaaugucuauuaccucaauauugaccacauccaauuugcauacccuacucuacuauguggcugccaguuagguuuccucagaagagcaaaaaauauucuaugaccaagcucuguuaguaauuuaaauacuuuuuuuuuaaacuaccaccucacaauucugacucaauucaauuaaugcuuguucucagaagcccuucucacaugaauccaaagugaugcauaugacuuuccuaaacccagauaaaacuguuaucauucuaacacagaaugcuguauuuuauacguaauuauaugcauuucagccuaucagaaacugggcucaugaaaugcaggacucaugccuuauucuucgcuuuaucgucuucaaugccucauauauguuaaguguuugauaauucuuucaugaaugaauuacaaggccccaaagaucuaaaucuuaccucaaaaaguagcguuaaaagcaagauucuaguagccaaauuggaggccuggggcaguguggccaucugacuuauccacucugacacgguuuuugugucacuuguugucaggggaagagcagcuuugaucaauacaucagcagcuucccacaccuagaaaagcaaaaaaaggguuaagucacggaaccgcagagcaagaugagguuucugaaaauauucucaaccuuuuaaaauacucccucugccuccaacacauucacuaaagaaagguagguaaaucuaacauauuuaccauagggauuuagaaucuauaucaaaagauguaugcuacuaaaggaucaccacuaaacaauuacuuuauuaggcuagacuauaagcagccuaaaaucuaaguuaaaggaaaugaguauuuuaaaacuuccuggugcauacagucaaccccaaaaagguucuaucaacuuauacuuccaucagcaaucuuucauuuuaucucucucucucagaauuauuguuaaaaaauagacacuaaaacuuucugugaaaaaauguuuuauccaguuuuccuuuacuuguguucuugugcauuaaaguucuauuuuacaaagcccagaaaaaaguuuucccuuuuuuaauuucuuucccugcuucuagaaugaaacauuacauaaaacaagauuccaguaacuuaaauacaaucgaaauguuaacuggcuaucuggguguggggauuuaagguaauuccuuucuuaucccacuucuauaauuagcauaauuucauaaugagagaaaagaaaaagaggacaaauaucaggucacaaguauucaucaggauggggacucaguuguucaagcggcuguuacauaggaaaaaacauuuauucaguauuaguccaggggacgaaccugacucaagggugaggcacauuuuagacauuuuaagagaaaaguagaaaaggagagcuuuguuuuucccuucuaaagacauuuuugugugugcgauguaguuaacacacuguuucaggauuaccagaucgaaagaauccaaauagagaauauacccauaucagguagaaugaaaauaugcugauuuuucagaaaucagguuuugacacaggcaggcaaaccacuucacauacuccccucuucugaccccuugagagcucaccugauugacuacuugcuucagaaucaugucacgauaaucugcuccauuacguuugauugcugucaugaucaggucacacacacgguauacugugucuggcagcucaucaagaagguggaagcagccuggcaacauaguaucugugaaaguguggagcucaucuuguuccaacgggucagcauccuggaacuucucuagacauuuagccucuuccuccuccugcuuuucccgagcuuuccguuccucuuccuccuuccggcaagcaacuuccuggaagcagggaaggaagugugaauaauacacaggagaggugaaggaggaaagauaagagagacucugagaauguuuuugcucuaccauaugauuacccucaaccuucuccucaagcgguugauacuuucauccaggauguggcagccacaaaguuuaaggcaagacagggaagguagaagggagggaugcuucaaacaacuuucacugucaagucacuuguagcauucuauacuaccucccgcaaaaucauuucuagacacuguucuauauucugugccagcagggaaaauuaaaguaacugucaccuagaaauauacagccaaguucggccuaauggcacuacugaguacacauugggucucuuauuugacaauaaagauuaacgcuucauaugccucccuuaaagcuucaggucaauacaagguagcucaauaauggauggcaaagcugggaugaauuaguacucuucucaugucuuccuuuagauuugaauucuaucaauuaguuugcaauacuagcagaauguucacagaauacuaagauucaugugccaagcccuuuaggaugcaguguuccauaguuaccucaggugacucugcccuuugauccauuggaauauccugucccagagacauagcaauugcucucaucaucugguccucuucagacaugcugagauccuagaguguuaagagaauauccaguaaggauacacacucaaaacaaagaaacccaacaagaccacugcaacucacaggcaaucagacaucuugugcucaagcuaaagagagaggaagggccucaaaaugcugcucuuguauaagucaaacccuaucaggcuuaugugguuacuacaaacaagaacagaugaggaaaaucacacguaaaacuaaguauaggaaggaggcuuacagugugaucaucuauucuacaucuuagaaaagugugccucuucuauuguuuugugacuggggguucuugugcaaacaaaguauaguaauuuguauugcugggggacagaaaacuucuguuauuaugaaaagaaaauacuggcauggacaugucugaaaaugagaagcaguuuauagaaaggaagaccaaugacagaauaauaaggggaaaaaggacuucagcagucaaaccaauauccuggaaaaucacugcuucugagccaacuuacccgaacaacuccucccaugauuggaggaggguggguuaaaagguacucuguggccugcuccauggugcugguguucaacagugccuccauugcauguucccuugugaagcccauguccaugagcuacauaaagaaugcaagggcucagaaucacauaacggaaauccaaauacauuuuuaaaaggaaggaaccuuuucaagauggaaauaacuuuuucuaacuucaucugggcugagagcauuuaugagcuagggcaauuagguaaaaugaacaauccuuucuguuuggugcuucuauagcauucuaagcuacacauuggguaaggagccaagaagauucucgauuucauccucuaagaaaguuagggggggaugcaugguuauuaugauuaacaggguuauuauaauuaaaagauugagacucauacaaagaaguauaaauuggucccaacuuucuggaaaacaaacugguaacagagcaagugccugaaaaacugaccuaguuaaucuacuaccaggcaauaaucaugagauguauguaaggauugguacguaaggaaacuauacaacacaguguuaaaacaucaaacuguaagaaaauuagcauccaacaauaaaagaaugaccaauuaguaaaaaaaaguucuugauaacagcaauacaaguauauguauuauuugauguuaacgacguaaaaauuaggcacaagacugacugaaaaaggagacaaugacuaucuugugugauaaaauuacgaaugccuuuuaaaagucuuguauuuuccaaauuugguaaugagaguauuuauuacuuuaaugauaaaaaacgggacaaguguauauaguagacagauuugaacaggacuccagacauaaaagcugacacacauacauacaaacuccaggaagaaaaucuuaaaaugcucuuugagauggaaguggcaggacuuuacaugccuuuccccucuccucuuucuggccucccaauuuuuaaaaugccccuuauacauuuuauuugcaagugaaaacaaaaguuuuguaggugacuaagguuucagaaagcucuuguuggagaauaaaucugguucacaauauccauucucuuuacagguuaaccagaaaguaacugaggacaguuugccuccacugaggcagcaggaggcuacugagaauacucaucaacaugcuugaaaggaguauuaccugugcagagcaucaggacuauacuccaguuuuccucaggagaaaaaaaauaaauacuaagagaaggaggaaaucuaaacugucuccugguuaaugugaccagggacucagugguaugugagcuuagaaaauccguaagcaucacacuccauugggugcaaagucuggacccuggagugugaggccaguacccuaccuguugcaguuguugcugguugacuugagguucccggcgggagccaccuuccucuugcccuguauccucuucuccucgagaccccuccuucuccuugcuuagucucucucgaaucacagguucuccucggaggauguggcauagaauggccagcaucgauucagccauucguccaccauauaccuucagggguuuccgguuccauaaguuuuugaugcaaguaaaggcugccuguaaguaauuugaaaagugugugaaaaucauuuugcuucaauucaaagcucagaaggauuaaguuaaagaccuauggaacaguccuuccacaacuaguaccagcaacaaaauaauuggccaacaugaggaggucuaaggaggcacagagaagaggcauuuuacucaaccuuaagcagugauacaguuuggaauauuugcucugcccaaaucucaugcugaauuguaauccccaaugcuggagguguuugggucauggggguggaucccucauuguuuaguguugucuucaugauagugaguuaguguguaccacccccuccaccuccuggcuccugccaugugacaugcaagcucccacuuaaccuuccgccaugacugugaacuuccugaggccucccuagaagcccagcagaugcuagcaccaugcuuccaaagcuugcagaacugugggccacuuaaauaucuuuucuuuauaaauuacccagucucagguauuucuuuauagcaaugcaagaacggccuaaugcaaguaccaaucugaaauuuacagcucaaauguuuaucacggaaaauucucaaauggucuauauucccuuacguaaggcagcccuaucugggaguuggauccagugguucuuaaauaagcauguuauuucauuaagcaggacaaaauagagugggaacgacuuagcaugagaaauuccuuuugauuuuagaauacugaauacucacuuucugaguuaccacaaggaagcgcagugcacugaacuggggaaaguucuggacaccuccaggcaauuuggcaggcagcgaauguggagauucaagcaccguggugggauucaccaucuucuccaccagcauaagccaggcaucuaggaauucuccugugccaucaggcaagucugaguguuccaaucccucagaaacaggaacuuuaccucccauggacagagcccaguugaaaguucuaaauucaaauaaggaaaaguagacagaauauuaguauuuuacccuggcaagggggguuuacaucuaaaagguccccaaucucuauauuggcccuacacgucccucuucuuagagcuauuacgucuaaucuguccaacaguuuucagcuauacuauuuuuuucuuuuguuccgccucuccuccguuacuuuuuagagucuuaaaaaccuaaaccagcugggcgcgguggcucacgccuguaaucccagcacuuugggaggcugaggcggguggaucacgaagucaggagaucgagaccauccuggcuaacacagugaaaccucgucucuacuaaauauacaaaaauuagcuggacgugguggcgggcgccuguagucccagcuacucgggaggcugagacaggagaauggcaugaacccgggaggcggaccuugcagugaguugaguuugcgccacugcacuccagccugggcgacagagccagacuccaucucaaaaaaaacaaaaaacaaaacaaaacaaaaaaaacacaaaaaaaccuaaaccagugaaacucaucuugaaaucaucugaccaagaauagcagaaaaauuauauucagagaaacaacagaaaaagacaaaccuauuuuaaaaacccauacuuggaacuggaagccacaugagaaaaagcagagacccuuacaaacacaacucuaggggaggcuaaauccuacccuccaagguaaauggagacaaacaugguuacuucccagaacacugaaggauacaaccaauagcuauuucuauauaucccacuguuacaagauaggguacuuaaaagcagugggcugggaaggcacacagcaaagaucaaacuccaagaaaugcuccucugugaagcaacuugauccuuacucaaaaagagcauuguggccuccggagcagagaaauuuuugcagcaugaggugguagggauacuuccucucaucaaacagcauuggggaugugaaaccaacugaacagaugaagaaugucagccugaaaguggaaaaaaaggcaaaacuuuaaccuucuguaaagcagagacagaagcaauaggaaauucauguaaaaggcaagaguaaaauuuacacacugaagugacaccucccaccuacuaaagaauacaggaugaguaucccuaucagaaaauucaaaauguuccaaaaucugaaacuucugauugcugacgugacgcucaaaguacauguucaugggagcauuucagauuagagaugcucaacugauaaguauuccgcaaauauuccaaaacccaaaaaauuccaaaauucaaaacacuuucuggccccaagcauuuuggauaagggauacuaccuauauaagaccacugaaaugcaguuugacuguaaauacuuaaaauauuacccauguucuguacuagguacaaccaaaacaaguaacuuacacuucauuuucuagaguaaacaagggaccuccaaauucucaaauucaguggcucacacuccauuuuaaguaguauaggaacaacuuacauauuuuuuauuguaacuuucuagucccugaaucucaagcugaacuucaccugaaucggggaguagguguauauggugggggcugccaagauaaccccuuagucaagagcuuagugagagcugaggcuguugaucgcgcggcaggugucggugcuguaguggugcuggcagcaugauggcuccuucucuggcggacaggagaucccacacaaaguuuaacaagaaguccaaauagcucagcaagugcucggccuaaucuggaggaagcugaaacccagaaaucagaauaagacuguacaguauucucagaaugguuuaauuacaacagacauauuaccauuaacauauuuuuaugacucaccacuuccuccuacaaccccuaguuaacacuuggauuuguucuacauucaauaauccaaaaaggaagucccacaaggaacaaaugccacuuuugacgguaggagacagauauguggcacucaacagauaccaaauguaaaagacaaauaagcacucauacugcuagaggaacauaaauugaaaccauauuuaaguuaaaugauaucuaguggaugauaaagucacuuaaaaugccuacagaaaacuuuuaaaaugccaaaaaugauuagccacuuagauaagaaaagaucacugacaauauacauagucugaucacaacaaaaaauauguagucccagaggaaaaaauaaacuaggaaaagcaggaaaauuuuuacaaguagcuucuuaaggaauugggcagauuauggacaucucaaauuuuccauuucauaggaugcuuuucaauauauaauucaacaaggaaaaggcagcauacaaauauaaacauauguaaaagaaaacacaaaaaacugagugcuuuccagcuucucuuuaaauauuucauguguuuuuauauuucuacaaugaaauauacuuuuaaaaucauaaaugaaaauguugccauagcauuuuaaaaauaaacguuauuucacguuuuuucaugaaacguuauuucaugauccagagacaagaagggcuaggucugaaucaaaguacagcugacgcuugaucaacacagguuuucaacuauagaugccuacuuaugugugaauuuuuuuucaauagauauacugaaaauuuuggagauuggugacaauuugaaaaaacucucagaugaaacauguagccucaaaauauugaaaaauuaacaaaaaguuagguaugucauaaacgcauaaaauauauguagauacuagucuauuuuaucauuuacuaccauaaaauauacacaaauuauaaaaauuuaauauuuaucacacuuaugcacauacacuuauacacggugccauuugcaguaaauaagcaguauugaguaacuggauaaaauuuaguacauauuauacucuguaauaauuuuguagccacgaccugcugauacuguggugagcucaaguguugccacaaucugcuuaaaacacugugugaggcuaagcacuucuacaugaacaguucaucucuccaguaaauuguguagugaucucucaugguucucgcauuguuuuucauguuuaccgcaauacugaaaaccuggaauaaaccugggucacucuaugaccccauaugaagugucacuagugacguuggaagugcucccaagaagcagggaaaagucaugacacuucaagaaaaaguugaauuauuugauauggauugcagauugcccaccacuucaggaaaaaugaauucaguguaaagaccauuguaaaacaaacaaaaggaaauuagugaagcuguugcugcagcuacaccagcaggcuugaaaaccuugcacuuuugugaaaucuuuuuauuucauauugaaaaugcacguuuauguggguacaggauugccauaauaaagacaaaucuauagauucuaaugcaauucaagaaaauaaugaacucacuauaugaaaacuuaaagcaaaaggaaagugaaggaucuaaagcuggagaauguaaagccaguaaaggauaauuugauaauuuuagaaagagauuuggcuuaaagaaugucaagauaauaggagaagcagcuucugacaaccaaccaacaggcaacagauaaguucccagacaccacuaagaacaucauugagaaaggguaucugccugaaaggguuuuucauacagacaaaagugcccuacuuugaaggaaaaaaaaaaaaaggccacaaaggacguuuauuaguaaggaauagaagugagcagaaggauuuaaggcaggaagggacagacucacuccucuauuuugugcaaaugcuacuggguuuauaaucaggacugcccuuaccuauauagcuccuaacuuccgagccuugaaggagaaagauaaacuaccagcugcuggucuuuugguuguacaagaaggccugggcaacaagaccccuuuucuggauugguuccauugauguuuugucucugaagucagaaguaccuugcuaguaagggagugccuuuuaaaguucuuuugacauuagacaaugccucuggugacccagagccccaugaauucaacacaaaaggcacugaaguggucuacuugccccccaaaaccacaucucuaauucagccucuagaucagagagucauaaggggcuuuaaggcuauuacacacaguacucuaaggaaaggauuguuaaugcuguggaagagaacccugacagagggaacaucacgaaagucuggaaggauuacaccacugaagaugccaucauugucacagaaaaagccaucaagccugaaauaaauuccuguuggagaaaacuguccugauauugugcagaacuuaacaggauuuaugacagcgccaaucaaggaaaucacgaguuuguggauauagcaaaaaaaaggucaugggugaagaauuucaggauaugaaucucagugaaauucaagagcuaauaaacaccacaccagagcaaguaacagaagacgucuugauagagaugagugcuucugaaccgauaccagaugaugaggaagaagauguagaagcagugccaggaaccaaagugacauaagacaaucuggcagaggguucugauuacuaaagaauacuuuugacuuuuuaugauguggaccuuacuaugauaugggcaccgaaacuaaagcaaacgguggaagaaaaauugguauuguacagacacauuuuuagagaaaugaaaaagcaaccaagucagaaagaaaguacuguguauuuccacaaaguuacaccaugcauaccugccuuuccuucuaccuccuugaccuguucugccucugcuaucucagagacagcaagaccaacauccccccacuuccuuccuccuccucagcuacucaaugugaagaccacccagaugaagaccucuaugaugauccucuuaaugaauaguaaauauauuuuucucugaagauuuuaacauuuuccuuuaucuagcuuacuuuaagaauacaggauauaauacauauacaaaacguguguccaucgacuguuuauguuacugguaaggcuucuggucaauagauagcuauuaguaguuaaguuuuuggggagucaaacguuauacauggauuucugacuguguggaggaguugccucaacccccauguugcucaaggguuaaaucuaugucuuuucaggauauacaugcacauauaaacucaguguguaaaaauaggcucuacuugagccuagguuacauauccugcuaaaauuuaguaauaagcucaaauguauacaguauaggaacaaggaaaacaguccuuucuucuuccuauuacauccaaauuaagauuucuuuauccuaauuagggaauagucuacagauauggguauacccagacuuugaaaaccuaaugaauccaaucauuggguuuacacuuucucaccacugcuuucaggugaacagauagcaaagugcuuaaagguaguccaaagacaagaggauggcaaaaggccaguaaccaaagagaaacaguauauggacuggguucacacagaaaccucugaaugcuccaagaucaaagaaauaugacaaagcaaggagagagaaauaugaacaucuucuugcuuggucaauuuuccuuugaagguaauguugguagacuuucaaauuaaaauaaauggagaauuaaacuaauuaaaaguaaaauguaaaaugcaaugggaauuugagguaacaaauggaaacaccaaaggccauuuucuguuugcuuuuacgaagggccccagauuccucuaaguuaggucuccauuuuccucuauauuaaggugccagaaagugacgacaauuuacgaacacacaaauagguucccaaacauugguauuacauuaaaggggaaaaaaaagggcaaacagaccagugcaaaucauuaaugcaguuuuguaugcugccaauacagucucaauaaagcugccaaagugacuuuaauauaaaacaccuaucagacuaugucucuugccaguuauguucaaggaacacaaaaagagaagacuagguggaagagccagauaguuauccgagaaucaagauagcuuaauaacacaagcaccaaaggaagaauauuucuagauggagauggugggucaacuaccaugcugcagacaagugagaagggacuuaggacaaggacguuguagaugccuugcugagacaucucagugaaauggaaggagcagcaacaauaugcaauaguugaagaguaaguaggaggaagaaauuaaagaagggaggguaguagauauggcucucaggaagggauucugucaugucuguauccguagcagcuaguacaaagccugucacauagcagccacucaacaaaggacacuuaaaaaugagucacagaaguuuuaaacuuccuuaggugaaacaacauagccuuuccaacucaaucuguuucaagacuaagggacugaaagccagaaaagguaggagaaaggagaaugacucaccugauaacaaaggcuugauuugcuuaauucuggcagccauugcuggugugauuuuagauuugcccuuagagucugaagcaguagguucaucugucuccaugggagccaaugugucaccaucuagcccaaugccuucuaauaagcccuggguagaagcauccauacuuccagcugcuccauccuguuccccaucuacagauguauaagaggggagcaauaggacaauguagagccaacauuuaccugguuccuugagaaguacugacaagauuaccuaugguuuuuguuacucuuucaauucccauggcuuccuaaauuugaaaaacaaaaacacgacccaaauauuuuacugauaugcuccucuggaguucuaaguaccuaaugcugacaucuucaaaugacagcauaugaauaguauuaacccagggcuaccuuggaagacuguuguaggcacagcccaacccaggggguaccauucacauggacuacagugugcacaguacccaaugcugucaauguggaugcccuacuagaauguuauagcuuguuaaguucaaacuagacaucacagauuaccacuggacaauuuuauuuccuagcauuuaagaauuauguauaugaaugugacaugugucuuuuucuuugguauaugcuugcucuuagaucuaagaaugagcuuuaugcaaacuuauaaaacaagucaccaaguuguucucuuaacauuccagaaaaacuguggagaagcugagucguuuuuguuaaauguguuaaauugcuagaaaaaauauaucuguuagagaggcaauucuuugacagugaaucuaauuucauucucaguucuuagucaauuuauucuuucccugaguuaaauuuaguauguuuugacuaaauuugaaauucucauuuugucagguuucuuuauaguuuauuaauguuaucccaucccucacaauaaccagcugucauauguaaguccuuguuuguugguucuaagccuaugucagcuuuauuaguuccuuagaaauuucccuuucuaguaauuucuguacaaguuuuaagccugauaccuuuuuuuuuuuuuggagacagggucucgcucugucaucuaggcuugagugcagggguauacucauggcucaccauagccucaacuuccugggcucaagcgauccucccaccucagccucccuaguagcugggacuacaggcauguaccaccauggccggcuaauuuuuguauuuuuuuuguagagauagaguuucgucauguugcccaagcgggucucgaacuccugggcucaaacgauucaccugccucagccucccaaaguguugggauuagagacgugagccacugugccuggccugaugcauuuuuauacacagaauuaucuucauugcuuucuuaauaguuuauccuuuuuuauuuccucauugauacugaacaccagagaaaaaacauucuggaaaaguugcuuguauucauuuuagguuuguagcauuagagucagaaaauuguguaugauuucuacuuacugaaauuuggaauuuuuuuuuuuuuuuuuccugaggcgguguuucgcucuuguugcccaggcuggagugcaauggcgcgauuucggcucacugcaaccuccaccucccagguucaagcgauucuccugccucagccucccgaguagcugggauuauagguaugugccaccacgcccggcuaauuuuuuguguuuucaguagagacaggguuucuccauguucgucaggcuggucugaacuccugaccucaggugauccacccgccucagccucccaaagugcuaggauuacaggcgugagccaccgagcccggccaaaauuuggaauuuuuaucaugagauaauauaaaagcaaucuucuuuauaaaacagcacugucgauagaaauauaacaugaaacacauauauaauuuaaauuuucuaguagccacauuaaaaaguauuuguuaauacccucugauacaguaauuucuaggaaucaauuuuacauuuguagaaaaguagauacaaaaauguucauuuuuuaaaaauagcauauuagaaacuuaacagggaauaguuaauucguguaccuuuauaugguaccuaacauuaagugaagaaagagaucuacgaaauguuuuuaucuaagacacuggcaaauguauucagagaaaaaagacgggcagacacuuccaaaauguuuuuuuuuuuuuuuugguggcagaaauacggguaauucuuucaacuacauuuucuaaauuuuaccauuauguauauauguuuuuauggaagaaaugacuaaaaauuagugagaggaugaaaacuagacuauggaugauagaacuaacuaaaaauuuucauaauaaaccuauaaagacguaggaacaaaacuuagaaguaaugacuaacauuuuaguuucuuagaguuaccugaucuuuuuccgcccugggucguaccugccuucucauccuuuggaaccaguuucugcauaucugccuggccaaauucacacccagaugguaggcugcaaaaagagaaaugcugagcaaaagaaauauauauauauauauacugauaauucaccucuuauauuguaaauggucucuaauuugcuuggcugacacuaucccuccuauagcaggcagguuaaacugaauguaauaaagcaucuauaauuccugagguagcaccccacaagcuuuccaauucuuuuuuuuuucuuuuuuuuuuuuuggagacccagucucacucuuucgccugggcuggagugcaguggcaugaucuugggcucacugcaaccuccaccuccgggguucaagcaauucuccugccucagccucccaaauagcugggauuacaggcgcccgccauuacgcccagcuaauuuuuuguauuuuuaguagagaugggguuucaccauguuggccaggcuggucucgaacaccugaccucuugauuugccuaccuuggccucccaaagugcugagauuacaggcgugagccaccguguccagccacaacucaauuuuuuguaucuggcuaauaacaggaacacauuuuaaacaucuaccaugacgacaaagcauuugucaucaaguuccuaggcugggaagagggaaggacaaggaggccucugaacucucuuccauacccuccuauccccaaccaaagcaauccuccaggcucaccgaacuuagauaacaaaguaauaagagagagagccauucucuuaccuguuugggguacacagagagaggaggacagugcuuucccacaccagggaacaguauaacuggcucagcuugcucaaaacacucagacccaauugagagccccacugguuuacggagauggaacgaauuucacucugcaaucauaacaagaauuucaccuuugggauguucucugaacaauuauacuuaaaaaaaaaaauugaccuucaacaguuuuauaaggguaagggauuuuucuucauugcuauucucagaguuauccaccucaucaaaauguccacacucaagacgacaguuccacaagguauccucuuacaauauuuacaaacuauuuccacaacauccguucucauuguuuuuuauaaagugaaagaaaggcaucagaggcuacucuuuuuuucugaaucaaagaaaugguuuuacagguucauuaacuacuuucuaaauuauuugguagggguauuauuauuuccauucaauuucuuuacuucaguaaguaccuagauuuauuuaauuccuugaauguuucauuuucauuuuauuucauuuaauaaagaagucauaaaaaucaaucccuaagcuuuguuaaguaauuuaauuuucuaaauccuuuauacuugugcuuuuuuaaacuucagauuugauugauucacaauuaacagagaacacacuccugcucaauagcauaaaacagggcuguugaacccuguuuuguuuaauguugauaccauaaaucuuuagaaucaauuaucugaggaauaaauguaguaaaacugugaggacauacacaaaaugccuucuuucuggaacuauggauuauggauuacaggucaaacguuugauauguagaaaauuuuuaguaauuuguuaauuacuauugauuuaaauguucuuugguaaaauguccuaccuaugccaucccauuaucagaccuauaaggacugguggaaagauuagaaaguacuaaggccagaugaauacccaauugauguuugucuguaauaacauguuucgcucucaagaaaguccacuucaucacauaauaaguuauauagucacucaacuuuuugacagucaaaaaaaucucauccuaaauuggacuguucuuuuagcugcuaccucaggcagaccuccuuucaagcauaguaacccugcuagguguaugcccuagauauuucacugccuuuaaauuaauauguucaccccuaagguuauuuuuaccuguccaacucugcaaguaugaacaaacaucaugauguaggcaugggcagcagugagugcaugcagcagagguguggccugggcugagaggguagcaucagcaacauugccugcgcaagccaguucucgcaacaacacugagcccccaggggauucaauggggcgguguaagggcuccagggaggagaggauggaguccaacugaaggagacccucuugaaggacuuuggguucaugugacagugucugaaacaggaagaauaauuaaaguguuaauauacaaugaacuucaaauucaucaugucuuuuaauagucacaauggaagugacaauuaaauggaagccucucagauuuuggauauggccauggucucucaccugguaaaugguggaacccaaauaugaagucagguacaacauaccuuaacaucucuuucuagagcaacacacuacuuucaaacuuggugagccaauaacacuuaaaagcuuaugauggucaaacugaauacuguuacggcaaggauucuacacuauaggauuaauuccaaauuuugcucgauaggaaacaauguuaggcaaaguuccaaagcauggaagugagucacuauuacacuguucuuuucuucuuaaaacaaaagcgauuauucugagauaggaaucagguaggcaauuuguuuuuaucagacaacccaaggauuauacgacccuugugauuuccucucaagucuggagaaaaaucugacaauaaaacaccaucacuugccaugcaaagauaggagaaaucaugugccuuccuauggcuuuaaauaaaucuaucuauccuuccacagcaucuuauaggauauuuuccccucucugugaugaagagcauuuaauucaauauuucaaagaguaaaacaaaauaaacuaaaugaagucacgucacaauuauggaucuuuccaagucuguaagcaaauggauuucucauucagcaggaauuacuuaucacucugcagcccagcuaacaaaggaguuucacagauuuaaugcaaucacuaucaaaauuccaaugcuguuuuuuguuuugguuuugcagaaauagaaaaaucccuucuaaaauuuauaugaaaucuuaagggaccccaaauagccaaaacaaguuggggaaaaauuuuuggaggucucacucuuuuugauuucuauuacaaaguuacagugaucaaaacugugauacuggcauaaagacagacguaaagaccaauggaauagaauagagagcccagaauuaaaucuucacauauauauggucaaaugauuuuugacaaagguaccaagaccaugcaauaggaaaggacagacuuuuaccauauaaaaaaucuaaucaaaauggauuaaagaccugaauauaagagcuaaguuauaaaacuccuagaagaagccacagugggaaagcugcaaaacaucggauuuggcaaugguuuuguggacacgacaccaaaaacacagguguuuacacaggcaacaaaaacaaaaaaagagaagcugaacuuuaucaagauuaaaaauguuugugaauccaaagacaaccaagaaaaggcaacucacagaacaggaaaaauauaugcaaaucauauaccugagaagaaauuaguaucagguauuaauacguguacaagaauacacaacucuuacaacucaacaaaacaaauaacacgauuaaaaaagaacaaugaauuugaauagacauuucuacaaagaagauauauacauggauaacaagcacaugaaaagauguucauuaucacuaugcauuagggaaaugccagugaaaaacaaaaugagauacacuuccuacccaccagaauggcuauuaucaaaaaacagaaaauaaguauuggcuaggaugugggaaaauuagaauuaaaaguagagucucaaagaguuacauguacauccauguucacagcaucauuauuauucacaacagccaaaaggagaaagcaacccaagugucaaucaacagaugaauggauaaacaaaaugugguauauacacacaauggaauauuauuaggccuuacaagggaaggaaauuaugacacaugcuacauaaugguugaaccuugagggcauuaugcuaagugaaaaaagccggucgcacauacaaaauauuuuaugaucccacuuauauaagguaccuagaguagucaaauuuagagacaaaaaauagaaugguaguugccaaggucuggggagaggggaggaugagaaguucaauggcagaauuucauuuuugcaagaugaaaagaguucuggagauuggcugcacaucaauaugaauacacauaacacuacugaacucuacacuucaaaaugguuaagaugauacauuucauguuauguguaguuuaccacuaugaaaaaauaaagaagcuucauuuuuggcaaaauaugagcaaugaacuaccaugucaauuaugcuuaaaauacaugacuaucgggcuugaaaaggggggaauuaaguaucggcaaugaacuacaugucaauuaugcuuaaaauacaugacuaccaagcuugaaaggggaggaaaauacaugguuaaacauaaccauaaacauaaaauguguuuaaaaugcaccuauaacaaagaagggagagguacuaauaaaacccaacuagaaaagcuuucuuggagauacacuuuucccuccaauaaacucuaaugauguagaacuacauacccaaccgaugaacaaagaaaaaauacuuugacuuuucaaugagaaauaacauggcacacuauauauuagucacaaaauucacuuauacaacauaacacaaauuuauucauuauuuuuuaguugaagggagaccauaguaaaaacauauauacagaaguaucgcaaaauugauuuccagaaagaaaugaaaacauuuggccagaugcuucuuaccaauauggauuugcagacaccugcaacagccugacaggcagcagaugugggaaagucaaugggcagauugggaagacccaaaaugguaaccaaaggcaacaguccuuucugauucacaaauuccuggcaguggucaucuguuguauuguugcucagaauagauuccacaaauuucaucuagguaauaaaaauuuuuuaaagaaguuagagccugacagguggaacuaaauggccagccuggaauaaggaugggguagccuucuagucaugauauuaguguuuucuauagaguaucaaaaccucagauaaaccagauguaugauacggauucuaaaacauccaggaaguaaagaauaucuacaauuucugcccaaucuccauuuucaagcacaccaagaaucagauauuucgagauaacagagaaguuaagugacuugcucagggccacauuaugaauuagugguacaaucauguuuaaucucuuaauuugcuauuuagugcuccuugccuaccucucuccugcaggcaaacaucauggaaaauuucccccaaaugugcuuauaaugcaaaugaaacgcauaaugcaaaugaaacacugaacucuggaagaguuuguuucaaacaaagaauuuuuuuaagaguaaaaaaguaaaaugugggcaauaaacacacaggcacaagacaaacuaucucuggaagucuuggaagugauuaguaggcugaaacaaaugcuaagaggucucucccuuauugguaaacaauucugggaaaauucaaacucuucacuuuuuuggugagauacccaggaaguaaugggaaaaaagggggaaaauauauguuggacacauuuggaaaacauauuacagguuguauauuucauauucgaaaugcuugggcaccaugaguguuucagauuuuuauuuuugaauauuugcauuauacaguacaggcugaaaaugcuccagugagcauuucccuucaguguuauguugguacucaaaaagguucaaauuuuggagcauuuuggauuugggaugaucagccuguacuagacuggcaaaacaaaaccuguuacagauuccugucuggauucuaauggagaaugguaacagugaacaaaaaaaucuggaauacaaaauaauggggcuuguguuggcuaauuucuggcaaaccagucuagaacaaaaacaaaaggguggcacaucuuuccccucuuaauuggauuccaauuaaaaugaauacgguaauuacuggacucugauaacgaaacacauuuuccagaaaagcacauauacaucuuuacucaguuugcccuguguugaaucuuaccacauuaaggauguaauccaugaggggaauaggaauacguuccucuguaccaacaacccuguuaggggagaaaagagugaguuacacagaaauucacaauaccaauauuaagagaacagaggaggaggcacuguauaaaauucuaggccuuuuucuauuuauuuauuuauuugcuuauuuuuuugagacagggucuugcugucacccaggcuggagugcaguggcacaaucauggcucacugcagccuuugcuucccaggcuuaugggguagagaugagccuuuagacucauauaccgcaggaaaaaaacagcugaaaucaauccugaaucuaccuuuccaagccugaccaagguugaaagcauaaaggggacaaccaagccuuuaaaaacucaacauuaguauacaucacaagagaagcuauccuaucuuuggcaaacuacuguuagggaaauuuauccacaugagaacacuaaaaauaaguucaauuaaaagacucaacauuugcuugaagaaagaggcuagacaaagaaacacuuaaacaucauacgauguuuuugcaucacguuuaaaguuauggagaguaggaaauacaauuuaauuuaguucaaagauucauacaccugaggucucccuucccuaacaauugguauuugcagcaugacaguuccugaacuaucaaaaaacugaucaggucuuuugucuuuucaguugcuucaauauugcacagcagaugagaaggcuacaacaugccacagcugcagaaaaugcagcucaaugcaaaaaacuacacauauaguauauugugaugaaucaaaauauaccucuaagauaaaccccaggaaggaacaaauacuuuagaaaauggaguauuuuggacacaggcccuugaaacagauuugggcacagggugcaggagagcgggauggggcagagacagagggagagguagaggaagaagacaagaaaguuggcaagaagcuaguaguucucaucuuugagcaagacaaaauguaaacaaagauuugccaggcacaagaacauuuggcagcagaauauagaacaggaaaagagaguggagaggcauuaugaaugacuucagugacaaaaauacccagaaccagguuuggguaggauguugugaaccuccucaaugaaaaauguggggaagaacuuuguagaaagggaguauaccuauaaggcaagacugaaaugauuccaugagaagaccacaaaccuuucuuuaaguuccuccucagaaccacugcagcauuccauguuacuuauaucaauuaccuauauagauccaccucuaucgauaaggagugcagguguggaucccgcccagagacacccaacccuuugaagaagccagauauaauggcaaagagccuaaguaguaaaaucaaaugagaccuauaugcccccuucauuugcuacauggaaacuggggagaagaacagagagaaagcaaaccaauagugguucuuaauauaauuucaggaauaaauuuguucaguaaccacuuuucuccuuccccucaucuuuuggcucucaggcccaagaagccauacaggaauaaucaaaaugaucaacucuuuccaacaggacucaacuuaccaacugauuucaagaaaaguccuucuaaacuuccugucucucucccuuuccccaaacauacacacauucccaaacucuggucaauuuucaguauuuauggugguggagccccagcucaugcccccaucaaaaguaaaggaggauaucaauuuagugucauaguaugauguauaugggguuuuuugggauggggggauggucaggugcuuccuccagcuuuugaggagacagcugacucugacaaaggagcccucccagugggccacauuucagggaacaacugcgucucugcacucauugccuuuaaauuccagacaauugcuauucaaguucuaaagaugacaaagacuuuauauaguccauuucuuucaagcugcucaugaguggugggugguaagcuaggcacacuaaugcaaucaaccacaaagugaaccgugaugcaccaacuacaaacccugguuacuuaacugcuaaguauauucauccccagcaauaucagauuuucugagaucaaacaauucagaaggcagaagaaagggggcaaaagacagguauuuagaacuacuuguggugagugagucugaguguagaaaggcaccccacguaccuggcguagacuauagugccuaaguuuccuuacuccaaaucuccagcacaaaaccauguauuucaagaguaaauacaaacaccauuugcaaauacuagcugcugauuuuguaaaaaaaaaaaaaaaaaaaaagaaaggguagugucuaagccuggaaaaaacucagaaacccaaguccaucaacaggaaaauggauaaucacuauacaauuaucacauaacagaauacuacucagcaaugaaaaguaacaaguugcugacagaugcaauaacauggaugaaccuccaaaacacaucaaacaaagaagcuagauacaagaagguauauacgucagauauaauauacacauaagacuuuauauggucauuuuauuuaaacauauucuggaauagacauaauaauaugaugacagaaguaagaugaguaacagucucaauuuugggcagggaaacuggaaauguaaaaucuguauggaaaucauaccugaauuuaaacugcugauaaauuggccaggugcggcggugcacaccuguaaucccaacacuuugggaggccgaaguggguggaucacaugaggccaggaguuugaggccaacauggcaaaaccccaucucuacuaaaaauacaaaaauuagcaaggcaugguggcacgugucuguaaucccagcuacucaggaggcuaaggaccgagaacugcuugaacucgggaggcggagguugcagugagcugagcucgugccucugcacuccagccugggugauguagugagacucugucucaaaaaaaaaaaaauaaauaaauaaaauaaaauaaagauaaaaguuaaucauuuuauguguguauaaggcauuggaaaacaaaugagagcaugggaaacagaaauucggaagaacuauggauauggaggaagggaugggcaagacuucuggggagaagggugacacauauuccaaaucuuucuaagcccuuucaccauauugugagaaaguacacaauuccccuauaacaauugccugggauagaagauaaaaagaacuuuugcuguuaauauauugugguuuucaaaaugaagcuaaguuuagacagucucuugcuuuuucuuccuucccuaauaauuuacuuagugacccaaucuaggccucugaagauggcaaaagugaaaaaauguaugugucaacaucugugagacuccuggauuauccaaaugaggcagugaugagcauccagaauguagaaaacuacugauacugggguacaguaacuacuagaguccucugcaucuuagaaguuacauauaacuaucacugugguagaauauuaaugcuacuggguuuauauuucuaauuucucuucauuuucauucaugucucauuaggccuagcucucuaagcauuuaagacuucaggaauccuucauuuaaggcucuuuauucauuucaauaaacaaaccuacugacuaccuacuauauacaaagugauagggauacacuggugaaugaggcaaugucuugcucuugaggagcuuauaggugagugaggaaaaccauuaacauguaugaauaauuuuaacaaaacuguugggagaacacaagauugaguucucauuuggagguaaaaaaccaaccaaccaaccaaccaaccuaccuccuucaagaauaagacauuugaacuagccuuacagaaaucugguggauguaaaaggaggugaugugggaauggggauggcuguggauagaacacagugauacaugauagcccaagaaaggaaaggaggguaagcaaaugaggguagugugcugauuaacugugucagcuugaaaucugggcacaucagauguaaggcaucuggaaaauauccagguagggacgucacaugcagaugaauauauaugagcuugaauuaaaaccaccaccaccuacaccuuaaaauuuuuccuuauuuguagccaggaaaaggaaccccacacuccaguagggucacugacauucaagggugugacaaaggaagcacuaagacucgucuacaaaaaaaagucgugcuuuuuuccaggguguccuccucuucuagaaaaagaacauuuaaaagagaacaaaagauacugcuagaaugaagauagguuugccuucucagacaggguaagguaucuguucaacaaagcaauauacuuaguaguuaaugccucuccuuaaaacacuugacacccacaggcucaucacuauuuagaguuccaagaggacauaccaguuucggauucuaggccuuugcuccuguugucaacuccaccuuaaauuuuaagucccaaggugccauucaggaccagcucaaaugcauucauagcugugccuaaaaugcucaagcuuuucucagaaugacuuaccuacacacuaaaagaccacuuauuauaugagggagugcaggacuguccagaaagaucaaucccauuuucagcaugcaggugacuaaaaguuacagguauacaguuacaguucaucccugguaugugaauacugcucaaagagccugguggacuacccccuaccaaucacuaagccuuuaagcaaacucccugcuuccaucuaagcagucaauucuugacuauuuacagucauauaguaaauuccaaagccuucuacuaauuaaucuggaacgaacagauaguaacaaaaugaacaaaaauaaaaaaacaacaagcaacaacaaaucuucacacaccccuuaaggacuucuuaggagacaggcuucaaaaguacauuguuuuucacacgugccugaaaaaaaucaagcagucgauguggaauaucaaaucaacaaagggaaaauaaggucucugugcaaaguccauuaacuugauggaccaaauucugauucaauuucaucaacagcuuuuaagaaugagcacuuccuggccggaugcgguagcucacgccuguaauccuaacacuuugggaagccgagguggguagaucaccugacgucgggaguuugagauuagccuggucaacauggugaaaccccaucucuacuaaaaauacaaaaauuagccaaguguggugguaggugucuguaaucccagcuacuugggaggcugaggcaggagaacugcuugagcccaggagguggagguugcaaugagccgagaccacaucauugcacuccagcaugggcaacgagagcaaaacucucucucaaaaaaaucaauaaaaauuaaaaauuaauuaauuuuuuuaaaaaaagaucacuuccuaaggcaaccaauacaauuaaauaccaaagcacaaaugacacacaagggucaaaaaaggaaaaacuaauacauucuuagaaccgguuagaacuuuaaaaugaucuaauacaacucucuugcuuuuuauagaugaaaguguucauuaagacuuagagaggugauaacaugcccacgauuauauggcuagaugaucuguucuguaaacacuuacugcugauuaggcucaguuucauuuugcuggguagaauuaaagcucugcauggccuguacuuccucuuccuccucauccucacuagaggcuucuucugcggcaugauuagaccuugggggaggagcaguggcagugccaucugccuucuggauugauggcuucugacagauguauuuggggucccuuccaagauuacagauuucuucaaguaacugaaaggcacaggaaauaagauuacuuauuaguaaucauggaauggggaggaggagacagcuaacauauuuagagcguuuucuauguguuguguauuugcccaaacacuuuguauacauguuauauacauaauucccagaauauggucauuaauuacauuuuauaaacaagggaauagaagugcugcaaacuuaaauaauuuguugagcgucacacggcuguauaagugacugacgaaccugacucccugucccaauucaccaagcaccaggaacuuauauaccaauuucaacaacaauucuaaaaggaaacuggcagagcuaauaaggcggggguggggggcagccacagggaucaacaaacggagacuagaaaggguaauaugcuuuacaaacuuaaucuaagccaugucugcuuguccauauaauauauaaaagaaaucauuauauacagguuacauuaaauggaaaaaaauuuuuaaggaaaacaauucucaaucuaaaauacuuuuuuuuuuuuuggagacagagucuugcaguggcaugaucuuggcucacuacaaccuccgccucccgaguucaagugauucuccugccucagccuccagaguagcugggacuacaggcacacgccaccaaacccggcuaacuuuuguauuuuucauagaaacggggcuucaccauguuguccaggcuggucucaaacuccuggccucaagcgauccaccagccucagccucccaaagugccaggauuacaggcgugagccacugcacccaggcuaaaaaaauuuuaacagagacuucuuucuaagaugaacuaaaaugacaacaucuuuuuauaaaggaccaaccuaaggacauggaaacaaugaggcagacauaaugcucuuacagcuauagcccaagaauccuaaugaccucuaguaggccaaucuucuaaaaccuuccccuucucugcucucucaugcucauggucacauccuuaucacuuucuaccuugaugauggcagucguugcaucuguuuuaagggugggcugaugucucaugagcucaucgacagcacuccccagguuggaugcaguauccccuuaaggcaaaaaaugaacuguuagaauuagaaagacugaagaaaauagagcuugggcucuuuucuguaccaacauauaaaguggaaagaagaaacugagccugguuaugauuuucuuuccuuuaaagacuuuaugucacccagacuggagugcagugucacgaucuccuggacucaagcgauccucccaccucagcccuccaaguagcugggacuacaggugugcgccuccgugacuggagaaauuuuuuuuuugguagagaugggguuuggccauguugcccaggcuggucucaaacuccugagcucaagugaucugcccaccuuggccucccaaaaugguaggugugugccacugugccaggccaggcuguugugauauuuuuuuccuauuuuuuuuuuuugguugugauuuucuaaugccacaacuucuuuaaugaauuuacacccagccccuauccccccaaaucacuagggaaaaggaaggaaucaguuuaguaaacuauuuuaaaguaacuaugugugcugcacucuacucuggcaaucuuugcugucaagaucuaaacuaguauuacagagugagagagaagaaagauguacaaaccauuaacccucuggcugcuccaguuaagaaugauagugucuaaaugcuacaguggugguugaaaaguacaaagcacauuuuugaaaacuguaaucuuucuggagcccuaccuuuuugcuaauaaucucucaauuaucuggucucaaguauacugaguaaaaaaaaaauauccaugugucguuaucuuagagaguuggacaucagaacacuagauuaccagaugaacaccucaggacuccauauuucucauugcugcagaccagauggugaaccuggaaaucuaccacugcuucuuaauaccuauuuucuaccaguaccaugaaaguacaauggugaacuguugagaagcauggaaauauuaugagcagagaagcugaaguauuccuucugaaguauaauagaauguaugaugauaauucccauuaaacuuagcacaccuaaccaguaaaacgaugagagagaugaucaaggaagaguuuccuugcaaacuaaaucaauuuucuacuauaaaauaaaucuuaacaacuuaccaaggggaucagaacuucuccuccuccgcauggcugggagguaaucuggagacagaagaacuuugaagaggcguucaaaaggcugacacugaacaaaagacugaagaccucgggcauucaaacagagugcacugaauacauuugggagggagccaaggacuucacggguagcaggaaccuaaagagaaaacaaagugagcuugaaugcaucuaaaagaguguagaugcuaggaaaauccggccauggguaucaagcugagauagaaggaauuuugacaaccaggucccaauuagauucaacacuacacacagaagagauaggauuuucacgcccuaagacauucuuuacagaguagcagaaaagacuuacaucuuugauaagcagugcaugcagcaugacaucugucaauccauuguccuggagugaggagagcagugaugguucuugaaauacaaacacagucaccacuucaguagcuaaaaaaagaugagaaaauauggaaaacugagagauuccucacagaaacugaaaacaaaacaccaaaagcuuaaaaaaaaauacauacucaaugucuagcaauuuaaacccuugugcuuacuaugaaauuaaagauccuaauacugcuccaucagagauucaauacuauaaagaaucuagugacuacacuuacaggauuuuuaugggcauauuuuuacauaaaugagguuacacuguuuuauauauuuugcuuuucccccacaacugucauaccguauaauguccucucccgacacaacgacccauucauuuugaauggcugccuacuauuccacuaaaugcauguaccacauguauaaaaaccaguccucaauugugaaaaugauaaaccuaaacauauauccguuuuugucugcuuuuaacaggaaaaaaaaucuaugaugugggcuugcuggguuaaagcaaaugcaagcuuuacugaugaaaauagauaaacugccucauacaaagguuauucaacaauuuuaaacuaucaccagcaaugcaagaguccuugaauauuaaucugaucaguuuuugacauuauaauauuuuaaaaugugcaguaauaacuaccaaagcuucuggaacaugggaaaaacucuacucaagaggaaauaguacagcauuaaaguauuuauuaaaaaguaaccaaacaagcuaugaagaauuaacagaaaaaagaauucagugaaaacgaaagcaaaaaggauaaacgaagccaauaucuagcuuugugaagacacuggaaaagcuuauaaaccuauagaaaauagagcaauaauauaaauuagaaacaagagcaguaauauacauuaggaaugagaaaggagauuuaacuagauacagaaaaaaaaaauuuauucuacaaaguguaugccaacaagugaaauaauauaaauuagaaaaaagagcaguaauauacguuaugaaugagaaaggagauuuaacuagauacagaaaaauauauucuacaaacuauaugccaacaagugaaauguauaguuuaauaagaaaaugucauaaaaaucaaaucucaggaagugacagcaaagcagacuagaccaguaagaauuuucuuuuuuuuuuuuuuuuuuagacggagucucacucugucgcccaggcuggaguacaguggugcaaucucggcucacugcagccuccaccuccuggguucaagcaauucuucugccucagccucccaaguaguugggauuacaggcacccaacacgccuggcugauuuuuccauuuuuaguagagaugggguuuuuaccagauuggccaggcuggucucgaacuccuaaccucaggugaucugcccgccucagucucccaaaguacugggauuauaggcgugagccaccgugcccguuccagaauuuuuaaaaggggaaaaaaaaaaaaaauccagguaauagagaggcaccaagccaauaguuuuauuaaaccuucuaggaauaauuaagacaaagcuucccaacucauaagacuacaauaacuacaauaacuuuaauuaaaaaaccugaugaagaggaauauacauacaacacccauaaaccauguauacagaacaaacuuguuuauggugaugccuaagaucuaaaagaaaccagaggauuuucuauucaagauggugaauacagcaucucuccuuuaucccaaaugcuaggggaauggcagauauauagcaguuaccggggaccaacaguuuucaauggccuuugggauuccucaugggcuauaaacuucugaaaaauuuaaguccuuuuugggguuccuauugguaugacacuccccucgauugacuuacauuuguagaaauguaugaauucuauagaguuacuaaaauugaguauuuaaaaacuaaaauuaguguucuacaagcaauuacuaagacaucaaaccuguuauuuuaucaagaagucgcaacgacacuaugcacugggaccccuauacaaaaacacugauaaccaagaauuagaauuaaaggguauauacacgcacagagcaaccagcuguguguggaaccaagcaacuaagaaauggaaaaaagguaauuaggguuuccaggagaaaguuaaaaggaaucagagaaauagaagaaaaaaaaaaaaaaaaaaaaaggcagaagcaggaacuauauacagauaagaacaagaaccagugugacaccaugguuaucuacaauaauguagcauuagaauacaaugaagaaaacagccaccaacuucugaaagagaagucugacaccuuaaaaauuacccacagauguacuucaauagaacugaaaaugaauccaacagaguuuggaaagucaagguuacagagaagagaguaaaggaaggcagaaggucaucacagucccugggcccaaaugccauugcauccccaugccacuagcccuacucaaacccuagccucccaauauguucuuugugcccugucgugccaucggcaucaucaccagugggggcucaccauaccagagguaaacacuccuuuucucacuggcaaaucaauuuuauugggccacugccccaaucugcuggcacaaaucgcuaugcccucacaacugauuguuauacagacccauucuuggcuuauccuuccugcccaacuacugccaacaccaccacuauuauagcccucaguuaguucccuuugggcuucugguaacaccgacucugaccaggguacguacguuaccgcucauucagucugggcaugggccuuuucaaacaaggcaucaccuuggagcuuccauuugucuuuuuuuuuuuuuuuugagacaaggucucacucuguuccccaggcuagagugcaggggugcaauuauagcucacuacagccucaaccuccaguacuuaagugauccucccaccucagcuuccugaguagcgcaccagcaugcccugcaaacauuuuuauuuguuguagagacaggauuucaccauguugcccaggcuggucucaaacuccugggcucaaggcucaagcaaucugccugucucagcaucccaaaaugcugggauuacaggugugagccagugccuggcccaucuguuguacuguucacagaaagcaggccuaauagaggcauaauggcuuguucaaugcucucuuaaacuuacuaaauggacaauggucucuuaaauugaucucucuuuugccgauugccuuaguuguaugacaucugaaaaaacacaauuagugcuuccuuuguccccuuucuagccucaaaaugagauacuuuccaucuaugagucuauaauacccaaacagaaucccccucacuuaacgacaccuccucauuugauauuggugcgauccacgguggacaggagccuagguugaaaguagguaacaggaugggacccacagaaaauugagggcccucacccucuaagacuaugcagaaggucucugccaaaguccuuuccuaauaugaugguuuuaaaggacugcuaacuggagaucccucuucauaggaaaugaaggucuuagucucucugccuggguugacauacacaacuguaugguucuuccaaagaggaaagaaaaaucuuaaguuaguuccuaguaccaacauucuuagacaggaagccaguucuggaaccaccuuauuacagagguauugaaugggagacuauugcaggauaugggauggcaaugccugugauucccauaauaaacuggcacuucggcaugccaaaagucuacgcaccacaggccugaaaauaucuuuguggaauauucuggcucuaguuggccugucuauaccucauuuggcucauggucugggucugggauacuacuaccccagcucaaugccaaacuucuugggcuccuuuuugcccaugcugugaucccacuuguuuagggguaaucagugcauagcuucccuaucugaaauuauucuaaaacucuuguaggcaaagggauacugaguuacuuuuauaauaauuucucaagugcgagccuagggcuucuauccauccagcauaccaaagcauccuagaugaugauuucaguacaacugacagucccagccuugacgcuaacacccucaagaugguaacugcccuuguaacugcccccacauaacucaucauaacuccacugccccaucaacucuuugacagcccacacuccacuuucacuauuuacacucuaauuucacuauuccagucacuaccuauauuuccugcuuccccucacucaaccugauagauuguaucuauguauuaguaacagagaaugccaccuacauacuaaaccuccagcaauacuaacagauacccuagcccaggcaacuacucauacaacuauaucuugcucccuuggaggauuucaauacucauauugacaacuugcuacacucucugguuaaguggucaaucauaagcaugaugacauuagcauaggcuacaaacagacccgaacagauaacaugagggguaaggcaggaggugagaaagaagagaggggaguuggggaaguuaaaugggauacuacaaaugaaauacagguggcuaaaaguggcauagaagagccagaggucggacacgugagggagaaggagucagaauauuuaguggguuugagugugaaauuauaagcaggacaucgugaccucacugggugcuuccauauuaaacuucccccuuaaggauuucaugucuuucccagccucugccaccaacugauaguacauacaaugaugccccccuguugagaauguccacccugauauaaguuugcccccuagaaacuccaacuuccaaccucuugggcuacugauucuucuguguuacaacuccugcucagcaggguuauacauuuuauucagcgauccuguucccuucuacccauacaagcugaccuauguacuauggacauuuagugcccagggcaccucaaauucaacuagaaagucuagcuguuuuaucaagucuugccacaaaaaggagcacuuuuuaccuauucugggccucaucagaaucuuugguguaacgggcacaaguuuagguauuuccaauucuguaacacagacucaacucauagagguuaccgagacauguuguaacuccugacagaccacauuaaccaaacaguucaggccuaagaagcccucaaugagggacaaagcaguuuaguuacuaugauaguugauaacagacuggcaugaaacuaccuacuggcauuucaagauagugcuugugccuuaaagggacuuccuguugcaugaucauuaauaaagaaaagguauccagaauaguucaacaaaaauaaacccaaacugccaauuauauuauuaaaauacuccaagagguucucagaacucccugaugucuuuccugggccaucuccuuccaccuggagugaaaggcucuguacuaucauuuggggagcuaaaauaacaauggcuagucuaauuauuuagguuucgcuuugcaaauuuguucucucucaaguacaaguguauuuuaugggaaaacugggagguugcuaugcuaauuuaaaugugagggaugaauuaagaaaaccauagggaaggaaguuggaccuucacugaccuuugauuuagugcucuaagucucauuuccugcccgugucccucacuucuggcaucauccucauagggcucaccugcuccucaccacuaucccagcaccuaagcacuauauccucuugcugccucccucuuuuaaacaauaucccugucaauggcaauugcuccuucuucuaagcuucccauuuauagaaaaaugccuguguauccuuuucucuuucucucuguucuggacuuucucccagaagacgggcauucucccugccccuggccuugagacguccccaccguaaaacaaaucuuaaaaaaaaacaaaaaaaccccaaagaacuauugucugaauuuugccaucugaacauaaccuuagcagagagcuuuuccauagcaugguagaguugcuacaccacaagaagacuuccucaaccugacaaaauugacaaaaccuucaacacaaaaccucugcuaacuucauucuuaauggugaaauauuaaaugcuuuucccucuaaauucaggaacaaagcaaagaggcccauucuuauuucuauccagcacuguaucagaaaucuuugcuaaugucauaagacaaaaaaaaaggcacaaagaccauaaacaaaguaaaaaugcauuugcagaugacaagauuauguagaauauucuaagaaaacaaaacaaguauguacuaauaagugaacugugcaagauuaaaagauacaagguuaauauacaaaaauccuaaauuucuucagcaagggggcaaggaaguaucuaaguuguaguagccaaaacuagucuccccaacaccccaaacuguaaaacacaaugcuugcuacuacaaggagacuuucccuauuuccacgucuccuacuaaauuccuuuagcguuuuaagaauucuagcacagauaaacaaaauguaugauaauguuacuuacuacaaauguacuacuuaucgaagguauauucagcacccagaaaauagguauuuacuuaaaacugaauucugaccuuuauuucaucaccaauaagacagauaucuacccggccucucuguuuuauauccuugcaggauuuuacuauugacauuugucuacuguccagguagacaguagagaugggguuuugccauguuggccaggcuggucucaaacucauuaccucaggugaucuacccgccucggccucccaaagugcugggauuacaggcaggagcuuccaugcccggccucucuguguuuuauauccuugcaggauuuuacuauucauauuugucuacuaaaaauacaaaaauuagccaggcaugguggcaggcaccucuaaucccagcuacucgggaggcugaggcaggagacucgcuuuaacccgggaggcagagguuguagugagccaagauugcgccacuacauuccagccugggcaauagagugagacucugucucaaaaauaaauaaguaaauaaguaaguaaguaaauacagagagagagagcucugccagguuaucccaaauuguuauaaccaacuaucaacuccacuuaccuaggaggaagagugaugggccauaguauucugcauugcugaugauguguuucagggagguaggcagagaaccauccaucacuaaaagaaaagugaacauuauggagaauacgaauagucuggaaaggugugaggaguggggauaauugagugauauguuauguauuaucacacugugguccucaaagccuguguuaauucuaaucuaauggcccccaguugucuccuccuauuuuauuauuuguccaugcaauaggcuuucuaacauggguuaaaaaaagaaagaacacaaacacuuaagagucagaaagggguaauaagacggaauuaagcacagagucgaaagcuggaaaaggggaaaaaaaggguaaaucauuaugaaaauagcuaagcaacacuuacaucuaggaaaagugacacaaaacaacuaaaagcuauugaaaauggcauggccuuuaccaaagacugccuuguaaaacaacaggugccagaauaguaugaaaagaaccaaucuuugagagaguaaaauauccuccaaaaaaaguuaucuggaaucaaauaccaugucguaugccaucugagaaagcagggucuuggauggccuucuugaggaaauucaacauggauuucagaagugcugcucguuguggaauacacuggacuccuggcaaugaagaaagacaaaagaauuaugcugaguucgccauuaaaccacaaugaucaagcacauaaaacaaaauuuuaagagauccaaauacacuauaauaaaauuagaagacauucgaagugaggucucugaauguuaggaagaauacuuaauuaagcuuugaaauuggaaaaauuacuaauacuuuuaauuuuaccaauacuaaaagucuaaaguaaaaaagaaaaauuacaaaguaaaaagguucaacuuuuuuuuuaccucacucaguucccauuuuggauauuaucugcccuccaacauggcuguuuugauaaucaaugugcaaauuguuggaaaaguauaaaaugcuaugaaagacauguuaauauaagaaaauggaacaccagaauggugaaggagcaugaauagucaugggaugcuaaccuccaaauguaccauuuaaguucugccuaaagccgccuucuucaauaguuuaauaacucuaccacucugaaagacugcacaucuauguguguacgcaccaggacgggggccagggccagggccggggccagggccgggaccaggaccggggccggggccggggccagggccggggccggggccggggccggggccggggccggugccgggacugggaccagggcuggggccagaagagauguuagugcugcugcuggaaccugaugcccuuaauucaacauccagccugugcuccauagagauggaugagccuggacugcuuuccauagccacaucugcaacuaaaguacaaguuaugauaaagaaacuuacuagaauaaaagguaccacaaaaagaaaaauuuuguuugagaaaauuucuuccauuaaugugaaaugaauauaaaaaugaagaucaggaauacugaaccccaaaaugaaaauauaucacuaguugcauguauuaauacguacauacauacacguguguguguguguguguguguguguguguguguguaaauuaacaauccuacagaaguccuucaauauuucucaccuaccaaauuggggaagagggggagagugguaaguaaaaugugcaauuucauauacuacuaguugguaguauacaaauagguacagcuuuucaaaagaguaauuaauaaauauaaaaagcaugaaaagauuaauacucaauauuccgaucuggaagaaugucuaugaaacacugaaugagcaaugcaagaugaacaguauguuuaugaucucaucuucccauucuaaaauacuacauacauacuuaacaucaacauguauuugaauaugcauaaaaaagccuggaaagauccgcaccgaaacuaguagcuaugguagguaagugagcauucauuuuuacuuuauacacuugaauaacugaguauaagauacacaaucauugacuacaguuuauaaaauguauuaaggcuccaucagugauaaaauacuauuuacauuuugaaaucacugcagccucaaacucccaggcucagaugauccucucaacucagccucccaaguagccgggaccacaggugcaugccaccccacccggcuaaguuuuguauuuuucguaaagacaagauuuuugccauguugcccaggcuggccucgaaccccugggcucaagugaugugccagccuaacggauguuguugccuacccaacaaccuuuuuaccucuccuuucucuucucaaaauagguaaaguuuuaaaaggucccauuuuagucucucucucucuaccaagcauauuucuaacaccuaggauguuaucaggcacugcggcagugaaaaagacaauauccugaucccauggagcuugaauuuuaguagaaauaagacaauaagaaauacauaagaaaauuacgugaugaaauaaaacagauuaacaccacagcuauagcaucugcuuuaccugccaucucuacuccaaagaacuaguaccuuucuuuucuuauuaucuuugugaaaaacaaauuugcaaaucacuuacauagaaaaaaaauuuuuguugcugaaaguauauacucaaguuaauuguguacuuuggaauuuaugaggaagaaugaaaacuggggugggaugacaaaaaaucucaagcacaaaaauacugacuuaauaacuguuaauuaccauccauaucaguuuccauuuccucuccuucuuguguaguauugggucucuggaucuuuggcuugaucacaaacggacauucuuuucggcacaaaucuacuucaugcuacaaucaagagaaagguuauaagaaaaucaaguauauauauauauauauauuuuuucagggauuaaaaacuauuauaauggaaaaacacugcaagcagauacacaguugauuucuagaaacagaagagacuguaagaucgcucuuuaggguuaucaggacaauccuuagguucagcucugaguauuaaauucugugcaaagcauuccuuguauaauaauaccucaagucuauaaaugaagauagaaaguccacuaugggauugaaaagcugccauauccagguuggugauaaggucaaccacucugacggcucuggugacaaauguuaucugguccuguucaucgccaagaaacuuuaugaccuaucacggagaaaaagaggcaaaaacaaugaacuauaaagacacaaaguuguaaaaauugcaugcuuuuguauacauguagucuggggccucaguaaggcagcacaguaugggggaaaacauguguuuuauuuuuggugccugccaaaugacaguucuaugacuucugcgacucaaccucugagguaauggggacaucaauuacuuugcaggauuaaguaagauauuuagggagaaaaaagcuggugcucauugcccugcacauaguaaaggcuauuacuacuacaacacaacuuacaaaguacccugacauauauuuucccuaugguuguguaaaggcaugauaacauguggcaauguuuuaaccagaacccaugaccuccugaccauucuacacuaugauaaaagucucaauaauggaaguagcugcucuuaaacauuguuaauuagauaacuagaaagccaaacuggccuucuacuuaaguauaacuuuuucuggauaagcuuucuuauauuauuugcccucacugugaaacaccccaaacuugcaucucuacacccuuaguugauuuccccauguaguuuaaaaaaaaaaaaaaaaaaaguacagcaccuucaauaaggcuuccaucauuccacaggagaccaaggcuucaccaccagcaucguagcuggccagaugguauaaaaaagagaagagagcaguggcaaacuggugaggguauggauccauggaaggaucuacaagggagguggggagagggagaacaaaaacaagcucaaaauugcuguuaagcaggcaggauauuaaaaagacaaaggcagagggcaaauguuucuucuugccuaagauaaucaccaucaaaacuuaccaaucauggccuggauacaguuccuuacaagcacuggcaaaaauccaugguaggaggcaguuccaguacagucaauaauacugcugaguuugggaguucucuccaaguggacaauugauguuaauguucguaaagaagcugcuuuaaucuccuauuaaauuagaagguaaacacauaaugugucaaauauaauaagaugacugaaccaaguuccaguugcuaauauccaaacuuuaaaauauaagucauucuacugguaacugcuugaggggauggaggucuguugagagcaacaaugaaaaucuaguauuuguuaguuuugcaguuuaauacccaaagagggaaguacugggaguucuuucuaacccucugggaaaaaccaaaaggcaaacaaguauaagccugauauacagagaacauuaaugcaggaucccugauucaaaaaucugaaauauucccaaauccaaaacuuugggaauaccugcaugccagaaguggaaaauuccacaccugaucucaugugacaggucacaguuaaaaugcacaaaauuauuugaaauauuguauacaauugccuuaagacuacguauauaauguguauacgaaacaucaaugaauuucguguuuaaacuugggucccaugcccaagaugucucauuauguauaugcaaauauccccuccccccccaaaaaagucucaaauccaaaauacuucuggucccaaguguuacagcuaaggguuacucaaccuguaaaauacuuaccauaagcugcuuauccguuaucugaaggacaucuaccaacuccucuaucaagccauuauacaagauacuguuugcugauuccugcaaggcauuggaauacacugcaaaaggagaaacaaacacuuuaggcaagaaggcaguggucaagccacugcccaauaacaaacuuuuugguaucuauagguucuggggaagaauuccauucccaaccagcaauggagggcagaaucaucaccaaauuaaauucugaaggacuggaucaaauacaacugauaaucucuaaacagacacugaauugacagauuccacuacuaaagguauuauuagucuugagaaagaauuuuggggauggaaauaggaaaagcucugaguuaauuuuucauaacauuacuacuugauguaacuccacuaugccuucaauauaagauuuccauuuuagccucuuccuaugcuucugcuuuuacuguaaacacuuguaaagaacagaauuuauggaccauugcagaguaagucagaaauuugugugacacuguaguaaaacuucagaauguguguaauucacauucaaugaauuccacgaugagguuaauaccggacacaguacccugaagcauaaacuaaugggauuuaggcauauucauuuaguuuucaacaaagauuuccugagcacccacuaacaugccagaaaucaugcuagauaugaguacacauaaaagagcaagaauuucacgccaagaaacucauaguuuaagagaaggcaagucauaacauaaugaacaucaauaauaacagcaaugguuaccauuuuauaucuucuaugugcuuguucugugcuagauugcuuucuagguuuucauuuaaucuuuagaccagccucuacggugaguaccucaauauuaaacgaauaagcugaggcugagaggauaaguguggcuaauaaucuacagaaucagggacagaguacaggacugauuacaaaaccacguguuuuccauuuuacugugccacaguaaaagaaguuaaaugcacaguauugacuacugaauauuuugugacuuaauucaaaaugauaucccugaaaggaugagagaggaggaagacacaauggcaagagaaagaguagggggacagugaacgauagcuacaagcauaucuauuaaaaaaaaaaaaaaagagacgaauaccaagaauaaacccaggugacaugucaaucaacaucaucauacccucuuucucguccaacauuaaggagcucaaggauaaugaauaaauacagugaacacugggagggguggaaguauuuaaguugcuaccuagguaacuauaauaggacucauagcaacaaagaugaaugaaguucaaaggaaaucaggcccaaacugucuaauacggccugguaauuaaaguauucuucucuuaccuaauauagauauugcaugcagucuggccugaacugccugcaaucgcuuccugugauuagaaaagccaugggccagucguauguguguaaauaacagcaucuguagagagauaagacauacauuuuaaaaacaucaaugaaaaaggugaauauucuuuaugagggcuaacucaaaaaacaacacaacuaaacguuuucuccuuugauauccgaaguguucagaaagcuaccaccacuuauuaccugcucacggugagguaguuuauguuuuccucaaacucucauaaggccuaggaaguuauuaaguguuaaccucauaaaagacaaggaaacuaaggcucagagaagcuaacaauuugcccauggucugacuccaaagcugacauucuuucugcuaugcaaucucccaccccaguacauaucauuaaucuauuuagauaacaaccacauccuguggauguuuuaaagccacaucauaccugcuuauccuuaggaaugcuguacauuuugguaagagauuccaugauuucagaagggcuuucugaaaucuacauuaaaaaaaaagauauaguuaggaacaaaaagugaaccaaacauuaagaaacgagccaagagucaaagauuccucuuaccuugucaaguugcucuaugugaauauaauguaguguguuacuaguugucuaaaauuaaaaaagacaagagagcuguaaggagucacugaacacucuagcuuccccuuccauagagcuccaaagggcugucugaaaaccaagaugucaccuaauaggcugaagccuaagugaaugcucuuaaaaucaagguaaauugagaaucuuccaaaacauccaucuuauauguagaauauucuuaggaaagcuccuuuaaaaccaguaguaucaaacuauaaugcacauagccaggcacauuucauauucuucuuuguccuuuuuuaacccuccacugacuuaauauccauagcaguauuaauagcaaagaccaaauucaugaaaauauuuucucucugaauauguauuagaguugcuuucaaggcaauuaagcuagaaagauuauuuauuuauugaauaguauagguagaagagaaauuguauuuucacuaagcuacuucuaaaccaaacucuuuaguaccuccucaaacaauacaaaaugaccagauaauuuaagcaggacacuauccacaauacauaaagacuuuugcaggcuuccuaauuagagaaaccugagccaucaccauccaaacuacuauacuacauguuggaauucucagagacugugggaaaagcacauaggucauagcagugccucauaauggaugggacuugcaucuuuuggcagcucccaacauaagacccaacccuaucagaguuggggaugcaauuaacacuccugaggagcugcuagguauauuuauaguuugcgagggcagcaguguagcucaaaaccauuuauucauuuaacugaggaguucuagaagaggcaaucccaguuacaguaaauuguagacuuugucagaacaaaucugaaucagacucacccuuuucucaauuuugaccucggccccaggaucugcauagaauucaaaguguaguguaguugcacuggguggauauuucuguguauaaagcacaucaaagaaucagacauugaguuucaacugauuauaaacauuaucccccacaucuucccucaaaguccuagccacuuguucaacuuauuguggcagaagaauaagcaguacauucaguaccuacagugccuuuaacuguuugucuuagagcagagcucagauaggaugagacuuuucaaacagaaucaaaaggacagagcccagagcucccaaaccuucugcauuucauacuuauaaauuuccaguuucccuuuaagagaucaauuuugacuguggcuauucccaagggggaaaagaggggcaagacugccaagcaguaaugaauaagaauccaagaaaggauggagaacaaauaccagggcccagaaaccagcuaaagaauggaaaagaacauuccuacgaaaaaccuuguaccuaucaucagccuucugaaauauuuaauucaaaguaugccucauaggcauaucuucauaauucuucaaacacuuuccuucuauaccauucuacaccacuucucaugguauguuuucugcacagguagauaccaagacaacauaaaccagacccugacaaaacauucucuuuaacucuagaaaagcaacaugaugaacaaaauuaagaugacagcagaaugcccacuaaaaugucucacugaaagacaccacuugcagugguugccucuggaaaauuaagaaguuaccacugcauaccucuuuauacucugaauuuuuuaacauguauauguauuacuuccuuuuaaaguacacguuaaccuuuauguugucauaauuagaauuccaaacucugaauauacuucaagauuuauguaguuuugauuauuaaacagacaacacucaccuacuguaucacccaauaucucuucauaaaauaaucacuaaagaaaaguaugccagcuaacgugggaaaguaacuugaucuaaucugugguuuucugagaccagaaaagagccauucucuuuaggaaaaaaaggcuugcuaagauaaauacacuaaauuucacugcagccauuugugcuaaacacgacaaacugacaagacaaaucccacguggaaaauauaguugcuuccagaugcaaaauaauuauugaaaaucaaauuguguuuuguagcuccacagcaacauaucaaagcagaaaggaggauggccugagcucauaacuuaaacaugggugaaaggcagagagauaaacaaggaaagcacauaaaacauuauaaguucucaauaaaccuaaugguagaacugcucuccaagcagccauuccuaaaucacaccacacuguccagaguucugauacaauaguuccagugugagaaugcaagcgaacauacuuucugggauuuaaaaaaaaucacauuaaaauuaauucaacaaauacagcuaccuacucaagaacuggguaugaacacacacucuauuucucagauuuuuuuaucuaccaccagcacaucaagagcccaagcacugcuagacugcuuccuauagacgugguucagcuaugucugaacugaucuuagguuccucaaaggucucgaugugaaggcgucacuucauauaccacaauucauuguaaaguaagguucacagagaggccacagcucugucaaaagacacccauaucccaaagaguuacuuaccaucauaugcaagucucugcaacauucugcaaguccaaagccauucuccuuuccaccccagcucuugaaaaaggaaaaagauaguguuaagacagugcuuauggugacuuugcgccacugcacuccagccuaggcaacagagugagaccuuaucucucuuucucucuauguauauacacauacauauauauauuuaagaguguguggcugcuuggaacauaauguugagaagacauccaaugugaaagucaaacaagaggaaaaaacgaacagaaauaagaacuuaagaaucaaggcaagauggucugccuaaaggugauuucuucaaugagaucaauuucacuguucagugaggaugcuccuaggaagaacucaagcagcaacugccagccauuauauuccauaccccuguagucacgugugcugacaggucccuccuguccuaucaggccuugccugaggcucugccuacucaccuuccgcacuagggaggaaagcacuagggaggaaaucaugcuuuccaguuccucucuuuuugacaugagcugaguuacaaagcagauucuaccuuauuuauuacuacuguacuuugccacucaaaucuaaaaccucaucaacaagcuccugagauaauggggggaguggcucaacuggcuucuaaauacaaaacuucagccacauagucucacuuacuaacuagccugcaucuuaacagccuuuaaaauaucacuuuaacauuaagagcauuaacguauuuuuauuuuuaaaucauucauaauuauuuuacauauauuacauaaaauauguauuuauauauguaaaaaauauauaucucccugccucauggggcaaggcauauaguucaggcaaacaauugacgaagugaaagaaaugagauauuauuugaaacaaauuuauuaauuuguuaugucaaacugaagagauuuuuauauuacaaauauaaaacauuucauauaaaaagauauuuuguauauuuuuaaaaaauuauaaauauguaaauuauauaaauuuuauauaaaauuuauaaaaauaaaaauuauauauauguagcuauauaugaagagagugugagagauagacaaggucucccucuguugccuaggcuggaguggagugcaguggcacaaucacaacucaccacagccucaaauuccuggggucaaaggauccuccugccucagccugccacacagcuaggacuacaggcauaugcugccaccacgccaggcuacauuuuaaaaauguuuguaggagccuugccauguugcccaggcuggucucaaauuccuggccucaagugauccuucugccuuggccucccaaagugcugggauuacagcugugagccaccuugcccagccaagcauuaucauauuuuuaagucuggcaugauugaagcacaaaaugcuacuuauauucuaugucuucauuuuauuccugucuagugugggucccaaucaccucggaucugggcugccaccaugaacuaacauggcucucucucuacaucuaaguguuuccucuuuguuaaaugcuauuauaucacuacuugccaaagaagucucaaaaacaaacaguguaaaccacugaagaugccagucacaaagguacauacuauagaaugcuauuucuaaaccuguaaauaaauaaaugaauaaauaaaacaucaucugacuauccugugagaaauaagcuuucucaaacuacacuugaucuacuggcagcauuucucaauccagguaucauauaugaaacacagaacauggugaaugaucauuuuauucuccaaauaaugguacauaacuagcaccaccuuagaugcacaagagagaagucucuuugcuacauuaauaauggauaccuuagggcauuagggcuuacuucucuagugaaaaccuaagugagaaagucugccuggacacagauauguauaucccccacucccagcugguuaaaaacagacuguucuacuaggaaugcugucagugaaaauggcagaauggggaaccccauaagcccacaccuucacaaaaacagugaauaaacugacugucggaauucaagucuaucagaacucuaaaaaauaaucagaaguuuaaaacaacuagggaaguuuaaggcaaugagacaagaaucuguaaaauacaagguucgacauucauuaagauguuuaacagacggccaggugcgguggcucaugccuguaaucccagcacucagccagugggagcccgaggcgggcagaucaccugaggucaggaguucgacaccagcuugcccaacauggugaaaccccgucucuacuaaaaauacaaaauuagccaggcauguggugcaugccuguggucccagcuacuagggaggcugaggugggaggauggccugaacccgggaggcagagguugcagugagcugaaauugcaccacugcacuccagccugggcaacagagugagaccccaaaaaagguaacaaacaccuggugcuaaauauggccaaauagucacguauuaaagauauucacuguagcauuauuuaccacagaaaaauacuggaaauuaccuaaguaagaagaaaacugugaaguaaauugagauaaccauagauggcacaauugacaguaccuaaaauauucacagacagaagguauaaaaucauacuguaauggaaucaauuucuucuuucauggcauuagucucauucuugaaaauaucuugccacuucaagcagcauacaaccaugcaguuauacuuucuuucaaugcuuguauaacuucauguuuuuaacauuucagcuuuuuauuacaucuuaauuuuacuuugaugagguagaaucuaccuuaauugccucccaaagaguaagccaguuuuuacaacaccaucuuauuugaauaauccauucuuuuucugcuaaucugaaaugccaucuuaaccauaaauucgauucuuacacauuggaucugcuucuggaaccuacugauuggucaauuccacucuuaauuaccacacuauuuaaauuacuauagcuuuauaaaaugguuuaauaccuaauaaguacuucauuacauuuucaauauuuucuuggcucuucccaggacaucuagugaagacgaagacacaugcaauuugcugaaaaccauaaaguaaggaugaggguauaaaggcuugaugcuacagagaacagacagguaagucaaaccaaaagucugaaucugcaaggcagaauaagcuugaaaggcuguguaucuacacaauuauuuuccuuuuguuucuucuguuauuccaacuaauuguuucagaauacuuuuauuagugucaccacaaaauccuucuugccaacuuuugcaacuugauaaaaaacaagcaccuuuaauuagaaaguuuugguaagcugagauccuuaaaaaacccugccaacucaaacgugacucacgaaagucugugcuguuguuauauuuaugaacuaguaacauuauaugaaauauaaagaaauguuucuugugaagaaauauucaucagauaaagacuaagaaaauauaccaaaaugaguagauacacaauuaugauaaauuuuguugcauacauaaaacaccaagcaccuauuuuuaucaggaagacaaguuuguuucgcugccaacaaaaucaacauauuaaauguuaagauucuaggguacuuuuuagucaguacuauucagaauaacacuaguucuuugcccuuauuauuauuaauuuauuaucuauuuaucuugcuuucucaaguacuaaguaagcuuguuuuuauuuaaaaaaacgaacaugaccaugcucaaagaauccccaaaugccuaagacaggaagaacagauauuauucuucacauuuuagcagaagcaaagagcccagggccuuuguccaaaaauaauggugaaaccccaucuccacuaaaaauacaaaaaaauuagccgggcauggugacgggcgccuguagucccagcuacuugggaggcugagacaggagaauggcaugaacccaggagguggagcuggcagugagccaagaucgcgccacugcacuccagccugggggacagagcgagacuccgucucaaaaaaacaaaaaacaaaaaaaaaauacauaaguaacuucugagccucacaguauucaccuaucugguaguguuacuguaacauccuagcccuuaaguagauaacccauaaauaacuauauucauuaugccacagaggcauauacaacacuaccucacacuagacaggauuugcuaaauauucagacaucaggaaaaaggcuugaugcucucuaagauggaauuauaagaauuugauaaaaguuuguaacuuaauaaaauagacuaggccagugguucucccuggaccagcagguuaguauuaauauuaccugggaacuuuauagcaaugcaaauucugaggcccacuccaagccuaaugaaucagcaacucaggaguuaggugggauggaggugaggaagacuaauauauuuuuuaauaaagugauucugaugcauccucaaguuuacuagaccuagaguauaccagaccuucacaaaagccagccaacuggcuuucaacugauucaacaagucuuucuggagaauuuucccuacaucuguaguuaacuaaucacuguucacauucacaauuagcccacaucacuggguugaccuagucauuaaaaacuacuaugaggaaagacaccauauccaaagucacuuuucauaaagaccaaaacacgauauucaaucuuuuauauaaaagcauugacugaaccauuuuugaaaacaucacauacaaaacacaauaaacaaagacaauauacaugaagauuaggggaaaaaauacuuuuaagaugacaaaggacuaauaucuccaauaugguuuuacagaguaggaaaaaguaaccaaauggaaaaauggacaaaagauaaaaccuuucacaagaacaaauccuaauggccaagcauaaagaugcucaaaaucauuacugaucagugaagugccaauaaagucacacugagauuucugggacucuaucuuaugaucuccauaucaucucuuauaauaucauauuaaauguaucaguaacuaaauucauauauaagauugcuuaauguagcaucauucauaacaaauauaaguaugcaucaauagggaacuugaguaaaauaugguacauccaaagcauggaauacuaugcagccaucaaaagaacccuauaguuauacaggugacuuuaaagugauuuuugaacaaggucugaaauaagaaaacaaggauguaagguauccugcauuuguaacugaaggacaaaaacacccucaacagucaauauaauaugaagauaauauauagagaagaauacauuugagguuauggggaggugaaccaagagggaaaaggcuguacugaaaauaaucaugugacaauaugcaugcacuuauaaaauaaugcauguguaacauuuuaaaagaaagcaaauacaaaagaauggcauguaguuucucugguugacauccaucuacaaaugacagcuguuuauuaaguacuuccaacaugauggcauuaacccuacagguuuuauuuaugacuuccuuuacucugauccuaaaaaaacuaugagguagauauuguaacccccaauuuacagacacagaaacagguuaauauuuguuggcaaaaguagguuucacauccaaauccagguucuuauacacaugcaagugaauguguuuguugcaaaggaaguugccugaaaagacugaaaagacaugaaccaagauuucuaugagcauuguuaaagaagcccacaaggacaggcaguggcucacgccuguaaucccagcacuuugggaggccaaggcgaguggaucgccugagcucaggaguuggagaccagcaugggcaacauggcgaaaccccaucucuacaaaaaauauaaaaaauuagccgggugugguggugcaugccuguagucucagcuacuagggaggcugaggugggaggaucaauugagccugggaagcggaggaugcagugagcugauaucgugcaacugcacuccagccuggguaauggagugagacucugucucaaaaaaaauaaauacauaaauaaaagaagcccacaugaacaagucaaguuuuuagagaaauuuuacauuuuagagaaacaugaaauuuuuaaauuuuaaugagggauauuaguauuggagguaccauuacuaaauaccuaauuaucucuaaaccucaaaaaccuguaaaaaucuuuuauugcaaagcaccaaacacaucaaucuauuaccaaaggcugcaauguacugcaccugucaagauuccaaauucuccaggacuagaaauuaaccuccaaucuacaaucucuuuagaucaauucagagcaaaaaguagcaagccucucaaagguaaaaagugucaaaaaugcaaagggacaaaaaagcaaucauuuaagcaguccuuucugugguaaaaucauccaaaggaagaacaacaacuggaucugaauuaccuaaaaaacaaaacaaagaaacauacccgauacuuuauauaugugagccacuuauaccaaaaacaguuugcauuuuaacuucuacuuaaauugucagaacauuuaauuaaaguaugaaauauuaguguguuuguaucagccuaaaaguagggugaugugaauucugucagaugcuauugugguccuauacaaauaaccaaauuaacaugaucaaagcuguauuuuuaaugacuucuaggucuguuaacuuucuuagcaaacucuuaucaaagaucuuaaaagucaccuguauuuaccucuaaauacguuccuaggauuuaugucaagugugaagaaaaguucuaaacacauuuuccccucaaaacagccuacugucccacuguucuaagcaacauaagguauacucuuucauuuugcagauguauugucuauuccugugccaacugcaagacuuggcuuaaucauaaaaagccuuaugauaaaaacuuggcuuuauaauaaaaccacuauagcuuuaugauauuaucugauacagcaacucacccugauucauuaucaguguuuucucauuuauuucugugucucaguugaugcuauuaacagacuuccacuuaaucaauuugacugauuuaaaugagaaagggaauuauuucacaaaaacuaagucgaauauuuugcaaaauauucaucuaaaaggcaagaugcuaaaauaaaaagugucaaauuaugaagagauucagggguaaacucuaaaaaauuuagaauccuguaugcaggcuccuuuucuucaaucggugcaacaccauaaaguaaucacagauuauaguuguaguuuaugucagaaaacagacugcuucuuacuaagucuuauggcccacauaagaugggaaagggaauuauuuuaguuuuuaaaaaaucauauguaucaaucacuuuuuaaacauuuccugcuuuaacaagauuuuuaaaauaauuaaacuaccaaucauugguccuaauuucauuaaagggcuucuacuacauuaagucuucccauuuaaaaaauguuacuugucucuauuuagaccaucuuuuaaaucuguaaguaaagguuuaguguuggucuaacagaucuuaaauacugcugguaagauuuauuuucccuuauccauagggauacauuccaagaccccuaguggauacccgaaaauacagguaguggcaaacccuauauaauacacccacacacacacacauuuuuucccuauacauacauacugaugauaaaguuuaauauauacuauaauacaaguuaugugaauguggcuucucucuuaauauaucuuauuguauuauacugcaaguaacugaaaccauggcaaucgaaaccucggauaaggggagacuacuguacuuguucauguaucugucccauuauugcccauucagauucccuucuaucaaagguauaacuuuugaugucuguuaauuuuucuuucuugaaacuauauguugcauuguguacaucuuuuuaaguuucagaaaugguacugagcaaugaaaacuguugcuuuuacuuuuuuaugcacuaaccacuauguuuagaagccaucaauguugcuguauuauuugguccacuguuucuaacugcuacauacuccauagugugcaugugccacauuuuacuuauuugaguaucuacuaaugauggauaccaagguugcuuccaacuccucacuaccacaaaugaugaugcaauacucugacagagaucacguuuauggaaaugaugcgaucucaccuuugaaauauauacccaugagaaccagucuacacuccuaugaacaauguaugaggguucccauugcuucacauaccugccaggacuuaccauuauauaguuuucuaauuucugcaaaucugaugcuuacaaagcuguaccuuguuuuauuuuuauuucucuaauuacugaguaugggcaucuacucacaugaauuuccuguucuauaaauugccuauccauauccuuugcucauccuuguugaucuggaagaguuccuuggauauucuacauuagcagucccuuuucaguuuuaaaacacuguuaaacauuuuuaaucuaccaugggucuguuaacuucuguuguacaaagugcugccuaauuuuguaugcagaccagcugcuugcuauuacaccaauuguuugcaaguuuuauugguccaugacaaaaugagguuguaccagaauguuauuuaacuacauugguaacuauacuauuuaguacaacugacauuuuucuugaugaaggaagcaguguguugauuuauauucuaguguaagggccuaaggaguagccuggagcuauguguuuuuuguugggaaguauauuuuuaaauacaauauucaaaauuuuacuuucagguuuaugccauggggauuuuaagaauucuuuccccaccauuguuauuacaacacaaccuccuacauuaacugcucuuaaauuuacaguuuuagccaauaugacuuauuuuacagacagaauauuugcuuauacugugaauggggucuuuucaccaaucauuuucuuuuuuuuuuugagauagagucuugcucuugucacacagccuggaaugcaguggcacaaucuaggcucacugcagcuuccgccucccggguucaagcgauucuccugccuuaccguccugaguagcuaggauuacaagugcccaccaccacguccagcuaauuuuuguauuguuuuaguagagaugggguuucaccauguuggccgggcuggucucaaacuccugaccucaggugaucugccugccucggccccccaaaguguugggauuacaggcgugagccaccacgccuggccucaccaaucauuuucuaauugguugcuauuaauacauggaagagcuaucuguuucuguauauugaucucuuggcuaccucacugugcuuuuacuaguuauaauaauuuuacauuaucuccccaagaaacaaagagacucaucaccuacauacaaauaguaacaaauauucucuuuucuuuuuuagagacagagucucggucucacucuguugcccaggcuagaaugcaguagcacgauccuggcucauugcagccuucaccucccaggcucaagugauccucuuaccucagccucccaaguaacugggaccacaggggugugccaccacaccuggcggauuuuuguacuuuuugcagagacgggauuucgccauguugcccaggcuggucucaaacuccugggcucaagcgauuugccugccucagccuccccaagugccaguaauaacaggcauaagccaucaugcccagcccaaauuuuuucuuuuaauauguauucuucgcuucuuucuuuucuguugguuagcaucuguacuacaaauguaaaugacagaaguuaaugucugacauuuuugugugacuuuugaauccaauggaaaugccucagcucccccauuaugacuucugguagguaacucuaguuuucuuaaaguuuauaugaagcuuuuguuaaugagauaaauuuuaucgagugcuuuggaagcaucuauugaguaauaguuccuuuuuccuuuuaacuguggacuugggaauccaauguuaaaccuccuugugguuuuuaauaguaagaggaaauauuuacaguaucuuaagaaaacaggucacaugcauguauacauguguuuccaaaugcaagaaaaaaaugcuccaacuuuaagggaggucucauagggaugaauuauaggugauugacauuuugucuacauuuuccuagaauuuucagaauacauguuauauuuauaauuauacaaaacuaauuuauaaguaaucauggcaccugaauuagccugaaaacuugaauuacuuugagguaagcauuaaauaugcuuuuaaaaagccagccauaacacuuuucuucuaagaaagcuuuccaacaguggguuaccucucaaagcuaaguauguauuaagaaguugccucugggaacacuggacaauaguuugguagagcugaacuuuuauaugagagcuucuggcuucaauuacaaucacuacgacuuacugaucacagcacugaguaccccacaauucauuucauucuaaaucaacccugaaguagauauguuaaauucccagaagaggaaaccagugucggcgcuaguaagcagggccaggacucaaaucuagaucuuauuauugcauuauacuuccuucucacacagaauugaaucuaauuuugaacuuuccuuucagaagugaaauugccacuuuugaacagagagauuuuguuuggugagcagagauuaaagaauuccuucaaaauuacuuaauaacugagaauacuuagguuuuaaaacagggcaccaauaguucuaacucaauuaggccagugaaguuaacuuagggauucuaauauauuuuaacacuccaagaaacaccuguugaaaggaaccauaugcuccaauuuuugcaccccuccaacucuucacccaagacucaccucugccaaauguuguagccgaguuagcagcgggguccucuugucagaucccagacgagugauguaguuugaucuuuugcuaaauacauauaggagauugaggacugccagcaccacuugcauaucagaggaagccaauaaaguugucaaaugcuaaagggacaaaaaagggcaaagcucaagguaucaggcacaacuggccuugaaaacaaaacaaaauguacuugucaacauuuacaaagcuaucaagaaguuuagucacaacaauacaaaaaauauauaaguauuuguacucgggaggcugaggcaggagaauggugugaacccgggaggcggagcuugcagugagccgagaucacgccacugcacuccagccugggcaacagagggagacucugucucaaaaaaagaaaaaaaaaaaaaaaaaauauauauauauauauauauauauauauauguauuugauaaucuacaacaugcaaccuuauccccaaggagcuuaaaaucuggcaguuagcuauaaagugcaauaaaaguaaaaaacguaaauagugguucaaaauugcgcagguuuucccacaggaaggaaaagagacaaauacacaugugggacucaagaagaacauuaagucucuaacuggacuaaaaguauugugaaagaaagauauuuuauguucucuucuguauccuuuaugacaaacauaaaauugaaauuaauuaaaacaggguccuucauauagaagcuaaagauaucgauaacagcucguggcaauuauauaacauauaaguguuacaguacaguauaugcucauaaggaaccugagugacuacucuggauuuuguuguuguugcuguuuggagacggggucucucuguugcccaggcuggagugcaaaggcaugaucauagcucccugcagccuugaccuccuggguucaagcaauccucucaccgaagucucccgaguagcuaggacuacaggcacgcaccaccacgccccgcuaauuuuuguauuuuuuguagcgauggggucucacuauguugcccagacuggucuugaaccccugggcucaagugaucuucccgccucaaccucccaaagugucaggauuacagacaugagccacugcaccuggccuuacuuuggcuuuuaaauacaauuaaaauucaccaauacauugaagcaguuggucagaauuaaaaucaguauguaauauagcuagaaaugaaccaaggcauuuccaguugccaauuauaccgaaggucauggacuuccaugggcagcauaucuauuucaucuucaacagacugccuauuuaccucccacuuaaagcucuguauguuaggccuuuaguucaguuaucccacuucuuuuccuaagccauuuucuuuuaaguuguuuguucugauucuguuucucuacugaagacguaggaaaacacaccuaaaauuaacagggcaccuaacuaaugaugauaaaaagucuaaaguugggcuucuauaaaaagaaaauaauuucuucuuacagugauuuuuaaccaauuaaaaagcucacugauugcugcaccuaccuuacucuucaaggacacaaaggaugcuaugaauauauauuuugggauggguguggcagaguacagagagacuuuaaagcagcacacuaacacuuagaggaguaguaaguacauuaaugugaugagaaaaucaaacuauuucuaggaauuuaaaaguaauguggggcugcucuaacaaccuagggcaaaaaucaauucaugcaaauuuccuuaaauacuuuaauacauauauaacauuucucauucauuucuugaaucuugaaaaggcaaagcaaaggugauaguacagaaucuucccaucaacccuaugaaggauaguaucuauauccaagaaacauucuacuauuaucuuugacaaugaaaaacccagagcuccacaaugaaaaggaaagaagcaauagaaauagcaauuuccuuauuucuggauguacacaauucuagucaagaacaggguacacaggcuuuaaccuccccuaccucuauggaacuguacagaugccgggaaaagcuguacucaaugagcaaggcugugaaguucaacacagccaagagaagcauuuucaguugcucucuuucuggccuaucacauacgagcauccaugacauauucuccacugucuguccagcaucugccaguauuccaucgaagcgguccaacagguccacccagugauauaacucgcacuggagaggggaggaaaaagaggauguaagaauaagguagaagcgccgcaugggugcuuucuaacugagcuuuguuacaagagauugcugagcaugacaccuagacaaguucacgucccacccuugcccauaugagaaagaucauacucugagcuaaaagugcuguaguucauugucauacccaucuagauauaugugcuaacaccaauagacaccauaaaaccccuagagcuaggucuuuagauggagaacuccgguuacauucuaagaucuacgaagacaagagaacuauccuugccagaauccauuuuaucagaaaaauucauuuuuagaguuaucuaauaaaaauucuucuaaacuaaaaauccagaaauuaucucaaacuuauauugucaaaccacaggaauucugugauugagauucuuaagcaucaccugugaaaucaauucuccauccucagccagcaaaauuuuccuugccacugguuuaaagcuguguuaggcacauggcacaugcuagaugcuuauuaauugcugaaugaggcuaucccauugugguuucuuauuccauaucagagcauacaaaaugauguauuaguauggugaguccugucuuuugggagcuugacuucacauaccuuuccaauguuccauguuuugaucugcugcaguuccaagagaaguugcucaucauuacaaacuuugaguuugucuauuaaggcucugcagucugcaggcugagaaaagaaaaguauucacaaaagauguuuuggaaugagggaguugcaaauaaggagaaucagaaaaggaacccuuaagcucacacagcaauuuuccuuuugcuaggauuuacuacuuaagaaaacgagaugugccagacaaucucuugggauuaaaauggaaaccucaugagaaaaugcuuuuauucccccaacaauccaccugggcuuaaaaaacaaaaaaaaacaaaaaaaaacaaaaaacaaaacaaaaacccaccuuggauuuggauaaagguagaugcagacaaacuauuuggaaaggugcugacaacaaaaacaauaauaaguuaaacaucuaaaaaaaaaaaaaaaaacaauuaaggaaucuauaccauggucugaaaguuaaccagaaugccugguagguuauauugaaucagagacugaaaaguccuagugaauucacaauuaaaggugaagauuagcacuagcuauauuuuucuguuacauaaaauccuucacuuguaagaugguaaacagcuuccgaacuucguaaaacuaggacuccauucuuucuugggguuccuauuuccauacauuucugcucucuucuacugaugaauggguccauuugucagguaacaaggaguggauugagcauuuauagucaaguuucugaaaguggaaggagggaaagggauaggggcugggagagagaagccuuccguuaaugaauggcagcugggagaagugauuauuacacuuguucuuuaacuccauaaaggcaguacagcauccugggaauggaccagaggucuggaaccaaacaagucuggauucacuuuuuaacuucauguuuacuaagcuguuugaucaugagcaagucuaaccucuaagccacagcucucuuaucagaaaaacagaccuaauagcuaccucacaaauaugaaacucaaacgucugccacauacauaaaauacuuaucucccauuacaggagcuuaaauauucagagacagcauacuauuaaaaagaguaugacccuuggaaucagguaguugguaagcuaccucuuugaaucucagcauccucuucugcaaaauaaacuaacauguaccuauauauccagcaaugcugucgugagauucaaacugggagaaacguauuuucggcaucugaaacaacauggaaccuaacagggguuucuuuaagcuaaguccaaaccuuuucucccucuaagcauuauuaagaucuaccucaaauguucaugguaauuaaauauauguaaaauccuuggcacaaaauccuuccauaaaccaggccugcacuuuuuccucuucuccucuaagauguaaguugagggagaggcagugaagcagcagaaauagauaacauggaaauuugaaccaccugcuuaugcaguucacuugugccugcuggaccuacuuggguccagcaucaaacguguuacuucuauuucuaauggaaugcagcuguacaaauccaauuuuacgauguguagguaagaugcaguucaugaugaacauuuggauccuguaauaauuugguaugucccauaaccaggcauucagucuuuaccaaggcccaguagcaagccagaagcugcuuuugugaauguagaauagcugguggcagaggacagcacagccaagaaucuaggggucuuacuuguaauucuauuggggcuugccaaaagcacaacauggcaucuuuagcugacaccuaagucagucaccugggucuacuaggucauaauguccaagugauagggcaacuuguaucauagccuggaccuuuugcagagucuuuucuagauccaaaccuuacuaacacuuuagugguuccccacuaaauguguuagagguuauccaguaaauaggucaaaauagcaugccuaaaugugaccaaccaauauguuggcuccaaaauccaaacgcaucacacauuguuccucuuucuucacagugugugguacaagguacagcaacuucccucucacuuuagaagggauaucccaauauuucccaaacccuggggccacuagaaacuuuccuaaugugaaaaggcccucaagcuuccacaagguuuguuucugacucucuggcacaaauaugucugaggcaucuaaggugugcuuguguuuucugcucacaagauccaguuagcauaauggcaucaauuuaauguaccaguacuauggucucuguuuuaucagacuaucaaggucccuugcauuuugcaggagaaagcagcaagcacaacguuaagauauaagaaagcauuugccaguucgauagcucaauaacaauugccaggguuuacagugauuuauuucaauagauaccaaaucuggggaaaaaauccuuugcacagcuacugauacacaaagugaucaauaaaagccuuucauaauaguaccuagcauugaccacaguaugggaaaugggggcaaucauguaugcugcucaaggaaaauagacaacucaagucuuaaaaauguccauaaccagugacauaaaaauuccacuucuaggaguuuaugcuaaguaacuugcuaguaacuaggaaauaagagccagaaaucaguauaugacuccaagagcaaccccuuacaauccacuagguuaaaaauuguuuuuuaauuugcauuucuccaauuacccgcuaaguugaaucuugcuggacguuuacuggguuuguucuuuucuuaaaugcccuaugcccauuuugucauugggauauucauuucuccugauuuagcuacugaaaauauuaacuacacuggguuacaaauauuuuccccagcuugucaugugucuucccccucccccaccccaccugagcuuauuaagggguaaaugguauacaaaaaaacugcacguaauucaugcauacaacugggugaguuuggauguauguauacacucacguugccaucaccacaauccagguaauaaacauauccaucaccuccaaguuuccuugugucccuacgugugugugcaugauugugugugguaagaauacuuaacgugagaucuacccucguaacaaauuuuuaaguagaguagucccucuguauccacuggggauugauucuaggacccccaugaauaccaaaaucuaugcugcucauccuuuguauaaaauggcaaugguauuuguauauaaccuauacacauccuccuauauacuuuaaaccaucucuaguauuacaauacugaauucgauguaaauagcuguuacacugcauugcuucaaaauuucuauuuuuacuuuuguauuguucuuuuuuauuguuuuuucccccaaauauuuacuauccaguugguuccaucugcaaauguggaacccacacacggagggcagacuauacucaauaccugacuguuaacuauaggcacuauguuguucuacagcagaucucuggaacgaacuugccugguauaauuuuauacccacugagcagcaacucccccuucucucucccaccauuuccugguaacuaucauucuacugccuaccuuuacaccuuugacuauuuuagaugccucauauaagaggauucaugcacuauuugucccucugcggcugacuuauuucacuuugccuaaugucuuccagggauuaauuuccaaaauauauaaggaacuccugcaacucaauagcaaaaaaaucccaaauaacacaauuuaaaaacgggcaagggucuugaauagacauuuauccagaugucuauuuacauacaaauaguuuuaaaauauauaaaaaggugcucccuaucaaggaaaucaagggaaugcaaaucaaaaccacaaugagauauuacuucacaccuauuaggauggcuauugucaugucuuuuuaauuuuggauacaguauuuaacauuuccauuaugguuuuuuuccuuuguuuuaaugcuuggaaagaccaugcccacuuaagacaaaguaaacauucaccuacauguucuacuucuccuauagcuuauuucuuuuaaaaacauuugacuuuugguuuaucuaaaauuuaucgcaauauaauagucccacaugcucuacaagauaaucauucuagcaugguuuccuaauacugucccuucuuuccaauuuauaaucccucuauuaccauauaucuaguucuuauauacacuaggaucacuuuucuaggucuucuauucucguagcaguagauucuuacauugguuccacuuuaaauuuuuaaauuauaguuucuuaagcaaguuuucuuuuuguccuucaguaaaagacauucaaguacacaguugucaaaacuucuagaugccaaaacacaucaaaaacaaaaucaaaagcaaaugaagauauuuccaacagauaugaaaaugaguacguucaauauauauggcauucaguaagagaaacacugauauuccaaugucagauacaaaaugaauggcacaagaagauaacugauauagaacagugaaauacuuucuuccccacuuaugaaauuaacaaaaauuuaaaagacaaucuguaauacugacaaggguauaugaagaaagugcugcucauacucauuaguacaaugcuaaaugaaaagggcaggauaauugugugugcacauguaauaauuuuuuaaaagacuggaagaagccugggcaacaaggcaagauccugucucuacacaaaauaaaaaauuagccaggcaugguggcaugcaccuauggucccagcuacucaggaagcugaggugggagcaucgcuugagcugggaggucaaggcugcagugagcugugaucgugccacugcacuccagccugugugacagagcaaaacccugucucaaaacaaacaaacaaacaaaaaaaacuggaagaaaugcagcaaaauguuauuguuaucuuuuggugauacuugccagguacuuuuacauuuuuugaaaaccaaguggcuuguauuuacgauaugaacuaacuuaugugccagauacuaugcuaagcaauugccucacaucaagaaggaaaaaauuuucagccccauuuugcagcuguggaaaccaggcaaguuaauaaccucucagccacaaaagucugguaagauucaaaccuaggucuaauuucaaagcuugugcucucugaacuaagcacaaggggucaacaggacuaucacaaugcaauaccacuuccucaaccuuagaaagcaguucaagcuagcugguggaauauuacuagauuaaagcugggauuucuacugucgacaaaggguuaauugauaugaccacccaauacacaaguuaagcugaauugugugauuaagaaucaguaauaaagacaagcuaaaacacuggccuuaacaaaaaaacuaguaagaaagauguuaccacuuucauuuucuaaaaaacaaaauugcaagaucccagaaguacauuaaaaaucugaacccauaucugcucuuuccauuauaccacacauccuuucugcauaggaaggaauugcacagcagccugagagcugacuucaggcacacacagcuacgaagaacuaacugaucgguguucacuuuccacuggucucuuggcuauccauuuuuuugauccagggaaguucaaaagaaaaucuuacuguuucuagacaaguuguuguuuuacugccuuuuguauauaugggugaugagauuugaagagcauggaugaacuguucacaaauauuuuuuuauuuuuuaaugaagaaaaaauaagcaaaguaaacuuuuggauacuuacagccucaguaggugucuucuucaguuuaguccugucuacuuucaugauuucaauuuucagcuuuacgaucugaaaaaagaaaaucccaaaagaagugagaacuuaaagcuacaaucuugagcucuacaagcuuggacacagacaauacagaaugaagagcaaugcaaaaugcuuaaaguaaaaacacuggaguuaugaugcuaugccaacucagaggcacagcuaucagguagagagagguaaagaaucucuccagaucaaacuggcccacaucccuauguugcacaagacugaaaccaaaucaggucaaaaugaaaauuuuuucucuuuuacaagcaucucaaacucuuaauugaaaauaagaguguacaauguuugcaacacaucucaggauggaaaaauucaccauagcccugcaguuuccugauaacuuccauuucuaggaauuaauccaaagaaagucguaaagauguacacaaauauuuaaccacaagaauccauacugcaugaccauguauaauaguaaaagacugaaaaagaccuacuguuccaucacaaggcuaaaaaaaagaucaaauguccaaaauacgacugguuuaaaauggaaugucacacaacuguuaaaaauauugcaaacuauguaauacacaaagauguucaugaugaaauaaaaagauuacaacacagaacauacgguauaaaacuuaugucuaaagaaaacagcuuagaggugcuaggcaucagaauauuaauucauuguuaaccaaaaggauuaaguaugacuguuuuaccuaugcaccuuuuacuguuccuaccaauaaaaauguauuaguuguaucauaagagcaaaggcaaaacaacacuuuuuucaacuagaaaaugaaguauaaggaucacaacagaaauauucugagcacagaaaacaaucauuuuauuaagccauguaauuuggaaggcucaaaagcagacaacagccugaucagauccacuguauaaucccuagaucuuugauggcagacaaguccuccaaagcacaagaagaaauaaguuucuccuguuagcaacuaagacacaugcacagagguagaaguggguugcaggcucuuuacacacaaaagauucugcuauuaacaauguauuuaacucaguggcagucacuagaaaucaauguuccucccccgagaaggcugccauaauauaaagcugaccaauuacaguauaaauuuuaggcagcuuuuugccuagauuuaguccaauauacucaguacuauggaaauagcguguauuugccuguacgaccuguauccauucaaucagcaggcauucaaggaagaguuugugaaaaauucagaauacguucuaaaacauuucugcagagaccauuccuuaagaagaaaaaauguuuucuaugguugauauuuaggguguguaauuccagauuacuuuuuaaaaaguuaucucaguaucaauacaaaaugaacaaaaugccugaugccaacaaccucaaaauaucucaaaugaagccaacaggauucuggcaacaauccuguccaugugguggaaacuauaagcugagcuauuuguacgcuuacucucaaggcuuuuuuccuccccuuuucucauaaacgucuuacgcaaguggcugucacacuauugucgcuucagucauuugcagggaggcuauuaaacugccccugcugcaagacguagcagccagccucaauacaacucaaauaacugaugcuuucccucuaagauuaggaacaaggcaaagaugucuguuaucaugacuuuuauucaacauacugcugaaaguucuagccaauauaauacaguaagaaaaagaaauaacaggcacacagauaagaaaagaaaaaauaaaaauggucccuauuugcagaugucaaaggaucauccacauagaaaacccaagaaaucuauuuuaaaagccucccagaggaugggcgcaguggcucacugcacuccagccugggcaacagagcgagacuccaucuuaaaaaaacaaaggccaggcaggcgcaguggcucacaccuguaaucccagcacuuugggaggcugaggcgggcggaucaugaggucaggagauggagaccauccuggcuaacacgguaaaaccccgucucuacuaaaaauacaaaaaaaguagccgggcguggaaggacaagccuguaaucccagcuacuugggaggcugaggcagaagaauugcuugaaacuaggaggcggagguugcagugagccuagauuguaccguugcacuccagccuggcgacagagcgagacuccaucucaaaauaaaaaaaaauaaauuagccaggcgugguggcgagcaccuguagucccagcuacucaggaggcugaggcaggagaauggcaugaacccgggaggcagagcuugcagugagccgagauagugccacugcacuccagccugggugacagagcgagacuccagucucaaaaaaaaaaaaaaaaaaaaaaaaaucaaagcucuaaauacauggagagaucuaagacucuaguaaagaugucaaaucuccuaaaauuguuauauagguuuaauauaauuccuauucaaaucccagcaagauguuuuuuuguaaauaagcugagauuauucuaaaguguauauguuguauaagaacaacaauggcugaaacaauuuuggaaaaaaauaaaagagggaggaauugaauuacccuacccacuuuuaagacuuacuauauagcuacagacaucaaguaguacugauauauauacaaguaucaauagagcagaauagagaacccagaaauagacucauacaaauaugcccaacugauuuuugacaaagguuaaaaaaaaaaacaauucagucaaggaaagauaguuuuaucaacaaauggugccagagaaagcagacaugcacaggcaaaaaagaugaacuucgaccuaagccucacacuuuauauaaaaaauuaacucaaaaugaaucacuuaaauauaggacaauaaaauuuacuaggagaaaauauuugcaaaccauauauaguaucuaaaauacauaaagaacucucaaaauucaacagugaaaagucaaacaaucucaguaaacuaggaauagagaacuucuucaaauugauuaaaauaucuacaaaaaaagcuacaacuaauaucuuaauggucaggaacuaggagcauucccccuuaaauaaucacaaacaaaaaaggccaggcgcaguggcucaugccuguaaucccaacacuuugggaggccuaggugggcagaucauuugagguaaggaguucaagaccagccuggccaacauggcaaaaccccuuaaucccagcuacucaggaggcugaggcaggagaauugcuugaauccaggaggcagagaucgcagugagcugagaucgcgccacugcauuccagccugggcgacagagugagacuccgucucaaaaaagaaaaagauguccucucuuaccacugcuuuccaacacuguauugaaaguccuagcuaaagcaguaaaggaaauaaaaauuauaaagauugggaaggaagauacagaacugucuuuuugucagagaugacaugaucauacaugcagaaaaucugaaauaaggaaaaacacccuggaacuaacaagcaauugcaccaaguuugcaggauauaagguuaauauacaaaagucaauugcuggccaggcacgguggcucaggucugcaaucccagcacuuugggaggcugaggcgggcggaucacaaggucaggagaucgagaccauccuggcuaacacggugaaaccccgucucuacuaaaaacacaaaaaauuagccaggcgugguggcgggcgccuguagucccaacuacucgggaggcugaggcaggagaauggcaugagccugggaggcugagcuugcagugagcugagauggcgccacugcacuccagccuggggcgacaaagcaagacuccgucucaaaaaaaaaaaaaaaaaaaaaaagucaauugcuuuccuauauaccagcaacgaacaagcagaauuugaaauaaaaaacauuuauauuagcaccccaaaacugaaaaacuuagauauaaaucuaacaaaauauguauaaggucuauacaaggaagacuauaaaauucugaugaaagaaaucaaagaacaauuaaauggagagauauuccaaguccauggauaggaagauucaauacugccaaaauguuaagucauuuccaacuccacagauucaaugcaacuccaauuaaaauuucaacaaguuauaugaauacugacaaacugauucuaaaauuuauaugaagaggcaaaagauccacgauagccaacacaauaucaaaggagaagaacaaagucagaagaccuacauuacccaaaaucaagucuuaucauaagacaacaguaaguaagaguacuguaccgguaaaagaaugaacaaaucaauggaacagaauuagggagcccagaaguagacccacauaaauauugucaaccgaugaucuuugacaaagaagcaaagucaauauaauggacaaaagauaguuuuuucaacaaauggugcuggaacaacucgauacauacaugcgaaaaaaaaaaucuaaaccgaaauuacauguuucacaaaaauuaagucaaaauggaucacagaccuaaauguaaaauauucugcucuguaaaagacacugucaaaagaauaaguggacaagccagacugacagaaaauauuugcaaaagacauacaaaggacuguuacccaagauacacaaagaacucuuaaaacucaacaguaagaaaacaagcugauuuaaaaaugggccaaugggccaaagaccuuaacauacaccucaccacagacagacagauggcaaauaaacauaugaaaagauacuccacaucauacggcaucauggaaaugcaaauuaaaaccaugaugauauaucacuacggccaaaacccagaacacugacaacaccaaaugcuugugaggauguggagcaaguggaacauucauucauugcuggugggaaugcaaaauaguacagccacuuuggaagucaguucagcaauuucuuacaaaacuacucuuaccacaugacccagcaaucaauacucccugguauuuacccaaaggaguugaaaacuuauguccacacaaaaaccugcacauggauguuuauaguaccuucauucacuauugucaaaacuuggaagaaaccacaauguccuuugguaggugaauggauaaacugugguacauccagacaauggaguauuauucaguacuaaaaagaaacgagcuaucaagccaugaacaaacauggaggaaaccuaaaugcauauuaguaagugaaagaaaucaguacaaaaaggcuacauacuguaugauuccaaccacaugacauucuagaaaagaaaaaacuauagagacaguaaaaagaucagugguugaggaggguuaguggggagggaagaaugaagagguggagcgcagaggauuuuuuggccagugaaacuacucuguaugauacuacaaugguggacacauguuauuaugugucuaaaccccaaaaguauacaccaugaguaaacccuaauguuaacuauggccuuugagugauaaugauguaucaauguagauuaaucaauuguaacaaguguaccacucuagugggagauguugauaacaagggaggcuaugccuguguggaggcaggcaguauaugggaaauuucuguaccuucugcucgauuuugcugggaauguaaaacuacucuaaaaauaaagucuauuuuaaaaaaacaauccuccaaaacaagagcacagaguaacuuaugcacugaaauaagcaaaucacaaccauuuuacuuuuuuaaugcagaugagucacugaugaaucuucaaacaaauaagcaacuugcucuaaugcuguuuugaccuaguguacuauacuagucaagugucuguaacuacagaaagacuggauaauuaaugcagccaaguaauuuacuggagaguaucugauagcucacagaacugacagaaggcuagagcuccacgugcagaaaacuaagaggaaccaaggaagcuagggagccuggaacuacagccagaccccccacggaaacagcuuagcuugggguacuucugcugccaacacaagacucuggaugccuagaaacuaugcugguggcauaauucuaaaucaucucagguuauuugcaugaguggcgcuagacucuaagucccaaguguaagcauuugaugcacccaauaaaauaacagagccaauaugaaugcacacacacaaauguucccauaacaagugcaguccuaccuuggugucuauaauucuacugcaagaaacauuuguaguuuaaaaaaccaagacaucacuguccaugagacaucaacuuuaaaaauuuagaaguuguuguguucucauauuucuaaaacugguuucaacagugggaggggggaacguuaguauacugaguguccauuacaagccagacaauacugagacuggaguuccccaaaguguguuagaaugucuugcucuauaaagggagacaagaauccuguaauuugggaaauguuauagacagaauuucucuuccacuagggcagucacauagcuaauugacauuauuaauggcucuaagacaucuuagguaaaggaggcuuauuagcgcacagaaccauuuucucaaguggcaucuacucaaaguccaauugaaguauuccaaagaauacaguuugagacaugcuaccuagggaauucauaugauauuuuuucauacaguccucaccacucaagucaaguuuugccucuauuuacagauagaaaacugaaguaagagagaaaaaaaguaccuuucuuggucaguaaauguuagcaccaagaucuaaauccaggucugacuaccaaguccaugcuuuaauaacaugcgauucacuuuuuuuuuuuuuuuuuugagauggagucuugcucugucgcccaggcuggagugcaguggcgcaaucucggcucacugcaagcuccgccucccggguucacgccauucuccugccucagccucccgaguagcugggacuacaggcgcccgccaccacacccagcuaauuuuuuguauuuuuaguagagacagaguuucacuguguuagccaggauggucucgaucuccugacguugugauccgcccgccucggcuucccaaagugcugggauuacaggcgugagccacggcacccagccucaccuuuuuuuaaaaccaguuuuauuacuacaaaauauuggcagauaagaauaaaaauuugugacagauucuucuagacugcugaauccuauuuguuugaaaaaauuacuccaagagaggaaacuagggcccaagaugagaagcugagaugcuguaauuucacuaaugaaaggaacaguaacuggggaaugaguucuaccucuuagaaguuaaucaggugaaaacccuauuacauuuaaaaaaaaauccuuccauaaaaauaaguuaguuugaaacaaauuccuagaaauggccuacugccuuuguugggucagaaccagaacucagggcaccaagcaaucucuauauauaauaaacauugcuuccuaaacuuagguuagaaagauagccaacuuaaaagaaaacaagugaauuacuaugaaucaccauccauaucuauuaccauuacuucaauacuuuuaucuaauauuuuuuuucacuuccuuauucccccaaccuuuccuuacaccccugagguuugaaucuugguuuuguacaguuuaccugcagaacaaguguacacaacuaaaauauccugagggaagccacucaaagcgugacucauauucuauaguaaucaccuccaguugauaauauuuaaaaauaaugacuuucaauacugaaucaguuuaagggcacaggacaccuguaguucccaaaucuggcucaagagcaguuggauguagugaaagacuagccuuacuaaucaagugugguccaaggaucagcagcacugacaucaccugggaguuauuaaaaguugcagaauuucaggccccaccuagauaugaggagucagaacccgcauuuuaacaagauccuuaggugauccauauaacaaaguuugagaagcacuagaucagaauacagacucagaaaaccugggcuagaaucccugcuauaucacuuacucacugcauaaccgcagacaaauccaccucucuaugcuuguuuccucaacuguguaauuauucuuuccauuuaguucuuggaacacucuaauuucuaaguucgccgcuggaauguuuuugccaccccuccuuucccacaacuaguuccauuugaggaacugacauuuaaacuaagacccagagaggcuuuccaugacaacccaccucaaguuggucccacuguaauuuuucuauuauagcacccaguuuauuuccaauuuccuucauaacaaguaucaacuguaauuacugguuugauuuucuaagauguuaagcucucaguaccuagcacgguaucuuccacaugauagguaugcaaauauuuguagaauggaguucaggaaagacguaugcauuaagaauaaaaucugugauugucagcacacauauauuacuugaagccaugggucuggagaugacugcuuacaaagaaggaaaggaggaggcccgcaacugaguuauuugcucuagcauuuaaagguaaggcaaagaaggggccggguacaauggcucaagccuauaaucuuagcacuuugggaggcugagggcagauuccuuaaacgagaccagccugggcaacauggugaaaccccaucucuaccaaaaaaaauacaauacaauaaaaguguaaagguaaggaaagaaggaaaacccagcaauggagaggcuagugaggaaagagcaaaacuagcuaauuaugcuaucacgagagacgaaagauggcaagagugaucaacugcaucaaaugucaaaaugagguauguccacugaaauugguaauagagacaauuugacaagcaauuguuucagugggauggagggaauggaagccagacuagagucagggaaucaauggaaagugagaaagcauaaaugguauguguaaaaaccucuucugaaaauguugggccaggggcaguagcucacgccuguaaucccagcacucugggaggccgaggcggguggaucacccaaggucaggaguuugagaccagccugaccaacauggugaaaccccgucucuacuaaauacaaaaaaauuagccgggugugguggcgcaugucuguaaucccagcuacuucggaggcugaggcaggagaaucgcuuaaacccgggaggcggagguugcagugagccgagauugcaccauugcacuccagucugggcaacaagagugaaacuccaucucgggggaaaaaauauauauauaggcuguaaauggaagcagagaauuauggggucacugaaauguagaggaaaagguaaauaaagacacuagcuuauguucucaaguggcugcaaacugucuugaaaagacggaguaacuguaagaaucccuuugaaaauuggggguaggggaccauuuagccucuauuucacuguaauauaauaagcacuuaugcagguuugaacagaaugauauccagaauuuggacaaucuucucccgaaccccucaaaucuugacuggauaucccaccauaugugauuacauuguacucuguaccuaucacuucccuauuuaugagaaaaugucugccacagggugggaaaguuaaaaaaaaaaaaaaaccugggaagggaagaaauacacauuauuaguaguuggccuuuaaugguugccucuagcuggcaggguaacacauaguuuuauuuaugcuucaugcuuuucuaauccuuccaaauuuccuauaaaucauggauccauuuauaaucagauuuccuuuuguaauuuguuuuuuuaaagaaacagggucucauucugucaccuaggcuggagugcagcggcaugaucuuggcucacugcagccucaaccucccaggcucaagcaauccucucaccucagccuccagaguagcugggaccacaggcacacucuaccacgccuggcuaauuuuuauauuucuuguacagacaggguuuucgccauguuguccaggguggucucgaaguccugaguuaaaacaauccuccuggccucagccucccaaagugcugagauuacaggcguuagccacugugccaggccuaaaauuuuccuuaaggaagaaaacacuggccccugagccaaaggacaugcaccagauuaagaacaccaucuaaacaaaugccuuagauuagcugcugccuacucuaggagcuucuucccuacaucuucugguguuuggagcuuggcacacaggaggcacuuugguugauuauuagcagguaagagauguugcacguaaguacgggaguggggaugaaucaaaaugagccuaaaauccccauagaaaucauggaagcauuacggcaguucuuaaacaaaaaaugcuuagagaaaacuaaacuccaaaguaccacaaagcaaaauacuuuauuuuuugccuugcaacgauuuccuuuugccuuauagucucugaaaguaaauucaggugagagcugcccugagcauucuucaugucaacaagcaguaagaugcaucuugaaauccagccugcuauucacuauuugauuauagaggaauaggugucacugauuaugauuuguuaaaggggacaccacauaauugucaggccuuuccauccuaucuaguuucugauuaucuauuaauacauuaauauccacucaacaaauauugugaaaaacauuuaugaucauaaaaaaauagcuaacacuuacucuauaccuauugugcauuaucuuuaauccuuggagaugaagacugugcccaguuuacugagaguggccacauaccuauuaagugguaaaacguggauucaaacccaaaucuguuccacaacucuacauugcacauaaugucuauaugcacagcccaccuugcuacgccccucuccuacagacaccagucucccuauccuuagccacauaaaacaugacucucaagugcccugagaacugcugaccuagguuuuacugggcacugacaguaaagugucauaauaaagcaacugaaaaauagccuuuacucacccaagacaaaucuggaaauuauuugcagaaauaccuugaaggagucucucauuuaaaaucugaaaacacacuauaccucagauuaagaguuuaugcuggcucuggguguuucucugcacugcaguuaugcuuaagcaaggaaaauaugggcagggagggauacuaagaaagaggaaucugaaaccuccaauguugacuuugaacgugagaauaguaucugagaacacaucuccugccacauccucuauucaaacagucuggggaagcugcagaucugggaguuauccuucccggauacucccaauuacuuagagaaacuggcaucagaagaacuaggcaaccaaacauggcucaccaaaguugcagauuaucaauuuuaccaauacagaggaaaugacagcaugcuaaggagcccuucuugguauucucaacaaaaaauaaaaacagcaaugccuaaguguaaguuaagcaaauuaagcaggagaggaacagacuccuugucuacacauuuuaaauugguacucuggaauauuccuagucuacaccuuaagaauugucaguuucuggcugcaugccuguaaucccagcacuuuggaagccugaggugggaggauaagccugaggugggaggaucacuugaggccaggaguuuucccgagaccagccugggccacagagugagaccuccgucucuacaaaaaauaaauaaaaauuuauaagaaaagccugccuguaucgaauaggugaauuucacccagaagggccacaggcagcauucaaugaguucaggaaaguauuuucauuugucagaaguuauuuuaaaauuaucuuaaaaauaacuuacuucacccgagacuuauuuugaaaacuaaaaaugccugaccacacaggcauuucaaagcuaucuaauucaguaggucugaaguggggauuauuuuuuucaagcuguacaggugauuuggcagcacaggccagccuugagagccauggcauuagauuauuauucaauauaugcuuugccauucugugacuuaggaacuugcuuuaauaaaaauagaggggaggagcgggguauaaauagaacaauagcccuguguugaucacuguucaagcugggugacaguuacauggguguucauuaugcuuuuuucuauuuuuguauauguuuugaaaagucucauaaauugaaguuauuuuaaagugagacuuuuuccugcuggauccauccauucuauccuccacauuguugccagagcaaucucccuaaaacucaaaaccuaccuacaucaaguacaaacuccuuauuuaaaccagcauccaagaccucuaggaccuggucccugcuuaccucucuuaccagugcuaugauauuacauaauauuucccucagcuccccacaugcuuuauuuagccccaacuauauccugcauauugauccucaaucagcacaccucuuuacuuaccugacagucuccccacuaugcuugcugaguucugcaagagugggacuguaucauauuuaucuuugcauuccuguaccagcauaugaacugucauuuauuaauagcagauuaauaaaugaauaacuauccaguaaaugcuuaacaaaacuaaaaaaaauccaagucacauuaaacucuuggugaacugaaaaaaacaauuuagauucauuuaaccuucaucuuuccauucaacaauuauaaacauacuauaugcagggcauugagaugaauacucagauagccagguguacagaaauguagaaaauaaggaaaaaaaucagaaauaaaauagauuagaagcaaucguaauauaaaggcaacgaagucaauacacaaaaaaagagaauuacaacuuccucaugcccaaaggcugaaaacacaaccaauuauaagaucaauacagaagauaaauuaaauuugcauaauacagaguauaucuuuaagcaaaagugacacaguuagccaagcuuacccuugaccacuguguagaaaaauaagucuagaaaaauauauacaguugcucuucaacauaugaugggauuauaucccaguaaacccauuguaaacuggaaauaucuaagucaaaaaugcacuuacuguacccaaccgaccaaacaucauagccuagccuaccuuaaacaugcuugcaauauuuacauuagagccuauaguugggcaaaaucaucuaacacaaagcccguuuuauaauaaauguucaaugucucauguaacuuaauaucgacugaaaguggaaaacaaaaugguuauguggguacucaaguaugcuuucuacuaaauguguuucgcuuucacaccaucguaaagucaaaaaauccuaaguugaaccaucauuaagucggggacgccuguacuaagaaauacaagaacaaacaacauagcaauuuagacaucuuaaugacauauagagaaaaacaaguguagaggaaucuuuagaauuccucauccuauacugaaggaugaccacuacaaaaacccugaaauucugugggaaauuuuacauauguuggucuuuuucccagaagacggucaacagcuuucauuggcuucuuaaaaggaucuaugaccugaagaacauuaggaaccaaugcccuaaagaaaguuaagacacugucuaucuagccaugacaauguuuucccuuguauuucccuuucauuuaugaaacacagguauaugguauuuuuuucccaaagccacaugauagacuacugucaaauacaauaaagaugguaccagauaccaaagaaacagaauuccaccccuuuugcauuauucagcuccaauucucucauguccuuggguuugcagagaaacaagcagcaucucuaaagaucaaaccuccccggccgggcgcgguggcucaccccuauaauccuagcacuuugggaggcugagguggguggaucaugacaucaggaguucaagaccagccuggccaacauggugaaaccccgucucuacuaaaaauacaaaaauuagcugggcgugguggcacacaccuguagucccagcuacucgggaggccgaggcagaagaaucgcuugaacucgggagguggagguugcagugagucgagaucaugccacugcccuccagccugagugacaaaguaagacuccaucucaaaaaaaaaaaaaaaaaaguagaggcugaagacuaccacuggaagaaaaguaaaaaugaaguaaaggacaacagcauaauggaaaagccugggaaacagacagaucugggccuaaauuccauuuacuaggugugugaucuuagacaaguugccauacaucucugaguccagucaccucuguaaaauaaacaagucuaucucauaggauugugcccagcaaagaguaagccguauugcuauuuguucuauuucuuuuggcuccagauuaaucuaaaggcagaaaccuuaugcuagguauucuacagauugauaagacagaaauacagauauauaaaucugaucauaugcaaaagagcuggccuucucaaucuuucuacacauuaccugcauaugaaggagaacauacaguauauacuaaucuccauacuguuagccauaacugcagacaaccaacaacuuaaacucuacuuugaugacaaugagauugggaggcuccaguuucauucucaaauuauacaguucugcaaaagguaaacagucuacuaaauaaugugcaggccaugccacuuaaucaaaaauuuuaacugggucucaacuguuuugagcugguucaaaugaauuuggaaggaauggagacaaagauucuuuugcaugguuuaaaagagcaaguuauuuauagcaauuaucaaccuggcagcaaacucuuuccaggauguugaaaagaauuccaacuucacagguuuguuaugaggcucaaauuaguucacugauaagaaaguuguaaaacaaagccuuuaaaaacaaaggugucccaacauauagaaaaaaauggcugucugaguaaauuuuauggugcuccacacagccugacacauaguuauuucaaauguucuuaaauaaaccagacaauucugaacaaucuacugcuuuaaaacauaucuauuacaugaaagaugcuugcuagaaaugaaagugaaguaugcaaagguacucuaguucucagccaccaacuggcuuuaagaccuuaugacauucugggcuuccaacaugauguaaaauggaaguacaauaacuaagaucccuuaaagcacuaucuguaguacuuugccuucagucuaagacaaauguuaaauauuaaacaugaacaaucugaauuauuuucaaaaacuaaacagcuaaaaguaaccaugcuaguuuucuacuugccacaaauuccuagguuuuuaaaaaauaaaacuacacuucugcaaauaauucacuuuuaagcuaagaauauuuuuaaagaucaaauagacuuugccaggaagaaaaacaggagcuacuggcuaaccauuuggaugaaaauaaaaguacacaccuacuucacaccauuacuucagcauaaaaagcuuaacauaguauaaaaauacuuaacauaaguauauacuuaacacaguaauacuuaacuauaaugcuaaaagguguaaacuauuauuuuguuucaaucuuuuuaaaaauagcaaacauguuauaguuuaaaacaguugaaaaaaggaagggaaaauaagauggacuuagaaagcagcccuuuaauuugaaaaaguuuuacaagcaggaaauucagucucaucuacugauuuauagcauccauaaaugcaugaaaacacauggccaaaucgaacuguuccaugaaagagcuccaaguugaucucaugucagaaaguaguaacuacgguuaaaagggcaaagaaacugagcuuucuuuggauuuuugccuuucucacguugacuuucuacuuuaaaauuccccuauuuggggaguaacuuucucauaggaagaggaccacuuacuuuguauuucuacagaugacaccagauggcacauuuagaaauaaaguucaguuuuaaggagagauaaaacauagugaaaacaauacuggacuagguaaccuggguuugaugcucaauuucaccacuauccagccauguuaccauggauauguuauuacuccuacaacugggccuauaaaauaaggaguuugauauggauaauaggaaauauaggguaucauccagcuuuucuguuggacaugaagacuacccuuuuaaagcuguugguaauuugcuagagggagagaucugaauucacccauaaaagcagccugucuuuacuuuuuaaaagcaaaaaucuaaaauucucuacguaaaaggauaucuucuagugaugucugcaucucuccagacuauacuuccuuuuaaggcuggucucaccaagauauuuaaagaaauguaagaagccggggccuggacuccagauuggguuaacaaacugcaaagcccuccaaaguagaagagucaaacuagccccuggaaaaauauggcagcagauauguauaugucuauguauauacguguacguacguauauguauauacguguauauaugcagugagccaucuacaacgauacuggcuauauccagauuuauacucuucugauuuaucaaggcuuauccugaugugcuacaauauuguaaaucaugauggaucauauacuaaacauaucacagugaaaaaugcaagguuagccuuucuaaaggccaauuuagcaaugaguauuaaaagccuuacauuuuuacauuccgguuguagaaauuucuuaaggauauaaauauggaugucacgcaauggacuuuggggacucagggggaaaggaugggaaaggggugagggauaaaagacuauaaauuggguucaguguauacugcuccagugaugggugcaccaaaaucucacaaaucaccacuaaggaacuuacucauguaaccaaauaucaccuguuccccaaaaaccuauggaaauaaaaaauuaaaaauauuaaauauggaucucauaaauauuuaucuauuaggauguaccuaugcuucuuucauucgacacuuauuuacugaaugcugaauuaccuguauguuaggaggcauuacuuaaaaucaugagaaacugggacuggaaaagugugaacacagcaaacugguuaaauaaauucugcauacaauaaaauacaauguagccauuaaaaaugcuacagaagcugggcacaguggcucacgccuguaaucccaguacuuugggaggccgaggcgggcggaucacgaggucaggagaucgagaccauccuggcuaacacggugaaaccccgucucuacuaaaaauacaaaaaaaaauuagccgggcgagguggcaggcaccuguagucccagcuacucaaaaggcugaggcaggagaauggcgugaaccccggggggcggagccugcagugagccgagaucgcgccacugcacuccgaccugggcgacagcgagacuccgucucaaaaaaaaaaaaaaaaaaaaaaaaagcuacagaaguauacauaaugacagagacauggaacgggucaauacgugggaagagcaaauuuaacaauaccauuucuauacuaguuuggagaaaacagcuugaaaaaagacaguuuggggacaccugagggaaaaguaugaacacagcaaaaggugugaacaaagcaaacugguuaaauaaauucugcauacaauagaauacaauguagccauuaaaaaugcuacagaaguauacauaaugacaaagacaugaaacaggggucaauaugugggaagagcaaaguuaaaaauaccauuucuacacuaguuuggagaaaacagcuuggaaaaaaagacaguuuggggacaacugagaaaaugugaauaugaaccggauauuagauaauauuaagaaaaaauaaacucccuaggcgugauaaugguauugugguuuuguagauguccuuacuuuuuuuuuuuuuuuugagacagagucucacucugucgcccaggcuggaaugcaguggcgugaucucagcucacugcaaccuccgccuccuggguucaagugauucuccugccucagccucccgaguagcugggacuacaggugccaccacacccagcuaauuuuuuuauuuuuaguagaggcaggguuucaccauguuggccaggcuggucucgaacuccugaccucaaaugauccacccaccuuggccucccaaagugcucagauuacaggugugagccacugcgcccggcugagauguccucauucuuaagacaugcagcugaaagauuuaaggauaaagugucauccuuacuucuaauguugagaaaaauuaaacacacaucuguacauauaaaucuaauauggcaaauacuuaauuguuggauccagcugaugguauacagauguucauugugcuauguuuucagcauuuuuguuugaaauuuuucauacaaaauugaaagcuggaagggagguaaugaauuacauuuuaaaaagagcauuucugaaaaaauauauaauauggcuacagagcaguuaagaaaagccuucgaagaagauacugcauaccaaaauguuaagaguauuuuaucugugaguuugggguuugcggaaauuugucuguuuaucuguauuuuucaacaauaagccauguauaauucuacagucaugaagauuacuuaaaaacaaauucaggaaaacguuuucaaacaagaguuaacaagaaaaugagcaaacgaaaaaaaguucuauucccaaagcauucuuacuaaaaucagaaugcuucuuacaaacucuaaaauacuguacaaauuuaauauuauuuaauaauagguuuuuguguggccaccacaucgguuuugaacuuuuacuuacauucauaauuuauaccauucucacaguagaaaaauucaagcaauucauuguacugauuguaaggggggaagggaaugcuggguauuaaaaaaguaucuccuguuuaccuauacagguuaaguaucuccuauccagugcuugggaccagcaggauuucagauuucagauucuugaauaucugccuauacaucaugagacaucuugaggaugcggcucaaguuuaaacaugaaauccauucauguuccauacacaccuuauacauacagccugaagguaauuuuacacaauuucucguauaaauuuagguggcacaaguacaguucuguuacauggguauauugugcaguagugaagucuagacauuuaguguaaccaucacccaaauaauguucguuguacccuauacaauauuuuuaauaauucugcucaugaaacaaaguguuaaguacuuaggcguagaauuuuccacuuguggcaucguguugaaacucauuuuggggcauuuugaauuuuggauuagggacacucaacuuguguuacuuccaacuccacaaaaaaauguaaggcaaaaauaaauguuaaaaaugaucaauucuggaguggggguagggacagggauuguuguauuauucucuguacuucucaguauauuuuucagaaguagaaaugcacauauuacagaaaaagguaaaguuccccaugaucccuccucccaaauaaaguugucaguuugccaugguuuuuuuuaaaacauaaauagcaucacauaguauguacucucuugcaacuugccaaaauugccuccaaaauagcuguaucaauuuacgccacuuguaggcaguauuauaaggccagacucuuccuuauaccuuuuacgaugacuugauauuaucaaauuauuuuuuaucaaucuaaugacuaaaaaugaccuuauuuaaauuugcauuucugauuauuaguuugaguaccauuucuuguuaguggacguuuuuaguuuccuauucugggaaaugccuauccuuaaaauuuccuacuagauuucuuuucuuauuccuuaaacacuacccuuaucauuaagaugugaauacaccaaaauguuaacagugacuaaacauugugguggaauuauguauauccucuccccaaauaugcacacauuuucuaguuuuuccugaauucagugauuaaaaacuagaaaaugauaaaauggaugaaaaaaauccuuuuagacaaaagcauuaacuuucaggauacucuacuacagguuacccuuaaggaggucauaaaaucuagcucaaagaaauaaaugcaucuaaagaguaagucuugugaagaaaugaaacaauaaugguuugagacuauugauucauuugggguacguuuaacuaacuuauuuguauagcauuuuugaauucaugaaguacuuuucauuuaucuugcuuaacccuaacaaaacucugugacauucucugaugccuucuuguaaacugcuauagcacauuuuguucauuccucauauuaccauacugacccuuuugugugauuugcaagucuccuuccccuagaccacacuguccuacauucuccagucacuuaucuuuguauucccaggauguagcugcaaugacuacguccucaauaaauauuuguuaaaugaauaucaccaucuucauuuaaaggaugaggaaacuggcucagugaugagguaauuugccccaaguaacauagcuacuaaguauuuuauauaaauuauaaugaccuuaucuucguacuuuacaagcauuuaaaaauacaucaucucgcuuuaaugcucacagcaaccuaugaaauaggcuuuccgauuacuguuuuauagauaagaauggaaauuuagugauauacccuaggcccacucgaauccuaguuuauaugaaguacagcuguuucuuuacauuguacuugaucacuaccuggguaugggagccucuauuuuuauguaccaaguacauuaaggguaggguauaggggaggaaagauggaaguaaggcaguuuaaaggcacaggaaagaggcuggagcccagguguacaggcccaucuaaagaccauaaacugguauuguaaugucaacugcacaugccacucugaaauccaauauuggcccaaagguuuuucuugauauuacccuguauuaauagaagacaauuguuggcuuucucacauaucagcagucucaaaggcuggggaggcacacagaauuaggaaagcugugagaaacaauggacaggcuauaucaugcauagacagugcaggggaagaaaugaugacacaaaggaaaaggcuaaggaacuuuaaacaugauuucacaguccuuaacucgacugugaguuucucaagggcagagaccaagucucauucauuuuaugucccuuacuccuuauacuuagcaacauucaguaaauguuauguuaaaagaaaaaaaaagauauauuaagcuaaaaacugaacaaugacuuccauuuauucagcagcacuuauuacaugccacauacuauacuuuagauauuauguguaauguuuaaaaaaauaagauuuaccuguuugcugaccugccaugcauggugcugcccaaauguguuaacaguggugauacugaugacuauuaggaauacuuauuauagguuacuaagguuacaacagaaccuugaacaccuugaauaggaggggccaguauagacggagagagaucaagguaaccaauguaauacacauuacagaacuagcuaagacccuucagaggguauaaaugugacuccuaaggaguuccaaagugaaaaacuacucuauggaacauucaguuaucacuggccaaagucucagacccaaaauaacucaagaacaaacccuauccugccucaccacugaugaucccacacagaccuaaaggguccagacacauuuuguuaaauggccauuauuuucaccacccugacugcccaccucugagcuguugaaggaguuaaguaaaauaguacauuaaauaaauuaccaucuacugaucaccuaccauguacuaacaccuuacauuuucucuuuaauuccaauaaccauaugaauaagguauuuccccacaucauaacugauauagguuaacuugcccaaacugacagaccuaguaaguggccaggccccaaauccggaacugccugggcuccaugaucuuccuaugauuaucaaggcuucucaaaccuuuccaccuuaacucuaauaaaaagguagagaagaaugaagaggcaggcuagggagguuaaguggaaagagaaaaguggaacuugauagaaaguuccaagcuacccuuggcaaaaacagaauuucuuuugacuucaccuuuuaucuuaaucccauuagcuaauuccaggucuggggcagaaaugcacaagaaugcgccuggaaacaucuugacauaccagauagcaaggaagcuaucaaagacuacuagagagcaugucaguaagaaucaggagccaacuuuaagagaguuccacuagccacaagaagggcaauuugaacuucgcuaaggaucagaacugcaauguauugaaacccaucaaauguuuacaucuauggaugcauaguuauauauacacuuauauguguaaccuuuugaagaugacaggggaccaauucaucaucuugaaagcaauguuuuaaaaaauugaguauuuauccugcucuuccuauauaaacuauauugcugaguaaccaaauaaaagaugaggggaaacaaaauuauuccagcuaacagaugaaaacaaaaugauagcaucagaacgucaccauuuuguagccccccaacaaauuaauggauccaaaaaauucaagucaucguaacauaaucaauguugugaaugaacacccccccaccccacccccccgcaauauauuugccaaagggaacgaaccugaaauuuaucaagucucuggauccagcugccaauuugcaggaaauagagaaguaucaccugggaacuuaucagaaaugcaaaaucuggggccccuccuagaucuacagaaucagaaacucugggaguggggaccagccaaucuuuuaggaaguccucuaggugauucugauguucccuaaaguuucagaaccauuguucuaagcacuuuauaugcauuaacucagcuaaauuucuucagaacucuauaaggcaggcaguauuaucaucauuuuacagaugaaggaccguguggcacaaagcaguuaaguaauuugcacaacaugacacaccugguaagaaaugggagucagaacuugaacucugugaaucuagcuccagaguccauguucuuaaucgcugugcugaaaggucuuuccaccuguaagaacucaauugucagaaugccguaauaaagaauauuggaaguuuaaaaaaaaaaaaaaaaaaagcaaagaccaggagaaacaugccucacuauaaaauagacaggaauauaagaaaauaaucauagcaaauaauguacccaaaguaaucuuccaaaaucauuccaaaacauuaacagccaccaaauguaauauacccacgcacuucuggggcaauuaucucugauaucuaaucacaaggaccuaaaaccuggauugugcuaaaggugguacauaaauucaugacaguauccucagacucaucaaucuuuuaaaucuaaaugguuauagugaaaggucauuccagaauaauucaucucccuacuuuuagucaccauuuacuuaaugacuacugaaaggaaaaacugcugucuuucaauaccuaagauuauaccaucagaaucucagaguugaagaauuuuaacauucaucuaguucaaucagcaauccagacugaaucagaucuacaaucccaaucuccacguaaugguacauucauaauaaauuaaaacauuccaacuuucuguaaaaucacauuaugggaucauucuaugccaccaacuguaauuuuuaaagccaaaugacuaaaaacuuuuaaagagaacuuaaaaguugaaaaugcucagguuaacagcccaaacaaaaccuacaguuguuuuacucauagagccacuucuucacuaccugaaaggauuucuauauccagaagaccaagcuggucaacaaguacaucaaguuuuaacaacaccaccuaugaaacaucaaacgacuuaaaaguugaguuauuccugacauuaacauauauaaacaucuaguaaccagucguugaggaaacaacgaauaauacagcaaaacaccaaaagcccaaguacuuaugaauaucaaccuuauagauagugagaucaucauaaagcagccuaaaaguccuuaaaggacuuuaugcuaaggaaacauaaauuucagaugaaaugaaaugaaaaaucacaguaggaaaacuaagguuguguauaauagcugaaaaucaacauguaaguagaagcucucaaaaacuguuuuaguauugccauuucaagaacuguaugacagccaggaacucauuauuaggucuuaauagcuuagaaguuaugggucagaacagcugagacacuaacaucaaaagaauaaaaagcaacauuauaaaguaguauaaaaauaacuaaaucaccuaaggaaauugaaaccaugcaugaaaaaccccaaaggcacaaucaggucauuaggaaacacuagcuucuuccaccaggaggccuacuuuucauguggagcaaugagcaaggccaagacauggaacugaagucagguaucaaaucagacuuugccacagaaaaaggaauccaugacuaguuauuuuaggauagugccuaugacagcacuaucaacuccaacuaggauacaggagauuauagccauuguuccauuauaauggguccuccagggucuuuaauugagcaagaauggguuagacaccacuacugggcuguaauccccaaauauggggggcgggaaacuauauauaggacaauuucuucaacaaauaaauuggaagaaaaaaaaaacaaaagacagaaccugcagauuaaaauagauuuaacagcuguaucaaugcuuugcaauaaaugugcuuucucaggauccugauucaaacaaacuguaaaagaaaaaaaacaaagcuuaaaaaaaaaucagaaaucugaacauuuuauauuugauauuuuuaaauaucuguuaauuuuuucaguugugauaauaguuuugaucuuauauuuaaagagcccuugccuuuuagaaauacaaacaaguauuuuacaaauaaauaugacagggauuuauuccaauauaauccauugaggggggcagugguuagaaguauagaugaaacaggcugggccugguggcucacgccuguaaucccaacacuuugggaggccaagaagggaggauggcuugagcccaggaguuugugaccagucuaggcaacacgaugaaaccccaucucaauuuaaaaaaauuaaaaaaaaccaaacaaacagaaguauagaugaaauagaaugugcaaguugauacuauuaaagcuggugauggguaaguggggggauuauuauacuauucaauguuugcauguuugaaauuuuucguaacuuuaauaagaacugguuagacauaaugacuugcaauuuuauuuuuugaacgaugccuagggugauuuaaaaaaucauguacagacaucauucauuuaaacaauucccuuuaauucaguaaugagcuccacuuuaaaaaaagaagcaaccaguaccacaucagauccagagaauggaagaaaccaaaguagcuccauuacagaaugggaauacauccaccccuacuaucuccauuccaggaaguaaaauacaaauacuucccacaagauuuacaaaaacuaaccuaaaaucacagccaaucauacucauccuggugggaaauuccccacacugcuccaacagcuucccgaaccuuccugaccaaguuggccugcugguuucucuggaucacuaacccacucaggucaggcugcuggaggaccuacaaaaaaaaaguugggggagaggagugagauacacaacacauuuauuagggugugugaggaggguuaaccauucuauuauguucaaacauaacuaguuauuauuucuaaagcaauaguccuuacauaucuauuugcauuuuuuaggaccugcuuugagaaguaacugaggaauucagaaccaacaacucuaauacuucuaacgcuuagacaacauuccugaaaacugaguucucaacccaaaugaaauuauagaagacaguuuauuuuuuagacaaguuuauacccucaauauaaacacuaaggacguauuuguuucauuguuucugugaaaaaaaacaacaacuguacauauaaaaauuauucuucaccuucauacaugcuuuuuggccauauugggagacaaacgauaaacauccuggcaacucagguugaacuuugccauugaaccuuagacaaaguuuuuauuugguauugucacuccuuccucucuucucagagaucuaccuagaauaaguuaaacuuuuaggucacaccuagauuaucauucccagauuuauucuauugcucaauaagggucaaauugaaauugagguuuaauaaauuugugaucacugcuuaacccacgguaaaaugcaccaaugcaaaaucucaaaacagaaagugauuuccugcccuccaaugaaaauggaagaaaauuuuauuaccuacaaagcacuucaaauuaaauaaagcagacccugaaguucgaaacuagaguccacauacagcuaauugugggaugguuaccuccuguaaauuuuaaauccuaguaaacuuuucaccacguuucuacuucaauucccaucacccagccgaaguaaaauaauggggauaguugugcuuguauuaaaggguuguugcuagaauuaguuaaaaaaaaaauuguaaaaugcuacacuuuaauauuggucuaaucaauauauuaacaguaaggaagccuguaaucucagcacuuugggaggccgaggcgggcggaucacgaggucaggagaucgagaccauccuggccaacguggugaaacuccgucuuuacuaaaaauacaaaaauuagcugggcaugguggcgcgcgccuguagucccagcuacucgggaggcugaggcagguaaaucgcuugaacccaggaggcggagguugcagugagccgagaucgcgccacugcacuccagccuggcgagagcaagacuccaucuuaaaaaaaaaaaaaaaaaaguaaggaaaacuuucuccaagucaaauagucacaucuguuuaauaaguacguuagaaaauauaaaauggcaauaacacaacaggaaguaguguauuaaagagccagcaguaauuugcuauggaaaagaagcuggguauuccaaaugaucuuucucucucggacaggaauuaucuugcucagguaagaagaugccaaauagcagauccccacacugaucugaggaaccaaacaaaugagggaggugaaaaguagcaugaauacuucaaaacuagcuaacagaaguuccuuuuaccacugugaaaugcaugacaccaaauuacuuuuguagagugaaugacaggacagacugccuuugaaggaguggaagaaaugaguaggcagggcaugaggcaccccuuccaaaagguagaacacuugggugugguucuugacaggaacauuauggcugguggucauuccaggauagugauuacgcacugaaauuccuagaccauuagaaggaaacaaagagugggaaucacguucaaacaucaugaaccacuggagauaaaaaguuuggccuaugaggaaaaaaaauauaaacguuauagaucuggccuagaaauacaccaagaauguacaguuaaagaaacaaaaaucucuuacucuuucccaggucauaaaauuagcauaugacacagguacaucuaccaaugcauucuuacaccaaaaaguaauccuaauuuauuaugugccuaccaugagcuaaacauuuuauuuuauuuuauuuuaacuaauucuagcaacaauccucuaauguaagcacaacuauucccauuauauagaugaacugagaaucugaaaauuugcccaaggucacaagguucaaugugaacccaaaacacacccaaaacacacacuauuaauuucaccauaccagaccgccgccuaugacuggggaauguugguaucuccucaaucuaugcaacacuggggcuaaaagaaaacaaugcugaacauguaaucuacaaaggagaaacaaaugauagggaauuaacugccuauaguaacgguggcauggggggaagaggaaauaaagaacagggcagacuggggggcaggacaaucaaugcuguuuucuaguaaauggaagggguaaaauguaguggagccugagaggaggguuaucuuccuucuaagggauucagcuccuggaaaaggaguauggggagugggggauagaaagauuaagaagugagaagcagguaagaggugcucagcagcaaaaauagauguccacagaccaagaggcuccagaaacucagagcaaggcagggaaaaggggcgguucccaggcuugcaggggaaauggaagaggcagggaagacagaaagcggguuuacuggagaguuauccucuacagccuucugagggggaggaaugaggaaggcaaggcuaauggccguaaacgaaaaggccacuuaaacugcaauauccaaacaccgacccguucauaguuucgcuuaauagugguuuagcagcaugcagagcuaagaaauccggaucagagucauacaaacaugaagacuuaaggaaauggaaggcuacuauggcaccauccacaaagauggaguaaaugcaggcaacaggauaagcucuauucaacgccugcgccaaggggaccaauggaagggggagacagagcgggcuagaggacuuaggcuaaacucgaauuuagaacuggggaaggagucacagggaaaagcuuugacuccccccucccuuaaauaccagccucaacuauccacguagaugaagauuagaugggacgacagaauuaggagggguguggggagaggaggaggaguacaccagugacacuacugcuugaacccuaagccuuagcucuaaaaccgcgagaguuggcgaagaugaccccaccucgagaaaaaccaggguauucauccgggucgucggaggugcugagaacggagguuggccggcagaaaagguaggggaaaggggccacucuucauugguugcuccucuuucccaccguucaauuuaacccccaaccccacuccccagcgaacuccagacuccccucccacccuucccaauccgcccacugcggcggcgacaacggaggcguugaccgaucgguggggcaaaggcgggcccacacgcggccgaggcccaggaaauggugucgccucaacggacaagaaacgagguggucuucgccucaggucuaguuuaccggcaccccggcguuucgccaaucgucaccuccuuaacgcugggcaccucagaggcgucauaaaggcagauagccaacaccucugugcuggguccuggccggacagacaucagccuccgccgccaucuuaacagcaggcggaccgacccuagucacugcccccccaccccccacccgcgagcuaccucagccaccgccaacgaaucccacgaggacguaacccugcucccgcgagaauucuccggcuuagaacggcacgagccgaagaccuugccgccgccuccgcggcuacugcagucaguaaccgagccaccgccgccuccgcgcgaucccgcgagaaccucuaccggacgggaaaagccugagcccagcccuuuccagaccccuccucccucccaccaaagccgaaguagcuacagcuucacccuacgcgaagcgaaaagcaaaugacgcacaaccuaacgaagcagugaggggcggagccaaccuaccacggccggcucccgcaugcguugagaacuaucgcgauauuacgcuuuagccucggcgagaccuucuuaauucaccgcaggaugccgcccgcgccucgccuuuaggaaacaugagauaucgcgagaccuggugcacacuccuaaaaaggagaaaggcggagcuucaugaaaaugacugggaguuuuucgggggaagggaggaacccucccguccugcagggaucucgccuaccacgagguuuccgacccacugcggagcuggcugccaaaccucgcgaugacacagcucagcgccaaaucucggccauguccugaaaacugccuccgcccccgaucuaggugucuagagccuagugcuugaggaaaauuuaaaaagucaaccuguuuauucucacgcuuccgggcaaggcuguaccaauuagccaaacuccauucuggaagcggagcaaagagucccccauuguuaccugucuccaggaauaacauauuauccuggacuaacauuuaaaagacguucaaucucacaguaagcacacaaaugcaaaugaaaacaaugacauaacauuuuuugcccauuagauagggaaaaaaauuuuuaaaccuacauuauccagacuccuucccucgccgcacugcaggcuaaccugaauccaucuuaaucuaacuaaaggccauaucauuaguucuaguuccaaagccaccaauuuuaacuacugaagcuuuaccuuggcauaaccaaaaagauccaauaaagugguuuucuccaaacaaaggagucugcccucaaaggaauauucaagcuucggggauggggggaaaugccugaagcuuuuaauauggcaguuuuuccacgucuagccaacaguguuucuccaauaaaucuugggauccaaucuggcuugauuugugggcuuuuccauucuaaugcauuguucuguccguucuaauuuaaauaguuccuuuagaguacauuuuaauagccaguaguacaaauaucccuaucuuuacuuacguuuuaaaauauuuuuuuucaguuauucuuagccauuuuuuucccccggaugaacuuuagaaucauaguaaguuccaaaaaaacuugguauauuuauugaaauugcaucaacuguauaaaccaauauaggaaaaauggacaucacuaaaauauugagccuucuuauucagaagcauaguauuccuucucuuuucaugcagauguucuuuuaugguauucgucaauaaaguuuuauaguuuacuucuagguauuuuuauucguuucucuugcuauugcgaacagguuuuuuauuauuaaaauuucaaaaugcuuauugcuuauagauaggaaaacugccuauauaaacuauugauauuugccuauuuacaaacaaaaauaugaucaauuucgccaguaaucagggaaaugcaaaugaaaacaaugacauacgauuuuuuugcccuuuaaauuggcuaaaauuacaaagauugauaauacguguuggcauaacuguggaaaaauaggcacucucgcacaacauuaaagaguguaaauuaguacaggcuuuugggaaggcaauuuggacaaaucuaucaaaauucaaaaugcauauacacccugacccagcgguuacucuucuaagaauuucuccuacagaaauacucauacauggcaugauacauauacacaaacccauucauuauggcauugcuuguaauaguccccucccucccccaacagagaaacaagcuaauguauaucaaucgggaaaugguuaaauaaacuguaguacaaucauacaaugcagcuguuuaaaacccaacauaaauuuggauucccggauauaagaagaucuacaagacauauucucagauuuuuaaacaagcaguuagucgaaaugaauguguguguguguguaguaccauuuagauaucaaaacauauauaugcaacgccuaguaguuacccgcgaagccugccugcccgccccucaccuucccucuccucugaggccgccuuccucgaaccagugagaaacgcugaaggcccggccucuacucucucuuuagggccacuuggccauggcuaaugccgguaccucgcauccccucugucagccgcucucucgccgcgccgccggcagcugccgggcugcccccgaagaugcggcuagcucuccgcuggcgccugccgaggccugggggaggggagaggaggcgggguucagggaggguuggggcaggccgccaugccccuccagcagccuuucccgcaggcuccccaaggccgccaccuccgcgccuccgcgcagggucccgugggaacuccccccccaaccucgccacugccacccgcgagaaaccgagaacggccgcgcguacagagcucgcccuccagcccagggauagacgcucaccucggccgcaauggcuccgcggggcccgcaggagcgugcgggguccgcggcccugcuucagcccugcuccagcccugcuccagcccugcuccagcccugcuccagccgugcuccccucgcuagcccucagucgaaagccuccucgcuucggcucagcucaaacu

SEQ ID NO: 19200 - RNA, 34922 nt, Homo sapiens
uggggaggggagacgcugacaaaccaagauggcggcggcggcgcugaaggccgcggcguuugggagguaacugugguggcgaaggcugcgguaguggggaggcaaccacacaguuuggaagaaacggagcgggacgaagaggcgguagcaguagagucagccugagacucucagagcacgacggccacacgcccccuuaggcccucggcgggcggcggcugccccgcuuagggccuagccuccgagcauugccucggcuucaaacagcggcggcgccaugaguccuuaagggcgguccaagccucccgaucccuggcccagaccucgggcccaccauggagccgggguccgacgauuuccuaccgccaccggagugcccgguguucgagccuagcugggccgaguuccgagacccucuuggcuacaucgcgaaaaucaggcccaucgcagagaaaucgggcauuugcaagauccgcccacccgcgguaagccccggggccgguuuucgccggcggcgagacggaaugaagcaguaggauagccagcggcgaagucuggggcggagggcagcucgagguggggagaggggguggcugggaccguugugguugcggcgcggaucggaaaaaggguguugggccagggguccucucguggugugaggcccacaggugaccuggagucagagauccacccccaccccggcccuucagaaucacuccggguuuaagacagggauuccuagugggccggagggaguucacagagaggcaccccgcacaucucuuagcccgggccaccuaggucgaggcuguaaaaauaagacguuucuccaaucuguugucaucacuuccuuuaaggcaggcagcauaguauaguauuaauagaaagaucgcaguccugaagggagacagacuugaguucaaaacuccacuuugaagcugagcagcugugugaccuugggaaaguagaaguaaucucucugagcccgugaaauggaucccagaaaugguuauuuagaggauugaauuaaacuagguagcgucuguauguaguacgcacuagauaagugguaauuauugugacugugaggguguuugauguggucauugguuuauuccuauguagguugacucauauuuacucauaccuugccaggccaauucaucuaugauaauauccuggccugcuggaccagucaggaaaucagucucacagggauugcucugucucccuugagguggguucagggaauuguccucuucuuuuccucguugaaggcaaugucaaggccuuuucugcacaucaucccgcagacuugacuuccuauggagauguuuggaccggucagcuuggugguggggugugaguccuucucagaagauuucuacucuccucugguccaggauguaggagaucccagaggauagggcacucuugggcccgcagaacagaauggagccauggaauucugucccuuuuggaacaugauugccaggggucagcaacaaaggccauagcuuuccuccuaggccuggcuucaggcuagaagucucccaagggcuagggcaagcugcugccuugcugauaugguggaaaagugaugauaauguucagugaucaguugggauuccaagggcagaaauugagcuuugcuggaaaaggguguuuuugagugggugucuccuggcugaaauggaauaggaagcuucauucccaccugaggagggcaccacaggccuccuuauccaacuuggugcuuucuggugcucagccacagaucuaggaugguuucagauagauccucuaggagguguuggguaagcgaauuucuuccuucuuggagucuggccacagauuucugagguauccuuguccauggugagggaguggcaguggguagagggucaggaaggcuaguggaagggagaggcaggaguccugggcagccucaaggaggcacucccugaagugguugggcaagccugugggaaaaagaggcauagcugacguaggggguaguugaggccugaauuccuuuuuucuaucuuggacugacuuaggcaggcuggccuuguguagguguuguuacccugcuuuggggcaucaggaaggggaagagugacaugucccaggugugcauggccagcaggaggccguccuuuucacugcucaacagugugcuucucucuaauccaggauaccuggcucucugguuugguuuuguuuuuuccuucucuauggcagcuccuaggccaccuuuaggcagcuggccuucuucugguugaaguuugaaguacucgcucaagugaugcuugggcccagggugggaaccuguauauggguggguaccugggaauuggagguuugcuggaggaaggaugguuuggggccugaauugcugggcaggugacugcuacgcuugggaaagaugggugggaggagaguguggguacccugaguagacccaguggaguuuggaaggaucuugcuuucuucaucagguagccagccuuuuuuuuaucaccacaucccaguaauaccaacauacauuuggcauacaguagucuggagaugaaggcaggcgguuugcagggccuucccagguaucuguugcauccauggcuccugccguagcauuccagggcugccauuuccugucaggugcuugauguugcacugauugucuagaacuugauucagcaggaaagaagggugcccggaguuuuggguuugagcaccuuuuuagcuggguuaccugugcugaggggagugcccuauccugaugagaggcaagagggcauggggagcuugucuggauuugagccauaccauuuuggccugccuguuuuuuuuuuuuuuugucccugcuuacugagccccagauguuugccaccugcuuuggcugguaggggcaggggaguguggucuguguaugcaugcaaaauaugaguccucuagcccauuuucuaaaagugugugugcagaagaggucaacaguuuuucuucucuuucacugucucucccccccgcccacguguaugcauguauguaugaacauugaugucugguguagugcaaaggccuuggaucagaggucagaagacguggguucuuggccccaccacuaacucagcauguaauuuuggaaauuucacuuuuuuucucugagccucacuuuccccauuuauaaaaugagaacauugguuuagguuacuuuagguugauuucaccaccccagcaggagccagggcucugggaaggagaggucugcauaggagguuggaaagggguguuggagaggggguucuucacagcugaccuuugggcaggacacagcaagcuccaacuuggcagagcagagugucucccacuuucaugaucuuucccugacuucccuccccaaauccucccauucuuugccaccacagucaggcaucccagcacuuacccccacccccuggggcuuccuccccugccucuuccuguaccaggcagguguaugagagaggaucuacaggaagccuuccagacugggugagugauacacauacuugcucccuguuccuugcucuucccugcagugucuaucucaggcccuuuaaacugagagaacaaacauuaaaggcccaaaccuuuacguccugccacaaucggaccugagcuacccugcauguguauugugagguguggucagccuuagaugucaggucauaacggugacuccuuugaauaacauuuucauuugaaaacuaguuuuaauuuuccauauuggucuggcaaggaagccagggcuagaguucauauucccaccucacagaugagaaaacagguucagaaagcuaaaaucucauagcuaguaaguagcggaucuagaacaugaacccauaucuucugacucuagauccugugugcuuuccaguacucccaggccuguguguccuacagcacgugccuaggggauaaggaauuaauguggguguggagaagguuuagggucaacaaaacagaggcuccaucucuuaauuucuugaaauccuggcacuguacuguugggugggacucaggagaaguuuccuagggcaugugcauggggccuugggugcagacuugaggggcugcuagacucuugugaguucuggggggaggugggggugggugguuggguaggauguuugcagguuaaagggucuggaguggcuagagguuugggaaggugccagugggauuccgagcugcuuuuggugacuuccggucuuacacuaugcugagauaacucaagucccuuuccccucucuacccucucaggacuggcagccacccuuugcuguggaaguggacaacuucagguuuaccccccgaauccagaggcugaaugagcuagaggugagaagacuaggagcugguggugggguugggagaauguauaccugaguucuaaucccacuucccuuauaguuucucuggcugagguacuuuaccuagcuaggccuuuauucucucuucugugaaauugcauuacuuuagugugcccagggcguggaagaagcuuuagagcucuaaauauaaccaagagccaggggcauuuagcauuugugauuugauagcccaaaggcuggggacauauaucccuuucucacaaagguuugcuacuucugaaacuccccuguaaacuagccuacccuagcugagucaacaaaaaggaauuauggaacuggcugauaccccuucuuccuuggccagcugaauguggcuucauauauccaauucauccacagcccugugcuuucuacuuugcuuccaugggugcuugguaaggugggaguuuggguagaugggcagaacaacacaagaacugggcucuguggaggcuggaaugguuagagacuuggccaggggucaggcagguaggauuuuccuucucccuuuuguucuguacaggaaguccaggcccuuuucauggacaggugggguuuuuccugcuugagaaugcccugggguagugagauuagguucccuaaagccaguuccacguaagauccuggaguuuuccauggcagcucuagguuaggcauauguugccacucccucccccauuauuauguacccacaaaucuuaauagauguccaagggguggggcauuaggcccaggcccagcugaauacuuauacccuaaaaguucacuuguguucuagaccagaguuccucagccucggcacuauuaacauuuugggaagcuaaggugggaggauugcuugagcucaggaguucaagaccaguuugggcaacauagcaagaccccaucucagaaaagaaaaauauaucuugucagguuuauagggguacagcuugggcaagauguugccuagcaugacacaagggcagguuuucuguagagggagugcugacuaauaagaaggagcagggaugaggccaacuucagaaagcuaaggggcugagguugaaggagcacuuccuugcccuuugagaguucucacagccaaggaacuguagguuguuucuuucuacaaauagaccuuaguuuuucucaacuaugaaauggaaagagcugucuuuguucccccuaaugggaucagggcaagguagugaaugguaaugacuaucuaguucuuccaagaaccaggcucucugacuggagugaggagguuguagacuuggggccuaugggaguccuucuugguuacugagauuucagggaagcaucauacauaucuuguuucuagucuccuuggcccacauuggguccuggguuggccaggugcuagugcuacucugauauaccaucucuuaguucuaggccauucugucuauaguuauagcaugcacuuucacccuuuagccaccauggaacaaguuuggugguacauaaggaggugcaugugccuuuuuggagcuugcuuucucugaaacaugccuagagcuuagauauaauucugaaaucugcagaggaucuucacugguccccucauuaagucuaccccucugggguaaguggacugugcaguuauuuuccuuuuauaauuauuaguaaaaggaaaaaggaguccacaguggaacugauuugcucaaggcagcauagcaaaucaguagcagagggagagccaaagcucaaauuauuuggcaccaaaauaucuugaugcuugcuguguguccuaacuccucugagccucuguuuccucaucuguauaggagaugauaauacucacaugaccuugucagggagauuagaggacauaucuaaagcuuuuggcaguugugacccucucuauugggaccuugggcuucucugauugacuggaaggugacaaaugagagagagguggcugggugcaguggugcaguggcuugugccugugaucccagcucuuugggaggccgaaguggauggauugcuugagcuuaggaguuugagaccagccugguaacauggugaaacuucauugcuacaaaaaauacaaaauuagccgggcgugguggcgugcgccuauaguuccagcuacucaggaggcugaggcaggaggaucacuugagcccaggaggucaagucuacagucagccgugauugcaccacuccauuccagcuugggcgacagagcaagaccgucucaaaaaaacaaaaacgaaagaaaugagagugagguggggcuaagcacugccuagagucugggauccgguucauugggagaaacccuggguagugaaaguguggagugcuguauuccucuguucuccccuaagacuggacccaaagauaguggucagugggaggggguggccagccucuuugagccauuucuucuucaggcccagacgagagugaaacugaacuacuuggaccagauugccaaauucugggaaauccagggcuccuccuuaaagauucccaauguagaacggcggaucuuggaccucuacagucucagcaaaguaagaacagguuuuugucaagcaccccucccaccaaaccccaauauccuugauacucugggggcccccuuaguuuggauauuagaucuuuaggcugcaauggaaggggcacagcuugguagcacacaagcugucaucagaacaucuuggaaucuuuugcugcaauuugagguugggauaaggggauagcccccagugaagugagggacuagaguugcccucauugcccuuuugcccuuucuacaggccuacucccucacauauaaauacacguggcacauccaugucuuuuccuacuuguuuuuucagauugugguggaggaaggugguuaugaagcuaucugcaaggaccgucggugggcucggguagcccagcgccucaacuauccaccaggcaaaaauauuggcuccuugcuacgcucccacuacgaacgcauuguuuaucccuaugaaauguaccagucuggagccaaccuugugguaaggaugucacaguggggcagggugcggcuuuacccuucagcacagauuuccacacuugcucuuaaugaaacugguuuaguggacuggagaccugggaguuggacucugcucuuuccuagugaugcuuauucucuuucuacacugcucagggucagagguccuggaguuaucuguacggcuagcuuauuuguuaugugacaaaguuuuaacugauagagaaaucagagaagggagagcuugggcuagaaggugugggaagagauggcgucugauuuaguuggggagaugguugguggaggaagugacuggaagggaggagugauacaagcaaagguacugagaauucccaaaaugugugcuggugucagugcuaaagaccaguggaacaggggcuguuggugugggucaggugaguggaccacagcuuuggaugccauugggugaggguagagggaaguuauugcuuuugcgggcuggaguccauguccugacccuuaccccuuaccuguccccagcaguguaacacacguccauuugauaaugaggagaaggacaaggaauacaaaccccacagcaucccccuacgacagucugugcagccuuccaaguucaacagcuauggccggcgggccaagagacugcagccugaugugaguacuccccuucuucgaacuuagagcuuugagguggagggaguccucuccuuccuucuggcuaaggcuguguucccuguuccauuaucccuucuuuuguucucugaguucuucugagcauuagugugccucucucuggcuucacucuugcuuuuuucuccccucucagcugagcugcugagcugggucuugaucuguuugugcaaccucuuuuguaugucugcucuucuugccuguuuuguuccuuuccggacuuacucugcucauagaaguagaacucuucuuucucuuuauaccuguaucuuuuguuuuguuuuguuuugaggcauagggucuugcuaugucgcccagacuggaguacaguggcuauucacaggcuugaucauaaugcacuauaaucuugaacuccuaggcuugagugauccucucaccucagccucuggaguagcuaggacuacagguguguaccacuguucccagcuccuuguagcuaugucuucaggcagaagcuuaugugccaggcauucuuggcacugggaauacaauagagaacaagauggacacugucccugggcucaucgaagcauguaauuuagcagauccuauuagacugccauuuguugguaaugccaaacacuguuagcuuuuucauauguauugucccuaaccccccucauaacuauaagggaggagguaauauucucauuuuacaguugggaaaacugagauauccugucuuuuauuccuuucugagagagggccgagggggcagcucaccuacccucagucuccaaaaagcaacucugaguucuuggcuuagcccaucugugccucagcccucagcaugagaucaggugauauguaguccgaguuacuguucuuuuaggaugggacagucugccccagauagcagucuugauucauuuccuucuuuccuuccagccggaacccacagaggaagacauugagaagaauccagagcugaaaaagcuacagaucuauggggcaggccccaagaugaugggccugggccucauggccaaagacaagacucugcggaagaaagguaaggccuaacaggcugggguggccucaccuggggagaaaagucagggcccuaaguguccuagaccuguguuuacagccauuuuucucucucccagauaaggaggggccugaguguccccccacaguaguggugaaggaggaguuagguggggaugugaagguggagucaacaucgccuaagaccuuccuggagagcaaggaggagcugagucacagcccagaacccugcaccaagaugaccaugaggcuacggaggaaccacagcaaugcccaguuuguaaggacccagcccugacuucuuaaugcucugcuucuugucccuucaauaagcauuccccugcauggcacuggaccaguucgcauuaaccacaaaagcgggccuccaugggcccugcccucagguagcucacuuaauuggggaaacaaagccaacucauauggaacaaagagcaagaaagggugaucaagugcugucaacaugaagugcuggaaggguccagagaaggagucucacucuccauugcuucaggauaaaggcuaagcuccucauuaccaugcaugauccagucccugcugaccucuagccucaucccccagcacugcccaccucacuccucugcuauagccacacugaacuccuuguagguauguucauuuuuccccguaagaugcaguaugcucuuucaucccuauccuuugcacauguuguuucuucagccuggaagagauucccccugugcucugcccuguugccauguuuuguuuugccuucagguuucagccaguuucagguguuaccuuuucaaugaaguccuuucucaaggccaucccuccuuaucuccagcugcuuugagugcuuccuucucuaggcucccacagugcccuuuauggaccgcuauuggcaauuuuuaauuuuuaugaacacaugucucuagaguacuguauauacuuggaaggauaccaugucuugucuuugugcuagaguccagcguaguucugaauacggguuuaguaaguguuuauuggaugaauaaaaaugggaggauucaagacuggaugauaaaagacugcucuugcagcucuaccugcuuauuuggggagaugguacauacgugcaguugagcuccagaccuagcaugacuagccuauacagggcuguaaaucauucagccagcaaacacaguggauuuccaauggagaacuuuugcucuucuccccuggcagauugagucauaugucugccggauguguucucgaggggaugaggaugacaagcuccugcugugugauggcugugaugacaacuaccacaucuucugccugcugccuccucugccugagauccccaagggugucuggcggugcccaaagugugucauggcgguaaggccuccccacuccacaucugccucauagggcuuccuugccuuccuucaucuggccuuauugagggcagccucuuagcucagccauagucuuagguuuugggucucuguggugggauuaggcugggcagagcuuugggagaaaggagcaggagauucagccuuugcuucuguccucuaagagcucccagaccaccuggagagguaagcaucauaauuagacuauauguggugacauauaaacagaggcuaaauuguguguuagaaacucugagauauagaaguucagaggagaggaaaauagcuaaggguaauaaucagggaaaaugucagaaaugagacuugaaggauaggaauauuaagaaaaaaauguucuuucaauuucugaguuuuuguuuuguuuuuuuuuuucuuuuuuagaaaguuugaggccgggcgcgguggcucacgccuguaauccuagcacuuugggaggcugaggugggcggaucguuugagcccagaaguuugagaccagccugggcaacauggcgaaaccccgucucuaccaaaaaagauacaaaaauuagccaggcaugguggcgcacgccuguugucccagcugcucgggaggcugaggugggaggaucgcuugagcccaggaggcggagguugcagugugccaaaaucaugccacugcacuccagccugggcaacaaaaugagacccugucuucaaaaaaaaaaaagacauuuuggaaaauaggcaaauuacuuguguucccaccacccagugauaaccauuguuaauaguuugauauauuuuuuucucaucuuuuugcuguuacuuauauguaacuaucuuuaacaaguuugagaucuuguuauauauuuucauuuguugcuuuauaaccauuucucuauauuacuaaguuuaauuaaggucuggaauuuuuuuagaugguguaucauggguauaauauuuauuuaguuguuuuccucuuguuauauuuagauugaggcagugcuacaggcuuuaacuagagaggugguuggcuguucaggacugggagguggaggacuagcaggaacagagguauagcaggagagcaugccuacuauggguauaggggcaguaaggagagcagcugaagcagcaguaagggccaagcagccaggaaguugggcagguacauuucaugaacuuccuaccuucacccaaauucucgguacuuaccuucuacauuucccucuggauuucuguagagcagacauucgccuuaucuuagggacucaacugugguuguagagaccgggugugcacaugcauacauacacacagacagacauacacagaugaggaaaaaucagggcagugcauauuggccuugguagugguggagauucuaguuggggaggaguuuggauaccaacaguaucaagacugucgacucuacuugacucucuucucuaagugguuauaagucaguggaccagacggacauuuauuuuucaaacauaagcauggugugugucugauuuugggguacauauuguucucaucuaaaauaaugaacauagguacaaaaugagguagacccacauccuaucuucugagacagucucaagaacaggauuaguggaggguuugauacuguaaaagccagugucuucauuuuccaucuuucuuuuuucuuuuucuuuucuugcgacagaaucuugcucugucacccaggcuggagugcagugaugccaucucugcucacugcaaccucugccucccggguucaagcgauucuccugccucagccuccugaguagcugggauuacaggcgccugccaccacaccuggcuaguuuuuguaguucuaguagagacaggguuucaccaugguggccaggcuggucucgaacuccugaccucaggugauccaccccaccucagccucccaaagugcuggguuuacaggcaugagccaccaugcccggcccuguuuuccaucuuucaagguacuggaauauucaaugccauuuucccagccuuacaguucuagucugggcauaaaaaaccuucucuaagcacccugcauagaaccacauuuuagaggccaggcgugguggcucacgccuguaaucccagcacuugggaggccaaggcgggcggaucacagggucaggaguuugagaccagccuggccaacauggugaaaccccaucucuacuaaaaauacaaaaauuagcugggcgugguggcgggcaccuguaaucccagcuacucgggaagcugaggcaggagaaucgcuugaaccugggaggcggagguugcagugaguugagauugugacccugcacuccagucugggugacagagcaagacuccgucucaaaaaaaaaaaaaaaaagaaucacauuuuagcuagagaggaaaaaugguggcagaagaacacaggauagcauauuaaagucagagccauuuagauaaaguccuaaaggaagaaaagagcaugagaugacucccuggaaguugugagacuggaauugaguuuugaggaaccaaugaaagaaaguggaaaaggacauuucaguagggaggaacugagcaaaagcaugauggggaaugaaaagacuaagccgaagugguaagagcaaaagguacagcuguaaaguaaggccugccucaggggccuugagugcagaccuagggcucuucucccucccuaccccuuauauuccaguuccacuugggaggauucuucaccucuuugccucuguuuuggugacauguucuccuuuggguuucaggaguguaagcggcccccagaagccuuuggcuuugagcaggcuacccgggaauacacucugcagagcuuuggcgagauggccgacuccuuuaaagcugacuacuucaacaugcccgugcauguaggugauggagggcugagguaguguugggcuaggaucauagguauugaugccagauggucucagcucaccuggaucaguggguccagggugugaugggccauagucaucugcuaccugucuucccccagauggugcccacagaacuuguggagaaggaguucuggaggcugguaaauagcauugaggaagaugugacuguugaguauggagcugacauccauuccaaagaauuuggcagcgguuucccugucagugacaguaaacggcaccuaacccccgaagaggaggugaguggaugauucaugguuacgugucagcugugugagcuuaggcaaaucauuuaguaucugaaaaacucaguaucucuguaagaugaggauaauuaugccugucuuauguagccaugagauuuagaugagaugaaagaaaacagucugguaccuggcauguacaaacaugagauggguucuuucgccucugugagcccauuuccuuaucuuuaaaauggggauaauaucuacuuugcaaauuuguuauaaaaauuaaaugagaagguauaugagauccuggcucauccauaaguaguguucagggagugggguuuguaugcacaggagaaaaugagggccuaguugugcuuccaagaaaggguacauuuugauccagagcaggauuuuuuuaacuugcagguauuuugguagguggauauaucgguaaacuucguagaaauugaagugaauacaauugaaauuuuguguguaugcuuuuugguggagagguagggagaaaaccuauauguuucuuaagauguuucaaaaaagucucugaccucaaaauuaagguucccuaggcuaaagaaaaugacuuaagaucucaguuccuuagcauaacccucaugcccuuuuuacaaauaccugaccuggcaggaguaugcuaccagugguuggaaccuaaaugugaugccgguguuggaacagucuguacugugccacaucaaugcagauaucucuggcaugaaggugcccuggcucuacgugggcauggucuucucagccuuuugcuggcauauugaggaucacuggaguuacuccauuaacuaccuccacuggugagugggacccuggggagccagggaaucaagucagugugggcucccugcaugaccaaggugugauuuacugugugugucccuuuuccacuugugcaggggugagccgaagaccugguauggggugcccucacuugcagcagaacauuuggaagaagugaugaagaagcugacaccugaacuauuugauagccagccugaccuccugcaccaacuugucacccucaugaaucccaacacccucaugucccauggugugccagugaguacccaggcaacagggacaagcggcaggagugauuuagugauguccuuugugaugguggugguggcggugguugucaucuguauucugccccuggccuuucuucauugcuguucuuaauugggcuacggguuugacuagucuaguagagacccaaaauaauagugauuagaugcaccguaugaugguaugcccucugggccauguguuugacgguaacagcuaagggguggcuuauuaucacaucuacauuccagccaguggaagagggaaguggggaagugcagggcuagacaaaucuuuuaaaggcacacaucauuuccauucaccuucuguuaguaaaaacuuggucauaugaccacaucuagcugcagggaaaacugggaaauguaauucuuauuuuggauggucaaguaccacuuaaaacuggaggucauguuguuaugacagaagacaagaaugaauaucgagguacaacuagcagccucugccauacuuuguauacucuuacccuucucagagcaguggauaggucuuuuuauuuaacaggucaaaaguugaacccagaguucuggucuauccucuguguacuucuuucuuacccuuuaaaacauuuugcuggguauacaacauggcuuaccugugagagacuuuauauuccugggaauuucuagcauugauuagcaucagccaguuuucugguguggaucuuaaaacagccugaucacuaguccuguaagaacaggaauuaguagauccucuaucucugcuuuaaguauuauccggggcugcuacucuucccuacacccuuccacgcucuuuggccuuggacacauuaccacuuacucuaauguaugagauagucaauaaauacugaauuaaugucuccuucagauauuccuagauaucuguacaguagggcuuuggacuaggucagugguucucaccugcauuucuuuuugccuucuccuuguuuugguauacuauaugccccaugaguaauauuuuuuuauuauaaaauuuagugauauuuaaccaaggacuugggauaucuagggaauuggacagaaggagguguccuauaacaguucaggcaaucuuccuccacucagggaguuauccuuuucucucucuaccucaccccauuuaaggaugaugaucaagggcuugaguucugcugcuuuacaaguagacauggggucugacuuuccuuagacuucucucuuccugacccauagcacagcaucaguccuugucuauaaugccauggaaaacuguaaaagaggauucucuuggccaggcacgguggcucacgccuguaaucccagcacuuugggaggccaaggcagucagaucacuugaggucaggaguucaaaaccagcuuggccgacacggugaaaccccagucucuacuaaaaauacaaaaauuagccagguaugguggcgcacgccuguaaucccagcuacucaggaucaggaggcaggagaaucgcuugaacccgggaggcagagguugcagugagccgagauuguaccacugcacuccagccugggcaacauagugagacccugucucaaaaaaaaaaaaaaaaaaaaaaaaaaaagagccgggugugguggcucaugccuguaaucccagcacuuugggaggcugaggcggccggaucaccugaggucaggaguucgagaccagccuggccaacauggugaaaccucgucucuaauaaaaauacagaauuagccgggcgugguggcacgugccuguagucccagcuacuggggaggcugaggcgggagaaucacuugaacccaggaggcggagguugcagugagccgagaucgugccauugcauuccagccugggcaacagguggagagacuccauuucaaaaaaaaaaaaaaaaaaaaaaggauucucugaaggauuuggguagcuaagaggcauauauauauauauguguguguguauauauauauauauauauauauauauguauguguauauauauguauauauacauaugcagaaggucauggagcuguuuaguccuuaccgcuuuuuaaaaaacuuuaucacagaauccaaaauacgugcuuuuugcuuacaccuccacagcauuucuccugcucguggcucaucaucuucucuggccagcugcuacuuuaccacccagcccucugucugcccugcccuuccuauagguaguucacagcaucuccaggcccuuuggacuuggcaguauccccuuaauucaaguaucugugauuuuuauguucucaugcugggagacugcaguuuagccagcuggagcucccccagagguaucuagcucccugcccccaucaccccaccuuccccuuuggugggagaaggccauuucuuuuuauagauauguaauguaaguauuauuuucuuuucuuuuuuuuuuuuuuuuuuuuuugagacagagucucgcucugucacccaggcuggaggcuggagugcaguggcacgaucucggcucacgaucucagcucacugcaaccuccuccucccgaguucaagugauuacccggccucagccucccgaguaggugggauuacaguugcccgccaccacgcccagcuaauuuuuguauuuuuaguagagacgggguuucaccauguuggccaggauggucucgaacuccugaccucaggugauccacccgccuuggccucccaaagugcuaggauuacaggcgugagccaccgcgcccgggccuauuuucauuauaaaauaaacauguccucuuuccagaagauggaaaacagaaaguucgccccuauucucuccacuguaaacaucuaagcauuguuauguuuccaucuguuauauuuuucuauguaaaauuugacauagcaauaauuaguguaugguuuuuauaaucaauuugguaaguuuauuggucuagaacugcacuguccaauuugguagccacuagcuacauguggcuguugagcacuugaaauguagcuaguccucacugaaaugugccaaaaguauaaaaugcauguuggcuuucaagacuuaguacgaaacaaaagaaugcaaaguaucucacuuaauacuuuugugugccaauuacacauagaaaugguaauauuguggauauguuaaguuaaauaaaauauauuuaacuuaauuuuaccuguuucuuuuugccuuuuuaauguggcuacuaaagauuuuuuuuuuuuuuuuuuuuuuuggagaaggagucucacucuuguugcccaggcuggagugcagugacgugaucucagcucacugcaaccuccgccucccggguucaagcgauucuccugucucagccucccaaguagcuaggacuacaggcaugagccacugugccuggcuaauuuuuguguauuuuuaguagagaugggguuucaccauguuggccaggcuggucucgaacuccugaccucaggugauccuccugccucggccucccaaagugcugggauuacaggcaugagccacugugcuugauuuuuuuuuuuuuuuuuuuuuuuuuuuuuuugagaaggaaucuugcucuguugcccuggguggagugcaguggugcgaucucggcucacugcaaccuccaucuccuggguucaagcgauucuuccgccuuagccucccgaguagcugagauuacaggcgugcgccaccacauccagcuaauuuuuguauuuuuaguagagacgggguuguaccauguuggccaggcugaucuugaacuccugacuucaagugaucugcccgccucggucucucaaacugcugagauuauaagcgugagacaccgugcccagcaaaagaauuuaaaaguaccuauguaccuagcauauuucucuuggacagcacuggucuagaaugauuuucgcuuuguuacuauaugaauuauaaccauuuuuuaaaguuuuauugcgguaugauuugcuacauaccguaaaauucacccauuuuaaguacacaauccaguaaauuuauggaguugugcuaccaucucuacaauccaguuguagaacauuucuaccaccccaaaaagaucccuuauacccauuuacggucacuccccuuuccagccccuagucccagucaaccauucaucuguuuucugucuauagauuugucuuuucuggacaguucauaaaaauggaauaauauguggucauuuguuucuucucucacuuagcauguuuuugggguucauccacauugcagcauguaucagaacuuuauuccuuugauggcccaguaauauacaccaguugaugaaccuuuugaguuguuuuuacuuuuuggcuauucacaguugucauuuuuaacagcugcagaaugugaggagaacuuuucuaaauaaccacauaggaaauaguaaagugacauugccagcaucagggugcagggugagacagaguuaugagcaucaaguucuacuccuggcucugcuaccugaggcuuaucugagacuuaguuuucuugucgauaaaauuaaggcuggcauaguaagaccccuucuaauuaauuaauaauaaauaaaacuaagccugggacuagaucauucagugaauguugcuagagcucauucuuugugcaaggccucucuggucaacacucagaaggcaaauaacccagugccugcguuuguguaugcauagcugagugcuggacagaggaguaaauaaguggaauaaagcauuaaaggugcugcaaaagagcaacaaacuaggucauuuaggaagcggggguuaucaggaaagguuuuguaggagcagugaucccugaaagaagaguaagaguuuaccugucagagcuguggcuuaaucaugugggcauggggauuccagugagaggcucucagcugaggcauuacauggucaaauuugcuauuuuuggaagauaguucuggcaguuaguaauugaggccagugcaguaauacagguaagaaagaaaugcugauguugccucuaaguagagauagauuugagaagaaaauaugacggaggugggagcugaugcaugguccaaauaaauguggagauauguuuaugaaugggaagauuugauauuguuaggauguuaauucuccccaaauuaauuuagacuccuggcagaggaaucauuggguugaaggguucuugauauacauuagcaaauuuguuuuccagagaguagaauguauuuauucccuuaccggcacuguaccuacuucacugugucuucaccaaaauugaauguuuaucuuaaaaagcuuugugagacuucucaguaaagaugacagauuaagcauacacauggcuacuuccauucuguacugaaacuccacaaaaauuacauaaagggauuuuuuaacgugaaaaaaauuacagagauggagaauacgagagaggagacaaugauaaaauucuugaaacuagaaaacagauagaugagaaaacugaaacauaagccacuacugaggacaucuugagaaccagcccgauucauaccucagaaucccccaaagauuuguuaucaguggcaccaggcauucuagggguaaagauggauggggugaaaauaaggauugguucaugucuguauaagaagcugugagggccgggugcaguggcucacgccuguaaucccagcacuuugggaggccgaggcggguggaucaugaggucaggagauugagaccauccuggcuaacacagugaaaccccgucucuaacaaaaauacaaaaaauuagccgggcaugguggcggaugccuguagucccagcuacucgggaggcugaggcaggagaauggcaugaacccgugaggcggagcuuacaaugagccgagaucacaccacugcacuccagccugggcgacagagcgagacaccgucucaaaaaaaaaagcugugagauacccucccaugcugggcagcuagaaaugucuagucacucuaguaaaagacugaagauuuauuucugaagagguuaaaacagagucucugguuuaaggucuccuagguacaauugaagguggaguuauagggaauguaauuaggauuuaucauacuggaugcugagguucccagccaucauucuccacuuggcuguuagaacacuggcugccaggccuuuuuuccuacaggcaaaaaaaaaaaaaaaaaaaaaaaaaggauuuucuuuggggaaucugacuggccugcaaggaaagaccuggaguuucccaaacuaaauggcuuagcuagaucacccuacagugaagcucacaguugacaagcuucaucuguguacucagagcuuccauuuagcuuuuuaaucucuuccucuuaaauauaagcaggcagccacagauuaacaacugagaggccagugcggugcaguggcucacgccuguaaucccagccaagguggguggaucaccugaggucaggaguuugagaccagccuggccaacaugacaaaaccccgucucuacuaaaaauacggcauaguggcgugugccuguaaucccagcugcuuggaaggcugaggcaggagaaucacuugaacccgggaggccgagguugcagugagccgaaauugcaccacggcacuguagccugggcgacaaagugagacucugcgucaaaaaaaaaaaacaaaaaacugaggaaacccuaaaaaaucccccaaaaaacagaagcaacuuggagauacagaggcuaggcagggagaaauaaacuucaaaagaaaggcauauacuguaaaaaugaaugaagaccagaauacuguuuaaaaaaauagcauaccgcaaacaaaguuaugauagcaaaagugaaaaauguaaaaaguguauguuuuccacuuuugaaagaugaauaguugaggaaaucucccaaaaaguagaguaaaaagauggaaaaggguagaaaaaauuagggaauuuuucuaggagguucaauauucaaauaggaguuaugaaaagaaaauagaugaaaacugagaggaugaaaucauuaaugaaaucacucaagaaaauuucccugaacuggagaaccgauuuuccagagucaaugggccuacccaguacaugagugaaaagaaauucauaccaagauauauccuguaaauuuccaugucaaacacugagaccagaagaauccuauaagcucgagagagagagaaacagguuucaaaugcuuaucaagcauuagaaaucagaauggcuucgaacuuuucaacaguaacacuagaagaucagagcagugugccuuuaaaauuauuuucugagucaacaacuaugggaguuuuuaaaaaaaggauuuuugccgggcgcgguggcucacacuuguaaucccagcacuuugggaggccgaggcgggcggaucacgaggucaggagaucgagaccacggugaaaccccaucucuacuaaaaauacaaaaaauuagccgggcgugguggcaggcgucuguagucccagcuauucggagaggcugaggcaggagaauggcgugaacccgggaggcggaccuugcagugagccgagaucgugccacugcacuccagccugggcggcagagcgagacuccgucucaaaaaaaaaaaaaaaggauuuucaucuuagaauucuauauacagucaagugugagaguaagaauagagacuuucuuuaaaaaaagaaaaguagguucuucacaccauuucucaggaaacuguuggaggauguucuuaagcauagcaaaggaauaaaccaagaaagaggaagacgugggaucuaggaaauaggagaucugucacaagagagugaugauccagggaggacagcugguccagauugggacagaucagaagguugcaugagacugcuacagaaagaugaaaauugauaggaaaagagauuuaaauauuggucagaaaauuagggauauaugcauaaaaaacugagcaaauugagaaacaggaggcuguuuuuaacauagucuagaagcauguuauuuaagguaguuauaaucaacgccaaaauaaucagaagagguggaagugauuggcuguggggaagggagaauggcaaggcuggcugauuuuauaacagaucuuuauagagccauuugacucuacaaacugcauauauaacugaugaaaguaaauaacuaaaaaagcuuguccagcuugauuaaaagugauauuuauaauuuuugcaaaaauuacuaaggaaguuggaauauuuugacagauauauuuuuuaaucucaaaucuuccuaucaucucaacacacaucaaaaccuugagagcagagaccagugguccuuccuuucagaguuggagagucugggauucuguugucagacuguguucccugaggcuuuucuuugucuccuuaauuaccuugcacuuaagucaggucuguauacaggaaaaucucuaucucaacagccauggccuuuuguguucuucagguuguccgcacaaaccagugugcaggagaguuugucaucaccuucccccgugcuuaccacagcggcuucaaccaaggcuacaacuuugccgaggcugucaacuuuugcacugcugacugggugagucuagaauguggugggaugguggggagaagcaggaggguuguagagaagcuggggcaucauggccuccagacuuggccacacucaaccuugaaccugcccacaguugccugcugggcgccagugcauugagcacuaccgccggcuccggagauacugcgucuucucccaugaggagcuuaucugcaagauggcugccugcccagagaagcuagaccugaaccuggcggcagcugugcauaaggagauguucaucauggugcaagaagagcggcgucuacgaaaggcccugcuggagaagguggggagaguaccccagaucaagcacccuauucugguggaaguucggggaggcagaggcagcaccaagaagauguagccucuacucuuggcguauagugaaaagaacuagaugcaucucgauugaaaaccacauaccauucucugcuauacccuuuaccagcaaccuuaagucgauuuacuucauugucaguuuuccccucugaaaaaugggauuaugauaaugcuuaucuuuuuggauaguugauuguauuaaagauaauguuugcuuagugacugacccauggcagguacugguauagcagcuauuuaucauuauuuacaugaccuagcaaaauagacuggcauaugaaaccucacugcugauuaucuaggugacuguaucaaguuacuugaucuuucauaucucacuuuccuacucuaaagugggaauaaauaccuaacuugcaagauguaagguuagaguaaggugauuuauaugaaagccaucucucuaacauugccuuugcaauguugcagcugcuauuauugguaauguuaauacaugaagaaacugauugaaauuuggaauguuucucaggaauugccauuuuauuacaugcagaugguuuauuaacuccagcuagggcaauaauauuaccaagcugaaggugguccugcuuuaauugauuucuuguaagcuugugucaguuguguguguagcugaguggaagcugcuacagagcucuaaaguccacucguguaguuucagccaucaucuucaaauuucacacuugcccaguuagggaauugacuuugugagagucuuucauaagauuacaaaggagugcugguucugugggaucccuugcugccuaucuaggguaauacuuucuuauuuuaaagcucauuuauagcuuuccugugagugugggcuauagggagaacuauagcuacaguaguguuggaagucuggggccucucagucgugguguaaguuguugagucccugggcuuuuccaggcaucauuuucucacucuguucaguacuguuauuaaaugauggccguguggcugugccaagcugugggaaggagccaaagcaagguggggagaauagaccuucucaucuugacauucagaauucuucacacuuggcccuuaccucagagaagcauucuggacaccauagucuuggaauccuguaagagauuguauguguauuuaaguauguuucugggaagaggacuuauaguuuacauccaauucucaggagucuguaguccaaaaaaacccuagagacuucauccuuagaauauucucuggcuuuagagucaaaauuaacucaguuuggcaaguuacugacccugagacuuaguuucugccuuaguaaaaugagauaggccuguggaauauauauucuuaucugaaaauuagagcuaauaacaguaaauauuugaugaacacugaaucuaagugcugagauacuugucugauuccauagcugcuuuauuuuuguuaauccucauaacaacccaacaaggaugauacuguuuaucuccaucuuacuagauaaugaaacagacccagagacguuaaaugauuuacucaugaucacacagcauauaaguggcagagugggauuugggcucauaacuuaugcagagauuagguguuaaaguugguauguaagacaaaaacuguuaagaguugacauuucccauuaaaaucccuaaaauugcccauuagauauacacacuggguugucucucgauuacuccaauauagccagcuuuuccuucauuuuugaaauggauugcuuuuucuuuaucugagcaacagaugaagucauuggauuagguuuggaaaccauauuguugggagaaaauuauuauaucucuuuaaacccugaacacaagcacauacgguugaauuucucuaaguuauauaugugcacaaguaucuccugccuacuaaguggccagcguggugccuggaacacagugggcucugaguaacuggaagccgauauuguuccccaguacacauaacuagccaggccugucccuuggccacuugcacucauugccaccucucugguaucuugguccaccacuuuccucacuucucacccacaagacccuuucugcugaucuggaucuuaccugauuuuucuuccucuauaaaauuaucugacucagcgcacacugaucuugcccugguuuaucugauuccccaagcuuugagagucuagacuuuacaaagggcagguaugcucccugggguuuggccucuuaaaccccaugacccucagcauagauuugaaucuaaaguaggggucggugguggcugagauggaggauuuugcuaccugguucugguuauauauaacgcauagguuaaaugcccuuaggguaucacagaggcugagcgagaggcuuucgagcugcucccagaugaugagcgccaguguaucaagugcaagacuacguguuuccugucagcccuggccugcuacgacugcccagacggccuugucugccuuucccacaucaaugaucucugcaagugcuccaguagccggcaguaccugcggugagcaugggccuuucuggaggaaguggggcaagaaggaggauggagagcugggccagacaugcucuugccugcccucuuccuccagguaucgguauaccuuggaugagcuuccugccaugcugcauaagcugaagguucgggcugaguccuuugacaccugggccaacaaagugcgaguggcccuggagguggaggaugggcggaagcgcagugagugaugggggggauggagggacuccacaggcaaguucuauucccuuucuucuguacucugacccccuuccucugccucuauucaauacugccuacucuuugcugcccucauuuuucuuccaggccuugaagaacugagggcacuagagucugaagcccgugagcggagguuuccuaauagugagcugcugcagcaacuaaagaacugccugagugaggcagaggcuugcgugucccgagcucugggacuggucagcggccaggaagcuggguaugacagcgugaggaguuagggcacacauaaggugcugaggauccagcaccgaggaaaagugcugcaagggguagacugugaauaccauuuggcagaauggacaucagcaggaagcugccaggcacaagagugugagauggccuggaagguguugggggggacaaggagaccaggccaccuaaaaaggagaggagagccucugugauaagaaagcuagaaguguuuauuuuuuaucaguaccuggaaguggccugagagagaggcugagggguuuugugggcagggaagaguugugggaggcuuacggguaagaacaggacaaagauguauagaccugaucccugcuaacacagcuuuagaguucacaguagaggauggauugcaaaguguagcucuuauuacaacccauuaguuucuaauucuuuccccucauaauaugaacaugcucuauaauuuaaaaccuucccucuaaccugggcaauuggggcaaauuugaaauaugcgagaucaagguggacagguguagugaggaaagguguucagucuuagcauagacauggagggaaggcacugaguuuggaccugaaaccucacaugugauacuucauagcccccacaggguggcuggucuacagaugacccugacugagcuccgggccuuucuggaccagaugaacaaccugccuugcgccaugcaccagauuggggaugucaaggugaggacgcuuggagugcugaugagggaucaaggggaccaggggaccugagcagcaggccaugcuuggcuccuuucaaaagcuuaaaguguucaggcaagacaggacacacgugugagaaaagaacaggugggaggggugaggcaagggucuagugacuugucuguuagaaaugggccuugagggucagguggcaaggguauggguauaggauacagaguccagguaagguuuccuggaggagggguagaggagaaggagguaacaggggugcuuguugggcuuggaaaguggagggaaauucaugaagguggaggaggagugagauggagagggcaacagaccccaggguggugagcacaaggguuuaugugaggacuaaucauagcaauuuuuagggcagggaggucucuuggugcccugagaacagagcccucugaaaaguuaaauaaagcauagauuaauaauuauuaguuaauuaagaaucucucaggguggggcccaggaaucugcauucuuaaauuccccagggcauucuaaugagcagucaguguuaggaaccccaacugucuuagggcuuggagaaggagagcucagcccauguuaggcuccuuugccccaaaagcuuggaggguaagaagauaggugggacaagguuccaucuggugguggaaccccucagugggcccagcugaggaguuuguucuucauccuguguccugguaggguguucuggaacagguggaggccuaccaggcugaggcucgugaggcccuggccucacugcccuccaguccagggcuacugcagucccuguuggagagggggcggcagcuggggguggaggugccugaggcccagcagcuccagcggcagguggaacaggcgcgauggcuggaugaggugaaacgcacacuggcccccucagcccgaaggggcaccuuggcugucaugcgaggacuguuggucgcgggugccaguguagccccuagcccugcuguggauaaagcccaggccgagcugcaggaacugcugaccauugcugaacgcugggaggagaaagcccaccucugccuggaggccagguagguccagcugcugcuucccuucccugcccuauuccaaacaucaaaguugaguggagacccagaagaggaugcccauggguggccuuagguaucacgcuccuguguuacuguauugacucuccccucuuuuguugucuaucuugucguuuuuuuaaaaaacaacucuguauacuuaaaggcaaagagaggcugauggagaagcagaaauggacagauagagauuaucuagaagacuagcccuacaggcuaaugugcgcauacccagaagcacaagugacaggcagaugggcagauguugguagaaagaccccacacagggcaguugacaaacugcagcaacagauuacacaauacagguuguauauguaggcauugcuagcaggccagcagacuggcagacaaacagaggugcaagagcuguggcagaagggaugaaguugggugcaugcagucuuggggaagcagggacuggcagcuacccuuagguggaauacaagcaaguaggcccaagugacagcaggaauaacagacacccaaggggcccaugcagauauaucugguggucaggcugggcuucuggucaggcagaccacaucagacugagcguucuuuuuuuccuuaccuuuaggcagaagcauccaccagccacacuugaggccauaauccgugaagcggaaaacaucccuguucaccugcccaacauccaggcucucaaggaggcucuugcuaaggcccgggccuggauugcugauguugaugagauccaagugaggacccugccacucccaccccaggccuucaguccagcugggaagagauggcauauacacugggaugugcuggguugcugggauggguuggguuggcuggagagaggaagggggcauggcauguagucaggaggcaagaugugccugaugagcagggugagaggaagagugugaggcuggccugaaggaagagagggcacugguuaggaugagauuggugggccagggaagcaggugguaugggacugagcagggcaggggcauggaggagaggagaagaggcaaaccacaacagaaggcugacuagauauuuggggcugagccagucaguagaugccgguguugugggagagagccaagugguuguuccuuaggaugacaccuauuuuuuuaaucccucaagacugagcccaguucaucuuuccagcucagggccaggcacagaguaagcaucaauagcauuggcaaguugaacugagcugucucucgcccuuggccuuagaauggugaccacuaccccugccuggaugacuuggagggccuaguagcugugggccgggaccuaccuguggggcuggaggagcugagacagcuagagcuacagguacugacagcgcacuccuggagggagaaggccuccaagaccuuccucaagaaaaauucuugcuacacgcugcuggaggugaggccugggaccuugaccuacagcgucucuuaacgccugcccuggcuucugugagauggcucaugagauaacauggguuuuguaggggcaccagggagggaaggaggcgggggauguaagggaagcccagucauucccucucuugucugccugccccagguucucugcccaugugcagaugccggcucagacagcaccaagcgcagccgguggauggagaaggagcugggguuguacaaaucugacacagagcugcuggggcugucugcgcaggaccucagggacccaggcucugugguaaggagcuucgacacagauggggagaagggcuuggugaugauagagugucugagcuggguggccaugagcagaccgcuuguccccugagccucaguucuccugguuugggaguggggguguuaagggggggcccagagaagggaagggguaggcugcugacccacuuugcuccuguccuggguauggcagaucguggccuucaaggagggggaacagaaggagaaggaggguauccugcagcugcgucgcaccaauucggccaagcccaguccacuggcaucaucgagcacggccuccucuacaaccucuaucugugugugugggcaggugcuggcuggggcgggagcucugcagugugaccugugucaggacugguuccaugggcggugugugucagugccucgccuccucagcucuccgaggcccaaucccaccucauccccacugcuggccuggugggaaugggacaccaaauuccuguguccacuguguaugcgcucaaggcgcccgcgccuggagaccauccuggcacugcugguagcccugcagagacugccugugcggcugcccgagggcgaggcccugcagugccucacagagagggccaucagcuggcaaggccgcgccaggcaggcucuggccucugaagaugugacugcucuuuugggacggcuggcugagcuccgccaacggcuacaggcugaaccuagaccugaggagccuccuaacuacccugcagccccugcuucugacccccucagagagggcaguggcaaggauaugccuaaggugagcuacucagcccagcucuuguccucagauucuugucuccuagccccuaccccaguuuaggcucggcccugccccuuguucuccaauuuucaguuuucuuuggaccagccuuccuacuccauucugcaucuguccagauuccuagacucugcucccugcuggcagccugugucuucccuccuccuccagaaggcggagggucucaaguuugggguuggcggaggaggaauagggccugguucuucacuucaguugccccuaccuauucuugcucuccuccgcagguccagggcuuacuggagaauggagacagugugaccaguccugagaagguagccccggaggagggcucagguaagagagguaggucuaggugugguguggguaggcuguugacugcacaucaccauagugacccauguaguccucagcucuguuguagugguggggauaagaccaagggcagccucuaaugccgcuuguuccugcaaccuccuagaucuggagcugcuguccucgcuguugccacaguugacuggcccuguguuggaacugccugaggcaacccgggcccccuuggaggagcucaugauggagggggaccugcucgaggugacccuggaugagaaccacagcauauggcagcugcugcaggcuggacagcccccagaccuggagaggauccgcacacuucuggaggugaggagaggggucaugggccgggccaggaggucaggccgaguagggagcccaggccugaccacuggcccacaaccugucuuucugccugucuguaaucacagcuggagaaggcagagcgucacgggagucgggcucggggccgggcccuggagaggcggcggcggcggaagguggaucgggguggggagggcgaugacccagcccgagaggagcuagagccaaagaggguacggagcucagggccagaggcugaggagguccaggaggaggaagagcuggaggaggagacugggggugagggccccccugcacccauccccaccacuggcagccccagcacccaggagaaccagaauggcuuggaaccggcggaagggaccacuucaggccccucggccccuuucuccacucugacuccccggcugcaucugcccugcccacagcagccgccucagcaacaguugugacaguggcugagccuagcacagacccugacagagaccccccucggccucaaggauccucuuucugaccaucaagccugcuucuuggggggugggcggguagggggguggccaucccugcuacccgcccaccccugagucccuugacuuuuguauucugacuccaagguauuguucagaccucagcuccugggggccggccccuggagucuucccucccugguagccucuaaccagcauucccagacaccugaggcagauagauggaugggcuggugggcagggggguggcuggggcugggccaucaccauuccagagacaaggccaguguauaugcaaacugggggacucuccucccuucucuccccaguucugguccuggccaggccaugcuacacuaaccccugcccccacucuccuccccucuuuuccuuccuuccuacccccuucucccucucccuuccccugacuguuccacccaggaggaggaaacuucacauagccgugcucacaguuuuuuauuuuaaaggaauuuggcuggggagcugaacagggcucccugugaucugaagaaagcuuuuggugcuuguccucacaaccaccucaguccucccucccuguccuccccugucuccuuuccuccuccuggguucauguuguaauaaaagaagauuguugguguguaauuaauuuguucaaaagaaaaaaaaaagcaaaacaagaaacuugguuccaacugaagccuauuuuaauuuuauuuuauuauuuuccucuuguuagaaauaaaacccuuagaaacauuuuuuggaaacauguuucugaagugcauuucucuuagacggggaagacagugcuuccaucaccagucaguggagcagcuguagugcuggcaggagcacuagggcugaagccagggagcucuggguucugaaaucaaguuccaccagcuucuuaaccuugggcaagacauucugauccucccccgacucuaaccccaagccacuuucccucaaguccaaacagaugggcucgggcccccucacccaaacuccuacacuacaaccucccccaguugaugcccuccaguuuauccuccucaagcucccaaagggauuuuuuuguuaauggcuuuauugagauauaauuuacauacuauaaaauucacuuguuugaaauguacaauucagugauuugggggguuucuaaaguguagaucugauuauauacugcuuaaaaccuuccaugaugcuuuauugcccuuaagauuauacauagaaucucguucuuccuagaauguuuuccugucuaacccaucuacugcauaauucccugauuuuucuccacagguuaugccccugaugaauggggacuaaagcucagauguguggucauuugcaaccccugaguucacuuuuuuaagacagcuuauugauauauauaauguacauaccauacagucacccacuuaaaaguauacaauuaaauagcuuuuaguauauucagaguugugcagccaucauucgaaaaaaaauuucagaacauuuucaucacugcagaaagaaacuccauaucccuuaggcguccuuuaccccucaucccauuugccuauucuggacauuuuacauaaauggaaucguauaauaugugauccuuugugucuagcuucuuucacuuagcaaagugguuucaagcccauuaauggucccauaguaguuggaaagaucucucuucugagucccaaagucuuuaagaugagggugcuggacuaaaucagggaccaucaacagauuguuuacauguuuuuguggguguuugcaugcauguguuuuucugacaagaagacuaaccagcuuguaucagauucauaaagggauccuugacccuccaaaggcuaagaaccauucuuuguggucuugaguguucuguguuuggagucugcccaugauacgaggauacaaaggaggaagcaagaguauggaagcccuaagccagucagcuuccuaucaugccugccucaagggcuuuccguccucucaaggggcugugaggaggcuaaaggcuggguccugaucccuagcccaggagcuuagcacacugccacucuuauuuugcuuucucaucugaacguucauggguuucauucccccuucccaauauuugcagcugauaggaaccuagugguaaauaagaaagcccgcccucuucuggcagcuuugauuggugggaaggucuggcucagcccugcuucaucuagucuuccaguugggacccuaggcuauacaaguaaggagagagagaggaguccguggacaacccugccggguccagcuugaccccaggucucagucuaggggaaaaggcugaccuuuuggcuggaauugaucaugaaaaggggguuggaggagcugacaggagagaugagugugagagcugggaugggcaggaaggggcucaaucucagcacuuaacuaccacugccaaggcagucagccacaggaaguguccagacaggagaggaagagauggugccuacaaccugaagcaacucccagguuagagaacugcuuggcccaggacggaggccucccugguauaggcccauccuucaccaguuuucagacagccuuuaccauguuggcacgucugugucccaucccucacacacu

SEQ ID NO: 19201 - RNA, 34922 nt, Homo sapiens
agugugugagggaugggacacagacgugccaacaugguaaaggcugucugaaaacuggugaaggaugggccuauaccagggaggccuccguccugggccaagcaguucucuaaccugggaguugcuucagguuguaggcaccaucucuuccucuccugucuggacacuuccuguggcugacugccuuggcagugguaguuaagugcugagauugagccccuuccugcccaucccagcucucacacucaucucuccugucagcuccuccaacccccuuuucaugaucaauuccagccaaaaggucagccuuuuccccuagacugagaccuggggucaagcuggacccggcaggguuguccacggacuccucucucucuccuuacuuguauagccuagggucccaacuggaagacuagaugaagcagggcugagccagaccuucccaccaaucaaagcugccagaagagggcgggcuuucuuauuuaccacuagguuccuaucagcugcaaauauugggaagggggaaugaaacccaugaacguucagaugagaaagcaaaauaagaguggcagugugcuaagcuccugggcuagggaucaggacccagccuuuagccuccucacagccccuugagaggacggaaagcccuugaggcaggcaugauaggaagcugacuggcuuagggcuuccauacucuugcuuccuccuuuguauccucguaucaugggcagacuccaaacacagaacacucaagaccacaaagaaugguucuuagccuuuggagggucaaggaucccuuuaugaaucugauacaagcugguuagucuucuugucagaaaaacacaugcaugcaaacacccacaaaaacauguaaacaaucuguugauggucccugauuuaguccagcacccucaucuuaaagacuuugggacucagaagagagaucuuuccaacuacuaugggaccauuaaugggcuugaaaccacuuugcuaagugaaagaagcuagacacaaaggaucacauauuauacgauuccauuuauguaaaauguccagaauaggcaaaugggaugagggguaaaggacgccuaagggauauggaguuucuuucugcagugaugaaaauguucugaaauuuuuuuucgaaugauggcugcacaacucugaauauacuaaaagcuauuuaauuguauacuuuuaagugggugacuguaugguauguacauuauauauaucaauaagcugucuuaaaaaagugaacucagggguugcaaaugaccacacaucugagcuuuaguccccauucaucaggggcauaaccuguggagaaaaaucagggaauuaugcaguagauggguuagacaggaaaacauucuaggaagaacgagauucuauguauaaucuuaagggcaauaaagcaucauggaagguuuuaagcaguauauaaucagaucuacacuuuagaaaccccccaaaucacugaauuguacauuucaaacaagugaauuuuauaguauguaaauuauaucucaauaaagccauuaacaaaaaaaucccuuugggagcuugaggaggauaaacuggagggcaucaacugggggagguuguaguguaggaguuugggugagggggcccgagcccaucuguuuggacuugagggaaaguggcuugggguuagagucgggggaggaucagaaugucuugcccaagguuaagaagcugguggaacuugauuucagaacccagagcucccuggcuucagcccuagugcuccugccagcacuacagcugcuccacugacuggugauggaagcacugucuuccccgucuaagagaaaugcacuucagaaacauguuuccaaaaaauguuucuaaggguuuuauuucuaacaagaggaaaauaauaaaauaaaauuaaaauaggcuucaguuggaaccaaguuucuuguuuugcuuuuuuuuuucuuuugaacaaauuaauuacacaccaacaaucuucuuuuauuacaacaugaacccaggaggaggaaaggagacaggggaggacagggagggaggacugaggugguugugaggacaagcaccaaaagcuuucuucagaucacagggagcccuguucagcuccccagccaaauuccuuuaaaauaaaaaacugugagcacggcuaugugaaguuuccuccuccuggguggaacagucaggggaagggagagggagaaggggguaggaaggaaggaaaagaggggaggagagugggggcagggguuaguguagcauggccuggccaggaccagaacuggggagagaagggaggagagucccccaguuugcauauacacuggccuugucucuggaauggugauggcccagccccagccaccccccugcccaccagcccauccaucuaucugccucaggugucugggaaugcugguuagaggcuaccagggagggaagacuccaggggccggcccccaggagcugaggucugaacaauaccuuggagucagaauacaaaagucaagggacucaggggugggcggguagcagggauggccaccccccuacccgcccaccccccaagaagcaggcuugauggucagaaagaggauccuugaggccgaggggggucucugucagggucugugcuaggcucagccacugucacaacuguugcugaggcggcugcugugggcagggcagaugcagccggggagucagaguggagaaaggggccgaggggccugaaguggucccuuccgccgguuccaagccauucugguucuccugggugcuggggcugccagugguggggaugggugcaggggggcccucacccccagucuccuccuccagcucuuccuccuccuggaccuccucagccucuggcccugagcuccguacccucuuuggcucuagcuccucucgggcugggucaucgcccuccccaccccgauccaccuuccgccgccgccgccucuccagggcccggccccgagcccgacucccgugacgcucugccuucuccagcugugauuacagacaggcagaaagacagguugugggccaguggucaggccugggcucccuacucggccugaccuccuggcccggcccaugaccccucuccucaccuccagaagugugcggauccucuccaggucugggggcuguccagccugcagcagcugccauaugcugugguucucauccagggucaccucgagcaggucccccuccaucaugagcuccuccaagggggcccggguugccucaggcaguuccaacacagggccagucaacuguggcaacagcgaggacagcagcuccagaucuaggagguugcaggaacaagcggcauuagaggcugcccuuggucuuauccccaccacuacaacagagcugaggacuacaugggucacuauggugaugugcagucaacagccuacccacaccacaccuagaccuaccucucuuaccugagcccuccuccggggcuaccuucucaggacuggucacacugucuccauucuccaguaagcccuggaccugcggaggagagcaagaauagguaggggcaacugaagugaagaaccaggcccuauuccuccuccgccaaccccaaacuugagacccuccgccuucuggaggaggagggaagacacaggcugccagcagggagcagagucuaggaaucuggacagaugcagaauggaguaggaaggcugguccaaagaaaacugaaaauuggagaacaaggggcagggccgagccuaaacugggguaggggcuaggagacaagaaucugaggacaagagcugggcugaguagcucaccuuaggcauauccuugccacugcccucucugagggggucagaagcaggggcugcaggguaguuaggaggcuccucaggucuagguucagccuguagccguuggcggagcucagccagccgucccaaaagagcagucacaucuucagaggccagagccugccuggcgcggccuugccagcugauggcccucucugugaggcacugcagggccucgcccucgggcagccgcacaggcagucucugcagggcuaccagcagugccaggauggucuccaggcgcgggcgccuugagcgcauacacaguggacacaggaauuuggugucccauucccaccaggccagcaguggggaugaggugggauugggccucggagagcugaggaggcgaggcacugacacacaccgcccauggaaccaguccugacacaggucacacugcagagcucccgccccagccagcaccugcccacacacacagauagagguuguagaggaggccgugcucgaugaugccaguggacugggcuuggccgaauuggugcgacgcagcugcaggauacccuccuucuccuucuguucccccuccuugaaggccacgaucugccauacccaggacaggagcaaagugggucagcagccuaccccuucccuucucugggcccccccuuaacacccccacucccaaaccaggagaacugaggcucaggggacaagcggucugcucauggccacccagcucagacacucuaucaucaccaagcccuucuccccaucugugucgaagcuccuuaccacagagccugggucccugagguccugcgcagacagccccagcagcucugugucagauuuguacaaccccagcuccuucuccauccaccggcugcgcuuggugcugucugagccggcaucugcacaugggcagagaaccuggggcaggcagacaagagagggaaugacugggcuucccuuacaucccccgccuccuucccucccuggugccccuacaaaacccauguuaucucaugagccaucucacagaagccagggcaggcguuaagagacgcuguaggucaaggucccaggccucaccuccagcagcguguagcaagaauuuuucuugaggaaggucuuggaggccuucucccuccaggagugcgcugucaguaccuguagcucuagcugucucagcuccuccagccccacagguaggucccggcccacagcuacuaggcccuccaagucauccaggcagggguaguggucaccauucuaaggccaagggcgagagacagcucaguucaacuugccaaugcuauugaugcuuacucugugccuggcccugagcuggaaagaugaacugggcucagucuugagggauuaaaaaaauaggugucauccuaaggaacaaccacuuggcucucucccacaacaccggcaucuacugacuggcucagccccaaauaucuagucagccuucuguugugguuugccucuucuccucuccuccaugccccugcccugcucagucccauaccaccugcuucccuggcccaccaaucucauccuaaccagugcccucucuuccuucaggccagccucacacucuuccucucacccugcucaucaggcacaucuugccuccugacuacaugccaugcccccuuccucucuccagccaacccaacccaucccagcaacccagcacaucccaguguauaugccaucucuucccagcuggacugaaggccuggggugggaguggcaggguccucacuuggaucucaucaacaucagcaauccaggcccgggccuuagcaagagccuccuugagagccuggauguugggcaggugaacagggauguuuuccgcuucacggauuauggccucaaguguggcugguggaugcuucugccuaaagguaaggaaaaaaagaacgcucagucugauguggucugccugaccagaagcccagccugaccaccagauauaucugcaugggccccuugggugucuguuauuccugcugucacuugggccuacuugcuuguauuccaccuaaggguagcugccagucccugcuuccccaagacugcaugcacccaacuucaucccuucugccacagcucuugcaccucuguuugucugccagucugcuggccugcuagcaaugccuacauauacaaccuguauuguguaaucuguugcugcaguuugucaacugcccuguguggggucuuucuaccaacaucugcccaucugccugucacuugugcuucuggguaugcgcacauuagccuguagggcuagucuucuagauaaucucuaucuguccauuucugcuucuccaucagccucucuuugccuuuaaguauacagaguuguuuuuuaaaaaaacgacaagauagacaacaaaagaggggagagucaauacaguaacacaggagcgugauaccuaaggccacccaugggcauccucuucugggucuccacucaacuuugauguuuggaauagggcagggaagggaagcagcagcuggaccuaccuggccuccaggcagaggugggcuuucuccucccagcguucagcaauggucagcaguuccugcagcucggccugggcuuuauccacagcagggcuaggggcuacacuggcacccgcgaccaacaguccucgcaugacagccaaggugccccuucgggcugagggggccagugugcguuucaccucauccagccaucgcgccuguuccaccugccgcuggagcugcugggccucaggcaccuccacccccagcugccgcccccucuccaacagggacugcaguagcccuggacuggagggcagugaggccagggccucacgagccucagccugguaggccuccaccuguuccagaacacccuaccaggacacaggaugaagaacaaacuccucagcugggcccacugagggguuccaccaccagauggaaccuugucccaccuaucuucuuacccuccaagcuuuuggggcaaaggagccuaacaugggcugagcucuccuucuccaagcccuaagacaguugggguuccuaacacugacugcucauuagaaugcccuggggaauuuaagaaugcagauuccugggccccacccugagagauucuuaauuaacuaauaauuauuaaucuaugcuuuauuuaacuuuucagagggcucuguucucagggcaccaagagaccucccugcccuaaaaauugcuaugauuaguccucacauaaacccuugugcucaccacccuggggucuguugcccucuccaucucacuccuccuccaccuucaugaauuucccuccacuuuccaagcccaacaagcaccccuguuaccuccuucuccucuaccccuccuccaggaaaccuuaccuggacucuguauccuauacccauacccuugccaccugacccucaaggcccauuucuaacagacaagucacuagacccuugccucaccccucccaccuguucuuuucucacacguguguccugucuugccugaacacuuuaagcuuuugaaaggagccaagcauggccugcugcucagguccccugguccccuugaucccucaucagcacuccaagcguccucaccuugacauccccaaucuggugcauggcgcaaggcagguuguucaucugguccagaaaggcccggagcucagucagggucaucuguagaccagccacccugugggggcuaugaaguaucacaugugagguuucagguccaaacucagugccuucccuccaugucuaugcuaagacugaacaccuuuccucacuacaccuguccaccuugaucucgcauauuucaaauuugccccaauugcccagguuagagggaagguuuuaaauuauagagcauguucauauuaugaggggaaagaauuagaaacuaauggguuguaauaagagcuacacuuugcaauccauccucuacugugaacucuaaagcuguguuagcagggaucaggucuauacaucuuuguccuguucuuacccguaagccucccacaacucuucccugcccacaaaaccccucagccucucucucaggccacuuccagguacugauaaaaaauaaacacuucuagcuuucuuaucacagaggcucuccucuccuuuuuagguggccuggucuccuugucccccccaacaccuuccaggccaucucacacucuugugccuggcagcuuccugcugauguccauucugccaaaugguauucacagucuaccccuugcagcacuuuuccucggugcuggauccucagcaccuuaugugugcccuaacuccucacgcugucauacccagcuuccuggccgcugaccagucccagagcucgggacacgcaagccucugccucacucaggcaguucuuuaguugcugcagcagcucacuauuaggaaaccuccgcucacgggcuucagacucuagugcccucaguucuucaaggccuggaagaaaaaugagggcagcaaagaguaggcaguauugaauagaggcagaggaagggggucagaguacagaagaaagggaauagaacuugccuguggagucccuccaucccccccaucacucacugcgcuuccgcccauccuccaccuccagggccacucgcacuuuguuggcccaggugucaaaggacucagcccgaaccuucagcuuaugcagcauggcaggaagcucauccaagguauaccgauaccuggaggaagagggcaggcaagagcaugucuggcccagcucuccauccuccuucuugccccacuuccuccagaaaggcccaugcucaccgcagguacugccggcuacuggagcacuugcagagaucauugaugugggaaaggcagacaaggccgucugggcagucguagcaggccagggcugacaggaaacacguagucuugcacuugauacacuggcgcucaucaucugggagcagcucgaaagccucucgcucagccucugugauacccuaagggcauuuaaccuaugcguuauauauaaccagaaccagguagcaaaauccuccaucucagccaccaccgaccccuacuuuagauucaaaucuaugcugagggucaugggguuuaagaggccaaaccccagggagcauaccugcccuuuguaaagucuagacucucaaagcuuggggaaucagauaaaccagggcaagaucagugugcgcugagucagauaauuuuauagaggaagaaaaaucagguaagauccagaucagcagaaagggucuugugggugagaagugaggaaagugguggaccaagauaccagagagguggcaaugagugcaaguggccaagggacaggccuggcuaguuauguguacuggggaacaauaucggcuuccaguuacucagagcccacuguguuccaggcaccacgcuggccacuuaguaggcaggagauacuugugcacauauauaacuuagagaaauucaaccguaugugcuuguguucaggguuuaaagagauauaauaauuuucucccaacaauaugguuuccaaaccuaauccaaugacuucaucuguugcucagauaaagaaaaagcaauccauuucaaaaaugaaggaaaagcuggcuauauuggaguaaucgagagacaacccaguguguauaucuaaugggcaauuuuagggauuuuaaugggaaaugucaacucuuaacaguuuuugucuuacauaccaacuuuaacaccuaaucucugcauaaguuaugagcccaaaucccacucugccacuuauaugcugugugaucaugaguaaaucauuuaacgucucugggucuguuucauuaucuaguaagauggagauaaacaguaucauccuuguuggguuguuaugaggauuaacaaaaauaaagcagcuauggaaucagacaaguaucucagcacuuagauucaguguucaucaaauauuuacuguuauuagcucuaauuuucagauaagaauauauauuccacaggccuaucucauuuuacuaaggcagaaacuaagucucagggucaguaacuugccaaacugaguuaauuuugacucuaaagccagagaauauucuaaggaugaagucucuaggguuuuuuuggacuacagacuccugagaauuggauguaaacuauaaguccucuucccagaaacauacuuaaauacacauacaaucucuuacaggauuccaagacuaugguguccagaaugcuucucugagguaagggccaagugugaagaauucugaaugucaagaugagaaggucuauucuccccaccuugcuuuggcuccuucccacagcuuggcacagccacacggccaucauuuaauaacaguacugaacagagugagaaaaugaugccuggaaaagcccagggacucaacaacuuacaccacgacugagaggccccagacuuccaacacuacuguagcuauaguucucccuauagcccacacucacaggaaagcuauaaaugagcuuuaaaauaagaaaguauuacccuagauaggcagcaagggaucccacagaaccagcacuccuuuguaaucuuaugaaagacucucacaaagucaauucccuaacugggcaagugugaaauuugaagaugauggcugaaacuacacgaguggacuuuagagcucuguagcagcuuccacucagcuacacacacaacugacacaagcuuacaagaaaucaauuaaagcaggaccaccuucagcuugguaauauuauugcccuagcuggaguuaauaaaccaucugcauguaauaaaauggcaauuccugagaaacauuccaaauuucaaucaguuucuucauguauuaacauuaccaauaauagcagcugcaacauugcaaaggcaauguuagagagauggcuuucauauaaaucaccuuacucuaaccuuacaucuugcaaguuagguauuuauucccacuuuagaguaggaaagugagauaugaaagaucaaguaacuugauacagucaccuagauaaucagcagugagguuucauaugccagucuauuuugcuaggucauguaaauaaugauaaauagcugcuauaccaguaccugccaugggucagucacuaagcaaacauuaucuuuaauacaaucaacuauccaaaaagauaagcauuaucauaaucccauuuuucagaggggaaaacugacaaugaaguaaaucgacuuaagguugcugguaaaggguauagcagagaaugguaugugguuuucaaucgagaugcaucuaguucuuuucacuauacgccaagaguagaggcuacaucuucuuggugcugccucugccuccccgaacuuccaccagaauagggugcuugaucugggguacucuccccaccuucuccagcagggccuuucguagacgccgcucuucuugcaccaugaugaacaucuccuuaugcacagcugccgccagguucaggucuagcuucucugggcaggcagccaucuugcagauaagcuccucaugggagaagacgcaguaucuccggagccggcgguagugcucaaugcacuggcgcccagcaggcaacugugggcagguucaagguugaguguggccaagucuggaggccaugaugccccagcuucucuacaacccuccugcuucuccccaccaucccaccacauucuagacucacccagucagcagugcaaaaguugacagccucggcaaaguuguagccuugguugaagccgcugugguaagcacgggggaaggugaugacaaacucuccugcacacugguuugugcggacaaccugaagaacacaaaaggccauggcuguugagauagagauuuuccuguauacagaccugacuuaagugcaagguaauuaaggagacaaagaaaagccucagggaacacagucugacaacagaaucccagacucuccaacucugaaaggaaggaccacuggucucugcucucaagguuuugauguguguugagaugauaggaagauuugagauuaaaaaauauaucugucaaaauauuccaacuuccuuaguaauuuuugcaaaaauuauaaauaucacuuuuaaucaagcuggacaagcuuuuuuaguuauuuacuuucaucaguuauauaugcaguuuguagagucaaauggcucuauaaagaucuguuauaaaaucagccagccuugccauucucccuuccccacagccaaucacuuccaccucuucugauuauuuuggcguugauuauaacuaccuuaaauaacaugcuucuagacuauguuaaaaacagccuccuguuucucaauuugcucaguuuuuuaugcauauaucccuaauuuucugaccaauauuuaaaucucuuuuccuaucaauuuucaucuuucuguagcagucucaugcaaccuucugaucugucccaaucuggaccagcuguccucccuggaucaucacucucuugugacagaucuccuauuuccuagaucccacgucuuccucuuucuugguuuauuccuuugcuaugcuuaagaacauccuccaacaguuuccugagaaauggugugaagaaccuacuuuucuuuuuuuaaagaaagucucuauucuuacucucacacuugacuguauauagaauucuaagaugaaaauccuuuuuuuuuuuuuuugagacggagucucgcucugccgcccaggcuggagugcaguggcacgaucucggcucacugcaagguccgccucccggguucacgccauucuccugccucagccucuccgaauagcugggacuacagacgccugccaccacgcccggcuaauuuuuuguauuuuuaguagagaugggguuucaccguggucucgaucuccugaccucgugauccgcccgccucggccucccaaagugcugggauuacaagugugagccaccgcgcccggcaaaaauccuuuuuuuaaaaacucccauaguuguugacucagaaaauaauuuuaaaggcacacugcucugaucuucuaguguuacuguugaaaaguucgaagccauucugauuucuaaugcuugauaagcauuugaaaccuguuucucucucucucgagcuuauaggauucuucuggucucaguguuugacauggaaauuuacaggauauaucuugguaugaauuucuuuucacucauguacuggguaggcccauugacucuggaaaaucgguucuccaguucagggaaauuuucuugagugauuucauuaaugauuucauccucucaguuuucaucuauuuucuuuucauaacuccuauuugaauauugaaccuccuagaaaaauucccuaauuuuuucuacccuuuuccaucuuuuuacucuacuuuuugggagauuuccucaacuauucaucuuucaaaaguggaaaacauacacuuuuuacauuuuucacuuuugcuaucauaacuuuguuugcgguaugcuauuuuuuuaaacaguauucuggucuucauucauuuuuacaguauaugccuuucuuuugaaguuuauuucucccugccuagccucuguaucuccaaguugcuucuguuuuuugggggauuuuuuaggguuuccucaguuuuuuguuuuuuuuuuuugacgcagagucucacuuugucgcccaggcuacagugccguggugcaauuucggcucacugcaaccucggccucccggguucaagugauucuccugccucagccuuccaagcagcugggauuacaggcacacgccacuaugccguauuuuuaguagagacgggguuuugucauguuggccaggcuggucucaaacuccugaccucaggugauccacccaccuuggcugggauuacaggcgugagccacugcaccgcacuggccucucaguuguuaaucuguggcugccugcuuauauuuaagaggaagagauuaaaaagcuaaauggaagcucugaguacacagaugaagcuugucaacugugagcuucacuguagggugaucuagcuaagccauuuaguuugggaaacuccaggucuuuccuugcaggccagucagauuccccaaagaaaauccuuuuuuuuuuuuuuuuuuuuuuuuugccuguaggaaaaaaggccuggcagccaguguucuaacagccaaguggagaaugauggcugggaaccucagcauccaguaugauaaauccuaauuacauucccuauaacuccaccuucaauuguaccuaggagaccuuaaaccagagacucuguuuuaaccucuucagaaauaaaucuucagucuuuuacuagagugacuagacauuucuagcugcccagcaugggaggguaucucacagcuuuuuuuuuugagacggugucucgcucugucgcccaggcuggagugcaguggugugaucucggcucauuguaagcuccgccucacggguucaugccauucuccugccucagccucccgaguagcugggacuacaggcauccgccaccaugcccggcuaauuuuuuguauuuuuguuagagacgggguuucacuguguuagccaggauggucucaaucuccugaccucaugauccacccgccucggccucccaaagugcugggauuacaggcgugagccacugcacccggcccucacagcuucuuauacagacaugaaccaauccuuauuuucaccccauccaucuuuaccccuagaaugccuggugccacugauaacaaaucuuugggggauucugagguaugaaucgggcugguucucaagauguccucaguaguggcuuauguuucaguuuucucaucuaucuguuuucuaguuucaagaauuuuaucauugucuccucucucguauucuccaucucuguaauuuuuuucacguuaaaaaaucccuuuauguaauuuuuguggaguuucaguacagaauggaaguagccauguguaugcuuaaucugucaucuuuacugagaagucucacaaagcuuuuuaagauaaacauucaauuuuggugaagacacagugaaguagguacagugccgguaagggaauaaauacauucuacucucuggaaaacaaauuugcuaauguauaucaagaacccuucaacccaaugauuccucugccaggagucuaaauuaauuuggggagaauuaacauccuaacaauaucaaaucuucccauucauaaacauaucuccacauuuauuuggaccaugcaucagcucccaccuccgucauauuuucuucucaaaucuaucucuacuuagaggcaacaucagcauuucuuucuuaccuguauuacugcacuggccucaauuacuaacugccagaacuaucuuccaaaaauagcaaauuugaccauguaaugccucagcugagagccucucacuggaauccccaugcccacaugauuaagccacagcucugacagguaaacucuuacucuucuuucagggaucacugcuccuacaaaaccuuuccugauaacccccgcuuccuaaaugaccuaguuuguugcucuuuugcagcaccuuuaaugcuuuauuccacuuauuuacuccucuguccagcacucagcuaugcauacacaaacgcaggcacuggguuauuugccuucugaguguugaccagagaggccuugcacaaagaaugagcucuagcaacauucacugaaugaucuagucccaggcuuaguuuuauuuauuauuaauuaauuagaaggggucuuacuaugccagccuuaauuuuaucgacaagaaaacuaagucucagauaagccucagguagcagagccaggaguagaacuugaugcucauaacucugucucacccugcacccugaugcuggcaaugucacuuuacuauuuccuaugugguuauuuagaaaaguucuccucacauucugcagcuguuaaaaaugacaacugugaauagccaaaaaguaaaaacaacucaaaagguucaucaacugguguauauuacugggccaucaaaggaauaaaguucugauacaugcugcaauguggaugaaccccaaaaacaugcuaagugagagaagaaacaaaugaccacauauuauuccauuuuuaugaacuguccagaaaagacaaaucuauagacagaaaacagaugaaugguugacugggacuaggggcuggaaaggggagugaccguaaauggguauaagggaucuuuuuggggugguagaaauguucuacaacuggauuguagagaugguagcacaacuccauaaauuuacuggauuguguacuuaaaaugggugaauuuuacgguauguagcaaaucauaccgcaauaaaacuuuaaaaaaugguuauaauucauauaguaacaaagcgaaaaucauucuagaccagugcuguccaagagaaauaugcuagguacauagguacuuuuaaauucuuuugcugggcacggugucucacgcuuauaaucucagcaguuugagagaccgaggcgggcagaucacuugaagucaggaguucaagaucagccuggccaacaugguacaaccccgucucuacuaaaaauacaaaaauuagcuggaugugguggcgcacgccuguaaucucagcuacucgggaggcuaaggcggaagaaucgcuugaacccaggagauggagguugcagugagccgagaucgcaccacugcacuccacccagggcaacagagcaagauuccuucucaaaaaaaaaaaaaaaaaaaaaaaaaaaaaaaucaagcacaguggcucaugccuguaaucccagcacuuugggaggccgaggcaggaggaucaccugaggucaggaguucgagaccagccuggccaacauggugaaaccccaucucuacuaaaaauacacaaaaauuagccaggcacaguggcucaugccuguaguccuagcuacuugggaggcugagacaggagaaucgcuugaacccgggaggcggagguugcagugagcugagaucacgucacugcacuccagccugggcaacaagagugagacuccuucuccaaaaaaaaaaaaaaaaaaaaaaaucuuuaguagccacauuaaaaaggcaaaaagaaacagguaaaauuaaguuaaauauauuuuauuuaacuuaacauauccacaauauuaccauuucuauguguaauuggcacacaaaaguauuaagugagauacuuugcauucuuuuguuucguacuaagucuugaaagccaacaugcauuuuauacuuuuggcacauuucagugaggacuagcuacauuucaagugcucaacagccacauguagcuaguggcuaccaaauuggacagugcaguucuagaccaauaaacuuaccaaauugauuauaaaaaccauacacuaauuauugcuaugucaaauuuuacauagaaaaauauaacagauggaaacauaacaaugcuuagauguuuacaguggagagaauaggggcgaacuuucuguuuuccaucuucuggaaagaggacauguuuauuuuauaaugaaaauaggcccgggcgcgguggcucacgccuguaauccuagcacuuugggaggccaaggcggguggaucaccugaggucaggaguucgagaccauccuggccaacauggugaaaccccgucucuacuaaaaauacaaaaauuagcugggcgugguggcgggcaacuguaaucccaccuacucgggaggcugaggccggguaaucacuugaacucgggaggaggagguugcagugagcugagaucgugagccgagaucgugccacugcacuccagccuccagccugggugacagagcgagacucugucucaaaaaaaaaaaaaaaaaaaaaagaaaagaaaauaauacuuacauuacauaucuauaaaaagaaauggccuucucccaccaaaggggaagguggggugaugggggcagggagcuagauaccucugggggagcuccagcuggcuaaacugcagucucccagcaugagaacauaaaaaucacagauacuugaauuaaggggauacugccaaguccaaagggccuggagaugcugugaacuaccuauaggaagggcagggcagacagagggcugggugguaaaguagcagcuggccagagaagaugaugagccacgagcaggagaaaugcuguggagguguaagcaaaaagcacguauuuuggauucugugauaaaguuuuuuaaaaagcgguaaggacuaaacagcuccaugaccuucugcauauguauauauacauauauauacacauacauauauauauauauauauauauauauacacacacacauauauauauauaugccucuuagcuacccaaauccuucagagaauccuuuuuuuuuuuuuuuuuuuuuugaaauggagucucuccaccuguugcccaggcuggaaugcaauggcacgaucucggcucacugcaaccuccgccuccuggguucaagugauucucccgccucagccuccccaguagcugggacuacaggcacgugccaccacgcccggcuaauucuguauuuuuauuagagacgagguuucaccauguuggccaggcuggucucgaacuccugaccucaggugauccggccgccucagccucccaaagugcugggauuacaggcaugagccaccacacccggcucuuuuuuuuuuuuuuuuuuuuuuuuuuuugagacagggucucacuauguugcccaggcuggagugcagugguacaaucucggcucacugcaaccucugccucccggguucaagcgauucuccugccuccugauccugaguagcugggauuacaggcgugcgccaccauaccuggcuaauuuuuguauuuuuaguagagacugggguuucaccgugucggccaagcugguuuugaacuccugaccucaagugaucugacugccuuggccucccaaagugcugggauuacaggcgugagccaccgugccuggccaagagaauccucuuuuacaguuuuccauggcauuauagacaaggacugaugcugugcuaugggucaggaagagagaagucuaaggaaagucagaccccaugucuacuuguaaagcagcagaacucaagcccuugaucaucauccuuaaauggggugagguagagagagaaaaggauaacucccugaguggaggaagauugccugaacuguuauaggacaccuccuucuguccaauucccuagauaucccaaguccuugguuaaauaucacuaaauuuuauaauaaaaaaauauuacucauggggcauauaguauaccaaaacaaggagaaggcaaaaagaaaugcaggugagaaccacugaccuaguccaaagcccuacuguacagauaucuaggaauaucugaaggagacauuaauucaguauuuauugacuaucucauacauuagaguaagugguaauguguccaaggccaaagagcguggaaggguguagggaagaguagcagccccggauaauacuuaaagcagagauagaggaucuacuaauuccuguucuuacaggacuagugaucaggcuguuuuaagauccacaccagaaaacuggcugaugcuaaucaaugcuagaaauucccaggaauauaaagucucucacagguaagccauguuguauacccagcaaaauguuuuaaaggguaagaaagaaguacacagaggauagaccagaacucuggguucaacuuuugaccuguuaaauaaaaagaccuauccacugcucugagaaggguaagaguauacaaaguauggcagaggcugcuaguuguaccucgauauucauucuugucuucugucauaacaacaugaccuccaguuuuaagugguacuugaccauccaaaauaagaauuacauuucccaguuuucccugcagcuagauguggucauaugaccaaguuuuuacuaacagaaggugaauggaaaugaugugugccuuuaaaagauuugucuagcccugcacuuccccacuucccucuuccacuggcuggaauguagaugugauaauaagccaccccuuagcuguuaccgucaaacacauggcccagagggcauaccaucauacggugcaucuaaucacuauuauuuugggucucuacuagacuagucaaacccguagcccaauuaagaacagcaaugaagaaaggccaggggcagaauacagaugacaaccaccgccaccaccaccaucacaaaggacaucacuaaaucacuccugccgcuugucccuguugccuggguacucacuggcacaccaugggacaugaggguguugggauucaugagggugacaaguuggugcaggaggucaggcuggcuaucaaauaguucaggugucagcuucuucaucacuucuuccaaauguucugcugcaagugagggcaccccauaccaggucuucggcucaccccugcacaaguggaaaagggacacacacaguaaaucacaccuuggucaugcagggagcccacacugacuugauucccuggcuccccagggucccacucaccaguggagguaguuaauggaguaacuccagugauccucaauaugccagcaaaaggcugagaagaccaugcccacguagagccagggcaccuucaugccagagauaucugcauugauguggcacaguacagacuguuccaacaccggcaucacauuuagguuccaaccacugguagcauacuccugccaggucagguauuuguaaaaagggcaugaggguuaugcuaaggaacugagaucuuaagucauuuucuuuagccuagggaaccuuaauuuugaggucagagacuuuuuugaaacaucuuaagaaacauauagguuuucucccuaccucuccaccaaaaagcauacacacaaaauuucaauuguauucacuucaauuucuacgaaguuuaccgauauauccaccuaccaaaauaccugcaaguuaaaaaaauccugcucuggaucaaaauguacccuuucuuggaagcacaacuaggcccucauuuucuccugugcauacaaaccccacucccugaacacuacuuauggaugagccaggaucucauauaccuucucauuuaauuuuuauaacaaauuugcaaaguagauauuauccccauuuuaaagauaaggaaaugggcucacagaggcgaaagaacccaucucauguuuguacaugccagguaccagacuguuuucuuucaucucaucuaaaucucauggcuacauaagacaggcauaauuauccucaucuuacagagauacugaguuuuucagauacuaaaugauuugccuaagcucacacagcugacacguaaccaugaaucauccacucaccuccucuucggggguuaggugccguuuacugucacugacagggaaaccgcugccaaauucuuuggaauggaugucagcuccauacucaacagucacaucuuccucaaugcuauuuaccagccuccagaacuccuucuccacaaguucugugggcaccaucugggggaagacagguagcagaugacuauggcccaucacacccuggacccacugauccaggugagcugagaccaucuggcaucaauaccuaugauccuagcccaacacuaccucagcccuccaucaccuacaugcacgggcauguugaaguagucagcuuuaaaggagucggccaucucgccaaagcucugcagaguguauucccggguagccugcucaaagccaaaggcuucugggggccgcuuacacuccugaaacccaaaggagaacaugucaccaaaacagaggcaaagaggugaagaauccucccaaguggaacuggaauauaagggguagggagggagaagagcccuaggucugcacucaaggccccugaggcaggccuuacuuuacagcuguaccuuuugcucuuaccacuucggcuuagucuuuucauuccccaucaugcuuuugcucaguuccucccuacugaaauguccuuuuccacuuucuuucauugguuccucaaaacucaauuccagucucacaacuuccagggagucaucucaugcucuuuucuuccuuuaggacuuuaucuaaauggcucugacuuuaauaugcuauccuguguucuucugccaccauuuuuccucucuagcuaaaaugugauucuuuuuuuuuuuuuuuuugagacggagucuugcucugucacccagacuggagugcagggucacaaucucaacucacugcaaccuccgccucccagguucaagcgauucuccugccucagcuucccgaguagcugggauuacaggugcccgccaccacgcccagcuaauuuuuguauuuuuaguagagaugggguuucaccauguuggccaggcuggucucaaacuccugacccugugauccgcccgccuuggccucccaagugcugggauuacaggcgugagccaccacgccuggccucuaaaaugugguucuaugcagggugcuuagagaagguuuuuuaugcccagacuagaacuguaaggcugggaaaauggcauugaauauuccaguaccuugaaagauggaaaacagggccgggcaugguggcucaugccuguaaacccagcacuuugggaggcugaggugggguggaucaccugaggucaggaguucgagaccagccuggccaccauggugaaacccugucucuacuagaacuacaaaaacuagccaggugugguggcaggcgccuguaaucccagcuacucaggaggcugaggcaggagaaucgcuugaacccgggaggcagagguugcagugagcagagauggcaucacugcacuccagccugggugacagagcaagauucugucgcaagaaaagaaaaagaaaaaagaaagauggaaaaugaagacacuggcuuuuacaguaucaaacccuccacuaauccuguucuugagacugucucagaagauaggaugugggucuaccucauuuuguaccuauguucauuauuuuagaugagaacaauauguaccccaaaaucagacacacaccaugcuuauguuugaaaaauaaauguccgucugguccacugacuuauaaccacuuagagaagagagucaaguagagucgacagucuugauacuguugguauccaaacuccuccccaacuagaaucuccaccacuaccaaggccaauaugcacugcccugauuuuuccucaucuguguaugucugucuguguguauguaugcaugugcacacccggucucuacaaccacaguugagucccuaagauaaggcgaaugucugcucuacagaaauccagagggaaauguagaagguaaguaccgagaauuugggugaagguaggaaguucaugaaauguaccugcccaacuuccuggcugcuuggcccuuacugcugcuucagcugcucuccuuacugccccuauacccauaguaggcaugcucuccugcuauaccucuguuccugcuaguccuccaccucccaguccugaacagccaaccaccucucuaguuaaagccuguagcacugccucaaucuaaauauaacaagaggaaaacaacuaaauaaauauuauacccaugauacaccaucuaaaaaaauuccagaccuuaauuaaacuuaguaauauagagaaaugguuauaaagcaacaaaugaaaauauauaacaagaucucaaacuuguuaaagauaguuacauauaaguaacagcaaaaagaugagaaaaaaauauaucaaacuauuaacaaugguuaucacuggguggugggaacacaaguaauuugccuauuuuccaaaaugucuuuuuuuuuuuugaagacagggucucauuuuguugcccaggcuggagugcaguggcaugauuuuggcacacugcaaccuccgccuccugggcucaagcgauccucccaccucagccucccgagcagcugggacaacaggcgugcgccaccaugccuggcuaauuuuuguaucuuuuuugguagagacgggguuucgccauguugcccaggcuggucucaaacuucugggcucaaacgauccgcccaccucagccucccaaagugcuaggauuacaggcgugagccaccgcgcccggccucaaacuuucuaaaaaagaaaaaaaaaaacaaaacaaaaacucagaaauugaaagaacauuuuuuucuuaauauuccuauccuucaagucucauuucugacauuuucccugauuauuacccuuagcuauuuuccucuccucugaacuucuauaucucagaguuucuaacacacaauuuagccucuguuuauaugucaccacauauagucuaauuaugaugcuuaccucuccagguggucugggagcucuuagaggacagaagcaaaggcugaaucuccugcuccuuucucccaaagcucugcccagccuaaucccaccacagagacccaaaaccuaagacuauggcugagcuaagaggcugcccucaauaaggccagaugaaggaaggcaaggaagcccuaugaggcagauguggaguggggaggccuuaccgccaugacacacuuugggcaccgccagacacccuuggggaucucaggcagaggaggcagcaggcagaagaugugguaguugucaucacagccaucacacagcaggagcuugucauccucauccccucgagaacacauccggcagacauaugacucaaucugccaggggagaagagcaaaaguucuccauuggaaauccacuguguuugcuggcugaaugauuuacagcccuguauaggcuagucaugcuaggucuggagcucaacugcacguauguaccaucuccccaaauaagcagguagagcugcaagagcagucuuuuaucauccagucuugaauccucccauuuuuauucauccaauaaacacuuacuaaacccguauucagaacuacgcuggacucuagcacaaagacaagacaugguauccuuccaaguauauacaguacucuagagacauguguucauaaaaauuaaaaauugccaauagcgguccauaaagggcacugugggagccuagagaaggaagcacucaaagcagcuggagauaaggagggauggccuugagaaaggacuucauugaaaagguaacaccugaaacuggcugaaaccugaaggcaaaacaaaacauggcaacagggcagagcacagggggaaucucuuccaggcugaagaaacaacaugugcaaaggauagggaugaaagagcauacugcaucuuacggggaaaaaugaacauaccuacaaggaguucaguguggcuauagcagaggagugaggugggcagugcugggggaugaggcuagaggucagcagggacuggaucaugcaugguaaugaggagcuuagccuuuauccugaagcaauggagagugagacuccuucucuggacccuuccagcacuucauguugacagcacuugaucacccuuucuugcucuuuguuccauaugaguuggcuuuguuuccccaauuaagugagcuaccugagggcagggcccauggaggcccgcuuuugugguuaaugcgaacugguccagugccaugcaggggaaugcuuauugaagggacaagaagcagagcauuaagaagucagggcuggguccuuacaaacugggcauugcugugguuccuccguagccucauggucaucuuggugcaggguucugggcugugacucagcuccuccuugcucuccaggaaggucuuaggcgauguugacuccaccuucacauccccaccuaacuccuccuucaccacuacuguggggggacacucaggccccuccuuaucugggagagagaaaaauggcuguaaacacaggucuaggacacuuagggcccugacuuuucuccccaggugaggccaccccagccuguuaggccuuaccuuucuuccgcagagucuugucuuuggccaugaggcccaggcccaucaucuuggggccugccccauagaucuguagcuuuuucagcucuggauucuucucaaugucuuccucuguggguuccggcuggaaggaaagaaggaaaugaaucaagacugcuaucuggggcagacugucccauccuaaaagaacaguaacucggacuacauaucaccugaucucaugcugagggcugaggcacagaugggcuaagccaagaacucagaguugcuuuuuggagacugaggguaggugagcugcccccucggcccucucucagaaaggaauaaaagacaggauaucucaguuuucccaacuguaaaaugagaauauuaccuccucccuuauaguuaugagggggguuagggacaauacauaugaaaaagcuaacaguguuuggcauuaccaacaaauggcagucuaauaggaucugcuaaauuacaugcuucgaugagcccagggacaguguccaucuuguucucuauuguauucccagugccaagaaugccuggcacauaagcuucugccugaagacauagcuacaaggagcugggaacagugguacacaccuguaguccuagcuacuccagaggcugaggugagaggaucacucaagccuaggaguucaagauuauagugcauuaugaucaagccugugaauagccacuguacuccagucugggcgacauagcaagacccuaugccucaaaacaaaacaaaacaaaagauacagguauaaagagaaagaagaguucuacuucuaugagcagaguaaguccggaaaggaacaaaacaggcaagaagagcagacauacaaaagagguugcacaaacagaucaagacccagcucagcagcucagcugagaggggagaaaaaagcaagagugaagccagagagaggcacacuaaugcucagaagaacucagagaacaaaagaagggauaauggaacagggaacacagccuuagccagaaggaaggagaggacucccuccaccucaaagcucuaaguucgaagaaggggaguacucacaucaggcugcagucucuuggcccgccggccauagcuguugaacuuggaaggcugcacagacugucguagggggaugcugugggguuuguauuccuuguccuucuccucauuaucaaauggacguguguuacacugcuggggacagguaagggguaagggucaggacauggacuccagcccgcaaaagcaauaacuucccucuacccucacccaauggcauccaaagcugugguccacucaccugacccacaccaacagccccuguuccacuggucuuuagcacugacaccagcacacauuuugggaauucucaguaccuuugcuuguaucacuccucccuuccagucacuuccuccaccaaccaucuccccaacuaaaucagacgccaucucuucccacaccuucuagcccaagcucucccuucucugauuucucuaucaguuaaaacuuugucacauaacaaauaagcuagccguacagauaacuccaggaccucugacccugagcaguguagaaagagaauaagcaucacuaggaaagagcagaguccaacucccaggucuccaguccacuaaaccaguuucauuaagagcaaguguggaaaucugugcugaaggguaaagccgcacccugccccacugugacauccuuaccacaagguuggcuccagacugguacauuucauagggauaaacaaugcguucguagugggagcguagcaaggagccaauauuuuugccugguggauaguugaggcgcugggcuacccgagcccaccgacgguccuugcagauagcuucauaaccaccuuccuccaccacaaucugaaaaaacaaguaggaaaagacauggaugugccacguguauuuauaugugagggaguaggccuguagaaagggcaaaagggcaaugagggcaacucuagucccucacuucacugggggcuauccccuuaucccaaccucaaauugcagcaaaagauuccaagauguucugaugacagcuugugugcuaccaagcugugccccuuccauugcagccuaaagaucuaauauccaaacuaagggggcccccagaguaucaaggauauugggguuuggugggaggggugcuugacaaaaaccuguucuuacuuugcugagacuguagagguccaagauccgccguucuacauugggaaucuuuaaggaggagcccuggauuucccagaauuuggcaaucugguccaaguaguucaguuucacucucgucugggccugaagaagaaauggcucaaagaggcuggccacccccucccacugaccacuaucuuuggguccagucuuaggggagaacagaggaauacagcacuccacacuuucacuacccaggguuucucccaaugaaccggaucccagacucuaggcagugcuuagccccaccucacucucauuucuuucguuuuuguuuuuuugagacggucuugcucugucgcccaagcuggaauggaguggugcaaucacggcugacuguagacuugaccuccugggcucaagugauccuccugccucagccuccugaguagcuggaacuauaggcgcacgccaccacgcccggcuaauuuuguauuuuuuguagcaaugaaguuucaccauguuaccaggcuggucucaaacuccuaagcucaagcaauccauccacuucggccucccaaagagcugggaucacaggcacaagccacugcaccacugcacccagccaccucucucucauuugucaccuuccagucaaucagagaagcccaaggucccaauagagagggucacaacugccaaaagcuuuagauauguccucuaaucucccugacaaggucaugugaguauuaucaucuccuauacagaugaggaaacagaggcucagaggaguuaggacacacagcaagcaucaagauauuuuggugccaaauaauuugagcuuuggcucucccucugcuacugauuugcuaugcugccuugagcaaaucaguuccacuguggacuccuuuuuccuuuuacuaauaauuauaaaaggaaaauaacugcacaguccacuuaccccagagggguagacuuaaugaggggaccagugaagauccucugcagauuucagaauuauaucuaagcucuaggcauguuucagagaaagcaagcuccaaaaaggcacaugcaccuccuuauguaccaccaaacuuguuccaugguggcuaaagggugaaagugcaugcuauaacuauagacagaauggccuagaacuaagagaugguauaucagaguagcacuagcaccuggccaacccaggacccaaugugggccaaggagacuagaaacaagauauguaugaugcuucccugaaaucucaguaaccaagaaggacucccauaggccccaagucuacaaccuccucacuccagucagagagccugguucuuggaagaacuagauagucauuaccauucacuaccuugcccugaucccauuagggggaacaaagacagcucuuuccauuucauaguugagaaaaacuaaggucuauuuguagaaagaaacaaccuacaguuccuuggcugugagaacucucaaagggcaaggaagugcuccuucaaccucagccccuuagcuuucugaaguuggccucaucccugcuccuucuuauuagucagcacucccucuacagaaaaccugcccuugugucaugcuaggcaacaucuugcccaagcuguaccccuauaaaccugacaagauauauuuuucuuuucugagauggggucuugcuauguugcccaaacuggucuugaacuccugagcucaagcaauccucccaccuuagcuucccaaaauguuaauagugccgaggcugaggaacucuggucuagaacacaagugaacuuuuaggguauaaguauucagcugggccugggccuaaugccccaccccuuggacaucuauuaagauuuguggguacauaauaaugggggagggaguggcaacauaugccuaaccuagagcugccauggaaaacuccaggaucuuacguggaacuggcuuuagggaaccuaaucucacuaccccagggcauucucaagcaggaaaaaccccaccuguccaugaaaagggccuggacuuccuguacagaacaaaagggagaaggaaaauccuaccugccugaccccuggccaagucucuaaccauuccagccuccacagagcccaguucuuguguuguucugcccaucuacccaaacucccaccuuaccaagcacccauggaagcaaaguagaaagcacagggcuguggaugaauuggauauaugaagccacauucagcuggccaaggaagaagggguaucagccaguuccauaauuccuuuuuguugacucagcuaggguaggcuaguuuacaggggaguuucagaaguagcaaaccuuugugagaaagggauauauguccccagccuuugggcuaucaaaucacaaaugcuaaaugccccuggcucuugguuauauuuagagcucuaaagcuucuuccacgcccugggcacacuaaaguaaugcaauuucacagaagagagaauaaaggccuagcuagguaaaguaccucagccagagaaacuauaagggaagugggauuagaacucagguauacauucucccaaccccaccaccagcuccuagucuucucaccucuagcucauucagccucuggauucgggggguaaaccugaaguuguccacuuccacagcaaaggguggcugccaguccugagaggguagagaggggaaagggacuugaguuaucucagcauaguguaagaccggaagucaccaaaagcagcucggaaucccacuggcaccuucccaaaccucuagccacuccagacccuuuaaccugcaaacauccuacccaaccacccacccccaccuccccccagaacucacaagagucuagcagccccucaagucugcacccaaggccccaugcacaugcccuaggaaacuucuccugagucccacccaacaguacagugccaggauuucaagaaauuaagagauggagccucuguuuuguugacccuaaaccuucuccacacccacauuaauuccuuauccccuaggcacgugcuguaggacacacaggccugggaguacuggaaagcacacaggaucuagagucagaagauauggguucauguucuagauccgcuacuuacuagcuaugagauuuuagcuuucugaaccuguuuucucaucugugaggugggaauaugaacucuagcccuggcuuccuugccagaccaauauggaaaauuaaaacuaguuuucaaaugaaaauguuauucaaaggagucaccguuaugaccugacaucuaaggcugaccacaccucacaauacacaugcaggguagcucagguccgauuguggcaggacguaaagguuugggccuuuaauguuuguucucucaguuuaaagggccugagauagacacugcagggaagagcaaggaacagggagcaaguauguguaucacucacccagucuggaaggcuuccuguagauccucucucauacaccugccugguacaggaagaggcaggggaggaagccccaggggguggggguaagugcugggaugccugacugugguggcaaagaaugggaggauuuggggagggaagucagggaaagaucaugaaagugggagacacucugcucugccaaguuggagcuugcuguguccugcccaaaggucagcugugaagaacccccucuccaacaccccuuuccaaccuccuaugcagaccucuccuucccagagcccuggcuccugcugggguggugaaaucaaccuaaaguaaccuaaaccaauguucucauuuuauaaauggggaaagugaggcucagagaaaaaaagugaaauuuccaaaauuacaugcugaguuagugguggggccaagaacccacgucuucugaccucugauccaaggccuuugcacuacaccagacaucaauguucauacauacaugcauacacgugggcgggggggagagacagugaaagagaagaaaaacuguugaccucuucugcacacacacuuuuagaaaaugggcuagaggacucauauuuugcaugcauacacagaccacacuccccugccccuaccagccaaagcagguggcaaacaucuggggcucaguaagcagggacaaaaaaaaaaaaaaacaggcaggccaaaaugguauggcucaaauccagacaagcuccccaugcccucuugccucucaucaggauagggcacuccccucagcacagguaacccagcuaaaaaggugcucaaacccaaaacuccgggcacccuucuuuccugcugaaucaaguucuagacaaucagugcaacaucaagcaccugacaggaaauggcagcccuggaaugcuacggcaggagccauggaugcaacagauaccugggaaggcccugcaaaccgccugccuucaucuccagacuacuguaugccaaauguauguugguauuacugggauguggugauaaaaaaaaggcuggcuaccugaugaagaaagcaagauccuuccaaacuccacugggucuacucaggguacccacacucuccucccacccaucuuucccaagcguagcagucaccugcccagcaauucaggccccaaaccauccuuccuccagcaaaccuccaauucccagguacccacccauauacagguucccacccugggcccaagcaucacuugagcgaguacuucaaacuucaaccagaagaaggccagcugccuaaagguggccuaggagcugccauagagaaggaaaaaacaaaaccaaaccagagagccagguauccuggauuagagagaagcacacuguugagcagugaaaaggacggccuccugcuggccaugcacaccugggacaugucacucuuccccuuccugaugccccaaagcaggguaacaacaccuacacaaggccagccugccuaagucaguccaagauagaaaaaaggaauucaggccucaacuacccccuacgucagcuaugccucuuuuucccacaggcuugcccaaccacuucagggagugccuccuugaggcugcccaggacuccugccucucccuuccacuagccuuccugacccucuacccacugccacucccucaccauggacaaggauaccucagaaaucuguggccagacuccaagaaggaagaaauucgcuuacccaacaccuccuagaggaucuaucugaaaccauccuagaucuguggcugagcaccagaaagcaccaaguuggauaaggaggccuguggugcccuccucaggugggaaugaagcuuccuauuccauuucagccaggagacacccacucaaaaacacccuuuuccagcaaagcucaauuucugcccuuggaaucccaacugaucacugaacauuaucaucacuuuuccaccauaucagcaaggcagcagcuugcccuagcccuugggagacuucuagccugaagccaggccuaggaggaaagcuauggccuuuguugcugaccccuggcaaucauguuccaaaagggacagaauuccauggcuccauucuguucugcgggcccaagagugcccuauccucugggaucuccuacauccuggaccagaggagaguagaaaucuucugagaaggacucacaccccaccaccaagcugaccgguccaaacaucuccauaggaagucaagucugcgggaugaugugcagaaaaggccuugacauugccuucaacgaggaaaagaagaggacaauucccugaacccaccucaagggagacagagcaaucccugugagacugauuuccugacugguccagcaggccaggauauuaucauagaugaauuggccuggcaagguaugaguaaauaugagucaaccuacauaggaauaaaccaaugaccacaucaaacacccucacagucacaauaauuaccacuuaucuagugcguacuacauacagacgcuaccuaguuuaauucaauccucuaaauaaccauuucugggauccauuucacgggcucagagagauuacuucuacuuucccaaggucacacagcugcucagcuucaaaguggaguuuugaacucaagucugucucccuucaggacugcgaucuuucuauuaauacuauacuaugcugccugccuuaaaggaagugaugacaacagauuggagaaacgucuuauuuuuacagccucgaccuagguggcccgggcuaagagaugugcggggugccucucugugaacucccuccggcccacuaggaaucccugucuuaaacccggagugauucugaagggccgggguggggguggaucucugacuccaggucaccugugggccucacaccacgagaggaccccuggcccaacacccuuuuuccgauccgcgccgcaaccacaacggucccagccacccccucuccccaccucgagcugcccuccgccccagacuucgccgcuggcuauccuacugcuucauuccgucucgccgccggcgaaaaccggccccggggcuuaccgcgggugggcggaucuugcaaaugcccgauuucucugcgaugggccugauuuucgcgauguagccaagagggucucggaacucggcccagcuaggcucgaacaccgggcacuccgguggcgguaggaaaucgucggaccccggcuccauggugggcccgaggucugggccagggaucgggaggcuuggaccgcccuuaaggacucauggcgccgccgcuguuugaagccgaggcaaugcucggaggcuaggcccuaagcggggcagccgccgcccgccgagggccuaagggggcguguggccgucgugcucugagagucucaggcugacucuacugcuaccgccucuucgucccgcuccguuucuuccaaacugugugguugccuccccacuaccgcagccuucgccaccacaguuaccucccaaacgccgcggccuucagcgccgccgccgccaucuugguuugucagcgucuccccucccca

SEQ ID NO: 19202 - RNA, 3959 nt, Homo sapiens
caguggguaucuucucaccucaaagucauuuucuauuauagagauaucaccuagcugccgaguccucccaaauguugccacaucccucaggauggcuccugaaucugcaggugacaaggggauggaaagagacaucacuucuauuaaggacuuuacccaaacccuucaggcccaacugaacccuucuuccccuucuccuuagugucuccaccugugccuuaccuggugucugaaacacacuaagauuaauaggucugucucuccucccacccccaagcucuggagcuucuggagggaaggcaaggcccaggccucagucugucuccacuuccaggccaagggcccgcaaucuagcuuagaaggagguaggagcaucaguuggggcuccacacugugcauaugacucuguuuccuuugcauugcagaguccagugguacaggauaccaccccuugggaguggcgccuggggucugagguacauggucaguggguccuugaaggggcagacacuaaccaugcuucccagaagaccugaaauugugaugggagaagagggguuaggaagcagaggaacaggguucuugccccugggcacucacaugaaaggaaggggaacagccccuugugaaccuccaccugggugcucagcuccaugugagguauuucacaaaguccccaacagacacaggaaacagaccccuaggaaaacaggccucaccuaagcauaucagccuggcagagcugggauuuucaccaaaucucugugacccuaaggccugugcuagacagaagggguccaaaguaaucagccugcaauccggaaauaguucacagugggagcucaguguugaucucugcuguugguagguugggaauucagcagugcuagggccacaguggccuugguagguuagaaguucauauugccgagguacauaaccuccacgccuaucucuauugguuauauauuugcuacauaacaaauuaucucaaaaacaguggcuuaaaacaacauuuuaucucacagucccugugguuaggaaucugggcacaacuuagcugaguuucuguuucagggucucacagccagcaaggugugagcuggggcuacagucaucucaaggcuugacuggggaaagaucugcuuucaagcugacucauguggcuguuggcauauucagucuugcuggcuguuggcugggggucacucucagguuccuugccaugugcacccuuucauaggguggcucauaauauggcagcuugcuucaucacagcaaacaaguaagaugagcuagagauagaaggagagugcccacaugccagacagaacucauagucuuuauaacuuaauuucagaugugagaucccaucacuuuugcaauauucuauucguuagaaguaagucaguuacugccgggcacaguggcucacaccuguaaucccagcacuuugggaagcugagacgggcggaucaccugaggucaggaguucgagaccaaccugaccaacauggagaaaccccaucucuacuaaaaguacaaaauuagcugggugucgucgcgggugccuguaauuccagcuacucaggaggcugaggcaggagaauugcuugaacccgggaggcagagguugcggugagccaagaucgcgccauugcacuccagucugggcaacaagugcaaacuccgucucaaaaaaaaaaaaaguaggucaguuacuagguccaggccacacucaaugggaggggauuacacaaaggugugaauaccaggaggcggggggucauugggggucaucuuggagacugacaacuauaguuuuuccacugguccuggugauucauguugcuuccacaugcaauauacauucaccacuucccaaagucucucaaagucucauccaauuacagcauugccccaaaauccagaacaucuaaaucagguccauauaugaaagaggcuguuugaguauggcuucuuaacuacuauuuuucuccaucuuuagauuugugagacaauuguuuuuuuguaaaaaauuauuuuuuggccgggugcaguggcucacgucuguaaucccagcacuuugggaggccgaggcgggcgaaucauguggucaggagaucgagaccauccuggcuaacacggugaaaccccgucucuacuaaaaauacaaaaaauuagccgggagugguggugggcgccuggaggcugaggcaggagaaucgcuugaacccgggagacggaguuugcagugagccgagaucacgccaccgcacuccagccugggcuacagagcaagacuccgucucaaaaaaaaaaaagaaaauuauuuuuuauuuuuauuuuguuauagagacgagaucuuacuauauugcccagacuguucucaaacuccugggcucaauccuuccaccuuggccucccaaagugcugggauuacaggcaugagccaccgugccuggcugauuugugagacuuaagaggcaaguuaucuguccccaacacacccuagguacaauggugggauagccauaggacaacuacuacagacauucugguucaaaaagaggggaaaugggagacauaaaggaguuacuggucuauaacuaacaacucugaaauccagcugggaaaauggaaguuucuugauuagaugucaaggccugggaauaauauucuaaggcucugcccucugaucucuugguuuuacccugugugccuuccuuuuucaugaaaggcagcaaauguuugcagcugaacuguuuccccaguuugcuuccugccaguagaauuuuggggguccaguggcuuuuuuucauuuugucuugucuguaaucagcugccaccaagaaauaguuccacaggggggcuuggguuacuguucuguuggcagguugggcacucagcaguggcuuauagccagauuggucgugguggaaguccauauuguggaguccaugcauaaccuccaugccugccaccauggccauuuuguucaggaauccauugggcaaagaaaagggugacagauaagaggcugacugacaucacagaacaggacaccuaccugucuacuugauugagcuccucuucugcaguggacucucucuggugcuuauuuaugugggacgugaauaucucugcccauuccaagagggacagccauaugcucuuccucagaccuugucaauaauauuucaguccuguuauuuccaaguccuucaccauuuagccgaaucauuaaaaacuacucaugaaacaguggaaaccuaucuauaccucugaccagcuaugugaccaggcaguuguucuacugggagaauuucccuucucacuguccuucaggaucaacccuaaguagggcuguaacacuacagcuagcuacuucagcagggccagcauaucaugcagggcuauguauaaaccaagcuggaauagaauauuguaucccuuagucaccuggucacagggaauuccccaugaggcuucaggugugggugagagagggauggcaguacagcaguugggaguaugauucacuugcucaggcagcuuauucaucaucuaggccugcuuguauaacucuauucuauucggugguggagugcuacugcacauagauaacuucguggcuugaugagacaguuaacacacaacucaccauggggagcucagcuugccugggucacuuggaguccuaugcucagccauucauucacaaaauagacccacuuuuccauuuuuauuuuucucugcuccugggacuccuguugucacgauauugccaccuccaauuuuaucccccauuucuugaaucuuuaacuugcucuucagcuguaguccuccuccccuuuaugccaucuauacuguguagauucgaauaguauauccaagaacuggagaaaucaccacaggauuucuucugggcccaguguaagaaagacucagaucaaaac

SEQ ID NO: 19203 - RNA, 2076 nt, Homo sapiens
ugguuggcaaguuuagucuguuuacauuuacugugauguauuugggcuuguuucuaccaucauacuuuuuuauuucuguuuaccaucacuaccuuuucugugcuucauuuucucuuuucucgccugcuuuuuuaguuuugagauuuguuuucuuauucaauuuuuuuccucccuauuuuuaaauuuuuuucuauucuuucugugguuauccuugauguuuuccauauguguuuaacuuauaaagucuaaaguuaaacaauauuuuagcccccuucuuaaagaaugcaggaagcuuagaaaccuucaacucuagucauuccucuccugaucacauacuguuguuuucaaauauguuaguuuguuccuuuuuauaaaccucacaauuuuacaucauugucaguguuauuuuauauagacaguguuuguuuggacuuacaugcauacauucuuguaucacacaucauccuuugggaucauuuucuuucauuaugaauauaguguuuaagugaguuuuuuuuuuuuuuaguacaggucucuugauguuaaauucuuccagucuuucuuauauguaaaugucuuuauuuuauccucauucuuaaaagauaguuuguuacagguauuuuuacucaacacuuagaauauaugguuccauucucuuuuggcuuugagaugucuguugcuauuaagaagucgacuaucagacuaauugcugguuuuguguguguguguaguaguaguaguaguagugguaguagugguaguaguaguaguggaaugugcaggggguccugcaguuuuacucuaacauguuuacauauguauuuuuuuuuaauucuacuuugggaaugucaugcuucguggcucagugaauucaugcuuuucauaauuucugggaaauucucaaccauuaucucuucaaauauugccuuucauuuuuucuaguuuuucuuucuuggaauacaguuagucauauuuuggaccuccucauucuaucuuccguaucucauaacaucucugagauuuucuaucuccuugucuuucugcacuucauucuggauaauuucuuuagguauaucuuucagcuuacugauucucuuuucaacuauguuuaaucugcucuaaucugcccauugaguuuuuuauuucaaaaguuauauuuuucauuuguacaaaccucauauauuuuacuugcuaaucugccuagucaucccuaauagucucuuauugcuuggucaucuuagugauuacaucuguuauuacuucuuuaaaacauuuuauauaauuuuuguucaaccaguagucacuguuugcaugaguaugacauuguaaauauuguucacaucaaaacuacauaguauauucugauuacauauccuucguuguauacccuuucguuuuccuuggagcuaauaauuguguauuuuguuuucuuuugcuuaguguucuaguaccuauacuauucuucucugaaauucuuuauacaauccaaaucagaucauguccuuccacuauucagaauucucccauggcucccaccucccucaacaaaagccaaagcccucaccauggcccaaagucccuacauaaucugguucccuuuaccucucuuaccuugucuccuaucacucucaauaucacucacucuucuccagcuacacuggccuccuugcuguuccccaagugugcuagauacccuuccuuuucagggccuuuguacuuguucuucucacugccugaaacacccuuccuccuaaauaaucugaugaguugcccuaguacuuccagugugcucaaaugucaccucccuagagaaguguuuccugaucaacauaucuaaaaucgccccaucacaugcauuuuauaucccuuuauccuauuuuauguauguuuuucuacaaagcacugaucaccaccugguauauuuuauauuuauuuauugugguuaguguucgucucucuucaguagacuguaagcuccauaaagcagggacuucuguuuuguucacugcuguauccccagugccaaaaacaacagugcauaguagauacucaauaaauauuuguggaauaaacuga

SEQ ID NO: 19204 - RNA, 6224 nt, Homo sapiens
uuggcgcggagggaguagagcgggcgcugugggagggaacgccagagcgagguggugaggagagcugguugcgugagucuccucagcucugcuuaccggugcgacuagcggcagcgacgcggcuaaaagcgaaggggcgagugcgaguccccugagcuguacgaacgcggucgccauggaccgcccagaugaggggccuccggccaagacccgccgccugagcagcuccgagucuccacagcgcgacccgcccccgccgccgccgccgccgccgcuccuccgacugccgcugccuccaccccagcagcgcccgaggcuccaggaggaaacggaggcggcacaggugcuggccgauaugaggggggugggacugggccccgcgcugcccccgccgccucccuaugucauucucgaggagggggggauccgcgcauacuucacgcucggugcugagugucccggcugggauucuaccaucgagucgggguauggggaggcgcccccgcccacggagagccuggaagcacuccccacuccugaggccucgggggggagccuggaaaucgauuuucagguuguacagucgagcaguuuugguggagagggggcccuagaaaccuguagcgcaguggggugggcgccccagagguuaguugacccgaagagcaaggaagaggcgaucaucauaguggaggaugaggaugaggaugagcgggagaguaugaggagcagcaggaggcggcggcggcggcggaggaggaagcagaggaaggugaagagggaaagcagagagagaaaugccgagaggauggagagcauccugcaggcacuggaggauauucagcuggaucuggaggcagugaacaucaaggcaggcaaagccuuccugcgucucaagcgcaaguucauccagaugcgaagacccuuccuggagcgcagagaccucaucauccagcauaucccaggcuucugggucaaagcaguauccuucuaaucgauacuccguaggucagaagcccgugacaggaaaggggaaggugggggagggacagaaaagguaaagcggguggaggagagccagaggugggcaugaucccccuaucggaagacggacuagacuggguggaagagggauggaaggaggagggcaaaacagcagagaagcuggacuggagaugaugaagggugguggagggggggcggacauaaaaacuggaccacagaugggaaagggggaagaggaggaacauagcauuaaaaaaaggaucacagaugauaaaaagggggaggguaguaaaggggcacacagcaaaaaaauuggaccagagauggugaaaggaggaggggaggggcacguagaagaugaacugacucagagaccuugaagagggaggggaauggcacacagcagagaaacugcccagaaagggugcuugagccauacaaggcucuguaaaccuagauuuuugcuuaagauacuaggagaccccaauccuggcuggagugccuugcauuggagggaggggggcuggagccccugaaagaucaagagagggagugucuagguauagagaaaaaggaguuaaaugaaggaaaggggagaguagacacauacacauacauguaacauguuaggaacaugagucgaacauccuaauagaauuauguggauacagacccuuagcccucauaugaaacagcacaugguaagaggcccuuagcacccaggcauacaauaucauuuagacauaggaccucagcuccuagacacaguauuaugugaccacagguccucagcauguagacacauggcauaacuugaccacaagccaucagagccauucacacaucauguggacauggaccuucaacacccauacauacaauaacgugaccacaggcccucagcaaucaguuacagcaucacuuggacauggcccuuaagcccccagacgugcauuuugugaacacaagcuuucagcacccagugacauauaccacaugcacauggauugucgacacccuguagggccaccuaacauagagguuuaucaugggaauaaguauggguuaugucccaugacucacuugcuuuauacacaccacauaagcacagaaggaauccucaugcuccagccucucuuacugugcccuuccuggccuucccucccucccuuucacggaauagucaauccuugaccuaaacugcuccacucaucaguuccucaaccaccccagaauuucaauuuugaucaaccgacgugaugaagacauuuuccgcuacuugaccaaucugcaggucaggccagagagacauuuuuuaguaggaucgggcacgaaucugguucuuggaggugacgggaggugggugggaagggccgugguguguugggggggggacagauuccaccaucacccccaccuggagcagguacaggaucucagacauaucuccaugggcuacaaaaugaagcuguacuuccagacuaaccccuacuucacaaacauggugauugucaaggaguuccagcgcaaccgcucagguaaguggcaguaccagaguaaauccauguucccccccucaaucuguccuuguuuugucccaucuccauagccuucucucucccuaggccggcuggugucucacucaaccccaauccgcuggcaccggggccaggaaccccaggcccgucgucacgggaaccaggaugcgagccacagcuuuuucagcugguucucaaaccauagccucccagaggcugacaggauugcugagguggggcccuuccuggcaucaccagagaaggccuugcuaggcuuguuccugggugcguggggaauuaagaggaggaucuggagcuuguacuaauggcugucuuauuccuucuccccuuuuucaacagauuaucaagaaugaucuguggguuaacccucuacgcuacuaccugagagaaaggggcuccaggauaaagagaaagaagcaagaaaugaagaaacgguaaugggaguuuggucgcugagaggugguuuguuggggauggggaaaagacuaguguaacacaggauuuauggagccaaaaagggaccuuugagauaaucccaguggaauauguuuuacaagugggaaaucaugcccagaaauggcuugagguuacacagucaggggcagaagugggacuuuacccacccuagccccauuccugggaucccuuauagccuacugcuuccccaguuacuucccaccuuugagugcuaugaguacaccaccucccaccaacccuauacucagccacagccuuccuuacaguaaaaccaggggcagaugugagguggugaucauggaagacgccccugacuauuaugcaguggaagacauuuucagcgagaucucagacauugaugagacaauucaugacaucaagaucucugacuucauggagaccaccgacuacuucgagaccacugacaaugagauaacugacaucaaugagaacaucugcgacagcgagaauccugaccacaaugagguccccaacaacgagaccacugauaacaacgagagugcugaugaccacgaaaccacugacaacaaugagagugcagaugacaacaacgagaauccugaagacaauaacaagaacacugaugacaacgaagagaacccuaacaacaacgagaacacuuacggcaacaacuucuucaaagguggcuucuggggcagccauggcaacaaccaggacagcagcgacagugacaaugaagcagaugaggccagugaugaugaagauaaugauggcaacgaaggugacaaugagggcagugaugaugauggcaaugaaggugacaaugaaggcagcgaugaugacgacagagacauugaguacuaugagaaaguuauugaagacuuugacaaggaucaggcugacuacgaggacgugauagagaucaucucagacgaaucaguggaagaagagggcauugaggaaggugagcuaauccccccccacccuugucuucccucuuuucuuuucucagagcaagccuggccaaggacaggguaucaaggcaugaacacaaucugcuuuuauggaggaaagaaaaagcauucugagcaacuuuuuaaacaaaggaaguccagugaacauuuaacuuaaaaauguaacaaaaccccaaaaaaucauuuuaguucuaggugauggauagaugguuguaacagcagaagaugaagaguacacagagauaggagacaguggguggaaaacugaaaaggacacuucacaucgaggugggggaguggcaaaacacagugcauuucagcacagucuguacccggccuuggccuuuggcgcauuuccaggcuuguguugggagcagagcaugaagugaacagugugcucucugaguccagaaaagggugcagccaguucuaccucaagaaucggggugggggggguggcgggggaagagcuagaggaaaaaggugacauuugaacuggaggaugcauucacacugaggagcuuuauggagcauucuccguggaguggaucaucugaacaaggaccuggaagggugaaaaugcaucguagguugggcaggguuuccaaaauuauguccugaggaucacucaccagaucugaaagcugcuucccacaaaagguuucaguggucguauauguuggacaaguacugcauauaguaauacccucuuguagagucacauuagcaccuuaaaggcucugagaauaacacgagaauuauaaaggugcugagaaguacucagaugggagguggaaggggcaggaaaaucaacuacucuucggguuuuuuuggcuauggggucccuggcaaacuuccauugagggcaaggccagggcacuaagggaagaggaaugaauguggagccucaaucuagacauguucagguaggagagagaaacagggauucucaguucucuuccccucccaccugauggcaucucuuuucucagaaggggaggcagagcuaucugcccagcccugagggugggaguggggguggggaauuggguugcagaacacaaacuagggccucuuuggaucagacugggggagaaagcgaggaagcugccuggagaugaauagguuuauucagcugaggucagagcucaggaagagacacacauugaggaguacaagggggagaaaaagcuacuaucagagauguaucaguuuugacagaggcagggaucccacacugccuuccugccucccuccaucucccucucauucugugggcuugcuugaguacacccacacacacucuuggcuguuuguuccaagcagaggcgcugacaaguugucccaggccgcuaaaaacccuggcuauggucucuguucccuuuuagagugacaccuaucugcucaucuaacugccuuccuccauuuccccuuccuugcuucuccccuaugcaggcauccagcaagaugaggacaucuaugaggaaggaaacuaugaggaggaaggaagugaagaugucugggaagaaggggaagauucggacgacucugaccuagaggaugugcuucaggucccaaacgguugggccaauccggggaagagggggaaaaccggauaaggguuuuccccuuuuggggaucaccucucuguaucccccacccacuaucccauuugcccuccuccucagcuagggccacgcggccccacauugcacuucuggggggugaccgacuucguacacggguuuaaaguuuauuuuuaugguuuagucauugcagaguucuuauuuuggggggagggaaagggggcuaguccccuucuuuuggcccuccgcccccgcaggcuucugugugcugcuaacuguauuuauugugaugccuuggucagggccccucuacccacuucucccagucaguuguggccccagccccucucccugugcuguguggaguggacacccugacccccgaagcggggagggccgcuguggccuucgucacagccgcgcagugcccauggaggcgcugcugccaccuuccucucccaaguucuuucuccaucccucuccucuucccgccgcgccgcuagcccgccucggugucuaugcaaggccgcuucgccauugcgguauucuuugcgguauucuuguccccgucccccagaaggcucgccucuccccguggacccuguuaaucccaauaaaauucugagcaaguucagagugcc

SEQ ID NO: 19205 - RNA, 31855 nt, Homo sapiens
uaucaggccagccucucucuccaccccacccccucuuucuggcguccauccccuccccaacaccaccucugcugcugccucuggcuguggaccugcaccucuuccccauccccgccaggcccggggagcggggugagccuggaugagagcccccccaaccuggggcucucccaggccauggcccgugugcucccagggaggagccccggacccugagcaucugcuggaggcuuggcagaggccccgcggggaccgugucuucugaggacaaaaggcggcggccagcaggcagacggaggggggggguggggggugggggggguagggggaccggcagccaggcaggcagacggguagcaggggccagcacuggccccccucccagcuuggcaguggcaugaagaugggagugggaguguauaguggaggaagcaccugccgggacccccaccugccagcuaguuggacaccccaaggcugugugcugcccaccugguguuccccaacacccccagcccuacccagugcaccccuccggugccugcuuucccugaugccugcgauuuagaccagcccggcuguauccacggcaacagaagcaggagugucacuggccgccagaucacugagggucccacaauguggcccgggcugugauuuaccugggugagacagcuugagccccaucguggauuccaagacaucccugcugagagagccaagguaagcagucagcaucccuccaccaaggauggggggcugggacuucuguucugucuccccacacauacuucagagucuccaucacugccaugcucucugucucugucugacucuguuagucucuuucugcuccaucaaggggcuccuugguacccaagccuggggacuccucaucuuccccccaucuuccccaaucccaaaugucccaugagaaagggaaccaccaccuguuuccccucacagggucuguuuuuaucaucaugguugcguuugggcaugaggcuguguuaaucuuuccuugugugcuggcuguggaagggaugccugggagcccggcggccguguucccuucacaaugccugcacccugggcaggcucagccucuugcggcugcuccucucccucucccuccuccuccacucuccuccaggaucccuggccugcuggccgggugugugugugugugugugugugugugugugugugugugugcaccuggguagcaagcagguggguagacaugacagagaagcugcucccagcccagaccaucccccacuccuucuuuccuccuuuccuuccuuccuuccuuccacccuccccaccuccccaucucucccuacagguagcagaguuuugcucacucaccacugaagauguugccgauucccagcuagggggaggaagucacuguagggcuaaaggacagugaaguggugguggggagcacuuccaggcccuaggcugccugaugguucugugggggcaaagaccaaucccaugacaaccugcaggggccaggaacaacaugguugucccuacagugugggacccagccuccaccacaaggcucucugucucuguuucagauguccauguugugucugagaccccccggaucuuguggccuugugcccaguagccggagguccauauaucuggaagggcaggaaagccugguacauggagaacauggauccucccagggacacuucccccaacuacuagcucugcaacuuuaguggaagcaugccacuuaccgaaccucaguuuucccaucugucaaagagacugguaacccuucccugauggguguguguagggauugaaugaguuggugcauguaaguaagagaugugcaucgagguggcacugaagcaaugucagcaaagcucacagucaauauuguugcugauuauucaugauuaauaguguuaucgauuacuuggaggagggacagguccuucuucuccagggucucagcagagaucuggggagggcagcaagugggcaaauggaggguaguggaagggaggcaggagaagcccuguguuaauacuucucauuuguagagaaugauaagugguuaugggcagagccucccucccccaccccacuccagucuucuuucccugcacuugucccuguuugugcgcacacacacacacagaaccuugagcccccaugagccagcagaggccuggcuugcagccugcagccuuucuggcccuggugauguaugugucucccuguugaggggagacuuggcaagaguuuggccuguggucagugguuggcagggccuggagaugaggcugaagcuccugagaucacggggcuucggguagagcugggguguggcccaugcagcagccagaccugugagggacgcgucccagggagcugcucaccuagagccuggggugggggaagaacggggucugcuggcugauuucagggcauggagaugugaugggacacagaguguggggucgguggccaagggaagaggaggaauggggaaagacugaggcccagaagaccaucucugugggggcagggaggggggcuuugaggcauaaaguagacuuuucugaagaagcauuuggugugggagaggaccuggucuguggucuggaggccucugggcccgagcgugguuguauauaugcuacugaaaauguguggcugaguguguagucugugugugcaugucuguucaugggcaguguggcuguguaugaaccuguguguguaagcaggccgugugauggcaugugugugaguguguggguaucuggguaggcuuguguguguacuguggggugggcaugacuuugcaugucugucugggugaucaaauggacauguuugauuuugagccugaguguggguguguuuucucugagccaucaggccuguugaaugucuaguuguauauguguguggcaucaguuuuucuuugaguguacgugucugguuguauguguaugaguguguggguuucagaaugccugggugugcaugcccaauuagaugaaugccuaguuguaucugcuugugcauauuggugugugcucaugaguguaggugcaucuaaagggugugcuugugaguguuaagggcauauaugugcauguccaugcauguaugagaggguguauauguguguguguauauaugaguguaucuguccugcauuuguguaagcaggcuuuugacuuucugugaaugucuguauguggguucuccagcauuuuaaauuauauagauguccgugugugcauguuccaguguauaucaccuguagacaaaccuuuauguccacauccgauuagagaaauguuaauauaggugggcacacuaauauaaggagaacuaauuuuauggguaggggagagugugugaaugaaaaucuauuuuguggguaugccuacaugugcacauuugauuauguaugugaguauggcuguguguggggguguaugccugucugcacacaaaaacacacacacacgcaaaaugcugugugcauaggugaaaugaugcauugucuauaugucuaauuguguuuguguguacacuguuaugugugaguacaugucuguggcgugcaugaguagguacuugggugugcaugucucauuauguguuuugucugaauuucugaguaugugagugugaauguguauuugaauaugccugugauugugaguguauauguggguguauaugcuaguaggugugaacaucuggcuguguguguuucauugaacaugucuguauaugccugccuguccauacacauauguccacacacaucuguccacacacacacgugugugugugugugugugugugugugugugaauaugccuguguguaugccuguacauucagacaggcauacacagagguauauucauaugugugaaugugccaguuuguacaguucuaauuauuugcauguauguguuuguguuuaugcaucuuuguucuggagcauauguuguagaacacaauguaagguaacguccaugcaugucacucucagccuacaaguguguuuaagugugugugugugaggaugugugugaggaugugugugugucugugaugaguguggaucaguccuucuuguauggauguacaguugugugcaugugaguguacuuccauguguacaugugugugaauauaccuuuguguccaaguccaucugugagaauguagguguaaaugauuccucuuuauuguguagcuucucauauggguguaugaacuuguaggaauguacaugguguacauaucuggcugugauagugugggcauguuuugugaguacauuuguauuuccaugucugaguguaagcauaugggaaugaauuaaugaacaagucuaugugcaugugaacaugcccaguuguguguacaagucuguguuaggaaugucugcauaucuauacuucaugucauuuacaagcaugugcauaucuagguguuuaugugugugaguguguaaauauauguggucaugucugggugugugugugcacacauuugggagcuucccugucuguguccauguuuguucaucaucuccuugggugugauacaaagucugucugucuguggacaugugaagguaugccuguauguaccccuguguuugugagugaauguacgucauucaugggcauuaugucaugugaauguaugucacgcaugcgugccuauguuuaagaguaaauggauguacacguaugacuaaguacagugugaguguguccauguguaaggaugaguguagguauuugugcaugugucugucagucgaugugagagagagauacuuggccuugggccugugcggauugggccuuauugacaaggggauggaaagggagaauacuuacaagucuguguaccucaguauguauuuguguguaugacugagagucaguggugcccugcgagacuaugucugucuguaaguguguagacauccugcagauuggcaaacuaugacaccugaugccugugacccccauucuggggcuucucuggccuugaccauguacugggcuuuugugggggucucaggauaauuccugucauuauucacacucaagaagugggcaccaaucauggcugauguccuacuggggaaaagaggccuauuuagaaaaagauuccuugaaacacaaagaccucccuucucauccccccaaccaucaaaggcccagaguagaguggcauuguaugauaucuaggguugguaaauaguuuucacugagaggacccaaauuaugccauccaggcagaaaucuagaugugaguguguauauauaaaagugaaaguaucuuaauagaguguguguguauguguguguguguguguguagacugguauaucuggugagagagaaaggauguggucugcauguguguaagagagagcaugggccgggugcgguggcucaugccuguaaucccagcacuuugggaggccaaggcggguggaucuccuaaggucaggaguuugagaccagccugaccaguauggugaaaccccaucucuacuaaaaauacaacugggcgugguggugcaugccuguagucccagcuacuugggaggcugagacaggagaauugcuugaacccaggagguggagguugcagugagcccagaucaugccacugcacuccagccugggcgacagagcgagacuccaucuaaaaaaaaaaaaaagagagagagagcacauggguguauggguguuucuggguagggugugcgugugaggcauuuggguguguuugggauugggggggugagugugguuguauguaaaguggccuguguguguggaggaugguaugagugagaguuggguuggggauaugggugaggauguguguauuugaggggugugugaguauggguuuaucuggauggugagauagggugggggauaccuggguggcguauguguuugcugguguggcugugucuguacuguguguguaagagaguguggguguuuccuggguggaguauguauaugagggaguauggguauauuggggucagggagauccaagugugguuauauguggaugauaugucaguaggugagagcacaaguguaucuaggcaauggaagugugugauaggguguauugugauggugugcaugagaaagagaauuugggcacaucugggugaggguggggguguauauaauugggggugucuauggaguguguguauggguggugugugugagacaguauggauguaucugcauugugugugugcagugugaguagaucuggcugauggugauuaagagagaauugggggucgagauuguguuugugugugagaguggggguguuucugagugugguaggggugugagcacgcaugucuccugugggaagagcauguauguguaucuggaugaggugugagaguuuggguuuaacuggguuggaggagaguguggauguauccagauggugugugaaagagaaaguguguagguacguuugggcugugugugagacaguguguggauguauuggggguggaguggguuugaauguggguguaucuggaugguaggugagugagagcacggauauauuugggugauggaguguguaguaagguaugucuggauggcguguggugagagcuuugguuguaucuggguggagagugcaggcguauacguacuuggguguggaugugaauguguauaacuggauggguuguguaaaagagaguugggggcacagcugagugggaaguguguguauggagugugggugcuugugggugguguggaggagaugagagcauggguggaucuggggaguggggcgugugcagaggugcacuggauggcaugugugagaguuggauauguccagguggguuguguguggauguaguuauaccuggguggugcauguggcuuugaguggaucuccauggucuauaugggaugaaucuggaugaugauauaugagaggguggaugugucugcauggggcugugagaguggggcuguauuuggagugugcgugugcuguaagaguggggcuguauuuggaguguguguguguguguguguguguguauggguaugagaaugaugugugugucuguguguguggauguauuuggcuugggaauuugugagugugaguaauuggaugggguguggguaaguguagugccuuuggaagguaugugugucauugugggugugucuuaauacugugugugagagagagagagauuguaggugugccugguucagguaugagggcucugaguuggggugggguacaaguuugaauguaucugugugauguuugugagaguguggguguacugaauugggaguuugcauaaguguggagggccugugcguguaagugcauuugagaugcguguauaugagaacgggaguauuuagaugggauuugugugagaggguguggguguaucaguguuggguauauguaugaaaguagguguauuugaggagaaugugggcacaucugaguuggaguaugugagagcgugggguauaucuaagaccgcgaagaccuauaggaugugagcagggcucagccuaugucugaacgucuacauggcuaugaaucaggauguguauaucuaaauaggaugugucaucucuggguggugugagagugugugggugugugugugagugugagugaaucuggggggugugcauguggcugcauccggccacaugugugaguauguggccagcaugugaguaugaggauagcaugugugaguauuugggugaggaauauaucugagaaugugaguguaucugugugugaguguguaggugguauaucuggagguuuuguguguucaauaaugugguuuuuucuggguagggugugugauugugggcauguguaugaauguguauauauuucccggggcauauauaucucugcuggaaugucuguaaaugugaacguguccauguuuguuuauguaugugacuaggugcguguggccauuuauaccuuaguguaucagcuggauugggugugcacauacuugugcuaaagugguauguaucuguacuugugcaugaggugaguguauuucuacauguaaguuggaucugcaaggucucuggaggcagccuuuguguucgaauccuaguucugccauuuauuagcuguauggcuuugggcaagucaccuaagcucaacaaagccccauugucuuaucuguaaaagugggaguacuauuaccuaucucauaggaugaggauugggugaguuauaugaaaagcacuuagaggcuggacgcguuggcucacgccuguaaucucagcacuuugggaggcugaggcaggcagaucacuugaggucaggaguucgagaccagccugaccaauguggugaaacccugucucuacuaaaaauacaaaaauuagccggguaugguggcacacgccuguaaucccagcuacucgggaggcugaggcaggagaaucacuugaacccgggagguggagguugcagugagcugagaucaugccauugcacuccagccuaggcaacaagagugaaacuccaucucaaaaaaaaaaaaaaagaaagaaagaaaaagaaaaaaaguggcugggcaugguggcucacaccuguaaucccagcacuuugggagccgaggugggcggaucaccugaguucgggaguucgagaccagccugaccaacauggagaaaccccaucucuacuaaaaaaaaaaaaaaaccacacacacaaaauuagccaggcgugguggcgcaugccuguaauaccagcuacucaggaagcugaggcaggagugucacuugaacccgggagguggagguugcagugagcugagaucgugccauugcacuccagccugggcaacaagagugaaacuccgucucaaaaaagagaaaaagaaaagaaaagaaaaagaaacagaaggaaaagaaagaaagagaaaagaaaagaaaagcacuucaaacagugccuggcauguaaugaguccucugcaccauauaagccauuacguacuaccauaauuauuagccaugccaguguguaauaguauguguccaucugcaagugugaaugggguuucuaugugcauauuugcccuguuaucuguaucuauacgucugugugacagaaugagcauauccuauguguaucuauguuuguacaugaaaguggguuuguacuucuguguaucccagugugcauauaaaaccacgagcaugugagaaaggaagcaugugucccgggcgugaauggaggggguuggccccguguguauauuuaccagugcacacacaucuggguguaugagugcacaugccuguaucugugguaguguaaugucugugagugugggugugaccugcacugcuggugugucugcacaugugagcaugcuucuaucugggugugugcaugccaguguauuuuuaucugccuauguaaacagguuuguaggggucaauauguaaacguauguaugugaaucucuguugugagagccuauaaaugucaaaagguugguauccagguuuauaugcgaugauccaggugcacguguguguguguguguguguguguguguguguguguauguaaagggcuagugugcaucugagggucucucuguauuuauaaaccucaguggcuauguggguguguaugauugagucugcauugcucuacaugccugcuugccuuuguguguguguagcagugaggcugagccaugugcuuguaugcgugagcaggucuguacuauguguauauggauguguuccagggcagauuugugagaguggcuuuguauaauaauagaguggguuuuaaucucuuaguguaagaaccagugggguggggcacgggagggccuggaucuauauaggaugugagcaggacuugaccuaugucuucuuaugucugcgcauguaacacuguaucuguaaguguguagguucauguaguuugguucauauguauguauguauguaagugccuauguaaauggcgaacgcauuucgccuagaccuguauuccuuuuuuuuuuuucguagaagaaagacuauuaagaaggcuuugaaguuaaaaaauaaaacucuaggccgagcgcgguggcugacgccuguaaucccagcacuuugggaggccgaggcgggcggaucacgaggucaggagaucaagaccauccuggcuaacauggugaaaccccgucucuacuaaaaauacaacaaauuagccgggcgugguggcaggcgccuguagucccagcuacucgggaggcuaaggcaggagaauggcgugaaccugggaggcagagcuugcagugagcugagaucgcgcaacugcacuccagccugggcaacagagcaagacuccgucucaaaaaauaaaaaauaaaauaaaauaaaauaaaaauaaaacucucaauacaauuuuugugugugacacagggucucacucugucgcccaggcuggagugcaguggcccggucucagcucacugcaaccuccgccuccaugccgggcuaauuuuuguuaaauacaauuuuuuaaccuuaaaucagcucaacaaauauauaaucagcaauuuagcuguauaagauuaaagauccauuacuuuaucuuaaauaaaauauguuuuaggccagguguggugacucacaccuguaauccuagcacuuugggaggucaaggugggcggauugcuugagcccaggaguuugagaccagccugagcaacauggcgaaaccccaccucuacaaaaaauauaaaaauuagccagguguaguggugugcaccuauagucccagcuacucaggaggcugaggugggaggaucacuggagcccaggaguucgaggcugcagugagccaugaucauggcacuauaauccagccugggugacagagugagaccaugucucaaaaaaaaaaaaaaaacccagaaccugucucuacaaaaaauagaaaaauuagccgggcaugguggcacaugccuguagucccagcgacuugggaggcugaggugagaggaucccuugagcccggaguucaaggcugcagagaaccaagaucucgccaucgcacuccagccugggcgacagagcgagacccugucucaaaaaaaaaacaaaacaaaguguauauuauauauauauauauauacacacacacacauacacacacgcacacacacauauauauauauaguucuuaaaauuuauuccauaaaguacacauuucccuguaaacucucuacauauacacaagagguaaaaagugaaacaaaaaaauuuuuugagacacagccuugcucuugucgcccaggcuggagugcagcggcaccaucuuaccucacugcaaccucugccucccggguucaagcgauucucgugccucaaccaaaaaaaaauuuaauuaaaaaaaugacggccggucgcaguggcucaugccuguaauccuagcacuuugggaggccgaggcgggugaaucaccugaggccaggaguucgagaucagccuggccaacauggagaaaucccgucucuacuaaaaauacaaaaauuagccaggcaugguggcgggugccuguaaucccagcuacucgggaggcugagguaggagaauuucuugaacccaggaggcagaggaugcagugagccaaggucgcaccauugcaauccagccugagcaacaagagcgagacuccgucucaaaaaaaaaaaaaaaagacaacagaaaccacagugggaaggggauuaauuauuaacaaaaaguuagaaauuucuuguuggggcaccccuacagcccuucaccccugccccgcgccccuuacccgucucugguugugcauagcugauguacaaaaugguauacgguuagccucaaaaagggaguaaaaaugucaccauccuccucuggaagugucuguacauucugagacuguaggccuguauuucuauagaaaggcaguuauacaggccuguauuucuauagaaaggcaguuauacaggccuguauuucuauagaaaggcaguuauacaggccuacagucucagacuguacagacacuuccagaggaggauggugacauuuuuacucccuuuuugaggcuaacuguauaccauuuuguacaucaggucaggagaucgagaccauccuggcuaacauggugaaacccugucucuacuaaaaaacacaacaaaaauuagccgggcgugauggcaggugccuguagucccagcuacuggggaggcugaggcaggagaauggcguggacccaggaggcagaguuuguagugagccgagauugcgccacugcacuccagccugggugacagagcgagacuccaucucaaaaaaaaaaaaagaaagaaaggcaguuauauaguuauaucuguauauuguaugcguguguaucuuugagcuauuugcugguguguggguaucuacaugcaugccuagcugcuucugugcaguuaacggggaauguuugugugucuguauaugagugucucauugugcuuaucggcuggucugaaugugagugcaaauuugaauuuccauguacacauguccccgugugcacauaucugucuguaugugcuaguguuucuauguaaugugacuagauguaaauguguuagggcauucacaaccugggacacagagaaagugaaauauuuuauggcacacuggaguaaacugaagaggguuagggguacuagaguugagugaaaaggaauuucuuacauuuuccucauauuauacaauuaugggaagaaaauuaaaaugcagaauuuuaggggaguuauuaaauauugaauuuguguacaacuuucaaaugaaaucuuuucaguuuuuuaugacacacuugagcucacuucuagaaacaugucuuagucuguuuugugcugcucuaacagaauacuugagacuggguaauuuuuaacaagcagagauuucuuucuuacaguucuggaggcuaggaaguccaagguugaggggcaugcaucuagcaagggccuccuuccugcgucaucccauagugaagggcagaaaggcaagagaacacgcuuuugcaugagagagagaaagagagagaagagaagggaagggaagagaaagaagagaagagaagagaagagaagagaagaaaagggagccaaacucaucuauuuaucaggaacccuucuuaugauagaaacccacucccaugaaaacaggauuaaucuguuuaugaggacagaguccucauuaccucaucacuucuuaaaggucucacuucucaguacugcugcauuggggauuagguuuccaacacaugaacuucggaggacacauucaagccguagcauucuuccuugacucccaaaauccauguccuucucaugucuaaaauagauuaauuccaucccaauagccccaaagucuugacucguuccagcaccaacucaaaauuccaaaguccagagucccauuugaaucagacaggagagacuccaggugcaauucauccugaggcaaauuucucuccagauguuagccuaugaaaauagcaaauuacuuucuuccaaaauacaauggugggacaggcauaggauagacauucccauuccaaaagggagaaauaagcaagaagaaagggguaacuggucccaaguaaguccaaaauccaacagaaaaaaaaaaaacauugucuucuucuuuuuuuuuuuuuuuuuuuuuuuuuugaguuaaggucucccucucugucacccaggcuggaguacagugaugggaucacagugucacagcucacugcagcuucaaccuccugggcucaagcgauccucucaccucagcuccccgaguuuuuguagagaugggauuuggccauguugcccaggcuggucuugaacuccugggcucaagcgauccacccaccucagccucucgaacugcugggauuaccgugcccagccaacauuaagucuuaaagcuggagaaugaucuuugacucugcguccugcaucuugggcacacuagagcugggcugggcccccaaggucuugagcagcccugccccuauggcuuugcugggcucaguccacccagcagcucucauggguugaagucucaugccuccagccuucgcaggcuggaguugcacauucgugguccuguaguucuguggucuugggacagccccacucccacaguuccacuaaguguugccuuagugggagcccucugcaguggcuccaucccuaugacaagucucugcuugguuccccaggcuguccaugaaauucuuugaaaucuagacaaaggaagccaugguuccacaacucgugcauucugugugccuacagaauuagcaccauguggacaccaucaagguuuacagguuauacuuucuggagcagcaagucgagcugcacuugggccugcuugagccacagcaggggcagccaagggguacugcuccagaauugaaggagcagagucccaagguggcacagggcagcaaaugcucaaguccuagggguaccucucuagaaaccuugcccucaagauccuagcuugccucaaaggccucugaauagaaucuggcuuccuucuacccauauuagucucuuuagcagucucuuggucacacccuuaguauucucuccccaacaugcuuuuguauuuuuuacauggucaagcugagaguuuuccaaaucuuucuguucugcuucucuuuuaauuauaaauucugucuuuaaaucguuuuucucucauuuugcuguacauagccaaaaguagucauguggcaucucaaacauuuugcugcuuagauauuuuuucugcuauauaugcuaguuuaugacucuuaaauucugccuuccacuaaguccuaggacaugaacacgauucugccaaaucuuugcacgcauauaacaaagguggcuuuuauuccaguuuccaauaccuuauuucucauuuccaucggagaccucaucaaaauggccuuuaccauccauauuucugaucaugggauuagaaacaaagcuaaggagccuaaaucuccuuagggauuacuuaaguggucaugaucagaaccacuuggcaauuacauuuuuaacacaugaaaucagaacugaucauggccacuuaaguaaucccuaaggagguuuaggcucucccuauagcacuugucuucuucugaggccucacacaaaaucacccuuaacccucuauuuauggcuuuacaggcuuuuucuagccugcuccuccauauucuuucaaccucuacccauuacccaguuccaaagccacuuccacauuuucaggcauuauagcaacaaccccauucuuggcaccaaucuucuuaguccauuucgcgcuacuauaacaauauuugagacuggguaauuuguaaagaacagagauuuuaggcuaggcgcaguggcucacacauguaaucccagcgcuuugguaggccaaggcgggaggauugcuugaggucaggaguucaagacuagccuggccaacauggugaaacugcaucucuacuaaaaauacaaaaauuagcugggcauccugguggcaggccccuguagucccagcuacuugggaggcugaggcacaaaaaucacuugaaaccgggaggcagagguugcagcaagccuagaucaugccacugcacuccagccugggugacagagcaagacucugucucaaaaaaaaaaaggaacagagauuuuauuuuauuucuuaucauucuggaggcugggcuguccaagaucauguggcuacaucuggugagagccuucuugcugcaucaucccaugguggaaggcaaaagggcaagagagcaugugcacgugacaaagagagaagggaaguggguagaacucauccuuuuaucaggaacccguuucugugauaaccaacccacuccugugauaacagcauuaauccauuuaugagggaagaguccucauaaccucauuaccucuuaaaggucccaccugucaacacuguugcauuggggauuaaguuuuuaacacaugaacuuuaggggacacauucaaaccauagcagaccauaacuuuuaaauucacuaaugugaauuuguaguggucaacauccaugcccacuucugaucaagucauaagugguuugauuuauuuuaugguccuuugauucauuuauggucauuuuaaucuugacuuggcaaauccacuggugcugagcauagaucuucuacaucaaguuauuguguuucuugguaaaagcucaaacaaaggaaaugaaguaaauaacaauugguaguuuugacacagauauaaacuucuauuguggccugccaguuuuugaucuuggaaagcauguuguugaagguaagacacauuccauggagauugcucacacacaacccaauguuugaccuaaugcccucaguaauuagcuugaauguaugaaauguagcugcaugauucuacaggucagcagagcugaccucaaaaacacaagcuuuggggucaucagauaacauuuugguuucucagaagcaucaggugcaguuacuaguguugaguauggcuggugcuuucacaccauacccaccuuucuuaagaaauggaacaacugcuuauucgugccuuccuuuuccaccucccuuuuauaauucucuuguucuugucauggccaggcagagacuaagguuuugugcuugaaauagcugcgugaucuuuucuaucuuuugguagucaccaucaacaggaaauugcuagccuaaguaaguugcagcaaauggucaaagaguauuuuuuaguggguuaaaacucguuucucgacaaauauucagaauuuggauaauuuguaguguuugaauuuugugcuucaaagggaggauucuuuuuuaaauguagcaucucuuucuuuucuuucaaucaaauaugaaauuucuuguaacaaaugcaggccaggugcgguggcucaugccuguaauaccagcacuuugggaagcugaggugggaggauugcuugagcccaggaguuugagaccaaccugggcaacgugacgaaacccugucucuaccaaaaauacaaaaauuagccgggcaugguggcgcgugccugugaucccagcuauucaggaggcugaggugggaggauugcuugagccugggagguugaggcugcagugagccaugaucaccucacugcacuccagccugggugacagagugagacccuguuuccaaaauaaauaaauaaauaaaugcucacaaauugaaugcaacagaaaauuuucauuuuguguaucuuaaaauaaugaugaagcuuuuccccuaagugaaugcagacauugcucuacuuacccuaauaagucuucuuuaguauucaaauugcaacaccaaguaaacaucacccagggaaccauacuugacuucacauuuccuaaguugaaguuuugcuucgaauccauaaacucugucaguagucuucacgcuauucuuuagugucuuuaacauuuuuuauguaacuuuauucgugugcaaaaaaagccauuuguugaagccaguaaacauaaaaucugugccugagcucagaaguucgaaaucagccugggcaacaugguaaaaccccgucucuacuaaaaauacaaaaaaaagaaaaauuagcugggcauggcagugugcgccuguagucccagcuacuugggaggcagaggcaggagaaucgcuugaacccaggaggcggagguugcagugagcugagauugcacuacugcacuccagccugggcaacagcgagacucaaaaaaaaaaaaucugaaaaaugagaagcauucacaaagaaauguugccauguuucuuuuaccucauuauuauuauuauuacuauuauuuuuaccaaaucucuacacauuuggguuuaaaacaacacggaaggguguacugaucccaguuccuuacagaaagcugaaaggcaggugggaaaugucuuggauuuaauuacauucaucuggcauaauuuacuguggaaaugagaccuauagacaaacuuacaggugagggcuccucaguaaaugaaucucagaguuuuccaaacaaacugcuguuguaaacagcagcaucuguccacagacuuauggaguuuccacaguauuucaaaguauucauguaucacuuugaauauuucaaacuuaguuuauguuggugcuucuuguacuucucuucaaguuucuaacuaguacuguaaacuaugcaaugucaacacccauagaugcauggguagaaaaugaaaaccuuucugauugaacaucuaaguuagugucaucucaaugcccuuugaccugucaccaguguaucuccuaacagcaauaauugaacauggccccuuuccuauucccuuuaccucauuggucuuaaaaauaguguacacaauuucccugcacaccgcuaaccugugagauucuacugggaggggcaucuuagcuuuacuuguuaaucauacaacccugucacuagccgguugagcuccagcuaaaaauauucuaacccaucucauaaaagaucccaguuucucaauuugcacugccagaugcuuuaaaaauuccaaaucuuucuauugaaggggucagcagaccucugugaguucugaaaacugauuuuucucugcauucuuaagaaagcaacacucuggcggggcgcgguggcucacgccuguaaucccagcacuuugggaggucgaggcgggcggaucacgaggucaggagaucaagaccauccuggcuaacacagugaaaccccgucucuacuaaaauacaaaaaauuagccgggcaugguggcaggugccuguagucccagcuacucgggaggcugaggcaggagaauggcgugaaccugggaggcagagcuugcagugagccgagaucgugccacugcacucccgccugggcgacagagcgagacuccaucucaaaaaaaaaaaaaaaaagaaagcagcacucugaaacaaagucauaaagcaacucaauuaaacuauuguugggcuucauucauuuauugacaaauauuuuuauguaaaaacaaaagauaguaaguaugaaaucccaccaggaaucagauuugguuaauuuuuaguaucaaauaccaaucacaaguaaaucaaucaauaaaccaagaaaugauaaaaaugauauugucguaauauuuuuaaaagagucuugaccuuuuaggaguagauacugaaauacuuaaggaugaaaugauauaacagauaugcuucagaauacugggagugagggaaguggguaggguuauaggcagaaugagacuagcuaugaguugguaauugguaagucugggcaauggauccacugagauucauuacaguauucucuuuacuuuuuaauguuugaaauacucuauaauaaaacuuuuuuauaaaaaaguaacaaucagaaaaauaaaauaauacuguucucuuuagaaacaccuaauacuauacuauauaauaguccacauagcaacaaucauacaaugcuucuauuuuuucucuguuucuuggugauaagacagcccuccuauuuuuguagaagaaagaaacuugaggaaaaauaagaagaaaaucaaauuaaaagaaaaauaggcggggugcaauaguucaugccuguaaucccaagacuuugggaggcugaggcaggaggacuucuugagcccaagaauuugagacuagccugggcaacauagugagacugcaucucuaccaaaaaaaaaccuuaaaaaauuagccaggcaugguggcacaucccuguagucccagcuacucugaaggcugagguaggaggauugcuugagccuaggagguugagguucaugccacugcacuccagccuggguaacagagcgagacccuguauaaauaaauaaauaaauaaauaaauauuuuucauaaaugaaggcuaggcgugauggcucaggcuuguaaucccagcaucuucggggccugaggcagaaggauuguucgagcucaggaguuugaggcugcagugagcuaugauuacaccaccgcacuccagccugggugacugagcgagaccuugucucuuuuuuuuuuuuuuuuuuuuugagacagagucucacucugucacccaagcuggagugcaguggcaugaucucagcucacucacugcaaucuccaccucucagguucaagcgagucuccugccucagccuccggaguagcugggauuacaggcaugcaccacuacgcccagcuaauuuuuguauuuuuacuagagacaggguuucaccauguuagccgggcuggucuccaacuccuggccucaagugaucaucccgccucagccucccacaguguuaggauuacaggcgugagccaccgugcccagccgaccuuuucucuuaaaaaaaaaaaaaaacagaaaagaaaacaaaaacaaacauuguccacauagguauaggccaaacuccaaaaccucacugaugauaaacuagcaaaguaauaaucauacuaucuggaauguuucaacgggaagugaugaaaacaguuaccaccucucuuugcacaugguugcucuggagccauucuugcucuagcccucugcugugguaggagccuaccagcugggcagcucugcucguuuguccacuuacaagugcaagaguuagcuggucucugcacaugagcagguuuggcuccagcgguauaccuguugcaggauguguaugucaguuaaguguaucugugugugagcaaguuuauauguguacacauguuugcccauguguacuugucuuugugugugucuguauauguacaauaugcaauuuuuaucuuuguguuuguuugcguauugcuaaaguguaugagugugccuuuguguguguguguuggagcuguuauaagucuguucaugggugggaguguauaugugaauggguguguguguguacauauaccaggauauacauauuuguguuggugagcacaccuaaucuaugugagagaguuugaaucugucucuuuguguuagagcauguguguguauaugugggcaguuuuuuacuugccugcuuuuuucugggugcauauauaucuauaggucucugagggggauucuauguacuauaccuguguguguauguguguguguauacacacacaugguaggguucaagugcgugucagccugcuggcauauguaaguaacuuugaguguuaauaucgugacaguguuuaucuaugugacaauauuaauauacaacuuuguguauaucuguguugugucugaauaugugggaggauuugaaucaucagcuauauugggucaaugaguauauauaugucugugugaaugaaaguauauguggguaaguuugcuuguguguaccuaucugucaguguuugagaucucguucauccauguguguguuaggggaguuacaaaggugguuuuguggaccauugcaugugugugaguguguaucugagugugucuguguaugugaacaauucucagcccucucauauccagugcccucuuguacauaacagauauuuuguaacaccccuuuacugucuggaaaugaaguucuuaggaauauaaucucucugcauauguaauuuuuuuuugagauggaguuucacucuuguuacccaggcuggagugcaauggcacuaucucggcucacugcaaccuccaccuucuggguucaagugauucuccugccucagccucccgaguagcugggauuacagguucgugccaccacgcccagcuaauuuuguauuuuuaguagagacagaguuucaccauguuggccaggcuggucucaaaccccugaccucaggcgauccacccgccucagucuuccaaagugcugggauuacuggugugagccaccacgccuggcccucugcacauguaauuuaaaaagaaaauccauauuuuauacaauauccauuuuguauuaacuauaauacaaauaagaaauaaaagaaaaaugauuuauaagaaaacgauuuguauuucaauauguaaaugcuugggcaugacacuccccaggagauucaaggaagugauuagaggcucccaaugucuuuuuuuuuuuuuuuuagauggaguuucgcucuuguuguccaggcuggagugcaauggcgcaaucucagcucaccacaaccuccaccucccggguucaagugauucuccugccucagccuccccaguagcugggauuacaggcaugugccaccacgcccuguuaauuuuguauuuuuuuauuuuuaguggagacgggguuucuccauguuggucaggcuggucucgaacuccgugccucaggugauccgcccaccuccgcuucugaaagugcugggauuacaggcgugagccacugugcccggcccccaaugucuuauacuggguaacuauggauuuaggagaaggggaaacaucagaggcaggacgugcaggaaaaugacaggcacaggccuuggaggugagauuuucuaaaauagucaacaacucuaaggaaagcucaucccaaaccaaagugcagccuccucuuuacuuacaugacagccacguuccuggauaauucgggguauguuaaaaucaagagaaaaaaaaugguguuuaucugugaaauagauucuaaguucacuuacuuaaaaguccaaaguccuagaggaugcgggacauguuggcugcgugggacucucccccauauuacuggauggccaacauccuccccgacuccuaaaugucagaaggacacccuacaccccagcacuguggccaucaaaaaugcuccuacacaaauuuccaaaauguccccuagagggcaguaacgccuuuguugaggacgaagcgcuggcgcucggagaggguacacuguguaccugugugaacacggcagaguacaagauguaccucugccuccgugugcgugugugcauaugugugugagugcgugugcguaugugugaguguguguguguauguguguugcaugcgugcgcacgcguuccucaugcaagagcggguugcugucugaggguguccacagcaguagaccguuuauggggggauggggugugcacgugucugggcucgagcaggugugcguguguucuguguuugcacgcgucuugagccucagcugggcccgggcugcagcugccagucugcggaggaaaacccucuccucacuuguuuguaaaaugucccgagcuuucccaggguuguguuuguuugcugcuauuguuugggggggaugugggggguuuuguuuuaucuuuagcuuuuguuuucacugagacucagggcuacgcauuauccaccuucucggucuuagcguggcucuccgugucucccucucuaucuccaucuuuauuucugucucucucucuaucucucuccagcuacccucucuuaucucugccccaccccaccccgucucuauuuuucuuucuuuccuggcguuagcccucucccucucccugcucuccuuuucucucucuugcucucucucucucucucucucucuauuucucucccuucucugucuggcaugcugguuucugugugugccucugucucuuuuuucucacucucauuuucacccuucuuccccuuuuugucucucucuuccucucuguauguaaggaucucucuccccuuucucuguuucucucucugucucuuucucccuccugugucuccgucugucucugucacacacaccucucucuccuucucucucucugugucucucuggccucucucuuacauucagucucugucugucucuaucccuuucccucugccuccccucaagguaaaggagagagaaagagaaagagagagagagaaagagaguaaguguguguguguuuacauucacccagcugcgggcuguuccacagucugagggggcugucaggccuugaagggcugaaagggagcccaccaaccccauuucugcucagccccugcccuagcacuuucuaaguacuaguuuggccuccugucaugggcucugagauuucagggugccauuaaaaagccuggcucgggcgcaguggcucauaccuguaaucccaacaauuugggaggccaaggcgggcgaaucauuugagguuacaaguuggagaccagccuggcuagcaucacaaaacccugucucuacuaaaaauacaaaaauuagccgggugugguggugcgugugcuuguaauuccggcuacucgggaggcugaggcacaagaaucacuugaauccgguagccggagguugcagugagcugagauucugccacugcacuccagccugggcaacagagggagacugucuaaaaaaaaaaaaaaaaggccgggcaccagguggcuguggcaggccaggcuggauugagcuggaaaaccaugcagaggggagacuuuuccugggagggagggaguaggaagacauccacucaaguuccacccccuaaucccagcccagccccaacaaucauccugaguuuccccaguuucugcccaauugccucacugccuucccucugggaccugugcuguuaccuggucacauccccacacucccggagcucuccucuuuccugcagcuuugcugcgcugcucucaccaccagauguaccccccaggcugcuguuguagcuaauccugccuggaugucuccagggcacccucucugacccacagccccagcccauuuaaucccucaaucaauucauuugauauauugucacugagagccuaccaugaugugcuauguaguguucuuucagaggagagucagugagucuuuaacuccugccuuuguggagcuuucauucugacaggacaaggcaggcaauaaacuaaaauuuaaaaguaaauuauauauauaaaauuauauauauauaauuuuuauauauuuaaaaaauuuuauauauauaaaaaaguuuguauauauaauuuuauauauauaaauuuauauauuuuauauauaauuauauauauauuuauauuuauuuauauauauauaaauauauauuuauauauaaauauaaauauauauuuauguauauuuauauauaaauauauauuuauauuuauauauaaauauacauaaauauauauuauacauaaauauauauuuauauauaaauauauaaauauaaauauauauuuauaaauauauaaauauacauguauauuuauuuauauauaaauauauaaauauacauuuauauaaauauauauaaauauacauguauauuuauucauauagaaauauauauaaauauacauguauauuuauucauauagaaauauauauaaauauacauuuauauuuauucauauagaaauauauauaaauauacauuuauauuuauucauauauaaauauacauuuacauauaaauauauauaaauauacauucauauauauuuauauauaaauguauauuuauauauauuuauauauauuuauauuuauuuauaaauaaauauauaaauauauauaaauauauauuuauauuuauauauaaauaacuauauagauuuauauauauuuauuuauaaauaacuauaaauauagauuuauauauauuuauuuauaaauaacuauaaauauagauuuauauauauuuauuuauaaauaacuauaaauauagauuuauauauauuuauuuauaaauaacuauaaauauagauuuauauauauuuauuuauaaauaacuauaaauauagauuuauauauauuuauuuauaaauaacuauaaauauagauuuauauauauuuauuuauaaauauuauaaauaaauauauaaauauauauuuauauuuauuuauuuguauuuauauauaaauauaauuauauauaaauauauauaauuuauauauaaauuuuuauauuauaaaauuauauauauauaaauauauaguguguuagaagagagaaauucuaggaggcaaaauagggagaguggcauggagggggcauuaucugucaccuggauugcugcaggggccucugaguagucucccuacuuuuaauacaccccacaugaccccugcucuucacaacggcaagcgggauucuguuccauccuagaucauaccacaucuggccucugcucagaauccucccgugacucccaucucauucagaggaaaaaguucucgccacggccucccugaucugaccucaccaccuuucugaccucaccugccaccacauuccccugacucacuguguuccacccacaguggcuuccuugcucuuccucaaauaugccauguagagucccaccucagggccuuugcucuggccguucccccugccuggacuucucuuccccgagauauccgcaugacucacucucucaccucccuuaggucugugcucagaugacacuuccuccgugaagccuccccuguccaccucaucuaaaacugcagcaucuuccccaccccuagcacuuccuaucuuccuucccuccuuuauguuuauucuuaggaacuugucaucaucugacauacuauacuucacccgugucucuucuuuguuaucuagaaugucgguuccacaagggccgggaucuuuaucuguguaguucacagcuguauccccaauaccuagaacagugccuggcacacagaugcuugauaaauauuuuuucaguguaugaaugaauaugcacaagcaucccuacauguuuauauucacacauacuugccuccucaccuaaaauaaaaaccaaaguccucaucguggcccacaacccuacacaaucuggccccaaggcaucucugcgacuucaccuuccaccacugucucccuugcucucaccguuccugccucacucgucuuccugcuguuccucaagcacacuaaacacauuccucaucaugaauaaagaaaucuauuaagugagugguaccagcauuuuaagaacacaugaaagagaauaaaaaugaaugggguacauugcauacagguucaguacuguuuugugaaacuuuugguugagcugugugugugcgugcauguauguguagcggguugugauguaaaauguauuuuuuuacuguggguggcaguaaaaaaaagucugaacacaaccuuagagcuuugcaaaaggggagaagagcugcaccaacaucccugccccacagauccaccaguggaggaaacagguaaccaaagacauccaaagaaaugcagcauccucaccugacaaggagcggguaggagcaggaguggcccaggggcagggccuggcaccagccagggcauaauuggggagggcucguagacacacuaacccuacccuuucuguuucuuccucaucuuuccuuuccaucuguuucucauggucuccugucugucucucucucucuccccucuuucucucuccucgcucuuucucauccccuccauuucugugucaaucucaauccauuuauaucgguggccacuuuucuaucucuuuguucuaucucucucucucucucuuucccacuuugucucugcacgccuguuguguuuuucugccugucucucucuugcccucaucucucugucucucucuugcccucaucucucugucucucugugucugugucucccccgcucauucccauuugcaggugcaauguagcaggacaacucauggagcccccccgggcccaucgaguaccggacuggcugacccccuaggguuggcaguagccccugacccucaguauggccaacacuaccggagagccugaggaggugagcggcgcucuguccccaccguccgcaucagcuuaugugaagcugguacugcugggacugauuaugugcgugagccuggcggguaacgccaucuugucccugcuggugcucaaggagcgugcccugcacaaggcuccuuacuacuuccugcuggaccugugccuggccgauggcauacgcucugccgucugcuuccccuuugugcuggcuucugugcgccacggcucuucauggaccuucagugcacucagcugcaagauuguggccuuuauggccgugcucuuuugcuuccaugcggccuucaugcuguucugcaucagcgucacccgcuacauggccaucgcccaccaccgcuucuacgccaagcgcaugacacucuggacaugcgcggcugucaucugcauggccuggacccugucuguggccauggccuucccaccugucuuugacgugggcaccuacaaguuuauucgggaggaggaccagugcaucuuugagcaucgcuacuucaaggccaaugacacgcugggcuucaugcuuauguuggcugugcucauggcagcuacccaugcugucuacggcaagcugcuccucuucgaguaucgucaccgcaagaugaagccagugcagauggugccagccaucagccagaacuggacauuccauggucccggggccaccggccaggcugcugccaacuggaucgccggcuuuggccgugggcccaugccaccaacccugcuggguauccggcagaaugggcaugcagccagccggcggcuacugggcauggacgaggucaagggugaaaagcagcugggccgcauguucuacgcgaucacacugcucuuucugcuccucuggucacccuacaucguggccugcuacuggcgaguguuugugaaagccugugcugugccccaccgcuaccuggccacugcuguuuggaugagcuucgcccaggcugccgucaacccaauugucugcuuccugcucaacaaggaccucaagaagugccugaggacucacgcccccugcuggggcacaggaggugccccggcucccagagaacccuacugugucaugugaagcaggcugguaggcagacaggcagagagaaggucauggccaccgugauggggccaacagcaagggagggguaggggcccauacaggaguccuccuuucugagcuccagccccagccccucgaaccaccuguaaucuaggcaccuuugccaacaccucccaaggauggaggacugggcgagggacugggaaagaggcauauuuaguuuuguggggccugucuccgcugccuccuucuccacuucuacaaucucauucucucucucucucucucugucucucucucucucucucucucucucucagaagugacaauucagaaaaagaaaagaacacugagaaugcagguuuuucuacuaacagcugaggagacaggcuuucuuacuuuaaugucucuccuucugacacuguccagaagggggaauuuguccuguaaaauagacuuccagagcucuuuugcccccucugcucccaugcacccuccccuuccaaguccuuuagcaaggccuggauguuuagggagaaagugguccaaggcugcugacaagagggaccaaagggggugcuggguucccagggagcagggauguuuaauuacuaugucaugugcaauguuguuuuaggccaacccuugccccaagcccagucucuucucccuccccaccauguccagaccucccaaaugguucuugugcaucuguuggagaagucaagggaguagggagaagggccccaaggaugggcccagguuaggugaagaguaagaugugagcugaacuccucgaacugaagagacccacacuuggucacauucucucacgcugccuucaggauccccagcccccaacucuucuuccugaggauggaaauccacuccagccccacuaggacugaugugggugccauacaggcaggagcagcccaccaggaaaguguaaggagggagcugaacuccccagaguagcuggaccacagagacuugggucagagcugauuucaaccccagaauugucucucggguucacccuacucuucugaagaugaaaauuuguuuggggccuugguaaccgauagcgguacaaacuccaaggcacuguggacuugaguccauuccuaucugaccucuuuuugucccccucaagccucaggggccucaagccccuccuuaguagcccuuggcugacugggcccugagccccaagcauccuucuuucccaacaacccuccuuccccauccuucccccacccuuaccuacacccaaaguggagcacacugcagucagauucuccaggagggagauccaagccuccucccagggguggaguccacucugggcuuacuuugaggccuguucuguggauuggugagccaagcuggcacuccuugcccuggucuuacccaggcucucugucccccucucacuuccuguggggccggaaucuguauuuauccaucccccuuucccuucuuuauagaagucccuguccuaaacucccucccuagcccaagagagccccagaacuggggaagccugacccauacagaauggggagggcacucuaggcaggagagacauuaaugagccuggcugcagaguggcccuggaaaggcaggccagaguggcugagaggcugggaguaggggagccuguucucucagcgauagugaugggggugccuuuccgaggggguggggugggaagaccaagggggugggggguagauaggguacauuuaggaggguuuuccuccauuucuuuuuucuaacugccuggauucaccauuggauuuuguaaauggaaaaacugaaaugaacaaugcuauacuggauguuuucucuuucugacugugugugugugugugcgugcgugcgugcaugugcccugucugaccacauguggagagacaugauugagugauagugugugucugugugacuuuguguggggaggcacuccugaagaaaacuugcccggugcacacacguaaaaugccuguauauggggacagauacagcacgugcaugcauacacacacacacacacacaccacaguugagaggagacaaacuagaguaugugcccgugguaggaagucgaguggucaagagauggaucuuggaaacuacauaggucgguagcaagaggguagacucccaucucacaagaugggccucccuuggcccaggcccugagcacgggagggcuggggccgccagggaacuugaaaaccucaucuccucacaaagccuguagccccaucucaaccccgucucagucuccuucccaaacucaaacaagguguuccuaaaauuggaccaccauggagaauggggacugggaauugaggaucaaaugugagggaaacugaugagguuaggaaaugccccccacaaaguaauggcuucuggagggacugcucagucugggaugggagcccuuccuaggggccacuguaugcagcugggacuuuggucagcuuugaccaaauuuagagggagggaugucauggggaaaaaaaacccaagcccaggagucuacccagccagccugcucccuagacaguuaauuuacuaucugguuauucucucaggugcacagaauugaguugaccauacuccucaguucuuggcacacuauaucaucauugguccaugugaggcccuuuuauuuuuuuuucuucaguuuuguccccuucaucacccauuccugaucccauccuccccgcccccuacacaggcacccacucucguguauuuaacguacguccuuccaauccaccguucauguguuuauuuacauauauguguaucugugaaaaauguaugguauugcuguguguuuuaauuuacauaaacaguauuguacuauaaau

SEQ ID NO: 19206 - RNA, 1088 nt, Homo sapiens
cguacuaguuguuaggcuuuuauuuuucucuguguucuguagucacaaugcacaaucauggaacgcguaagucuuuauauaacauacacaaaaaugcagggggauuauacagaugagcuuguuuuauuuuauguuuuucccuuuuaugaccuggcuauuuuacugaagaauccauucaaauauuuaaagugcacucaauugaaauccuauguacuauauauuucauauaauagaauaucaugaaaaugauuuuuguuuuaaaaaacuguuaaaacucuugugaggaaccuguacaggcaacaggaaaacaaguccucacaaacuuauuaauacuuagaauguguucuuuuaccaaaaucuuaugaugaauauaacuugugaacauccgguaauuaaagggaggaaaagcagcaauauugaaauaagaccuaaaucauaauguuacccacagaaacacaaacacuaauaccaaauauuuuguuuucucuucauuuccuuucuuuccaaaucaguaauacccauuguccuggggcacucuggcucuucuaguugccccuccucaccaagugauagcugugacuuauacuucacuagcugcaugaggaguugcugaugguagcauuugaaggaagcugaaauuggaacuggaacuugcacaggaucuggcaggggcuggaacucuggaauggguuugggccuggacaucaguuagugcuuuguauuuggcugugucucuggccuucagcuguuucauagcuucacuguauugugauggccagucccagaggucccuguuaaagacuuuggccacaaaauuuuaaauuuccaucuuacuguuuuucugguuggcuuugggaccccaaaauaaugcauaccccaguggauugucauaguucacaaguuuauacuccagguacccaugcuauacaaacuccuuggugauuaccuuuuucagguacccaaauauucuguacuucuccuucaguuucacuucuaacuuuugcagaaccucccagaugaggcuuuccuuagcucaagugagcaccaugaaaucgacgccuaauaucacaguuaggagaccuuuuuug

SEQ ID NO: 19207 - RNA, 1088 nt, Homo sapiens
caaaaaaggucuccuaacugugauauuaggcgucgauuucauggugcucacuugagcuaaggaaagccucaucugggagguucugcaaaaguuagaagugaaacugaaggagaaguacagaauauuuggguaccugaaaaagguaaucaccaaggaguuuguauagcauggguaccuggaguauaaacuugugaacuaugacaauccacugggguaugcauuauuuuggggucccaaagccaaccagaaaaacaguaagauggaaauuuaaaauuuuguggccaaagucuuuaacagggaccucugggacuggccaucacaauacagugaagcuaugaaacagcugaaggccagagacacagccaaauacaaagcacuaacugauguccaggcccaaacccauuccagaguuccagccccugccagauccugugcaaguuccaguuccaauuucagcuuccuucaaaugcuaccaucagcaacuccucaugcagcuagugaaguauaagucacagcuaucacuuggugaggaggggcaacuagaagagccagagugccccaggacaauggguauuacugauuuggaaagaaaggaaaugaagagaaaacaaaauauuugguauuaguguuuguguuucuguggguaacauuaugauuuaggucuuauuucaauauugcugcuuuuccucccuuuaauuaccggauguucacaaguuauauucaucauaagauuuugguaaaagaacacauucuaaguauuaauaaguuugugaggacuuguuuuccuguugccuguacagguuccucacaagaguuuuaacaguuuuuuaaaacaaaaaucauuuucaugauauucuauuauaugaaauauauaguacauaggauuucaauugagugcacuuuaaauauuugaauggauucuucaguaaaauagccaggucauaaaagggaaaaacauaaaauaaaacaagcucaucuguauaaucccccugcauuuuuguguauguuauauaaagacuuacgcguuccaugauugugcauugugacuacagaacacagagaaaaauaaaagccuaacaacuaguacg

SEQ ID NO: 19208 - RNA, 41028 nt, Homo sapiens
cagaugcccacgugauccuggccugcaguuggguggcugcggugagauaccuggguuccugaagggcgggugguuaggucguaacuacugcccccgccggcugacucuccgagcggccgggcucggaagccacgagccagcugaggcguucuccgcuuagugccuacggcaugggucagcucuuucugccaccuccgccuucgcgguccucaccucuuugcgggugaaguuaccuuuggguuuccagaccuugggggccugaggcccaaacucgggacgaaccccuaacccaccucucuuuuccugucauucuccaacucuuacuuuguaccacggaaucacuuggccuuaaagcuagccagcucggccgugccuugaggccagguucgagagauaaagguaaccguggggaaagcggccccccaguggacaaaggcggaggcaagaauagagcaggccugagggccauaggcgaugagaauaggcaguugaggggugaaaaagaaaacaaacaaacaacaacaacaaacccugaagaguacugaagauuuagaagggacuggaaaggacuuguugcgcaauggaagaaucugacucugagaaaacgacggagaaagaaaaucuggggccgagaauggauccaccacuaggggaaccggaaggaucgcuugggugggugaaggguauuugugaaaccuggaaguggggguguucaaauugaagagaguauugugaauuagaacacuucuccccaccccgcaccaugauaaauugcuuugauuuaccaguaauguugauugggauuaugcuuuggacgacaggauaaacuggaaagcgaauuggugcuaacugaucagaaacaacccuugggaaggggcugauauuccuggugguggugcugggggaguguucuaauuaaagcaguuaugaguugcuuugaauuaucaguaaaggagauuugcugucaccagguuggggauggaaagacuagaaagaagauuugcauuuccaggucagagcuugaggguguuuucugugccaauuuguaccugaauuugagacuuacaucuacuuugugucugugaugagugaaauagggcuuggaaggacagcugaaggacuaaaaagauacuuccagauuuuaaaauuaggaggcugaauguuuuuuauacauagaagauauucaauacucaguccucaaguagaggauaucaauauauucuguuuuuuuagaaauagaagauauuguuugauuaaagcagcuguguugcuuugauuaagaugaugaaaaauugaaucuugaauuuuaauggcucauuuguauuccuaaauaaaucuuccuaggaguucucucuugaacuucuaauuaggagauagagaguauacacacaguuuuauaauuuaggaaaaugggaccucuauucaucugaggucccacacacacagcuguacucagccguuguacuaaacaugcucuuuuguaccuccauguuuauuuauacuucauuaauuucaauuucuaagggaauuggaucauggaaacuguuuuuugguuuauaucugcaggugggugcuaccaaauacagccaugaagaaaaagguaagacguguuagauacgucaaaaccaugaagguaaagguaagaaguugauauucaggaacuuugugacauauauacaccaucuuuucuggacuauugcaggagccuucuguguggucugucugacucucuucuccuuguaugcuaucagauuuaauuuuucuaauaugaaaauccgacugagucaucuacauacuuaagaaccuuuaguaacuucuuuaagcccauggaauaaaauccaaaugauuucauggcccuuuaaaaucuguuccugaccaaacccugugccacacuuaugcacccuaucacagcccuacagaauuuauuguucuccagauuuacaaauuaauuugcacuuuguguaagccauauacacacaccauacaggccucugucugcacauuuauuuuuaaccuaacucaaguguuaccacuauaaggucuuauugaguucuucagauagaauuggacacaccuuccuuugugcucucauaguacugugcccuacguugggguuuaggcagaauugcuaagagugcagcucaagcuaauuucuuaaccuuuuggggcuucaguuuccucauuuguaaaaugguaguaauaauauuaacuguaucguaagauuguugugacguuuaaauuaguaaaugccuguagaacacuuagaucaguaccuaacaugauuagccuugguaagucuuucauaggcaauugaaagagguacacuguauaaauuaauaaccgaaggaaauguaccauauuuagccuuagcuucaucuaauaauucaguucuguaacuacaguuugcuaagagaauguucuugaugagccugucugaaguugcuuucauugagaaugccuaaaaguacagaaauuucuacaugauuaagaacaaaaauuagcuugauuuaaucauucugcauuguauacauauaucaaacauugcauuguaccuccuaaauauaaagaguuauuguuuuucaauuaaaauuuuaaaguacaaaagcaaacuuuuuguagcaacuuuagacuggcucagcaguggcauuuccuuagugagauaaaguuauauagcuacauuuuuagauuaaaucaagucugaguguaguauauuuucaucaauacuucuuauauuaguaauuagaaauuuguauaaaauaucuugggauugaagguagaacauagguucccuucauuugaaaagcaaguuaaggcugggcacgguggcucaugccuguaaucccagcacugugggaggcugaggcaggugcaucacuugaggccaggaguucaagaucagccuggccaacauggcaaaacccugucuguacuaaauauaccaaaaaaaaaaaaaaaauagccggacaugauggugcaugccuguaaucccaggcaugggauggcugagguggggggcucaggugggguggcugaggcaugagaaucacuugaacccgggaggcggagguugcagugagcugagaucaugccacagcccuccagccuggaugauagagugagacuuggucucaaaaaaaauaaaauaaaaaagaaagaacgaaaaggaaagcaagguaauuggaacuauauuucauaaauucuagauuugaaaggacucucaaaagucacuuuacuaaauucccuuuuaguacgagaguauagaacaucauugacgagugcucucugugugacaugcugacauugacaggaaggcugcuuaccuucaugaggcuaccuuuucccuuggacaguucucacugucagauacucucuugcuuucuauauuuguuuugauaacuugcuuguucuuuugauguacauacuuugagcaucuguuguauguuaggcacuggagguaugaggggacuuucucuccccuuccagagcacagagucuucugagagagaaggacagaccccccaaaauaaguaacugcaaugcauuauagucuuugcaaugaaauaacagugccaugggaggacagagguaagacacuuaagucagccuagagcauuagacucagaauaucuucuugcaaaaaugauuacugaaccaagucuugaaggauaacugcaauuuagcugaaggaagaaaagagaauggauaguuuacuggcagagaguacugcgugaaacaauggcacagaugcaggaccucccagacggcugggaacaaucagagggacuaccagcaguucaauuaaguguggcuguaagcuaaaaguuucaggccaggagggacaggagaugagggaugagaaguaaauagacuagaucaaggagggucuuauauguagucuaaggacuucauccugcaggccaugggaagcuuuugaaaagaaaaaggagggacaguaauaaauggaauaagagcauagagguaaguagaagggaugagaucaaaggcagagguggaaagauugaccuugaucagaaggaggaagaacuuucaguuauguugcaauccucuacuagguaauucaguuaacaaaacauuggguuaugauagaacaggguuuaguuuccucuaaacuugguauuuuucuaaccuguuucugaacauauuaauggugcaucuuaauagcauaaauucaguguaauucugucaccuaaaggauguauguccugugacagguaaguaccuggcuccuggaauucuaaguaucucugcauucacccuucguugggaagaguuuaguuaguugugaguaugcgcaccagguuguugguacugucaguucaggaaaauaucaaauccaggagagaaauagaucccuuuagacuugauuugcucuagauugcuaacuuuuuuccuuuccuuuucccuacuuuguccuuaggugcuguugauggguaaaagugggucugguaagaccagcaugaggucuauuaucuuugcaaauuauauugccagagacacacgucgccuuggcgcaacaaguaagauguuuuaucuuauuguaaagucaggugaucuuaacuauuaauaaucugcauaacacacuugguuucaguaccuuggggaugcagagagguuggggaauuuguuauggagcauguuuacccuuuuugcauucguuuucaaagagguguggccuaauaccaguuacuacugcuugcugucuugggggagguucuuuucuuucuagguuguuuaugaaguggauugcccuuguccaacuuuuuguuuauucugcuauuucuuaaacaagcauuguuuguucgucuuguggggagaguguuuuuaacucuuauacaaagggaaauccauagguauuaacaagcauaacaguaaaauaugcuaagauuuuuuaaagcaguaguuacaccuugucuucguugaaagguaaauuacgguggugggaaggaaagaaguuaacuugaucuguacucugcuacuucuuuuccuggauacacauagaugaucucauuagaguuuugguucugacuuagggaauauguuguugccuuuuauaguuugaguguuaguauauacuaauugggcugccauggacagugaauguaggauccugggagagcccuucugucucuggguuguacugccauuucauucugcagcauucaagcauuucuggauucugcuugguccuugauuuuuagggaaaggccacccacuacucuacacauuuccugaaguuucaagaacaacauuuuaaaaacacaguauguuucagacccuaggaaauaaaggagaaggaaaccucauuucuguuauuaucgugcuuggaguguaaguguagacucucauaauuggggcagcuuuguugucuagaaagcuguuucuugaauguauauauauguauuuuuugagauggagucuugcgcucuguugcccauuuuggagugcaguggugcagucuuaucuccuggguucaagugauucuugugccucagccucacgaguagcuggaauuacaggcacccacaacgacgcccagcuaauuuuuguauuuuuaccagagaugagguuucaccauguuggccaggcugaucucuaacuccugaccucaagugaucugcccgccucggcuucucaaagugcugggauuacaggugugagccaccgugccuggccuauuucuuuuuuuuuuuuucuguuagcuuguucucuuucuguucucuuaagccucuacaaauauuugaggauagucagugucucaguuuguccuagcgaucucuugccucacaaaucuuuuuuuuuucuuuuuggagacggagucuugcucugucauccaggcuggagugcaguggcaugaucucagcucacugcagccuccaccuccugguucaagggauucuccuggcucagccucccaaguagcugggacuacagguguguaccaccacauccagcuaauuuuuuuuauuuuuaguagagauggaguuucaccauguuggccaaacuggccucgaacuccugaccucaggugauccgccugccucggccucccaaaguacugggacugcagguaugagccaccaugcccggccaucuugccucacaaaucaugucuuccuuaaguuaaaaauguccagcucuuccaucuauuucucauuugacauauuuugaaacauuuuuggggacuuguucaaacuuguuuacauuuuucuuaugguauugagaguuagaugcagguggagucugaucagggcagagugggccuaucacaucucuuauucaggacauuacauugcuguuagcacagucuaacauguauccuccuuuuuuggaguaacuuucguuaugaggagacuuacuaaaaaacucuuucaaauaguucaaauucccuuucagauauguuguuauuaaaacacauacccuucuggcucuugugcaguuaauauuuugaaccaaagaauaaaugcuuacuucuauuaaaucauuuaguuuuguuuguuuuagcccaugauauguuccuguacccuuuguuuguuaacugugaaauccagaacaaguccaaucccuuuuuccucauccauaaaaaaagggauuggauccuauuuucauuuuagcuacuuauucucuuaucugauauauuaguuaucuuuccuaacucuaauaucugauacauuagcuaucuuuccuaacuccauggaguuuguacauuugaugaauaucucaucuaguuuucaucuaagucauugaccaaaaguuuuggucaggauaguguccuauggccugucaugccucuauaauugacaucuguagcucuggccucuggaaugucuaccuguccaaacuucucucugcuugauuugauagauuaaaacuuuuuuuuucuuucaaguuaaauaucugggccuaauuacccuuaugauuucaguagauuagaggaagcuaaugguuauugaacaacuguuauuugucagacuuuuguuuacuguuuuauuuacuuuaguucucauguuaacuucauuuuuauagagaauaaagaaggagguacaacuuagaaauuaauauuacucagcuaggaaguaucagagcuggaaugucaaucuaugcucuugcuuuauuccuuaugccacauucuaucuagcuuacccucugcuaacgauuccuggcagacuuauuuuuauuucuguuuuaaauucugaacacuuuuguugaagcaucuuuuucuaguccaauugcuguugcuguuuuuauauagcugaucagaguugacuuauuacccugaauccagagaacagucuugcaaccagcauuucagaguuauucaaacugcuugaaauaguuuugacauaaccuagcagccuuauugugaacagaauuuugcaaauuauaugaaccccauacauuaaggcaaaccauuuauucagcaaguacuuuucugaaacuuuuuauguagcaggcacagagaacgggacagagcucuugcccuuaagaauaucucaagcaggaccuuuauuacuaauacuuuguuaguaaucacuguaucuccuuacagguagugaaaguauacuuuaaaauauuauguuggucuuaaggcuuuaggauaucaucauuagcuaguuugucauugcuaaagaaauaccugcguucuauugcuaaacuuauagacaaguucaaaaugcauauauagugcucugcuuuuuauuugauaguccucuuuauguaguugcugauuuucuuuaaaaguaguaagaguacuuuuaaaauauugcauugauuuuaauguuuuaguguuuuucuaguuucucauugcugaaaauaguccaguuuuauuuuguuaaacuuagagccugcuguguuuugaaauuugaaguaagaauacaugauggugauauuauuaacuuauuagggggcugcuaaaauguauuuguuggaacaguaaacuugucaauaaaaaugauuaugaaguauuuuagucucaaacacuguugacggcuccaagauuuccuaccuucucaaaauucucuguucccuuggcuuuuauuuaaugcucuauuacccugguuuucuuccauuaucuuuaauuaucccaucccucuuuaaaaaaaaaucuuuaucauaguauuuucuucuuucugccccguaagugugugucauuccccaaagcucuguucuugguucuuuuuaguuguucuugugauaauaggguaggaagacuaggagagcuagagauccauauauggaagacaugagacuaaagagggaagcaggaagugggugguuagaucauaaaaugucuuguaagccaaguuagauaguaggaacugaggguaaagagaguuuuaaacagaagagcgauauuuuacaggucccagggauuaaggaaaauguuaaaaaaaaaaagaaaagcaacaugagcugauuuauauuuuauuguuuuuaauuuucaguuuuaauuacaaaaguaguacuugugaaaaauucaaacauuacagacguguaaaaagccucuuuucucccucacucucaggccugcuuccuagggacaaccacaauuaguaguuuugagguuauccuucuggcccuuucuuuucuggguguauacaaucgugcauaugcggagagacaugguuuuuuucuguuuaaagaagaauaaaaaucugcauuuuggagagagaucacucugucuguaauauggaggauagauuggagggagggaaggcuagaaacagguugguaaguuaggaaacuauuuuaauagaccaggugagagaugaugggggcuugauuugggcuagggugaugauaguggauauggugagaagcaaauggauuugagaucuauuuaagagauagagucagccggacuuucugguagauuuggggagaaugaugaggaaaaaaguggacugaaggaugaaacugagguuuuggcuuaggcaacugguugaauucacuaagauaagacugaaagaggaauagauuuuguaggaagaaagggggagaugaugaguuacauauacuuggauacguugaguuuuggauacuugugguucauucaaauggagauuuguaauauaugucagaaagguagagaaaucuguucuagagauaccuguuucugagucgucaguguccaaauggcaaauaaaauaauaagaauagacuagcuugccuuggggaagguggccaaggauggaguccugaagagcuccaacauuuaagggacagaaagaagaauaggaauuguaagggaggaucugccagagaaguuguagguaugauaucagagaccaagagaagagaauuuuuugagaagagaguagucaacagugucaugcugcagaaaguaagacaaggacuaaaaaguccacuggauuugguuauggggccauuggucacuugaugagaauaauuucuaugauaugggaguagaaaccugauuucuaucccaugugccccaugucuaaacagucacugacuccugucacuucuuuuguuauugucuuucccuuucucaguagcacuucuuuccauuuuuuuuuaguacuagaccguauacauagucuucaaauuaauagcaguuugagcaccuacucucucguagacucuguuggaaauacaaagacauguaagauaugauuccuuuuccaaggagggggaaguaaaggggagaagggaaguaguuugagcaccuacuaugugccaggcacuuuauguaugauaauucauugaauccucauaguaauccugugaggucagugcuaugccccgcccccccgcuuucuuuuuuaauagaagcggaaacuaauacccagagcuuaagugacuugcccaaggucacauagagagguagagcugauauuugaaugaagauuuguucgauuccaaagccugugcuuuuuaaaauaaugcucugcugcuugugauguaguuuauaagaagauaaaauugcacaaaaguuagauagcagucaauuuaagcaacagcuuugagauagucauaggagagauaucacugugugauugauuaucacaaauuguauagaugauaauuccuagacuuugauaaauuuucaggauaaaaucuuucauuauuacuccuugggguuuuuagugccuggcagagaguagaugcuuaaugaguguuugaaugaauucagagggagagaugaugguaaguagggguagcuaggcagggcuuuuagaggaggugggauuuaggcuggcucuuaaaagaugaauauauuuugaaagaaagauggggagggauuuccaggcagaugaacagaguaggugaagaauagaggggagggaaguguaacucagaggucgcaaacaggcagccuauauccuggauaaggccuguagauguguuuuguuuggcccaugugauguuuucuaaaaaugggaauuaguuaucagcauguaaaaguuuucauaaaaauauggauuucccacuacugcugaaaaacuuaaagaucugguaacccagaguccccauuccugcauggcaaaugaaccagagcugaguaacugcugcucacucuacuaucucauuggguagauguuuacacuccauauguggccaacuuugcucauguacgguuacuggccuggccccuguuagcaaguuugcgaccccugguguaaaguauuuuggggguuggggaggcagugggguuugggaggacugugaauaaaccaaauugggcuggagugaaaggcuuuauuaauguggaucauuggggaauguauagguagauuggaagccaaauugugaaggaccuugaaugccuccccauaggcauggaggagccauugaaaguguuuugaauggggagugacauguucaaaguaguguuaagaagaugagccuggcaguagccugucggaugaaguaaaauugaguaaggcuuuuugguggggaggugaguuauggagcuauuguaguaguguagacaugagaugauaaggggcuuccuuaauguuugugguagguuauaaaauaaggaauggauuugagagagauuacaaaggauuagcaauguauugaauguggauagaggagucaaaagugggaaaaaguuagggucauuaacuggaaaggaaaucaauagcaggaguucauuugguuauuguuuuauguuuguuuuuuguuacuuuuuuuuuuaauuuuuguguguaugugagguuggugggggcaagugggacagggaagacugauuauaugguauauaucuauuacauguugaaauuuuaacaguauuauaguuggagauuguuucugcucuaaguauuaaacuacuaaaaagugaaaugacuuaacaugagagccaguucuauagcccaggguaguuuaggugccuaccuugccacuaaaccacacuacucagcugaaaaucaccuucuuguuguggcuuugagcauuucacuccacuuugguccuucuaaauuucauggguuagugcuuugcuuauuuugaauuucacuucaccuguuauaauuacuagauuugucauauuugucuuccaguugauguagaacauucucauguucgauuucugggaaaccugguauugaaccugugggauugugguggguaaguaccaucugcuuacuuguuugugaagccgaugucaguaaucguggcaucuaguauaucagcauggcgaauacaccuagaguaacuaucauuuguaauagauuggauagaauuacuuuaaaauugacacuugagucaauaaacaucucugacuuuuauggaauugugaaaaugcccucuguaugugacauguuuaaauagcgcuaauccaagcuccaucuagguaucuguaguuugggauagauuauccccuuucguggaggaauaaauuagguuucugucucaggcagccugacaccagugcugagcucuuagcugucacaccauacuacuuuguucuuaguuauaauacgucaauaauuuucuccaggcagucucaauacuguagaucagacacugagcacacauucucuagcuaaguuaccuacuuuuuggaagaguaggaguuagcucuuccucuuaugagcaaaauauucaccacauauuccaucacaaauguacacacacuguggauguaugcuggcuauggugcaucucugugcugaaggaacagugugcacugcacaguggauaggagcauagguuuuggagucagauugggguuuguaccucagcucuguuagcuguguuaucuuggguaaaucauuuaaacucucugagccacaguuucuucaucuguacaguagugaaggcaaugguaccagcucauaggguuguuuugaugauuaaguaagauaauuuauacaaaguugcauagcagagugccucacaaaauacauagauauuguuagcucaguguaucucgcucuuagcauagagccagccauagagugggugcucagugaauauuuguugaaagaauaaugcaauagcuaaauacucuuuaagaaaaugacuccauuccugcuagcagauggaucacuuaacauccuagcacauaucuccauacaaauccuuccucauuaucauugguucuaauuuucuaaucuguguuaagacauuagucccaagucccuugcuuuuaggcacuaagaugugaugaucuucauuuuuagagauaaggcaacugagguccagggagauuaucauucugcugaguucacacagcuaauuaauagcaaagugcaggacuagaaccuagguuccugauuuuuuucuccuacuaccggaugcuacuguuuucugcuggccaagugguaauugagaacuuccuggaaagcagcacuuagccuaacgagcaaagagcaacauucuguuaaaaaguuaccauuggagucauuuuaauguaguuuagaauauuugacuauugaguuauucauucagcaaauuuucauugaguacuuaacacuccauuagaagcugggaaacaaugaaggauaguaacagacauggaacuugcugucuagggaagugaaugguguuaaugaaaaacucacaaacaaguguaauaacuugugguaaauguuagaaguaagaggaauguauugauauaagagccuaugcuuaguggauugaccugucaggaggccauggguaguuucugugaggaaauauggauugaacugaaaucuaaagagacaagcaggaguuaacuagaugaggaggugggggguagcaucugagacagagugaacagcauguguaaaggccacauaguggauaaaccaugugccacuugaggaauugagaaaaagucaguguguuuagaacauaaggagaggggcagagaaauggaucugguacaggagaaucaaugagaccggguaagaaacagaaaaggggcugcaccaaaugauugacacgcucugcaaacuucuuuuguuggcucaaguuguggcucaagaggugagaagguaaggccagacuuauuuguuaugauuugcccuuuaaauugaagccuuaagauuaucuuucacauugaucaagccaacaaaaauaggcuauaaguaggagugauugaauugaggauuugcuuacuauauauauauuuuuucuaucaggcaagacaccuucauggaaaauuauuucacuagccaacgggacaacaucuuccgaaauguggagguucugauuuaugucuuugauguggagagccgcgaacuggaaaaggacaugcacuauuaccaaucaugccuggaggccauucugcagaauucuccagaugccaaaauauuuugcuugguacacaaaauggaucugguacaggaggaucaacgggaccugguaagaaacagaagaagugcugcaccaaaugcucgacaugcuuugcaaacuuauuuuguagagguauagguaaauuuguaccauuuuuucaggaauaaaaagucagcagaaguuuugaaaguaaaguuuugucauuuacuuuaacuaaacacucuuuuaaacacauuuucaauaagggaaagauuuauuaguaaauaauuuucagaauuaggcaaggauucuguccaagugaucucacuaagcagcauuuauuuauuuuuaaaauauauuugcugccccaguuuuauuguccuucaaagcagggagauagugucaagguuaagacccacuaggagugagaugaagagagguugcugcuuucauuagauugacuuaggaaacugguaugcaccaguucaagugcuaaccacaguguguuaggcacuaugccaggucccucauaauuucacugauuuacuagauuucucuuuucugacaugggaguuaguacacacaaauuuaaaccagagaaggcacaguagcggugaugucaccaagauaguggaguaggagauaaccagucuucauuccccuacaaaaaaacaaauauagauagcuauccacaaaccaaaauagcccugagaaggcuccgaggcccauuauagaaagacguaguaaaauggguaaacuccugcuuagcugugagacuccaggauuggcaagucauauagucuagcugcaauauagucugucuaguuugcucaguauaaaauaagaggauuggauuuuaaggucuaugcuaaaagagaagauccuccucuauuucuaaggguauaaaacuaaggaaagcaguuuuaggauaugcuggucauauagaggaauacaguuucucuuugaguuggaguauaagaaucuaaggaaauccuuuaaugaaaggauuuuuugguaauugcugugguaaggaauacuuuuuuauaugacuaguuacaggauugccuccacuguuuucuaguguuuugguauuuauagguuagcuuauaggcuuucaaaaaccauuugaaggguuccauauuugacucagaaaacugcuuuugauuauuuaguagucuuuuuagcucuuucucccucaacuucugucaugaaguauuaauuacuguuuaauaccuaauaauuaauaugguuuuacuucagcagaaaaucauguacgcagcuugggucuugaguuugugagggccuuguuauugcucuugcuguuuuauucucguuuccuuuaaaaaucacuuuauuuccuauccaaaauugcaguagaaaaacuuacagcauuccaauaaaugagcuccuuuaaacauuuagaaguguuuuauucacuuguaauuuugugggguuuuuuuuuaguauuuuaauuuauuuuauuauuucaguaacuuuaugguuauaugugguuuuugauuacauggaugaauuguacuauggucacgucugggcuuuuagugcauucaucacuuaaauaguguacauuauacccaauagguaauuuuucuucccucaccccccacaaccuccccguuucugugucuccaguguccauuauaccacucuguaugcuuuuauguacccauagcuuagcuccuacuuacaagcgagaaugugcaguauuggguuuuccauuccagaguuauaaacaagagauaguuugacuuccuuuuuucaguuuggauccccuuuauuucuuucucaugccuaauuacucuggcuaggacuucuaguacuauguugaauagacguguugaaaguggauauaauugucuuuuuccaguucuuaggggaaugcuuuaaacuuaucuccauucauuuugauguuggcuguggguuucucauaaagggcucuuacuauuuugagguauguuucuucugugccuaguuuguuggagguuuuuuuaucauaaagggaugcuggguuuuauugaaugcuuuuucugcaucuauuaagaugaucauaugguuuuuguuucuaauucuguuuauauagcaaaucacauuuauugacuuguguauauugaaccauacuugcaucccugggaugaagcccacuugaucuuggugaaugaucucuuugaugugcugguagauuagguuugcuaauauuuaguugaagauuuuugcauuuauguucauugaguauauugauuuguagcuuucuuuuuuuauguccuuucguggcuuugguauuaggaugacacuggcuuuguagaaugaguuaaggaggauucccucauucucaaucuuuugggacaguuucaguuggauuggcaucaguucuuugacugucucauagaacuuggcuaugaaucuaucugguccugggguuuuuuuuuuugguugggaaauuuugaguuuuuguuucuuuuuuuuuuuugagacggagucucgcucuuucacccaggcuggagugcaguggcguggucucgucucacugcaagcucugccucccagguucacgccauucuccugccucagccucccgaguagcugggaccacaggugcccgccaccacacccagcuaauuuuuuguauuuuuaguagagacgggguuucaccauguuagccaggauggucucaaucuccugaccucaugauccgccugccucggccucccaaagugcugggauuacaggcuugagccaccgugcccggcuggguuuuuuuuuuuuuuuauuacugauuacgucucacuaauuguuagugcucuguucaggauuucuauuucuuuuccugauugaagcuugugugguuguauauuuccaagaauuuauccauuuccuuuagauuuuguacuuugagugcauagaaguguucauaguagucucagucauccuuuguauuucuguguuuaucaguaugauguuuccauuuucauuucugauagagcuuauuggaaucuucuuuucuugcuuuaucuagcuagugguuuauuaauuuaguuuaucuuuucaaagaaccaacuuuuuguuucauugaccauuguauuuuuuuaauuuauuuucaauuuucuugaguucuacucuaaucuuuguuauuucuuauuucuuuucuucugcuagcuuuggguuuggcuuguucuuguuucuccaguuccuugaggugugauguuagguuguaaauuugugaucuuuuuguccuuuugauguaggcauuuagugcaauaaacuuugaucuuagcacugcuuuugcuauaucccagagauuuugauaacuugugucaguauuuuaauucauuucaaaaaauuuuuccaucuugauuuuauuuuugacccaaagaucauugaagaauagacuauuuaauuuccauauauuuguaugguuuugagaauuccucuuggaauugauuucugguuuuauucugcuuugggcugauuugauacuugauaugauuuugauuuuuuaaaauuuauuaagacuucuuuuguggccugauauauagucuaucuugaaaaaguuccacgugcugacaacaagaauguauauucugcaguuuuuggguagaauguucuguaaaugucuguuaaauccacuuuuucuagaguccaguuuaaguccaguguuuguugacuuuccgccacaaugaucuauccagugcuguccauggcguguuguaguccuccacuauaauuguauugcuuucuaucucuuuuucuuaggucuaguaguuucuguuuuuaugaaucugggagcucuggaguuaggugugcauaaauuuuggguuguuauaucuucuuguugaauugauuucuuuaucauuauauaaugacauuuuuugucuuuuuuacuguuguugauuuaaagucuguuuuaucuaagaauaguuauucccacucacuuuugguuuccauuaacauggaauauucuuccuacccaucugccuuaagucuauaagaaucuuuacaaguuaacugggucucuugaagacagcagauauuugguuuguguuuuuuuccauucuguccaucuauuaucuuuuaaguggcacauuuagaccauuuacauucaauguuaauauugacaugugauguacuguugcagucaucaugcugcuaccuaguugcuugguuuucuucaauguguuacaguuuuauaaguccugugaauuuuuugccuucaaguguuuuuauacuggugcauaugaccuuucauuuagauauuuagaacuccuuuugcauuucuuauaggucuggucugguggagacaaauuccaucagcauuugcuugucugggagagacuucauuucucuuucacauaugcaauuuaguuuugauagauacagaauucuuggcugacaguuauuccguuugaggagacuaaagauaggacucaaucccuuuuggcuuguaagguuucugcugagaagucugcuauuagucugauagguuuuccuuuguaaguuauccaaugcuuuugucucacucuucuuagaauucuuuccuucauguugacuuuagauagccugaugacuugguaaugucuuuuuuuauaaugaaucuccuaggaguucuuugagcuucuuguauuuggaugucuaaauuucuagcaagaccaggaaaguuuuccucaaauauuuccucaaauggguuuuccaagcuuuuugcuuuuucuucucccucaggaacaccugugauucuuagauuuggauguuuuauaccuaaacccauauuuacuggagacuuuguucauuucuuuuaauuccuuuuuuaaaauuuuuaucugauuguguuaauuugaaagccuugucuucaagcucugaaauucuucuucuacuugguccaguuauuucuuuauguugguuucuaacuuucucuuggauaucauuuagcaaccuaauaauuaacauuuugaauucuuuaucugauauuucaaagauuucauuuugauuuggauccaucacuggagaguuagugugaucuuuuuggggguguuguagaacucuguuuuugcauguugccagaaucauuuuucugguuccuucucaucuggguggacaauuucgucuuauuauuuuugaauuuauuucugauuuuacuggguuuuuaaauguuuuucuccccuugaguaugugacuuuaauguguguaguguauggucaccuagcuuuggcucugggugcuuucaguggcaaagacuguguaugagcucuuugguuguagagaaucuuugugcaguggcuuucuuagcugcugguuguaguagcagugugcugggugugugagaaggcucacugucucccaugggccagaauggcagaggucucaugaagcauaucucauuuccccgugguguauauuuuguuauuuuugugaaaaauauacuggggaaaaaaauaacaaagugcauaccacuggggaaugagauaagcuucaugagaccucugccauugaauaguucagccuucaugcuaguacaggcacccacagguaaaaaccagcugcagcugaaguagguggguauaugcaguaccccauuugugggcagaaggcccagccuugacugagcuggcugggggagcucucagugaaauguacugaggucuuuacagggggacagaagggagccaccucagcuccucucccaggccagcaggaaagccaucugcuuccccaucaugcuuuugucccaguguucuggauauucagaucagacaagcaccucuguccaucugcaggaaugcugacauuccauguaaagagggguugugacuuuacuucuugugcaagccugaacccagagggcacuccuccuguggagauguagucacccugaagugcuccagaaagacugucuauaggcacacucaugcugaguuccuggaagagaagccccagcuguaucugcaaguggugggcaagggagagaaguuuccuucucugggucccuucaugagcacuggagcugccugacugcugggguagaacugcaguuuuucaccacugagcauggccuugcaccugugucucugcugaaggaaacuucccacaaguggaaacuucugggacucaaggccugcagucugguuucuuuugucccacagggugcucccuugauguggugcacucccuguucccauagguguggcagucccucagggccagacuacugcaaauccugcugcgcaucuggucuagccgccuuguggggcuuccacacucuaagcuggugcugggggaauaugugcaaggcauccagugaugugaagacacaaggauugaaggucccugagcaaaacaaagucucacaaugggugcacauccagcauggcacccacugcuauagcucagguccagggggaacuugugaagggaccuugugcgagcaagguaaugcccuugaggagucccuaaaucgcagcccacucugguacuugugcucgugagugcaaagaagucgucuuugagcuuggauaccagcagucugcugcaagggccagagaggccaagagcacucccaccuccucuguccgcagauuauuaagucucugaggguuugaucucugccagcuucuuguuacuuucuuuuuucuuuuuuggugugucacagauucuuccacugaacucucugauaagcuccagcacucuccgcuuaacauuccauuugggcuaugauuauucaccuguaauuuugguucuucccucugaggagaauuggucacugaugcuucuuaucagccaaguggagaagcucucugaugccaaaggcugugggacaggucugcaggaugugcagugucuuaggcucugcucugagcuucagagggggacaauguugaguggaucuggaccaagcuguccugcccucuggucucccagcagguguaagcacaagcuaugauaaggguagcaggagagugacauagacucugaaagauuucccuggcuaaaaauagccuuagugugauggcuuucucaaaucccagcuauaguaguaauguacuaggcacaugaguaggcucaagaccucccgauuagcugggaugguguggguaaaugauguuagcugagaucacgcagaaguuuucuccuucucaagugguguguuauugugucagcagauguuguaaugggcugcaccaguugcccucuagccaggagguggcguuuguaggagacagccaguugugaugguggccaugggauuugugccuggcuuaugauacucaggggaagaacuugugucucaggcgaugggcaaggccauggaacucccaaaagucccugucuguuguguuaugcuaccagggcagguggaggggcaaaccggguuugggcugggucaaacagauuugcacucuggcuccccauguguaagcacaagcaguggucccaguggggcuuggagggcaguucccuggccacuaggguaauguuccagggagaagcacaacugacucugcugcacaaaagaauccacauugggagaaggaguagcaggugucagugagacccacccaacucccacagcuuugacaagguagguaucacauccacagucuucugcuagcagcagcuagcuggaucccaggcagucuuuguuaagaaugcaaaaccgccccaggccauaagccuuccugcugccugagacagaaacuaugccuuucaggccucaccucucccuguuuguucacgaagcuggggcacuuggcugcugcuccuguggcaagagcguacuucccacuugccccucaguucuggccaagggaguuuguccucacucgagagauuagacugcagaucucaguugggagcuucucccauccugugaccacugccugaguuagcugugagguuccucuuaucaggaaugguuuccuucuguccccacugggguuucaggguacaugcaaaguacuucucaauaccgcucuuuuucauauacuucccacugcucaccaaaucaacugcagugcuggguaggguuaaggugcuccccuguggccuggcuugcucagcuucucagugggaauguguaucaaggagacauugucucccccuuucaugcucuggagacucacaguggucugccuggcucaugguguagguugcugcccaccacuucuuucaaagugucugaagcuucuuucaguuuuucuguugaguuccuguguuccuucuuggauaaaaauuuacacugugaaucucuacacaccacucugcuguuuccaagcaggugaggucugcuaacaaagccuucagucuaccaucuuggaaaaaaaaaaucacuuuugauuaaucaucuuauuauuuucuaaaugcguauauaaagauuuccaaagauagauuaauauucuucaagauacuuuaagcuuaguuaagaaaaguauauucuuuauuuuauuaaaaauguacuuagaaguuuuaagguaaaaugguuaguguacuucccuaaauauccauuucagcuaagacuggugcaaaaauaauugugauuuugccgggcgcgguggcucacgccuguaaucccagcaacuuugggaggccguggcgggcggaucacaaggucaggagaucgagaccauccuggcuaauacggugaaaccccgucucuacuaaaaaauacaaaaaauuagcugggcgcaguggcgggcgccuguagucccagcuacucgggaggcugaggcaggagaauggcgugaacccaggaggcggagcuugcagugagcccagauagcgccacugcagucuggccugggcaaaagagcaagacuccaucucaaaaaaaaaaaaaucauugugauuuugaaccaugaauuuuaaaucauuaugacuaggcucaaacacaucuuuuggaaugaaaauaggaaccauuacagucaacacauuuuugucaacaagaaacaaauuuguuuauuccuguagcacaaaaauccgugcuuugggauucaacaaacucuuggaaagaauuuucugcauccugcuggcuguggaaguguuuucccugcaaaagguugucgagaugcuugaagugguaguugguuggcaagagguaaggugaauaugguggaugaggcaaaacuucauagcccaauuucuucuacuuuugaaguguugguugugcaaugugcggucggguguugucauggagaauugggcccuuucugugaccagugcuggcugcaggcguugcaguuuuuggugcgucucguugauuugcugagcauauuuaucauauguaaugguucccccgggauucagaaagcuguaguggaucagaccagcagcagaccaacaaacagugacuaugacuuuuuuugugcaaguuuggcuuugggaaguacuuuagaguucuucuuaguccauccucugagccaguugucaccaguugucauauaaaauccacuuuuuggugcacaucccaauccaauugagagaucauuuguuguugcauaggauaagagaagacaacacuucaaaaugauuuuuuuuuuuuuuuuuugcucagcucgugagcaaaccuuuugagcuuuuucaccuuuccaauuugcuucaaaugcugaacaacuguagaauggucgacguugauuucuuuggcaacuucucauguaguuguaagaggaucagcuuugaugauugcucucaauugaucauugucagcuucugauggcuagccacuaugcucuucaucuugaagucuugugucuccuuugcaaaacaucuugaaacaccacugcaccauacguucguuagcaguuccugagccaaaugcguuguugauguugugaguugucuccacugcuuuacgacccauuuugaacucgaauaagaaaaucgcucaaauuugcuuuuugucuaacaucauuuccauauucuaaaauaaauauaaaauaaacagcaaguaauaagucauuagcaaaaaaacauaaagcgagaaauggacauuaaaaugaugucuaacauaaccacauuuacuuaagaauguauuccaaaaucaaauggcaaauugcaacaauacaaaaaccgcaccuaguuauuuucuucuauguguguaucuuaggguucuccagggaagcagaacuaacuaaucauguguguguguaugugcgcgugcauagaaagacaggaagagacacacacacgcagagagagggguauuuauuuuaaggccuccaacugauuaaauaagacucacuuauauuauagaggguaaucuuuacccagagucuccugguuuaaauguuaaucucaucugaaaacuaccuucacagugauaucuggacugcuguuugacuaaaugucaggauacuguggccuagucaaguuaacacauaaaacuaaauauuacagucauaccccuugucaacuuggcacucauacacaucuacugaaaccauaccuaaucuucaaauaaaaacaauaacaaggucauacuuccauuuaacaugauacaguaauccugcguacaaccaaaaaugcaauaaucauuuucccagaagaggauguaaaguuauugacuguuuacucuucuuuuacauuauaauguaaaguuaacaauacuuaaauauuaugauauaucauaugauauguucaugauaagggauuaaaagggaaaaaacagacauuuacuuuauauacauauauacauauucauaacaaaaucaagaugaaguacucaugacaauugcaauucucauuuguauaacuggucacgugauuuuuaacuggucuuuauaacugccuuauucaguuccagauuaccuuugcccacagcacucaccucagcuuguuguauauucucugguggggugacccaaagaccauuaguggaccuuccugaauugggcauugucguuuuccauugaguuuaaucacagagcaugguauuacuaagagacauccuaagagcucuccuauauuccagaaauacucuucuuccuuauaucuauuuuggaggagcaauccaguuuccccauaguagucaggaucagucaguccagucagcauaguaacuuccuucuuugccuguugauucagaggcuugagggacccaagguggcugguuggcagucuuaacuuccaguucaguggaaucacuauguuuccugguagacacauuucugccuuuggaacugagaccucuaggccagcagagcauaaggucacaggggcaagaaacaaaaauuuugcuagugggucacuggagugagugguggcacuccaguuuccaccccaugaauccucacuauaaaauuaaaagcaccauuuauuggacgcugacucagagcacauacagccuccuagagaaccuugccuagcucugcaaaguauugcaacuaucuaacauaguuggcacuguaaaugggucuucaaaaggccauucuaaccagguaugaugacucaugcuuguaguucuaccuccuugugggaggguaaggcaagaggguugccuagccucguugaaauccagccuaggaacauagugagaugcaucucuaauuaaaacaaaacaaaaggccauucugccauucugucaagccagcugcuuuaggaugguggggaacaugguaagaccagugaauuucaugaggaugagcccauugccucacuuuauuugcugugaagugaguuccuugaucagaagcaaugcuguguacaauacugugaugguggaugaggcauucuguaaauccauguaugguaguuuuggcagaagaaauggaugcagggaaggcaaauccauauccagaauguguaauucaguaaucaugucccuuccaugauggaagcagaugaguguaaucaaccugccaccagguacuuagcugaucacccugggggauagugccauaucagggacucaguguuggucucuguugcuaacagauugaacacucagucauggcuguagucagaucagccucggugaguggaaguccaugaugcugagcccauauauaacaacccugccaccauggccacuuuauucaugagcucauugggcaguuaccugcaugguuggagaaaggggcugaacaggucauccuaucuacuugguuauuaaaauccucuucugcugaagucauucuuugguggcauucauaugagacacaaauauccucacauuuuucacccauucagaaagaucuguguauauaccucuuccacagaccguuuugucaccaauuuuccagucauguuccuuccaagucccugaccauccagcaaaccaguggccauagcucaugaauugauaacuaauuguacaucuaaccauuucuucuuccuaguaaagugaacaaccagguggucaaaguucugcccauugggaggauuucccuuuaccacuuucuuucagggcugucccauaacuuucuuucuguaaagaaaguuaccacuuucuuacagggcugcuguaguauugcaguuguccacuuccagauggcaccugcguaucaugcagaacuaucuguaaaccaguccugaguuuucuuucucugucagcugauugugggaaacuccccauaaggccauaguugcaggcuaaaaaagagaggguaguauaggccggacaugguggcucaugccuguaaucccagcucuuugggaggcugaggugggcaaaucacuugaggucagaaauucaagaccagccuggccaacauggcaaaaccccaucucuacuaaaaauacaauaauuagucaggcgugguggugugugccaugcgccuguaguccgagcuacucaggaggcugaggcacaagaauugcuugaacccgggagguggaaguugcagugagccgagacugcgccacugcacuccagcuugggugacagagugagccaaaaaaaaaaaaaaaaaguaguauagcaggaauggggacuguggccauguuccuuacuuguucauccaaggccuacuugagccugaucucauauauaccgcuuuaauuuggugauggaguccuacugcauaugcacaacuuuauggcuugguaggucaaauaauacccaguucaugauggguagcucaggucucaugguuacuuaguggcccaugauuaaguguucagucuauacuaagaccuaauagcaaaccaagaacuguuucccaaaagggguauaguuaucugugaacagcagcugggcuuugcuucaauaugcugaaggcaugugcugcaguucacauaugggagcuugccagugacuccaaauggcaucccugucugccauugacacuucaagcaccauuggauaugcuggaucauaugacccaaguggaaagcagcuugaguugcagccugaaccuucuguucugggaccuacucaaaacugucagguuuuugggucacuugguaaaugggccagaguaacacagccaaaugaagacuguguugccuccaaaauucagaggcuugcuagauguugugcuucuuucuggguuguaggaggggccagaugcaacaacuuauccuucaccuuagaagggguaucucuccauaccacugcaccccucaaaacuucacugagguagaagaccccugaguuuuugucagauuucccauccucugacaugcagcuaucuuaccaguaagucuaauguaguuguugcuucucgcucauuagguccaaucagcauaaugucaucaauguaauggaucugccuaauaucuuguaaaaggguggucaagauucuugugaagguggucaagauucuugugaagcaaauuaugacauaggacuagagagcugauauaccccugcagcaggacagugaaguguauugcuggccuugccugcugaaagcaaacaacuuacaguguacuuauggugggccuuaauaaagacagguauggagaaaagagcguuuguuagaaaacuagcugcauacagguaccaggggauauguuaauuugcucaagcaaugaaaccacauuuggcacagcagcuacaauuguagucaccaucuaguuaaguuuaugacaguccacuguccaggagccaucuuucuucuacacaggcugaauaggagauuugaaggaggauguggugguaaucaccaacucugcaucuuucaagucugaugguggcacuaaccucugcaauccuuccaggaauaugcaauauugcuuuugguuaccauuuuccuagguagaggucauucuaauggguuccaccuggcuuuuccaccacaacagccugcacuccacaggucaagagaccaaugagggauucugccaguuguugagcaugucuguuucaauuuuguacucuggaacagggaaaauaacccacaagaagguugcaaggacccacugggccuacaugagacagaccugagcuaaaacuccauugauuacuuaaccuuuauaaggcccuacuuugacugguggaccacaguuacauuuuaggucucacuggaauuagggucauuucagagcuaaugcucaguaguagauuauuuccuuuucuguaacgcacagucacccugcuaaaaggccacauagguccauuuggaggaggcugggaggaagauuaacaguauaaauacuuggcaguguccuuccucaaggggacccaggcuccccuucauucaaggggucugguuuuguaaacugguacaagucuggguauugauugagaagccgugagucuccaauuuaauaauucaaauuaaauuuuuuaucacuugaccuagaauucuuccacauauacagaucaaguaaaaaauuaguagacuucccauccauuucacuucuaggaacaucaugauaacuagccaacaccauaggucucuacgagucagacuauucugauuaaugcuuugacucugcuucaguuaugguacuaugaccaccuugucuuuggugauuaagugcccccacuugguuccugccauucuaggauccaacuacucccgucgcauuuagguuucccaauucaguggcagcaguucccacugaaaguucuagccuacagagaagaaugaucacauaauugaggaaagaagcuggggcugcccuuacaaauuuauuuuucauagucaugaugaaagaaaggugugucuucuggaaccucgcagguuuggugaguaggccuuaaaugaaucuguuaauacuugaacauuacaaugucccuaaagccucuuuuucuauggaucucuucuucuagaguauaccaaggcaguucuggcauuucaacuucaugucguuuaggccaccuuuugguccauguuucauccaaccauccaaacaaacuguuaaaagcucuuucuuaccccaugggcugcaacauuaaguguggaaccucugcuuaaugagcuccuaucgguaaauuuagccugauccaacuuuauauuuuuuccacuauuauccuauaccuuuaauaucuauucccauacauauuuccuugguuuuugucuguaaauuggagaaauuauguaguucuuuggaguauagcauaauuccucaugggucauacuucacacgucaccuuuaggagucugcugagacuugaacuaguuauagguguagaagcaaagagggguagugggagugaaucaggagugucuugcauggcagauaccucagaggagaccauugcaguuuucucaggccaaauagaguuaauaucagauauggauggaguggcugcuucuacuggcaaagaagacugagaauuuaagguuucaauuuugccagcuucaucaggaucuucccaaauaaccuccauuccaaauuuuagaauccuacuucuucuuggccaaugcccucacuuuauuagcagaugcccugugagguugugaauucaguucgcauuguaauucauccacuuaaaggaugagauucugaauuugguuucaucagucucagcucugcagcuauaggggguaagaguuuuuuuucagggcagucauagaaacuuuguggucguuuauaaaguauuuauacugauaauucagaucucugagcucauccuuucucuacuuuguucagcacaauuaggaucagccagccaaucucauauuuguuauuuugacaaaaauguucgaaauuauguauguggucacgugguaccuugccucuuaaaaguauuuuauuaggaauauccaguggugguauuuuguguaucucugcugccacaucacacuauagauuaucaguacugucuuuucuacuggaaagugagucauuagggccuuuaaaucuaaucagauuagagaaccaaccccagaaccaauuuagaaaacucauccuuaagauuauucucgcucccucucccucucccucucccucucccucuccccacggucucccucucccucuuuccacggucucccucucccucucuuuccacggucucccccugaugccgagccgaagcuggacuguacugcugccaucucggcucacugcaaccucccugccugauucuccugccucagccugccgagugccugccauugcaggcgggcgccgccacaccugacugguuuucguauuuuuuugguggagacaggguuucgcuguguuggcggggcuggucuccagcuccuaaccccgagugauccgccagccucggccuccggaggugccgggauugcagagggagucucguucacucaaugcucaauggugcccaggcuggagugcaguggcgugaucucggcuugcuacaaccuccaccuccuagcugccugccuuggccucccaaagagccgagauugcagccucugccugcccgccaccccgucugggaagugaggagcgucucugccuggccaccuauccucugggaugugaggagccccucugccuggcugcccagucuggaaagugaggagcgucucugcccggccgccaucccaucuaggaagugaggagugccucuucccggccgccaucccaucuaggaagcgaggagagucucugccuggccgcccaucaucugagauguggggagcgccucugccccgccaccccgucugggaugugaggagcgccucugcugggccgugaccccgucggggaggugaggagcgucucugcccagccgcccagucugagaagugaggagacccuccgccuggcaaccgccccgccugagaagugaggagccccuccgcccagccagccaccccgucugggaagugaggagcgucuccgcccggcagccaccccauccgggagggaggugggggucagcccccaccaggccagccgccccaucugggagggaggugggggggucagccccccgccuggccagcugccccguccgggaggugaggggugccucugcccagccgcccccacugggaagugaggagccccucugcccggccagccgccccauccgggagggaggugggggggucagccccccgcccggccagcugccccguccgggagggaggugggggagucagcccccccgcccggccggccgccccauccgggagggaggugggggggucagccucccgcccggccagccgccccgucugggagggaggugggggugucagccccccgcccggccagccgccucguccgggaggugaguggugccucugcccggccaccccuacugggaagugaggagucccucugcccggccagccgccccguccgggagggaaguggggggggucagccccccgccuggccagccgccccguccgggaggugaggggcgccucugcccggccgccccuacugggaagugaggagccccucugcccggccagccgccccguccgggagggaggugggggggucaguccccagcccggccagccgccccauccgggagggaggugggggggucagcccccgcccggucagccgccccguccgggagggaggugggggggucagccccccgcccggccagcugccccguccgggaggugaggggcgccucuguccggccgccccuacugggaagugaggagccccucugcccggccaccaccccaucugggagguguacccaacagcucauugagaacgggccaugaugacaauggcgguuuuguggaauagaaaggggugaaagguggggaaaagauugagaaaucggaugguugcugugucuguguggaaagaaguagacaugggagacuuuucauuuuguucuguacuaagaaaaauucuucugccuugggauccuguugaucugugaccuuacccccaaaccugugcucucugaaacaugugcuguguccacucaggguuaaauggauuaagggcggugcaagaugugcuuuguuaaacagaugcuugaaggcagcaugcucguuaagagucaucaccacucccuaaucucaaguacccagggacacaaacacugcggaaggcugcaggguccucugccuaggaaaaccagagaccuuuguucacuuguuucuuuguucacuuguuuaucugcugaccuucccuccacuauuguccuaugacccugccaaaucccccucugcgagaaacacccaagaaugaucaauuaaaaaaaaaaaaaaaaaaaaaaaaaaaaaagguuauucucuagaaucacucucaguacugaagucuguguuaggguucuccagaauaacagaauuaauagaauaugugaauauacauauacauacauacauacguauguguguguguguguguguguguguguguguguguguuuagagagagagagauugagaaagauugagauugauuuuaaggaacuuucucaaguaauuguagagacuagcaaguccaaaauuugcagggcaggcugacagacuggagacccauggaagaguuaauguggaguuaauuuugugguucgggucagaaagcaaucuggaggcaaaauucuuuuuucuuggggaaaugacaggcuuuuucucuuaaggccuucuacugauuagaugaggcccacccacauuauacagaauaauacucagagucuacuguuucaaauguuaaucuuaacuaaaaaaaugccuuugcaacaacauacagauugguguuuaaccaaaugucuggguaucauggccuagcuaacuugacacauaaaauuaaccauaacaguguguauguacauauuuaacaacaauccacugacuccugggaaaauaucuguguauauauauuuauauagauauuuuuccauaucuauauaugugucugagaaagauauauacaaggguuaaaauauuuucauuuauauauucuugguauguguauaacuaucuuaaaaugacccagauuuggugcuuuggaguguuugauguauuuuauuaagacuccucuguaugauaagcuuuauuuauaaacauagugcucguagugaguauucagcauaagcaggauaggccugaagaauucuaacuauugugcuuuuagaccugaccagaaacaguuucugccauccuaguuugugaaauagacauacuuaaaauuccucuuagaaaggaacaaaagcuccugguuaaaauaugauaaaauaacuacaucuuagcuugaaagaugggaacuauuauaugcugaucaguauguugggcuuuuuaauuuagauuuuuaaagagcgagaagaagauuugaggcguuugucucgcccauuggaauguucuuguuuccgaacaucuaucugggaugaaacccucuauaagguguguaugucucccugaguucccucauuuuaagagcaugaaaaaaaaccuagaaggauauuaacaaaccuaaaagauuuuaaacuauuucauagccaucuagauuuguuguacuaaaaagaaaaauaaucugcaacaaauuguuugaagaauaucaaacuuaacauuaagagacuuggguuuugaucuuauauuggguugacauagcuaccaagucacacugaauuagccaguuuggucaugauuaauuugauacuggucuuuguaauagcagagguuucacuuacuggccaucauccauuuugaccuguuguggucucaaugcugauuggaguuguaucuaguauucagguacuucuacaugauauaagcuagucugccuaaguuuggauggcaauaaaaugaaaauauuuagggaagagauuggagaaggagucuuagaaucagacauguuaugccuagcauaugguauaauagcuucaacuuucaugccaaauuggagacaagcauucuuucaaccagaaguacuguucccauugcuggaauggauaccacacugcuuacacuaauuauggagguuacaacaauagcuuuguuauggaugaagcugaaauuaccuuauuggcacauaggcuccuuauucugauuccucccuuucuccuacugaucuaguuauuugaaggacuagguccuuuuggauccuucuguaguuagcccuucccuucagacugcuucugguauccauugacaagucugacucuggguaggaaagcacccuucucugucacugguagcuacagccucaguaucaacagcaucugacaaguaucuacaaccagaagcacagaaaccugauguggcaaggagaaaaaccauuggacuuuuaaauagccauugcuuuuuuuuuuuuuaacuaauucauuuuccccaauauuauguugacccagccucacucuaauaacagaucauuuugagauaccugucuaggaaauacuguucuagauuaauaugggccgaauuucucucaaagccuuauucccauagaacagguaaccgugaauaaggauggacaugacgcacugauaagaaccaacugcggugugaaggauggcaauacauaacacgaccaaagacaauuggcuaaucacaacacugcugugagugacaaugucucugcugugguuagcuuuggugccuucuccaagguaaauucagcagugacauuaacaccgaccugggaacuuggaaccugaacccucaugccuaaguaauaaaacuaauuggaacagagacauggcacuucugucucuuacaucaauguugcauagagcuaacuuaaauuuuuauauuaaguuuuauucaacaagcacucuuuacauaccugcuugaugcuguuggauacacaaaugacuaagaccagguuccugcccucuuguaggggagagaagaacaaaguacaccuuaccagacaaauuggagugagagugaaggaaguauuauaaugaaaauacaaauaaaagagccuacaagaauagagggagagugugguuaauuucaacugcuuacauuagucauacuccuggaugaagucaguuuuaggcaaaaacacaguagaccauuuugaauucaauuggaucaauaauuuauauggauaacaacaaaccuuugggaaugauaaugccacuaguuucucuuuuaaugguauauuauucuauugaggggaggggccauuugucuauguggcucugcuacuuucauaaaauugauucuuagguauauguuaaauauagcauaauuagguucugaucuuuagagaaaucuacacuguuggacuuaaauauuugugacuagauuaggagcuuuuuaacaaaguagaucauauuuuucaacuuuuuuccuaaggcaacaugauggcauuaaauauuuguuugcuuucaauuaucaauggaaagaaguuucuccagcauuuuacaaaaguguuugaacuuaaaaaaaauucaacucaaggguaaaaaucagaugcuagcuucauuuucucauuucauuuguguuauaucauauuuaaugucaguauuuguuugggacuggauuaucaucauauuuugcuguccacauauuauaguguacuuacuaauuucaaaggucugggacugacuagcuguuaauaauaguacacuguguuucuguucuguuaggcuugguccagcauaguuuaucagcugauucccaauguucagcagcuggaaaugaaccuaaggaauuuugcugaaauuaucgaagcugaugaaguacuucuuuuugagagagcuacuuuucugguaagaacuuucugcuuugcagauguacuucacacuguacguucuuuguuuucagcaacagagaacagcaugucacuacuuucaggaagaaccuuuuucccucuugucaacuuuagcauguacagacuuauuuauaaaauaguauugucagcaagugaccugaaagaagcccuuugguguguagcucuuuggaaguuagugaaacuuagauuuuuccagguauguauuauuagagaguucagauuguuggcugggcaugggggcucacgccuguaaucccagcacuuugggaggccgaggcggguggaucaccugaggucgggaguuagagaccagccugaccaacauggagaaaccccgucucuaccaaaaaauacaaaauuagccagguguggugacgcaugccuauaaucccagcuacuugggaggcugaggcaggagaaucgcuugaacucgggaggcggagguuggggugagcugagaucaugccauugcacuccagccugggcaacaagagcgaaacuccaucucaaaaaaaaagagaguucagauuauuuaugcuaguaacuguucauuuauguuaaaggauuccuauuuccuguggacuuuuauuaugaaaugugggauauuuuccuuuugagaaaacucacauccuauccuuuucucuaaaagacucauugaaaacuuuuaauguagaagagauguuauggucaucucagugacauaggaguucacaugaagaaguggagagggaaagaggcauguugguauuuuuauuuuucuuguaaauugaacuuagcaacuauauuagagccuauuguuuguauaacccugaaagggggaugcaaaaaccaguauuguauuuguaaauacauuuuaaaaauagcaauaauagaaacuaaggugucacaacacacugcauaaguaauugcuaauuagccuugguaaauguaacucuaagagcaguucccaguaaauaauuuguuucugagcccugccaaugcuuggugauuuuagaaacaauucuuaaucucuaggggcuuguuuuccuucuacaaauaucuauaucauagauuuauugugcagaugaaaaugggacacaggaacauugagcacccagcaagccuuggcauuuaguugacaaacuauuaaauauugauuccuuuugcuacuauagcaacagggcagagaauccaaaguacaauuuuucccucuuccuuuguggaaauauuauuuguaaccccagagguauuugggagccaucuuucuagcugguauagauggggcaaggaguccuaauuagaguaucuuucugucucagcccacuggcagaggucacuugcuuggaauugugcuacccugagccuguuuuuccugcuagugugaguaacaaugagcaagaaagcuauucugucuugauguacguggcaggaccgaaaccugcuucagcaguauuccccuacuaugucugccacacaugguuguagagguuaaccuaauauaagcucccuguuccuuacuaauaguaacagguaguuuuuguuucucuugagaccaaguuuagaugugacugaacauuuucacugagcggggugaagucaagcaagggggauuuguucuuccacugguauagaaauuauguuuugaaauuuucacauugucucauggaauuucccugugaguuuucuucuggugagugacucaguuuugcuuccuacuagacacucugcaucuguauauucagccuauagguaauacuugugugguuuuauuaaaaucugaaaaaguuagaaaaaguauuuucagcugguguggguguccauccugaauaaguucauuuguaaauauuccucagggauuggaaucaaacaguuaagcuuuuaaaauacaauuccaaaagcuauuugguuagcuuggccuuuauuaaaauuaaacacaugaaguauaccucaagaacagcuaggaauuuuuauuuguuuuucuuuuugauugauacuuuuuaaaaaucgaagaccaucaugcgaaauauugaaauaaaaugaauauuuagugauuaaaguuagaaaaaauagcagugaaccaaaauaggcaauacguaaaugauuuaauuauaaccaaaugguacuagaugggccaucugaauggacguugaaaccacacagaauguugauaauauauaggacagaggaaaagagacaauaagccaggugccaagucuacccuaaaaaccagugaccaagggacugacaaaugucugcuuugaggaguagcagaggaugauguaacuauuuugcauggauucaaaggacaauauucuuuuucauagguaauuucucacuaucaguguaaagagcagcgugaugcccauagauuugagaaaauaagcaacauuauuaagcaguucaagcugagcugcagguaagagaucuaguaggaaugaucuguuuaucucuugaaaaaauuauugucauuuuuuagaaguucaaauaacuauaguuaacuguacuucuauauucagaauaguuccuucaaucaaagacaaagcuaaauucuaaggggccuccaguugacugaaaugcaggucguuguccuuuaaugcaaacucagcugguacagaaguguaugaaaaauauccaaacagaauauccuuuugagaugauugauacuauuugcgaagaaauaaauagaauauccaagggaguuuugaaaaagaaggaggaaggagaauuugccuuacugaauaccaaaauuuacucuaaaacuacuacuuuaaguauuuacuauuugacuuuaaaauagugagguacugauucagaaaugguacagaauggagagucuagaaauguuuaaucacauugugucagcuauuguuaaauaaaguuugaaucauagcauugugaaucuaggaaaaaggaauggccgaacaucauaauuuagcaaagauuuaauaaucaaaauccuuacccugauaacaguuugauuccagaacagcaggaauaaguuuacucucuuuaugccuuagcacacuuugagacuuucuggaauguuuaugcuaacauuuugaagaagaaauagccaaugacaagcaaauauaguugccuuguuuguuuucaaagaaaaaaagaucauuucuugaauuuaaauguaacugaaaaguuauauuaaucucaaugauaaggaaauuucaacuuaagaugcuuauuaaauauugaagaagucuucugaaacaugauuuuaaacauggaucuaggucuaagccaauuuucauuucacagucaguuucaagugcuuuagccagaugugguggcaugcaccucuguagucccagcuacuugggaggcuuaggcaggaggaucacuugagccaggauuucaaggcugcaaugagccaugauggcaccacugcacuccagccugggugacagagcgaaacucuugacucauaaaaaaauaaauugaaauuuaaaaaauuuuaaaagucaaguccuagcccacuuuugucccaguuacuuuucaaaacauguuaaauucaguauaagaguuuccuuggaaaaaguagaguuagugauuaacaaucuuaaugaaguggugaauugagguauagugcuauaccucaaucaucaaaagauguuuaacauaaauaagagcuuguuguaguguuauuauuucauucuuuaaccucucuucuucauuuuccuauagcaagcuggcugccucuuuccagaguauggaagucaggaacucuaacuucgcugcuuucauugacaucuuuacauccaacacuuaugugaugguugugaugucugauccguccauucguaaguuuaaacuuagcugaccuagguucaaagccacauacucuuuaaacaauugucccagagguaguacuuuauuagauacuuaaaagcuauuuuauaguggggaugguuacauaacaaugugagggcacuuaaucccaaugaacuguaugcuuaaaaauaauuuaaaugauaaacuuuguguuauguauacuuuaccacaauaagaaaaaguauuuuaguacuagugguaaauaguuuuuauuuaauagacuuauauuuuaaagcuuaaaaauaauuuagcuucuaggguauuacguuuuucuucaugggaacuucaaaaagcaagucacuaaauccaagaauuuuaaagaaaaaacccaaauacaugauuuaugcugcaucugguauagauuuuuaaaagacuagucaaucuaagcucuaaacuauuaaaugacaaaccauuucauaugucauugcauauuccuauguaccacauucucauauuucuguuaugggcaugaagggguguuugaugcuuccaugccauaauaaccaugacuaucacaaccauugaaauaaagguucuugcaguauuuucaggauggucccagaaauuuaaauuaaucucucauccauuggcuuuugcuacuuuagguuaauauuaaaauauaacauacauuuuugggguuuaugcuguuagcuccaaaccaaaagauuuuggaaauuuauuuuggaaauuuuguguuuagaauaugaauaaaucugcuuauucagaaaaauuaaaccuugauaacuugggaccuccuauuccuguauguucucugacauacauugagggauuuggcucucuuuuguuuauuuguuuuacuagucagacauuccuuuggcugcccauacuuaauucuguuggguguuuccgcccccgcccucagcuucugcagcuacucugaucaacauccgcaaugccaggaaacacuuugaaaagcuggaaagaguggauggaccaaagcagugucuucucaugcgcuaaacauugaugaauauuguuucacacaaaaauuaaaaguuuccuaauuaauguuguauucauauauguaggcucugaaauguugugaugcuuauugcuucuguauuucuucucuacucccuagucuuaauguuuaaccuugaaugcuauuaacuuaaauagccauugaggaguuagaagaugaauuguucaugaagucgguguuacauaaaaguaggugauauguaaguuuucugauaacaagguucuaauaguguuuaaauguacugguaaccugguuccaauaguuguguuugcccaagccuuucucggcaucaucuuguauuccuuaucagauaguaaguaaccuguaaguuuggaguauuacuguuuucucagcaugcauuaaaaauauuccuuaacuucaauuguaaauaaacuuuugguguuagggau

SEQ ID NO: 19209 - RNA, 3407 nt, Homo sapiens
gagcgcggaacugggggaggggaaggggcggggaucagcaggcggagcggcugccagaguugcugggagugcgcgcggucggaucacaaggcggcggcggaggaggcccagagaccggagcgcggagaccucagccagcggccuacgcccaggccuuucuccaccggaggaccagggaaccgcagucuucaucacagagguaccgugcuccgcgcuccccgccugacccggcccagcccgcugcggcggugccuccuuccuuccuccuucccucgcgcucucucuuucgcccgcccgcgccuucccugcccgccugcgucaccgcggccgccauggcugagaauggcgagagcagcggccccccgcgccccucccgcggcccugcugcggcccaaggcucggcugcugccccggcugagccuaaaaucaucaaagucacggugaagacucccaaagagaaagaggaguucgcggugcccgagaacagcucgguucagcaguuuaaggaagcgauuucgaaacgcuucaaaucccaaaccgaucagcuagugcugauuuuugccggaaaaaucuuaaaagaucaagauaccuugauccagcauggcauccaugaugggcugacuguucaccuugucaucaaaagccagaaccgaccucagggccaguccacgcagccuagcaaugccgcgggaacuaacacuaccucggcgucgacucccaggaguaacuccacaccuauuuccacaaauagcaacccguuuggguuggggagccugggaggacuugcaggccuuagcagccugggcuugagcucgaccaacuucucugagcuccagagccagaugcagcagcagcuuauggccagcccugagaugaugauccaaauaauggaaaaucccuuuguucagagcaugcuuucgaaucccgaucugaugaggcagcucauuauggcuaauccacagaugcagcaauugauucagagaaacccagaaaucagucaccugcucaacaacccagacauaaugaggcagacacucgaaauugccaggaauccagccaugaugcaagagaugaugagaaaucaagaccuggcucuuagcaaucuagaaagcaucccagguggcuauaaugcuuuacggcgcauguacacugacauucaagagccgaugcugaaugccgcacaagagcaguuuggggguaauccauuugccuccguggggaguaguuccuccucuggggaagguacgcagccuucccgcacagaaaaucgcgauccacuacccaauccaugggcaccaccgccagcuacccagaguucugcaacuaccagcacgaccacaagcacugguagugggucuggcaauaguuccagcaaugcuacugggaacaccguugcugccgcuaauuaugucgccagcaucuuuaguaccccaggcaugcagagccugcugcaacagauaacugaaaacccccagcugauucagaauaugcugucggcgcccuacaugagaagcaugaugcagucgcugagccagaauccagauuuggcugcacagaugaugcugaauagcccgcuguuuacugcaaauccucagcugcaggagcagaugcggccacagcucccagccuuccugcagcagaugcagaauccagacacacuaucagccaugucaaacccaagagcaaugcaggcuuuaaugcagauccagcaggggcuacagacauuagccacugaagcaccuggccugauuccgagcuucacuccaggugugggggugggggugcugggaaccgcuauaggcccuguaggcccagucacccccauaggccccauaggcccuauagucccuuuuacccccauaggccccauugggcccauaggacccacuggcccugcagcccccccuggcuccaccggcucugguggccccacggggccuacuguguccagcgcugcaccuagugaaaccacgaguccuacaucagaaucuggacccaaccagcaguucauucagcaaauggugcaggcccuggcuggagcaaaugcuccacagcugccgaauccagaagucagauuucagcaacaacuggaacagcucaacgcaaugggguucuuaaaccgugaagcaaacuugcaggcccuaauagcaacaggaggcgacaucaaugcagccauugaaaggcugcugggcucccagccaucguaaucacauuucuguaccuggaaaaaaaauguaucuuauuuuugauaauggcucuuaaaucuuuaaacacacacacaaaaucguucuuuacuuucauuuugauucuuuuaaaucugucuaguuguaagucuaauaugaugcauuuuaagauggagucccucccuccuacuucccucacucccuuucuccuuugcuuauuuuuccuaccuucccuuccucuugucuccccacucccucccucuuuguuuccuuccuuccuuauuuccuuuaguuuccuuccuuagccguuuugaguggugggaaucaaugcuguuucacucaaaaguguugcaugcaaacacuucucuuuauucugcauuuauugugauuuuuggaaacagguaucaaccuucacaguugggugaacaaguguuguccuacagauguccaauuuauuugcauuuuuaaacauuagccuaugauaguaauuuaauguagaaugaagauauuaaaaacagaagcaaauuauuugaagcucucuaauuugugguacgauauugcuuauugugacuuuggcauguauuuuugcuagcaaaaugcuguaagauuuauaccauugaucuuuuuugcuauauuuguauacaguacaguaagcacaauuggcacuguacaucuaaaaauauuacaguagaaucugaguguaauauguguaaccaaaaugagaaagaauacaagaaauguuucuggagcuaguuaugucucacaauuuuguagaaucuuacagcaucuuugauaaacuucucagugaaaauguuggcuaggcaaguucaguuaaaauauaguagaaauguuuauccugguaucucuaaguauacauuuaauuguacagaaaauuuacaguguaacauugugucaacauuugcagauugacuguauaugaccuuaaucuuugugcagccugaaggaucaguguaguaaugccaggaaagugcuuuuuaccuaagacuuccuucucagcuucucccauaaagagacccuaauaugcauuuugauuuguaauuggaaauguaacuuucacugaaagugucaugugauguuugcauuacuuuuaacugcuauguauaaaggaaagugugucuuuugacuucaucaguuauuucucuugugcacagagaaaaaugcauuaaaaaugacuaaaaaaaauaaaaaauuaaaaaauggaua

SEQ ID NO: 19210 - RNA, 3407 nt, Homo sapiens
uauccauuuuuuaauuuuuuauuuuuuuuagucauuuuuaaugcauuuuucucugugcacaagagaaauaacugaugaagucaaaagacacacuuuccuuuauacauagcaguuaaaaguaaugcaaacaucacaugacacuuucagugaaaguuacauuuccaauuacaaaucaaaaugcauauuagggucucuuuaugggagaagcugagaaggaagucuuagguaaaaagcacuuuccuggcauuacuacacugauccuucaggcugcacaaagauuaaggucauauacagucaaucugcaaauguugacacaauguuacacuguaaauuuucuguacaauuaaauguauacuuagagauaccaggauaaacauuucuacuauauuuuaacugaacuugccuagccaacauuuucacugagaaguuuaucaaagaugcuguaagauucuacaaaauugugagacauaacuagcuccagaaacauuucuuguauucuuucucauuuugguuacacauauuacacucagauucuacuguaauauuuuuagauguacagugccaauugugcuuacuguacuguauacaaauauagcaaaaaagaucaaugguauaaaucuuacagcauuuugcuagcaaaaauacaugccaaagucacaauaagcaauaucguaccacaaauuagagagcuucaaauaauuugcuucuguuuuuaauaucuucauucuacauuaaauuacuaucauaggcuaauguuuaaaaaugcaaauaaauuggacaucuguaggacaacacuuguucacccaacugugaagguugauaccuguuuccaaaaaucacaauaaaugcagaauaaagagaaguguuugcaugcaacacuuuugagugaaacagcauugauucccaccacucaaaacggcuaaggaaggaaacuaaaggaaauaaggaaggaaggaaacaaagagggagggaguggggagacaagaggaagggaagguaggaaaaauaagcaaaggagaaagggagugagggaaguaggagggagggacuccaucuuaaaaugcaucauauuagacuuacaacuagacagauuuaaaagaaucaaaaugaaaguaaagaacgauuuuguguguguguuuaaagauuuaagagccauuaucaaaaauaagauacauuuuuuuuccagguacagaaaugugauuacgauggcugggagcccagcagccuuucaauggcugcauugaugucgccuccuguugcuauuagggccugcaaguuugcuucacgguuuaagaaccccauugcguugagcuguuccaguuguugcugaaaucugacuucuggauucggcagcuguggagcauuugcuccagccagggccugcaccauuugcugaaugaacugcugguuggguccagauucugauguaggacucgugguuucacuaggugcagcgcuggacacaguaggccccguggggccaccagagccgguggagccagggggggcugcagggccaguggguccuaugggcccaauggggccuauggggguaaaagggacuauagggccuauggggccuaugggggugacugggccuacagggccuauagcgguucccagcacccccacccccacaccuggagugaagcucggaaucaggccaggugcuucaguggcuaaugucuguagccccugcuggaucugcauuaaagccugcauugcucuuggguuugacauggcugauagugugucuggauucugcaucugcugcaggaaggcugggagcuguggccgcaucugcuccugcagcugaggauuugcaguaaacagcgggcuauucagcaucaucugugcagccaaaucuggauucuggcucagcgacugcaucaugcuucucauguagggcgccgacagcauauucugaaucagcuggggguuuucaguuaucuguugcagcaggcucugcaugccugggguacuaaagaugcuggcgacauaauuagcggcagcaacgguguucccaguagcauugcuggaacuauugccagacccacuaccagugcuuguggucgugcugguaguugcagaacucuggguagcuggcgguggugcccauggauuggguaguggaucgcgauuuucugugcgggaaggcugcguaccuuccccagaggaggaacuacuccccacggaggcaaauggauuacccccaaacugcucuugugcggcauucagcaucggcucuugaaugucaguguacaugcgccguaaagcauuauagccaccugggaugcuuucuagauugcuaagagccaggucuugauuucucaucaucucuugcaucauggcuggauuccuggcaauuucgagugucugccucauuaugucuggguuguugagcaggugacugauuucuggguuucucugaaucaauugcugcaucuguggauuagccauaaugagcugccucaucagaucgggauucgaaagcaugcucugaacaaagggauuuuccauuauuuggaucaucaucucagggcuggccauaagcugcugcugcaucuggcucuggagcucagagaaguuggucgagcucaagcccaggcugcuaaggccugcaaguccucccaggcuccccaacccaaacggguugcuauuuguggaaauagguguggaguuacuccugggagucgacgccgagguaguguuaguucccgcggcauugcuaggcugcguggacuggcccugaggucgguucuggcuuuugaugacaaggugaacagucagcccaucauggaugccaugcuggaucaagguaucuugaucuuuuaagauuuuuccggcaaaaaucagcacuagcugaucgguuugggauuugaagcguuucgaaaucgcuuccuuaaacugcugaaccgagcuguucucgggcaccgcgaacuccucuuucucuuugggagucuucaccgugacuuugaugauuuuaggcucagccggggcagcagccgagccuugggccgcagcagggccgcgggaggggcgcggggggccgcugcucucgccauucucagccauggcggccgcggugacgcaggcgggcagggaaggcgcgggcgggcgaaagagagagcgcgagggaaggaggaaggaaggaggcaccgccgcagcgggcugggccgggucaggcggggagcgcggagcacgguaccucugugaugaagacugcgguucccugguccuccgguggagaaaggccugggcguaggccgcuggcugaggucuccgcgcuccggucucugggccuccuccgccgccgccuugugauccgaccgcgcgcacucccagcaacucuggcagccgcuccgccugcugauccccgccccuuccccucccccaguuccgcgcuc

SEQ ID NO: 19211 - RNA, 2077 nt, Homo sapiens
caggaagcuaagcuaggaaaagagcgaggagauugcaacagcagcaacggcuccuggaaguccaguguagcagaagggccgccaccgacaggaaggcagagggcuaacaagccuagugcuggggaugcugcugccuucccuuucgccugccucacaacccuucuagacguuuuccacgccuacagauccuacccuccuagcuuuugcaagcgcucacucuguuaguggccugcugauccuccuucgccacaggcuccuagcagaggcaacagugaggggucugauuugggcgcgggagguggcacugccaccucuccggcagugcgggaggugggcggcgcgggaggugggcccugggcugcggaaccggaggauggggguuggugggggccaggcgugaaaauucgggugggugcuggcguaagaaaugcaggagacugggaagggugauuugagggcugggggcaugaggaccugaagagcaccaggaugguauacaaagguggccagaaagggaaauagguuugugguuggagcccagaaggaaaauggaguuuaccaggaagagacaggaaagagaggugagcaccaggcgggaggcgagggaugggaauguacgggggaugaauaccacagagccauggggaggggacauggagacugcauguacagaaauggaaaaaugaggugggagcuaaaaaauggagaauguugggagaugugauaggauggcgacagagggucagggaauaggcaaaguagcccacuuccuuuugcugugcucucaacuaccacggccaccacaccuaccuguucucuaucucucuugugcagcuaaacaagccuggaaggaagacauuguaggcaggcauccaagagugucuugauaucuaacauugcuacuggacacacaugaacaacauggguggcaauguaccuggugcacagggacuucaugauagaagaaaaaaacucauacauuuaauguuuuucccuggccucucuccuuccccuccaaauaugaagacucuccuucacaaaaaggcagcugcaaagcugccaaccagggaagccauaggucaccacacuggaacuacaaacaugaggaagaaaaagacaucuccaaugaagccaagaggaaggucuuccucucaguccugcagacacaugguaggcugcagaauuucacauggauagaagaagggagaugagcccaucacccaguguaaagggaccguucugaaucaggugccuauauaucccuuucuuuaucugguaaaauauuauggaauugacuguguuuauggacuagaacuucacagagaugaaagaauuuuaaagcuuaaaauccuuccucauaaggugccauucucacaagucagggauuucugccuugcaaauaccauaauuggcaaagcagugaaacacauguuugagggagagcaugguucuauggauaaauggagggggaugguccuagcccaagcaccuaucaugaaagccugguuuuauauuacuuauaagaaagauccugucuugcacauguacuagcuacucgaugauuauaaggcaggugaccucugcaucaugccagaaucaagugugucucauccagugaagagggaaccagaaggauuuauagauagccugauagauaaacauguggaauauaccaaagaagacgacuccaaaaggacagacaaggucauccaccaaguuaaagccaaaccuguguauuucaucguuugaugaugacuuccauaucuaugucuacgauuuggugaaaauaucuuguuagaguaaaauuugcuacauuuguggagacaaauguguaauacgcaggcaaacaaaaaaaguacaacuuuucaggguguugaaagcucaaggguccugauaucacaauauuugccugcauaacuguuguuuuaugcugaaaaauacaaauuuauaugacauguauaagcaguuugucuuguugaaaagauuggguguguuuuguggauggggcaugaaaggaaggaacagcugucaauuccaauugugaacaaaguucagcuagaaucacaaucagccaucu

SEQ ID NO: 19212 - RNA, 49826 nt, Homo sapiens
ugcuuauagaaaagauggcuaauauuaaccuaaaagaaauaaccuuaauaguaggugugguuacugccugcuauuggaacagccucuuuugugguuuuguuuuugaugauguuucagcaauacuggauaacaaagacuugcauccaucuacaccuuuaaaaacuuuauuucaaaaugacuucuggggaaccccuaugucugagguaaguaauuacuuacauauuacuuguacaugucucagauuuugaaauauucugguauuuuauuacuucuaauucuuuaucaacauuaucaucacaacaguuacagauuuuuaacccuaaaauguuuauaugaaacguaacauguuuguaauaaauugaacaggaagcugaggaugaguacuuuaaagcaguacuugguuauuucuuugccuguguaccuuggcugcugcuuuuuuuuuuuuaacuuuuauuuuagauacagggcuacauaugcagauuugucacguggguauauugcguuaugcugauguuugggguaccaaucugucacccagacagcgaguauaguacccaauagguaguuuuggcuuaacuucuuaaaaauaauauauauuuaugugaaaaccaaauguauagggagagcaauagguguaauacaugccuguuucuugcuaauugacuuuauuucucuuuuuucugucuugugaguaaggcaaaagagaugugauauauuucaacauuuuaaaauauggcaacuucaauauaaauagauaagaauuuaagaguaaaaauaguaaguacacauauugccaauuucucuugcagaagaagugguuauuacaaauuuugaaucuuuguccuaucucuuacauaauaguuauuuagguuauauaucgagaacccaaaaguuuaguucaauaauuuaauauuuuauucauccauaugguucauuuuuaugaggguauuuuuacuguuuugaaggucacuguuaaacuguugggauuaaacccuuaucagcuugauaucauauagaauggauucuaauuuuaguuaugucauauauuaacugugugaaauaggugagaauacaucuuucagauggaaaguaauuuuccugaucuguaaaagaggauaauuccuuuccaaaauaaaaaagagaguaaugcuucaaauuucugggggauauugauuucuaaacuaaaauucuauauuaauaaaccuaaauuucccagguggaaaaguagaauaaaaacauaagucauuuaaggucucaaguaauaaaugaauuauuuuaucuacacuaccuggcacauagauauugaauaaauuguugaaacauaacauguaacucucugcaauguuaacaguauguuucucggucauuguggccucuuuccccauuccccaaauuuggaagccucucaagguuagggauggaaucuuucauuccucugaucacaagcacauauaauuauuuugucuuauuuaguaagaagacuuuauucgccuuuuuguucucacccaauucuagcuuuugaaaaaaaaucuuuugauaguaagggggaaaauauggcccuauuauacauuauucuacacagcuuguccuccucuauaccuaccuuugaucuccagagacccucagaacuauguguccauucccucaauuuaugcuaguaucuguuaugauuuuaaucauaauguugagguuuugaacugaugguuuagcuggccauauuaaauggucucauuuucuagauuaggcuauucuuguauugcuacgaagaaauaccugagacaggguaauauauaagaaaagagguuuuauuggcucacaguucugucagcuguacaagaagcauagcagcaucugcuucuggggaggccucaagaagcuugcagucauggcagaaggggaagcaggagcaggcacuucacauagcaaaagcaggagcaagaggaguacggugggaggugcuacacaguuuugaacagccagcucucucaagaacucauuguagcaaauacaguaccaagugggguggugcuaaaccauucauaggaaauccacccuaauaauccaaucauuucccaccaggccccacuuccaauauuggggauuacauuuugauauaagauuugggcagggacacacacauaucacauaccauggugucagugaucuguucagugauuuucucagcuuugcagauugaaaauuugauuuuguucagaaagcccguaagcagauggacuaagaaaaagacucauauguucugacagaauggaugaacaaacuagaauaacaguuuauuaagagugaagaguguaguuguguaguuuccuuguauuuucugaugggcauauucucucccugaaggcaaaugugacacuagggaaaauuauucuagguaauccuuaggugucauagguuucaugauaagccuggaauuagcauauucaaagaucuaaucauugauaucaucaaguuaugauagccuagaagauacguguccacacguaucuuacaagaauuuuuguaccaaugcaggucuuaaagacacauuuugggcuuaggacauucuccuaagccauauaaauacugccguauuaggggucuuuggacucaugugaaccucucaguguuuagauuaucucucuaguaggcuuaugcuauagauaugugcugcucuauuuauugauaauucauuggaucucaacccugacugccguauuagaauuugccuggggcauuuaaaagaaugaaaacauauuaccaaggcucuguccaaaccuguuauuucagauaaucucagagugggauauagguaucaauauuuuugucuuauuuuguguguguguguuuaguuguuuugugugggagggaggguggggcuuuuguuuaagucauccaggugauucuuugguauagccguggcugagagcgagggggcuguaaugagccaccuuccucuggcauuuggccuauaaaguaccuugugcuaagguaacuucugcaaauauuuuaucucauuaugauuuugccaucccuauauugagauucacauuaacagggaacuguuagcuuaaucauucauuacacuguuguguauuuuuauugccaacuaauaucaugaguaauuuuuucuuuaauaugcccgaaaguaauaaugaucugaauuguuuuauucauaauggcccuagguguuuucacaaaguaaacuuaguaucuaauaggcugaugaugauuugucacaguggaaucugaaauagaucccuaaugaguuaugugaauaauuauguuaauaauuggucugucuguuaguuggucaucaccuauaguauauguaugucuaauaguccuaacugaacaauuauguauacugcaauucaaaauacauauucccuucuacuuucugaguacauccuuucaccuagaauauauguuccauuguagccacagugacauuucagguacucgaaggguuucuagaguccuuuucuacuuucuaguacaaaucaugucaguucaguacagugccuuaaaaauagcuuuauaugccugagaugaaauuugaaggauguaaaggaauuaggcaagcaggaaagaacauucuaaguagauaguacauuauggaguauauagucaguacagagauacuaaaauguuccuaauuucaagaugagaaagauuuauucuuuguguuuccuaauguucccuacuaaggaugaacaggcuuaagucuacuugugugccagaaaguuacagcaaaauaugauaggaaguagaagagcaaagaagcugaauauggaugcguauauuagucuguuuugcguuaguauaaaggaauaccugguaauuuauaaggaaaauauguuuauuuggcauauggaucugcacacuguacaagcauggcaacagcgucuucuuggcuucuggugaggccuugaaaguuuuacuaccuguagaaggugaagggggagcagguguaucacauggugagagggggagcaagagggaggagaggagguuccaggcucuuuuaagcaaccagcuuucacaugaacucauuacaguggggaagacaccaaaccauucauaaaggacccaaccccaaugacccaaacaucucccaccaggcccaaccuucaacauuucaaccuccucauauuucagcaugagauuuggaggggacaaacauccaaacuaugucaaugcccuuuguauaaaacuacaaaaaauaacuuuauuaauauuuuauauauauucgaacuguguguuuuauucuuaaaucugguuugguuuuguguuagggaaagaaguauuucugauuaaauguaacuuauaauuuaaaaagagauucaguacuuuacaugaaauuuuauuuauuaccaaaggagaauaccacaagaauggugucuauuugcauauucuaagaaaguuuuuacucuuguauuacucucuguaauuugggaauuccuaguuuaauauauucagauuuacacauuauggagauguuuuucauaaaacagcuagacaguaccuuuuugagucaucacuauuuuaauugaacugguaagcauucuguucuuacauuuccuuuugaagaucuagccaguaguuacaugaacuuuuguauugcugauagauauggaggcaggcuuuggagagaauccugugcucuaacuugaccaaugccggcauugucuuuuuuuaaaauuguuauauugaagaggaauuaauugucaaauguccuuuuacuguuaguucucugaccacuguauauccaggaggaaauuaaccuuguuuguggccuaaggaaauagaaaaacacagauuauaaaacuguauuuuauuuuuguguuacucuuacgacauuucauauuuuauuguuauuucucaguaaaauguagauauuaauaucuuuaaugguaaaugcagugaugagcuuuuguacccuguuggaccaagguacuuuaauaaucacugaucguuuuuuccuuguaggagagaagccacaagucuuaccgucccuuaacaguauugacauuucgcuuaaauuauuuguuaagugaacuaaaaccaaugucauaucaucuccugaauaugauuuuucaugcugugguuagugugauauuucucaaaguaugcaaacuuuuucuggacaacaagaguagugugauugcuucuuuacuuuuugcagugcacccaauacauacagaagcaguaaguaaaacuaugaacugacuuuuuuucuuuuuccuuuuuuacaaauccugcacagugauuauaaugguauauauuuuuaagaaaaaaaaaaauuaacccugacuuuaauccaaauauuugaagacucuuaaauucguacaguuaauucuuaacuuccuaguaugcaaaguauaacuuccuacuguguaaaauuuuuaaauuuaacauuuuugaaacauaaacauuuuucauucaauaauauaaaaucuguuuagaaauauauacaugaauacaguucuucggucacuuuuuuuaaugaacaagauuucuaaggacuauuuaaaguuuauugucuuuuuaaacuuuauuuuucagauuuauuaugagauguaacuuuuugaauuuauggugccuuuguauauuaagaacauucguauuuuaagaaaauauguaagaaguacuuaaguucuagauauucuaccauauuuacgugguuaccauuggagaaagcuggauaaagaguacgcaagaucucucuuuacuaguuuugaaacuuccuauaagucuuauuauuauuucaaaauaaauuuaaaaaaguauaaacuguuaagagucacuaauaaaugucuauuuauguaagauucacaaauucaccaccugagggcacccaaagaauguuuaagaaacaaaugugcacuugaaaaguuacggaaauuaaaguauuuuuaccauuauauauaguaauuuuucaagauauucuuuauuaauaugaacccccuucauuuuuccuuucuagguaacaggaguuguuggaagagcagaacuuuugucaucuaucuuuuuucuagcagcuuuuuugucauauaccagaucaaaaggaccagacaauuccauaaguacaugucucacauuugauuuuuuuuuaauagugcuaaaacuugauuaaggaauuuuuauuuacuccaagugcuucuuauaacacauuauauaccacauuugggauuuaucuuuauguauuguuuuacuuuagcauaugugaaaauaugaaauauguaacauugcuaguauuuaggaaguuuguguauaauuuauauuuuuaucuugagcuaauagauuuuauaugaucuaauuuuaaaaaccaaauaaccuuagaauagaagaguuuuagaguuaguccuaguuccaucuucuguuaucuauuaaugauauagauuccaguauuucaguugucuuuggauaaauaacaccugguagacugucauauuguuuagguaagguuaaaagccuccuagaauauaacuuuuauuguguguugaucauagcuauuuauugagcuccuaccuugugaccuacccuggaaagugcuucgaauacauuagcucauuacucuuaaugauuccuggcauuaucagaaaacaaguucuaggcaauaaaaaugauuuuuuucaagugugggcacagugggcacaaaccuuuaaguucuuggggaaggggcagauuuucucacuguaguuccaagguacucaugacaagaagacuaguuuuauguguggaaacugagguucaagaaacacaugauuuagccaaacaucuuaagaguguucuggauuuguaauaguagguuugccuuugcugcucugcauaaugccuucuuaaaacaauuugaguggcagcauagcauaguacuuaaaagcauggacuaaagagucugguuucaaauucuagcuccacuguuuauuuacuaguuccauucaccguaacacaucaggcaaauuaaccucucugugcuuaacauuucuuuaucuguuaaaugugcauaauaauaguccccuaccugugcagugcaucauguaguaggagguacuuuuguaacuaauauggaauugcagaccaguauccucuuuaaguaccauccucaccaaagccugaaugguaaaguuagaaaauacuguggccuacaggauuauaaucaggcucucaauuaccugucuaaucauaucuucugccauucuugcccuagcugucuucacuauagcuagauagaccuucuugcuguucccaaacaggcagagcacccaccuuuauaccugcauuucccauuauugaauuuucuucccuuagaucuuuauguaguagucucauuuauacacuauucuauauuaucaggccucagcuuaaguauuucugucuuagaaaagccuucccuguucuaacugaaauagcuuuucaccauauuauaucuuuuguuccaaauacuuguacuuggugcuuuuuaaugauuucuuauucuuuacaauucuaauaucuugcuguauuuccuuaagaauuacuuauuugggcugggugcagugguucacgucuguaaucccagcacuuugggaggcugaggugggcggaucacauugucaggaguuugagaccagccugggccauuguggugaaauccugucucuacuaacaauacaaaaauuagccaggcguaguggcaggcaccugcagucccaccuacccggaagaaugaggcaggagaaucgcuugaaccugggaggcggagguagcagugagucgagaucacgccaccgcacuccagccugggagacagaauccaucucaaaacaaaaaaaaagaauuauuugaaauucuuggucugucucuuuaaguaauucugauuuaguaguauauguuauuauguuuguucucucuguuuuaugauuguuguauccuucagauauugaguuguuuuggcuugugagcucaagcacauguucuucuaaaguuauaaacuacugugccuguuaaagggaaaggccagggccacucuuuguucauccugugagucugaagggaugaaaggaauuauaaaccaggauauaaaguuccagguuccgcagagcugcuguggaucacuguuguuccuaccagugcuacuaggcacacucucuguuuucuuuaagagaaucagcauuaagaggccaguccaccaucccucugcauuuaaaugguagcucuguagaaguuacugccuaggagugauugguugguuuguaccuuuuaaaaaauaucuaccucuuaccccaucaagacuucugaagugcucugcuuuuaccucuggaacacccacuagccauuguagcuguggauuucugcaguaacagaguagagagugaucuacccaaagcagucaggagaggauaaaacaaaaguuaaaaaaaaaaauucccacucuugucuucugccuuaaauguaaucccucauaacacucacagaaccacacaugcuuaaaauaaccucgaaaugcuaagguuuuguguguguguguguuuuuuuuuuuuuuuuuacaaaaagugucuuagaaacuauuuuucccucuuacuuaccuuuuucuaggguugauuuuuggggaaaggaccaacaggucaagcuaguucaccauuugagcgaaacaaaaacagaguaauguuguuuucuauaccuuuaacuugcauuucugaaaauacucauuucuaaccugaaaauacauaguuuacauuuuucuuuuguuuauugcuuucucacaauagaacgugaccuuccuuaggguagguaacuuuuucuccauuuuuugaucuucauuuccuaaaaugauuccuaguuuacaguagguguuuaguaugaguauauugaagaaauaaguaagugaaugaauguaauguauuuuaaauucuaauugaaaaaauacugaaaucuaccuuggaccucucuuuauccucuuaaccacugugauacuuuguacucuuaguaauuuuacccuugaagccacaguuuccacaucaucuuuguauucccuauuguaucuaguauacacuggccugugcaaagguuuucaaguuguaauucuuuauauucauuuuaacuucuauauucaugucccauaccccuuuuguaaauauggugauccaauuucagggcuuuacacuugauuuuuuauuacuuuggguuucugcuuaaauauccacuuaaaugucaucaauaucacuacucaucuuucccagugguacuauuuuuauuucccuucauccucuuuuuuucucuauaacacuuaaacguugucaccauuugacagaguauauuauuacuugucucucuucccuauacccuugaaauguaguagauacuuaaaauaacuguuugaauaagugauugcugaagauguguuucuuuuacacauguagagucaguuuagaagccuguauuuugaaaugggaauagauuuaaguguccuuaacuuauuuaccagguguacuuguuuuggacaaaaucacauguaacuuuuaaccacagugaucugauuguaaaaucaaaguguuuauauaguaauauagucacuagaggcugaagaacugaagugauugguuucaguaagacauuugcauuuauuacucuuaguugagauggaauucaaguuuguaaaagguaaccauuugcuuguucuuccuugaaguagaaauacaaauuacugagaagcucugacuuuaaaaucagaagaaccauguuaaagucuuggucuccuuauucuuuguuacuuuuuaaaaaauaccucuacaauucuuuccucaucuuaaaaauggguaugauuacauccauguucuuacuccauagagugauuuuaagauucagugaaauaauauaugccaaacuggcuauauaaacuguuuaaaauaucugcuuucaaugcuauuauuuccuaugaguuuuuauguagacauacacauccauucauacuauucucuauauccuucauuugcuuagcuuacucucaccccuauuuauuucuacauccaccuuucccaauuuuuccauggcuucuauauccuucaagggccaacauuagguccagccuguuuuguaaauaaccaucuucugauuucuuccucuaugaaguucuuguugaauuuagcauuguaguguaauauaaucuauuauauuaguauugauguuuuggccuaaugagauuauaagauuuuuuuuuuuaaggaaagaguauuauuauacuuaguaucugcaauaguuucauggguuugguuuuuuucauuuauuucuuuguuuucgguuauuuuuuccuucaguaauuuuagucuacagaguacuuugaaaacaauuucaaaaauauguauuucuauauuaagcccagugacagaagaaaauguauucaugaauucuguucuuguuuauauuuagauuuaagucaauuauuugaauuuuugcuuuaguuaauagucuuaauaaaaaccgaggucacggccgggcacaguggcucacgccuguaaucccagcacuuugggaggccgaggugggcggaucagcugaggucgggaguucaagaccagccugaccaacauggagaaaucccgucucuacuaaaaaauacaaaauuagccaggcaugguggugcaugccuguaaucccagcuacucgggaggcugaggcaggagaaucacucaaagcugggaggcagagguugcagugaacugagaccgugccauugcacuguagccugggcaacaagagcgaaacucugucucaaaaaaaaaaaaaggaaaaaaaaaaaaaagaaaaccaaacugagaucacacagucauacuaccagaucuuuuuuuaaacuagaaaagaauuagagauuauaguuuuucauaagaaaacugaagccuggaaaagcugcccaaacucacaaguucacaaugaacuuucacaguucauuacucuuuagucaaauuacuacuacaugguagacacuuacuuaaaguugaugaaguauguuuuucauuuaaauagaacuuauagucuauugcaaauuuuuugaagaauaguauuuauuuaagugccuauuguuaaccacuuucauuuuaguuuuuauaaaaaugggcuagacacaauggcucgugccuggaaucccagcauggugggaggauggcuugaggccaagaguuugagaccagccugagcagcauagcaacacccugucucuacagaaauaaaaaaaaaaauagccagaugugguggcacaugccuguaguccuauuugggaggcugaggcagauggauugccugaacuucagaauucaaggcaguagugagcuauguucacaccacuguacuuacuccagccugagugacagggccagacccugucuuaaaaaaaaaaaaaaaguauaguacccuacuuuucccaauacuuuuaaauuuuaaguuuuuaauaauuuaucaguuuaauaagguauaaagauaucugucauaauuucaggaauuugucuucauuucagaaugauagcucauuaauuaugacacacaaaccuguaaauuucucuucuccaaauucaccacccuaccuuuguuuuaaaaguuaguauuugaugaaauaauuuuucucuuuguaaaaaauuucaguucaaauuauacauguugauauuuugcuuugaauguauaaaguaaaaauuauuaaauuuaaguauauuuuaaaguauguacuacuaauuaaugagaaauagcacucauauggauauggaaucacaaaguuuaaaauaucuuuuuuugauauuauaaaauuguuuucugaauuuuuauauuuucuguucucaaauugcaguauggacuccaauugccuugacaguguuuuuaguggcuguugcaacauuauguaaagaacaaggaauaacaguuguaggaauuugcuguguguaugaaguguuuauugcccaggggguaagccaaacuauaaauauauaaauuuucuuauugauauauuuuauccuaguugaaucaaauuuuauuuauuuuuauuuucuaaauguaucauuauguaaauuaauguguuuaccaauaauaauaccagaaaucauguuuuauccucauaccuacugaaaauuacuuaacauuuuaugauacuuuaaguguuuuaagaacuguguuuuaaauuucaauaauggaaucauuaggcagcuuggaaaaguaugcaauaguacuguacaguauaauucauuauuagguaagacuguugagcucaguuuuauucauuauuagcuucacacauucuuccacauuaauuuuauaauuauacuuguaucuaaucuugcaauuagaaaguacuacaguauugaaaacauugagauaugucguuauuuguugcuuaaaacauuucuuuucuuuuucaguauacuuugccauuacuauguacuacugcuggacaguuucuccguggaaaggguagcauuccauuuucuaugcugcagacacuaguaaaacucauugucuugauguucaguacauuauuacuuguugugauuagaguccagguuauucaaucccaacuuccaguauucaccagguaugaaauucugguucuuuguuuucuccauucuuuuuuuuaacuuuggauuuuaaugaucauaaauguugaagaaaguauuuuauuuuguuuuuuaacaguuuuauuaagcuauaauuaacauuuuuuaaacugcauauauuuaaaauuuauguacugauaauuuuugacauauguauacacccuuaaagcccccacaauaaagauaaugaaugacccaucccaaacugguuaaguguuaagguuaguguuaauuuagucuccuauauccuuagugauuuuugucuacucauucugucaguuacugagagauguugaaaucucugacuauacuuguagauuucgcuauuucuccuugcacuucugucgguuuuuguuuugugcguuuuugaagcucugcuauuaggugcguaaacaacuaggauugucaagucaucuugaggaacugaucccuuugucauuauuaaaugagcuucaucccuaguaauagucuuuacucagaaauucacuuuuucuuaucacagcugucuuucguuaguguuaggugguguaucuuuuuccaucuuuuuacuuuuuaccugucuaugcuuuuauuuauaaagaggauuucuuguagcauccauacaauuuggucuucuuuuguuguuuggucagauaaucugacuuuuagaugggauauaucauugauuuauauuuaauuugauaauugauauaguuugauggaaaucuuucaucuugauaaaauuguuuucucuuugucucaucuaaucuuuguuccuuuuuucucucuuuccaccuuccuuuggauucuuuuuuuaauauuucauuuuaucuccuuguuggcuuauuagcuauaaaucuuuguuguuuuaguguugcuuuagggauuuuagaacauccucugcuuaucacaguuuaccuucaaggaauauucuaauuucgaauauauauauaaaauaaaaauaucaguguauauauaguauaaauauauguaauauacauuuuauauauguaagaacuuaacuuuugugcaguuugcauauguuuuccuugaacauacauugcuuuaaacaauugucuuggaggaauuuaaauaauaaaaaaguauuuuacauuaaccaugagucaccauuuccaguguucuuuauuccuuuguuggauaagauuuuuaucugguacuauuuuuccuuuuaccugaaggaauuucuuuagcacuucugauuaaaaauaucagguuuugaaagauaccuucucuggguggagaauucuacacuggcuuuuucauucaguauucugaaaauguaaaucuacugucuuccggcuuuuauuguuuucagugggaaaaccucuaucauccuuaucucuuuaugcuaauguauguuauguguauuuuuucuaugccuguuuuuaauauuuccuguuuaccauuguuucuuauguauuuauguuucuugugcuuagguaaacugagcuucuugaaaucuguagauuuuaauuuuguaaaaauuuuggaaaauguuuagcuagucuucaaauauuuuugccaucuuuucuuuuuccuauuuuucuuguaugucaguuaaguauauuuaaguuucuugaaguuguugcacugaugcucuguuuuuuucccucaaucuuuuaccauuuuuaguuuggauaguuucuuuugcuauaucaaguucacuaaucuuuuuucugcaauaucuaaucuacucuuaauuucaucuaguuguuucuuaccucugaaucuguuuucaucuucagaaggaagucugauuugaguauucuuuuauaucuucuauaucucuacauguucuauugcuuuaauguccuugccuacuaauucuaucaucugugucauuccuuggucaguuuuuauugaauaaauuuucucuucauuauagguuguauuucucugcuucuuugcaugucgggaaauuguugaacagauaccauuugugaauuuuaccuuaauguauucuauaaauuuugaguuuuauucuggaaugcauuuaaguuacuuggaaaauguuuuaucuuucagucuugcuuuuuuucuuucuucuuuuuuuuuuugagauuagaguuucgcuuuuguugcccagggcuggagugcaauggcgcaaucucggcucaccgcaaccuccaccucccagguuuaaacgauucuccugccucagccuacugaguagcugagacuacaggcaugcgccaccacgcccagcugauuuuuguauuuuuaguagagauaggguuucuccauauuggucaggcugaucuugaacuccugaccugaggugauccgcccaccucagccucccaaagugcugagauuacaggcaugagccacugcacccagcccagucuugcuuuuaagcuuuguuuugugggaccacaauagcauuuaggauaagacuaauuucacuucacuacugaugcaagaucuuuuugacuauuggaugugaacuguaaauuacgaagauuuccacacugucugccgaggaacuauuccuggcucgguauauuugggaauuuuuagcucuaaugcauucaggagguuuuugccugauuguauuaguuuucugaaggcugcuguaacaaauaacuacaaacugaauagcuuaaaauaacagaaauuuguucccucacaguucaagaggccagaaauaccaaaucaguaugucagcacaauugguuccuucuggaggcucuaaggaagaauuuguuccauaacugucugcugguuucuggugguugcuagcagucuuuggcauuccuuggcuuguaacuccaucacuucaaucuacuuugucuucacauugccuucuuuuccaguguaucucuuucuucucuuuuuaugaggaccccagucguuggauuuagggcccacccuaacccagugugaccucaucuuaacuaauauuggcagaaacuauuuucaaauaacaccacauucugaaguuaggguagacaugaauuuuuuagaaauaugauucaacccacuacaccgaccauggguauuuccucacauauaugugcugauuugaacucaucaaaaucaggccaggugugguggcucacgccuguaaucccagcacuuugagaggcugaggugaucacuugaggucaggaguuugagaccagccuggccaacauggggaaaccucaucucuacuaaaaauagaaaaauuagccagcgugguggugcacgacugaucccaccuacucgggaggcugaggcacaagaaucguuugaaccugggaggcagagguugcagugagccaagacugugccauggcauuccagccugggugacaaagcaagacuuugucucaaaaaaaaaaaaaaaaaaaaaagaacucaucaauauugaaaacuggagagagacccucuacagaugucucagguucucuuucucagcagcuuucuucugucuggauucuuccucacuaauucuagcccccgcacuccuagggcucccaacuucauacucucaauucaguauaccacugggcucagccuggguucccucuugcuguuuuacugacuaaaaacucuauccagguacuaaacucuuuccagaaaaagcuccccuuauuuguuuuucuucucucagguauuacaguccuuuuucaccuuaugcucaguauguuuaaaaaaaaauuauaccucuuauacaguuuuuuaguuguuuaaggcuagaaagcagaagauauagugaauuuuaagucugcauaucauauuuaucuacuuuaacauuuagccuuuuuucauuucaccugacuuggcuaaaauuuaaaaugaaauuuauacuauuucccuguucaauuuuaaguuauugccauuacaugcaagaacuuuuauuuuuaacaaaaggccaacauguuauucacauuauguuacaugaucgugcauugcuggcgcuggguagaauaaauuuuauucagauaauuuuuaaacccaaaacugugugauauuuucacauaacuauccucccuagcauuuuuuuuucuuuaaagaauaauuacuuguuaauauccuggauuuuuaucucugagucuagccgugcuaaaaugaacuugugcagauauuacaguauuggaaauagagaagauugaauuguuuauauaagacuucggauuuccuucuuaguuucauugguuuucuguuauuccuuuuagagaauuugaaucaacuauuuucuauuucccuaucuacagucuaaaaauauaguuuauaggugugaauuuauguauguguuaguagguaugaauauggugcuuauagcauauaaauauuuuccaaauaaagcauuucaacauuguguauauauguuuguguauguguguauaaauucuauuacccucugaaguuggauuuaauauaauuugauuuauuuugacauuaacucuuucuuuaaaucagcuauccuaaauaaacuguaauuuuuaaaacuaaauuccgaauagugaauuauaggcaaaaagauaacuuuuuauucaguucugcugguuauuuugagaauucaaguucagacucaagauuuauuauuuuaucugaaaaauaauauguaaguugugagauuccguaugaaaauuuugaaaugauauuauuuguucaaauaguauuuauuuuuaucaaauauuugauauguuuucagaaaaucaagucaaauaaguggcaguaguugauuuuccuuggcuuacucaucuuaaaaugagaaaaugggucuuuuaaguacuauauauuauaaccaauauaauuuagaacacagacuaaacuaaugaaauguauauauguuguggccugggaaaagauaaacuaugauauaagcuuauauuaguauuuacuaagagagaaaguagaacacaaauucuuacacaggccuacacaguuacuacuuuguacuagaaauuugguuuuuagcuuccuaggagucaaagaaaagagggaaggaagcuaggugauaugguuuucucucuccaugacagaagaaaaauauacgaauuuuuuccaggaagcauaauuuuuaauuagcauuuagcucuaaaagaaaugucucauguaggaaagcauuggugaguguuuucaaaagugauucauacaacacauacaaccauaaaucuuauacaacuuuuuguuacuacuuuuaaucaaaagguuuaauggaacacuuuugcaguguuguaauauuauaggaugcaugucugaauuauucuaauaauaaacagaaauggaugaccugcuugccuuucaaacaguccuucauaaauaucacuucucugaaguagauguuucauaaaguuuugauaguuugaacucuagcaagagucugagguacacauaacauuugucugugucuucuguuuaauaagaugauauauaaaauguuuauuguuuaguguuuuacuuauguaaauaauucuguacuuuaaaaguuuuauuuguaaucuuuuuuuuaauccuuuauacagguuugauaacccagcugcuguaagcccaacuccuacaaggcaacuaacuuuuaacuaccuccuuccugugaaugcuugguuguuauuaaauccuucagagcucugcugugauuggaccaugggaacaauaccacuuauagagucauuacuagauauucgaaaucuggccacauuuacuuucuuuuguuuucuggggauguugggaguauucaguaucagauacucuggugauuccuccaagacuguuuuaaugguaagaaacuuuucuuaacuuccaaaugauguuaacauucaguugaauaaguaagaaacuaccuuuaauucagcaaaagcaucuuuuuagaagcacuccuuucuuuguucaacggcaucccaauuuauaaacguauuugaguuuaucccaaaauucucaguuaauuugcaggcauaauuugacauauguucagcacauaaaauauuuguuaccuuuauccaacuagauuauacacuuuuugaagaaauugauuauauuguauauuauuuguuuucuuggcacagagaagaacaucauauaagauauacaacuagaaauauagagcuuuucaguucucaugagcaaggugguuuuuauuacucccuuagauagcuuucacuauguucggagaacucugauuauuugaacaguuuuuuuuuuuuuuuuuugguggugguuuuucuguacuguuuuucuucuuauuuucuuacccugugucacuucauacucauaagaguuauguuuucucucccuuuuaauuauugaagacaggcugggugcguugguucuugccuguaaucccagcacuuugagaggccaaggcagguggaucauuugaggccaggaguuugagaccagccuggucaaccuggugaaacucucgucucuacuaaaaauacaaaaauuagcuggguagcugggugugguagugggugccuguaaucccagccacucaggaggcggaggcacaagaaucacuugaaccagggagguggaauuugcagugagcugagauugcgccacugcacucuagucugggcgacagagcaauacucuuucucaaaaaaacaaaaauaaaaauaaaaguuuauugaagacaauaguacauuuucucaggcauuuauuauaugucagaaaguauguuuaaugaauugcagauacauaauuuuuugcuguagcugcuagauugauuuauucauucaauaaaaacuuagacuuuacccuuuguacagugcagcauuuuaggugcugagguuaugauaguaaauacacaguucacguuuccagagaacuuacacaguucacguuuccagagaacuuacauucuagagaaauuuggaugucugagauacagaguagauuuaaagauuguguugucuauuauccuugaacauguugaguuugcauuacuguugaaacauccuguuggacauuuugaacagcacuuuaugucuggaguucauagaagauaguuaaguuacacauagaaaucuuauccauuaacauagaggugguaauugaaaccaggauguagauaaggugaaauguagaugagguuauagagcagccuuucucaacugggguuuugucaauucugucaaagaugguagcuguuaacauucuagaugcacagaaguucacucauacucauaauggaagccuuaggguauuuggucuuaauucuccccagaaaacaguugagugggcuaaauacagugaaaagagaagauaccuacuacuaggucuugagaaacuccuauauuuagauguugaagagaaggauccugaauagaagacauaucgaaugaagagaaaaguaggaaaguguauuacagaccaaaugguuaacacuaacagaugcucuugagggggaaagugagaucuagaaucuguuggauuggacuucuuuuagucuguagguacuuaaaugaaauuuguuuaugugcagugagugauuugaugaggaagugaagagagcuaguauagaccuguaggaauaauuuaacuuugacuguuucaaaggaugggauaaacuugauuaauuccucccuaagggaagacuaugcuggucaggcaaugguuucaaguauaacaaacugcuuaucuuauguagggccuggggaagcauugagaucuggcauugguagaccuucagagguaggagggagcaaugucagggagagacuguugauugguuggcauauagaagcauuuuuauuggcguacucagcuacucagcugacuuuuuugaaugcggauaucccugauggguuggcuugcaggaacauauuuauuaagcugaaauguugauugguuaagugguagacuuaaguugauuaguuaagugggcuacuugauacuauggcaacaaaaucuuuuccuaagaucaugagaacuuguuuuguaccugagguauguaacgaauagggaagguagcuuaaaaaauguauuguuaaagauguuuaaggcuggagagacaagagcauguuuaaauauagauaggaagaauacaguugauuagaaagugguuaauaaauuagagaagggauaauuguuagugaaguuuaugaggagcaggagauagggagcacagguuuggccugagauagaagagacaccccuuauguuacaagaagaaaugaauguggauguugguagguuuaguagcaggaaauuaaagaaauucuuguuuuauggcuucagcuuucauuguaaauuaggaaauguaguugccugcuaaaacugacaugggucaaaaauuugagaaaaguagugaagauucaaagcagucaagaagaguggaaggaacuuuccagagaaaccuagaaaucccaaacagucuuaaggauaaauuugaacuuggugcucaugcuuuuaugacaguauuaaucuguucagcuuugggacuuucucuagcagugcguugccacucugguaaauacagacaaaagaaauaaacgguagaauacaucuaaagcuggaguuuuccuaaaagaaagguuaaaaaaaaaggagagguaggggaauuaagguuucagcaaauaaaauaaugguguauguaauguaagcugaauuuuaaauguauauaaaaauggaacagcuguggccuuaagcauaacucuauuuucaguauaguccuaauaaaggugcuauuuuuuuuauggugauguuuucugaagaucucuggaagggauaaguagaacaaaggagcaccuaccagauaccauguuaagcacuuauuagauaagaugucauauauaugucaacagcauaauguaaguuguuauuaauccccauuuuauuuguaaagaacuaacuggguucaaucgcucaugccuguaaucccagugccuugggaggcagaaaugggaagaucacuggaggccaggaguuugggacaaaccugggcaagacagugagaucccaccucuaaaaaaaauuuuuaaauuagccaggcaugguagugcauaccuguaguccuagguguuugggaggcugaggcaggaggauugcuugagcccaagaguucaagaaugcaguagacuaugaucaugccacuauacucuauccuggaugacagacaagacccugucagaaaaaaaaaaaaaggaagaagaaaaaaagaaagaaagacucuggaggugacugagugguuugccguauguaggaaaugagaaguaaagcagauuugucucgaacucuuugcucuuucuacuaauauccuaacauuuaaggacaguuuaugcuacuggaagaaggaaauuacaagagagugauaguuaacuagguuggcauacauuauuagagagcauauuaggaccugugaauaaguuaaucauuagagacauuucuuaucccagaaccuauagauuuuuccugagagauuuuuuuuguuuuguauaguuuaugcaucagucuacaauacacuuuugagugaauuuaacacuuaauucccucaagugaaauugccuuggggcggccaugaauuaauagguauaauuuuuuuuucaaugaacuacauacauauucaggaacuuuucuuuaucuguuucacauuuuuugcugauuauuuuugucaagcaucucugggaaauggaaagugaauucuaugcacucuuaguuauucuuaccuuuuugauuuaaaaaaacugaagugucagaccuauaaauugguaugauggugaccaguuugaugguagugauuuuccucagauucaguguugccuuauuacaaaucauuaaugugugaacauuuguggagaguauucuuuucaauguauacaccucuauauuucacaaauuaagucaaauagaaaaaaaggacauucuuucaccuuagcccauuagaagagucucaaacuugugaagcuaaagguuuaacuuguuuauucaauuaaguacuguaaaacaaaucgggguaacaaaauauggaagcagauguccauagaaacagauuuccuaauaacgaccaaacuuauuuccuucacaagcuauuuaugugcuaguuuuuuauggguguauaauguggaaaccacaugucaucccauuuucaaaaugguaagaaaucuaaacauuuuuaugauguuucauuucaauguucaguguuauauuaauaauuuuagaaauucuuguagaaugaaagacuguugauuuaaaggggggcaguuuuauuuuuaugcauacacuaagcuucuaguuaaauacauuuaaccuuucaggauguuaugugaaguaaugcuaagguacaguagucugcuaucuugucugaacgacaccugauuucauucccucaguuuccaauaucaugugguuucuuaaaguaguaaaguuguaaaaacugacauguuuagcuuuuuuuuaaucagcauuugugguuuuguuuuguugaaaaaccuauuagcauauuucauuaucaucuuauuuuuaccacacgcacauaaguuagauguguaaaauuuuuauuuauuuaauuuguauuccuccuaacugaaguuuuaugccuuuugaccaaccucuccccaaccuucucccuccaacccuggugaccaccauguacuguacuucugugaguucaacuuuuacaaauucuacauacaagugagaucaugcguuguuugucuuucuguggcuggcuuauuucucuuaacaugguguccuccggguuuauccaugucagaaaugacaggauuuccuucuguuuuaaggcuaaauaguauucuaaaguguauauguaccacauuuuuuucauccaguaaucuguugauggauacuuagguuguucccauaucuuggcuauuguaaauugaauaaugcugcaaugaacaggggaggucagaucucucuucaacauacugacuucauuuccuuuggaucuauacccaguagugaggaugcugggucacaugguaguucuauuuuuaauuuuuugagaagccuuccuacuguuugcuuaauggcaaugcuaauuuacaucccaccaacagugugcaaguguuuccuuuacguucuugccaacauuuguuaucuuuugacuuuuugauaauagccauucuuacaggugugcgaugacaucucauugugguuuuaauuuucacuuccuuaaugauagugauguugaacauuuauauacuugauggccauuggcauguugucuucugaggaauaucuauuuagcuacuuugcccauuuuuuaaauuggguuguuuucuuaugauuguuugaguguguuauuuuagauagaauuucaaaaaguacuuccacuauuuaacuggaugaaccuuuauuguuuaauuuuugcuuaaagaugugaauauuuacauuuauuaaaguuuuuauauuuuacuaugcaagcauauucuuuacagaaaaccagugagauauagcuaauuaugcuucucaaauuuaaaaugcuguaaugguuuagauuuuaauuucaaggaguaaucacucccaaacacaccuagaaaucuuguuuucaaaguucauagauauccucuaauuuuaacuuuuagaauucaagauuuccauuucaccuugcuuacguacauccugauguuuguuaaugucuaaguugccuucuuuauguuuaaauuaauauucuucacaguauuauuaaaaauaguuuagcaguacacuauccagguuaaaugauaaaauauuuggauucaaguaucagaugcccauauauuucuuaauuuauuauaaauuauuuuaaauuuauuauaaauuauuaaaucuucuuuuuuuuuuuguaggcgcuuuguuuaauggcauuaccauuuauuccugcaucgaaccuuuuuuuuccaguuggauuuguuguugccgagcgaguauuauauguucccagcaugggguucuguauuuugguagcccauggauggcagaaaauaucaacaaaaaggugaauuuaaaugucaguucauguaaugcuuacuauggaauuaagugugacacauuuuaaaauuuaaauauuuaguucaguuuucuaagucaugcuuuuguaucuuuugguuuuucaucuccauagucuccucauuugucuuguaagucaaguuaggaaagcuccauggcaccuacuuauucuguguucuucccuauauuuauguaauuugauuuuacagccugagacagaacaaacuuugagucagauccaaaugaaaacaaggauguuacugagaauaaagucucaaaugaccauugccacuuccauauucagugaacuaagauaauagucauccuacuuaagugagucauauugaguuaauauauauaaaaugcauauaguaagcaaucuguaauuucuugcuaucaucacuaucuucauuauaaucuuuguauccuaguugccucaaacuaacaguuaaggaacagcauagucacacuguauauaugcuuaggaacuauaauuguuauagguauuaucucauuguauacuuaugcuguggcacuaaaauuaucaaaucaagcaaauuguuaaaggucaaguaauacuaauguaauaauauugaguuugcaacuugaaaaagaaauagucacuucuuucacuuuccuauuuuccagucaucccucaccccacagaauucugacuucucuccacuucacccuuaagcauauaacaaagugccuccuaguagcuaaacuaagucaacucuuuuaauuuaaaguuuauuucccuagugucuguaaaaaguauuuguccugauuaauucuucuggcugcaccugcucuuugaauauuuacauuuuucaaagucuuauggccacuuuuuucacaccgcauguguuccacagauaaucucaucccugucugcaauauuuaacugccaucuaccaaaccuguucucuuagcuuuuacccauauauccauuuauaaucacuacccauuuuugaaugccugccauguaccaagggccaugauagacacuuuagauuucuuuucucauuuaaucuugacacuucuuaagucugcuuugcagaugugaacauugaagccauauagguuauccaagaucacacagcuaguaaauaacagucuuguuucagauucacaucugacugcuuccaaugaccauguucuuucacauccauacuuguguguucuaguuaaguggaucuaucaaaaugaaauaaauuaaaccauguuacaggaacaaaaacacagacucagagacuauuaauacuaaacaagaucauaaagauuauaggugaagaauugagcccucaaauaauuaaccuaaaguuguauaaguaauuugccucuguuuaaugaagagucacuuuuacuaugccuguuaauagacaauucuagcuuuacaauagagaaauaaaccaaaaauaucaugauagucuugguauaaauuguaaguaaaacauuuucaaaugugaucagugauaagguugaccccuuucuaaacucaauuaagaauacucaguuguagaaaauggcacaaaggacuguaaguguaaaaagucacguuuaaaaauugguuuuuuccauuuuuuaucauuuauuuuaaacagagcuuuugaaauauagccaauauuagcauauauaauguaauugacuggaaggucauauucacaguauuuaauuuuuuugguguuguauccucuaaaguuggguguucauuagaaugaauuagaauaaauuaacauaugauauuuuaggagcauuuaagauacuucuuaccucuguucuaaaagguaaaaugcuuuuggugaugaagacaauuuuuuuuguuuugcuuuuuuucucuuaaacaguguauuuaaaaagcuauccuggauuugucugucuauggugauacucacucauuccuuaaaaacauuccacagaaauugggauugggagucugaauauacauuguuuaugucagccuugaagguaaaguguuguucagaaugacaggaaaguaugucaucagugauuucuuggaacaauuucuaagcuguuuuaacuuuguuuuuaauuagacauuuaacagucaauauuaaguacuuuacuaaaagauuaaugaaaauaauuuguuguuuaacauaaugccauaaccaaaugcucugaauaauacuuagcuauauguccaaagcauauaugauaauucccuaaaugcuauacaguuauuggaagcucaaaugacacaauguuuaaaucagaauacuauauuucauugguucuaaaggugcuuauauuuuuccuuuuuuauaucucugaaaucaaauaagucuuacagugaaaagcaucuuaaauuaguggccuuuuuucucucuuaaugguacuuaaaauaaugauguuauaaucgauggcaucaauucaguaaaauaaaauguacagcgaaaaaaaaaaggcacccaaugauguggaagauaaccagugguuacaauacuaucagaaagauaagaauuggcagaaagaaaggaucaagauuucuauagaauggacauuauaaaucggaaaaaggucuuuuaaaaaacaaaaauuuguuuucuuuaaagguuauccgcaaagauuuuuucaagcucucccuuaccaguaccccucuucagauaucugaauuuuuacuuccuuuggacuguuucuuaacucuucauuacuuagcuuuauuggauugcugcuucauuccaguggucugugugauuucuugguuccccaucucccuaagaucagaugagucucuucuuauacaacucaguagcucuacucucucucccaacucagaagucugccaacaagugagaccucauuaccaugcuuauuaauccauacuccuaggauaccaguggagccccauaauuuuccagaauuuugcuuauacucacucccaggacagugguuggaaccuauagccacaacgacugcaauuaguuccuuggcuaggugucaucuaucugcaagaacacuacggcaaucugcgaacucugaaagcacagauugacucagagcuuuaaucucagguuuuccauuaccauaauggacuacauaaauaauuuuaaauaugucaagucuaaaaauaagucaucagugcaacauuuaaacauauucucauguuccagugcuuuugcuccuaaaaauacaaauggcagagcagaaguuuugaaacaccacugugcuuucaucaaauaacauuuucaguaaaauguuaauauauaacgugaaugaaauaagacacugcugugguuuuaguauguugguguucagguucagggagaguaaauuuggugaagcagucuuuauuugacuccugugucauccccagagacauuuccauagaacauuauuuucuuaauaguauaccaaacaaauaucuguaugaacuggagucauuuuuuuuuaauuguaacuuuuucuaucugugcuuguauuuaagguaaauaaaaauaaugccaaacuuuggaauaaugugggucaugcucuggaaaaugaaaagaacuuugagagagcuuugaaauacuucuuacaggcuacccauguucagccagguaagcauuauuaacuaauaaaaucaugaauuuuauuuuuuaaaaaguuuugauuauccuugggggaaauaagguaguuuauuuacuagcuuuauucugagugacuugaauacuagaguucagugcuuauuuugaacuggauuacauauaacagccacuuaauaucagacucuguuaccaggcugguggcucacaccuguauucccagcacuuugggaggcugacacaggagggucacaccaggaguucaugaccagccuaggcaacaaagcaagauccugucuuuacaaaauaaaaauuaaaaaauuagccaggcaugguggugugggcauguaaacucggcuacuugggaggcucaggugggaggauuccuugagcccaggaguucaaggcugcagugagcuaugaucacaugauuauaccacuguacuccagccugggugacagagugagacugugucucaaaaacaaacaaaaacauuuauggauuuuuucuuaacauagaguuguuguguggcauggauauggauaagcaguuuugguggaaugaugggugcaaaagccugauaguagugagcuuaagagaauggggaaagaauacuuggagacaauucguauagaaaacucuuuugaaggguguugauaagaaaugguggcagugcuggguauguggucaagaaaggaugguaagauaagaggguuuuggcuuuuuuaaaccaguuugggccagacacaguagcucaagucuguaaucccagcacuuugggaggccaaggugggcagaucacuugaggucaggaguuugagaccagccugggcaacauggugaaaccccaucucuacuaaaaauacaaaaauuagccagguauuguggugggcgccuguaauuccagcuacuuagguggcugaggcacaagaaucgcuggaaccugggaggcagagguugcagugagccaagaucgcaccacugcacuccagccugggugacagagugauauacucugucucaaaaaaaaaaaauaguuacauguuuuucuguugcaacuuuuuagcuauaauagugauggcauagacauggaaaauucuguuaaauaggauuaaaguuuuuucaguuguguauuacucaucaagaaaggguuuaaggagugaauaaaugaugagccacagaaucuaagcugguuaagaagggaugugagagaggaugagggauggaggaaagguaacaagaucaguggaucugaggaauuguugguuucugaguaggauguagcuagagcagcaguauuuuucgacaggagugcuauuggcguuuugagugcagaacuguauuacaggauauguacuagacauggccccccauccaccaaaugccaucauuauuuuccauucagagugaugaccaaaaagaaaccccugcacauuacuaaauauccuugaaggggugcagagugucagacacuguuguuuuuuucuaguaaguacaacuaugaccacugcacuaacuggcuaagguagaaaggaggugaaaaucauuuggaaaaaaggucaucaagaccacaguauucaaagauuaauaucuauauggauuaugaaaucacuaaaucauuaagaauuuugacaaaaguaauguuagagaaagcaacagggagccagggucugugauccaggaaucaaagacuacaacacugauaagaauagcagauaauagaguuaaauuacaaucagacaugaguaugguaaaaaggagagagaauuguccaaaaauggcaacauggaucaaggaagaagauaccuguucuucccccaggcccaguguggcaaaggauagaaaagaacacagucaccacuugaaagggcuaaagguaaccaugucuccaaaacaaagcuaaguuucaauuagagaaaggugaagaaaaaguugugaaaauauaacugauggucuagccuuucaguuuuaucucucuuagcccuucauguaguuuaguuuuucuuggaaugugggauuaauguccuguacuuccuuacuucuuugccuuuauuuucuuccuugagacuagaauuucucccuucucccuuuccucccauuuuccagugacuucucuuguaaaaacucuuccuaucuuuccagcuguaagcaaauaguuuucauauguaaaaccccuuaacuuccucuguaucuuuccuauauuuguaauuuucuauuuagugcuauauuuuauuuauuuaaauacaaauuuauuuaaaauauuuauuuauuuaaacuguggagcuuccuugggguagcaggaacaucugauucauuuuuguaccccugcaucaucaaguaggguccuauacgcagucagcagucucuaaauauuuuaauuaauuacuuucuuaagucuugagaugugcaaugcauggauuaauuauauucuaagaguuuuuagagaagcagccaucuuugauugucaggcacacaagggcuuugagacugagauguuacuuaggccccucagacucuucuuucuuguuucuaaaaugggauaguaauuucugucucacaguauuguuguaaauacuaaguuaagugugugugggguguguguacacauucaguuuugucuagugaauagugugccuaucacaggauguugcagacauggacacucaguuuuuaaauaauuuuucccccucauugucaauugucacuaauugcuguuuuugagauauuugcugaaccuuucuucaguuugacuucacuaucacacuuugagaauugcuguuucuauuaaucauaagccaugagauaggaaaacaaguaaaccaguuuauuauauuaugaauaaagcguuuuuuaaacuuagaaauauugaauguggcaucugagguuucuuggcuuauuccauguuuuuuuaagcuguauucuuccuagauggguuugacagaugaaaugacauguuauuuuacuguaucuuagauaguuuagacggggcaagacagugaccaggauaagguuaagagggacaacuagugugaugguuaguuaaaaguuuggacucuggcaucagaccuuuucucaaauuuaguucaaucacucuaaguuuucuaucuauaaauuuggaguaauaauaccuccauucuuuuguauggguuauguuaaauacugguuauauaagacuuaggccaguuucuaggcaauaauguauauucaauaaauaugagcugguaaguauuaauggcauuauuuucacuggagccaggaaaggagguugcugagucuguccugcagacucuggcugagugauggaugaaagagguaugcugacacagguauuuugccugacaguguggcuaggagacugcacagcuuagcaccgccaaugagagagugcagcagccaccaagagagugcagcccccguaagcaggccccggucgcauuuauuuaauacagauuuaaugacacaggcuuggagcaaacacaauuuguggguaauaaacauugucaacccccggaguagagagcaguccugugcgcaaaugaucaaagauugguuucuggagacaggaguaaacaaauuuaucuagauaaguuccuuuacauucccuuguuaucuacccuuugcucucaggcucuggauaagagaaucuggcugccuucagccauaauucucuucugaagcuuuugcaaaaccuccuggccuuccaaaaagauuugcaucuuucccuauaacuuuuucuuacaacuuuucccacuacccugaccgaacuccuacaucucacccuuuucuguuuuuugcaucagguuuuguugauugaagaguacagaugugugcagcaacagguuugucaggcacagcaguuaacacucguauuccggcuuugcauccuagaauuaguaaauaacauaagacaaacaugaguauaaucaguaauauucuuuuccaauuaaggagugacauguaguguuacuuggcaccucaguccagugugugucauuacuaaggaaccccacuggggguauguuaaucccuccuagccaagcaguuacguuauuagaggccgggaagggggugucugcccagguaacagggugaaagaaaggcggauuuagaagaugggccuaauagagaguagcagguacagauagcaggaaaagugagagaauaagaaaaaccaauguccuaugagaguuguaauguacaacagaaagcauaguaaggaacaaauuaucuggagugaauggugucuguguccagaacaggauucccucagccuccugaguuaucuucuucagcaucccgcagguaauguuuggggcuugugucauucaagaaaaccgcaucuucuggggcugcaggugcugcagggucguuuccuucauuucugguaccagguuggguccuagcgacaccauaguaugguuugaugcaucaugcuggaauccauagaggacuugagggggugugaacacaagcauauucucuuccccaugucaacaaaucauuuggaccacaccauacauuacuauuuacaucuuuccauaaaaccacagguuuuauguuuugaagaacuuuagugaaaugcuuuucuauggcugauugaaauuuaucaucuaaauuuuaaaaauuaaggguaaauaaggcuugugccaauaguguugcaggauccuuacucauauucccccuuuuuaguuucuugagcauauuuuuaaggguagaguggacacguucuacuauggccuguccuugagguuauaagggauaccuguggaauguuggauguuccacgugugacaaaauuguugacauugugagcuggcauaagccagaccauuaucaguuuuaauuuuugugggccaccccauaaacacaaaaguuaagagaaaauguuuaauaacauauugggaggacucuucaggaagagcaugugugcuaauuaggugagaauugguaucaauggauacauguauaucuaaguuuuccaaauucaaggaugugaauaacauuuguuugccauaaccgauuagguucuaguccucuaggguuaacaccuguugaaggaggagacaugccugugaguuggcaaugugggcauuguaaaauaauuuguuuagcuagucuuuggguagguugaaauuguuuaguuaaguuucuucaguuuugguggaaaaauugaugcaauugggugguuuggucaagcagugacgucauaacuugcaggucugcuuguucauugccauaagccagugggccaggcagugagcugugggcucgaguauguguguuaaaaauaggauauguacauugauccagcaauugcugaaguugaagaaaaaguguacacaggugggcucgagaguggacuuaaugagggcugucuuaagcuucuguaauaaauagaguaagcagagucauuaacaauauugauaagcugagcagaaaaggucuccagggccaauauuaaggcuccaaccucagcucucugagugcugguaaauccagaacaagugagggaauuaugcaguuuccaccaaauagccacuuuuccauuuuuaccagagccaucagugaaaagcguuaaagcauuggguaugggggagugaacuacuuguguagacacaacuacaggaguacgagaaaagaacugaaguaguuugucagcaggaagggcaugcucugcauggccugcauaauuagagagugcuaucugaagaucuagagauaggggcaauauugcuucgaguugcuuuuuacucaaaggaauucuuaugacaucagggucauaaccuagaaacugauugcaucaucugcagccuguauaggugacuuuacuaacuagcuggauauagggagauaguguuuuagucccaguacgugagcaaaaaacccauccuaggaagcauagcccuggggcugucuguccuauuaauccuguuggggaauguuuaguagggaaaacaaacaauugaacugaauauugcaggucugugcaaucuaguuaccucugagaaacagcuugcucuauuuuuucaauuucccuuuuugcugcaggaguuaaauaccugagagagucuaaggcuguauugcccuuuaggauagaaaacagguuauguaacuuaucaguaguuaugcccaagauggggcaaagccaauuaauaucgcccaguaauuuuugauaaucauuuaagauaugcaaguugauaguauuuaauuuaaccuuuugaggucuaacugaccaggaaguuaguauguauccaagauauuuucaaggagaagacaauuguacuuuuucaggugcuaugacuaaaccucuuagcuauguauucuuuacgacagaggcuuauaaacuuaaaaguacuggcuccguuggggaugcuaguaaaauaucaucuauaaaaugaauaaucuuguauuuaggaaauucuuuucuacuugggagcaaagccugauuuacaugauacugacacaugguaggacuguucagcaucccuugaggaagcacuucccaaugaaaucagugagcuggccuuucauuauugauagcugguauuguaaacacaaauuuuucucuguccuguucugcaaggggaauaguacaaaaacaguccuuuaaguucauaaugacuacaggccaaucuugaggaaucgccacgggggaagggagacccuguugaaggggcccuauagguuacaaauuagcacugauagcccguaagucaugcagaaaucuccauuugccagacuuuugggaaaugaugaaaaugggcgaauuccaagggcuguuugacgguucuguauggcuggcuuuuaauugcuccucaacuaauucaugggccaacuaauucaugggcucuuuguaauuuuucucccuuuaaaggcuacuguucuacccaaauaggauuuugagagagccaugucagggggaggagaggaauaacaguggccauuauuagaaagaggucugcagaaugaccucaguuaacccucucauaaaugggcuagcagcuguuuucuuuaaugcuuuuccuuaucucuuuauaagugccgaaaguaaugaguucauauaccccauugccuuguugaucuugcauugccaggcaggcuaagagcuccccuucuaaugcugcuaccuaagacagggucccauagcuauaguguaucccuugucuuucuuccaauuuauuggaggaggggccucaggcaaaaccucuguuuccccuuugguauuuuugcccuuuacugguggggcugagggagaaggaggaggcgguaagguaggugacgguuucuccucccuucccuuuuuagguuauucuguguagugcgggaccaaagcagcccuaacuaagggccauaacauuagagaugcuacugggaccugauauccuugggcaugauguuaagauuucuccacacuuguucucagagcccuaugucuagcauaccuucuucugggaaccauggguuaugggaaacagcaguuugcauuaugucccuuaauugagccugcgaaacuggggcuccacuagcuuuaagcagcuguuucaguacuuuuauauacuguuucuguugagcugacaaccacugucccaugaugaaacccuagccugaacaauucccucgaacuuggaaaucccaagcgggcaccaaugacuuacugugcagucucuuaaccuucguuuuugaggguuccaucgcaauccauugcagccuuccucacacggggcaccaccugccgagucugucccacagacucuggccgagugauggaugaaagaaguacacugacacaggaauuuugcgugacagcguggcuaggggaccgcauggcucagcaccaccaacaagagagugcagcagccaccaagagagugcagccccccuaagccagcccugcuagcauuuauuuaguucagauuuaaugauaaaggcuuggagcaaacacaauuuguggguaaugaacauugucgaccccccaaguagagagcaguccugugcaugaauaaucaaagguugauuucuagagaaaggaguaaacaaauuuaucuagauaaauuccuuuacauucccuuaucuacucuuuucucucagacuccugauaagagaaucuggcggccuucagccauaauucccuucggaagcuuuugcaaagccuccuggccuuccaagaagguuugcaucuuucccuauaacuuuuucuuacaacuuuucccaccacccugaccaaacuccuacaggagguggcaaaaaagugauguauaaugcagggaagaaggcugaaagagaauggauagcaaauggcucuguagguauauuuguucauugggcacguauuugagaauuuaccaugugucaagacacuguuuuaagugcuggggaauccagaagaaauaaaacaaauuuccucccuucguggaguuuccauucuaaauaaaggcauaaacauaaguaaacaaauacacaccacauguaaauauauauauauauacacacacacaaaauauauauauacacacacacauaugcaugcacauguguauuuauaugaaagugauaaaagcuauaaaaagggcauagagauuagaaauuuucagagaaagucucuucgagaugauaauaaacagagcaaccuucgcacauauacucugguguaauuuuaaguaucacuggcuaugcagaaaacagugaagaaaagcaggaagaucauuuagaaggcuuuugcaguaacccaaagacaugauugaguuguaauuuuuuaauagcaaucuugaaguacaugugacauacaauagacuauacauguuuaaaauacauaauuugauaaguuucggcauauguauauuaucugugagaccauaauuacaauuaagauacugaaaauauccaucaaccccucaaauuccuuggauccuuuucugauaccucccucuuaccccuuuucaccccagccuucucuaagcaaaagcuuucuaucacuacagauaaugugcuuuuucuaaaauuguguaugaauggaauuauacucuauggacucucucuuuuuuuuuuuucuuggcuuuuuuacucugcacaguuauuuugauacucauucauguuguuguaugaaucaaaaacccauaccuugguauggcugaguaguauuccuucacguagauauaccacaguuuguuuauccauuuaccuguugauggauguuuggauuguucacaguuuggagcuguuacaaacauggcuguuacgaacauucauauaccagucuuuauggauauauguuuucauuucucuuagguaaaaaccugagagaaaaauggcauggucauaugauuucuguauguuuaacuuuuuaaaggcugcuaaauuauguuccaaaaaauguauuucccaccagcaguauaggagagcucuccugccuuucuuaauucuucauuugcugagaauuuuuaacacaaguaaauguuggauucugucaaaugcuuuugugcaccauuugagaugaugauaagguuuuuauuuuuuuugucuguuaauacaguggauaucaucaauugauuucauaauguuaaaacaaccuugccuucaguaauacacaauuugauugugacuuauuaucuuuauuauauuuuauuuguuaaaaugcuauuaguaauuuuuacaucuauauuuaugaaggauagagaguuccuaggagauuccagauauuuauaaauuuauuuuuuuaaauaaauugauaauuuuguggacaggaaauacugaaacucuacauaauugccuaagccaucaaugugagaauacuucacuguugggcagcuaauauuucacuguugggcagcuguguauuagucauacacaguugccugaaaacuucccagccacaucacauuugcaucccuaggcaggaugacugagaucauaugugaaccagugucuaauaacuacugucauuucaaauaaauggugacuguaaaccuguguacacagguguuuguuacuauuaaaaacacaugcaaacauucaugcagguaaguugauaaccuuuagcagugagguaaguucccuucuaaacaaaguuccuuuguuuuccuagugaaaauaugauauuagagaugugaggagagauaagaaaugaaagagacucaacuaggauucuggaaaaauuaacugauuauagaaaccuaguauugacaaacugagacuacauuugagauuugugagguccucauuuaccauugaauuaaaagcuagauuguuaacucaugcugcuguuguuuuggauagguacugguaagagugggcuuguucuuugaaguuccuuuaguuucuuuagucauuuaaaugucauugauuuuuuacaucuugccuucuuuucuuaccuuuuguuaauacuuaaauuuaucuuaaaagugauacuauuuuacccucuagaaucuuaaaacuuuguaaauuauaaagaauugcuuagaaauuaggucuuucauuuuauuagcuguauugaguggccuuuuugaugcuaaacaauaucuaauugcaucucugcucuuugaaaacauagggcugcuauacucuagugucugaagucuacauuaaugacaauaucuccuggccuuaauucuaagagcaugauuucaauggauaguaauucaccucauuuuuuaucuaaguauauaaccucuuucuuuucuaacauugguuggggauaauuucaauaacauuuuaaauacucagcuggcauaauuacaguuuuauuuuaacaaauuuucaguuuauucuuaaauucuuaguguauaauuuuuucagguucuauguaccuuagcuuuuccuaaauaacauucugagcucuauaaacauaugguauggauuuaucugguaaaaaaaaaaaaaaagauauaaaagcaaagacuaccccauauuuuuaauugacaauaauaguacauauucaugggauauauagugauguuuugauacauauaaugcaagcaaauacccugaucuaaucacuauacugcauauuuuauaugcaauuggauaauacaaugauuuucagcccugauucuacaucagaauugccuuugacacuuuuuaugaacauauuuuugcagauuucauuucugaacauuauguuuugauggaccuagguggggcugaaguaucugacuuuuuuuuaaacuacacagguauucugauuugcagccagaauuaagaauggcuagcuuaaacguuuuuuuugcuugaccccuccuggcuccaugagacucagcaauacaucuaaaaagaaaaaaaucuacuuccuuacuccuaaacuuaucuauaaucaaaccuggaccgcaucugccaguuuuugugcagugcacacaauugccagccuaaaacauuauauagcaaguucuuaggacuguuacucagggaaugcccaagauauauaugcuuggccccuauguguccuaggaguugcaggcaaagaauuauugcacaauugcaaaauaauugguaucacaaggcaaguaguaaucauaaugaaccuuuucauguauuuuaguucguguugaguauaaacugucugauuuaagaucuucuaccuuccuucuaucauuauuccaaaccuuugaaauauuuacuggcaaguauaucuuuuuaaaaagcuacuguacaaugaauccucaucucuuuccuauuucagcuacauuuuuuuuccuaucccugaauaaauuugcugggauuuuuacuuuccacaucagaaaaugagacauaaguuccugacauucuaaaauuaacacaaccuuuuaaaaaaaucuaaaauuaauuuuaaggaguuaauuaucauuuaaaagagcugggccacugcaucuuaaguaauacuauuaucauuauguuccauuauacucucauucuagccacagucacaaaaauuuuuaaaaaucgaauggcaaaguuuuuuuucagucucuuugccccuguuccaccaugaugcauauuuguuauaacacuugaaauaauucuaaaaauccugaugauucauuuuacuuguagaguugagcuguaccuuuugagugaauuccuaagcuaugagauuaaguaaauggaagcaagcuuuaguguaguaaaauacaaugaaggaagguaauaaaaauuucuucauuaccuuuaucucuggaagcaagcuuuaguguaguaaaauacaaugaaggaagguaauaaaaauuucuucauuaccuuuaucucucuuaugucucaacucuucaaaaauccauucaaauaguuuuuucaugccauguauguauuuucugucuuuacaugcuuuaaguaauuuuguguauaccauugguuuuaaguuauaacaaguuaaauuacaagaacuuuaaggaagaagcaggaccuguugccugcuuuugcauuuuugccuaguguguuuguuucuggaaauaugucuucucauuaguuacauugaauacuuguuuauauaucaaauacauuuaaucauuucauugaguauauugaauauaucaguuguauacuugccaacaaaugauuguuuuaaaauuuuagaugauauuggugcccauaugaauguaggaagaacuuauaaaaauuuaaauagaaccaaagaagcugaagaaucuuacaugauggcuaaaucacugaugccucaaguaaguugccauaauuuaucuauugugucauaucuauuagauguccauauugaauagaauuaucuagaaggaaaaucuuuaucuuuucuucaguuaguugauauaaaaguaaguuuuauaaagaauuacauuuuucuagcuuacuuaauuuuuuuuuuuuuuuuggagacggagucuugcuguauugcccagacuggagugcaguggcacgaucucagcucacugcaaccucugccucccagguuuaagugauucuucugccucagccucccaaguagcugggacuacaggugccugccaccacacccggcuaauuuuuguauuuuuaguagagacaggguuucaccauauuggccaggcuggucucgaacuccagaccucgugaucugcccaccucagccucccaaagugcugggauuacaggcaugagccacugcgcccggccguagcucacuuaauuuuaaaaauuguuuuuauaguccauuuguaaaaacuaaauucauaaaguaugaauuuuagauauucuugauuaugaguuaucagcaaguuaaugacuuuaaauaaauauaauuuuauuuauguauauuaagcauacaguucaacauuauuccuaucaaaaaauaaagugauaaaauuaguagauacaucucuuacuauauuguguccaucaguuguuagaauaagauucauuaaauauaagguaguaucgaaauuggaagaucuuacccuaugucaauuuucauguuaucagcaaaauauuucuggguugugaccguaggauaguuaauuuauuccagaauacuaaggacucacuugucuggugaaguuuggaaauuaaacagucugauuauuaaguuaagguuuuuauaauacauaguauauauggaucgagacuuccagugaacacaauaaauuagauaugauaaaaaccaauaacaaauacaauuuaacuguuacaguuaaggauuaaaauaauccuuaaaaugucauacaguucaacuuuaaaaaaaauuaacuauccuaucacuauuaauauuacuauaaauauuauuacaauugagaaaacuucagcccagcuuaagcuauuuuuucugaggacauaagacuaugccacuaauuuuaccacuuuguuaaaaauaaauaauaaaaauguaaaagaaaacacacacaaaaaugugaauaaaaauauuuuacuuacaguauccucaaaaauguaaauaaaauaguacuuuguggcauuaaggauauauuuuuucauucaugccaccucaguggauuauuagcuuuuuauuuguaucugucuuuuucugaagucaaacaaaucagaacuuuuagaagucaagguaucuuagguuuagucaaaacaggaguagaacccugaucucucaguccaguguauuuuuuacaguauguucugaguuauuuugaauuagccaauaggaauauguacuuuugauuuuugauacugaaauaucaaaucaugaaaaugccuuuucuucuaaacagauuauuccugguaaaaaauaugcagccagaauugccccuaaccaccuaaauguuuauaucaaucuggcuaaccugauccgagcaaaugagucccgacuggaagaagcagaucagcuguaccgucaagcaauaagcaugaggcccgacuucaagcaggcuuacauuagcagguaucccaguucaacuuuaagcuaucauuauggaauauugaaacugcaucuccauguacauuuugaaugaauugguuuuuuuugaaaaaaaauuauguuuuuaauaaucuuacuuagcaaccaagugcauagaagagcauaacuuuuuagacugacagucagauuuuauugauuugaaauuaacaaggggaaucccuaacuuguaauagccaacuuagguuuuguauuaaggaaaggguagaagcagcucugucuuaguugcauuuucuucccaucaccaaaauuguucuuuuccuauuuaaauuaaaacuugaaacuuacauuuuauaauaguuacuucuaauaucaaacucucaggaacuuucuuguuuuuagaguugauugguuauugaugccuuugacacaaagaaaacaucuugguucucagcaaaaaaaaaaguuuucuggcaccacauguuaaaacuucauuuauuuucucauguauguguuaucauuuguauuacuuuugaggaaaaauguguuuuuaaacuucguuuuguagccugguccagaaaacuaauaguaauuuguaacauuuuuuccuuuggggaaaguacauucugaauuuaaguuuuugagauaaaaucuguuuguaaguugggguuuucuuuguuccgccgugccuauugaguuuauuagcaggguuguaucuauaaauaacaccugucauguauuaauucauaaagaacuauucaacaaucucuacauuaaaaaaauaauauuuuggacaaacauucauucuagaagugguuuuaaugagaauauuaauuguuguuccuuuuauuucugugcugauacuauaggaaagaguaguauuauaagaacaacucucauaucacuacuuaaauauuauuuguacauauguaaaaauaauucuuuaagcaaaauuacuuuuuaaaauuuucuaacagaaaauagaaccacacuagaaagauuuauacaaugguuucuuaacugguccucaauucuaaguguguuccucaaaguuaucuacaggucagauuaaucccucccacucuaccuguucagcuuuuuuuuaguccuuuuucuguuuguuuguuuguuugugacagagucucacauuguuacccaggcuggagugcaguggugugaucucggcuaacugcuaccucugccuccuggguucaaguaauucuuguuccucagccucacuauuagcugggacuacaggcgcgugccaccaugccuggcaaauuucuguauuuuuaguagagacagaguuuugccauguuggucagcuggucuccaacuccugaccucaagugaucugcccaccucagccucccaaagugcugggauuacaggaacgagccaccaugcccagcauuuuucuuuuuuuuuuuuucuuuuuuuuuuuuaagaauggucguauuauaagaagacauugaugaggacuaaauuaauauaagaagggguuacagauuuuuaauauuuugguuuuuugcauagugagccuucuauuauacauucaaauauuggaauuucucuuaccacuacuauaugucauuuuuuucuucuaaugcuguuauuuugucaccugacaaauucauuaaucuuucacucuggcuagcugcccuuuuucugaugcaguuuagucugucuccuuuuuaagauaaagucaaagaauauauuugcucuguccuccuuccuggauuccuccugauagguugcccucugaaaucaggcauaauuuuuuucuucuuaaauaauauuugaaaauauaucaagccaaauauacugaacuaaggaguucagauuugaggacaguuucaaagaguuguuuucgaaagagaguuuuuuaagagucugaguuaagagaaaaaaaagcuguauguggaaaggcuuaaaacuuggcaaaaauuguaucuacaaacugagaugguaauguuguaaguaaagcuuguguuugauuuuuccacagaggagaauugcuuuuaaaaaugaauaaaccucuuaaagcaaaggaagcauaucuuaaagcacuagagcuggacagaaauaaugcagaucuuugguacaacuuggcaauuguacauauugaacuuaaagaaccaaaugaagcccuaaaaaacuuuaaucgugcucuggaacuaaauccaaagcauaaacuagcauuauucaacucugcuauaguaaugcaagaaucagguauguuuucucaaaauauuucuguuuauauaaauuguaguuuauaauauaauaagaccuuaauuuaacuuuauuacccauagcaaacacuuuauguauugacaguuuauagcaauacugugcuuaacugauuuauagaaagaauauuuaaaauacuugaaguaaacuauuuucaaguaacaugcauucuaacauaugauaauacugauuuuuaauucuucuggcauguguuaagacuaauuuuucaggcagucuauuaagcaacauuaacuauuuugucauuuuauauacauaaacauaauguaacuuauauauaaacucuccaaauaauaugaacuugugaaauuuuuuacauaauuggcugugaggagccaagagcauauguuuucaaaaaaauagcauuuuauuuucuuuugauucauaagagcaaauacuuuuggcaccauuuuauauccaguuuuacuacguuuucugagauguuguaauuuuuuauauuuccuauaauuuagcaaaacuaaauuauuaaccacaguaaaucuggauccuucauccauauuuuauauaggaauuucaguucugccucauaagauaguguauaugauuuauaaucuuuuuaauuuauaaauuagaaaaaucuauuauaauguuuaguuauuucuuagauacauuucguaaaacuuuuguaaaauaugaaagaaucauaaagucguaguauuuuagagcuaaagaggaccuuugaguuugcauuugccagucuucuauuuaguagagugaaaaccaaauagauuuuaugacugccccaaagucauauggcuaaauagguaacccaagacaagaacugaagccuccugauuuauuuucaaauuuucuuuauccaucgugcugccaaauaaaagaauagagagaagucuuuaugccugguguccaaaaaaguagaaauuuggagaaaagcuaauauuuuuguaagguuuucuaccuugauaaucaugaaggaugcucauuauucgacacaagauuguacuauaagguuuguaauuguagaacuugaacuuuuuuguuuuuuuggcuuuuuuuuugcaauagaaauuaucucaauggagauuuguuuccugccaggcaguggcugaugccuguaauccuaacacuuagggaggccaggguggggaggaucacuagaggccaagaguuugagaauagccuaggcaacauaguaaaacucugucuccacaaaaaauuuuaaaaucagcaagaaaugauggcacaugccuguagucccagcuacucgggaagccaaggugggaggauugcuugagcccaggaguuugagguuacagugaccuguggacacagcacugcccuccagccugagugacauagugagacccugucucaaaaaaaagaagauacauguuuccuaaauccuaauuuuauagcccuauauuuaaugguauguuuuuguccucgaaacauuccuaaaacuuugaaguaacauuuuuuaaaaugugauacagucauucugaagcuuuuuucuacccaguaauaguuacuauuugcugaacauuuuuucgauauacaacauacaauuauuagaaaacucaguuaacccagagaaguuaaguaacauguucaguguauaaagucauaauguuaucagaaucaagauugaauacaugucuuuguuggcaaaucccaugcuucuuuuucugaauucucuauuuuccuucuauuuccaauugaauucuaaauuauaagagacauuucucuccuuuugguuucugaagcacuguuacugcuuuaaaggaaaagaaauaagcuaucuuuuuacuguuucaaauauuuugcuuuuccuaugaagacuucgagauuuuugcuuucuacuuuuuuuaacuauggaaauuaguuguuuugaagcugucuuuuuguaaucuaaguauuugaaaauggcuuuguuccucacauuuaauuauuuuauuaacaauauauuuuuucuuuaaaaaaacuuucuaggugagguuaaacucagaccugaagcuagaaaacgacuucuaaguuauauaaaugaagagccacuagaugcuaauggguauuucaauuugggaaugcuugccauggaugacaaaaaggacaaugaagcagagauuuggaugaagaaagccauaaaguuacaagccgacuuccgaagugcuuuguuuaaucuggcucuccuguauucccagacugcaaaggaauuaaaggcuuugccaauuuuggaggaguuacucagauacuacccugaucauaucaagggccucauuuuaaaaggagacauucugaugaaucaaaagaaagauauacuaggagcaaaaaaauguuuugaaaggauuuuggagauggauccaagcaaugugcaaggaaaacacaaucuuuguguuguuuauuuugaagaaaaagacuuauuaaaagcugaaagaugccuucuugaaacacuggcauuagcaccacaugaagaauauauucagcgccauuugaauauagucagggauaagauuuccucaucuaguuuuauagagccaauauucccaaccaguaagauuucaaguguggaaggaaagaaaauuccaacugaaaguguaaaagaaauuagaggugaauccagacaaacacaaauaguaaaaacaagugauaauaaaagucagucuaaauccaacaaacaauuaggaaaaaauggagacgaagagacaccccacaaaacaacaaaagacaucaaagaaauugagaagaaaagaguugcugcuuuaaaaagacuagaagagauugaacguauuuuaaauggugaauaacauuaauauuuaucgugacaaugguaucaaagaacaucaauccguaucaugugauugcuuuuacugggagcuuugaaaaaaaguucaaggguuccuaauggucaaucaugagcugccuugaaguaggaucaaaauaagauuuucauuaaagaccuguauuaucccaggauguauauuauguaucgcuguuuucagagugugggugaauauagcagaaauauuacagcggaagugacaaauuuacaacuuuuauuauagaaagaagguguuucuggcaauguaaucuuuacugcucucaauuaaaaauaauuuugaggccugaaugauaaucccuugaggacaaauccaacaugugcugguuuauucuguuaauucccauuuauuugccuacuucauuuuucuugcaccucuuagaaucuaacuaugaauugaaaacacuuaaguaauucuguuuaaucaagggauuuacacuacaaaagaaugcuggcuuuuuuuauguuguauuccuuaguugaguuuuagaaggaaugcuugaugaaacauuuuaaaauaagucaugacauguuagcuugagaauguauuuucauaauuguauacuuguuuuuaacuuuaaauguaauuuuuaaucagguaaaguuugacacauguauagcuacauacacacauuuuuaauggugcucauauauacuguauuuuuuguuguuuaguuuuacuuauugagagugucacaacaugaaucacauaaucaugauuuuuuuuuuuuacuuuuacuccccaaauuauucauguuucuuagaucguagucauugagaagucccaauaacucuaaacuuuugaguuauaacguaguaaacuucucuuucaucuuuguguuagcucuguagucuuaaccuggauuuuaauuuuuuuguuuccaaagucacaauugaauuauucuuagauaccuuaagccacugaauucaguucuguuugacugaaagcaaaacaacgugacaguuuauuuucaaacacuaacuucuugauauuuuguuaugguauaucuuuuuauuaaauauuuauuuugacuaagcuuucauaaaauauuugaagcuauuuuaaucaucaaguauggaaaacaaauuacuauugcauuuuccuauauaugcauauauuauggauuaaccagaauuguaucauuuuuggccuaaugucuggauauaaaagauaauuagccuacuauaguauuaauaaauuuuucaguugguuugggcaaauuuaaaccugaaaaauagguuaaaaaguaguuacaaauuaaacuuacuaauuuauaccugauuuuuuuucuugaauuaaaguacauuuuaaaugagcuuuauaauaccuuaaaaaguugguucuaauuuaaaauaugaaagcucuggcuaucauccugggauaguaauuucuaauuauauaguauuucaaaacuauauauuuuuuaguuccuuugagauaacuaauuucuaauuauauauguuucaaaaaccauauccuguauuuuuuuuaagaauuguuuuauaaauaggucauaagauacaaggucugcauuagaagacccacucuuacuagguucccuaaggaucugccauagauuuuuuuuuuuuuuuuuuuuuuuuuagguaguuuaaagcaagcacugauaccagugggaguuggucuugaucuaggagauucuguuaagcauccaaaaacaaugccuaauuucaguucuuagguuauggcuugugacuccagauaaaagauggagaauaccucauguacugugacuugaaaaugaauucuuaaaauucuuaggcucucuccauguaucuuucuuaaggaaaaguuucugagugugaucucucuuuugccauaguaucaaguggaggguaguucagaaaaguuaauaggaaaucuuuugugacagcagacuauaauagaaguuugaguaauauuuuaauaaauuuauauaauucaaaugauaaaaauguaucaauguuauccaaugauuuuuauuaaaaaauuaccuuauuauuagaacugugccuauuacauaaaaagugcucauguauuugaauuuuaaauaauuuauuuaaaucaagaccaccauaagucauuaauaauuuaauaauuguuuuaaaucagugguuuucaacccucacuucauauuagaaucaucugaggacuuuuaauauggaauccaccucauaacaauuaagucuaaauuucuggaagauggagccaugcuuguuuuuccaaaagcucuuugagugauucuaauuuguagucagaguugaagaccacugcucuaaauuagugcaggaaaaugcuuuuauuucucccauguuaacuuuuaaaacuaguaauguacccaguuaaguuuugaugguuuaaauuccacuaaagaacauauucuucuaauaacuagcauuuauuacaugaaauuuaagaguuuaaguuccaucaaacuagcccuugugu

SEQ ID NO: 19213 - RNA, 3175 nt, Homo sapiens
uggugccugggagaggaaacgaugcgccccggggccgcggccucauuggaugagaggucccaccucacggcccgaggcggggcuucuuugcgcuuaaaagccgagccgggccaauguucaaaugcgcagcucuuagucgcgggccgacugguguuuauccgucacucgccgagguuccuugggucauggugccagccugacugagaagaggacgcucccgggagacgaaugaggaaccaccuccuccuacuguucaaguacaggggccugguccgcaaagggaagaaaagcaaaagacgaaaauggcuaaauucgugauccgcccagccacugccgccgacugcagugacauacugcggcugaucaagguagcggagagccagagcuccucccggggcgugggguggagguggcuccguuucccagaguggggugauucacgucuugaggucucggccggugugagagcccagccuguuccccuuucugcgcccauccccggcucggccgccaccccgcccgcccgccccauuccguuccccugagcuggccgggccggagccucauuuuguuuucuacuuuuuucucuccuaugugcauccccccaggagcuggcuaaauaugaauacauggaagaacaaguaaucuuaacugaaaaagguaauucaacaguggcgggacgggggacaagcguucggugccugucaccuucgccaaggccauuaccgccccugcucccccuucuugcagaucugcuagaagaugguuuuggagagcaccccuuuuaccacugccugguugcagaagugccgaaagagcacuggacuccggaagguaaccccucgcccuuuccagaagccagagagaccaaguguuauguaagaaguagugucggcuguguagaaccacugacuacacaggccgaaguuacugagaacuuggacagaaaaaauagccagcaaguguucaaacuacugaggaaaaaaaaaaauuagauaugcugcacuuaagaauacuagggcagguuaaaagagcuguuuaaguaaguaucagagugcuguggagacucggaaguguuuaagcugcuuaaguaaguauaagugcuguggagacccggaagaguuagauauaaugucauuuguuguaauucaguuucauaaaaugguucuuguuugacccuaacguaacaguuuuuguaauuguguuaaaucacauuuuuuucuuuaauuugucccaaucuucagguuacagucucuagcuucgccauguacauggcccuuccguguacauggaugggcggggagguaacuaaaagauccuuuacacaauaaaguagaugaucaugauaaaugagguaagguccuauuaucacacacuucaaacacgguagaucagaaacccacuaugauacucgcuuccugucuguuugcuaaggaauauaaaauggcuagaaaguuuaauuugaaaccuuugccuccauuuggaauaguagacaccaguuaagagggugucagaugccuuuuuuuuuuuuuuuuuuuuggcuggucccuguugauuggucagaagacagcucagcuaaaaggggaaguugucugggugguugcuuuuuuucugacgucuguuccucaggcuggaagaaaugagcagaaaacaagggaugaguacuuuuuagaguaugugcauguuacguaauaccuguuucugggcaaugcugcuucuucugacucaacaaauggggagagcaaauugaaaaugcguaaauuggaaggcaaguucugaaauuaaacguuguacuuuggccugauguucugaccuuuaaggaagcaagaguuuguaaacuuccaaauauuuacuauucugaacugccguguaaaccugacguauucccaagucaacauaccaguauaccaauaggaugugaauaauguguguguugaguuuaaaaccauagcaguuuugcucuggcaaguaaugaaagcguucucgcuuccugagugugagcuccagcagacugcagaguggccaguccacaguuguagccugacuucagugaguucugaugugugcuuuuugcaaauacauguucucagaacagugagaucauccagcaguggccuggacugcacucacauaaaaaucaugagacagccauggcuacuuguuucuguaauacaugcauguguguuuuuuaaaaccuaugauaggccucugauucugcagcugcaacuuuuauggaauguuuuccuucuccacaucucaugugaugcucuuauuacaggacacagcauuguugguuuugccauguacuauuuuaccuaugacccguggauuggcaaguuauuguaucuugaggacuucuucgugaugagugauuauagagguacgauugaguucggagcagagggucugaagagaguucagaguuauaaaugcuuacaaugacuuuuuaaauuguacucuuucuuuuuaggcuuuggcauaggaucagaaauucugaagaaucuaagccagguaugucuuaguuuuugguuuccaaauuuguaaguuuacuggauuauuuuaaugauggaauaaaaauugggucuugagagcaggcugaaaugucacugaguguguguuuuacucucucauaauagguugcaaugaggugucgcugcagcagcaugcacuucuugguagcagaauggaaugaaccauccaucaacuucuauaaaagaagaggugcuucugaucuguccagugaagaggguuggagacuguucaagaucgacaaggaguacuugcuaaaaauggcaacagaggagugaggagugcugcuguagaugacaaccuccauucuauuuuagaauaaauucccaacuucucuugcuuucuaugcuguuuguagugaaauaauagaaugagcacccauuccaaagcuuuauuaccaguggcguuguugcauguuugaaaugaggucuguuuaaaguggcaaucucagaugcaguuuggagagucagaucuuucuccuugaauaucuuucgauaaacaacaagguggugugaucuuaauauauuugaaaaaaacuucauucucgugagucauuuaaauguguacaauguacacacugguacuuagaguuucuguuugauucuuuuuuaauaaacuacucuuugauuuaauuguuugguguaag

SEQ ID NO: 19214 - RNA, 22130 nt, Homo sapiens
caacagaacugagggacgaacaguaggugccugagagcuggccgaucuggucacucucuccagugggccacaggggcccacuuggugggcagucucugcugccagcuagggcaucucagcucagcccagagcaaagacguguagggacauaacgcuuuccucaagcuuccuuucccagguccaaacuuagaggcccaguuuugggccuagaauucacugagguuuguggcuguuuguccaacagucaccauggaucaccgaagccgacuacggggcacaggccugaaccgaaucccugggacucagucccgagccccccgagucccacuccccuuccacgugcaacaggaggccagggaaggagaagacugggagcgagagccaccucgucagaggccuccuaucuaugagccaccagaaagugaagagcugccagauaauguuauggguaaggacacacccucccucagcagaaggaggcuggcaucaucuuuuucauccuuuaccuccaggaagcaggggccgggaggcagaaagcagaguauacagugggcagaacuagggugagggaugaguuuggaaaggggaaauuuucuaucugccacaaaagauuguuucacaaggaguaaggauaaaauaugugaaagcaacuugaaacugaggcugucugcaauauuagguguuauuuauaaaaucagguguuugcaaugucaguugcuuacugugggccagguucuuugggaaacaaagaccuauuacacauugauuucagccccagacagcccacagucuaguagaggaaagacaaacuuaggaugguuucugcaggauucagaaagauaacaggugcuuacagaaaacaaacuuaacauguucucacuuaauugugggagcuaaaaauuaaaacaauugaacucauagagauagagaguagaagaaugguuacuagaggcugggaaggguaguggggggcuggggaggaaaguggggaugguuaguggguacagaaauauagaaugaauaagaccuaguauuugauagcacaacagggugacuauagucaauaacaauuuaauuguauacccuaaaauaacuaaaagaguauaauuggauuguuuguaacacaaaugauaaaugcuugaggugauggauaacccauuugccaugaugugauuguuacacacugugugccugaaucaaaauaucccauauaccccauaaauauauauauauacauauacauauauauauacauauaccuacuauguagccacaaaaaauuuuuuuuaauuuaaaaagaaagauaacaagcacuugcaggaggacagagggcacccugggaucauacaggcucaugccuguaaucccagcacuuugggaggccaaggugggcggaucacaauuagcugggcaugguggcgcgcaccuguaaucccagcuacucggcaggccgaggcaggagaauuacuugaaccugggagguggagguugcagugagccgagauugccacugcacuccagccugugcgacagagcgagacucugucuaaaaaaaaaaaaaaaaaaaaaaacaaccuaacacaggguuaaguugcaacauugccuguuugccccauaguuccuuuccagcuggaagagaagaaauggucuagggauauggcuuuucagguuagacuuuucuucuccaaguuuucuggggaccugaaaagggcuccgacuugagagaggagucauggcuguucacaaagaucacugcaaggaaaagaauaagaaaugucuguuagagggauaaaacgcgagcuauucagaggcagaaaggucaguuucccuuugaggggcggggguggcgugggaugaggaggcuuuuugggagagaugggcguggaaggaugucuaacaagugcuggcggcgagggucguuggcacuucaauggugggaagacagccaugggcgaagcuuuguggaagaaauaggugugaaggaugagaaggccuacaacagugcugagggcgcgaggccagucaccugcgaaguuuuguguacaagaugggcccagaaggaugaacagggucuaaaacagugcugagggugggagugcagaagaucggucacaagugacgacacaagguggucuuaguccaguugguggacgcucgguggccugggccugcccccagugcgcagacgcacacggcagguugcagcggcaagcggggcggugcccacggcggggagauggguggggagggcagggaaaaggccagggguugggugaugggguaauugucagaaaaaggaacaacacugcugggagaguuuucugguaacuuuucaagucuucauuuaaauuaaaaaaaaaaaaagcugucuuugaaacaauagauuaggucacuaaaaacugccuguacgcccuugcaugcuggaggaaaguaaaugguuagaccuacccucccuaaguuuuuccaggacuuaaaagagcugcaaguagugcagaucauggccccguucacacaaaucacuucaagaaaaaaaauuaguaaaugucuauuagaucuugaaacuuauuccugucuaucuggaacuugguaaccucugaccaacaacuaacuccccauuccuucccucucgccucgccuucccuacuucccaaccucugguaagcagcaggguaaauacagucaauaauaauguauauuucaaaaugaauaagaguaaauuugaaaugucucaccauaaaagucauagguaaacaaggcgauggauaaguuaaugugauguaaucaucccacauuggauacauauuucaaaaaaucacauugcaucccacgaauguauacaauuaugauuugucaaguaaauauaauuuuuaaaaacguuaagugacuuuuuaaaaagcuuauuagaaguauaaaaugcaagccauucacaagcauauagguuagauuccgcuugugaggggcuugugugcaguggugaggcuuuguggaagagauggacguggaaagaugucuaaaacagcgcggaggucaggagaccuugucgcugccuucacagaguugggcaacgcucccgguccuggucagccgcgggacgcaggcgcaaaugcaggcuugggaugggggaggugcggccggcgcccacguggcggggcggggagcagauaggggggguagggggaggagcuggucucgcgaggccgcgccccgguucgcgcgggcgucgugcacgcgguuguagcugcccggcggcggcagaagcggcgcucgcgccaagggacguguuucugcgcucgcguggucauggaggcgcugccgcugcuagccgcgacaacuccggaccacggccgccaccgaaggcugcuucugcugccgcuacugcuguuccugcugccggcuggagcugugcagggcugggagacagaggagaggccccggacucgcgaagaggagugccacuucuacgcggguggacaaguguacccgggagaggcaucccggguaucggucgccgaccacucccugcaccuaagcaaagcgaagaguagguggugucccgccaaagggugggaggggagauuccggagacacguguaccccgguuacacccccggaaucugggcuugggcggcacccccugggcugccuccgggcccugggcgggccugguucucaccuaggagggcggggaggggaauaaaggggaguucuagcugugaagaaagguaugguuuccacugaucagauuuuagaagagguagugguuaccccaaaagccgcagcugagggaaaguggguggcccuagucccgaguuugcaucgaggauguugggcaaacugaaacaguuccugaaacaucucaaagugccuucagcacauccugucuuuuucagguacuauuucagcgaaggaagacauugauagguugaauaaugauucacaaaaaguuugauuaaacagaaaaguugcuaaacacagugcucgggaggucaaacauuucauuuuucuuucuuccuuuuuguuugcaucuuacaaagauuauuacugaaagccaccuuccccaaagccuguguaguuaauggauauuccuuauguuucucagacaugaagaaccuauuacagaguguacuuuugagggaaaugggggaaaagguuagaaguaugcauuuggguugaugauaaaccucguggcaaauuuguguccugccaauuugguuuuugauuauuugcauuucuguccaguguacaaagcuaauggccacuuucaggaaugacacgucagacgaaguagauacugugaaaguuguagccugcuacaucuggauguuaaaauuaaccaaaagugaacaguggcuauagauaaaggcugucucuugcuugcuauucaguaaccugcuuuuccugcagaucauuugacauucuguagguguguaguugguuuuuaugguucaguuacagcauguuccaugccaguauucagugaaaaaaguaaugcuucaaauucugaaucccuagaguuaaauggaauguuguuaugacuuaggauggguugguugggagugauaaaugagaaaaacuguuuuguccucuuaaacauuuacaguucuuacuugcugaaaguaaguacuuucaguuaaccacuuugggacuuuuuuuuuuuuuuuauuugagaugaagucuugcucugucacccaggcacccaggcuggagugcggucgcgcgaucucggcucacugcaaccuccgccgcccggguucaagcgauucuucugccucagccucccagguagcugggacuacaggcgcgcaccaccacacccggcuauuuuuuguauuuuuaguagagacgggguuucacuauauuggccaggcuggucuggaacuccugaccucaugauccgccugccuuggccucccaaagugcugagauuacaggcgugagccacggugcccagccuacuuugagauuuuuaacaaaaccagucuuaaauuuuaaaaucaguauuuccaagucccacugguuuuacuugccugggaaaguauuuuaaauaugucagccaguuaaguguuuacuuacauuacauauauuuuccauaggaaacaaaucuacuucaaagcuuucccuuuaccagcaaaacuuaacauuuuaguuguuuacuacauuucucugucacauguaggcuuaucuauaauuaaagauacaaagacuuuuguuaguaaagacuauuauggagccauuaaggccauauuuucaaauaauuuuuaguaauaucaaaaacuguucauaauuaauuuacuguuuccuuuaaggagaaaaaaaaggcgggaugcaacacguggcaaauuuguguuuaaaaaagaacggaaaggccaggugugguggcucacgucuauaauuucagcacuuugggaggccgaggccauccgaucaccugaggucgggaguucgagaccagacuggccagcauggugaaacccugugucuacuaaaaauacaaaaauuagccgggugugauggcgcauaccuguaaucccagcuacugggcaggcugaggcaagagaaucccuugaacccgggaggcggaaguugcagugagcccagaucacaccacugcacuccagccugggcgacagacugagacucuugucucaaaaaaaaaaaaaguaaauaacuaaaauuaaaaaaaauaagacuagaaagacagacaucagaauguuaacaguaguugaugggaguuauggagagagaggauuuaaguauucuuuguacuucucugcauuuaccagaaucuuuauguuaauuacauaauuuauauucaagacaauuuuuguuuuuuuaauaaaugcaagggauugcuuugggaauuccauuuauagaucuuagcaaaguaacuaccauucuuaaccaaauauuuccaaaaucaauuuucagaacaaaauuuauuuuucaaauaugguuuucccaguaugcuaaaaucauuaaggcgugucauuguaauagaucauuacaauuauuauaaccucucacuugaguagcauuuuaaguaauuuauuuaaaguauauauaauugaauacucuucugcugucuauuucucccuccuggccuuuaccuaaucagaucaggauuauauauaugagguaggaugcuggcucaagauaaguaaucauauguuauauauuaauuuuuaagagaaauucauguuguuugucucuauuuuggagugaccauaaaugguggcuguuacagagaaguauaagccuuacuuucuaggacccuuagccaaacuuagaagcaagcauugacuucaguguuuguaaggggucugaaaguauaagugcuaucugaauguguuaacagagcaugaaggugcauuaguaucuaaguguguuggcuaaaauuacuguacgcccuuacaagagagcagcaugaacuguucaguuuccauugggucacuugaaaccuguucaagggagucuucuuucaaagcccucuaggaaaaugaucccauggucugggauuuuacacuucuggccugacauauuuguacauucccuccucauuuuguguagccucaucugcagcagguccuccauguguaugucagaagcuggacaaacuaguacaucuggaagacugccauuagagaaaggaaaaucuaauuauuugaaauguaggaaguugacaacuugaagcgggacuauagugaaguauccaggaggguuuagugcaggguagaauuuaaggggucugugagcaugaauaggggaaaaaaguauuuauuuucacuaauccccaucugaaauuuaguguuuccuucuauuaugaaugucagcaacaaacuacacuaucuucagcagcacuugcuuguaccuuucaccaauagaaucacuuauuuucuugcuacauaugguuaucgcagguauccugaaacaccauuuucacucaucauuaucuuacguaguugucagauuacaacuagaucuugcaguuuugaaguguuauagagcacauguauuaugauaucaccaauuuuuuuuaauauuuuuauaauugcauuuaaauacaauugguuucuuuuguaauucuauguauuuuccuuuuugcauucaauaacacucuuuuaagaagucuguaagcuucaccagacugccaaagagaucuaaagguagcccugauuuuuagugauuuucuaaagauguccuucuaccauuccaccaacuuucucaguguuacagaacaucauguauuuuauuuucuuaguuuccaagccagcgcccuacugggaaggaacagcugugaucgauggagaauuuaaggagcugaaguuaacugauuaucgugggaaauacuugguuuucuucuucuacccacuugauuuguaaguaauacauguaaauagcuaguaaaaucucagucuuuaucaauuauuuuucaggaguaucaaacaaauuauuuuguucagcucuugguuuuuaaaaaggcaagcugaaguaaagaaauguauuuaaaaagguaacaucuaccauauauuucagagucauaacacaccgaccucaauacuuaugucuacaugauuauguuauaauggaauaauuagaggaaagcuacaauauauucauuaagcuauaccuacuaaggcaagaaaauggacugauaauauauuagaaagcauuuaauagcaagaccuaugccauaauucuuuuuacuguaucucucuugauuagaaaauuaauucuguaaucccagcacuuugggaggccaaggcagguggauuacaaggucaagagaucgagaccauccuggccaacaugguaaaaccccaucucuacuaaaaaugcaaaaauuagcugggcguggugguacgcgccuguagucccagcuacucgggaggcugaggcaggagaauugcuugaacccuggaggcggagguugcaguaagcugagauagugccacugcacuccagccuggcgacagcgagacuccaucucaaaaagaaaagaaaaagaaaauuaagccauuuucucuagugauaccauguaacugugguuuuuccauuuuuauucuuugcugcaucuguugcuuuucugggauuugaacauuuugcugaaaauauuauauacugcuuaaggaauaaggaauaacaccuguguauauguuaugguuauugugggguuucucgucuuuuuuuaacucugugacagugagcguuuuuguauauggucagaaaguugacuaaaaguaaauacccuuacagcuuuauucacguugaggauuuaauuuuauuuuacaaaacacuauuuugaguguuuuucaaaauucaugaaagugagaagagaccaaaaagaguuaugucaauuuuuaucuuuuauucucuuggaacuuacuuuuugguuacaacaaauaacuagaaguuuccuccucuaucuuugccacugugccuuuuuccauuaggacuaaucuggaacuacauagaucaaauuuaaacuugcagggaggguauacuuaagcucauugcuauagguuguuucuaggccagggauuaacaaauuuuuucugcuggauuuggccuauugaccuauuugccaaccccugcucuaagccacaaaggaagaauucucaugaaaauuauuacauugagacuaaaguuaugagucugcauaauauauaaucuuuuaaauuauaagaacuugcuucuuucuaaucaacucauauugugacuugauuuuuuuaaguauagcuuaauuucuaauagaaaccagaaguagaaauuucaguagacauaaaaaaugacaggccuucuaaauucauguuguuauaaaaccagaagguuaacauguauguuaaauauauacgacuaacacccugaauuuggaaguuagucuaauguagcagaaaaauauguucuguguuucuccauuguuauucauaacuccauaauggguaagagauaguuaauuggagcauguuguuagcaauggucuucugggacaaggagcuaagauagccucuuccuguuuucauguaaugcuggacugugccugguuagagaaggaagaauucuggggcauuugccacagucuacaaggaggaaaguuacaaacguaacccuucaguuuccugccaaaacuuuuucugucuucacuaagaaguuggucaaauguaucucuagguagcauuccuugaaauaagaagaaaggcagaggcugggugcaguggcucacgccuguaaucccagcacuuugggaggccaacaugggcggaucaccugaggucaggaguucuagaccagccuggccaacaaggugaaaccccgucucuacugaaaauacaaacaaaauuacccgggcgugguggugggcguuuguagucccaguuacucagcaggcugaggcaggagaauugcuugaacccgggaggcggagguugcagugagcugagaucgcgccacugcacuccagccugggugacagagugagacccugccacaaaaaaaaaaaaaaaggaaggcugaggcugaccauuccuacccuuuagaaaauauuaaaaauacauuuuauagcccagguuuccagggacaucauccgagauuagaacugucuacuuggacaugacagugcuguaccugaauaccugaaacauguuaaaauccuguauugguaucugguaggaacuugugcccuaacuaagucuauguuuuucaaacuuucuugaccaugucucacaguaggaaauacauuuuucguugucagccaguacacaggcacauauauauacgguaacauuccaucuggaugcaccagcacagccaugcuccuuaaaauacugaaaaacccucauaucaugugguaaauagccacuucccuuuccucaccaacuaguuaguccuccugccugaucccuuucagaaaccuccagaacuaaagccagcuuugaguuaagauuguuaaauauuuugaauaucaucacuguugaagacaaacauauauauuuguauauauaaauauguguuucauaauuuacccuuaguauguaugauagagucuccuguuuucuauucgauuucacuuuuuaaaaauauuuuuuagaacucaguuaauuuaaggagucccuaccacgguuugaaaaaaugccacccuaguaauauucuguaaacauggccugacaacaugaggguauuaagguauaaaaucccuggcugcacaggacugguagacaagguggaagaggaccuuaucaagaaaggagggguggggguacuggaaaacauugccuccucuccaaaauacacauagaugcaucuaauucauaggguugguauaggaauauuaaaaaaaaaauagugaaaugacauaaaauuuguauagauccuuugaaagcuauaaaauacuauauaaauaaaagguauuauuaaauaaaaguaauaaaaugagggguggcuauugcuauaagggagaagggaacauugguugacuacugaucuauuaaguuguaauaagaaaguuuauugagauguaguugggaacucuguaauauguuucugucuuaaauauuugauuaaaugacagucuuuuagacuacuccauuuugaaaagguucaaauauaaaauuguucuuaaugugcauuuuuauuauuaaagguauuuguaaaaauugucauuugaaaguuuagguauaugcuuauuuggagaauacugaauauuuuuuuuuuuuuaccuuucagcacauuuguguguccaacugaaauuaucgcuuuuggcgacagacuugaagaauucagaucuauaaauacugaagugguagcaugcucuguugauucacaguuuacccauuuggccuggucaguaucuuacacuuauauucguagaaaaaaaagaauggauuuacucuuaaagcauggacagauaacucuugauaugauauaagaauauagucauuuaucagacaauucaggaauagcuuuaucuaagaguaauacauguaacuacacauuuuccagguuaaaaaaagagagaagaguaauauaaucagcugcuauaauaaaaaugcuuaaggauuuuauaggacauuucaaaauaaggggaaaaguuaaaugcaauagaugugauuucuauagcgaaaaccacugaauuauaugcuuaugauaaauuggguuaccauaaucuggaggaaaaaaaucuuuaaaauaugccauuucucuguuacacaguuauauagucaaacucagcuuuuacaauuuugaagaaacaauacuuuuuaaaaaugaauuuuaaaaaauguuuaaaaauucauuaaucauaaaaagauguuuuaccuaaauucguuauaaagaauugcaaauuaaaaugacgagaugccaauuuucccugucugguuggccaagauuuaaaagauugaaaaaauguauccacuguggacaaaaauugaagaaacggcacucacacacagcuguuuagcauuucuggagagcaguugggcaacaugucucaaaauuggaaauuuacauguuaauaugaguuuuuauaguguccacagucuugugcagaaaacuuugugcacaauaaagaccauucagaauugggcugggcacaguggcucaugccucuaaucccagcacuuugggaggccgaggcaggcagaucaccugaggucgggaguucgagaccagccugaccaacauggagaaaccccgucucuacuaaaaauacaaaauuagccaggcgugguagcaggugccuguaaucccagcaacucaggaggcugaggcaggagaaucacuugaacccaggagguggagguugcagugagccgaggucacgccauugcacuccagccugggcaacugggcaaugagagugaaacuccaucucaaaaaaaaaaaaaaaaaaaaaaaaaaaaaaagauucagaacuauugguuuuaaaacauaauauucaauuuauuaaaguuacaaauuugaaacacaagcuuuucucauuuauaaucuguguguguauaacaaauuuucauugcuuggugagcuacaauuuaauuaauuacauuucccuaagaaauuaauucccauaaguauuuuuaaaugcaguuauauauuuaauauauuugaauuccuuaaguaucucaauuuucagacaaaccuucccaaauacuuaaguaguucuaauaugccaaauucucuuaaacauuauaaauaacuuaacauauaaauauguacugauuauuucuuaauguaaaaauauuaaaauagccuggcaugguggcucacgccuauaaucccagcacuuugggaggucaaagcaggagaaucauuucaacccaggaguucaagaccagccugggcaacauagugagaccccaucuauacaaaaaauaaaaaaaauuagccaggucugguggugcaugccuguggucccagcuacucgggagccugagauggaaggaugaccugagccuagguggucgaggcuguagugagccaagaucauaccacugcacuucagccugggcaauagagugagauccugucucaaaaaaaaaaaaaaaauuaaaauauaggcuuaauuugcuucaucauuuccuuuaaaaaaagaaagacagggucuuacuauguugcccaggcuggagugcaguggcacaaucaaucauagcucccugcagccuugaacuccugggcuccaacaauccuucuaccuccccaaauaguugggacugcaagcuugcaccaccauaccuauuuuaauuuuuauuuuuguagagauggagucuugccauguugcccgggcugugcuucaucacuucuguaguaauuauaaaucuuccgaggauuaaaaugcauauccacuaaggaaaaaguuauggcaucccaaauaauuugggauugcuuucccaaggaaauuuggggauacauucucagccugauaggguucacaucaaccagaaauuucuacuugggugucagaacuggggcuccagauaucuagagcaaugucguuuuguuuucuaucugcugugucaguacccuccuguuagagcaucagcccaugucuccugguuucaaguuacagaauacagauugagcgucccuaaccugaaauccacaguguuccaaaauucaaaauuugagugcugacaugaugcucaaaggaaaugcuuagugaagcauuucagaguucagauuagggauguucaaccaguaaguaugcagauauaccaaaaucggaaaaaauccuaaauccaaaacacuucuggucccaagcacuuccgauaagggauacucaaccuguagugaagacugaggcaucugauauuauaacucacuuccuucacugcuucaaguggacuuugcauuugucucucagaauauuaaaaugucauccauuuguauccugccugucuguucaaggcuuuaucuuaugaucacacuacuaagguuaugcuuuugauacuacguaucuuuugaucuaucaguuucacuuucagaaaucaauuagacaaguguauaaaaguaagaauacaaggauguuuucagcaguguuuauaaagcaaaaaaaaaagguaaaugguuuaaaucuucaucauggaauuaaguaaaauacaguaaagauguuccugacuuacgaugguuugacguauaauuuuucaacuuuacaguggguuuaugggauaguaaauacauuuuuagcuaaugauauuuucaauuuaugauguguuuaucaagacacagccccagccgggcacaguggccuguaaucccagcacuuugggaggccaaggugggcggaucaccugaggucaaguguuugagaccagccuggccaacguggcgaaaccccaucucuauuaaaaauacgaaaaauagcugggcgugguggcgggugccuguaaucccagcuacuuacaagguugaggcagcagaaucacuugaaccugggaggcagagguugcaguaagccaagaucgugccauugcacuccagccugggugacagagcaagacuccaucucaaaaaaaaaaaagaaagaaagaaacaaccccaucuuaagucaaggaguaucuguguauccauacauuaaaaauguguuauaggccaggcgcgguggcucacgccuguaaucccaguacuuugggaggccaagccggguggaucaccugaggucaggaguucgagaccagccuggccaacaugguaaaucccugacucuacuaaaaaugcaaaaaucagccaggugugguggcacaugccuguaaucccagcuacuugggaagcugaggcaggagaaucgcuugaaccugggaggcagagguugcagugaaccgagaucacgcugcugcacuccagccugggcgacagagcaagacuccgucucagaaaaaacaaaaauguguuguaggcugagcacaauggcucacggcuauaaucccagcacuuugggagggugaagcaggaggauugcuugaagccaggaguucgagaccagccuggguaacaaagccacaccccaucucuacaaaaaaguguuuaaaacauuagcccagugggauggugcacaccuguagucccagcuucucagggggcugaggcaagaggaucgcuugagccuagaaguuuuaggcuacgcugagcuaugaucacgucacugcccugcagccugggagacagagcaagacccugucucaaaaacauaaaauaaaaauguguuguguauauauauuuuuaauguuuaaaggauaugaauauauuaaaugggaaaagcaagaaaauagaaaguauauuagccuguuuuuguuagugaaagaauguguguauuucaugugugugcgugugcauguauagagaaagagugcuguuuuaauauaugccguuuacuuagcucugagagguaagcguucuguuuguuacaggauuaauaccccucgaagacaaggaggacuugggccaauaaggauuccacuucuuucagauuugacccaucagaucucaaaggacuaugguguauaccuagaggacucaggccacacucuuagguaccuuucagugguuuuauauuaugacaaauccaagcguguuuauaauccuccuugaaauagauguuauuuaugaaauagaagaacaaauuuugaucaagaaauauaauuuugaggccaggcacgguagcucaagccuguaauccuggcacuuugggaggccacggugggcagauuacuugaggucaggaguuugagaccagccuggccaacauggugaaacccugucucuaccaaaaaauauaaaaauuacccaggcaugguggcguaugccuguagucccagcuacucgggaggcugaggugggagaauugcuugaaccugggaggcggagguuucagugagcccagaucaugccacugcacuccagccugggcgacagagugaaaaaaaaaaaaaagaaauaauuggcugggcaugguggcucacgccuauaaucccagcacuuugggaggccgaggggggcagaucaugaugucaagauaucgagacuauccuggccaaccaacauggugaaaccccaucuuuacuaaaaaauacaaaaauuagcugggcauaguggcauacgcuuguagucccagcuacucgggaggcugaggcaggagaaucgcucgaacccaggaggcggagguugcggugaggcgagaucacgccaccgcacuccagcccaggcgacagagcaagacuccgucucaaaaagaaaaaaagaaagaaagaaaaauguuacuuuguucuauuagucuuuaaacuacuaaacuuaaaccguuaguuuauauuacccugauuaaacuauguuagcaucauagacuuuuagagcuggaagauuauuuagaggucuuucacccacccugucaucuuacagauaaaagagacagauucauagaguuccgugaucuuagccaaaguuauauaauaauuuaauugcagagcccagacuuaaauccaggucccccaacuccuuguccauuucuuuuuccuuuuuugcaaccugacuccaguaauguuuuuuucuaaauacaagugucauacuacuuagcaaaccugugucuuuggaguaggaaaaauuaaggaaauauuuuacccagacgcucucacuggguuacuugagcuaacaaacauuaauagaauucuuugaaaagggggcaauuuuaguguggaacaguuguaauuugguuguauugauuugcuuuguagugccaauaguuuuucuugaauguuuuaugugaaagugucaguauuuuauaauccuguguuuuuuuauaacaacuuuauuggaauauaguucacauauaauacaauacccauuuaaagaauacaauucagcugggcaugguaguucaugccuguaaucccagcucuuugggagaccuaggugggaggaucccuugagcccaggaguuugagacuagucugggcaacauaacaagacccuugucuucuacaaaaaaaaaaaaauaauuuuuuuuuguuaaauuaggccauugugguggcacauuccuguagucccagccuacucaagaggcugagauaagaggaucgcuagagccuggaaguucaagguugcaaugaucuaugaucacaccacugcacucucgccuggguaacaagagugagacccugucucuaaaaaaauaauuaaaauuaaaaauaaagaauacauagccgggcgcaguggcucacgccuguaaucccagcacuuugggaggccaaggcaggcggaucacgaggucaggagaucgagaccauccuggcuaacacggugaaaccccaucucuacuaaaaaaaauagaaaaaauuagccgggcgugguggcgggugccuguagucccagcuacucgggaagcugaggcaggagaauggcgugaacccuggggggcggagucugcagugagccgagaucgcgccacugcacuucagccugggcgacagcgagacuccgucucaaaaaaaaauaaauaaauaaagaauacauuucagugguuuuuguguauucacagaguugugcaaccaucaccacaauuuuagaauguuuucaugcuccaaaaaaccccauacccauuagcagucacuccauguuuccccuaacccacuuccccuggcuuuaggcaaccacaaaucuacuuuaugucucuauaguugccuauucuggacauuucauauaaauggaauccuacaauaugugcuuuuaugacuagccucuuucacgcagcauaauguucucaagguucauuguauuguaucauguauugcuaccaguaguuuccccucuuuuguacuugcuaaguauuuaauguuuucugcuuucauaaaaucuguuacuaaguuaauuuccaagaauaaauaugccccaaaaacgacugaggcaguuuuaaaauguggaaucauuugaacauuaaccaaguaaaauuaucuaacguuagcuauauuauuugaccugagccaguaguuucuuuuuaaaauuuuuuuguuaaggccgggcaugguggcucacgccuguaaucccagcacuuugggaggccgaggcagguagauugcucaaguccagcaguuugagacuagccugggcaacauggcgaaacccuguuuguacaaaaaauacaaaaauuagcugggcgugguggcacacaccuguagucccagcuacucaguaggcuguggcgagaggaucacuugagcccaagagguugaggcugcagugagccgagaucaugccacugcacuucagccugggcaacagagugagauccuguuugaaaacaaauaaaaaauuuauuauuuauuuucaaaauaauacauguacauaugcacauaguuuuuaaaggucagauuaucuucaacaacuguaaauacucugguacauuucuuagccaaaaacaaauuuuuaaagcugcaguuuuacagugauaauuccaaauuauacauuagauugagggagggauguccacagguguguguacguguguguguguguguguguguauaccauuggaguagguagguagugugguguuuguucuguauagcauccuuuuguguggaugguauaggaauucacaauacauaaaugagaagaaaugaccucaucucuaccauucuucuguuuuacagaggucucuucauuauugaugacaaaggaauccuaagacaaauuacucugaaugaucuuccuguggguagaucaguggaugagacacuacguuugguucaagcauuccaguacacugacaaacacggagaagguaccucucccuucuaaccuuuugauuuuuuaguuugaaagauagcauaauuaguuagguuucuuaucguaaaaguaaucgauauuuccaaaguuuucugauuauuuacaaauuauuagcagauccuuuuaacagaccaaauuauaauuuacagugcuuuaacaaaauaucaggccaggcaugguggcucaugccugaaaucccagcauuuugggaggccaagguaggaggauugcuugagcucaggaauucaagaccagccugggcaacccagugaaaccucaccucuacuaaaaaucaaaaaaaaaaaaaaaaaaaaaaaaaaaaauauauauauauauauauauauauaaacuaauauauucugcuuacuaaaugagaugcaaaaauauucacuauuugcauaguccuuuuugauaaacucaaagacaaaaguuucugcuacugcaauuuuuaaaauuauguuucugcaagcuuagaaugugucaaucuggcaacauuuagugauguaguuuucauuugccucuuugcauuauugaauuuagccuuuuaaauaauccuugaucacuucucugccuuucagcuaagaugaaguauaguaauguaaucucugggcuuauucaguaucacauuuguaaucuacaaguucaucauuuugcuaaaauagaacacauuauauauuccuuuuaaaaaugucacugagucaggaugcauucuaaugucucuuuugacaaacagugaaucaugucaucaguacaaaguacugaaguauacauggcaaacaagcguacuggaaguuuauguaaauuuggaggaauuuuugccaugcccaggccuuucagcucaccagauucccaaacuuuccaacuguauuagaggggcaaucaauuugauuucuuauauuuuaaauguaacuaaacauaauugguaaaaaugaaaauagauuagcugccugcuuaugagcuccaugacuaaaauuccuuggugucaacaggcagcuaauagaagucaugugcucgguggucuggaaauguucuuauuaguauauucuauucaguuucauauagaaacagaaaaagucaguugcugaagguaacugaauucuguuuuuaaaaugucuucugccucuuuuuguuucuuuuagucugcccugcuggcuggaaaccugguagugaaacaguaaguauauauauauguuuuuauguugaguugaugguuagaguugaaaaaaaugcuggccgggcgcaguggcucacgccuguaaucccagcacuuugggaggcugaggcgggcagaucacgaggucaggagauggagaccauccuggcuaacauggugaaauccgucucuacuaaaauacaaaaaaaaaaaauuagccgggcaugguggugggugccuguagucccagcuacucgggaggcugaggcaggagaauggcaugaacccgggagguggagguugcagugagccgagaucaugccacugcacuccaugcugggcgacagagcaagacuccuucucaaaaaaaaaaaaaaaaaaaugcuaaccuuagaauaaucuucccuuguuacuagaacugucuugauuuuguaaaugaaguaaacauugcuaagcagaaaucagaguacagacauucuuuggccuguaggaagaguagcugaaaccggagaaagcagaauauggggcgugaugcugugaauuuuaaagccagguauacagauaaauacaccguucgaaaaaaaaaaguagggcagaguggagacuugguagaauaauucagaggucuuauaggucauguaucgaauuucuuccuguauugggacaaagaaaacagucacaagcaaaaccuuucuaugcauaguaagagguuuugagaaaaucuagcucaauuaauacugaagauaaugauucucuccuugucaugaagaaagaaaagauugaaacacguauauucuuucauuuaggaggcuguauaauuuuuuuuucuuuuuugagacggagucuugcucugucgcccagacuggagugcaguggcaugaucugggcucacugcaaccuccgccuccaggguucaugcaauucucaugccucagcccccuaaguagcugggacuacaagccugcaccaccacacccagcuaauuuuuguauuuuuugguagagacaggguuucaccauguuggccaggcuggucucaaacuccugaccucaagcgauccacccaccucagccucccaaagugcugggauuacaggcaugaggcaccgcuccuggcccaaccaaccuauuuaugaaagcauuuauuaccacaaccuaaaauuagaauuaggauauaacuccaagggcagggacuuuggcuguguuguucacuaauaaauacugccuaucauaauaccuugaauaguuuccauauagugagucuguugaaagaacguccaaacacauaaauauauacaacuauuauuugucaaucaaucaaaaauuaaaaagaaugaccaccacaguaugugauaacacguaugcauuuuucuggagggagaauccauaguuuucaccagauucucagagauuuguggcccccaaaaguuaaucauguaaauagucaacauguuuuccgaaauguccgguacucauccuauaauaccuuucagagugaaauuguacuucuugggagcucucacugaucucugggaacuuggacaccuagcacaugccugugauuggagaugauguuuucaucagucacagaggguuuugcugcaccuccagggggaagugcccccuaccuugaagaugugucugaaaugcuuuuuaaggcuucuuaagcugcugcuuaagccagcagcuucugauucauauuucuuucuauaagccucauaaucaacaaauguaaacuaaugugacugauuuauacuuuaagguaccuaguggucaaaguaccuuuaauguguaauuucaaauccccuuugagauccaucagauuaacauagagaugaguaaguuugcuauuguaacauuaacuuugaccucaaagcaaaacuguuuugcaaacccaucagaaauugauucagaaucagucaauuacaaaaguuacaauaaguuauuuuuauauauauaaagauagauguacuuuaccuauaacuagcaaauaacauaaugugaggccaaauuauauuggaaauuuuuuuuaagucuaacaggauucuaaggcugugaugcucuuagagggaacacaacaguauucauuaacuauugacaguagugcuugauguauuugaguuuggguuuuuuuuuuguuuuuuuuuuuuuacuuugcagcuugagauuuaaaagguguauucuggacuuuagugagcccuuagugaacaccugccuccuuuucagauaauugugacauaccaucauuuuagcagcaugauuuuaaaaguacauuaacaucuguagccaugcucucuaaauguguuugacuuaauuagaucaaaccugaagauaccaugaaagccugguggccaagagagagcuguaaguaaguuuuggggugcuugaguacagauguuaauuuauucacacaaaauaaaaauauuugucuuuuggaauagccgaaauuaguaggcaggacaaaucucauuuuuuucuaaauauacaaucugauauacaaaaauaauuuuuagucaaggcaugggcaacuaaugucagacuacucauuauguacuuuggcuuuaaaaugaauaauuuccuuucuucguuuuguuuuaacagauaaucccagauccagcuggaaagcugaaguauuucgauaaacugaauugagaaauacuucuucaaguuaugaugcuugaaaguucucaauaaaguucacgguuucauuaccacau

SEQ ID NO: 19215 - RNA, 573 nt, Homo sapiens
acccgcgccgagcgugcgccucgcccuccucccgcgcccgcucugcucuaggaugcugcggcagguucugcacaggggcuugaggacguguuucucccggcucggccacuucauugccagucacccugucuucuucgccucggcgccggugcucaucuccauccugcucggcgccagcuucagccgcuaccaggucgaggagagcguggagcaccugcuggcgccccagcacagccuggccaagaucgagcgcaaccucguuaacagccucuucccggucaaccgcuccaagcaccgucucuacucggaccugcagacccccgggcgcuacggccgggucaucgucaccuccuuccagaaagccaacaugcuggaccagcaucacaccgaccugaucuuaaaggugagaggggacgggugcgggcagacuccgccagcgccgcggccgcggucgggcuggcucugcgcuggggucccggcugagagcgccaccucuccuagcccaggcagcugccgcagggacucuccugcaccgcgcgccccagggcggccgacuggagccucccagccucc

SEQ ID NO: 19216 - RNA, 965 nt, Homo sapiens
cugugggcaaugugaaugcuugauauacuugagcuuccuuuacaccaccuccaagauccaagaagcuggcuggcuuccuaccauuaaggaaaaugauaucacaaguagccauggcgagcccagcaccauucacaaagcaggcaauguucccaucuaguccuauguauuuuagaucauauuuggcagcuucauuuucaaugggcucauucucugauuugucguccauagcaaauaugucuuuuuguuggaauucugcauugucaucaaaguuuaucuuggcaucaaaacagacaacuuguccuucuggaguuucaccaaagggauucacuuccaccugaguagcaucaauuuucaggaagagauuauacagcuucguaauuugaucugcagccuggcuuuucaaaggcccaacgaagccuagauuuucugccauccgcugagcuuggcuguccuuuauuccuucaaaaaugucaauuugcuccuuaaaaaugagcucuggguuugaagcagccaccucuucaaugucgaugcccuccugggggcugcccaccagcauggggccauugcaggacugguccaucagaauugccagguagguuucucuggaaauguccaaggcuucagcaaccaucaccuuguuaacuuucacaccuucuuuuggaguuuguuuugucgcuagauuguacccaaucaucuguuuagccagcugucccacaacauuagggucuuuuguuaaaugaacaccucuuuucaaaccacuauugaagacaccuuuuccucuuccuccagcuaagaucugggcuuuuaaaacaauuucuuuugcauuuagucucuuagcggccucaagagcuucauucgcagugucugcuacaaagaaucuuugaacugucacucuguuaucagacaucaguuucuugcucuggcauuccugcaggcucagccaucuucuggagguuaauugaacu

SEQ ID NO: 19217 - RNA, 18243 nt, Homo sapiens
gggaggugacgggacugauuguaaagggcacaugaggacuuuugggagugacagucauuucuguaucugugcugccaccuucauagcacauuggacaccuaaaaaggguaguuuacugcauaaguaaauaaauaugccuccaucaaccugacauucguuuugggccacuuagaaacgagcuccagagcuaccucuuggaauguggacuagauaagcucugaccucaacacuaaaaccuauuuccuuguaggauuuccagugcaguuagggaugugauuccuaaggaaaggcauuugaaagauguggggauaagcauuuaaagugguagaccuaacaugucaaauuccaaacuaacugaagguauccuagaugaggaggcuuucuagaaagugaaucucagaauuaugaauuguguaauacguauuagcgugguucagugauacaggguuaauucaucucuuuuucacaucacauuuacauucuggaaucauuuauuaauccaacugguuacuuuugaagaguuuuaugguuagacuaauauauaacaaauugccaaucguuacagguauuacagagaacccagcaggccccuacgggcagagaacagauaaagagcuuauagacugguugcggcugcaaggagcugaugcaaagacaauugaaaagguaaauuuacaacaaagaaauucuuaugcuguuguuacacagcugcucagcucuuaaggaucugaucuuuguuucagauuguugaagaggguuauacacuuucggauauucuuaaugagaucacuaaggaagaucuaagauaccuucgacuacgguaagagccucaaaacaguuuguauaagagaauacaacuuuuuaugugugaauaugcuucaagagcagaaaacaaagggcugggccuccccccaaacucuggaguucuauuagguucaagcugggaaaaagccaagguggggcagaaacugaaagccaggcagaagucagaaauaggaaugugacagagaagagcuggccaaucuccugccauuaaugccuggcugggaguggguggaggcacauggcaagcgugccugcacgcuggacccacccccuucuuuaaacugcagccugccuucuuguucccgagucauuugaaauagccagcucucugcagguacguaccucuaaggccauguccuacuacugcugggacacgagcgucaccuccauaugugaggagaauguuuuuauuuucauuagguuuuuaaauuagggacugcaguuuuaagcucuguuggcuugaagcacugacucugaagacagcuguguuuguuucccagggguggucuccucugcagacucuggagugcggucucccaguacagaagggcucaggaggccucagaaaccaaagacaaggcuugauaccaaucagcuaagcuguggcagagugucccaccacgcuacauguuuuguuaaagcuucuguuaguguauacacgaauuccgcuguguuuacauauuuaaaaaugccauuguucaauuaauaguuuaagaacuuguuuuaaauacuguccugaguuucuuuugaaaccuguuauuuauaaacauagaacuguguguauugugaaaacagugagccuugguuuugaccucccggaauauuaggaaauucacuuguagucccagcuaugcaggaggcugaggugggaggauugcuugagcccaggagguguggaggcugcagugagccaugaucacaccacugcacuccagccugggcaacagagcccgacccugucucaaaaaaaguacacccuucagcacuugcuggaauggugaaacaaacaagggguauuuaacaaacauggaagcugggacacugccucagaacugguaugguacuucaauuugagaaacacaaaacugauacgaaugugccuuguaguuaauguuugauaugaacagaaaauagcuucauauuuauacugaauguguaaguagagaaaacuaaguuauguggccuuugaaaugauuacaaaauuggaaugauuacaaaagucuuauuuuaaaauggaacuguccucuugccugauaauaaauauuguaucuuguagagaaauggucagcgcgaacaggcugcagcaccagcgcugcucggggugggugcuaugguugguagaaugcugugaggggccccgccauaauggucuccucccaaaaagguggcugggggcaggggaaacaggcauacaaggaauuguucuuccuuuucauaauuagaguauuuguucaaaguauacuauuuuaagucaaaaauaaucuuuaagcacucaauaauucaucuuuuaaugcacuaauguacaaacugcaugcaauuacuaccugcucaaucuacacacuuaauggaaguuuccaagaauuucauugaauuucauugacuggguuuucuuccuccuuaaccaaguugagaacacugucugguagcccccugaagguauaaccucuccuucuccuccccuuaacugacugacuuaaacuugauccacugauuggcaccacgaacuucaaaaggugggucgcuggaguagaugugguagcccagcucuuccaaagguggcucaggaucggccguggcaaacugggcagcauccucaaucuccuuccucacuuccacaucaauuuccuaaaaauuagguaacaguguaaaagguuuuagaaugaacagcagcuuagguaccaacuagaguucugcugaggaccuguugcugguguaacucuuuaacuacaaguacgaacaguugcuaauucagaagauuuuggaauacagauuucuaggguguaucuauuuuaugaauuaaaaauccacaguauacuuuuaggaaaaaagaaccauacuacugugggggcuuugccacugugauggugguucacaguccaccaaaaucugaaaucugaagaguaauacaauuuugaauagaggaaacuaaaggaaaagcccccaccccaagggacuuuggaacuauggaacuauuuaugucccaggacaucacuuucugggcuuggaggaacccacacaaacucuguggccacccagggguggcaacuuuuaaagccaaccuucaaaccaccaugaacaagugacuguaccuuuaguucuuccacacuggcaagauugcuguucaccauccuguccuugagaagcauaauagggucacucuuacuucuuacuuccugaauuucuucucguguacgguaacuauggggagggaaaaguaguaaucgaucaguaagagcaguuccaguagagcaaggacggcgugaugaaacaugauaugggguuggauugucccaaugaggugaaauacagaaguguguuucugaaacaaaggggcauaccaaugcuuaugucacuauaggcguggcagaguuguuguuauacuuucaaaauaccagaacgcagccuaacauucuguaauaacugcuucugucuuuucuagaaaaccguacacuggugagucacauggcuucccuggcauuccgacaacaggggccaaguuuuugcuugcugcuuugauuuagauguaagguucuaaagaagugucacuugucccacccauuugggcuccuguauacuacauggguggggacagcagagaugguguguguggugauaauuagacuuugagacaucagagcgccaagcaggaaauccaugugccuugccuuucucccuuaagucccccuaaagaagcacagccagcaaaaccaauguaucuuaugccuauaucaucugaaguaacacuaaaaggauucuaccauuuucaacaauagauuuacacaaagugcauuuuuccauauacugugcucucuacaugauuuuuccuuagaaguccacucuacaaaggcuuauuuauucaacugugucaaaacugggauuccagaaucacaggccagagcuacuaagcaaaaaaguaaaauucaugccuuccuaguggaaccuagcuuuuuugauugauguauuucaacggauugaacacccaguuacccuuagcucuauaccagacagaggaacaucuccaaauucugauccucuucagguagaguaugccagguguagacuugggguaaugccuacaaaagcuaaaugcccccaagauacuacacuaccaucagcccuguuuuauguaacaauuucccucuacaauuaagguauauaacacucuuucuuuaaaaauugcugcuugugcucacacacacuauacacuguaggcauuuucagaaagcuuucuuauuaggaggcacugcuuucagauaacuugaugcccaacacaacugcguacaugaagugaacugguaucuagcuccaaaagcaaauacugaaauguguugcuuuugccauguaacaccauucaaagcccaccccuauggaaaccacacugcccaugagcguaccugacuccagggucacucauacuguguccgugguaacgguaagucugcagcuccaucaggaugggccccuaaaacagaaccgguaggcaguuaguuaguuaggaacgaugacuggaagaacaggccggcaauccacggccucaaacgcaggcccuuuauuaagcguccaguguagucuuaucagaucuucugaguugucacgaauuucuuauugguugacugaucuguucucauuucuagcaaguauugauugcauauuucaucuuucucauuuuuaauaaggcaaucugccaacagcuuguuuugaaucaaaaaggcuuugaaggccaggcaugguggcucaugccuguaaucccagcacuuugggaagcugaggugggcagagcacuugcgcccaggaguucgagacuagccuggacaacauggcaaaaccccaucucuaucaaaaaauacaaaaauuagccaggcaugguggcgugcgccuguagucccagcuacuugggaggaucaccugauucuggaaggucaagggugcagugagcugugagugugccacugcgcgagacccugugaaaaaagaaaaaggcucugagcauguucuagagccuccugcuauuggcuagacagauuuccaucucaugcuccuuucucaugguguguuguggggcuggcagccacuccuacuucacagaccuugcuaguguguaacaaaguuggcaggcaccaacaaccucugcuacccaaaccccaaggcucugcugggagucuggacaguugggcucgcucauucuacacuagcccacuuccaggagacggcucugaacacugggguggagaaacauugaggauccuugguugguuuggugcagcaguuaaaaugggcgaguggggagcuggcuccaagacagaguagcuguguaccuuuaacugcucuauggcucaguuuccuugucugcaaaaugggcaaaacaauaacaccuaacucagaauugugaagguuaucuguuugggaaagucacacauucuacaacuacauucuacaacuccccuugucuccagccagggcuggcccccauguauucuuuucaggaauugggagagguggcgucaauacccaucacucagggccuggcacucccagccuuaggguccugacauagacugcucagcccauuguacccaagcuguagucuugguccugcucuaguucauucuacucauuagcucuuauuuaauguuacuacauucccacccucacuucccugucucuccacuuugugacauuuccaucauugcuggccacaucugauucacaucacugccuaaacguacaugguauggcgcugaagugccaacuucagaaaccuuguuucugggcuguagaacacugauuuagggagaacacccaaaccuccuaagccuauacuagugccaaaggaagugaaaccucuuuaggccagucucccucuuaccaucucccucacugccauacacugaaaagggaaagauccuuaggacugagcaagacuaagauuacgagcuucuaccauacuguuuaauuuguauaagacacacauauuaaaugccuauuguauacaugacauucuaugcuggacacuguggggauccccaaucuguuccuucaagggacucaugauuaaugggggguggggaggagggacagaauuaaccuaaggaaaaggcaaaucaguugucaugaagacaggccaaagcagaggaagcaccagaacggacuucccccaaaugagagaaacguaggcuucccagcaggugagcuaccaagaccaagcuacccaaaggagcccugcucccuucacucugcuuccaucucaugcaccucaauuagcagguacccacuaacagcuucagcaggcacaugggaggcagucuuugaacuuccagagauaaaugucacuagcccagagggcuuuagagccuuaccuucccagaucuacaauaggcagcagcaaaccuuguugccucucggacgcacaggauauccauuccauccaccugguaauaaacaggggaggggcgaagcaugaauccaacugccccaaaccauuuuacuuucacaugaccugcuccuguaugagaaugaaacucuccaauguuucuaagaucgucaagggucugcacaaggacauacccuuggccuuggccuuggccccggccccaccacagguguccuuacucucagcccaggaaugaaaucgccucucuuguaguaaucagugcuggcugccgcucucucaacagacguucccauuccauagcgauuauucucacagaugaaaauacaagguaauuuccacaaagcugccauguuguaagcuucgaauaucuggcccuggaaguaguuacgaaaagggguuucauuuggcuucuuucuccaggcuucaucaucucuaacagcugcugcucugccuggcacagaaagcuuucauaaagcacagaaagccuccucuucuaaaaccgagcuuuggguggugagggaaagcggggugggugguggaggagaaguagcaggcaucauacucuugcaacuaaggaaggugacaaaccaacuacuacuuguuucuuuggggccaugcuagcaguaaggaacacacuggaaaaaagaucaauaugaaaucuaucaggcccacuggauagccagagugaaccagcaccuaagaaucagccucuagaacagggcuucacagagugcuggccacagacuggggauuacucgguaacaagagaagcauagaaacugaguuaggacucagacgcuauuauccgaauuugacacugccagcccggacauccaagagaaugggucuguauuguuuugcaauagguuguggggagguccuuuaccacagggccuuugccaagcacugauguagagcaaaggugagcuccuucacaggaaugugcccccguaagucucuugugaaacaacgcuaagaggucaaucucuaaucuggccauaagucaaccaaauuugagcuagccauaggacuugcuauuucaccuaauaagcaauaugcuacuucuuuagaaauucaacuguaaauauuaaagacuuugaaaauaagacuguuuuugggaaguuaagagacauaauuaccugguuagcagcaccaucgccauauaaagucaggcagaccucaucuuuuccauuauacuuacaggcuagagcaaucccagcgcccaggggcaccuaacauuaaggacaaccgagaaaggaaccacagaaauccaugaggggagauacuaauuaaugcccugcauuuucacuccuggccagaaucugacacagaaauuacacugcugcuacaaacucuccuuccaacccuaucucucuguuuaucccaccuccgauauuuucaauaaagcacuaaaguaauauauaaauacuauguucuauuuuaaccaguaagcacuaacauuucugcauucaagaguuaaaaaauaaaaccuggccgggcgugguggcucacgccuguaaucccagcacuuugggcagaucacgagguccacagaucgagaccauccuggacaagauggugaaaccccgucucuacuaaaaauacaaaaaaugguugggcaugguggcacguaacuauauucccagcuacucgggaggcugaggcaggagaauugcuugaacccggggguggagguugcagugagcugagauuacaccacugcuccagccugggcggcugagcaagacuccauuucaaaaggaaaaauaaaaccuagguuuaaaaaaaaacaacacauaauagaaucuuaauauauuagaaaggaaaagaaacaguccggauauaauuuugugcuguuaauucuucaucauucacuaacugaugagaacaaggaccccaaaaugaaguugacaagauaaagcaauuaauguacugaaauauaaauaggaaggggaagguauggcuccacugcuagagguuccugcuuacuuauaaaacagcagacaccuaaaaggaaacauuauaaaucaccauccaaaucuacucaucucucaaacgguaggauaugaagcacuaggucuuuaaaagcaaaccaagcccccaaaauagucacgcgucacuuaacaacagggauauauucucagaauugcaucacuaggcgauuuugucaugugaacaccauacuguaaugcacgaaccuagaugguacagcccacugcacaccuaggcuguauaguagagccuacugcuccuaggcuacaacccugcacagcaugugacucuacugaauccuguaggcaaaauauuuguguaccuaaacguagaaaagguaauguguugugccacuacaacaucacuaggcgacaggaauuuuucagcuccauuauaaucuuauggguccaacaucauauaugcgacauugaccaaagcgucacugugcagcacauggcuguacuacuucaggaaaaguugucuggggcugugaaaguuuuugaagacaaaguccagggccaaaucuaaagcagcacacaauccucguccuugacuaccugcgcucccacgaugccauugcccccguagaaguucuuggcauacaugugcaucgauccuccuuucccuuuagcacaaccuccuuuucguccuggaaauggcagaacauacacaugugcagaacaaaccaacucuacaaagcaaaccaaaccgcaccccaaauauguacucugaggcucaaccauuagaacacagaggccaguucagucgucuaaguaccugucccuccaggcaaacacauguuucuccuuguccuuucacuaguuccaugugcuucaaccuuuccagcuuuuccuacucucuagucacuuaguuuccuucagauguuccauccagaugauacccuggacuuuucuggguuuucuggccaguuacaaacaucuuaggaccucuccuauacuaguacacuaaauauauucaauccuugaacaggguuugaacugcacagguacacuuauacacagauuuuuuuucagccacacauguauugaaaauagaauauucucaggaugcaaacccgaagauauggaaggcugacuuugggacuugaguauuugaggauuuuuguauacucgaggguccuagaaccaauccccuggauauauagagggacaaccauaguucaagagucaaggagggccgggcacggcggcucacgccuguaauccuaacauuuugggaggccgaagaggguggaucaccugaggucaagaguucaagaccagccuggccaacauggugaaaccuggucucuacuaaaaauacagaaauuagccagguguggugguugggcaccuauaauccuagcuacucaggaggcugaggcaggagaauugcuugaacccggggggcggaggcugcagugagccaaaaucauaccacuucacuccagccacuccagccugggugaaagagugaaacucugucucaaaaaaaaaaaaaaaaaaggaggaggaggaggaccgggcacaguggcucacgccuguaauccuagcauuuugggaggcugaggcaggccacugcacuccagccugggcaacaaagcgagacucugucucaaaaaaacaaaacaggccaggugcgguggcucacgccuguaaccccagcacacuuugggaggccaaggcagguggaucaccugaggucaggaguuggagaccagccuggccaacauguugaaaccccaucucuacuaaaaauacaaaaauuagccaggugugguggugcaugccuguagucccagcuacucaggagguggaggcaugagaaucacuugaacccgggagguggagguugcagugagccgugaucacaccacugcacaccagccuggacaacggagugagacacagucucaaaaaaaaaaaaaaaaaaaaaccaccaaaacaaacaaauagucacgggggacaaagaaaaggggaauauuaagaagauuucuagaauuuacauugcauaccauggagugcuucaaccgaacuuacuuucuaugacugcuagacuucuucuggcaugcuugaaugauaaccaaaccuacugugauuuuauagcaccaaccuguuuuaaacuuuuaccugaggggccagagaacuucacaaauggucaguuaacucaagagcacaacagaaguaccagagcaccaaaggagagaggguuaaaaaaagaaacuuaaaauuuuuaacaaauauuaacucauaauagcaucuuaaugacagauauuuaaaaacuuaauccacucauuuccccuuucuguaaaucaacagcaaaccuguaagcucugcgagaauuucucggacggaaaggccccgggugaaaguaaagccgugagcccgguaggcugugaugagauggucugugggguugaugccggccuccaggcccacacagcaagcuuccuguguuagaggaaggagaaacuaugaggcaauaugauacauguuucuaaauaaaaacguuuccuagaccacagugaaauaugugggcuaguagaaccugucauuaauaaccagagaaaguagcuauuuuccaccaaaauacagaguggaaggcccaaaccagaagcaauaaacuggcaacccacacaugugccacuuccuuccuuucuccuguaugaugaccuaaaagaaaagccuacaucagaugucaacauuaaaacacuggggaauuucacaugaaaauccagacuuccgccuucucuuagacauggaaaacaggaaacauuaccccugauuuccacauggcaccaacuggcuggaaccaagucauggcauuccucuggguagggcaugcuggugccaguucagcaugagucccugucaccauuuucuguuuuguauaccuagccuucuucacucauuuauucuaccuggcuggcccuuguagguauuugacucuaacccuugaccuaagcccacaaaacaaaaaacaaacuaauccuuucucuccaaauuauauacaguacaggcgaucauagugccagaaaguuuuaaaauaguaaaacucuaagaacagguacagaaaacuggcaauguuaugugugaaugaauucuuuagccuaagcuucauagcagguuuuggcauucuacuuuuuaauucuaaaauacuggcuucagccaggcacaguggcucacgccuguaauccuagcaccuugggaggccaaggugggcggaccacuugagcccagaaguuugagacuagccugggcaacauagugaaaccccguaucuccaaaaaauacaaaaauuagcuggguguguuggugugcaccuguggucccacauacucgggaggcugaggugggaggauugcuugagcccaguggacagaggcugcagugagccaagaucacacuguacucuaaccagaggcugcagugagccaagaucaccacuguacucuaaccugggcgacagagagagacugucucaaaaaaauaaauaaauaaaagaaaauuacauuaccagccucaaacucuucugauacauauggcaggguaaagcccaauaaguacaagccauacuucaguaccuaaauaacacaguuccaccacaaaccuaccacucaccugaccaucacacaagugacagaaaccacgaauaauuuucuguuuauacagcugaucugcuuucaacuccauucggcguacagucugcaucauccuguaguauuugagcccauccucccuggugagcacuguugugacaggagggccuucuuccagccggugaaggucacauuucugaaauggaauaagguaguuauuauccuccacauacuacauugcaaacacuguugaccacucuaagaucuaacuccauugcaaauaauauugaacuugaaaaacugcaaaggagcacaucaguaaugcuucauaucgccucuguuccuuaaauccauaaaccucacugugcaaugagauggggcuugggggaaggaaaucuuucuaagaugauuuucacugaaagccccuagaagccaacugaguuauagguugaaagaaccuucaaagaaacaacuaagacucuucuuauucaaauauuucacugaauuacauuccaaacuuuugaauaagcuuuuauuuuuauuuucauuuucuagcuccucccccuuccccccacagaacaacagcaagcugcuaauaauaaauucuaguuuucgugaagcuucucugaacuucugauccuggaacauuuagaagaaaaugaugacuaagcaugaacaucaaaauguucuauucuaaagguaaaacuguauaucagaguguaccugugaaaaaauuauuaacaaaguaaaacaccucuuaccuuaauuucaaauguagcaucauuugcaaaauuacgggaugcuaccagcacucugcuugccuuaaaagacaaaaauauacaaacaaaucaguacuuuuuaauugucagcuauuuuggaaaguauaauaaucaguuaucagaaugaaguuauggaaauuuaauaagccccaacauauucauaggcuucucuuccacccugugcacuguguuugcaucuuccuuggccuccaaaaugaauccaugcuuuggccaaugaaacaggauuaucccgcaucugaaggcaagcagcgcaaagaggggcaaaaaacaaacccauccuuuguuuucaaagaaauuauagugagaauauaaugaaauuaguggcuaaagagacuagaucaucugugagcugugucuguuuaugccauucuuuuguuuguuuguuuugagacggaguuuugcuuuuaucacccaggcuggagugcaguggugcgaucucggcucacugcaaccuccgcuucccggguucaagugauuucuccugucucagucucccgaguagcugggauuacaggugcccaccaccacgcccggcuaauuuuuauauuuuuaguagagaugggguuucaccauguuggccaggcuggucuccaacuccugaccucaggugauccaccugccuuggccucccaaaguacugggauugcaggcaugagccacugcgucuggccuuuucaugccauucuuagucauaaccagauacuguucauuuugagcaagccaaaauuauacuucaaauaaaacuaugauuuaaucuccacucuaggcaaacuugacucuucuaucaaauuggaucuguaagaaaaaauauuuuaaauugauugaaguaugagauaaauacuuuagggagacaagacaaaagaaaagauacuuagcacucucugacuuaaacacaaugggcuugagccagcuguuuuauaauuuauaauuugaacagccuaaaucuuggacaggcuccuccugaagccccaguagaaauguucucugaaacacuguucucuugauguuuggguggcugucacuguuuggagguaaaaagcuuggaggcggggggugagaaaugauuccuuuccaguuuuacaacugagcaaaccugcucacagcaaaaguauucuauguaauggcuaagguuuagguuagaccacaaaauuuauccaguaguauuaucauacuauuuuagcucccuucugccacauucucacacacugacguguaaaccaacaugauuucuccauaaaaagcacaucugauguguucauaccuuaccuaauccagcacuggacugaucuuggugagaagaguuaagacugaucugccaaguauacccuggaguguacaagccaauaggcagaaagcuaauuacguauaucuucaccccucaauagaccauuauuggacaaagccaacaaacacagacaaugacagugcuggaggaaaacaacugaaauacuaggaaucaguguuucaguuaacuuacaggcagagacaguccacuaauguaucucagaaaaagugaaggaaauuuaggaauuugggaagaaguaaagcugagagaaggugaaacagcaaaucaaugguuauauuuagcaaucaaacagauguguuauucuuggcaguuaauaaauauuuuguggggccagaaauuuauuguauugugaaauaaauuuccaaauacaacuacagaaacugcaguuuuuggaaggcaggaguccaaaccagccaggcgacaguaacagagaaaagguaacuucuuucucaauccuagaguugaaacaaugaggcaggauaaugcuauacaauaaagagcaagaaggggcccagugcuguggcaugcgccuguaaucuugcgccugcaaagauuaggacugccagaaagcuacuuagauacuuucucccauggcuucauuacuguguaucucaaaaauaagaaccacugauaugagugaaaggaacaaaguuaaagaagcuaaaaguccuaucagaaguguguguguaucauuucugagugagagcuuguugaaaagauaaguuuaccauucauuuucucuggagagccauaaaaagauucucuguuaaaugggauuccucucugacagagaccacgaacaacccacucaaauuuuaaaaaauaaaaacuaggccgggcaugauggcucacaccuauaauccccagcacuuugggaggccagggugggaggaccacuugaagccaggaguucaaagccagccugggcaacaugagacucucaucucuacaaaaauaaauauuaaaaaauuagucagguaugguggcacacaccugaggcuacagugagcuaugacugugccacugcauuccagccuaaaaaaaaaaauuaauuaaaaaaaaguaaaacuuuaacuuccuaaauacauaggaaccauucaugugaaagaggaaaaacguuucaaaaauuccagauucuaacaguguaaauuaaaacucuuaccuaccacuuauaaagccaaaacauugcuaguaaagaucucacaaaaggagccauacagaaaugcaaacaauaaaauaacauuuuaaaugcauucaaucuucuuccaugaaauaagaacuaugaaaacuauaaaccuuauucaaaaauaaaaacacaaucuugauauucauuucaaaguuucacaccaaacacucuuugaugagacaauggcaaucuuuaagccugagauaaaucucccuaccugccugguuuuaagagagugagaguaaucccagcacuuugggaggccgaggugggaggacugcuugagccuggagauggagaccagacugggcaacguagcaagaccaugucucuaguaaaaaaaaaauuuuuuuaauuggcuggguguggugguggcacaugccuguguucccagcuacucaggaggcuaaggcaggaggaucgcuugagcccagcaggcuaaggcugcagugagcuguccugcuacugcacuccagccugggugacacagagacccugucucaaacaaaacgaaaguaaaccagggagaauaaaaaaggaaaaaacacacagcgucuugggagguuaaggggauuaucuugugucacagccaucagaccagcugccuacccuucucccuccccuucucccucccuucauggaguaucacacagaugguaggagucuagugcaguaagucugccuaauuugggugagccacugcuuauuguuuacugucaagauuuuugugaaaggcuuauaugcaaaaugucuuuuuacauguauaauauaaaaaacuaaaacguugaucuauuuuguuacuuauaguuaaguaaaaagacauccauaaguaugaagaauuacaaaauacaaagagucaacacguuaguuuauuauuccacccuuuaaaaaaauaaaagugaaacuuuuaguucuauccuuaaaagcuucaggaaugguuccuaauuaguccaugacaaguugagugacacagaaaacuucuaauuaucugaagaguuuacaccaccaaguggaaagauaccugggcacuuucaaaggugacuucauaucuggaacucaauuuucuuccuacuguaagguggcggggggggggggacccugcaaacugauacaggaaacaaugaaccugacuugcagaagaagaagaaaaccuacaucaggugccuaaaggaaggauguuucugagcccguaacuaccgguacagcccucuacccacagauaucccuaaagggaacgcuuuuuuuuuuuuuuuuuuuuuuuuuuuuuuaaaauacggagucuugcucuugucgcccaggccguagugcaauggcacgaucuccgcucacugcaaacuccgccucccggguucaggcuauucucccgccucagccucccgaguagcugggauuacaggagcccgccaccacgaccggcuaauuuuguauuuuuaguagagacgggguuucaccauguuggccaggcugaucucgaacuucugaccucaggugauccaccugccucagccucccaaaaugcugggauuacaggccugagccaccgcacccggcaguuuugucauuauuuuaggcaacaggauuccuagaggggcauaccucuuaccuuuugacaaucucugccuguacuaaguagagcgguaucaaguccugggggaaauaccagaaucccgaggccugcaguuacaccaauuaacacgaccucacugugccuaggggggucagaaugcuagcucagguguuaggcaccucuaaaugcugaggccaugaaauagugcuaaacucuaccccccaccccucaagcaucguugcucuuugcuuuagcuacuuguacccuaagaauguguagguaaggggaggggagggcagcguccucugaguucugcuucggcgcuccugaacucacugccaagaaaagcucagauguugagggagagggaagaggaggaaguuuguuucugaagaggcugaccuucugugaacccgccucagaacugagcacagguguucaagaaauguauaccgaacuggagacucaauaaauaacacuauucaacacacauguuaucgauuaugugccaggugcuauuuggaaucguuuccacacgugucacucguugaauccucaagacaaccccaagagguggggacucuuauuaucuccauuuuagaguuaacugauaacauuucagagauaacucuuaucuccauuuagagauuaacuccacuucgagcaaacauuuuaggaaaccggguccccgggacguuuaaaaacuugcucaaggucacagggcuagucaauggugagggugcuguuugaacgaagccacccugucuccagauucuacgcuauuacaaagccucucggucaagagaaauuaaguuagaagauccgaaaugaguggggucaauuggagacucgaaggaggccgaggccacccuuuccguguccuguaacccaacaggcaccucuugagcacaccgacuucgccuggcgcacagcugggcccgggggcgggaggugggugucgagaagggggaaguucacacggaccuuggcgugaucccgguccgugccgcuucucccgaggccaggaacggaaugcagggcgcggaggcgaaguaaaggcuccccggcuccccuggcgccuuccaccccgcucuggguggcccggccuggcccgcccugcccuccggccccgccucagccccacucgcgccccaucccggcccgcccgggaggucucaccggcuucugagaagcgccagacagcacgcgggagacggcggcgagcaucuuccucaugaagcacaggcaguggcggcagcggcgacuccucacaacccaggaggcacgacgcgggugcccccaagucuccuucaggugccccagcagacgccacgccucagucgcaccgcggcgugaca

SEQ ID NO: 19218 - RNA, 9028 nt, Homo sapiens
aucugauccaaccccuuuauuugagauaagucacuuugucgagauuuuucuuucuuuaugauggaguggagaggacaugaaccaucagaacacucacguaggcucgggacuggccuuuccagggcaguugcugggcagcacuggcuugccagccacagugaucaggaggugauuuuccugcagcaaggacccugggccguguugcugauucugcuuuaucuccacagaacguggugaagcugaugcgaggucuucuccagugcaugaugagacagguaggcagaacccacacacguguuugccaagugggcauuccaugucauuguaauugugacaguuaacaugcuuaagacguuuuguacuuuucuucucaagaggaagagaaauugaaaauauuuugcuuacuuucucucucucuuuuuuuuuuuuuuuuuuuuuugagacagggucucacacugucacucaggcugagugcaguggugcgaucauggcucacugcaaccucaaacuccugggcucaagugguucucccaccugagguguguaccauucaccuggccuuuuuuuuuuuuuuuuuuuuuuuguagauacaauaucucacuauguugcccaggcuggucuugaacaccugggcgcaagugauccucccaccuuggccucccaaagugcucggauuacaggugugaggaguuaccaugcccagcuaccuucucuuuuuaaaauuauuuucaguaacuuuacuauuguaucacagucucaaaggacaguuucugagaaucucuuuugaagagguacauggauaaaaggagaaacaugcuuuuuuuuuaauggagaagaaaacauuuuuuuuuaaaagccacgucuagaaagccauauauuauuguuuauuccaucauguuuguaaaaggguauauuuucauugagaugaaaugcuugaguuuuaaaaacuugauauuauuguuuagugguauuuucagugagggguaaauaaaacaauucauugagcauguacugcacacagaacauuauacuaggaucugcacaaauucaaagacgaagacaaaacaguccucacucucagucagcgcaagaaaagacauaguugcucuuuuccuuucaacauuaagaaacaagaaauugaaauuuaaacagguuccuuuccuccccuccuuuucucccuucuucccucccuccaucucuccuugaguaucuaccgugugucacagcuggggauauguagacaaggacacccuuugucaugacccgucacuccugcagaugagacuccccccaggcugggacauuuuaggcaagugggcgaaaagaauccccagcacagucccucugugcggugcugccuagcagcugccuuccaucccucuggcucccagaaguagcagauaagagcucuagauccagguggcuggccauggccgugaucucugccagccaugaacccccauaacuaugcagagcgggcuugccuucucccucagguggccaaaguggagaaguucaaacacacucagagcaccaaggacagccugcacgccaaguacaacaccgccaccuguggcacgguggugggcgacgaccaguggggccaccuccagguggaugccaccucucucuuccuccuguuccuggcccagaugaccgccucaggugagcugggguugcuggagcccauuguauaaggagugacaauccggaaaaggggugggaggaggacagguagcggccagugugucaggccaugugcugcuucacugcuuuaauaaaauaccucagacaaggccauuuauacagaaccgaaaugcuuuuucucgcaguucuggaggcugggaaguccaugaccaaggcacuaccaggcucaguuguccaguaagggcuccauccuccaaagaggaggacugcugugcccucccaugggggagaccagaagggcaagagagccagaggcuccacgaaguguguuuuguaagagccuucaucccauguaggauauguaggaugggaggaguccucagggccuaaucgccucuuauggccccaccucuuaauaccaucacauuggccacaccucaauuuuggaggggacacauucaaaccguagcaaucaguauuauaaaucagcaguuuacacaaaagaaaagcaugcuucuccauauucugugcauuuguuucugcaauagggcagggagugcagggacccugccuguaaccugcagagaggacagucacccuccaccugggcaccagcaggguaaaggccguugagcuggcucucuuagcuucccucuguugaacacagaaccccuuuacugucacucucuccuaguuccuggagccaccuaggucuggucuaacuuugacacuuagcugucugcagaccaucucaccccugcucuuagacuuuucuccuccaggaucagcagcccuguccuuucagcucucccacucacuacccuggucacccucuucuagacacacccucacuuuuccaaauuauauuugagcaccaccauuucugccacucagcagugugcccagagcgggcugagcagcccgcuacucagcgggcugaguaggcucacaguuugucggcggugugccuuguucccauugaagccagagccgcuggccucuguggcagccuggacgccaggccucucucuuucccacuagggucucacaccagguggucucucucucacaauggcaugugccacagaugcucccccagguuagggcacuuaacggcuaugucugggaguucuuaucaccuaccaguccagucaacugaugugucugaggccucccauucauugcagacugcaagugugaaacucucaaaaucccagaaaucaguaagcaguauuguuauggcugugugaauaaaucacacauuuaugaaguuacguuuuggcuaugaaaguuaauaugagcucacuguagauauuuuggaaaauauaacagaauacaaagaaaaaaauuccacugccaacuuucauuuggcugcaucuucuccaagucuuuuuuccugugcauuuuuuacauguuuaaggucacauuguacacauaaacauagucuuuuuauuacguagcguuauaacaagcacuucucccgugauauaacaagcucuucauaaacauuauuuuagugaguuuaucaguggguauaccauaauuaauuuaacuauuccuuccuucuuuuauuuugcuacuauaacuaauguugcaauaccaacuuugaccccaucuucauuuacuuccuucugagaguuagauaucacucaaaggcaacucauauauauugccaaauuguuuucaguuucuaguuaaacuuaguucugauugaaauucuaaucuggcuuacuaguuaagcugcccucauugauguaagaguccauuuccuaucauauccauagcagcuuccagaauucauacuuuaaaaauaccuguauuuguuauaacugacuauauuuuucugcaggguggaaggccagcuccuggagcuggggacucccugucucccacugggaaaaguauucacccuucucuuuggcucucucaaagauagagacagugucucugguucuucuggacuaaaauccuugcucuguuggaaccuuccccgcaucaauccaaccuguaccagaggucccaaaucucucucaucccuuucuacucauaggcacacacaggaaaguggagcccuuccuuuccuucuccuuauuuuccuuccuucccuccuuccuucccucuuuucggagauuagacacucacuguuaugccuuacuuaagacuucauuuuugaugccuuuggaagaaaaaugaaaaugaggguaaaaggguuuauuuccuagugugauauuuguaauuugugacuggcagcucucugcaacauggcuucauaaccucauuguuuuucuuugcuaggcuuacguaucauuuucacucucgaugagguggccuucauacagaaucuugucuuuuacauagaagcugcauauaaagucgcuguaaguaucaacccugguagucuuuucagauguuccagucaacaaaaagaauaaaaaucauacaguguuuugagggccaggcuguuuggggcucaccaaaagguuagcgagacuagcgcuaugagauugugucaccuccacacacaaacugcauauuuuuguccuggaauagaguuggggguuucagguuuuuggaauguacucugugcucugucugaauccauuaugcuuguuauauuuuuuuauuuauuuuguuuauuuauuuauuuuuaaacagagucucgcucugucacccuggcugguguacaguggcaugaucucagcucacugcagccucugccucccagguuccagugauucuccugucucagccuccugauuagcugggauuacaggugccugccaccacuccccgcuaauguuuguauuuuuaauagaaacgggguuucaccauguuggccaggcuggucucaaacuccugaccucaggugauccuccugccucggccucccaaagugcugggauuauaggcgugagccaccacuccuggcccauuaugcuuguuuuauuuuauuuuauuuuuaauuuuuuuauuuccauagguuauuggggaacaggugcuguuugguuacauuaaaguccuuuaguggugauuugugagauuuuggugcacccaucacccgggcaguauacgcugcacccuauuuguagucuuuuauuccucucccgcuucccacacuuucccccugaguccccacaguccgcugugucauucuuaucccuuugcauccucauagcuuagcucccacuuaggagugagaacauaugaucuuugguuuuccauuccugaguuacuucacuuagaauaacagucuccagucucauccaggucgcugcaaaugccauuaauccauuccuuuuuauggcugaguaguauuccaucauauauauaccacagcuucuuuaucuacucguugacugaugggccuuugguuggucccauguuuuuacaguugugaauugugcugcuauaaacaugcaugugcaagugucuuuuuugucuaaugacuucuuuuccucuggguaguuacccaggagugggauugcuggauuaaaugguaguucccauuaugcuuguuugaaauaagauccuaacauguccuacgggaugcauaugugcuggcuugaguuggggcuaaagagguagcagcauuagcaccuuggugggagcugggaugccaugagcgucgccccaaccaggccacagguagaggggcuugagccaggcagagccccagccugggccagauuugcugaguauaaauguguauaaacccccuuuccuccgagcuucugucugguuuggaaggcaaagccugaggcaccuuuacacaacaaccccaguguguaaagcucucagggaaggagggaaaagguaaaggcugguuuuaaaaaagccacuauggucuaaaggaaggucagcaaagguuuucuguaaagggccagagaguaaauauggucggcuuuacaggcccuagggucucugucgcagcuacuuggcucugccuuuguagcaugaaagcagccauagacaacacguaaauaaaugagcauggcucugucccagauagacuuugcaaaaauaggugggaaacuagauuuguuccaaagacuggguggaguucccugaccccaggucuaaagcagugauucccaacgagaggcaaucuugcccucccaggagacauuuggcgaugucuggagacauuuuugguugucgcaccuggucaguagguguucguggcaucuagugagccaagacuaggacugcugcuagacauccuacaaugcacaggccccccuccccccaccccaaugacucagauuaccuggcucgaaauggaauagugcugaaguugacaaacccuggucugaagaaacuugagaagucuuuguggaaagggugggcauugaguuggaccuuggaagcugagcagagucuagaucagcagaagggaggagauagggaguuugggugcaggaauagcuugugcagucccagaggcaggaacaggcucugaguguggcugggugggcuagggggugcuugaggaaaaggguacagaggaaaggaguagauuuaggaggaaagcugacauuggaaaagaguagaacauaaguggaucuuauguuccacucucagcuugugggugugucuaaggaggccaaaucauggggcauauggccauucagagagagagaugugaaugugauccacuaggaaauacaccacuugucauuuuagacccugaaacaaggggaagcagcaaucaaagcaguuuuugaggaugaaucacccagugccgggguuggaggaaagguggguugggcugcaggaaggcgcagaugagaagagugcucaagggaagaagcccaggcucagucaccaggcacgcucagcagggaaguugcucuaggaugcccgagucucaaucucuauauuuugaaaauguucuggccaggcgcgguggcucauaccuguaaucccagcacuuugggaggcugggacagguggaucaccugaggucaggaguuugagaccagccugaccaauauggugaaacucugucuuuacuaaaaauacaaaaauuaccugggugugguggugugcgccuguaaucccagcuacucgggaggcugaggcaggagaauugcuugaaccugggagguggagguugcagugagcugagaucgcgccacugcacuccugagcaacuaagccagacuccaucucaaaaaauaaaaauaaaaaaaaagaaaaaaagaaaauauucuuuuuuggagauaaaaaauaaagauugaaauguuggcaucagucuuguguguguuggguggucagcuuucaguaguacacauagaauuguuuaaaacagcaucccauauguggauuuuuuaaugaaaauaugaauuauacauuagguacacauguaucaaguccucugggugccagcauugugagccaaucccuaguaaucgguuuguaaauaccacguagguucaguguucugugucucaguugugacuuuggcuccaguuacuugcugagcauuuuuuccccaagagguaaugcuaaaaauaaguacuaaauuauuuuaaaugcuuuugcuggcuuugacuaguuaugacccaugugcuaaaguuucugucuuccauuuuacaacauaauauaaguucaaaggcauugacuagagaggcagcauuuuauucaaucuuaagaagauaaaauauuuuguucuccauacauccagaguuucuuacaaaugaauaccuucuagaaauaagaaauaagaaauuugagaguguuguggcaugcacuuuugucccacuugaauauuuucuucuaaaauucugcacagaggucgcaugaacugaaauugaggaagagcacaguaugagucuacaaagccuccgagaagauccacuuauguuucaguguggcugcaggaacauaaaggaagcauuuuucccauagcacuucuuauauaccucuuucuccccucugauucccaccuuuuucucccccaggauuauggaaugugggagcguggagauaagacuaaucagggcaucccggaauugaaugcaagcuccguaggaauggccaaggugacaguuguccuguuuguucuuccuucugcauguuuuuacugcuuugauuugguucccuucaucaggaguuuguauuuaaucugauuagcauauuugucaaaagucagcaucaaggaugugaaauucaaguggcacaguuaccccagccaccugaaauucuagguaaagaagguagguuuccaaugcugaaaucugcccauggcagaaaguaagagugcuccguccugguuagcugcugccaucacccaugggucuaagcucuugcuguuguuuaagaagcugcacgugugauguccagucuucuuuucugggucacagagaggacuggagaauaucaccacuuuguagguuggacucacaaguucaaaagucuacaaggucagucaaauaacaguacgaagugaaacuagccagacagcaaggugggggucaggggaggaauuggggacacugggaaacuuucccugaagguacucugauucaaacucauuuaaaauacucuucaagccaaacaaaacacaccuauggggcagauucgaucugugggucaccaguuugcuucucuugccauagacauauggugugccuccuucccucccuccuccagaauguaauguauuuuuuggacagaguagagccuccagggcuauaauuuuuaaagcaacaaaaaauaugcucuauugaaguaaacagacagaaaguguacuuauuacuaaaagaauuaacuuucugaagugccagauguuugaaguuaacuguuaaaacaugugagagaaaagacgaccaugaauuuagugcacacacacccacacacacacacacaacguuaugaacuuguuaauucauuuuuagguagaacacuaacuucacuugggaaaauguuuuucuguuuucucuuucuuguuuccauaaugagcagcaauguacaggagagcucugauccacugaaaauaagaauagggucgggcacagugguucacgccugugaucccagcacuuugggaggccgagaugggaggaucaccugagcccgggaguucaagaccagcccuggcaaaauggcgagacccugucucuacaaaaaaaaagaaaagaaaagaauaaaaaagacuagaacaugacuacaggagucuagcuggauuuuuaaaauguguuucauuaccuuugggaaaacauguauacuagauugcuuaaugaaaaaggaacaccagauauuggaguguauguuuauuagaaagaaaaaguaacucauaccuguguuuguaggcagcucuugaggcaauugaugaacuggaccuuuuuggagcccauggaggacgcaagucagugauuca

SEQ ID NO: 19219 - RNA, 26021 nt, Homo sapiens
ugugcuaaacacacugcuuuauuuuuacagcccacgucuuucaugaggauacgaauuguuaagaggcagucucguuuugcuuuucaaagacauuuuguagagauuuuucacuaaugugaaucugauuuuaucuacuugauucuguauagauuaaguaaauauguaugauaaacuuaacagcuucuguguauucuuucauuauccaugugaccuuaacuguaggaguccaaagguaccauuuuacccauuucuacucaaaaaguagacucccccgcccccccccacuaagcuuuuaaaaaaacacaaguuuuauuuuaaaacuuuauuucugcaaagccaaucaagaaguguuggaaggaaaaaguguaaaaguuauucuugcauauuugggaacagcaagcacuuaguuugagaaaaugaggacuuaaaacaguugaaucaaaggcaauacccugcuacuuguauuuaaaaucaauggugauguucuuucuuaagcaacauucuucucuucccuaauagcuacaauaugauacaguacgcaacagcucacuugaaagugcuagaaucagaggauaaagaagccauaagccaccccacuuacauuuccuacuauacaaugccuuuuuggcgcuugauaaaucaagcauucauguagcauuacauucaacagaaacauuucucguacuuuggguuuaagauccuugucccuccaguucggaugucgugacaucugacucuucaucauuguaaauauuuucagccuggagauaaccaaauaaauucacagguaaaaacucccuaugguuuucacauggucauguaaaaacaauuuaaucuauuuagaacuuaauaguuucauuuuuacauuucucucuuaaaaacuucaauaaggaaaugguaggcuagccaguauuuugaaaaauucuuugccaguguguaauuccguauguauacuuagccacccaucgaugcacuacuuauuucaaucacuguucauaagagauguuuuccaaaggcacuucaagcaucguuuagaggaagugguagcccagauguuauggaagucucgguuaacaacaacuuagaaaugucagcuacuuagugcucauccucagagaacuugcugucauuugaaugccuugaccucuccuuccuguaucccucaugccuaccacacagaacagacacuggagacagaguagcgacgccaagacuccaguguaugaagagcacaacaacaaugaaaaucagugcagaugcagagauuucuccugaccugacaggugcuacaaauagcaaacaguggacgaagcaccauaugggacuaaagauuguauuguugaaauggaaaaaguucuuuuaaacgguuucuguaaauguuuggcauaauaugcaccuacauauucgaaauaacuuuauuacauuauguaaguaguaaaucucuccuuuacaagacagucauucaagaaaaacauuuuaacucaccauuugccauaucugcaugauguuauccucagacacugagcaaaugacccaaggcucauugggguuccagcuaaaaucugaaaucuuagcaguguguccuccaugaauaaacuguuacaagaacaaaaaaagcuuugauuucauauacucuccuguuaauccuaacaaagguuuuacuaaguuuuuagagcuaucaguauuucaacugggggugggugcugucugguuuuagaaggugguacaggcucaguaaucuauuuauacuuauuuugcaaauuuccaaaccuccagaauaggugacagaauauaguacaauggauaccuguauacccuuuaccuagauucaccaagugauacuagcauaacugaugcuuuauccaugagccuauacaaugaaauggcugaagacuucagccugcaucccuuaagaaugaggacauuuuccuagucaaaaugccauuuccauacugauuaugaugaacauuaauccagcaucauuugcucauauacaguuaggugcaaacaucuaagguaaucaauccguuauaugccauguaacauacucuucuauuauacaaggggccugaggagucuucugguucuuccccucuccacuuuacugagagaggcauacuucuugcccaucuuuccaacguacacagacagcaccagggugaaagaaaaucccuggcuccaaaagcauagcuccagauagucccucauaagcuaugccuaaggugagagcuuugcuaaacaauucugaagagagcaguuguuccccgcaagagacaaccucgucggaaugcacuaugccuuauuuuuuuaucuuagaauuaagauuuaaacgaaacacuucuucacaaggacaguacuaaauacacuguuuggaacugggacaucacacuuucugacaaagucugauuugacucuaguuugacaaugaggucucugccugccaacuagguauuaugcaauguaucuauuuuaccgaauaaucuuaucggguuaaaaauaugagguggggcuggguaaaacucacgccuguaaucccagcacuuugggaggccaaagcaggcggauggcucgagcucaggaguucaagaccagccugggcaacaugacaaaaccccgucucuacaaaaaauacgaaaauuagccgggcgugguggggugugcccauagucccagcuacucaggaggcugagaugggaagacagcuugaaccugggagguggagguugcagugaacuaagacugcgccacugcacuccagccugggugacagaaccagaccuugacuuaaaaaaaaaagagguaaauagcuuuuuaaaguacucuuaagggguacacaagugaauauacuggccgggugugguggcucacgccuguaaucccaccacuuugggaggcugaggcgggcggaucacgaggucaagagaucaagaccauccuggccaacauggugaaacccugucucuacuaaaaauacaaaaauuagcuggacaugguguugcgcaccuguagucccagcuacucgggaggcugaggcaggagaaucacuugaacccgggaggcagagguugcagugagcugagauugcaccacugcacuccagccugggcgacagagagaguacucuuaagggguacacaggugaauauauuuuaagaucacuggggcuuagaaaacauacaggaguuaucaaagcauacugguggaauaguuuacuacuuuguuuuugggacagggucucacucccauugcccaggcuggagugcaguggugugaucauggcucacugcagccucaacuucccgggcucaggugauucuccuaccucagucucccaaguagcugggacuacaggcacgcgccaccacaccuggcuaauuuauguauuuuuuuuuuuuuuugguagagacaggacaggguuuugccauguuucccagccuggucuugaacuugugggcucacgugauccaccugccuuggccucccaaagugcugggauuccaggcaggagccaccaugcccaggcccaguuuacuacucucaaaugucccuugauuucaagcucucuuguaaaaagcaaaauccuaguguauuuucucaaggaccuuggaauuguugcagaggcauaauauacaaaguaauacgcuuuccuuucucccuaaaaaaaauagcuggagaccuugaaaacauuguacuaugugaaagaaucagucccaaaagacaaaagucauauuuauaugaaauaucuagaauagcccaaucuuauagugccagaaaguagcacaguaguugccaagggcuggaggaagaagagaauugggaggugauagcuauaguuucuuuuggaggggaugaauaauguucuagaauugauuuguggugauaguuuuacaagucuaugaauauacuaaaaaccacugacuucaagaacaaaaaaagaaaaaaaacccccaaaacccaagaacacucccuccccacugaacuguacacuuuaaagaagugaacugugugguauguaaauuauaucucaguaaagccgucaucaaaauaaaagggucuggagcauucuuacaaggugggcuuagugaacaucuucugugugcagggcuugcucucaaggaccuucuuuaccuuugaaaacuuguggacauucaauauacuccauagguucacagaaaaaaugaauaaauaaaacucauggacaaaguacaagugugccaaaaaugaguacuggcauuagaacuaaaaucguaaaugacagagugaugagugacuaucggccaaauaaugggaggagacaaauguuggauucagagcaaggacagggaaccauugcuaaauccggcaaugcuucauagaaaaaugacgaagugagcacugaaggacucagacgggaagaaugaggaugggcagauaccaccacauaagcuuucaaagggccaaggagaugcgugaugcuucaaucaggcaugggagggagauagugggcucugcuaacaucaagauugagaaagcacuccuuuucugggcaggaaacuuaaaaagcauuuaaaauuuuuucuauacuguuaggaaauguuaaguacugccaacugaauagcaauuauacucacuccccauccccaaaccaucacaaauaccagaguugaaaucagugagaaauuacuauauacuauuuuccaggaccucaaaccauucucagugaaacauucauaaaaaccuacugggcuccauuuacuauuuuugauaaaugucaaagcccaguugcaauaaccuucagggccuccauuuugaaaccaucugcaagagcuagaauucgaaguucugacccauucucgaaauaaagagaucaaugacaauccaaucugcauaugacauuucaucuucuauaagccaaugcguaccaggaguucuggaggcccaucuucugcaucuucugcugauuguucuuccccaauuuuacuguaagaauaaagaauauaacgcuuucaucagugaaauucuuguagcacgaacaucugcuaaaccaguaucagcccagaaaguaaucuuaaaacauaaacacacucacaaaaacaacuuauuucuauacuacaaucaauuagguuuuuuuuuuccuuagagacauggccucgcuauguuucccaggcugcagucaguagcuauucauucacaggcacgaucacugugcacuacagccuugaacuccugggcucaaaagcgauccucucgccucagccucaccacaucuggcuacuguuuauauuugguguaaggacgggauguuuacuuucuggaaauaaguuagaguuguucauaauugaaguugcagaaugaggaauuauugucaauaauaaacauuaacucaaaaucccuucauuaacuguuuauugccuuagaauuaaaaggugaaauguauaguuaaaaaaaucuacacauaaacugaugugcaaucccuauacuucacucaaagccuguugcaucccaggaguaaaauauaauuacaaaucaguacuauagaucugucuaaagauauggcaauaaaacuuugagaaauguguaagccaaggaaauguuuuuaugguuuuucucuuaaaaacuucaauuuguagaauuugccagugcucaacagugaaaucacucuuuauguaucaauaucagcccuguccuuauaccuagcccaaagacuuuaguaguaacaacuacuaaaaaacaaaacccagcccuccaagugagacauuuuuuuccuucccacaaaacuaaccaaacaaucucaaaccugugggauugcuagacaauacuuaucuuccaccugucaguauaguugcuaaaacucaccauuuuaaucccaaauuuuaucuaauguaauuuuacaauuuuuuguagagacagggucuauguugcccagguuggucucgaacuccuggguucaagcgauccuccugcuucagccucacaaaguacugggauuauagacaugagccgccaugccuggcccccuaucuaauguaauuuuaauauuaaacaagcuaagaaauaauucuaagaagaaauuacacacaaugcucacaaauuauuggcaccuucaggggcaauucaguugccagggcaucagacuuccaaaccuugcuguacgcuucauacaaccucuuuauaguuuugauuuagguuuuauuuuacuacuaaaauuguuuuuaaaucaaauacaaugcccccaacugucugcuuuaaagguuuucuacaucuucaaguauuuaucacggcaagaguuugcuccaucagaacccugaacauuagcuauuuuaaguuuuacauacaagcauuuuauucuccagcgucucuucuauauacugaggauuacugccucuauaauuaaggcagccuugguuuuaauauauagguugagcaucccaaauccaaaauguuccaaaauccaaaacuuuaagcaccacgugacacucagaauuuggacuuucacaccgagugcaauggcucaugccuguaaucccagcacuuugggaggccaaggcgggagaaucacguggggucaggagucugagaccagccuggccaauauggcaaagcucugccuuuauuuauuuauuuuuuuaguaaaaaauacaaaaccgggcaugguggcuguggcagugcuuguagaccuguagacccaccuccucgggaagcugaggcaugagaacugcuugaaccugggaggcagagguuacagugagccaagauugcgccacugcacuccagccugcgugacagagcaagauucagucuccaaaaaaaaaaaaagaaaagaaaagaaaagaaaaagaagaagaauuuggacuuucaguucagauuugagaugcucaaccaauaaaguauaaugcaaauauuccaaaauccuaaaaauuccaaaaccccaaacacuucuuauuccaaguauuuuggauaagggauauucaaccuguacuaaauucaguccacuucaaagcaauauauuuaauacaagcaggaaauaaguuauuuuuugguaauuuuaugauuuaaacuuaagaugacaucuuacggaggaguauguaacugagcaacuuuauuaaguucuaaaggcucagaugaacaaguaaaggagucuaaaauucuuagaacagcaagucugaacuaaaggaacuuuaaaaauuggcagaaacucuuuauacaaugaggccccagagaacauaagcucucugacagcuugggcuguccuuguccccuucacaaaggucuccccagcaguuacacaacccacagcaggagugcacaucugcagaaugaaucacugaaagcaaaguaaaugguacaaaaacccagaaaaaacaguccugccuacacguacugagauccaaugagacauaaaacagcuaacaucuugauuucucuauaucaaguguguuuuaaauacagucauuugaaugcaaaaacaaaaacagacacauacaccuucaugccugaauauuaagagacaaaacucacacuagagaaauuuauuuuaugguccauuugcugcuucacuucuauuuuacagaacaaaggcucuuuaggaagaugcuuagaaguuucuuuaauauuagguuucuugaaggggggauuaccaaauugcuuuucuaguuuaugaaugacuauguaacuugccagauaggcacauuuaugcaguaucuugucacaggacuguaaguuaccuuaaaucccacacauucaggcggcggucaguaccacuugaagccagaauaguuucauuauguggagaccaguggaccuaguaauagauaauuuugaaaauguauuuaaagaaucauccgcugcuagguuuguggcuguuguucuaaucugauauuuucccaucuugcacucuauuaucuuauccuuggccugauggccucacucucuuguccccgacuuucaagugcucugcaagggcucagcuccauccuguccucaggaaggcugcacuccccagcacugaggaacucagccugggaucucaauaaauuuauucgaccccauaaccaucccagaagcuuuuuaauucuucaacaagguguaccuuacccuaugagcaucuccauguaacaccacguacaagacauuuuuuucaauaguggacccacgagucugguauagcuuaacugaugaaucccuggauuucauuuccugacauacagacaccagaaaacugucacauaccuggaaaauuucaucuuuaugagauucgaagguauggaguuuuaauuuuaaguuacgcagaucccauaaagcuacggucuaaagaaaaauaacaagugaaaaugauuucuaugcuuuaccuaagaauuuucaaauaucugauuaaggcacaagagaacuggguuuuauaaacaccaaauaaugcaaaaacuucgaaaccuuauccgcagagccgguggcuagaauaaauucgcuguagggauugaaugagaggcaguugacuucggcagugugcgcauccaccaagugacucggcuuggaggugguauuggaccuggugucccaucuaaaacacaaagguaaaggcacacggcacccagggaugacacacucacauucggccucacaucacugucacugcacuccacaacuagcuccacuaugugcuccccuucaugaagaaaccaaccacacagcuggugauucagaccucgaccacuaaaugauacauucgaaaccuacagagaacaagcuagggcuguuaguccuguuuuuuaaauuagauuccuauuuuaauuaccaacuauuucaaguguacacaaaauacagacuauguagagaauaaugucacaaucugauaccuaaaacuaguuuugacaaaugcccaguauuuugucacauuugccucagguauuucuuuauaagauuauaagugaaugaagcccuguggccacaccuugaugaaaucauuuuccuccucgaccuccaacuggcaucacucuggaucucaauuuugauauuuaccaccacaccaaguauguuccuucacauguccauaccuaguuuucuuuuuuucuaaauaauaagugauccucccacuucagccuccugaguagcuaggacuacaggugcacaccaccauacccaacuaauuuuuuguuuuuaaauuuuguguagagucucacacuccuggucucaagcaauccuccugccucagcuucccaagguauugagauuacaggaguaagcuaccuaaagcuguuuuuuaaagccauaacuuaaaaaaaaaaaaucaaacuacagccugcagcaaucacugauggucauucaggucacccauuuaacaagaucccacugaauuuuccaccuuacaucauaaguuucugaucaucagcaacagauccaaacaaugacucgugcagcaggugccaggccacauccucuacaacagcugaguggccaguaaagauggcuuuagcauccacaauuuugccuucuuuugguccugcguuuauaucccacagacaaacagucuaagagagaaggagagaaaaaaaaaagaacaagggcuauaagagacugauuuuuuuuuuuuucccucgagacagugucucagucugucacccaggcuggugcgaucucggcucacugcagccuccgccuccagggcucaagcgauucuccugccucagccuccugagcugggauuacaggugcaagccaccaugccuggcucauuuuuuuuguauuuuuaguagagacgggggucucaccauauuggccaggcuggucuugaacuccuggccucaagugauccgccugccuuggccucccaaagugcugggacuacaggugugagccacugugcccggucaagagauugaauuuaaaugcuaacaucuuauuuaaaauaauuucauuacaaacaaaacuauucaacuauauaaguuugagguaaacacaagagagaaaauauaagcaaacagaagaguauguggcugcagccuccaugugaggugcagaggaaaaggacacuccacuguaaugagggggaggggagacugaguacaguggcaggcaaggacacugaugcuggaauuucuaccuacauacauucagacauucaaguaccccaaauucacuuagacaacacaacaaaucaccaagagcccggcgcucagcaucuacugaacacaaaugcacauccuaaaaguuuacacugggaugggaagacugggaauuaaaauuaaacucugccucucacauagcaaaagccucauggacaagucuuucacuucauggcagaaaccaccacagacaucaggagaugggacagguaaacgacacugggccagaaaccucuacuagucuacucugagaggucaaggccuggcgcccacagacagauccccaaugaugugcuccuugaaacgucagcagagcccaagcagaggccauggggccucugcuugggccucaaaggucacagcagcccacaaauaaggaggccucaugaugugggccuugacauccuaucacagaaagaguuaagaggaaaguuuuaaugaaaaaauauugcaagguauagggcaacgauucucauucaauaguuaauaagaaauaauaccaugaagguauauuagcacuaauuauaguuccaccgacacugguauggguuuuuuuuuuuuuuuuaauucauagcacgugaucaugaaagggcuucaucuguuuuuauuaaaucaccuuuuuuuuuuuuuugagacggagucucacucucuugccuaggcuggaaugcaagggcacaauuuuggcgcacuacaaccuccgccucccggguucaagcaauucuccucccucagccucccgaguagaugggauuacagguguaugccaccaagcccagcuaauuuuuuuguauuuuuaguagagacggaguuucaccacguuggccaggcuggucuuguacuccugacuucaggugacccacccaccuuggccucccaaagugcugggauuccaggcgugagccacugugcccagccacaugaaggacuuucuguaacaaagcuauuucccaguaauggcuauuuucccaguaacaaaauuuuuuuuuacacaauacauaugcccucagucucuguuguuacuuacacaugaagacacucaaugugugugaacugaagagaaaggaacauguggugcuccugccauucacacugacucagaaggaccuggcaagauuagcaugaugcuuggcauguggguagccccugguaaaugucagcuauuauuauuacuaccaauucccagccuggucucuucaaaagguacuaguaauuggguuacugaguacaauccacuuauccacuuucccuacuugggaaaccgucucauacacacuuugagggaagcauccuuucagagagccuauaaucccagcucuuugggaggccaaggaagguggaucacuugagcccgggaguucaagaccaguuugggcaauacggcaaaacuccaucucuacaaagaauacaaaaauuugcugggugugguggugggcgccuguagucccaccuacuugacaggcugagguagagaaccacuagagcuggaaagguggagggugcagugagccgagacugagccacugcacuucagccugggugacagagcaagaccuugucucaaaaaaaaaaaaaaaaaaaaaaaaaaagugaaaagacaacagaaugggagaaaauuuuugaaaaucauagggacuuauaccuagaauacauaagaaacucuuauaacuugacaauaaaaagacaaaauuaaaauauggacaaagaauuugaauaccuauuucucuaaaggagauaugcaaauggccaguaaguacaagaaaagaugcucaucaucauuagucaucagggaaaugcaaauuaaaaccacaaugagcugggcguagugacucaugccuguaaucccagcacuuugggaggccaaggcaggaggauugcuugagcccaggagcucaagaccagcauggccaacauggugaaacccugucucuacuaaaaguacgaaaauuagcuggguuucauggugcauggcuguaaucucagcuacuugggaggcuaaggcaggagaaucgcuuggaccugagagguggagguugcagugagcugagaucgugccacuauacuccagccugggugacagagacagacuccgucucaaaaaacaaacaaaacaacaacaacaacaacaacaacaaaaaccaacuccccacccccaagccaaaaacaaacaaaaaaaaacccaggaaauaccacuuuaugcacacuaggauagcuauaauaaaaaagacaagcauuagugaggauguagagaaacuggaacauuuguacauugcuuguggaaauguaaaauggaaagccacuuuggaaaacaguuugguaauucuucaaaaaauuaaacagagauaccauaugauccaauaauuccacuccuagguauauauccaagagaaauaaaaacauacaucuacacaaaaacuuguaaacaaaugcuuguaacauaauucaaaauagccccaaaguagaaagaacucaaaugguucaucaacugacaaauaagcuaacugugguauauccauacaguggaauauuguucauccauaaaaaggaauggaacauaaguaauguuacuugaaaacauuaugcuaagugaaagaagccaaacagaaaaggccauauaugagauuccauuuacaugaaauaccaagaacagauaacucuauagagacagaaaauaaauuagugcuuaccaggagcugggggaaggcagggaaugaguggggagucacugcuuaauggguauggaauuucucuuucagagagcgaaugaaaacauucuagaauuaguggcaauaguugugcaccuuugugaauauacuaaaacccacugaacuguacacuuaaaaaauacuuuauauuaaucaggucccacaaacacucuacaguuuccauuuuaagggccuggaggguccucuuuuaaauaaugggaggccuuuugccuaugcucccuccauucuaaggcuacuucaaaagagcucuguggaauccgaagacucauacagggcaguaugaaaaccaucucucuaaaguccugggggaauguuaccacaauaaucagcaguauuaucuuagaaaaccuuucaucuauauaguacuccuucagcacagcugugacacgucagcucucacuauaugaacaaauuacaaagaauacguuucucacauggucaucagaugcacuuaggagauguccacucaaauuugaauuccaggagagaccauagccuuccuucuggugaccucuuaaucugagaucaggauuacauucuccacuugggucuaagaaaagaugaaaaacauuaaguuauucucuguuuaucagaacuggugagaauaaauucucacuccuucauugagugaaccauuacagcaacugcacacgaacgagaucuggucuuuaauacccaaugcaaauugagccucaugaccauuagaugauugguuucuuuggaaaaccuaauacuauccccaacacaaaaauauuaaaaacuauagcuauccuacaaauuugggcaguggugaccguauccccgcaaccccccaauuuuuuagaaauauuucuaacacaacaggucugguugcucaguccuugcaugccucuaggguagccugcaaccauaaaugacccuuggccaaccccugggaaugugacccucagaaaguucuucacgucacugacugauaaaguuuuguaagcccagagcagugggguaugccauagggaccugucaagacuuguaggauuguuuagcaagauucacaauguauuuggcuucacuauugggguccucaauuuuguuaccauggcuggucauagaacaggaugugcccacgccaacagaccuccacaaaaaucccagauucugaaacucaaaugggcugcccuggguagagacauuuagcacauguuccuaugguuugcugcuagagacaaaacaugucccacguggcccuggaugggaaggacucagacgccuguagcuaaccccucuggacuuccccugauguguaucuuuuucuuccuacucuugcucuggauucuuugcuguaauaaacuuuagcuguuaguauaagcugcuuuuagguaguucuggcaaaucccugaacuugaggaugguuaugggacccccaaagcaauuuuuaaaccuuuaaauauuauaaaguaugcuacuuugaccuuaaaaacauuaccaguuugaaucaagaaaacugcucaaguaaugaccuaacucuauuauuacauaccugguuuagcaggguguuuuguauagucaaaaaccaacacaucagaagaugguguuuuuguagcaaugaugugaggauucugcggcauguaacgagcacgguuuacuucuccuucgugauugauuuuaauuucacauucaauuuuuccuguuacagaaccaaagccaccaaauucuaaugugaggagaaagaaacacacacacacacacucaggauuaaaauucacaaaucacuuaguucaaucaaccuaacagauuuugaccuggcagaauacaacacaaacugacaagacaaagacagaaacaugcauagagaaaacccaaaaauguggguucauuugccacaucaauuuauucuuaaagcccauuugcacuggaaaauauugguagcugccuuaugcaacuuaauucaguuccaccuuggaucuaaaacaacuguccucuuucaguuaugaagaugauauaguuauucacugaaauuucaaguaaccauauaauaagcagaccaauagcuuuuuaguucaaauacaacucacuguaaguacugcacugaauuagcaucuuauuuuaggauucaucaaaacaggaaagguuuuaacccuccacaguaugaacacccuuugagucugaagucagaagcauccucaaaucaaucagaaacccacgcuaaccccuaccugucccuaaacacacauacauuggcccugccagcauacuugguuuaacugcuagugcagugccaagguuaaccucuccgcccaucuggugugugaauaagacuauaguauuaaauaaucaugaaaaaggccuuguaaaguaacaaagucauauaaaaaguacgguaacuuccaagaaguagcaacauguuagcagaaagaauacaaguagagaacaucuaagcaaauacagcaaacaagaacauucuuuuuugugcucauagauaaaaaaaccugaauuaguugcugacgcuuaaaaagauaggaggguucacauuacaauuguguuauucuuccugaccuauauugccuuuucuuugcacauuccauuuuagcucacccugugucucaggucagggacaacuaacacaaaugccuacuggagccagacagguaagaaguaaaauagaccggggccuggagcaaccaccaaaaggagcaaaccauuucucaguuccaggcagcuccuucuauguggaaugcuuaaugaacacucgcuuccaugucuuaauaucaguaucuagccguuccucucugaagcaaacauagcuuacuauuucagugugguugaaaaaaccguaucucaaauccacgauuacuccaaagcuccucuacccacuacucucaugugaccacaugcaaaaggauccuuuuuccucguagcaccuucuguuccauggugucaauggaagaaaugugccucggcaugcuaagaccccuccugauccaaucgucuccucccuccugagacugcuccaaaucugcuccacuuugaccuucaacaucccauuccauggacuccaguggcucuaacccuucugcuacaaagauacucaaguuuccugauuccuuuagcuaaaacaaccugaagagcucuccuuuaaaaaaaaaaggggggggggcggggcuuccaaguaggauuuacuuugaacacagaguuuuguuuucucaaacuuaaaauuuugaaaagucacugucuuaaugauaauauccauuaaaaaauguaacucaauauuggccgggcgugguggcucaugccuguaaucccggcacuuugggaggccaaggcgugcggaucaugaggucaggaaagcaagaccauccuggcuaacaaggugaaaccccgucucuacuaaaaauacaaaaaaucagcuaggugugguggcgggcgccuguagucccagcuacucgggaaaucgcuugaacccaggaggcagagguugcagugagcugaggucacaccacugcacuccagccugggugacagagcgaaacuucgucucgaaaaaaaaaagaaaaaaaaaaagaaaaaaaaaauauauauacugaauauuaacaaagguauuaacugaauuauuucagcuacuuguuagaauacacuggauguguaacuuuaauaauauauuaacaucauuaugcagagacuguuaaacugcaagcccgguaaauacauacuucagggcuaaaagccauuuaaaaauuucugauuacaauauauucaggccgggagugguggcucaugccuguaauuccagcacuuugggaaguuuaggcaggcgaaucacuugaggccaggaguucgagaccugccuggccaacaugacaaaacccagucucuacuaaaaauacaaaaauuagccgggcauggugguggacgccuguaaucccagcuacucuugaggcugagguacgagaaucacuugaacccaggagguggagguugcagugagccgagauugcaccacugcacuccagccugggcgacugagcgagacccugccucauaacaaacaaaaacaaaacacaaaaaaaccccaauauuuaaagaaauaaugcauacaguugucggggaaugaacaguaaauugugggaguaguaaacuggguaaaucacuuuggaaaauaguuuucuaugaaguugacaaugaauacaccauacaaccuagcaguuucacuacacuagagaauguaguauuuuugagacaggaucuugcucuguugcucaggguggagugcaguggugugauccuaguucacuacagcuucgaacuccugggcucaagcgauccucagccucccaaguagcuaggacuacaggcaugcgccaccacacauggcugauuuuuaauuuuauuuuuugauagagacaaugucucacugugugcccugaguggucuuaaacucccaggcucaagcguuccuccugccuuggccucccgaaguguugggacuauggguauagccacugcaccuggccaguauuuuauuuucaauaagaaaaaaacccuaaggcacauauuagaaagugcuaauagcguuaagccauuugggacugugaagaaagaguuaauacagcagucugggugcuuagcccuggagucucugaggaacacugggacccuauuacugacccuuggcuaacuccugggaacaugcaccucagaauguucuuucugucacugaugaacugaugauuuuguggugugcaccuggagcaauggaccgcguuguaccaguuugucaggguuacucugcagauaucaagauugaugacacguaccuucuuuuauuacuggguccucaguuuguauuacugggguccucaaguuacaguugcuguggcugguugucagcaggaugugccuaugcaacuagucccccaagaaagccucagaccccaagacccaaacaggcuucccugagcagagauauuucacacaugucccugcaguuugcugccggaagacacauccuguguggccuuggacaagacuugugccagaccucccugaacuugccgauguacaucuuuuuccugcugcuuuuguguucuuuacuguaacaaacuuuagccacaaguauaauuugcucuugggaguccuagcaaaaucaccaaacuugggguggucaugggaauaccaaaacaggagaguauauguuugacaaauuaaaaaaagaaaaaagcagccaacagauuccugaauuaacccuaccacuacugccucucuccucaaacaaaaaauacccauugcacacaccaacacauauuacuuuuaccaaaguggaauacuguaauuacacauagcaguuagucacuuaauuuaucuuggauaccuuccuauaccagugccuacagauuuuucucauuaaaaaaaaaaauuuuuuuuuuaaauuuuugguagaaaugaggucuguguuuuucagacugggcuugaacuccugaguucaagcaauccucccaccuuggccucccaaagugcugggauuauaggcgugagccauggcaccuggccuuucuuauuaauugcugaguaguauuucaaacauaccaugugcuuaaccaacuuucuaugaaccaacaucuggguuacaagguugauccuaauuuuucaauucugcaauuacgacuaaaauccuugugcacaugugggugggaaguucuguagaauaaaguccuagaaguuaaauuacugggccaaaagcuaauaguauaguuuuaauagcauaugcuuugaaagagacauuuucccuuugacaccaauauuggaauauaugauauaccuaccacccuugucacugucacaaugggaagcaucaaacugugcaucaucauugggaauauguacucgagcaaccaccagaugauucugcucaucagacguaugaguccccagcacuagccaaugaagggcauaaucuuuuccuucaggucuguuuaagaaagaaaauaagucacacuaauccuacaagaaaucuccaauugcuaacaaauucagucuaguucccucaaaauacauucauauuucuuuagcaaauauauacuuagcaucaacuguguaucuucucccccucugguuaccaacuuuacaauccccacauaugcaaauauaagaaaauauucuagcuacaacaugcagagggcuugcuucuuucccaaagagccauccuccugugccucaauuaucagcgugaacacuaccuuuuauagagcagcacuccggggaagguaggcccaacucaguaaacacagacaaacaucuacacaggaauccaccaacaauccccacacucauaaaucacaacuucccaccuaaagaaaucuucuucccaccuaaaaauaucuuauacacuagauguuucuuauuucccaauaagaaauucuacaagguaguauggacagaaaguguugaaucaaaaaaacuuagcuuaaauccuggaucaaacuaaaaugcaguugcuuaaaacacaaccucccuggggccucaguuucuucacugaauaaaauaggcuauaagugcaaauggcaugaugugaaacucacugacguuuaugauaccuaaguuuaugaaacgaacauucucaauuuuaccgagguaucuuuguuaccuuguucuguggaaacaccuugaggcugaagaacuugcccaaaccucuuggcaccuugguccgagcagugauuuuugcaucaguaucuauuaaaaaggcuuucccauuuguauuaucuagaauacaauuuucaacugugcuccauggucccacuucaaugaagaggacugagaaguaggggucuaggcccuaacacaagacaaguuaggccauuuaucuguuucuaaauuucagcugcacaaaggauucaauuuuuuuuuuuuuucuaaaaagauugaagauuacuucuaggcaaguaauuuaguaauaagaaaauacaagaugcaauuuuaccaaaauuuggcuuacgguaaaaaagugugugcacauggagaagagacacacacacacacagacacacuccccccaaaacagaguaaggcagccgugacuaagcaauagcaacguguuugaaaaaaagacaaaugggcgccguggcucacgccuguaaucccagcacuuuaggaggccaaggcaggcggaucaccugaggucaggaguucgagaccagccuagccaacguggagaaaccccaucucuauuaaaaauacaaaauuagccgggcaugguggcgcaugccuguaaucccagcuacucaggaggcggaggcaggagaaucacuugaaccugggagguggagguuguggugagucaagaucucaagaucacaccauugcacuccagccugggcaacgagugaaacuccgucuccaaaaaaaaaaaaaaaaaaaaagaaaaagaaagaaaacaugggucuugguugauacaugcacagugggccaagaauaugauguggcuaucaaaaaauuaauuaauuccaucuuagguggucuuuauauguauguagggggcaaugcacaugagcacaugugccccccacccccgaccuuuucuuuuuuuaagagacaaggucucacuauguugcccaggcuggccuccaacuccuggacucaaguugauccuccuacaucaaccucuucagcagcugggacuacagaugugugccaccauaucuggcuugcccacuuauuuuuaaccaguaaaaccauuaaaauuaggcucuaagcaacauacuuuaugaggacuuggauaaaaaucaaaccuuuacagggaauaguggcuuaaaaugaaaggguaagccaggugcagugcugugcacccguaguaccagcuacuagggcuacuacggaagacugcuugagccuaggaguucauguccagccugggcaacauagcaagacccugucucaaaaaaaaaaaaaaaaaaaaaaaaaaagaauaaauauuuggccggaugugguggcucacgccucuaaucccagcacuuugggaagccaaggcaagcggauugcuugaacccaggacuucgagaccagccugggcaacguggcaaaaucccaucuccacaaaaaacaaaaaacacaaaaacaaaaaacaaaaauuuaaauaaauauuuaaaaagagaaauaauaaugcuugagagaaagaaggcaccacagagcaaugcugguacugucaucaaaggaaaaaagucacuuguuuuuuguggaguugagcaggaaaacuaagaccaacaaguaaaaaauaacagguaggucaguuuaucacaggcccuuucuaaggaacacugucccaagacggacuggaggagcuuaaaaaucccucuggacucaaauuuaauuauuccaguuuuccccaacuugaucaucauaugaggacuuuucuuuuuacuagaaaucccuucaccuccaucauuaaaacacagccuguuuuccuaaacuaaucaauaugacacuauuuuccuccaauacuggauguaccuaaaggcugcagaaggacuaaugguuaagaaagccuauucauuuucagugcagaauccuuugaccccaguaacuaccacuaggaaauuuagccaagcaucacauaaaucuggccuauugcaagauuauucucagcaguauuguuuauagaaggaaaaagacugaaaauaacuaaguauccaucagcaaggaacugguaucauacauuacacaguguauccauaaacaaaauucuauggcacucuugaaaagaacaagcauauccaagcaugcugacaggaaaaucuccaauacauacucuuacugacaaacucaagugaagaacuugcuaccauaaaaaaugaagauacagguaugcacuucuacacgcuggcaaggauggguuaggaaauugaaaacaaugacuggggaaaggaaguaggacaguaagggauguggaaaggggacuuauucuucacucuauguccuuuuauacuuccugaauuugaaaaauuacaaagcuuuuuagguagacaauaaguuagucucaauauauuuaagacauuauucaacaagagauaugaaauaacuaucuaauuaaaacaaauuucuuagagauacuuaaauaaaaccuuuuaaaagccaaaucaacaccuguaaucccagcacucugggaggccgaggcgggcggaucacgaggucaggaguuugagaccagccugaccaacauagugaaacccugucuuuaccaaaaauacaacaauuagcugggugugguggcacaaaccuguaaucccagcuacucaggaggcugaggcaggagaaucgcuugaacccgggagguggaggcugcagugagccaagauggugccacugcacuccagccugggagacagagcgagacugucucaaaaaaaaaaaaaaaaaaaaaaaaaaaaaaaaaagaaagaaagaaagcaagaaagcaagaaagcaagccagccagccaaaucaauuauuuggacaauuaccuaacucaauugaaggacaauagcuaagaaaguccaaguaaucguuaugaagcauguuguaagucagcagaagaaaggccuaugagguggaguaggaucuuguuccucagagucaggcauugagaauagucaacauuuuuacuguucuguauggugauaaaacacagucccuuuauaccccaaacugaacccugcaaagcaccacacaacaauccucaacauccaagaaugcaggcugcuuggcauuuucuuacauucucuaagccacugcacaucccacaacccaaucccacaacagcuuuguauacaaagaacaccaugauacacauuaaauaauuuaauuaaagcauuuuguuacauuccuaaguauuacauauuauagguaacauuuuuuuaaaaaaaacuucagcaaguagcuuucauugaaauccaaaugaagaaacagagcuauuucaauccugacaaauuauuucugaacaggaaggggugggagaaucagcaucagucaccacuuaccguguacuuaugcugcaccaggcacuuuaacaugcaugaucuuauuucauucccucaaauguagguagucaguaugaccaacaucuccauuuacagcccagacaacacggccccaguucaugaagcuaagaaguaggggcaugauuuuaacccaggucucuaaguuuaaagccccugcuguuuucuauuauguuacagugggucaaaaagaucccccaaaagguaaauuuaguuaauacauuuuaaaucugcuuaacagaccaaagaggcaaaugcacacgaugcuccaaaccagaacuugaauacccgaguauaugaugcuuaaucuauuuuucaaucuguuguggcuguaaacgucaaugcuuccaagucuccaucauuuaguucuucucuacucuucccacaucuguacauuuauauuuagauuuuugggaagccuaguggaaauuccuaucuguauagaaaucaauguuugcauauggagaacccggccacuguaagagcaguuuuauauacauuagauuauuauuauaauaauuauuuuuauuuuuaagagauggagucucgcucucgcccaggcuggagugcaguggugcgauguuggcucacugcaaccuccgccucccagguucaagcaauucuccugccucugccucccuguagccuguagcuaggacuacagguacacgcugccacgcccgguuuuuuuuuuuuuuugguauuuuaguagagaugggauuucaccuuguugccugggcugguuuugaacuccugagcucaggcaauccgccugccucggccucccgaagugcuacgauuacaggcgugagccaccgcacccagccaaaauuagcuuauuauuuuuauaacuuguugcaaaauccucuuuuuagguuagaguuucauuuaauccucuuuaaauuauauguccgcaacacccaaauuuaagaugcuuguuuuuuguuucuuugagagacacggucucacucuguuggcuaagcuagaaugcaguggcgcaaucauggcucacugcagccuugaacuccugagcucaagcuaaccuuccaaagcacuaggauuacaggaguauaaaccacugugccugaccccauauuuaauacacuuuaaaaguacauggucaaguuccuacuagaaaaggugcaagugaaugagaaaggcagucuaaugcagggaccagcugugugaucuugggauggcacuuaaacucucacucccaguuuccuuaucaguaaaacaaggaugaugaaaaguaccuacagcauaguacuauuaugaggauuacaacaaacaacaggacguagauucuucagaugugccaggcccuguucugagugcucaauaaaugccagcaauuauuaccagagaaacugcagauguaacagaaaagaauacucuuaugaagacuaacagcaaucucaaaguguauuccauaagccgauaacaucuuuucuuuggucaauuguugacaaggucuuuuucccuuuaccaauuaaaauguauuuaucuuggaugacuguuacguguguucacuuuguaaaaauuuaucaagccauacaacacuuaagaugugugaacuuuuccguaaauauucuauuuuucaguaaaguuuuaaagaaacgcauuaguuugggcccagaaagaugcugcucuacauucaagcccaggaaaugucaaauauauucagugcuuccuccaaacacgauuaaucucacaacagcuucuuucuccccuuuuaccaccacacuauacaccagaaaucaucccacaaaucacguaaguuuugaaaauaaaaaccaccugccaccucaugcaagggcugauuacauacuuauguucuaugcauaaaacgccaaaacuaggaaauucagaacgacaguuaaauuuaaacaaaauaaaaguugccagaaacccuuacuuagucacuucaggaagccacugaacgguaagacugggccacugaagagcaugggucauaaccaggucauauagaaacgguguauucuucuuccagauuuuauauucuucauugaugacacgcuccuccacaguaucuucaaacacugaaauuuggagaaagcccacacgauuaaguggcugagauagaucaaagucagaaauuggaggucaccucaagauggccacaccucauguacucuuuccuuuuaccucuaauuuggacacggacaacuaacugcucuuccagaagguggagaaaauacuaacaaucaggaagccuauuuuuuccauugagaucaauacccccugcguacaccauguuggguagucaauuacacggacauggaaauuguuuacccuguuacagcuguucgcaccuguucuaagaugacgaccuguacguacaggggcugcgcgacccagucgggaagacaaaugcacguguagcagaagcccacaggccuggucucuccaauccccaucaggggaggccccagcucccacgacgcccgccucggcagccauaggccugaggaccccagcaacccccggacaagggccgcgaccccgaggcggucaacgcgcgcgcgcgcguagaaagagccgcggcgcucgcuucccagcggcgggggccgccuccgccccggggccgagggcgccggagggagcgcagccgcuggaggagggaagggaagaggggggcccagcccucggccccgcgcccggcuccggaagugcucggagcccucggcgcggcggucccgucccgcgcaggccccucgaggcgcgcgcccagucucgcgcccggccccgcccccugcuccgcacgccaauucgcgccuuucgccggcgcgugccgcggccucgcgcgcccgccgccccccgcggccccggcgcgcgccgccccgcagggccucuuacucucuuuacucgccaucuugcgucgggucguucgccccucgccgccgccucggacuccucucguuagccaagagcagcccgaccgcuggcgcuccugccuuucccaagcgcgucacacuccccacugucgaaagcccgggccccgucuugcugccugggugcuccccagacgccgcguccuucuuuccugccuccuccccgcucgcggguaccgaggucugaggcgcucuucucucucucuccaaacuuggaacgagacuuuucaacccgcgccucccagcccgcccaggcagcugagcgcaggcgcauccgcccugggaaaagug

SEQ ID NO: 19220 - RNA, 935 nt, Homo sapiens
gacugaauuacuuuuauuaauauacacaucaaguuacugaaacggugacuucauguaguuucccccuuaaagauggcacuugcagguacaaagaugcagagaugucuacagccuucagauguuuacuugaaaugauucuucaacagcaguuugacauugaguuucuucaucuagcugaagauucacaaauucuccauaaucaaacugaugucucugauuuagaugacuaacgaaauuucugguaaucuggcuaggaucuccccaaggaagagauacacaaauaggacaugucacaggaacuaucugaaauaagugauuacuguuagagugauccaguaaacgcucucugguaaaauuugauucuugacacaggggacacuuauaaguaggaugaccagaagaacuuguauucucuugguaaguuucuguguuaucagauguggauguuucacuccuauugcuguucccuacugaaucuucagagaucugaaaguuuggaaugauagaagaaacaucauauucauccugauacuucuuacaagauuugcaaugaagucucaugcgauagaauuuaaucuguuuugcacagcaucugcagcuaccagaaaacuuccucauuauauuuucaaggucuaaggcccguucagggcaugcucucucuucuagucacauuuccacgacacaggggacaaugugcuccgcuuucccucauugcagucaggaaacauuuucuacagaaaacgugcugacagggcgcgguccgcacgggcguuuugagcaccuccugacagacggggcaguaggauguggccgcggagagguccucagccauggcgggggaugggggaacaaggcgauggugacagcggcagcggccccgauggugacauggugacagcggcagcggccgaggugacggugacggcccggggcuc

SEQ ID NO: 19221 - RNA, 29460 nt, Homo sapiens
ccgcuucccgcgcgucgccuagcccgccccucagcucgccgcagccccggcuccucccucguccggcccccggggcggggucugucagcuugcccuccccucuccgccuaagccugcccuaugccagccggguguccuccccacagcaccacggcuucucuuccucagcacggcgacaggggcuuccccuucgccgccgccgccgccgccggccaagcuccgccgcgcccgcggcccgcggccgccguaagucccugggggcgaaagggggcgccggggaugggggagagggggagggaggacugggcgcgccccccgccaccccgcgcgcgccccgacgaccccaccccgagccugcccggcccgccacugggucgccgcgcccgcaacucacuucucuccguguccgcgcccuccgcaccacuccgcgccgcgcccggggaugugggggccagucccgggcuccgcgacagccucgcggcaccugugguucgggaaucgccucaaguuuugcggggcgcuuucgggaggggccgggggcgguggcggccgaggacucuuggcgcccccugcgcggcggcggaugccauugucugcuccgcuccuugccugucaccucucccgggcuuggucagugauggaguguggccacgggagugggggggaggcaccggcgacggccggacccgaggaacgcuggccccgagcccgcgccgcggcugagcccauuguuuuuaaugccagucucgaggaauuguggugcccugugauuugcggcaaaaucaaagcguugguuuuuaacacgagggaaggaauacucgugcuuugcaaccggguuucgucccauguuaggacauaauuuauuuuaaggagaauacauuguuuuuucguccugcaaagugguagggcggauacaggacccugcuccagacagccuugagcccauacucuucgcaggcaaacccucacccuuucuggucaccaagaucuaggaauacgagguccauucuuuuccaaguucugguaacggguuugcaguaaaugcccaguugaugcuucacuuccugcccccuucgaaugccgcuaucuucaggacuugcacgggaggcacuuugguaucaccuaauaauguccuuauauuuuguuccccugacgcauuuuaagugagguaauaagaccauuuuaacuuuacuaaaguugaauugccacgucauacauuucuagauaucuuguugauaccuuuuugggugguuacaaaaagcgacgauaauuucuuaccgaaauuuagggcccauuuuuauucuacauugguucuguaaauuuccccuccccguguucaaauucaagaugguguggugaaucuugagaaucaugcuugaaucuuauuugcaguaacgcuguuaaaggaacuuaacagugauuaaaagaaaaaaggauaccuaugugaauucugccuuuaaauuaccuuuguagaaacaauacuucuguuugcaguugagaugaccaauuggauuacaaaaagcuuggcguuaaaaaugaaacaugcagacuaaucaacacauuugcagaucacaaauaaauacauacaaauuaguuuaaguauaaaacacacuagaauucagcauccauuccaucuguagauacuauuuuuuauuuuaaaugaaguauuucauguaauguuucaaugcugaaucuuauuuaauaaguguaaaucuuauuguggccuuuuaaacguuuguuuucuuuuucauaauacauuaacucaguucuagauuuuguacauauuuaaguuggaaugcuuuaaaagucagaugaaaacauacuuuuuuauuaaugaaaauuuguauuuaugggauuuuucaguuaauauuuuggaucauucuguuuugcuuaaaauaugccaucauaaacugaggagaacauuccaagacauaagcuacugucugcaaguaauucacccuggaacuagaacggccucaggaugaaaaauagcaggucuucuguuucuuucaaaaguacccaaaccagaugaugucuaccauucucuuuugaugcauauagagagugcgcaauguauagcacagguagaaaauaguuucuuaaauugaaagagugaucuuuauuuuucuucaaaaauuucacuucagcuuauuacccauuuuucuuuuuucuccugcacacuccccuucaaacuuaauguggaacaaggugggauuggaagguuugcaucuagaggaagaucuguccaaaagaauuucuugcuauuuuaauuggcauagaaauauugauggcuacuaaucauuugucauguaaaugccccaucccccaaaacuucucugugaaacacauaaucuuaacuuuauugauucaaaguauuacauguaaucuugauuuuauuuaucuuaacagaugcaguuuauguugcuuuuuagucgucagggaaagcuucgacugcaaaaaugguaugucccacuaucagacaaagagaagaaaaagaucacaagagaacuuguucagaccguuuuagcacggaaaccuaaaaugugcagcuuccuugaguggcgagaucugaagauuguuuacaaaagguauaauuuuuguuugucagaaaggugaaauagaaucaaauguuaggucauuuaggaaauugcagacuucagugaugacauuuauaaauaacgauuaauaaagauuuagaugaaauagguuuaagguaaagcuuuguguuuuuaaaauaacuaguguuuugauugauaauuacugaggcugaaaugauaaaggcagggaaauccuuugaaaacuaguuauauaauuaaaggcauaaaugauuauucaugcuuaaucaucuuuauagaagaguuuaaugaauucauuucauugcaggggaaaguagggucaguauuuuaaauugugugaguaauucucugaauugagacaaguacagauagagucuaauucuuuuuccccgaaaaucuauaaaguaaugacuaauauuugacaugccuuuuaucugauuuuuagaaucuuacucacguguaaauaccuugacuauguagacuauuucaaucacauagauguuuuaaaaacuuuguguauacaugagauguguuuguaaguaguguuuauuaacuuuuaaguacccuuguugcuauggugggggugcaauuaaauaugacagauaauuuuuccaaggacagauuuuuuaaaaauuugauguuacaaaaugacucauagauuggcuuuuaacacuaaaauuuuuuuaaugcuauacgucuuuauuuuauaaauaucugaaacccugaauacccuaaaauaaauuucucaagauuguucuaaguagguuaaaagaaauaaacuuucuucuuuuacagaacauuuuuugaggggacauuuacuucauuccccauuuguuucuuuuugaauaauuugcugaauuuaagauaagagcauuucugcauauaaaaaguucucuuguguggggaguauacauggaaguaacaguaugggauacaaugagggugggagagaagucugguuuucuucucagcuucccuuuauugcacuccaaauauggguuggauauuuugucagggagauggcugggaagaaauggagauuacaagacauaaguuucuuaaauacugaggacuccucuuuauuauugaaugaucuuuggugauuuuguaucuuugggugauuuuguauccaguguuucguuuggucuuauuaaagauuauagaaaagucauaucauuugagaggugagagauguuuuacagugaucuagucaggugauuuuguuuuguuuuguuuuguuuuaagcuuuuugccccauggguagaaccuuaaauaaaaugaguggaagugaggcugcuccuugugaaaucaggaaugaggauccuguauccuggcucacuuggccuuuaccccucugcacaggagacaguucuugaguuugaaaacugccguuguugaucaaacuucaauuuuauaaagaaugcaaauuugggagaagugacuugucuagggccauaugccaguuagugauugacauggggcugcaacucagaucuuaagcuuagaggcaaagauuuuaaacagggcuggaaaaagaucagguuuacauaucuuaaaagauugaacugagacaauggaugagggcaggaggggcugagacuggcaccugcaggaucaguaggagacuaugugagauccugaacccaggcgcuagaaaggagggcugucacuaaauagccauuaucaaauagguagguuugauaagacuuggucaccucuagaagugggaagaauaugggaggucgaggcaggagaaucgcuugagcccaggaguucaaguccagcccuggcaacuuagugagaccccgccgucucuacaauuaaaaaaaaaaaaaaaaauuagcugggcgugguggcaugcaccuguauuccuagcugcucuggaggcugaggugggaggauugauugugccugggaguucaagccugcacugagcccugauugggccacugcacuccagccuaggugacagagugagacccucaacgacaacaacaaagcggagagagcagcgaaggaaagggaggaguggggugaucuccacauuucugguuugcugaugggguacaaggugagcuagauaacucggcuuauuuuggggugaguugauuuggggaugucuaugugacuuucauuaagagaagccugauuuucuggugggaugugguugguguaaguauggaagucuggggaaaauaagacaaaguauuagaucaccagcauucaaguggcaggcaaaggagaugaagaagggaccuucagaguggaaugagaaauuucaccaaugccagauguugcauaaaguucaaugaaagugaggaaggaaucugguagauuuuacagugagcauuucauauaaugcccuuugccagaacauuuucaguggaauaguggagauagaacucucgauguaauggggcgaagugugaagagguggagaaauuuaaauagcauguguagacuauuuuggggaacuuugcugugaaggacaggagacgaggugguaaccacucauagacauaggagugggggacaagguuuuuaaaaaagaaggugugagaggcuuaagcuuauuucuagauaggggaaggagucccccguguggaggaggaaaauaccagcaagggauucaaucccaggaaugggcuguuaugggaagaaaggaaagcacugcuugguguucaugcacaugucacucagucuguccguguugagccacuacuuuuucuuuugaaagcuacaaaggguaucuaauccaacucugauacuuauaucaagcaccuuuaaauaaaagguggacuuuaaaaaaaacagcuuuauugagauaucagucauauacaaaagguggaauuuaucaguucuuucucuauacguucccccuuccauuucauacugaaaaccucaucuacucuaccacuuacggacauauuuuuuguugguauaaacaggugguuuguuuucccuacugcuggaagcgaagagcuuuuuaagcaggagaauuacugcuuagcgccugagaaauucuggacugggacuucugcuguucauaucagcaagugauuuuuguuguuuuuguuaaauuaucucaucuacauucuucauccugaguauuuggcauacaaauucccccuuuugagaggggaaugauggauaagaauaauauuagcugaaaagacagacugaaaaucuggggacuuaaguucuguucccuuuguaacguuagcuaguuuuaugacuuuaaacaagucacuuuguuuccuuaucucuaaaugcucuugaagaucccuucaagacagaauacugugcuuuuuugauuccuguuuuguguagcauuuuguggaagagucacuggauuaaggucuuuuaaaauuaauuuaaaaacauauauaucuccaaauuacuagcuugauaauuuguuaaagaauacuuacugauuuucuuuacuaacaaaagaauuuuuaaugacauaccaguggguauugagaacacuucagcuacauucacccacagucagcugauauuuagcugauauuuagcugacugcggagaagucauguguuuugaauauaagaauaggcacuuucagauguucucugagugccaguaauuagaguaagccuuaauccacugugcuaaaaauaaccaaacauaccuuucuucuuacuagucuauuauuaauuuuacuucagauuuagacuuacaaauaggcacuaagagaacaaaaugagcucauuauugauuuuuuuaaaaccauuugguccuaaauauaggaaguacacuucagguucucuugguaaucuuuuacuaaaucaguauggcauauuuuacuucucuucaaagcucuuaaaauauuguuucgagcacauuuuaauuuuugccagguaugggauuacguuaaugcaauugcuggcuauaguuuuuaauguaaaacuugggcucuagagucaaauugcuguuccuaggcagguuacucaaaccugggucucuuaucaaugcaaauaauaaugguaucucauggauacgguuguugugaggauuagagugguaaaauaugcaaaagccuuagcuaacauuuaaugucucauguagggcgaggauucagugaaugguacuuaauuauuauguuucuguuuuuuuccugcccuaagcuuucuggaaagagguacauuauuauccugauagcuaucuguucaccuacaccaaagaauucauuaauuugauuauucuuuuuccauuccgagugaaaguaaacauuacuggcuggggcuuagacacauuguuucugaugauuuuuaaauuaaugcuuccaagugauucaugcaguuuaggaccuuugacuaguguuuaagugcuuuuuauuuguaaguaaagaggcaguacuguggauaaggagcgaggaugguacgagcauuagcuuguuuaauaguagcaugaggaaaucuuaaauaaaaggaauuuuacuugaaacuguuaguaaacuuuguauaauaaauuauuuagcauucuguuccuaucagcuagucauaucugguuuuuaaucuaccauuuuuaugucagucccuuuaauguuuaguuuucuuaaaucagggaaucuuaugugucauuuaucaguuuccucaaauucaaaguucuauuuaaugagcauggguuagggaggauggagaguuggaauacucuauucucuuuuaaauagacaaacaaaaacaguaacgaugggaaagagagggagcacuuuguuaaaguuggcauugaugcccuguuuugucuuccaugacuuauucccuucacaaugaugauaaaugaacacaugugaauaccuccucucaauaagacugcaguagcuccaccauuuuaaauaacuuacugaguguggaagucagguagaguagacaugcacaaacucaugauauauaugccaagugaguuuguaugauacaguggaaaaaggccuggaguuaaggucaaaagaucagguuucuuaucccaguacuagcacuuguaggcgcuguacucuuaagccucauuuuuuuuuugucuuuuuuuaaucugugaucaaggaugaaagauaguacuugcuguugaaaacaucaaauaagaugaaaugguuuuaauaaugaaauuaaugcuguugugugaauacuaguuauuuucauacuaaggagcaagaauucauugagucucaaaacagguuguguuauucuguauacaguauuauuuuacauuaaugcuacgagcaguaacugcccauuguguuuucuaaaaaucauuuaagugaucuucagugaaaauuauaaucuccacugaaauguucuguguuuagccuaucuuagguuuuuauuuucuuucuuuucaaaagccuuaaguacauguaaaccauuuuaaaaugcccuuuuaauccuccucaaaggacuugcuaugccucaggguugaaguuuugcuuccuugggucaagcauaacaugauuccauaugcuagaauccuaauuugaaggagaauauaaguuucccaaccuuauucccucuucuaggguaaauaaacuacacuucaguucaacaguguagaacuugguaaauuugagaacaggccucuguuucccuuaagugauaggaacuuucuguucucuuucucuaacuucuguaauaacguggagcuguuguucuuuucguaugguuuauucugcaauccuagaaaccuuuuuaaaaacaauucuauucuguuagaagucaagagcauaguuacccuugggggugggagguugugacugggagaggguagcagaggaguuucaggguucaguaguguucagcuucuugaugugggugcugauauauaguugaguucacuuugaaaauuuauugagcuuguaggacuuaaggucuucucuguguauauauuauacauauuccaauaaaauaucccaaaauauugaccucaccuuggcauuauccucaacaaguccuccuucaguuggaagguuuguuuucuucucuguacuuacaguuugaauuaaucugcuauauauuuuguuuuaauuaaguaaacuuaggaaaaaccugggucugcuauguuuuaaaaugcuuauagaaaagaaccugaaaggaagaagggcaaaaucacuuauucuaagugguaugauuauuuugauuuuuucuuuauacuugccuaugcuuuucaaaauuucuguuaugcguuuauuacuuuuguagucuaugagaaaaaucuguacugucgugaaagaagaaauaaacuguauaaacuuggggcuuuucauaauaggauaugaaaauauauuuagaaaacaucauuauaggauaacaguuuuuuucacauuuguacuuuguuacagauaugcuagucuguauuuuugcugugcuauugaggaucaggacaaugaacuaauuacccuggaaauaauucaucguuauguggaauuacuugacaaguauuucggcagugugaguaguauuuuauuuuaggaaauugaaugccauaguauauuuuggaaccuuuucucuaacaaguuuauuuuuugguugucuuggggauucuaaccgcgggagagggugggaaugacuauuuauuaguagaaauuauuaaguuguccauauugggaacaugcagagcccagucuuauuuagcuuguaggaauauguuuucaaguacuugagauuuggaaauuaagcuuacuuaaaccagugauacuuagucauuuuuagaaagaguuaagauugauucacucuaguucgauuuuauucacuaccugauagugaauaagcaucuucugcuucugcaaguuuuaacaauuuuuucuuuucuuuuuucuuuuuuuuuuccuuuucaggucugugaacuagauaucaucuuuaauuuugagaaggcuuauuuuauuuuggaugaguuucuuuugggaggggaaguucaggaaacauccaagaaaaauguccuuaaagcaauugagcaggcugaucuacugcaggagguaagcuacuuauucucuucacuaggcacuagcauguuuugcucuugcuggggaagucucauucaucauucuuacaguuucagaaaguacucugaagcaugcuugucauguaguguccauccaugugcaguuuauugacuggaauaugugucagucacgucaacucaguuaucuauggauggaugguucaguuuggagauggucuaucggucaggccucuucccaauggcccuuuuuggacccuaaaacacuggagucuaaaccuuuagaggacagacuauuugaagaagggaaaagauuggcugaaaguagcaguaaguugagaacucuccaucuauugcuucaaauuguuuaagauaacccccuuuuucauuaguguagauaaucaggaguugacuaugagauuaugacauuuuaauuccaaauuggcucauauuuuuaccucauguccauuaaaugcaaaaguagccaagcaaaugauaguguuuucuaauuauacuuuuuguagaaacuuccagguuuuuuuuguuagcaaaacuaaacaguauuugcauuucucuuugcucuucuuaaauaacaaaccauguucugucaaacugcauucuugucuuaccuccauauccccagauguguaacucccuuuucuuucuaauuaccauagucaucuuggguuaauugugcaguugaugcugauguaccuucuauuucugaagcuuaacauuucauagauaaggcuaccuuuuuccaaaaacuuaaugauaccuuaauucagauaccaaauugaauuaugcuuuagagcuaauugugauuuuuaucauauggaaagcuuacagcaugagaagugauuaguaaauauugaaaaaugaaauguguuuucacuaaaguaguuguuaaguguguguuugcauguauguaaaagucuugaauauuuuuggcucacugguucauuuuccagaagcauugaaaauaugauuuuguauuuccaguuuauuuuagucccuucuuuguuacauacauguuuaucaguuuguucuugucuuuuuuuagucaccaaaggugacuuucagucccauuuuuuagccuuggaggcauucaguuuuaagggagugaaauaaggggagaagaguaacuuacuuucuccauuuuaacuucuuaacucuuggacucugugaggaagggaaagcuguuugagaaucucacugcaucagucacugacugggacaguuguggggauugcuugaaguugagaugacaucaucuggauagacaucuacuaaaugugagacaaugcauuguacacuuaaugaucuuguaguuaucagaagagugguuaaggugccugcaaaagugaaguauuagauuggcagcccuggugccaucuacucuucaguagugaaaugaacacagaccuuuugccuuguguguacaguuugccacagugguuuaccaauugauuggaaauguuauucuggagguuuguuuuuaauaucaggugcgcugacuauaagcauauacucuacuguuguaaaauugguuuuuaaaguuaguaucuccuuauuuugcuguucacuaaucagacuuuuuuaaaaauuaggucaaaaccaggauuagaaauugggaauuuuucauauaggucuucccuugaucacuuucauauuuugucacagaucuguauucugcucugucagaaccuggcauuucuuccaaguuuuucuaucauuuucugauuaauuacauuggcuuuaaaauguauuuaaaguuauugaaguucaacuuuuaauuuuaauauuuuuccuggagaguaauuuuuuguuuguuuguuugagauggaguuucgcucuuguugcccaggcuggagugcaaugacacgaucuuggcucacugcaaccucugccucccgggcucaagcgauucuccugccucagccucccgaguagcugggauuacaggcuugcacuaccaugccuggcuaguuuuguacuuuuaguagagacaggguuucaccauguuggucaggcuggucucgaacuccugaccucaaaugauccgucccccuuggccucccaaagugcugggauuaaagguguaagccacugcacccagcugugccuggauuuuuaaaugcuacugggaaauugcuaugggccuuagaauaugacagcaauguuaaguuuaccuuagagcauauauucaguauuuaauguacuaggggauaagaacauuauugcagauccacauuuauuuguguguguauauguacauauguauauauauuccccuaugggaguauuuuaauaguuaauauuguccuucuguuugaaguacuauuuuuaugucuuuuuuuuuuuuuuuuugagauggaguuucgcuuaucacccaggcuggagugcaguggugcaauuucggcucucugcaaccuccgcuuccuguguucaagcaauccuccugccucagccucccaaguagcugggacuacaggugcacaccaccaugcccagcuaauuuuuguauuuuuaguaaagacaggcuuucaccauguuggccaggauggucucaaacuccugacaggugauccacccaccucggccucccaaagugcugggauuacaggcguaagccaccgcauccagccuauuuuuaugucuuuaauuggggaaaguaagugcaaagagaaaagcauaggaugaguaugguuggucccauguaaaauuuuccuuacccccuuguaaccuuuguuuaaaauaaagaaaugaguacuguuaauuacaguuccuugucuuuagaagaaagcugugguccuguuucucuucuaugacuacuuuuacauugcuuuguacacaaacgaaacugaguaccacauugagacauugucuauuuagcagucugagugaaccauuuuucuuagccauguaggucuuggggaagcaguagguggugguccauucugaauuuagagugagaauacaucguagguuaaggccauuaugaagccaagcucaagucuguguggagcaguaaggcuucagguuauucuguucucuucaucaacauacucugagaagaaaugcaggaauggcaagaugcauguuuccuaaaaauagauucauuuauauuuuugaugcaugauacaaguuuacaucugugggagaguauuugaauauuauguucauaaaauagcaaguggaauaagagaaaaagcacuccacaaacugcuggaaaacuuuuuguuuuggauaccaugacaacaaaaauaauuaugaugguaacuaacgcuugagugcuuguaugugaggcccugggcucagcaguuugcuuuaagcauccugugcuaauccucaagacacccugugaaagguuagagguagccuaaugagaaaguggaaucucagugagguuccaugacuggucugaggccaccugguuagcaacuggcaaaaccaggauucuaaacccagaucuacuaggcuucacagcuguguaaaaucuuaaccacugugcacuuccccuaaccccaguuauguauugucuugguauauauauuuuaaacguucuguuuuagauaugaacuucuuuguuucucagucauauagugagaaauucauaauucucccagagguuuuucuguguggaaaagaguagauuuccuaagacagugccaucuuugacuucuuagacugcaaauuuuuauuguccagauuaucagcaguuggaauuuuuuauuggauauguagauauaaauaauauuuuucaaccuauuucuuguuggauugaucaaaaugccuggauuuauaauaacuuuuuuggucuuauaguuugggguauagcauucacuuaaucaauuucaugaaaugauuuugcuuccaaaauuguaaauauagcugugaagaucuaaauucagacuuacauuuguaguagaaguccuaauuggucaauuuuaaucuacuuuuucaugugucauuauuuuucuguuuagugucaggucuuuuacuugaauugauuauuucuaagcaccaaagaugacuuugaacuuaucauguacuuaucuguuggcuuaaagguguauacacaucucaaugauuuugauuuuuuuuuaauuugugaaauauacauuucuauccuuaagaaugcuuauuuucuucagaaaaauuaaaaaaaaauuucucuuacccaauuuguauaaacacauaguuuaagguaguccuucauuuuauagccaaauagggaagagggucaguggauacagauuuucuguuagcauauuacaguuaguaauaaaaauguaacauuaaauguacauucaaauaauaguugcuaaaauauuagcagauauugugauuagauaauaaagauaucuuuuuuauuuuacuucauuacuugguaaauaaaggauuaguuuugacauuucuagaccaaacuucauguuuauuccuuuugguguuugguuguaugaauacauaauuagauuuggggguaaagcccagaaauuggcccguuauccauuuuuuaauguuuggcugucuuaacaugccacugguacuaaagaugauucuuaaauuauuaaaguacaacaugcugaaauugcuaaauugauauucuuugcaauacuuggaauacuuuuccccaccaccuauuuuaagcuagauuuuuggagggauauggugggggguggugauguaguuggauuuauuuaaacacacacauauauaaugacaaaggaaauaauaguauggcuuuuuuucuguaaagucaagcacuuaccaguuuuucucugcuccuuaauuuuauagagccagaaugaagaauggggagguuugucugaggauaucuuaugauaaagagcagucuaaggcuuuagucccuuugauccccaacuuauuuauugguaacuacuaaauuuaccauuuuuguggcauggauaaaauggagugcuaugcaaauacuguugcacgugagaugauuucuaaguccuugcuugauccgugaagaucaaauaguuaaauacugggcauuugggcuuuaacccuuagcgguugaugcaugaugguguugauuagugcuuugagaugugucaaccuuucuuuuuuauacuaacagcaucauuuugaaauuugugguguuguuuuucuuuugagcuuuguuugcuguugguauuuuuucucacuaaaguaaucugugaaaugcaaaauaagugagguaccaaaagcaagcauaauacucaugaauuugcuuuuacuuugagaugauccacuuuaugaauagauuuacuggauuugcaguuguuuaucugccucaucuagaaagugguacucuacggaggauuagcgcugcuaaaauugauuuguuuuagugcugggggcugcaugauauaucuuaguacuaugcuauauuuuugugaaaguaauaaucugugggacugcauacaaauggaaagguaagaaucuuaggagaaaagugauuucuuuuaaaaaaugaagcuuuuguaacuuaaaauuauuuuaauaaguacuuuuugaaguauugaauaacauaucuuuuaauaugaaguuuuggacuuuuuaaaggucagcucuugauauaauuaagaauauuugggcugagcacgguggcccaagcuuguaaucccagcacuuugggaggccggggcaguuggauugcuugagcccagaaguucgagaccagccugggcaauguggugaaaccccauccuuacaaaaagugaaaaaaaaaaagacuagcugggcaugguggugugugucuguaguccaagcuaauugggaggcugaggugagaggauugauugagcccuggagguccaggcuauagugagccaugaucaugcuacuauauaccagccuggguggccacagaacgaaacuuugccgaaaggaaggaaggaaggagggagggagggagggaaaacagaaaaaagaaagaauauuugggcaugcuaguccaacuugagaauaucuuaaauuguuuuaaaaaaagagaugcuuccaaauauguacaagaaugucauuuaacagcaaaaagcauuuugauauaaauccucuuagauuugcuuaaauaagacaaacucguguaacuccuuuguaauuacuacuguucauguuaaaaccuucaagccucuuuuaaaguuaacaagacuauagucuuuuauugccagcguacuuuaguuuuuuuauagguaaacuuaaucaggguuuauuauaacaaauucuggacaaaugaaguuugauuacauuaaugcuugaaauggaagugcuugaaaggaagggcagaaagcaggacaaauguugccuuucauuuuacauuuaauaagaaacaauuuggccaggcaugguggcucacgccuguaaucccagcacuuuggaaggcugaggcaagcggaucacuugaggccaggaguucaagaccaaccuggccaacaugguaaaaccccaucucuacaaaaaauacaaaaauuagcugggcgugguggugcacaccuguagucccagauaccuggggggcugaggcacaagaauggcuugaacccaggaagcggaggcugcagugauccgaaaucaggccacugcacuccagccugggcgacagagugagacucugucucaaaaauaaauaaauaaauaaaauaauaauuuggccaguguccuuacucucugguucucagguuguagucauuuugcuuuauguguuuuugagccuuuuuucuuuucauacuuuucaaaauuuugaggauuuuccgcuugcuauuucuauucuauucuuuucuuaaaugcugauccugaccuaguaauuugauuucaugagcccuaggguuggaaccugcacagggaccugcaaagggaauagucuguggugucgguggugauuuuuuuuuuaauuaaaaaauacuuucugaaaaaugucacguuugaguccuuuuuucaccuacugacauuuucuuuuguuuccucugagggccuuuuuuuaaaaauaaaaauucccauucuggaaaaauuagcaaauacaggcaaacacacuagaauauaaucuuacccaccaacuagagccaauuagauuaacucagugguucccauggagugggaguggugcaguugugccccucuaggggacauuggguaauguuuggacacauuuuugguugucacaauugggggugcagugcuaccggcauccaguaggugaagaccaaggaugcugcugagaauucugcagugcacaggacagcccccuuagaacgcggaauuaucuggccucaaaugucaguugugcccagguuaagaagccuugguuuaauuuaacacuauggaguaaagauuccauuuacauuuauagacugcuauaucuuuucaauauuauauguagaccacaguauaaauaaguggcuaaaaauuaaucaaaaaugcaaaaaaucaagaaaggauaaaugugcuuaagaacauacaaauagcuauaaaaaucauuccuaggccaggcgcgguggcucacgccuguaaucccagcacuuugggaggccgagguggguggaucacaaggucaggagaucgagaccaaccuggacaacauggugaaacccugucucuacuaaaaauacaaaaauuagcugggcgugguggugcgugccuguaaucccagcuacuugggaggcugaggcaggagaaucgcuugaaccagggagucggagguugcagugaagcgagauaacgccacugcacucuagccuggcgacagaguaagacuccgucucaaaaaaaaaaaaaaaaaaaagucaucucuaugauucaccaaaauuaccucuacauaaugaccaguuacuggggagauaaucuaugguugacuuuagaauccacccuacagcaaggcuuguaggaugucacucuauaauuuaauuuccucaacaacagccaaaucuguuaacuucuauuaagguaauugaguuuuuauguggaaacugaauugaguauacccugcagacagaacaccuuugaauuuucugccaaucuccccagccacuuuagggauuuguuaauuucuuaaaggaggaauaguucaaaugaccagaauuuacauauauagacuuuuguugcauauauagacuuuuuguuguuguuguucucuggcauccuguuagccuuaaagguuuuacuuagugaagauauuuaguagcauuugaguauuugaaauucugugauuccaagaaaucuuuuaccuuugaaaaacccuaauuuaggguauuccaaggcaaauacaauacagcauguccuaaaacaugcuuaaaauauuucuuugcagucuaaaauuauauuugcuagcugggcacaguggcacacuuccauaaucccggcuacuuggaaggcugaaguggaaggaucccuugagcucagaaguuugagaccagccugggcaacauagugagaccccucacucuuaaacaaauuauauuugcuaaguuaauuauucugcuuuuuuuuguuuguauauuuguuuugagacagggucucacucugucaccaaggcuggaaugcaguggcaccaccauggcucacuugcagccuugaacuccugggcucaagugauccucccaccucagccucccgaguagcugggauuacaggugcacaccaccaugcccagcuaauuuuuuaaaaauuuucaguagaaauggggucucgccauguugucagggcuggucuugaacuccgaggcucaugcaguccucccaccuuggccucccaaagugcugggauuacaggcgugagccacugcaccuggccucugcuuuuuuauuuuaaaagcacaacuaacugguagauaaagugauuugucuuuaguauuugauaacuaauggguuuuagaguguuauuuauaagauguaguaaauuauccucaucauuauuuuuaagacaaauuuauaagacaaguguaauagaaauagaucaacagcacaauagaaaaagauggcagaaaacaugaauauguaauucacagaugaaagcaaaacaaaugguccuuuuauuaagggaaugcaaaguuaaaaaucaacuagacccuuuuuuguuuguuucuucuuggauuggcaaagaggagcacuuaaaagcuguauuuuguuuuggaggauuaguuugguuaugucuacuaaugacuaaauguguacauacauuuugacccauuaguuacacuucaaagaauuuuauccaacaaaaauguacugagacacauugcuuaguauaauaagccauugaagcuuacccaaauauucaucaaugagaaauagguuaagaaaauuauaguacaaccauacaugaaacugauguagcuguaaaagaaaugagaucgauuuuuuuuuguaaugauauggaaggauacucaaaguauaucaagugagaaaagaucuaggaacaggauauuauuauuauuauuauuuuauuuuuuguagggacagggucucaccauguugcccaggcuuaggagcaggauauuagcuaacucguguuacuucugaaaaucuuugaagcucccccugcucuuuuuuccagaaguguaaaaacaagcauguauuuaguauuacacauuuuuaaaaaaugaaaaaaugcugcugugugaaugaaagaguauacaucguguugcuccagaugguaaaacuagaguagaauuuacuaaaauaaaguuucagcacguaaaguaaagcacuucucugcucuuggccauuuuagacacuaaccaucuggagcaaccauguaacucuugccacucauagcuaacuuaauguaaaaaaaaaaaaucgcuugacuuucuuagcacuucacaaaugcuuguaagacugacaccaggagcccugucaucuaaaaggcacuuuauagagugcuuucaauucuucuguuuuuucauucauugcucaaaauagaucguagugagauaagauagucucuggccuucuuggucuuuggcacaaggaagaggguuccagaguugagaguaaggacuuugcauccuuugccauagaauuugauuaggggccauaaaaaggaccauuguguucuagaaugugaaggacuaagcauaccacuuuauagugcaaggaauaagugaagaaguccuuuuauaagaaaaacugcaguagagcaauaacuugaaauuacacuuauuuauauuuacuuuucauuaaauguaaauuauuuucuuuuaccacauuguacuacuagaaagagaaucaggaguuuaggcauucagucauagauauucgauaccauugauuuacuuaagcacuucucaugucaacaagacuuaagccugcagauaauuccuauuuuaucaguguucguuauagcuucccuguugguuuuacuugugagucauaagccuaguauggugaauaucuaggaaauuucacgguaacagggcuugucuuagguuuugagaacagguguaacuugacuucucucugcuguuugucauccuacacuucccacuacaucugguccuuuuuguaggguguugagaacaacauuuuucuucaugcaggggaaaguggaagugcauguuuucuaagaaggacaaauaggaauagaauaaaagaaaaaguauauuggggcugggcauagugguucacuauguaaucccagcacuuugggaggcugaggcggguggaucaugaggucaggaguucgagaccagccuggccaagauggugaaaccccaucucuacuaaaaaaaaaaaaaaaauacaaaaauuagccgggcacaguggugggugccuguaaucccagcuacucaggaagcugaggcaggagaaucgcuugaacccgugagguggagauugcagugagcugagaucaagccacugccuucuagccugggcgacagagcaagacucugucucaaaaaaaaaaaauuauauauauauauauauauauauauauauauauauauauauuuuggaagggagaaugggaguggaaucaaaaacauuggucucggaugagaagagucuuucucauugguuauguggugauaaugggguaaagcuguagacuuuuuuuuucuuuaauucaugaguaagaugagcaaaauugaggaagugucauuuucuuggccuugagaaaugacaucaucuaaaggagaaucguugggacuggggagaaggggagggguguauagcuugaggacagugugaggaguuggcaguagacuugguggggagcaaauuagugaggagcaaaaaagauuuccugggauugaaagcccguuucagguugaaauaauacauugucauccuuauucaaagaauaggucuccagagaaccuguacuaaggacaauacaugguuuauaguuguacaauacaacuggauuaaaaaauuuuuucucacuguuuucauucugaccuuuauucccacuuaauugaaaucacugggguuuuaguguuuuaagaaacggauaguuugcugaguauuauaugugacuauuuccuacgggugcccaggggaagaacaagauaguaggccuaggccugcacagggucccuugugugcuaugacagacuuuacucucacccucccuaauuccuaauugauauaauuuuuaugugacucacaagagguacuggugguaagagguauaaacuggaauuuauaauugaaucuacuuucuuuguaucugaaagaaaaauauuuugguuaauuaugggcauauaauuuagcuaaaaaauuaccuuaaauguuaagugguccuuaaggcauuuauaacagaacuuuuucagacccuagaagucuaaacugggaaauuauuuaaaacguuauuaaagcaauuuaaaaugguaaaaauaauacauuuauuuuugugcauuuuagaguuucuuuucuucuugaaggauguuuuuccagugaagagggguuucucccuaugaagaguauucucacauuuaauagaugguaauuucuuacuuaaguacaguaauauggaucaauggcuauaaagaauaguuuggcuuaucaucaacccuuuucuuuccuaaaagcaguaaaaggugugucaggguauaagugguggaaaugccuggguggucacauugagaauuguuccuguagaauugcugguguaguucauaguaagucuccuggggaggaaugguugcauacuccgcccuguuugggaaaccaccucuucucuuuuaaugagcguaagcucucgaugguugguuuuuacaugguaugauagaaaauuaagagagaaaagaaaaagaugauaaacuauaauauaaaggcucaaagaacugguauuauuuaggcaaaagguuauuugacagauugguauuauuuaggcaaaagguuauuugacagacuuaaacuuuucuuguucucucuccagaaaacagagacuauguaucacagcaagaguuucauuggguuuaagaaagcguacuagaauacgugcuggaguacugacaugcaucaaaauguaguaggauauauaaauucaguuuguaaugacaauuuugucaaguuuguuauuuauauuuuagcauuaccugaaaagucuaauuacauuaaaucccaagggauagucccaauuacuucauuaaacugguauuuucauagggaauuuugcuuggauaaugauccauuauuggggcuuauaauuuauuuuuuacacagaauauggaaauagcuucagagguucauugacaauaaagcauucauuaaauacugugaaucacuaaugccauugauacagaagaauuucccuaugaaaaugagagcuucugugagaaaaugaaguaguugggaguuuaauuucuuauuaauaugauuuuaacuugcugcuucauuccacuauauucugaguugggggaaaagggcagcuaucucuuuaaaauauuuaggaauucuuugaggauuaaaauguaacuggcuuuuguccucagauacguuuguaauuaaugguuguguaaguuuagggauuuguuagauauuuuucuuggaacaguuuacaugauuuuguaguucaacauuucaaaguuucaacuugaauaaauauuaaaaugaggauacuuuaaagacacucaaauaagcaauuuuaaacuugcuuucugguggggauauaaucccuuugagagucugaaggaugaugggcugucaccccaggaaaauuugcacaucauuuuguuucuaauuucagggaacucucagagccccuagaaguccuucuguagacacucaaaucuggagaguucguuaaaaucugucuugaggauuuuuaaaaaaguaauauccucagucucagucaaauucuuuggauuuuuugcuuuuguagguauaaguaaacgguuaaaaaccuucauugcuacuuaaaauaccagaugagugacuacuuuuccaguuuuuauugggaaagauuuuucucuagguucuuuaguuuauguaauacaaaugaacuaaugaauuuaaauacugguggaaggggaauauucuaauugaauuuuuggucaacucaguauugaccagaugacuuacacugaaaaucuuuucauaauauuaguaguaaauauaguguuuuaggauuuuguaaaauuucuggaggaugucugucaucauuuugaacacuguauguaguaaaguuagaaaaaaaugaaucuaaagucuugggcauuguuuagaaguuaaauauucagccuuaaaccaaagaaugaaagcaaacagaaacuuaaguuuuaguuaucuuuacugugagcuaaauguucuagaaaucugauugugucugugucaguuuguauacuguguguaagaauauaugcauuucuuuuguagccacgucaugaauauuuuaaugucccuguguacuaaaugacuacucaucgaguaugcagaauuucacagaggaaauagaaugcugauauacauaugaaagaaaauauccucagcauggugauuuauugucuuguauaauaauaguagaacauuuuagaacuaguacuuuuaugauuguauuuuuuuccuguucacauuccaaacuuuucuguuuuauuuucauucuauaugugaucuugauacagcucauuccuuucugcaacugauuuaaucucaucuugacaaaauaugaccuagaaguguuuugaguaauauuaaaucuuaaacacauacauauuauuaaugaaccaucugugauuuaucuuauaagaggaaaacaugacaaucauuaaaauguuuaccaaagaaaauauagcugaagugcuaggucaaaauaagcagugccauaauauauaguguaguuuggucuucaaauauggagguuaaaaaaagaaacuauuuugugugauuaucuuacaaucuguaugagcuaauguguucuaauguaucacauaaaaguauaugugaaaauauuacaagaaacuaaaauuaauuuguaccauuauauaauauuuaagguuaaaacauucaguauuaagaaauuuuguagugccacauuuauugaaucacauuugugcuauauaauaauaucaaacaaucccuuuaagaacuuauuagagagcuaugucugaagucuguucugcaauaucuguugcugaauaauaacucuuucaaagcauuaaugcugaguuuauauaguucaaaaauucuaauauucauucaguuuuaauaccuaaauacuuauauuuuacuagugauggcauucuaauauauuaaguccucauuuaaauacuugauacuuuguuaacuguggcauuauauuucugaauuuuaaaaccuuuaauauugguaacuauugcauauucuuuuaauaaaacaugcagcauauuuuuuuauaaaaggaaaagaauucauuguuuauaucuagagagcauaaagccuaaguuaaguaaguuauuaaacaauaacuucacaagauguucaaaucgauuuaucacugaaagaagaucuaugaaaauguguuuugaccaaacuuaguauuaggcagguacacagauaagauuuuccauucuuaacauucucacuguaaugcacgacauuugaagcaccuggaugugcuaucaaucaggugggaaauuuagcauuauauauuggaagcauugagaaacauuggucuuucauuucuauuuuuuuuuccccuccuuuccuccuccugccccacaauauauuauucaucugguuuuaaugcuacauaaauaugcauugucucaugccuguuuguguuggaugccuugugcuaagcuguaacaaaauguugcuucuuuugcugucuguauacagcugcuugcuuuaaauuaguagauucugaaauagcuuuccuugcaugucuaaaauaaaaguauugcauguacuucgucucaugugaaugacuuuuucuuuuccaucccucauaaaauaacguuuuauauuuucauuuuucuaggcaaauuuuuuaaauugugguuaaaaacacauaacacagaauucaccaucuuacgcaguuuuaaguguacaguucaguuguguuaguuaaguuuauucacauuguugugcagcagaucugcaggacuuuuucaucuggcagaacugaaacucuauacccauuaaucaacaauuccccauuucucccugucccccagccccuggcaaccaccauucgacuuucuguuucuauaaauuuuacuacuuuagauagauaauaguuuuucuggguaguuuugagcuacaauuucagugugaacauguguaaguuccauuuuauauuaucaccacaauuuauuuuaaaacucuaccugugcaagucucacaagaauaaaauguguaaauaauucuuugaaacuaggccuuuuagaaaggacacauauuuucaauaaugcauauuugauaagcaguaugauucucuacaggaaaugcuauauaagauugcaggcagugagcacauggggaaaagucugaccagcuccacggaguagcuguggggcauuuuuacauggagaagcugagaauguaaacuguagaauucaauggaggcauuauuuaauugauacauucaaggcuacaugaaccuuuaaacuacuuaacauuacauggaaauaauuauuuuaaauuuuucuugaauauuuaugagauuuagaugucauucucaguguauuuaaugcuuaaggcuaaauauaaaugaaagggauuggcuuacaucacucuuggguguuacaucauuuccaguggacuuucuuaaaaaacuuuaucaugaaaacuucaagacucacgaguauaggaaauaguauaaagaacccucguguacacaucacugagcuucaagaaccaucaacuuaauacuguuuccccaaccacuccccgcauuuuugccucaguaucuuagagcaagcccuagacaucuugucaguuugucuuuaauacuucaguaugugucccuaacagauaaaguaccaugccccacaaaauuaacaggaauuaauaauuacuaucuuaugccuggcucaauuuuuccuaauugucugaaaaaugccuuuuuauauuugguuuguuagaaucagauuccaaccaagacucucacauuguaucugauugaugugcguuuuaagucucuuuuaaucuuuaacaaaucgucugcuuuuucccgccuugccauuuuuuuuuuuuaaaacgaggucauuuaugcugcaggauguccuaccuuauggauuuggccaucauacucauauggcaauguuuagcuguucuuauaucccucauuucuauuuagaucuguaaccugacuagauugagguucaauuugagggggcaagaauacuucauagguuagacucuuuuuaaaaaaauaccuuuuuucgcuaaagcugauuuuuacccauuuuuauuacuaugcagacauacuaaaaggucaucauaugagcuuuauaaguagaauugguguauaguacuugcguuuaauaauaaaugcuaaaucauuucgauuucaauuguguaacuauaucaccuaacauuuuugaagcacuuucuauaaauuaggcagagccuuaauucacuuaaucucaacauaugaagguaaguacuauuauccauguuuuccaaauaaggaaacagaccauagaguuuaaguaauuuacuuaagauuacaccaugaagugcuuuacaugcaauuaauauucuaaagauuuaugguuuaauauaauuucucuucuccuugcuuugugcuguaccaugauuaggaugcgaaaguaaguuuauuacuggaugccaaaaauuuauauuauuuuccaucauuaaaauauaguguugccuuuuaauuacaaaauucguugcuaguaauaccugaaaguuggccuccuugguccuuuauuuugugauuugcaaaaucagccacuuuggaaaauuauuaaauaauuuuuuccuggauaugcuuacuuuguuuugaccuccuuugacacuuaaaaaccagugcugguugcuacauagaauaaaaaugccuuuggcccauggcauucuuugcauauguggccucuagugaugccauugguugcacuggggaggucugggaagauagcuguuucugaagacuugccgcuguggacacaguuaacuaaaaacuccaagaggaagacauuucuauaaaugcaugugacaaaaagcauggaacacaacaguaggcgaagaacugugggaacucggagggaagagguuuugaauuuuaccacuaagauaacuuaucuuucauauauauaauugaguagcagugauuucauaaauugccagcagguuugcacugggcuugacugcuuuuugcaugacagcaacggcaucuagcacauugguagguaauuagcagguacuuaaugaaugcugaaaacguccuuuuguggucuccaauuuugagggcacaaaacccuaaauaaccaauggcugucaacuagaaugcuacugugacacgaaauugcuuucuugauucucuaaaacaagcauguucuuccaugucaauguuucacauucucaagacucccuggaucugcuuaccagagucucacauuuucccuccacaggaagcugaaaccccacguaguguucuugaagaaauuggacugacauaacucuccucccuuguugaugacuucuuguggcauuucacacacuguagauggucacucccuucauguccauguuagcucaugguguaagaugaugucuugucaguauuacuguuuugcuaagccgcuucauucaugccuacacaauuuuuuuuuaaaagggaacuuuaguuaauuaagugauaagggacuuaaauaugaauuagaauggugcagaaagagauaccuuuucuggauauuuuaaaguuuaaaggucaguuucucuuaaucugauuaugugcacauaugaaaauggcacaucauauacauguaaaaucaggcaguauacauuuauuaauuacuguauuugacaaaggaaacucuuaaauuauaaugugaaaccugguuuuaugaaaccaaagacuagugcagcauuucagcauauguaaaaaaaaaaaaaaagggaauugacaugucacauaucaaaugaauggaaacuuuguugaaacuuuaaaaagcaaauuuacuccaaagacuuguauuggaaauuacauaccuuuuuuuuuuuuuuuuaaaggacuacagauuauuuuuaaugacuaaauuggagugauacuucuuacacuaaaaauuauuucuuaggcauucugaaucugggaugagaaacaggauuguuucacaauaguaagcacauaauuuuuaaggccaaggcacauuugacuccugagaugaauuuuuuguggucauaaucaaauacuuaguuguuuuugaugccccaaaauaaagugagaaugguaauuugccaggaauucuucauaacaguaucuuacaaaaaacguguugcucucuucacaguauuauguguaaagucauuguuuaaagcacgaauguucccucugggguacuuguuaaagcuaaauuuauuuugcuucccuccacuuagaagugcugcacacuuuacagcagcuuccuuucuuuccauggcacugccuaguuaacagaagucuuauaaaaauuuaaaaagacacauuucuuacaaaaaagaguugaaugagguaaaauggcauuagauggcucuauauuuuuuaaagcuauguaauuguucagcgucacuuuucuaaguacuuauacauaucuaaacaugucuucaugguuuauauuuucacuuauauaugcugggcuggauuaagcuuuguugugauugugaccaacauucaggccacgugagcacugucuuaucacaucgccaauuaguuguaauaaacguucaacguacaaacacuggaguguguuuuuaucucuuuccaaaaguuugucaaacuaugcagagcugcugaaggaagaauuucucauuuuuuuuucaguaaaauguugaaaauuccccuccauuugaauauggugguuguuauaagcacacacaagauacaugguggaagaucuaaggagucuucauguacuucauuaaaaaauaacauggauuccauacugagagccuaucuacacauuuauuuucaaucaauaaaugcugcuuuuaaaaccuugaugcaguugacuuuucuacucuuucugaaugaacaacuuagacuguuacucaaaagguauuucaaaucaacuggauuccucuuacccccuugugaacugaaggugcuagcacaugcaacagaaagggacuaauacuugcagacuguacuaccuaaccuaugcaacaaaucaaaucuaugguaaucaugauaguuaagggaccuccuauuacuacagauaggaaauguuacauucuaaaacugggcuauuuaagaaggaggcaggaacuaccaucaaauuaaguugcuagucuacuggaaaaaaagacguuuauagguuuaaaaagccuccaac

SEQ ID NO: 19222 - RNA, 29460 nt, Homo sapiens
guuggaggcuuuuuaaaccuauaaacgucuuuuuuuccaguagacuagcaacuuaauuugaugguaguuccugccuccuucuuaaauagcccaguuuuagaauguaacauuuccuaucuguaguaauaggaggucccuuaacuaucaugauuaccauagauuugauuuguugcauagguuagguaguacagucugcaaguauuagucccuuucuguugcaugugcuagcaccuucaguucacaaggggguaagaggaauccaguugauuugaaauaccuuuugaguaacagucuaaguuguucauucagaaagaguagaaaagucaacugcaucaagguuuuaaaagcagcauuuauugauugaaaauaaauguguagauaggcucucaguauggaauccauguuauuuuuuaaugaaguacaugaagacuccuuagaucuuccaccauguaucuugugugugcuuauaacaaccaccauauucaaauggaggggaauuuucaacauuuuacugaaaaaaaaaugagaaauucuuccuucagcagcucugcauaguuugacaaacuuuuggaaagagauaaaaacacacuccaguguuuguacguugaacguuuauuacaacuaauuggcgaugugauaagacagugcucacguggccugaauguuggucacaaucacaacaaagcuuaauccagcccagcauauauaagugaaaauauaaaccaugaagacauguuuagauauguauaaguacuuagaaaagugacgcugaacaauuacauagcuuuaaaaaauauagagccaucuaaugccauuuuaccucauucaacucuuuuuuguaagaaaugugucuuuuuaaauuuuuauaagacuucuguuaacuaggcagugccauggaaagaaaggaagcugcuguaaagugugcagcacuucuaaguggagggaagcaaaauaaauuuagcuuuaacaaguaccccagagggaacauucgugcuuuaaacaaugacuuuacacauaauacugugaagagagcaacacguuuuuuguaagauacuguuaugaagaauuccuggcaaauuaccauucucacuuuauuuuggggcaucaaaaacaacuaaguauuugauuaugaccacaaaaaauucaucucaggagucaaaugugccuuggccuuaaaaauuaugugcuuacuauugugaaacaauccuguuucucaucccagauucagaaugccuaagaaauaauuuuuaguguaagaaguaucacuccaauuuagucauuaaaaauaaucuguaguccuuuaaaaaaaaaaaaaaaagguauguaauuuccaauacaagucuuuggaguaaauuugcuuuuuaaaguuucaacaaaguuuccauucauuugauaugugacaugucaauucccuuuuuuuuuuuuuuuacauaugcugaaaugcugcacuagucuuugguuucauaaaaccagguuucacauuauaauuuaagaguuuccuuugucaaauacaguaauuaauaaauguauacugccugauuuuacauguauaugaugugccauuuucauaugugcacauaaucagauuaagagaaacugaccuuuaaacuuuaaaauauccagaaaagguaucucuuucugcaccauucuaauucauauuuaagucccuuaucacuuaauuaacuaaaguucccuuuuaaaaaaaaauuguguaggcaugaaugaagcggcuuagcaaaacaguaauacugacaagacaucaucuuacaccaugagcuaacauggacaugaagggagugaccaucuacagugugugaaaugccacaagaagucaucaacaagggaggagaguuaugucaguccaauuucuucaagaacacuacgugggguuucagcuuccuguggagggaaaaugugagacucugguaagcagauccagggagucuugagaaugugaaacauugacauggaagaacaugcuuguuuuagagaaucaagaaagcaauuucgugucacaguagcauucuaguugacagccauugguuauuuaggguuuugugcccucaaaauuggagaccacaaaaggacguuuucagcauucauuaaguaccugcuaauuaccuaccaaugugcuagaugccguugcugucaugcaaaaagcagucaagcccagugcaaaccugcuggcaauuuaugaaaucacugcuacucaauuauauauaugaaagauaaguuaucuuagugguaaaauucaaaaccucuucccuccgaguucccacaguucuucgccuacuguuguguuccaugcuuuuugucacaugcauuuauagaaaugucuuccucuuggaguuuuuaguuaacuguguccacagcggcaagucuucagaaacagcuaucuucccagaccuccccagugcaaccaauggcaucacuagaggccacauaugcaaagaaugccaugggccaaaggcauuuuuauucuauguagcaaccagcacugguuuuuaagugucaaaggaggucaaaacaaaguaagcauauccaggaaaaaauuauuuaauaauuuuccaaaguggcugauuuugcaaaucacaaaauaaaggaccaaggaggccaacuuucagguauuacuagcaacgaauuuuguaauuaaaaggcaacacuauauuuuaaugauggaaaauaauauaaauuuuuggcauccaguaauaaacuuacuuucgcauccuaaucaugguacagcacaaagcaaggagaagagaaauuauauuaaaccauaaaucuuuagaauauuaauugcauguaaagcacuucaugguguaaucuuaaguaaauuacuuaaacucuauggucuguuuccuuauuuggaaaacauggauaauaguacuuaccuucauauguugagauuaagugaauuaaggcucugccuaauuuauagaaagugcuucaaaaauguuaggugauauaguuacacaauugaaaucgaaaugauuuagcauuuauuauuaaacgcaaguacuauacaccaauucuacuuauaaagcucauaugaugaccuuuuaguaugucugcauaguaauaaaaauggguaaaaaucagcuuuagcgaaaaaagguauuuuuuuaaaaagagucuaaccuaugaaguauucuugcccccucaaauugaaccucaaucuagucagguuacagaucuaaauagaaaugagggauauaagaacagcuaaacauugccauaugaguaugauggccaaauccauaagguaggacauccugcagcauaaaugaccucguuuuaaaaaaaaaaaauggcaaggcgggaaaaagcagacgauuuguuaaagauuaaaagagacuuaaaacgcacaucaaucagauacaaugugagagucuugguuggaaucugauucuaacaaaccaaauauaaaaaggcauuuuucagacaauuaggaaaaauugagccaggcauaagauaguaauuauuaauuccuguuaauuuuguggggcaugguacuuuaucuguuagggacacauacugaaguauuaaagacaaacugacaagaugucuagggcuugcucuaagauacugaggcaaaaaugcggggagugguuggggaaacaguauuaaguugaugguucuugaagcucagugauguguacacgaggguucuuuauacuauuuccuauacucgugagucuugaaguuuucaugauaaaguuuuuuaagaaaguccacuggaaaugauguaacacccaagagugauguaagccaaucccuuucauuuauauuuagccuuaagcauuaaauacacugagaaugacaucuaaaucucauaaauauucaagaaaaauuuaaaauaauuauuuccauguaauguuaaguaguuuaaagguucauguagccuugaauguaucaauuaaauaaugccuccauugaauucuacaguuuacauucucagcuucuccauguaaaaaugccccacagcuacuccguggagcuggucagacuuuuccccaugugcucacugccugcaaucuuauauagcauuuccuguagagaaucauacugcuuaucaaauaugcauuauugaaaauauguguccuuucuaaaaggccuaguuucaaagaauuauuuacacauuuuauucuugugagacuugcacagguagaguuuuaaaauaaauuguggugauaauauaaaauggaacuuacacauguucacacugaaauuguagcucaaaacuacccagaaaaacuauuaucuaucuaaaguaguaaaauuuauagaaacagaaagucgaauggugguugccaggggcugggggacagggagaaauggggaauuguugauuaauggguauagaguuucaguucugccagaugaaaaaguccugcagaucugcugcacaacaaugugaauaaacuuaacuaacacaacugaacuguacacuuaaaacugcguaagauggugaauucuguguuauguguuuuuaaccacaauuuaaaaaauuugccuagaaaaaugaaaauauaaaacguuauuuuaugagggauggaaaagaaaaagucauucacaugagacgaaguacaugcaauacuuuuauuuuagacaugcaaggaaagcuauuucagaaucuacuaauuuaaagcaagcagcuguauacagacagcaaaagaagcaacauuuuguuacagcuuagcacaaggcauccaacacaaacaggcaugagacaaugcauauuuauguagcauuaaaaccagaugaauaauauauuguggggcaggaggaggaaaggaggggaaaaaaaaauagaaaugaaagaccaauguuucucaaugcuuccaauauauaaugcuaaauuucccaccugauugauagcacauccaggugcuucaaaugucgugcauuacagugagaauguuaagaauggaaaaucuuaucuguguaccugccuaauacuaaguuuggucaaaacacauuuucauagaucuucuuucagugauaaaucgauuugaacaucuugugaaguuauuguuuaauaacuuacuuaacuuaggcuuuaugcucucuagauauaaacaaugaauucuuuuccuuuuauaaaaaaauaugcugcauguuuuauuaaaagaauaugcaauaguuaccaauauuaaagguuuuaaaauucagaaauauaaugccacaguuaacaaaguaucaaguauuuaaaugaggacuuaauauauuagaaugccaucacuaguaaaauauaaguauuuagguauuaaaacugaaugaauauuagaauuuuugaacuauauaaacucagcauuaaugcuuugaaagaguuauuauucagcaacagauauugcagaacagacuucagacauagcucucuaauaaguucuuaaagggauuguuugauauuauuauauagcacaaaugugauucaauaaauguggcacuacaaaauuucuuaauacugaauguuuuaaccuuaaauauuauauaaugguacaaauuaauuuuaguuucuuguaauauuuucacauauacuuuuaugugauacauuagaacacauuagcucauacagauuguaagauaaucacacaaaauaguuucuuuuuuuaaccuccauauuugaagaccaaacuacacuauauauuauggcacugcuuauuuugaccuagcacuucagcuauauuuucuuugguaaacauuuuaaugauugucauguuuuccucuuauaagauaaaucacagaugguucauuaauaauauguauguguuuaagauuuaauauuacucaaaacacuucuaggucauauuuugucaagaugagauuaaaucaguugcagaaaggaaugagcuguaucaagaucacauauagaaugaaaauaaaacagaaaaguuuggaaugugaacaggaaaaaaauacaaucauaaaaguacuaguucuaaaauguucuacuauuauuauacaagacaauaaaucaccaugcugaggauauuuucuuucauauguauaucagcauucuauuuccucugugaaauucugcauacucgaugaguagucauuuaguacacagggacauuaaaauauucaugacguggcuacaaaagaaaugcauauauucuuacacacaguauacaaacugacacagacacaaucagauuucuagaacauuuagcucacaguaaagauaacuaaaacuuaaguuucuguuugcuuucauucuuugguuuaaggcugaauauuuaacuucuaaacaaugcccaagacuuuagauucauuuuuuucuaacuuuacuacauacaguguucaaaaugaugacagacauccuccagaaauuuuacaaaauccuaaaacacuauauuuacuacuaauauuaugaaaagauuuucaguguaagucaucuggucaauacugaguugaccaaaaauucaauuagaauauuccccuuccaccaguauuuaaauucauuaguucauuuguauuacauaaacuaaagaaccuagagaaaaaucuuucccaauaaaaacuggaaaaguagucacucaucugguauuuuaaguagcaaugaagguuuuuaaccguuuacuuauaccuacaaaagcaaaaaauccaaagaauuugacugagacugaggauauuacuuuuuuaaaaauccucaagacagauuuuaacgaacucuccagauuugagugucuacagaaggacuucuaggggcucugagaguucccugaaauuagaaacaaaaugaugugcaaauuuuccuggggugacagcccaucauccuucagacucucaaagggauuauauccccaccagaaagcaaguuuaaaauugcuuauuugagugucuuuaaaguauccucauuuuaauauuuauucaaguugaaacuuugaaauguugaacuacaaaaucauguaaacuguuccaagaaaaauaucuaacaaaucccuaaacuuacacaaccauuaauuacaaacguaucugaggacaaaagccaguuacauuuuaauccucaaagaauuccuaaauauuuuaaagagauagcugcccuuuucccccaacucagaauauaguggaaugaagcagcaaguuaaaaucauauuaauaagaaauuaaacucccaacuacuucauuuucucacagaagcucucauuuucauagggaaauucuucuguaucaauggcauuagugauucacaguauuuaaugaaugcuuuauugucaaugaaccucugaagcuauuuccauauucuguguaaaaaauaaauuauaagccccaauaauggaucauuauccaagcaaaauucccuaugaaaauaccaguuuaaugaaguaauugggacuaucccuugggauuuaauguaauuagacuuuucagguaaugcuaaaauauaaauaacaaacuugacaaaauugucauuacaaacugaauuuauauauccuacuacauuuugaugcaugucaguacuccagcacguauucuaguacgcuuucuuaaacccaaugaaacucuugcugugauacauagucucuguuuucuggagagagaacaagaaaaguuuaagucugucaaauaaccuuuugccuaaauaauaccaaucugucaaauaaccuuuugccuaaauaauaccaguucuuugagccuuuauauuauaguuuaucaucuuuuucuuuucucucuuaauuuucuaucauaccauguaaaaaccaaccaucgagagcuuacgcucauuaaaagagaagaggugguuucccaaacagggcggaguaugcaaccauuccuccccaggagacuuacuaugaacuacaccagcaauucuacaggaacaauucucaaugugaccacccaggcauuuccaccacuuauacccugacacaccuuuuacugcuuuuaggaaagaaaaggguugaugauaagccaaacuauucuuuauagccauugauccauauuacuguacuuaaguaagaaauuaccaucuauuaaaugugagaauacucuucauagggagaaaccccucuucacuggaaaaacauccuucaagaagaaaagaaacucuaaaaugcacaaaaauaaauguauuauuuuuaccauuuuaaauugcuuuaauaacguuuuaaauaauuucccaguuuagacuucuagggucugaaaaaguucuguuauaaaugccuuaaggaccacuuaacauuuaagguaauuuuuuagcuaaauuauaugcccauaauuaaccaaaauauuuuucuuucagauacaaagaaaguagauucaauuauaaauuccaguuuauaccucuuaccaccaguaccucuugugagucacauaaaaauuauaucaauuaggaauuagggagggugagaguaaagucugucauagcacacaagggacccugugcaggccuaggccuacuaucuuguucuuccccugggcacccguaggaaauagucacauauaauacucagcaaacuauccguuucuuaaaacacuaaaaccccagugauuucaauuaagugggaauaaaggucagaaugaaaacagugagaaaaaauuuuuuaauccaguuguauuguacaacuauaaaccauguauuguccuuaguacagguucucuggagaccuauucuuugaauaaggaugacaauguauuauuucaaccugaaacgggcuuucaaucccaggaaaucuuuuuugcuccucacuaauuugcuccccaccaagucuacugccaacuccucacacuguccucaagcuauacaccccuccccuucuccccagucccaacgauucuccuuuagaugaugucauuucucaaggccaagaaaaugacacuuccucaauuuugcucaucuuacucaugaauuaaagaaaaaaaaagucuacagcuuuaccccauuaucaccacauaaccaaugagaaagacucuucucauccgagaccaauguuuuugauuccacucccauucucccuuccaaaauauauauauauauauauauauauauauauauauauauauaauuuuuuuuuuuugagacagagucuugcucugucgcccaggcuagaaggcaguggcuugaucucagcucacugcaaucuccaccucacggguucaagcgauucuccugccucagcuuccugaguagcugggauuacaggcacccaccacugugcccggcuaauuuuuguauuuuuuuuuuuuuuuuaguagagaugggguuucaccaucuuggccaggcuggucucgaacuccugaccucaugauccacccgccucagccucccaaagugcugggauuacauagugaaccacuaugcccagccccaauauacuuuuucuuuuauucuauuccuauuuguccuucuuagaaaacaugcacuuccacuuuccccugcaugaagaaaaauguuguucucaacacccuacaaaaaggaccagauguagugggaaguguaggaugacaaacagcagagagaagucaaguuacaccuguucucaaaaccuaagacaagcccuguuaccgugaaauuuccuagauauucaccauacuaggcuuaugacucacaaguaaaaccaacagggaagcuauaacgaacacugauaaaauaggaauuaucugcaggcuuaagucuuguugacaugagaagugcuuaaguaaaucaaugguaucgaauaucuaugacugaaugccuaaacuccugauucucuuucuaguaguacaaugugguaaaagaaaauaauuuacauuuaaugaaaaguaaauauaaauaaguguaauuucaaguuauugcucuacugcaguuuuucuuauaaaaggacuucuucacuuauuccuugcacuauaaagugguaugcuuaguccuucacauucuagaacacaaugguccuuuuuauggccccuaaucaaauucuauggcaaaggaugcaaaguccuuacucucaacucuggaacccucuuccuugugccaaagaccaagaaggccagagacuaucuuaucucacuacgaucuauuuugagcaaugaaugaaaaaacagaagaauugaaagcacucuauaaagugccuuuuagaugacagggcuccuggugucagucuuacaagcauuugugaagugcuaagaaagucaagcgauuuuuuuuuuuuacauuaaguuagcuaugaguggcaagaguuacaugguugcuccagaugguuagugucuaaaauggccaagagcagagaagugcuuuacuuuacgugcugaaacuuuauuuuaguaaauucuacucuaguuuuaccaucuggagcaacacgauguauacucuuucauucacacagcagcauuuuuucauuuuuuaaaaauguguaauacuaaauacaugcuuguuuuuacacuucuggaaaaaagagcagggggagcuucaaagauuuucagaaguaacacgaguuagcuaauauccugcuccuaagccugggcaacauggugagacccugucccuacaaaaaauaaaauaauaauaauaauaauauccuguuccuagaucuuuucucacuugauauacuuugaguauccuuccauaucauuacaaaaaaaaaucgaucucauuucuuuuacagcuacaucaguuucauguaugguuguacuauaauuuucuuaaccuauuucucauugaugaauauuuggguaagcuucaauggcuuauuauacuaagcaaugugucucaguacauuuuuguuggauaaaauucuuugaaguguaacuaaugggucaaaauguauguacacauuuagucauuaguagacauaaccaaacuaauccuccaaaacaaaauacagcuuuuaagugcuccucuuugccaauccaagaagaaacaaacaaaaaagggucuaguugauuuuuaacuuugcauucccuuaauaaaaggaccauuuguuuugcuuucaucugugaauuacauauucauguuuucugccaucuuuuucuauugugcuguugaucuauuucuauuacacuugucuuauaaauuugucuuaaaaauaaugaugaggauaauuuacuacaucuuauaaauaacacucuaaaacccauuaguuaucaaauacuaaagacaaaucacuuuaucuaccaguuaguugugcuuuuaaaauaaaaaagcagaggccaggugcaguggcucacgccuguaaucccagcacuuugggaggccaaggugggaggacugcaugagccucggaguucaagaccagcccugacaacauggcgagaccccauuucuacugaaaauuuuuaaaaaauuagcugggcaugguggugugcaccuguaaucccagcuacucgggaggcugaggugggaggaucacuugagcccaggaguucaaggcugcaagugagccaugguggugccacugcauuccagccuuggugacagagugagacccugucucaaaacaaauauacaaacaaaaaaaagcagaauaauuaacuuagcaaauauaauuuguuuaagagugaggggucucacuauguugcccaggcuggucucaaacuucugagcucaagggauccuuccacuucagccuuccaaguagccgggauuauggaagugugccacugugcccagcuagcaaauauaauuuuagacugcaaagaaauauuuuaagcauguuuuaggacaugcuguauuguauuugccuuggaauacccuaaauuaggguuuuucaaagguaaaagauuucuuggaaucacagaauuucaaauacucaaaugcuacuaaauaucuucacuaaguaaaaccuuuaaggcuaacaggaugccagagaacaacaacaacaaaaagucuauauaugcaacaaaagucuauauauguaaauucuggucauuugaacuauuccuccuuuaagaaauuaacaaaucccuaaaguggcuggggagauuggcagaaaauucaaagguguucugucugcaggguauacucaauucaguuuccacauaaaaacucaauuaccuuaauagaaguuaacagauuuggcuguuguugaggaaauuaaauuauagagugacauccuacaagccuugcuguaggguggauucuaaagucaaccauagauuaucuccccaguaacuggucauuauguagagguaauuuuggugaaucauagagaugacuuuuuuuuuuuuuuuuuuuugagacggagucuuacucugucgccaggcuagagugcaguggcguuaucucgcuucacugcaaccuccgacucccugguucaagcgauucuccugccucagccucccaaguagcugggauuacaggcacgcaccaccacgcccagcuaauuuuuguauuuuuaguagagacaggguuucaccauguuguccagguuggucucgaucuccugaccuugugauccacccaccucggccucccaaagugcugggauuacaggcgugagccaccgcgccuggccuaggaaugauuuuuauagcuauuuguauguucuuaagcacauuuauccuuucuugauuuuuugcauuuuugauuaauuuuuagccacuuauuuauacuguggucuacauauaauauugaaaagauauagcagucuauaaauguaaauggaaucuuuacuccauaguguuaaauuaaaccaaggcuucuuaaccugggcacaacugacauuugaggccagauaauuccgcguucuaagggggcuguccugugcacugcagaauucucagcagcauccuuggucuucaccuacuggaugccgguagcacugcacccccaauugugacaaccaaaaauguguccaaacauuacccaauguccccuagaggggcacaacugcaccacucccacuccaugggaaccacugaguuaaucuaauuggcucuaguugguggguaagauuauauucuaguguguuugccuguauuugcuaauuuuuccagaaugggaauuuuuauuuuuaaaaaaaggcccucagaggaaacaaaagaaaaugucaguaggugaaaaaaggacucaaacgugacauuuuucagaaaguauuuuuuaauuaaaaaaaaaaucaccaccgacaccacagacuauucccuuugcaggucccugugcagguuccaacccuagggcucaugaaaucaaauuacuaggucaggaucagcauuuaagaaaagaauagaauagaaauagcaagcggaaaauccucaaaauuuugaaaaguaugaaaagaaaaaaggcucaaaaacacauaaagcaaaaugacuacaaccugagaaccagagaguaaggacacuggccaaauuauuauuuuauuuauuuauuuauuuuugagacagagucucacucugucgcccaggcuggagugcaguggccugauuucggaucacugcagccuccgcuuccuggguucaagccauucuugugccucagccccccagguaucugggacuacaggugugcaccaccacgcccagcuaauuuuuguauuuuuuguagagaugggguuuuaccauguuggccagguuggucuugaacuccuggccucaagugauccgcuugccucagccuuccaaagugcugggauuacaggcgugagccaccaugccuggccaaauuguuucuuauuaaauguaaaaugaaaggcaacauuuguccugcuuucugcccuuccuuucaagcacuuccauuucaagcauuaauguaaucaaacuucauuuguccagaauuuguuauaauaaacccugauuaaguuuaccuauaaaaaaacuaaaguacgcuggcaauaaaagacuauagucuuguuaacuuuaaaagaggcuugaagguuuuaacaugaacaguaguaauuacaaaggaguuacacgaguuugucuuauuuaagcaaaucuaagaggauuuauaucaaaaugcuuuuugcuguuaaaugacauucuuguacauauuuggaagcaucucuuuuuuuaaaacaauuuaagauauucucaaguuggacuagcaugcccaaauauucuuucuuuuuucuguuuucccucccucccucccuccuuccuuccuuccuuucggcaaaguuucguucuguggccacccaggcugguauauaguagcaugaucauggcucacuauagccuggaccuccagggcucaaucaauccucucaccucagccucccaauuagcuuggacuacagacacacaccaccaugcccagcuagucuuuuuuuuuuucacuuuuuguaaggaugggguuucaccacauugcccaggcuggucucgaacuucugggcucaagcaauccaacugccccggccucccaaagugcugggauuacaagcuugggccaccgugcucagcccaaauauucuuaauuauaucaagagcugaccuuuaaaaaguccaaaacuucauauuaaaagauauguuauucaauacuucaaaaaguacuuauuaaaauaauuuuaaguuacaaaagcuucauuuuuuaaaagaaaucacuuuucuccuaagauucuuaccuuuccauuuguaugcagucccacagauuauuacuuucacaaaaauauagcauaguacuaagauauaucaugcagcccccagcacuaaaacaaaucaauuuuagcagcgcuaauccuccguagaguaccacuuucuagaugaggcagauaaacaacugcaaauccaguaaaucuauucauaaaguggaucaucucaaaguaaaagcaaauucaugaguauuaugcuugcuuuugguaccucacuuauuuugcauuucacagauuacuuuagugagaaaaaauaccaacagcaaacaaagcucaaaagaaaaacaacaccacaaauuucaaaaugaugcuguuaguauaaaaaagaaagguugacacaucucaaagcacuaaucaacaccaucaugcaucaaccgcuaaggguuaaagcccaaaugcccaguauuuaacuauuugaucuucacggaucaagcaaggacuuagaaaucaucucacgugcaacaguauuugcauagcacuccauuuuauccaugccacaaaaaugguaaauuuaguaguuaccaauaaauaaguuggggaucaaagggacuaaagccuuagacugcucuuuaucauaagauauccucagacaaaccuccccauucuucauucuggcucuauaaaauuaaggagcagagaaaaacugguaagugcuugacuuuacagaaaaaaagccauacuauuauuuccuuugucauuauauauguguguguuuaaauaaauccaacuacaucaccaccccccaccauaucccuccaaaaaucuagcuuaaaauaggugguggggaaaaguauuccaaguauugcaaagaauaucaauuuagcaauuucagcauguuguacuuuaauaauuuaagaaucaucuuuaguaccaguggcauguuaagacagccaaacauuaaaaaauggauaacgggccaauuucugggcuuuacccccaaaucuaauuauguauucauacaaccaaacaccaaaaggaauaaacaugaaguuuggucuagaaaugucaaaacuaauccuuuauuuaccaaguaaugaaguaaaauaaaaaagauaucuuuauuaucuaaucacaauaucugcuaauauuuuagcaacuauuauuugaauguacauuuaauguuacauuuuuauuacuaacuguaauaugcuaacagaaaaucuguauccacugacccucuucccuauuuggcuauaaaaugaaggacuaccuuaaacuauguguuuauacaaauuggguaagagaaauuuuuuuuuaauuuuucugaagaaaauaagcauucuuaaggauagaaauguauauuucacaaauuaaaaaaaaaucaaaaucauugagauguguauacaccuuuaagccaacagauaaguacaugauaaguucaaagucaucuuuggugcuuagaaauaaucaauucaaguaaaagaccugacacuaaacagaaaaauaaugacacaugaaaaaguagauuaaaauugaccaauuaggacuucuacuacaaauguaagucugaauuuagaucuucacagcuauauuuacaauuuuggaagcaaaaucauuucaugaaauugauuaagugaaugcuauaccccaaacuauaagaccaaaaaaguuauuauaaauccaggcauuuugaucaauccaacaagaaauagguugaaaaauauuauuuauaucuacauauccaauaaaaaauuccaacugcugauaaucuggacaauaaaaauuugcagucuaagaagucaaagauggcacugucuuaggaaaucuacucuuuuccacacagaaaaaccucugggagaauuaugaauuucucacuauaugacugagaaacaaagaaguucauaucuaaaacagaacguuuaaaauauauauaccaagacaauacauaacugggguuaggggaagugcacagugguuaagauuuuacacagcugugaagccuaguagaucuggguuuagaauccugguuuugccaguugcuaaccagguggccucagaccagucauggaaccucacugagauuccacuuucucauuaggcuaccucuaaccuuucacagggugucuugaggauuagcacaggaugcuuaaagcaaacugcugagcccagggccucacauacaagcacucaagcguuaguuaccaucauaauuauuuuuguugucaugguauccaaaacaaaaaguuuuccagcaguuuguggagugcuuuuucucuuauuccacuugcuauuuuaugaacauaauauucaaauacucucccacagauguaaacuuguaucaugcaucaaaaauauaaaugaaucuauuuuuaggaaacaugcaucuugccauuccugcauuucuucucagaguauguugaugaagagaacagaauaaccugaagccuuacugcuccacacagacuugagcuuggcuucauaauggccuuaaccuacgauguauucucacucuaaauucagaauggaccaccaccuacugcuuccccaagaccuacauggcuaagaaaaaugguucacucagacugcuaaauagacaaugucucaaugugguacucaguuucguuuguguacaaagcaauguaaaaguagucauagaagagaaacaggaccacagcuuucuucuaaagacaaggaacuguaauuaacaguacucauuucuuuauuuuaaacaaagguuacaaggggguaaggaaaauuuuacaugggaccaaccauacucauccuaugcuuuucucuuugcacuuacuuuccccaauuaaagacauaaaaauaggcuggaugcgguggcuuacgccuguaaucccagcacuuugggaggccgagguggguggaucaccugucaggaguuugagaccauccuggccaacauggugaaagccugucuuuacuaaaaauacaaaaauuagcugggcaugguggugugcaccuguagucccagcuacuugggaggcugaggcaggaggauugcuugaacacaggaagcggagguugcagagagccgaaauugcaccacugcacuccagccugggugauaagcgaaacuccaucucaaaaaaaaaaaaaaaaagacauaaaaauaguacuucaaacagaaggacaauauuaacuauuaaaauacucccauaggggaauauauauacauauguacauauacacacacaaauaaauguggaucugcaauaauguucuuauccccuaguacauuaaauacugaauauaugcucuaagguaaacuuaacauugcugucauauucuaaggcccauagcaauuucccaguagcauuuaaaaauccaggcacagcugggugcaguggcuuacaccuuuaaucccagcacuuugggaggccaagggggacggaucauuugaggucaggaguucgagaccagccugaccaacauggugaaacccugucucuacuaaaaguacaaaacuagccaggcaugguagugcaagccuguaaucccagcuacucgggaggcugaggcaggagaaucgcuugagcccgggaggcagagguugcagugagccaagaucgugucauugcacuccagccugggcaacaagagcgaaacuccaucucaaacaaacaaacaaaaaauuacucuccaggaaaaauauuaaaauuaaaaguugaacuucaauaacuuuaaauacauuuuaaagccaauguaauuaaucagaaaaugauagaaaaacuuggaagaaaugccagguucugacagagcagaauacagaucugugacaaaauaugaaagugaucaagggaagaccuauaugaaaaauucccaauuucuaauccugguuuugaccuaauuuuuaaaaaagucugauuagugaacagcaaaauaaggagauacuaacuuuaaaaaccaauuuuacaacaguagaguauaugcuuauagucagcgcaccugauauuaaaaacaaaccuccagaauaacauuuccaaucaauugguaaaccacuguggcaaacuguacacacaaggcaaaaggucuguguucauuucacuacugaagaguagauggcaccagggcugccaaucuaauacuucacuuuugcaggcaccuuaaccacucuucugauaacuacaagaucauuaaguguacaaugcauugucucacauuuaguagaugucuauccagaugaugucaucucaacuucaagcaauccccacaacugucccagucagugacugaugcagugagauucucaaacagcuuucccuuccucacagaguccaagaguuaagaaguuaaaauggagaaaguaaguuacucuucuccccuuauuucacucccuuaaaacugaaugccuccaaggcuaaaaaaugggacugaaagucaccuuuggugacuaaaaaaagacaagaacaaacugauaaacauguauguaacaaagaagggacuaaaauaaacuggaaauacaaaaucauauuuucaaugcuucuggaaaaugaaccagugagccaaaaauauucaagacuuuuacauacaugcaaacacacacuuaacaacuacuuuagugaaaacacauuucauuuuucaauauuuacuaaucacuucucaugcuguaagcuuuccauaugauaaaaaucacaauuagcucuaaagcauaauucaauuugguaucugaauuaagguaucauuaaguuuuuggaaaaagguagccuuaucuaugaaauguuaagcuucagaaauagaagguacaucagcaucaacugcacaauuaacccaagaugacuaugguaauuagaaagaaaagggaguuacacaucuggggauauggagguaagacaagaaugcaguuugacagaacaugguuuguuauuuaagaagagcaaagagaaaugcaaauacuguuuaguuuugcuaacaaaaaaaaccuggaaguuucuacaaaaaguauaauuagaaaacacuaucauuugcuuggcuacuuuugcauuuaauggacaugagguaaaaauaugagccaauuuggaauuaaaaugucauaaucucauagucaacuccugauuaucuacacuaaugaaaaaggggguuaucuuaaacaauuugaagcaauagauggagaguucucaacuuacugcuacuuucagccaaucuuuucccuucuucaaauagucuguccucuaaagguuuagacuccaguguuuuaggguccaaaaagggccauugggaagaggccugaccgauagaccaucuccaaacugaaccauccauccauagauaacugaguugacgugacugacacauauuccagucaauaaacugcacauggauggacacuacaugacaagcaugcuucagaguacuuucugaaacuguaagaaugaugaaugagacuuccccagcaagagcaaaacaugcuagugccuagugaagagaauaaguagcuuaccuccugcaguagaucagccugcucaauugcuuuaaggacauuuuucuuggauguuuccugaacuuccccucccaaaagaaacucauccaaaauaaaauaagccuucucaaaauuaaagaugauaucuaguucacagaccugaaaaggaaaaaaaaaagaaaaaagaaaagaaaaaauuguuaaaacuugcagaagcagaagaugcuuauucacuaucagguagugaauaaaaucgaacuagagugaaucaaucuuaacucuuucuaaaaaugacuaaguaucacugguuuaaguaagcuuaauuuccaaaucucaaguacuugaaaacauauuccuacaagcuaaauaagacugggcucugcauguucccaauauggacaacuuaauaauuucuacuaauaaauagucauucccacccucucccgcgguuagaauccccaagacaaccaaaaaauaaacuuguuagagaaaagguuccaaaauauacuauggcauucaauuuccuaaaauaaaauacuacucacacugccgaaauacuugucaaguaauuccacauaacgaugaauuauuuccaggguaauuaguucauuguccugauccucaauagcacagcaaaaauacagacuagcauaucuguaacaaaguacaaaugugaaaaaaacuguuauccuauaaugauguuuucuaaauauauuuucauauccuauuaugaaaagccccaaguuuauacaguuuauuucuucuuucacgacaguacagauuuuucucauagacuacaaaaguaauaaacgcauaacagaaauuuugaaaagcauaggcaaguauaaagaaaaaaucaaaauaaucauaccacuuagaauaagugauuuugcccuucuuccuuucagguucuuuucuauaagcauuuuaaaacauagcagacccagguuuuuccuaaguuuacuuaauuaaaacaaaauauauagcagauuaauucaaacuguaaguacagagaagaaaacaaaccuuccaacugaaggaggacuuguugaggauaaugccaaggugaggucaauauuuugggauauuuuauuggaauauguauaauauauacacagagaagaccuuaaguccuacaagcucaauaaauuuucaaagugaacucaacuauauaucagcacccacaucaagaagcugaacacuacugaacccugaaacuccucugcuacccucucccagucacaaccucccacccccaaggguaacuaugcucuugacuucuaacagaauagaauuguuuuuaaaaagguuucuaggauugcagaauaaaccauacgaaaagaacaacagcuccacguuauuacagaaguuagagaaagagaacagaaaguuccuaucacuuaagggaaacagaggccuguucucaaauuuaccaaguucuacacuguugaacugaaguguaguuuauuuacccuagaagagggaauaagguugggaaacuuauauucuccuucaaauuaggauucuagcauauggaaucauguuaugcuugacccaaggaagcaaaacuucaacccugaggcauagcaaguccuuugaggaggauuaaaagggcauuuuaaaaugguuuacauguacuuaaggcuuuugaaaagaaagaaaauaaaaaccuaagauaggcuaaacacagaacauuucaguggagauuauaauuuucacugaagaucacuuaaaugauuuuuagaaaacacaaugggcaguuacugcucguagcauuaauguaaaauaauacuguauacagaauaacacaaccuguuuugagacucaaugaauucuugcuccuuaguaugaaaauaacuaguauucacacaacagcauuaauuucauuauuaaaaccauuucaucuuauuugauguuuucaacagcaaguacuaucuuucauccuugaucacagauuaaaaaaagacaaaaaaaaaaugaggcuuaagaguacagcgccuacaagugcuaguacugggauaagaaaccugaucuuuugaccuuaacuccaggccuuuuuccacuguaucauacaaacucacuuggcauauauaucaugaguuugugcaugucuacucuaccugacuuccacacucaguaaguuauuuaaaaugguggagcuacugcagucuuauugagaggagguauucacauguguucauuuaucaucauugugaagggaauaagucauggaagacaaaacagggcaucaaugccaacuuuaacaaagugcucccucucuuucccaucguuacuguuuuuguuugucuauuuaaaagagaauagaguauuccaacucuccauccucccuaacccaugcucauuaaauagaacuuugaauuugaggaaacugauaaaugacacauaagauucccugauuuaagaaaacuaaacauuaaagggacugacauaaaaaugguagauuaaaaaccagauaugacuagcugauaggaacagaaugcuaaauaauuuauuauacaaaguuuacuaacaguuucaaguaaaauuccuuuuauuuaagauuuccucaugcuacuauuaaacaagcuaaugcucguaccauccucgcuccuuauccacaguacugccucuuuacuuacaaauaaaaagcacuuaaacacuagucaaagguccuaaacugcaugaaucacuuggaagcauuaauuuaaaaaucaucagaaacaaugugucuaagccccagccaguaauguuuacuuucacucggaauggaaaaagaauaaucaaauuaaugaauucuuugguguaggugaacagauagcuaucaggauaauaauguaccucuuuccagaaagcuuagggcaggaaaaaaacagaaacauaauaauuaaguaccauucacugaauccucgcccuacaugagacauuaaauguuagcuaaggcuuuugcauauuuuaccacucuaauccucacaacaaccguauccaugagauaccauuauuauuugcauugauaagagacccagguuugaguaaccugccuaggaacagcaauuugacucuagagcccaaguuuuacauuaaaaacuauagccagcaauugcauuaacguaaucccauaccuggcaaaaauuaaaaugugcucgaaacaauauuuuaagagcuuugaagagaaguaaaauaugccauacugauuuaguaaaagauuaccaagagaaccugaaguguacuuccuauauuuaggaccaaaugguuuuaaaaaaaucaauaaugagcucauuuuguucucuuagugccuauuuguaagucuaaaucugaaguaaaauuaauaauagacuaguaagaagaaagguauguuugguuauuuuuagcacaguggauuaaggcuuacucuaauuacuggcacucagagaacaucugaaagugccuauucuuauauucaaaacacaugacuucuccgcagucagcuaaauaucagcuaaauaucagcugacugugggugaauguagcugaaguguucucaauacccacugguaugucauuaaaaauucuuuuguuaguaaagaaaaucaguaaguauucuuuaacaaauuaucaagcuaguaauuuggagauauauauguuuuuaaauuaauuuuaaaagaccuuaauccagugacucuuccacaaaaugcuacacaaaacaggaaucaaaaaagcacaguauucugucuugaagggaucuucaagagcauuuagagauaaggaaacaaagugacuuguuuaaagucauaaaacuagcuaacguuacaaagggaacagaacuuaaguccccagauuuucagucugucuuuucagcuaauauuauucuuauccaucauuccccucucaaaagggggaauuuguaugccaaauacucaggaugaagaauguagaugagauaauuuaacaaaaacaacaaaaaucacuugcugauaugaacagcagaagucccaguccagaauuucucaggcgcuaagcaguaauucuccugcuuaaaaagcucuucgcuuccagcaguagggaaaacaaaccaccuguuuauaccaacaaaaaauauguccguaagugguagaguagaugagguuuucaguaugaaauggaagggggaacguauagagaaagaacugauaaauuccaccuuuuguauaugacugauaucucaauaaagcuguuuuuuuuaaaguccaccuuuuauuuaaaggugcuugauauaaguaucagaguuggauuagauacccuuuguagcuuucaaaagaaaaaguaguggcucaacacggacagacugagugacaugugcaugaacaccaagcagugcuuuccuuucuucccauaacagcccauuccugggauugaaucccuugcugguauuuuccuccuccacacgggggacuccuuccccuaucuagaaauaagcuuaagccucucacaccuucuuuuuuaaaaaccuugucccccacuccuaugucuaugagugguuaccaccucgucuccuguccuucacagcaaaguuccccaaaauagucuacacaugcuauuuaaauuucuccaccucuucacacuucgccccauuacaucgagaguucuaucuccacuauuccacugaaaauguucuggcaaagggcauuauaugaaaugcucacuguaaaaucuaccagauuccuuccucacuuucauugaacuuuaugcaacaucuggcauuggugaaauuucucauuccacucugaaggucccuucuucaucuccuuugccugccacuugaaugcuggugaucuaauacuuugucuuauuuuccccagacuuccauacuuacaccaaccacaucccaccagaaaaucaggcuucucuuaaugaaagucacauagacauccccaaaucaacucaccccaaaauaagccgaguuaucuagcucaccuuguaccccaucagcaaaccagaaauguggagaucaccccacuccucccuuuccuucgcugcucucuccgcuuuguuguugucguugagggucucacucugucaccuaggcuggagugcaguggcccaaucagggcucagugcaggcuugaacucccaggcacaaucaauccucccaccucagccuccagagcagcuaggaauacaggugcaugccaccacgcccagcuaauuuuuuuuuuuuuuuuuaauuguagagacggcggggucucacuaaguugccagggcuggacuugaacuccugggcucaagcgauucuccugccucgaccucccauauucuucccacuucuagaggugaccaagucuuaucaaaccuaccuauuugauaauggcuauuuagugacagcccuccuuucuagcgccuggguucaggaucucacauagucuccuacugauccugcaggugccagucucagccccuccugcccucauccauugucucaguucaaucuuuuaagauauguaaaccugaucuuuuuccagcccuguuuaaaaucuuugccucuaagcuuaagaucugaguugcagccccaugucaaucacuaacuggcauauggcccuagacaagucacuucucccaaauuugcauucuuuauaaaauugaaguuugaucaacaacggcaguuuucaaacucaagaacugucuccugugcagagggguaaaggccaagugagccaggauacaggauccucauuccugauuucacaaggagcagccucacuuccacucauuuuauuuaagguucuacccauggggcaaaaagcuuaaaacaaaacaaaacaaaacaaaaucaccugacuagaucacuguaaaacaucucucaccucucaaaugauaugacuuuucuauaaucuuuaauaagaccaaacgaaacacuggauacaaaaucacccaaagauacaaaaucaccaaagaucauucaauaauaaagaggaguccucaguauuuaagaaacuuaugucuuguaaucuccauuucuucccagccaucucccugacaaaauauccaacccauauuuggagugcaauaaagggaagcugagaagaaaaccagacuucucucccacccucauuguaucccauacuguuacuuccauguauacuccccacacaagagaacuuuuuauaugcagaaaugcucuuaucuuaaauucagcaaauuauucaaaaagaaacaaauggggaaugaaguaaauguccccucaaaaaauguucuguaaaagaagaaaguuuauuucuuuuaaccuacuuagaacaaucuugagaaauuuauuuuaggguauucaggguuucagauauuuauaaaauaaagacguauagcauuaaaaaaauuuuaguguuaaaagccaaucuaugagucauuuuguaacaucaaauuuuuaaaaaaucuguccuuggaaaaauuaucugucauauuuaauugcacccccaccauagcaacaaggguacuuaaaaguuaauaaacacuacuuacaaacacaucucauguauacacaaaguuuuuaaaacaucuaugugauugaaauagucuacauagucaagguauuuacacgugaguaagauucuaaaaaucagauaaaaggcaugucaaauauuagucauuacuuuauagauuuucggggaaaaagaauuagacucuaucuguacuugucucaauucagagaauuacucacacaauuuaaaauacugacccuacuuuccccugcaaugaaaugaauucauuaaacucuucuauaaagaugauuaagcaugaauaaucauuuaugccuuuaauuauauaacuaguuuucaaaggauuucccugccuuuaucauuucagccucaguaauuaucaaucaaaacacuaguuauuuuaaaaacacaaagcuuuaccuuaaaccuauuucaucuaaaucuuuauuaaucguuauuuauaaaugucaucacugaagucugcaauuuccuaaaugaccuaacauuugauucuauuucaccuuucugacaaacaaaaauuauaccuuuuguaaacaaucuucagaucucgccacucaaggaagcugcacauuuuagguuuccgugcuaaaacggucugaacaaguucucuugugaucuuuuucuucucuuugucugauagugggacauaccauuuuugcagucgaagcuuucccugacgacuaaaaagcaacauaaacugcaucuguuaagauaaauaaaaucaagauuacauguaauacuuugaaucaauaaaguuaagauuauguguuucacagagaaguuuugggggauggggcauuuacaugacaaaugauuaguagccaucaauauuucuaugccaauuaaaauagcaagaaauucuuuuggacagaucuuccucuagaugcaaaccuuccaaucccaccuuguuccacauuaaguuugaaggggagugugcaggagaaaaaagaaaaauggguaauaagcugaagugaaauuuuugaagaaaaauaaagaucacucuuucaauuuaagaaacuauuuucuaccugugcuauacauugcgcacucucuauaugcaucaaaagagaaugguagacaucaucugguuuggguacuuuugaaagaaacagaagaccugcuauuuuucauccugaggccguucuaguuccagggugaauuacuugcagacaguagcuuaugucuuggaauguucuccucaguuuaugauggcauauuuuaagcaaaacagaaugauccaaaauauuaacugaaaaaucccauaaauacaaauuuucauuaauaaaaaaguauguuuucaucugacuuuuaaagcauuccaacuuaaauauguacaaaaucuagaacugaguuaauguauuaugaaaaagaaaacaaacguuuaaaaggccacaauaagauuuacacuuauuaaauaagauucagcauugaaacauuacaugaaauacuucauuuaaaauaaaaaauaguaucuacagauggaauggaugcugaauucuaguguguuuuauacuuaaacuaauuuguauguauuuauuugugaucugcaaauguguugauuagucugcauguuucauuuuuaacgccaagcuuuuuguaauccaauuggucaucucaacugcaaacagaaguauuguuucuacaaagguaauuuaaaggcagaauucacauagguauccuuuuuucuuuuaaucacuguuaaguuccuuuaacagcguuacugcaaauaagauucaagcaugauucucaagauucaccacaccaucuugaauuugaacacggggaggggaaauuuacagaaccaauguagaauaaaaaugggcccuaaauuucgguaagaaauuaucgucgcuuuuuguaaccacccaaaaagguaucaacaagauaucuagaaauguaugacguggcaauucaacuuuaguaaaguuaaaauggucuuauuaccucacuuaaaaugcgucaggggaacaaaauauaaggacauuauuaggugauaccaaagugccucccgugcaaguccugaagauagcggcauucgaagggggcaggaagugaagcaucaacugggcauuuacugcaaacccguuaccagaacuuggaaaagaauggaccucguauuccuagaucuuggugaccagaaagggugaggguuugccugcgaagaguaugggcucaaggcugucuggagcaggguccuguauccgcccuaccacuuugcaggacgaaaaaacaauguauucuccuuaaaauaaauuauguccuaacaugggacgaaacccgguugcaaagcacgaguauuccuucccucguguuaaaaaccaacgcuuugauuuugccgcaaaucacagggcaccacaauuccucgagacuggcauuaaaaacaaugggcucagccgcggcgcgggcucggggccagcguuccucggguccggccgucgccggugccucccccccacucccguggccacacuccaucacugaccaagcccgggagaggugacaggcaaggagcggagcagacaauggcauccgccgccgcgcagggggcgccaagaguccucggccgccaccgcccccggccccucccgaaagcgccccgcaaaacuugaggcgauucccgaaccacaggugccgcgaggcugucgcggagcccgggacuggcccccacauccccgggcgcggcgcggaguggugcggagggcgcggacacggagagaagugaguugcgggcgcggcgacccaguggcgggccgggcaggcucgggguggggucgucggggcgcgcgcgggguggcggggggcgcgcccaguccucccucccccucucccccauccccggcgcccccuuucgcccccagggacuuacggcggccgcgggccgcgggcgcggcggagcuuggccggcggcggcggcggcggcgaaggggaagccccugucgccgugcugaggaagagaagccguggugcuguggggaggacacccggcuggcauagggcaggcuuaggcggagaggggagggcaagcugacagaccccgccccgggggccggacgagggaggagccggggcugcggcgagcugaggggcgggcuaggcgacgcgcgggaagcgg

SEQ ID NO: 19223 - RNA, 33788 nt, Homo sapiens
aauccaucacaggauugauuucagcacaggauucuugaauaguacaaaauuaaaaaucuaacaaugaggauaugguugaaaaaacugauccauauugugcagugaguaaaacgaagaauagggcuugaugaaguaugacugcuucuugugaauaaaagcauauucaacugcauucauauguguucuuuguauuaaaaaauguguacauagggcugggugugguggaucacaccuauaaucccagcgcuuugggaagacaaggugggaggaucacuugagcccaggaguucaaaaccagcuugggcaacauggcaaaacgcugucuccacaaaacaauguuuaaaaauuagccagguguggugguguguaccuuguagucucagcuacuuggguggcugagaugggaagaucaccugagcccaagaguuugaggcugcagugagcuaugaucacgccacugcucgugagaaccuaucucuaaaaaaaaagaaaaaaguguacacacuaaaacaaugcuccaauguuuaguucucucucaggguuaggauuacaaguaauuuucauguuguuauuuauguauuuuauguuuucuauacuaaccauacuucaugauuauaagagaauaaaaauauuuuuaaauagaauuccaggcuacacaggguucagccagacuugcgaacccaucugcguucauagccuucuauccgaguauguagcaaccauaauaaauaagauauacaaucauuuaagaacaaaacuaguuuauuuggauuugggacucugaacaguucugucucuauuacccgaccuccuccugccacgacuucgggaccuagaggaacuuuggcuccggcugcggcggcuccugcggcuccggcuccggcuccggcuccggcugccccggccccggcugcggucccugcugcggucccuauuucuuccucugcuucgugaauugugccucucccgacucuuugaugugcguuugugagauuucuucccccugugacgacuacuuuuccucucggauuccccauuucuuuuguaggaguggucuggacuaggguuucuccuuccccgcagccugcuguaguagucgucgugguggcccauccucucccuccuuucggaguucuucccaaaggaggagccaguccgaucuggagacaaguagaugucucuauuagcuucccagaauucauuguugggauuucugaacacaugaagaaaguugcagugcuuuccucuuggacauuguuguauuucaaauaaaccugcaauggcacagugaugaaacagcacuuaucacugcauauucugaagaugcuacuuuauccuuuuccgaagguacauuucugauauuuggauaugcuagaacuauuuucuacuguguauuauguaaaaggggcuuacauaaauugaugucauaauuugguucccacgauuucaaacgugcucuaauaaaugacacucugaaagguaacaaaucagaaguuuucauuaagcagaauagccugugccccuguuggauuauggugcagacugcaacugagcaaauggugaccacguuaucuucuccagguuucaccuucccacugauugacgauuuugaucccugauuaacaucaaauagccagcucuuugggucccugugguagcacgguuugauggcauggaggaaacaggccagaaccacuggucaaaagagaaggcguggccaggugcgguggcucacaccuguaauccuaacacuuugggaggcugaggcgggcacagaccugaggucaggaguuugagaccagccuggccaacauggcgaaaccccaucucuacuaaaaauacaaaaauuagcugggcgugguggcaggcgcuuguaaucccagcuacucaggaggcggaggcaugagaaucacuuaaacccaggagguggagguugcagugagccaaaauuaugccacugcacuccagccugggcgacagagugagacucacucucaaaaaaaaaagagaaggccuauuaaacauagaggagucuauauuuucuuuaaacuuuaagauuauaaacauuacacuaaugcuucaaauucacuaagugcuuuuaauacagaagauucuuaucacagauaaaaucuauucgaacaauuuugagaucuuugggguucucaaacguuuuuuaaaagcaguaaauuccccagauaugcacaacaguuagaagugaaauaccuccguaccacauacuauauacaaaaauuaaacuguauccaagaccuaaauguuaagaaaugaaacuaugaccuugaagaaaacauacaaguaaaucuuugugacccugggcuaagcaaugucauccuagaugugacaccaaaacaaacaaaaaaauaguuaaguuggauuucaucaaaauuuacaacuuguauuucaaaagaacaugaagugaaaagaaccuacaaaaugggagaaaauaucugcaaaucauauuugugaccagguacuuguauggagaauauaccaagaacucuuacaacucaauaauaaaaagacaaagagccuaguuagaaaauaggcaaaggauccaaacagacaucucuccaaagaagacauacaaauggccaauaaugaaaagaugcucagugucuuuagucaauaaggaaaauaaaguguuuuuuuuuuuuuaaugaaauaguccccugcuuuggaggagucaaggucacacucagaagcuccucacugaacucacacuggauucccaggaacugacaaaaguaacugccuuuauggagcgaacaauuccaccucuuccaucccccgagccuuuaaaguguaaugguucuucugguuucccuuagccaggaauccuaaaaucuuucuuuucccuucauaaaugguuucagaaugacagaauccaaggaagacaagcuugccaaagauucugacuuugcguuaggcaggcauguauacagcaaagaaacacaaguaaacgguaagauaagugcuccccagaggcauuuagagcucaucucuuuucaccuagggaacaguccacugagagaaaucagaacauaacuaggccuucaaaacugcuggcuauucugcacaagacuggaucauuuccugauuggguugccacuguccgaugucagucugacugcauucauguuuaacugaucccaagccuacaauuagucucuagugcacagaaggauguauuauuccaaguaaggcaggaaaugcuaugggcaagguaacguagguggucaugacagaagauucauuagggauaaagauggaaagaaagaaacaaacaaacagcucaagugaagugagccaaugaauauaaaauaccucugaaacugcaacaagggaaauggggcuuccacagacguaaacuccucaggcuuccugauuugucagacacagagcccaggacugaagauuggaagacuggaauucuagccccaccucugucaccaauacguugugaccucagucacuucaucuaucaagugacucauugaggucgguuacagaucuaaacugugguguucuuuauauaaaguucucugcucaucuacugugugaggcaaaaagcuaugccucaccacuugaaaauacuggguuucccccaaagaauaucccuuuauauagcaguggaacaauugaggaaaaaaaucaucacuuugucuuuuaccacaaaucgccauuuuccaccgggucacggggcagaauucacacugcagcugucguccugcauaccaucguccguuaaacagagaaagggcugcuuggcauucuucuucccuuuaaaccaaaaaucaaaugauaugcuuuacaguaacuuccuaauauguagauuagcucuacuauuaauuaaccccguuauuaauuuauuguaggaccaccaaguucacugauuuuguaccuagggaagagucauuaaaauggucaagcucccaaagcucccaauuuauucaggaacccuuuuuacuaacccucggagagguuucaaugcauggaaauuggcuugaaugaaaccgucuuaauccaaaagauuggaccauuaaaaaugcagaaguguuuuccauuauuagggccuauucuuucucagauaggauugcuguucuucuuauuacacugguuaauuuaacccauuagccaugguauggccuaggcaaacagcaagauaagaagaaaugauacauuaauugcucucuuagcuggucaaaugcacacuaagaugauuuugggcuucaaucuccggcucuuucacuauaaaugcuuuuauguucucuauucuaguuaucccuuauuaguuuguauuuuaauuauuaaaauuaugaguaauaauauaaccauauuguaaaacauucaaaacuauguaaauauauaaagaaugaaauauaaauuuauuauuuuuuucuuuuugagauggagucuuacucucacucugucccccaggcuagagugucgugguacagucauaccucacugcagccucgaccuccugggcucaagugauccuccugccucagccucacaaauagcugggacuaccagcacaugccaccacauucggccaauuuuuaaauuuuuuuguagagaugaggucucucuugaagcgauucuccugucucagccucccaaguagcugggauuacaggugccugccaccacgccuggcuaauuuuuuguauuuuuaguagagaugggguuuugccauguugaccaggcuggucuugaacuccuggccucaagcaauccucccacuucagccuccaaaaguguugggaugacaggugugagccaccaugcccggcuuauauuauuuucacauccauucuauauuucuguuucaacucuuaauauuuaaguuuuaaauauuuagauuuauuuaaacuuuaauuuuauuuaaauauuuuaaaauauaugaaagcugggccaaacacaguggcucacgccuguaaucccaguacuuugggaggccgagguggguggaucaccugaggucaggaguucgagaccagccuggucaucauaguaaaaccccaucucuacuaaaaauacaaaaaauuagcugggcaugguggcaggcaccuguaaucccagcuacucaggaggcugaggcaggacaaucacuugaaccugggagguggagguggcagugagcugagaacacgccauugcacucuagccugggcaacaagagcgaaacuccgucucaaaagaaaaaaacaaaauaaaaauaaaaacauaagaaauaaaauacaugaaaguuauauauccaguggaaaaaucccagacaucaacagaaacagaacaacaaacugugacaaaucaggaagacauccacaagcagaauacuuacgacugguacugaacauauacauugccccucaggugagguuccaaauugcagcugaccuagggagcaaugaagaaugcuaucauaaaaaauucaggaaaagaaaccagccauucaucaaauguuguuuguccaggcuaacauuccccaaaguaguuaccaaucaaagauugcaaaauagagauacuagcugacucuugcaucuauuuaaggcguacuuggcacauggcagcgugccugaucccuguugguccaggucuguuuucucccacaaauaugaaauguuucacacauccauaaaaauacagaagauaucaaucagccuauauaugcacuacccagauuuaacacuaacguuuuccacuucugaaugagaauauuuacauauguaaaacauuaaagacucaguugaagcccuucuaucccauucuucucccuccuccaucacauaggugaacacucuccacaggcuaggaguguagccuucacauuccaaacacaaacacacauauacauacauagaccuacacagacacaaauacaaauacacagauacaggcauauauacauacaucauaugcaugccaaaacccacacauauguaucauacauauaaauguccauuauuuauaauggguauacacauauauauacauaugcaaagaaacagguaauacguauugauaaacaacauauaguguugcuuuguauguuuuaaaauuuuauaucaauaguauuuauuccauauucuuuuuucaagauguagucacauaaacuuaacuacuguauacuggauauaccaaauaauaaaacuuaucuacucuagaaugaugguuuuucaagaugcuuccaauuuuucauccacaaacaguaccgcagucagcauucuuaaacaggucucuguggguauaaagagcucucuacugugcauagccaggagugugccaauuuauagguuacacguaccuucacuagguauugacaaacugcucucugaagugguuuuacuaauguacacauccucaucuacucuugguauuaauagaauuuauaauuuuuuugccugauaggugugaauaucaucccauuuucauauguacuguuccuauuacuaguuagguuaaauauuugaucauuugccuucaacaaugacaaaucugauuuguuuuuauauaauaguauguaaaaagguccucaaauauucauacuaguguuuagcguuuauguucaaaaugaaucuauaauuuuacaaauuuguuccagaguauuuuucuuaggguaucccaaaacgagcaggauccauacucagugacaguuuguaacaccacccuuagaaggaagaauaaaaggccucgggaauccaugucagcugugcaagccaggaugagagaacucuaaacaaaagaaaaaauacguuguggugguugugguuugugggugcagccuguugcaaguaagggugcaauuuccauuaacuacucugcaguucugaaagcagcccucccauuaccacuucacagaagcaguauaaucaagaaacccuacgaggaaaaccacugacguaauccaguccccucacuuucaggauaaggaaaaggcaggaagaagugacaaggcuagucaaaccacauggccuccucggccagugcuucuaacaugguauuguguggcugugaccaggcaguuccacuuuagcaguuauugcuugugcugacaaguaaugugaagacaggaaggcauaugccccagaaacaaaagguuaaggaggaaaaaaaaaauaaaaagaauuuuuaaaaaucuugaagucgguugauagaaguauagccuuaaaugucaggaauaucuucauuuuuggggggguguuccaacuuuucaucaucauuugcaacuugcaggaaaaaaaaucacgguucuauuccugucuuuucccaaauuaugggacaauuucccugccuuaacauaacaaaggcauuccagcucagaucugaugaaaucacagacaaggcaggaagcuucacccuauuagaauucaacuaauggguccugggggcagcagagauuacaucuggccuuacccuugcauuaaggaauauuuuaaaauaauuaugugucaucugaaugccuuuuucaccaaguaugcugcaucacagaccaugguuuguauaauacuauauucaguauugaaagaauccaaugaauaaaaacaguguaaaaaaaagaaggggguuaggugguggaaucuagauuuauguuccuguguggcuccagaagaaagaacauacaccuuggguggaagcuaagucggcacugucaacacaaugcaccaacaaacuuagugagugaaguugugucacacugcacacggaagccaccuacagaggaaggaagggaaugcaccguuugucacaugcagcuucuaagugaaggacuggauggcuauaugcaggggaccugauacagagaauucaugugcuggaaaagaacuggagcacaaagcuacuaaauaaaugaaagauccuuuccaaucuagaccccuagcauucaggaaauaccaugcuaauauauguuuaugauuucaugugguauugacgugacauuggcaacaagguaggggguggaaagagagaaagagggaagucacauuuauagagugcuagcgugccugaccccagcugagccugugucccagcucucuugugccauuaaguacugcagggugaagcaaaccaguccccuccuccacacgcaugcccaccuugaacugaaucacuuuccccacguucuugaacucgggcaacacauccucauagaagucuaggaacuguugguagguuucuuccucgcuguacuccaggcuugcgucagggucauagucaucccuccugcacugcuccauuccaaacgucguaaacaugcucuuaauaagaaggguaggacuggauguugggaaauuauguuuacgugaacaucugcguaugaaagaaaagcuuaaauucacuaggccaauaguugaaaauuacucacaaaacaacugcuuuagaccaggcaugguggcucacgccuguaaucccaacacuuugggaggccgaggcgggugaaucaccugagguccagaguucgagaccagccuggcuaacauggugaaaccccaauucuacuaaaaauacaaaaaauuagccgggcguguuggcgugcgccuguagugccuauaaucccagcuacucaggaggcugagguaggagaaucacuugaacccggguggcggagguuacagugagcugagauugugccauugcacuccagcuugggcaacaagagcgaaacuccgucucaaacaaaaaacaaacaaaaaaacacuugcuuuaaauuuugagauagaaacucauguaauuuaguuguuuugacuuaacugaaagauaauaaaccccacucagaugccaaguuucagcgcuuaagaggauuuuuuuaaguguugaaacuuggcacuugcuguuuuaaugucaaguuggaaacauuucaaaguucauauaccauucagcugccuuugaaugaaguucaggaagccuauacauguugaaccauaggggaaaagaaggcccgcugauuggugugacaggauguggugacaggcaugaagaugucacaugcgggacugcugagaggaaggugggaacuaacaaugcaauccugguucuguacaaucgucaguggacucaauguuuagacaauauaguaauccaagaauuuccaguuaaugaagcaauucaaucugaucuguguacagcaucuuguagcuuucauggcauuuuuacauuuuuccccucugguccuuuuaucccuuuaggacagugggggcuaguauuuucaccacuuugcaaagacggaagcugagaccuagaaaagcacacuugcccaagucagucauauggcuuggaagagagggauccaagacaucugcauuaaucuacaaucuggugccuguucacgaugggguguaauaaauacaauuuguuuuugagacagggucuuguucuguuacauaggcuggagugcaaugguaugaucauacuucacugcaaccuugaauuccccgggcucaagugauccuucugccucagcaucuugaguagcuggcgcaugccauaggcguaugccaccacacccggauaauuuuauuuuuguagggacggggucucgcuauguugcccaggcuggucucgcacuccuggcuucaagugauccuccugccucagccucccaaagcucugggauuacaggugugagcuaccauaccugcaucauuuaauucuuauuuaaugaagguggccaaccauuaugaagaacaauuuuauuuucauaguuuaaacuggaccaaggcuaagcugaccaggcuguaccugaguaauauuucaaaaauccuucauaugaguuuacuuucuuacuuccuuccuucuccuaacauacaauguggaggaaaaauguaguucaagguuccaaauaaacaaaauuuuccugguuagguugcuaguuaaaaauugguaagacaaaaacuuuuuuuuuuuuuuuuuuggcgaggggaguccacagaauuuaggaagaaagaaaguugaagaauaggacguguugggaaaaaacaacaauggcccugaaaugacuaaauguuuaauaauacucacuuuccaugucuguaaugucuaucuaagcaccuacugagauaaugcuuacagaaugcccagcauacaccaugcucagcucagaaaugcuucaucaacguucauuaacgugaaauuuucuauuuuccaaaugaccuccuggauuauucaauuagagaccuuguaauuagaucccucuucccaacuacugauagaacaaagagcaaagacucaaccugacuggcaacacuaacagugaaucaaaauguuauaaguaugaagcaugcagagaauuaaacaaggaacuaauuuaaugagguuaaaauucugcucaagggauuccuagaucugaaugaacuuggcccuaguucccaggaugucaaauaagcauuugucaguuuuggaauagaaccaaagucccugucuggggaaaaaucccaucuggccuaaagacaguccuuauaaucuaaguguauacaaaaggccagcccuauagcuuuuauugaaaacucagcuaagagaagugacauuuacgaaggcagucuaaagcugugguuccaagccugugugguucucagaauuaccuggaaagaacugagauuucuuacuuccuacccuagaccaucugaucagaccucaaggggugggggacccauauuuucaaaguagcucccuaccugguccugaagaucagccauauuugggaaccacugguuuagggcauaauauuuacccauuauucugauacuuaagucaguuugcugcaaaaacccacaguuguuggauauuaccuuaggccaaggauggccaauaaaugguguggguauccaaaugcccccucggguauagcuaacugacuacuccucuuuuucuucuucucagggaagugcuccugguacgcauuaccuuuguccuacauagaauccccgcauugcauguuaaagugaagcugcaaucauuuaucgaaggucacuguaagaaacauccucaugaaaauuacauaugcaacuguuauaaagcaucuauuaaaguuauuguccaccuuccuauuuaaugucuuuguaaaauauuccaagggagaaaccuuuagaaucuggugccaggaaaauuucugucuuucuagagauaccacucauucuuccuuuuugguaagaaugacagcuuacuaucugcuugagaugaauucaaauauggagaaauaaaaaccuggagaaaauaacucacuuucucuuccuuuccuugcuuucaauuuccuuuacuuucucuaacuuaaugugcuagaucacgaaccuucuuuaaaucacuuuuggaaguaagugagguauaaauagaccacuaaguuuuaccuuccauuaguaauuauuaccuuuuaggagaaaaacaaauagauuccccucaaagcugugacuccaaaaaauaccaauuccagcauggcucuagaauugaacucuguacuaauuacaaaaacaaccagccaaagaaaugcugagguuauggaaguguuccucugaugcucugacaaaacuuaacgacagaacagaacagcuguacgaucuggagcaagucaccaaggcucuccauaaaaagggaacagagcagucuacuugucuaaagggauggugcuggauuuuguaacugcaaauuucgcagaauuucaugucacaacuuaucacuugaaugaugaaaaucuccacacugcuguuauacuuugauaguugugaugguaaaauuucauaugccuaugaaaauuguaagaaauguucgcagccaggcgcgguggcucacgccuguaauccuagcacuuugggaggccgaggcgggcggaucacaaggucaggagaucgagaccauccuggcuaacauggugaaaccccaucuauauuaaaaacacaaaaaauuagccaggcgugguggcgggccccuguggucccagcuacucgggaggcugaggcaggagaauggcgcgaacccaggaggcggaguuugcagugagcggagaucgugccacugcacuccagccugggcgacagagcgagacuccgucucaaaaaagaauaauaauaaaauaaaauaaaauaaaaaaaagaaaugcucgcaaacuaauuugaccacuguccauauuuccuugaaaugacuugaggagagaugggaucugagagcaugacgggccauucccucuucccacaagguagggccugucaaccaaguucucgaaaucguuuaagacaucuccccuccucucacuuaugcccaacaaaaggagaauuaggccgggagcaguggcucaugccuguaaucccagcacuuugggaggccgaggcacguggaucacaaugucaagagaucgagaccauccuggccaacauggcgaaaccucgucuauacuaaaaauacaaaaaaaauuagccaggugugguggcaugcgccuguagucccaacuacucgagaggcuaaggcaggagaaucgcuugaaccugggaggcagagcuugcggugagcugugaucaugccacugcacuccagccuggugacagggcgagacuccgucucaaaaaaaaaaggggggggggugagaaucaagaaucaggcuaccacgggucuuaaauuuggaggaaauguuagagauagauccuacaugagggauccugcagcuggaaaaccuuaaaugcaauuugguucaaguacccaugcaaaugugaacuuacauggagucucaguugucucugaaagguaauucacagugcauuuuucuuuggugggaaguuuuuuacaccaaucauuaccauuucuuguuuagauaaaguggauaucugagaaaugguucuaaagguaucaaagggaauaaagucucuuuccuuuucuuaguucccaguuuuucaagaggaggcuuucuacuaguuagcagaucccaugacucuuuucacagacauuccagacaucugcaaucccaccucuaaaauacaaaaggacauacacacuugacauuaguggcucucaauccuagggcacacuagagacaccugaggacauuuugaaacuaaggccacccaagucccugguauucuuauuauuuauuuauauaauauuuuuauauaaauauauauaaauauauuauuuauuuauuuuacuuuuuuuuuuuuauagauaccagguuuuaccauguugcccaggcuggucucaaacuccugagcucaagugaucugccugccuuggccucccaaagugcugggauuauaggugugagccaccgcgccuggcccugauauucugauuuacucaacuugagguaggacauaauuuuuuaaagcuuucuagaugacucuaaugugcauccaggguugggaaccacuguucuuaaaaaaugaaaaauggugugaacgcuuaaauucaaaaagaaaaaggagagaaccauagagaaggauauauuuucaaagaagaagaagaaggaaaaaaaccucacagcauggauacuuuuaugaauaaaguaaagcugacagaugacauaugguuucugauuaaauacaucugaauuuuacuauucauaucccuuuucaggauuaauaggauguuaagguuaugauuagaucuucucuucugcagaauauauggugauaauuaucagauuuugccucagauggacucauucaccauuaggaauuauuuaccuacuuuaaguuguucauuaauaaacaggccaaauuauaaaaaucaccauuaccuggcauauaauagguguucgaagacuugcuaaaugacugaagagaucaacacuagguuuccacaugaacgucuucuuucaaaaacauugacccaaaaggggcagggaacaagaagagugucucacagaauaacaucaagagucacaauaaugaaaaugccagcaagcacuccuggggcccuguucuacgggugugugugcucauuucggccucacagcccccucagaaagaugagacuauguuuaaucccauuucauagaugagagaacgaaggcacacagagcuuaagcaacuuucccaaacuggcagccacugaagcccguuuugaacccaacggucuguaccugagucugggcacacucacugacaacagaaauuaaaacacuuuuccucuccucauuuggauccugucuuucacagauaucccuuuacacaugccaaguuuuguuuuuuuuuuucuuuuuugagacagggucuuguuuugucacccaggcuggagugcagugguguggucauagcuuacugcagccuggaacuccuggcacaugccaaguuuuaaaagccuguuuuggggacagugugugcccuucaaaaaauaaagccaagcugcucuaagcucuucaaauauauuauuuccccaacccaguuguccaccauggacuaaugcaagcucaggaagaaaccaacaagcaaaguggcuuccuaaagaugcagaaugcaaaggaagcacccucagagaacuaggcuaagcccacccagggaacaaggauagagggaacagggauggucaaagcagaggaugaucagcugggaaaacgagagcagcagcaagaaggcagcagaugucugaugacggacauuugaaauggaaacaugcgccucucccaaaaggggaacucaaaaacgucagcauuuugaaucacuucauucugacaugauaaaacaaaauuaguuaccuaucuccaaaucugcaagcuccuguuuuacuguagaagggacaauuagcucgauccuucuccauuacucugaaauccacgggugguucuggguuuugccaugugguaccauuuuccaacuguugaaaauaaccaugacuuuacugguggaguaaaaacccaugaaagacgaaauguuucaaaguauauuaaaauauuuuccucaaagauaaacauuguuucauuuaauaaugcaaacauuuaaguuggaacaggcaaucaagacuuuacaaacaacgguacugagacaugagcuccaugucucucuuggcuccuggucacuuuccuuuaucugguaucacuacugccaccaggggcagucgccaagguuuccauccauucuaaaaaggguccaagaaggccgggugcaguggcucacgccuguaaucccagcacuuugggaggccgagguggguggaucaccugagaucaggaguucaagaccagccugaccaacauggagaaaccccaucucuacuaaaaauauaaaauuagcugggcgugguggugcacaccuauaaucccagcuacuugggaggcuggggcaggagaguugcuugaacccgggaggcggagguugcagugagccgagaucauaccacuguacuccagccugggcaacaagagcaaaacuccgucucaaaaaaaaaaaaaagaaaaaaagagaaaaaaaaggguccaagaacuuauuagggaaccaccacagacagaaauagaaguuacucugauucaagguaaaccguccacuggaggcuaacgguaugugauguugcuuaaacauacuguaaggacucuaaacagguccaguccacaggggucaugaauaccauuuguauuuguucaucaauaaaguuuguuguuguuguauaaaucaaagcaucauaaacaugaguccagauauccaaacaugaucuaacuaaccuaccacgaaacuaacauuacuggaacuauuauuucuaaggaaacauuaauuggucucaaauuaucaauguaagguuuuaaaaauaccucauuuucagccugauccagcaucuucugcaaagcuuccuaaaauggugcaaacacaggacuaauaaaaacccagaagucagguaagucacaucugguuucucugguuaagaaucucaaguggaacaauuaaaacacacacacgcacacaaguucuaguuuucuuuugaaucacagaucuuuugaaaagcuuucaaaggauauauagcugagacuuuucucuuuuuuuuuugagacagggucucacucugucacccaggcuggagugcaguggcgugaccucagcucacugcaaccuccgccucccaggcucaagugauccucccaccucagccuuccgaguagcuaggacuacaggcgcacaccaccacgccuggauaacuuuuguauuuucuguagagacggaguuucaccauguugcccaggcuagucucgaacuccugagcucaagcaauccacccgccucagccucccaaagugcugggauuacaggcaugagcuaccgugcccggcccauagcugagacguucuauucaaauagaaaauuuaccagaucacauugcaaaauauuuaaaauagucuuauaauaguuucaauaauaguaauacuuaguauauuugaguauauauaccauguccuaguucguaaaaggggguauuagugaauauaaaacacaaugcuaggccgggcaugguggcucacaccuauaauccuagcacuuugggaggcugaggcggguggaucacuugaggucaggaguucuagaccagccuggccaagacggugaaaccccgucacuacuaaaaauacaaaaauuagccaggugugguggcacgugccuguaaucccagcuacuugggaggcugagacaggagaaucgcuugaacccaggaggcagagguugcagugagccgagaugacgccacugcacuccagccuaggcgacagagcaagacucugucuaaaaaaaaacgaacaaacaaacaaacgaaaaaacccaaaaaacaaugcuagaugaaaucauaaacauuuagcagaagcuaaaauaugacaugaccagugguaauuagcauuuaggagaaaauucuaacuuuuuaauaaggcaaaggagguucugcaauaugccaguaaauuucuaccuaauuggcauuugaacaaguuguaccuauguuuaacagacagucuuaucuucccuagccccuuaaagcauuacauaagacucguaugucuaguugcuuauuuguggugcucaaaacagaacucuuguccucuacacucccuggcccacauccaccugaaugcucccucagugaauaguguugccagucuaucugucuauucaaacuaaaaaccuaaaaauaugacuugaauuccucucucucuccuuguccucuggucaacauggugaaacccugucuguacuaaaaacacaaaaaauuagccggguguggugaugggcgccuguagucccagcuacucaggaggcugaggcagaagaaucgcuugaacccgggaggcagagguuucaguaaaguaaaaaugaucuguuaaaaaagucuggugcagugguucacacgagcacuuugggaggccgaggcggguggaucccuggaggucaggagcucgagaccagccuggccaacauggugaaacccugucucuacuaaaaauacaaaaauuagcugggcgugguagcaggcaccuguaaucccagcuacucggggggcugaggcauaugaauugcuugaacccaggaggcagagguugcaguaagcagagaucacgccacugcacuccagccugggcgacagcaugagacuccaucucaaaaaaauuuuuuuuuuaaaugaaugaucuguuaaaagguacagauauaaaugagacagagucauucccugcuuaaaccccuucaauggcuucccauuauaggaaacauaaaauccaaacuccuccuucaaauccaggaagcccuacaugaucugacucugcuuacccuccacugccccuucucccucagcaaccuccuccacugcccccucucccucagcaaccuccuccacugcccccucucccucagcaaccuccuccacugcccccucucccucagcaaccuccuccacugcccuucucuccuuuggacucuagauuucagguucccuggccuuuuuucagccuucaagcuucaggcuucuucuugcugagaucucuccacucaggugucagcucaaacaucaccuccucagaaauuuccuugagcaggcaaucuauagaagcacaacucuauucucauuacucuaucacaucacucugcuuuauuucuuucuuuuuuuuuuuuuuuuuuugagacgaagucuaguucuauugcccagguuggagugcaguggcucaagcuuggcucacugaaaccucugccucccgguucaagugauucuucugccucagacuccugaguagcugggacuacaggcgcccaucaccacgccuggcuaauuuuuuguauuuuuaguacagacgggguuucaccauguugaccaggcuggccucgaacuccugaccucgugauccucucgccucagccucccaaagugcugggauuacaggcgugagccaccacgccuggccugcuuuauuucuuuauagcacuuaauaugaucacauuuugaaugaucuguuuugcuuaucaucucacacucccauauaaaaaacuagcucaaugagagcaaagacugugucuuucacugcucugucucuguccgcuagcgaagugucuagcauacagcaggaacacauacugcugauucuuuuuuauaagcuuagaaucuauuucauuucccucauuucuccuugaagucucacagauuuccucugaaacaaaagcauucaaaagaggccuuagcuguuacugaauuccugaaagaccucaguugaggaacacucuacuguuaaaaugggaauuaauuccucucuauaaaaaaaugacaaguuccaaacaauuuuucugcccccuaaaaaccuagcaugaacuugccucaucuggaaagaagugcucaaauaaagguguuuaaaaucugcacugaaauuaacugauggccuaagauacaaaaaacaaagaucguggaggcugcuucugccccauauugacuacaaugaagacacaugcauuuuucccaauuauaaggugauuauccaauuuuaugcuauuuaaauuuagcuguauuacaaaaaagacaaauccugaugaaucagucaagggaagaugagcugugauaccucugaaauaaauauacugucaaggaauagcagcaaaacauaccaaaucaauccuuaaaaaagaauccuggaagauagagaagauacauacacacauaugccucacagauuuuuuuuuuuuuuuaaauaagcaacuguguguuagcuacaauuaucuucauagccuaaguggaagaggaagucaagauuuaauacaaauaacaaaaacuguuuccuaguuccucaauauuugaguuccugauuucuuuaaauccucuaauucuugcugacaugucauaagcaguucucuuaugaccuaaauaaauguggaaacaaaacaaaguauuauucucuaaagaagucaacucauauacagcagaaccucagaagaacauaacuugcuauaaagcaagggcuagcugccuguuuuguaaauaaagcuuuccuggaacacagccauacccauucaucuacauauuaucgauggcugcuuucaggguacacuggcagaguuggauguuugccacagagaccaaaccauaaagccuaaaauauuuaccaucuggcccuuuacaacauuugccaaugcccaguauaaaggguaaauaggguaaagcugaagaaaacuuuaaggaaucugccacugcacggacccgaagaagagcaucagaagggaacucugguguuaugucuaaacugaaauaugauucuuuccaaacaaacaaugaaaugacaagaaaaagagaaaaaaaaaacccaaacucugacaugccuacugauuauucuucaaacucaucacacagcacaucccaugacaggaaucaccucuuuuucuuucuucuccugucguuucugcuccuccucuucucucucuuuccucugcuguucuucccauuguuccuuuaacuuucucuuuaaaggggaagaaaaaguaacuuuguuucagucacuuuuuaaaaacauuucacauacagcgcacauagaugaaaaacuuaaaacacuggcaaacugaauaagaucaguuuuuuguuuuuuuuuuuuaaguucaagauaggcaacucuuuuuuuuuuuucuuuuugagauggaguuccgcucuugcugcccaggcuggagugcaauggcgugaucucagcucacuccaaccucccaagauaggcaacucuucaugagaguuauuauggugaaguaaucaguuuguucacuaguuacgugauuccuaccauaccucuuguucuucuugccguuuuuuagccgccucuuccuuuuccuucuuuauucugaauucuucuugugccuucugcucucuuagcaaccacuccucauguaaucuuugccuaucaguauaaugauguaaucagauaaaagaaaugggcauuaauccacaaauacacacacacacgagagcaaaaugacacauuuugggacugauucaaauaucacgaaagcuauuuucuauuaaagcagucaaguggguguaagagaacgagaagagcagagcuuuuggaaaagcaccacgugucagcaacuaucuuccuaauggguaauaacuuaaaaucucucuuacauuucauagguauauauggcugugacauacuuuacagaaaaaaggacacuaugacuuucccucuagacugaucacagugauguuuaggugacaauaaaauggguagcaaguuucaaagcagcaucuaccuuuucauauucagaaagcauuucccuuccuauucuaugcauuuauuuuuauuuauuuauuuauuuugagacagaguauuacucuguugcccaggcuggagugcaguggcaugaucuuggcucacugcaaccucugccucccggguucaagugauucuccugccucagccucccgaguagcugggauuacaggugcccaccaccacgcaaggcuaauuuuuguauuuuuaguacagacagcguuucaucauguuggccaggcuggucucgaacuccugaccucaagugauccaccugccucggccucccaaagugcugggauuacaugugugagccacugcacccagccccuauucuuaaaaguagcaauuccaugauggcagcacgcugaaaacccaguauccuuugccauaaaccuuuggacuacuacuacacacaguuaagagacuccugugguuugccuccaaacaccuaaacagccaaaagaaggaaaauaaaaguacauuguaaucauguuuuuaaaauaaagcuacagguuuuaagaaauggaguuauaaaaauaaauuagugagggccgggcgcaauggcucgcaccuguaauccagcacuuugggaggcugaggcgggcggaucaccugaggucaggaauuugagaccaggcuggccaacauggugaaccccaucucuacuaaaaauacaaaaauuagccaggcgugguggcagccgccuauaaucccagcuacuugggaggcugaggcaggagaaucgcuugaaucugggaggcggaguuugcaaugagccgagaucaugccacugcacuccagccugggugacagagcgagacuucgucucaaaaaaugaaaaaauaaaaauaaauuagugagugucuagucuauuuuuuauaugaccaauuauaaugagugguauuaccuuaaaguggcaagugucucagacauccaauaucacaaauuucuaauauaaagaggggguuagauugccaaagucuaccugccaauuagguguguagaaccucaaauucauucuuccacugaauuuauaaaagggaaauuaaauaugagaaacuguucuauauuacuucagcaguauuaggaguucaguaaaguuuuaugucuagucuggggaccuaaccacaauuuuaaauaaaauauauuacauuuccaaauacagauuccaggaacacaucuuuuagccauggcagaggcuggcacauugcaucuaucaguguuccuaugccaugugugaggguaccauauagauguuucagugggcacaacucugauuuacaaaucuuuugaaaaacauauaauuguauauaaaugaaccaaaugauauauaaauuaagaccacaagaaaguaaaauguuaaaaauuuuaaaauuuaauaacuugaauauacaucugcuuugaaauaggacauaaagucauacaguauuuuuacauaauuuucuugcuuuucaauaauaguaugcaacucauaaagaaauaaagaucuaaggagcacaaagauacauguaugugauuuaaaagaagcauuucaaauaaacaggaaaaaaauuacucucuuauuucauaccguaucuauugucuucaucauaacagaaaucuauaauaauaagaacuagagcuaucacagcaccucucaucugcugacacuguguuaaacacuauacauccaucaccuccuuuaaucuucacaauucugugagguggauacugugauugacuuuaucuccauauuacagacaaggaaauagaagcuuagagacauuaagaaauuucggcugagcgcgguggcucacaccuguaaucucagcacuuugugaggccgaggcgggcagaucaugaggucaagagaucgagaccauccuggccaacauggugaaaccccaucucuacuaaaaguacaaaaaaaaauuaacuggguguggcggugcgugccuguaaucccggcuacucgggaggcugaggcaggagaaucgugugaaccugggagguggagguugcggugagcggagaucacaccacugcacuccagccuggugacagaacgagaguccgucucaaacaaaacaaaacaaaaacaaauuuuaaaaaaacauguaucccaaaagagaaaggugugagacuugagcaaucuacaaauagguaauaaaacauauaaaaagauacucuaccuaauucagaaaugugcauuugaaacaguuucauuauaguuuuauaaacugauaaugccuaguaugagugaagguauggggagaugggccccuacauucacugccagaagggcugcaaacugcaaaccaggaagcccuuucuaccuggccaucuacauuuuacauggacuuaugauuugauuccaacaaucucauuuuuagucauguucuuaaggaaauaacuggacaauuaccaaggauauauaagcauggaugcuuacugcaacuuuuuacauaugagugaaaaaccaauauaaccugaaaguccaucaguagagaacuauaaauuauaaaugaauaaacuaugaauagcaaauaaauuaugcuacaucuguacaguggguacuguauugccacugaaauggcugaauuagaucccugcaucaguacugaaauaaaugcacuauauauuuagcaagaaagcaauuuauagaaaaauauguauaaauaucaugccauuauagaaagacacacguaaaguacauuuacacuuucuuuuucucuuucuuaacaguggcuaucuuuggguguguugcaauuauuaaagucuuuucccuuuuuacauuuguuaauuuuuuuuguuuuuuuucuguuuucaaaaacaauuacaggucaggcgcaguggcucaugccuauaaucccagcacuuugggaggcugaggcaggcggaucacuugaucacaagagaucaagaccacccuggccgacauggugaaacccugucucuacuaaaaauacaaaaauuagcugggugugguggugcacaccuguugucccagcuacucggaaggcugaggcaggagaaucgcuugaacccgggaggcggagauugcagugagcugagaucaugccacugcacuccagccuggcaacagagcgagacuccgucuaaaaaaaaaaaaaaaaaaaagaaagaaaaaaaauuauaaauuagcaaaaacagaagaaaaguacuuccauuuuuaaaaaaaauaacaucuaguuuuagcccaucaacuacagauuuaaauacuuuauacaggauauuuuauaagaccuauuugguacaagauuuuauacagaagacugguacugguuaguaaagguugauaauauuccaauaaaauaacuucauucacuuuaaguguuucaauuagcacugaccucucucuuuccaauagcuucucuucuucuaguuguuguucuucaauaaaaguguccuccucuuccuccuucugugagaguccuagggaauuuaaauguuuuauuaaacugagugcugcaaauccuuggucaaaaauucaggaaaaaaauacauguaaucuuuaauguauaaaauuaugguaaaaaucuuuuucuuaaacuuucuaacaaaaaggucucugaucaaccuucuuugguacaacacaagcaucaaaaaggacaauagggguggcagauagcacauuacauuuaaaaauuaaucaaugguuccacaauuauacuuaaaaaggaaauuagcuuggcaugguggcaggcaccuguaaucccagcuacucgggaagcugaggcaggagaaucacuugaacccaggagguggagguuucagugagccaagaucgugccauugcacuacagccugggcgacaagagugaaacuccaucucaaaaaaaaaaaaaaaaaaggugguggggguguggaagggaacauccaucuucacagaagaaugguaacuaaaaaauggagaaaaacuuaaguagaaaaaucaucacuuuugcaacccccacuguaaaaauuuagacaaagacauuaaaaacaucgaaugaaagcuugcuaggaagaguauauucacacuaucucaacauaucaccccagacaugaggacuaauuagaaaagaaaaaaugcaaugcuuuccaauggagcgaucuggacacuuuuuuuuuuuuuuuuugagacgggagucuugcucugucgccaggcuggagugcaauggcgcgaucuuggcucacugcaaccuccgccuccuggguucaagcgauucuccugccucagcuucccaaguagcugggacuacaggcgcgcgccaccaugcccagcuaauuuuuguauuuuuaguggagacgggguuucaccacauuggccaggauggucucaaucuccugaccucgugauccgccugccucggccucccaaagugcugggauuacaggcaugagccagcauguccggcccuggguggguaacaccuuaaccacaguuagcaucaccgggagugcaacaaccugaugugaaaggucucaugauguaugcaauaagaaguuuacaacaucugcucuguaauccuuuguucuaaagaguguuguuaccugaaguuaaucaugagaagacagaacaauccagaauacagggcauuccacaagauaacuggcuugaguuuuucaaaacaaucaauccugguuuggggaaguuuaaauauggccuguauaugauaccauugaauuacuugcucauguacucaggugcaaguuugguauugugguucugcgggagaauguccuuauucuuaggaguugcaagcugaagaauuuaggggugaggugcugcuaucugcaacugccauccaaaagguucagaaaaaauguucuauguauguaucucuuuaaauagagaaaaagaaagaaaggccaaacuuuaacaacuggcaaaucuugcugaaggguucauggauauuuauugugcucuuuuuuucaacuuucuguagauuagaacauuucccaaauaaaaacaugaaaaaacaacuuuuaauagaauagacauuuacauccucucccauucaaaauuugggaaaaaaaucagugaaaguggaagagaaauggaagacugaaauaaucuuaaagaaauguuacagaugucaggcuuaaagaaaaaagagucuguuugucacauguguugaguacaguucuaacugaaggcucauccagucuuagauaauuacaauaauuuacuuuucuuaaguaaguaaacuuuauuauuucagcagcuggaauuaaaaugggcaacaaauguagaauaaguucucaaucauauaaaauaguaucuaauuguucagauaauuaaaugaucuaauguacuuaaagcgccagagaaccuggcacagaggauauggccugacuacuugcagagguaugccauagauuagacagggcauagacacagcugacacucacaaacaccuguugacugacucacucaacuccccaucaccucgaaaccaagcucauauacuccacagaagugauugcuaacaguucuggguacagcauuuuccccacguguacaaucggacauaugcaauacauauacauacaauacagcugacccuugaacaacacagguuugaaccaccuuggucuauuuaaauacagauuuuuuuucaguaaacacacuggaacauuuaggggauauuugcaacaauuugaaaaaaaaaauagguaaguggcauggccuagaaacacugaaaaaaauuaagaaaaagguaugucaugaaugcauaaaauauauguacauacuagucuauuuuaucauuugcuaccauaaauauaaaucuauuauaaaacguuaaugcagagcugggcgugguggcucaugccuggaaucccagcacuuugggaggccaaggcgggcggaucaccugaggucaggaguucgagaccagccuggccaacauggugaaccccaucucuacuaaaaauacaaaaauuagccgggcgugguggcagccccccguaaucccagcuacucgggaggcugagggaggagaauugcuugaacccgggagguggagguugcagugagucaagaucgcgccacugcacuccagccugggaaacaagagcaaaacaccgucucaaaaaaaaaaaaaaaaaaaguuaaugcagauacuguuaagcaauauugugcuggcuugagcagcacauauacagauacuguuacaauauaaguuaaguguuuuauuguuuccuugcuuaaagcauuugaaacaggccagggagcgguggcucaugccuguaauccuagcacuuucggaggccgagguggacggauuacuugaggucaggagaucgagaccagccuggccaacauggcgaaaccccaucucuacuaaaaauaaaaaaauuagccaggugugguggugcacgccuguaaucccagcuacucaggaagcugaggcaggagaauugcuugaaacugggaagcagagguugcagugagccgaaauugcaccacugcacccuagccugggcgacagagcgagacucugucucaaaaaaaaaaaaaaaaaaaaaaaaaaacgauuugaaacaaaaugaucucugacuucauuccauucuaagacagagaaguucggucucaaacauuuuuccuugaauauuacuauaaaaguugugcuacaacauaaucauugacaacuuuuuuuaaaguuaaaauuuaucaaaacuuauauuuauagaccauauauggcacauucacaguugagaaaaauguaaacaaacauaaauaugcaguauuaaaucauaacugcaugaaauuaacuguaguacaaaacaaggaaaaaaacgcauccaaugagguacagaaggaagaaaaaaauuaacuguaguacacacugcacuacugcaauaauuucauagccaccuccugcugcuauugcagugagcucaaauacuaugaguauucacuuaaaacaccuugugacacuacucaucucugcaugagcaguucaucucuucaguaaauuguguauggcaguaagaagugaucucuggcguauuuuucacuguguuuacuacaaaaugguaaaccuugaauaacaucaugagacucacacaaagugcgacuagcgaugcuggaagugcucucaagaagcagagaaaagucaugauggccgggcgcgguggugcgugucuguaaucccaacuacucuggaggcugaggcaggagaauugcuucaacccgggaggcggagguugcagugagccgaguucaugccacugcacuccagccugggcgacagagcaagacuccaucucaaaaaaaaaaacaaaaaacaaaaaagaaaaucacugaggagaaaggauaucugcgugaauaggacgcccagcuacuuuuuguauuuuuagcagagacaggguuucaccauguuggccaggcugcccucgaagucccgaccucgugauccacccgccuuggccucccaaagugcuaggacuccaggcgugagccacugcgccuggccugaacagguuuuuaaugcagaugaaaguauccuauucuagaaaaacaccacaaaggacauuuaguaggaagagaagcaagcagcaggauugaaaacaaaaagagacaggcuaacucuacuguuucaugaaaacguagugggguuuaugaucagaacugcccuuaucuauaaagcugcuaacccccacccccaauccuugaagggaaaagaucagcaccagcugccugucuuuugguuguacaacuagaaggccuggacaauggaaauccuuuuuucugaauugguuccacugaugcuuugucccugaagucaggaaguaccuugccaauaaggaacuggauuuuaaaauuauuuuaauauuggacaaugccccuggccacccagaaccccaugaguucaacacugaaggugucaaaguggucuacuugcccccaaacacaauguuucuaauucagccucuagaccagggggucguaagaaccucuaaagcucauuacacgugguacucuacggaaaggauugucaaugcuaugggagagaacccuaauacagagaguaucaagaaaguguguaaagauuauaccauugaagaugcuauuguuguuauagaaaaagccaugaaaaucaucaagcccaaaacaaaguccugcuggagaaaaaaauguguccagauauugugcauggcaucauuggacuuaagacagagccaaucaaggaaaucgugaaagagauuguaaauaugggggggggggaaaagugcaggggggucggggugaagggucucaagauaucuugaagaaauucaagagcuaacagacacaccagaguaguuaacaaaagccaauuugauggggaugaguccuuccaaaccagugcaaggugaugaggaagaaaacugaggugaagcagugccagaaaacaaauugacacuagacaaucuggcagaagggccaauuauucaagacugcuuuugacuucuuuuauggacccuucuauacugaaaacuaaugcauuuaaacuaaagcaagugguggaagaauugguacuguauagaaacauuuuuagagaaaugaaaaagcaaaaaugucagacagaaauuauaauguauuucugcaaaguuacaccaagugccgucuacccucuugccuucccuucuaccuccuccaccucuuccaccucugccacccaagagagcaagaccaaaucauccucuuccuccucggccuacucaacauuaagacaaggagaaugaagaccuuuaugaugaaccacuuccauuuaaugaagggcaaauauauuuucuccuccucgggauuuucuuaguaacauucuuuucucuagcuuacuuuauuauaagaauaugguauauaauacauauaacauacaaaguauguguuaaucaacuguuuauguuauugguaaggcuuagagucaacagcaggcacuuaauaguaaguuuugggggagugaaaaguuauaugcaaauuuuccacuguggggaggggcggggggcggucagaguccccuaacucccacauuguucaaggaucaaauguauauccaaugguauuauacagguugagcaccccaaauccaaaaaugagaaauauuuugagugacaacaaugcucaaaggaaaugcucauuggagcauuucgaauuuuggaucuuuggauuugggaugcugaacugguaaauacaacgcaagcauuucagauaagggauacucaaccuguacauguaacuguacacacagaaucaugcuauaguuuugcaacuugcuuuuaauaucuuaauuucugacgagguagcuuguuuccaguuaucugaaguagaauggaugccaaagaagcuaucuguaauuaagagcucacuauuccagaaaucauuugccaaggcacuccaaucauuugccaaggcacucucauaguuacacucaacauucuagccuucuggguaauguuuacccaucuaacgugugcuacaauaaacagcaguguuccuggccgggcgcaguggcucacgccuguaaucccagcacuuugggaggccaaggugggcagaucaccugagaucaggaguuugagaccagccuggccaacauggugaaaccccaucucuacaaaaguacaagaauuagccgggcaugauaguggguaccuguaaucccagcuacucaggaggcugaggcagaagaaucacuugaaccugggaggcagagguuacagugagccuagaucgugccauugcacuccagccugggcgagagagugagacucugucucaaaaaaaaaaaccaggaguguuccauagucuacaguauucaugaaguaccacuaggcaaagaauugugaguuggagugggcaaaaguaggagcagaagugcagagacaggugcuuagucuuggauaugccauuaguuacauaaucuugacagaccagugaccuggauuuaguccauuaaaaugggcuaaacuaccaugggacaugacucgccugacucuccacagaggcucauucugaacacauuuugcuaaguaaaaaggaaaaaaaaaaucaaaacaauacaaauaccagcuguuauaggauuuagugcaggaaaagaaaaagagaaagaaguuaaaacaaauuuagaauauauaauauuuagaauaaaacagauuaaaugaacaaaguaaaguagcugaaaauuucaaggggggagagacgaaguacaauaagggccucaauaacuccaaccuauucuacuuuuccuuuuaucccugaugcuuuguucugccucuaguggaugaguuuucaacuaauaagacagaaaugcuaacacagguugcaguuaaacacacugcuccuuccauucuaaauaucccaguacugacacuaaaauaauuacucaggaacaccaaugguaaauaaaaccucuauggcuauguuucucaagguccaagaauccuaguuacuugaggccauggucucuggauuuuaagaauugucuaggauaauuucaugagcauauucuggauaaugcggaugacaaucauuauaagccaguacuacugugugauuucagugcucccaucuggauuuauaacuacuacauaauuuuauaacuaaguccuaauuuuauugcauuaagcagguagauuuaauacauaaauguuagguuuugccaugugaaggucaaaugaccaucuguacaaauaaagguucuacaguaauuucauagaaaaagugguaaauaacuauaaggcaacauuaguagaggcauuccaaacucccaucagugccauauacauauugugaggagcauuaguuucacaucaucccuagcauuaccugauguagauuuaaauuuuaccgaauguguaauuucauuuaguuuuauaauuuauaaauguauuuuuauuuguuuguuuguuuuuugagacagaaucucacucuguugcccaaacugaagugcaguggcaggaucucggcucacugcaaccucugccucccagguucaacugauccucuugccucagccuccugaguagcugggauuacaggcaccugccaccaagcccagcuaaucuuguauuuuuaguagaggcaggguuucaucauguuggccaggcaggucucgaaccccugaccucaggugauccaucugccucggcuuuccaaagugcugggauuucaggcaugagccaccacgcgcccagcccauauauuguuuuauagucaaacaauggcuucaggucaggugugguggcucaugccuauaaucccagcacuuugggaggccgagguggaaggauugcuugaggccaggaguucgagaccagcccaggcaacacagugaaaucccgucucuacgaaaauuuuaaaaauuagccaggugggccaggggcgguagcucacgccuuuaaucccagcacuuugggaggcugagguggguggaucaccugaggucagaaguucgaaaccagccuggccaacaugaugggguuucaccccaucucuacuaaaaauacaaaaauuagccgggugugguugcgcacgccuguaaucccagcuacucgggaggcugcagcaggagaacugcuugaacccagggggcggaggcugcagugagccaagaucgugccacugcacuccagccugggcaacagagcgagacuccgucucaaaaaaaaaaaaaaaaaaaaagaaaagaaaagaaaaaauuagccaggugugguggugaaugccuguagucccagcuacuagggaggcugaggugggaggacugcuugagccugggagguggaggcugcugugagccgugguugugcacaucccuccugggcaacagaacaagacccugucucaaaaauaaauaaaugagcuucauaacuaguauuauguugauauauauuugaauaacauaauaauuuggguaaaccaagggucucauauuagucaaguuugagaaaaacuugcaaaacgucuaauuaauaccuucaacuccugcugguuuuacgaagaaaaacauucaccgaauacuuacuacgugugcaaggacugugcuagcugcuguaauucaugaagcuugcaacuguaauauuagauacuuuauaaguuacacagaaucagugggcgaucauucaccaagacuuccucuuccugccuuuaguauguuaacauuguuucugacauguguuucuaaauaacuacuugggggcagaagucacagcuauuuuuccuccgacacaauauuugacuuccuucugacacuggggcuucaaguuagggcuggaguggacagagcaauuucacaacacagaaaacagaauaaagaguccaucaccugagucucucagucgagcaaguuccugccgacguuucuuucguuucuccuucuucagggcggcccuguacuuuuuguggcuggaagauuaagacauauacacgacgaucagcggcuacaaugcagcgcugcccgagcuccccgcuccucugugcccaaugaaaggaaauaguucgggugcugaggagagaaaccuugcuuccuguauuuuaauuacagaacagccaucuaucaucgccucauccucccacucccagacaguucuucuccauccgccaaccugauccucuccucgcuugccugagccacagccgcccgugcaaguccggggagggcaccagagcgcgcaccaggaaggaauggagcugccgcgguggcucacuuagcuuggcccagcuucucuuuucuuccugccaccacauccuccaugcccacgaucggcccgcucgccugcucaucuccccguacggcgcuuaccuugguuucucgggaaacgucaucuucucgggcgcagccaucuugccggcaccgccccgccccuccaggucuggcaggaaagggcgggccuaagagucgagacgggcacgcgcaggcgcggguaccgagcaaccuccaccagcgugggacuugaaacggaaagccggagguacccuucggcggcucgucuuccagaacccugcucaaauaaauaccuccuuccagcaaaaauacucuggggcuuuuaccccgcccuagaaguaauugucgcuucagcacuugcccagugcuguaucacugucucccuccucgcccuagca

SEQ ID NO: 19224 - RNA, 33788 nt, Homo sapiens
ugcuagggcgaggagggagacagugauacagcacugggcaagugcugaagcgacaauuacuucuagggcgggguaaaagccccagaguauuuuugcuggaaggagguauuuauuugagcaggguucuggaagacgagccgccgaaggguaccuccggcuuuccguuucaagucccacgcugguggagguugcucgguacccgcgccugcgcgugcccgucucgacucuuaggcccgcccuuuccugccagaccuggaggggcggggcggugccggcaagauggcugcgcccgagaagaugacguuucccgagaaaccaagguaagcgccguacggggagaugagcaggcgagcgggccgaucgugggcauggaggaugugguggcaggaagaaaagagaagcugggccaagcuaagugagccaccgcggcagcuccauuccuuccuggugcgcgcucuggugcccuccccggacuugcacgggcggcuguggcucaggcaagcgaggagaggaucagguuggcggauggagaagaacugucugggagugggaggaugaggcgaugauagauggcuguucuguaauuaaaauacaggaagcaagguuucucuccucagcacccgaacuauuuccuuucauugggcacagaggagcggggagcucgggcagcgcugcauuguagccgcugaucgucguguauaugucuuaaucuuccagccacaaaaaguacagggccgcccugaagaaggagaaacgaaagaaacgucggcaggaacuugcucgacugagagacucaggugauggacucuuuauucuguuuucuguguugugaaauugcucuguccacuccagcccuaacuugaagccccagugucagaaggaagucaaauauugugucggaggaaaaauagcugugacuucugcccccaaguaguuauuuagaaacacaugucagaaacaauguuaacauacuaaaggcaggaagaggaagucuuggugaaugaucgcccacugauucuguguaacuuauaaaguaucuaauauuacaguugcaagcuucaugaauuacagcagcuagcacaguccuugcacacguaguaaguauucggugaauguuuuucuucguaaaaccagcaggaguugaagguauuaauuagacguuuugcaaguuuuucucaaacuugacuaauaugagacccuugguuuacccaaauuauuauguuauucaaauauauaucaacauaauacuaguuaugaagcucauuuauuuauuuuugagacagggucuuguucuguugcccaggagggaugugcacaaccacggcucacagcagccuccaccucccaggcucaagcaguccucccaccucagccucccuaguagcugggacuacaggcauucaccaccacaccuggcuaauuuuuucuuuucuuuucuuuuuuuuuuuuuuuuuuuuugagacggagucucgcucuguugcccaggcuggagugcaguggcacgaucuuggcucacugcagccuccgcccccuggguucaagcaguucuccugcugcagccucccgaguagcugggauuacaggcgugcgcaaccacacccggcuaauuuuuguauuuuuaguagagauggggugaaaccccaucauguuggccaggcugguuucgaacuucugaccucaggugauccacccaccucagccucccaaagugcugggauuaaaggcgugagcuaccgccccuggcccaccuggcuaauuuuuaaaauuuucguagagacgggauuucacuguguugccugggcuggucucgaacuccuggccucaagcaauccuuccaccucggccucccaaagugcugggauuauaggcaugagccaccacaccugaccugaagccauuguuugacuauaaaacaauauaugggcugggcgcgugguggcucaugccugaaaucccagcacuuuggaaagccgaggcagauggaucaccugaggucagggguucgagaccugccuggccaacaugaugaaacccugccucuacuaaaaauacaagauuagcugggcuugguggcaggugccuguaaucccagcuacucaggaggcugaggcaagaggaucaguugaaccugggaggcagagguugcagugagccgagauccugccacugcacuucaguuugggcaacagagugagauucugucucaaaaaacaaacaaacaaauaaaaauacauuuauaaauuauaaaacuaaaugaaauuacacauucgguaaaauuuaaaucuacaucagguaaugcuagggaugaugugaaacuaaugcuccucacaauauguauauggcacugaugggaguuuggaaugccucuacuaauguugccuuauaguuauuuaccacuuuuucuaugaaauuacuguagaaccuuuauuuguacagauggucauuugaccuucacauggcaaaaccuaacauuuauguauuaaaucuaccugcuuaaugcaauaaaauuaggacuuaguuauaaaauuauguaguaguuauaaauccagaugggagcacugaaaucacacaguaguacuggcuuauaaugauugucauccgcauuauccagaauaugcucaugaaauuauccuagacaauucuuaaaauccagagaccauggccucaaguaacuaggauucuuggaccuugagaaacauagccauagagguuuuauuuaccauugguguuccugaguaauuauuuuagugucaguacugggauauuuagaauggaaggagcaguguguuuaacugcaaccuguguuagcauuucugucuuauuaguugaaaacucauccacuagaggcagaacaaagcaucagggauaaaaggaaaaguagaauagguuggaguuauugaggcccuuauuguacuucgucucuccccccuugaaauuuucagcuacuuuacuuuguucauuuaaucuguuuuauucuaaauauuauauauucuaaauuuguuuuaacuucuuucucuuuuucuuuuccugcacuaaauccuauaacagcugguauuuguauuguuuugauuuuuuuuuuccuuuuuacuuagcaaaauguguucagaaugagccucuguggagagucaggcgagucaugucccaugguaguuuagcccauuuuaauggacuaaauccaggucacuggucugucaagauuauguaacuaauggcauauccaagacuaagcaccugucucugcacuucugcuccuacuuuugcccacuccaacucacaauucuuugccuagugguacuucaugaauacuguagacuauggaacacuccugguuuuuuuuuuugagacagagucucacucucucgcccaggcuggagugcaauggcacgaucuaggcucacuguaaccucugccucccagguucaagugauucuucugccucagccuccugaguagcugggauuacagguacccacuaucaugcccggcuaauucuuguacuuuuguagagaugggguuucaccauguuggccaggcuggucucaaacuccugaucucaggugaucugcccaccuuggccucccaaagugcugggauuacaggcgugagccacugcgcccggccaggaacacugcuguuuauuguagcacacguuagauggguaaacauuacccagaaggcuagaauguugaguguaacuaugagagugccuuggcaaaugauuggagugccuuggcaaaugauuucuggaauagugagcucuuaauuacagauagcuucuuuggcauccauucuacuucagauaacuggaaacaagcuaccucgucagaaauuaagauauuaaaagcaaguugcaaaacuauagcaugauucuguguguacaguuacauguacagguugaguaucccuuaucugaaaugcuugcguuguauuuaccaguucagcaucccaaauccaaagauccaaaauucgaaaugcuccaaugagcauuuccuuugagcauuguugucacucaaaauauuucucauuuuuggauuuggggugcucaaccuguauaauaccauuggauauacauuugauccuugaacaaugugggaguuaggggacucugaccgccccccgccccuccccacaguggaaaauuugcauauaacuuuucacucccccaaaacuuacuauuaagugccugcuguugacucuaagccuuaccaauaacauaaacaguugauuaacacauacuuuguauguuauauguauuauauaccauauucuuauaauaaaguaagcuagagaaaagaauguuacuaagaaaaucccgaggaggagaaaauauauuugcccuucauuaaauggaagugguucaucauaaaggucuucauucuccuugucuuaauguugaguaggccgaggaggaagaggaugauuuggucuugcucucuuggguggcagagguggaagagguggaggagguagaagggaaggcaagaggguagacggcacuugguguaacuuugcagaaauacauuauaauuucugucugacauuuuugcuuuuucauuucucuaaaaauguuucuauacaguaccaauucuuccaccacuugcuuuaguuuaaaugcauuaguuuucaguauagaaggguccauaaaagaagucaaaagcagucuugaauaauuggcccuucugccagauugucuagugucaauuuguuuucuggcacugcuucaccucaguuuucuuccucaucaccuugcacugguuuggaaggacucauccccaucaaauuggcuuuuguuaacuacucuggugugucuguuagcucuugaauuucuucaagauaucuugagacccuucaccccgaccccccugcacuuuucccccccccccauauuuacaaucucuuucacgauuuccuugauuggcucugucuuaaguccaaugaugccaugcacaauaucuggacacauuuuuuucuccagcaggacuuuguuuugggcuugaugauuuucauggcuuuuucuauaacaacaauagcaucuucaaugguauaaucuuuacacacuuucuugauacucucuguauuaggguucucucccauagcauugacaauccuuuccguagaguaccacguguaaugagcuuuagagguucuuacgacccccuggucuagaggcugaauuagaaacauuguguuugggggcaaguagaccacuuugacaccuucaguguugaacucaugggguucuggguggccaggggcauuguccaauauuaaaauaauuuuaaaauccaguuccuuauuggcaagguacuuccugacuucagggacaaagcaucaguggaaccaauucagaaaaaaggauuuccauuguccaggccuucuaguuguacaaccaaaagacaggcagcuggugcugaucuuuucccuucaaggauuggggguggggguuagcagcuuuauagauaagggcaguucugaucauaaaccccacuacguuuucaugaaacaguagaguuagccugucucuuuuuguuuucaauccugcugcuugcuucucuuccuacuaaauguccuuugugguguuuuucuagaauaggauacuuucaucugcauuaaaaaccuguucaggccaggcgcaguggcucacgccuggaguccuagcacuuugggaggccaaggcggguggaucacgaggucgggacuucgagggcagccuggccaacauggugaaacccugucucugcuaaaaauacaaaaaguagcugggcguccuauucacgcagauauccuuucuccucagugauuuucuuuuuuguuuuuuguuuuuuuuuuugagauggagucuugcucugucgcccaggcuggagugcaguggcaugaacucggcucacugcaaccuccgccucccggguugaagcaauucuccugccucagccuccagaguaguugggauuacagacacgcaccaccgcgcccggccaucaugacuuuucucugcuucuugagagcacuuccagcaucgcuagucgcacuuugugugagucucaugauguuauucaagguuuaccauuuuguaguaaacacagugaaaaauacgccagagaucacuucuuacugccauacacaauuuacugaagagaugaacugcucaugcagagaugaguagugucacaagguguuuuaagugaauacucauaguauuugagcucacugcaauagcagcaggagguggcuaugaaauuauugcaguagugcaguguguacuacaguuaauuuuuuucuuccuucuguaccucauuggaugcguuuuuuuccuuguuuuguacuacaguuaauuucaugcaguuaugauuuaauacugcauauuuauguuuguuuacauuuuucucaacugugaaugugccauauauggucuauaaauauaaguuuugauaaauuuuaacuuuaaaaaaaguugucaaugauuauguuguagcacaacuuuuauaguaauauucaaggaaaaauguuugagaccgaacuucucugucuuagaauggaaugaagucagagaucauuuuguuucaaaucguuuuuuuuuuuuuuuuuuuuuuuuuuugagacagagucucgcucugucgcccaggcuagggugcaguggugcaauuucggcucacugcaaccucugcuucccaguuucaagcaauucuccugccucagcuuccugaguagcugggauuacaggcgugcaccaccacaccuggcuaauuuuuuuauuuuuaguagagaugggguuucgccauguuggccaggcuggucucgaucuccugaccucaaguaauccguccaccucggccuccgaaagugcuaggauuacaggcaugagccaccgcucccuggccuguuucaaaugcuuuaagcaaggaaacaauaaaacacuuaacuuauauuguaacaguaucuguauaugugcugcucaagccagcacaauauugcuuaacaguaucugcauuaacuuuuuuuuuuuuuuuuuuugagacgguguuuugcucuuguuucccaggcuggagugcaguggcgcgaucuugacucacugcaaccuccaccucccggguucaagcaauucuccucccucagccucccgaguagcugggauuacggggggcugccaccacgcccggcuaauuuuuguauuuuuaguagagaugggguucaccauguuggccaggcuggucucgaacuccugaccucaggugauccgcccgccuuggccucccaaagugcugggauuccaggcaugagccaccacgcccagcucugcauuaacguuuuauaauagauuuauauuuaugguagcaaaugauaaaauagacuaguauguacauauauuuuaugcauucaugacauaccuuuuucuuaauuuuuuucaguguuucuaggccaugccacuuaccuauuuuuuuuuucaaauuguugcaaauauccccuaaauguuccaguguguuuacugaaaaaaaaucuguauuuaaauagaccaaggugguucaaaccuguguuguucaagggucagcuguauuguauguauauguauugcauauguccgauuguacacguggggaaaaugcuguacccagaacuguuagcaaucacuucuguggaguauaugagcuugguuucgaggugauggggaguugagugagucagucaacagguguuugugagugucagcugugucuaugcccugucuaaucuauggcauaccucugcaaguagucaggccauauccucugugccagguucucuggcgcuuuaaguacauuagaucauuuaauuaucugaacaauuagauacuauuuuauaugauugagaacuuauucuacauuuguugcccauuuuaauuccagcugcugaaauaauaaaguuuacuuacuuaagaaaaguaaauuauuguaauuaucuaagacuggaugagccuucaguuagaacuguacucaacacaugugacaaacagacucuuuuuucuuuaagccugacaucuguaacauuucuuuaagauuauuucagucuuccauuucucuuccacuuucacugauuuuuuucccaaauuuugaaugggagaggauguaaaugucuauucuauuaaaaguuguuuuuucauguuuuuauuugggaaauguucuaaucuacagaaaguugaaaaaaagagcacaauaaauauccaugaacccuucagcaagauuugccaguuguuaaaguuuggccuuucuuucuuuuucucuauuuaaagagauacauacauagaacauuuuuucugaaccuuuuggauggcaguugcagauagcagcaccucaccccuaaauucuucagcuugcaacuccuaagaauaaggacauucucccgcagaaccacaauaccaaacuugcaccugaguacaugagcaaguaauucaaugguaucauauacaggccauauuuaaacuuccccaaaccaggauugauuguuuugaaaaacucaagccaguuaucuuguggaaugcccuguauucuggauuguucugucuucucaugauuaacuucagguaacaacacucuuuagaacaaaggauuacagagcagauguuguaaacuucuuauugcauacaucaugagaccuuucacaucagguuguugcacucccggugaugcuaacugugguuaagguguuacccacccagggccggacaugcuggcucaugccuguaaucccagcacuuugggaggccgaggcaggcggaucacgaggucaggagauugagaccauccuggccaauguggugaaaccccgucuccacuaaaaauacaaaaauuagcugggcaugguggcgcgcgccuguagucccagcuacuugggaagcugaggcaggagaaucgcuugaacccaggaggcggagguugcagugagccaagaucgcgccauugcacuccagccuggcgacagagcaagacucccgucucaaaaaaaaaaaaaaaaaguguccagaucgcuccauuggaaagcauugcauuuuuucuuuucuaauuaguccucaugucuggggugauauguugagauagugugaauauacucuuccuagcaagcuuucauucgauguuuuuaaugucuuugucuaaauuuuuacaguggggguugcaaaagugaugauuuuucuacuuaaguuuuucuccauuuuuuaguuaccauucuucugugaagauggauguucccuuccacacccccaccaccuuuuuuuuuuuuuuuuuugagauggaguuucacucuugucgcccaggcuguagugcaauggcacgaucuuggcucacugaaaccuccaccuccuggguucaagugauucuccugccucagcuucccgaguagcugggauuacaggugccugccaccaugccaagcuaauuuccuuuuuaaguauaauuguggaaccauugauuaauuuuuaaauguaaugugcuaucugccaccccuauuguccuuuuugaugcuuguguuguaccaaagaagguugaucagagaccuuuuuguuagaaaguuuaagaaaaagauuuuuaccauaauuuuauacauuaaagauuacauguauuuuuuuccugaauuuuugaccaaggauuugcagcacucaguuuaauaaaacauuuaaauucccuaggacucucacagaaggaggaagaggaggacacuuuuauugaagaacaacaacuagaagaagagaagcuauuggaaagagagaggucagugcuaauugaaacacuuaaagugaaugaaguuauuuuauuggaauauuaucaaccuuuacuaaccaguaccagucuucuguauaaaaucuuguaccaaauaggucuuauaaaauauccuguauaaaguauuuaaaucuguaguugaugggcuaaaacuagauguuauuuuuuuuaaaaauggaaguacuuuucuucuguuuuugcuaauuuauaauuuuuuuucuuucuuuuuuuuuuuuuuuuuuuuagacggagucucgcucuguugccaggcuggagugcaguggcaugaucucagcucacugcaaucuccgccucccggguucaagcgauucuccugccucagccuuccgaguagcugggacaacaggugugcaccaccacacccagcuaauuuuuguauuuuuaguagagacaggguuucaccaugucggccaggguggucuugaucucuugugaucaagugauccgccugccucagccucccaaagugcugggauuauaggcaugagccacugcgccugaccuguaauuguuuuugaaaacagaaaaaaaacaaaaaaaauuaacaaauguaaaaagggaaaagacuuuaauaauugcaacacacccaaagauagccacuguuaagaaagagaaaaagaaaguguaaauguacuuuacgugugucuuucuauaauggcaugauauuuauacauauuuuucuauaaauugcuuucuugcuaaauauauagugcauuuauuucaguacugaugcagggaucuaauucagccauuucaguggcaauacaguacccacuguacagauguagcauaauuuauuugcuauucauaguuuauucauuuauaauuuauaguucucuacugauggacuuucagguuauauugguuuuucacucauauguaaaaaguugcaguaagcauccaugcuuauauauccuugguaauuguccaguuauuuccuuaagaacaugacuaaaaaugagauuguuggaaucaaaucauaaguccauguaaaauguagauggccagguagaaagggcuuccugguuugcaguuugcagcccuucuggcagugaauguaggggcccaucuccccauaccuucacucauacuaggcauuaucaguuuauaaaacuauaaugaaacuguuucaaaugcacauuucugaauuagguagaguaucuuuuuauauguuuuauuaccuauuuguagauugcucaagucucacaccuuucucuuuugggauacauguuuuuuuaaaauuuguuuuuguuuuguuuuguuugagacggacucucguucugucaccaggcuggagugcaguggugugaucuccgcucaccgcaaccuccaccucccagguucacacgauucuccugccucagccucccgaguagccgggauuacaggcacgcaccgccacacccaguuaauuuuuuuuuguacuuuuaguagagaugggguuucaccauguuggccaggauggucucgaucucuugaccucaugaucugcccgccucggccucacaaagugcugagauuacaggugugagccaccgcgcucagccgaaauuucuuaaugucucuaagcuucuauuuccuugucuguaauauggagauaaagucaaucacaguauccaccucacagaauugugaagauuaaaggaggugauggauguauaguguuuaacacagugucagcagaugagaggugcugugauagcucuaguucuuauuauuauagauuucuguuaugaugaagacaauagauacgguaugaaauaagagaguaauuuuuuuccuguuuauuugaaaugcuucuuuuaaaucacauacauguaucuuugugcuccuuagaucuuuauuucuuuaugaguugcauacuauuauugaaaagcaagaaaauuauguaaaaauacuguaugacuuuauguccuauuucaaagcagauguauauucaaguuauuaaauuuuaaaauuuuuaacauuuuacuuucuuguggucuuaauuuauauaucauuugguucauuuauauacaauuauauguuuuucaaaagauuuguaaaucagaguugugcccacugaaacaucuauaugguacccucacacauggcauaggaacacugauagaugcaaugugccagccucugccauggcuaaaagauguguuccuggaaucuguauuuggaaauguaauauauuuuauuuaaaauugugguuagguccccagacuagacauaaaacuuuacugaacuccuaauacugcugaaguaauauagaacaguuucucauauuuaauuucccuuuuauaaauucaguggaagaaugaauuugagguucuacacaccuaauuggcagguagacuuuggcaaucuaacccccucuuuauauuagaaauuugugauauuggaugucugagacacuugccacuuuaagguaauaccacucauuauaauuggucauauaaaaaauagacuagacacucacuaauuuauuuuuauuuuuucauuuuuugagacgaagucucgcucugucacccaggcuggagugcaguggcaugaucucggcucauugcaaacuccgccucccagauucaagcgauucuccugccucagccucccaaguagcugggauuauaggcggcugccaccacgccuggcuaauuuuuguauuuuuaguagagaugggguucaccauguuggccagccuggucucaaauuccugaccucaggugauccgcccgccucagccucccaaagugcuggauuacaggugcgagccauugcgcccggcccucacuaauuuauuuuuauaacuccauuucuuaaaaccuguagcuuuauuuuaaaaacaugauuacaauguacuuuuauuuuccuucuuuuggcuguuuagguguuuggaggcaaaccacaggagucucuuaacuguguguaguaguaguccaaagguuuauggcaaaggauacuggguuuucagcgugcugccaucauggaauugcuacuuuuaagaauaggggcugggugcaguggcucacacauguaaucccagcacuuugggaggccgaggcagguggaucacuugaggucaggaguucgagaccagccuggccaacaugaugaaacgcugucuguacuaaaaauacaaaaauuagccuugcgugguggugggcaccuguaaucccagcuacucgggaggcugaggcaggagaaucacuugaacccgggaggcagagguugcagugagccaagaucaugccacugcacuccagccugggcaacagaguaauacucugucucaaaauaaauaaauaaauaaaaauaaaugcauagaauaggaagggaaaugcuuucugaauaugaaaagguagaugcugcuuugaaacuugcuacccauuuuauugucaccuaaacaucacugugaucagucuagagggaaagucauaguguccuuuuuucuguaaaguaugucacagccauauauaccuaugaaauguaagagagauuuuaaguuauuacccauuaggaagauaguugcugacacguggugcuuuuccaaaagcucugcucuucucguucucuuacacccacuugacugcuuuaauagaaaauagcuuucgugauauuugaaucagucccaaaaugugucauuuugcucucguguguguguguauuuguggauuaaugcccauuucuuuuaucugauuacaucauuauacugauaggcaaagauuacaugaggagugguugcuaagagagcagaaggcacaagaagaauucagaauaaagaaggaaaaggaagaggcggcuaaaaaacggcaagaagaacaagagguaugguaggaaucacguaacuagugaacaaacugauuacuucaccauaauaacucucaugaagaguugccuaucuugggagguuggagugagcugagaucacgccauugcacuccagccugggcagcaagagcggaacuccaucucaaaaagaaaaaaaaaaaagaguugccuaucuugaacuuaaaaaaaaaaaacaaaaaacugaucuuauucaguuugccaguguuuuaaguuuuucaucuaugugcgcuguaugugaaauguuuuuaaaaagugacugaaacaaaguuacuuuuucuuccccuuuaaagagaaaguuaaaggaacaaugggaagaacagcagaggaaagagagagaagaggaggagcagaaacgacaggagaagaaagaaaaagaggugauuccugucaugggaugugcugugugaugaguuugaagaauaaucaguaggcaugucagaguuuggguuuuuuuuuucucuuuuucuugucauuucauuguuuguuuggaaagaaucauauuucaguuuagacauaacaccagaguucccuucugaugcucuucuucggguccgugcaguggcagauuccuuaaaguuuucuucagcuuuacccuauuuacccuuuauacugggcauuggcaaauguuguaaagggccagaugguaaauauuuuaggcuuuaugguuuggucucuguggcaaacauccaacucugccaguguacccugaaagcagccaucgauaauauguagaugaauggguauggcuguguuccaggaaagcuuuauuuacaaaacaggcagcuagcccuugcuuuauagcaaguuauguucuucugagguucugcuguauaugaguugacuucuuuagagaauaauacuuuguuuuguuuccacauuuauuuaggucauaagagaacugcuuaugacaugucagcaagaauuagaggauuuaaagaaaucaggaacucaaauauugaggaacuaggaaacaguuuuuguuauuuguauuaaaucuugacuuccucuuccacuuaggcuaugaagauaauuguagcuaacacacaguugcuuauuuaaaaaaaaaaaaaaaucugugaggcauauguguguauguaucuucucuaucuuccaggauucuuuuuuaaggauugauuugguauguuuugcugcuauuccuugacaguauauuuauuucagagguaucacagcucaucuucccuugacugauucaucaggauuugucuuuuuuguaauacagcuaaauuuaaauagcauaaaauuggauaaucaccuuauaauugggaaaaaugcaugugucuucauuguagucaauauggggcagaagcagccuccacgaucuuuguuuuuuguaucuuaggccaucaguuaauuucagugcagauuuuaaacaccuuuauuugagcacuucuuuccagaugaggcaaguucaugcuagguuuuuagggggcagaaaaauuguuuggaacuugucauuuuuuuauagagaggaauuaauucccauuuuaacaguagaguguuccucaacugaggucuuucaggaauucaguaacagcuaaggccucuuuugaaugcuuuuguuucagaggaaaucugugagacuucaaggagaaaugagggaaaugaaauagauucuaagcuuauaaaaaagaaucagcaguauguguuccugcuguaugcuagacacuucgcuagcggacagagacagagcagugaaagacacagucuuugcucucauugagcuaguuuuuuauaugggagugugagaugauaagcaaaacagaucauucaaaaugugaucauauuaagugcuauaaagaaauaaagcaggccaggcgugguggcucacgccuguaaucccagcacuuugggaggcugaggcgagaggaucacgaggucaggaguucgaggccagccuggucaacauggugaaaccccgucuguacuaaaaauacaaaaaauuagccaggcguggugaugggcgccuguagucccagcuacucaggagucugaggcagaagaaucacuugaaccgggaggcagagguuucagugagccaagcuugagccacugcacuccaaccugggcaauagaacuagacuucgucucaaaaaaaaaaaaaaaaaaagaaagaaauaaagcagagugaugugauagaguaaugagaauagaguugugcuucuauagauugccugcucaaggaaauuucugaggaggugauguuugagcugacaccugaguggagagaucucagcaagaagaagccugaagcuugaaggcugaaaaaaggccagggaaccugaaaucuagaguccaaaggagagaagggcaguggaggagguugcugagggagagggggcaguggaggagguugcugagggagagggggcaguggaggagguugcugagggagagggggcaguggaggagguugcugagggagaaggggcaguggaggguaagcagagucagaucauguagggcuuccuggauuugaaggaggaguuuggauuuuauguuuccuauaaugggaagccauugaagggguuuaagcagggaaugacucugucucauuuauaucuguaccuuuuaacagaucauucauuuaaaaaaaaaauuuuuuugagauggagucucaugcugucgcccaggcuggagugcaguggcgugaucucugcuuacugcaaccucugccuccuggguucaagcaauucauaugccucagccccccgaguagcugggauuacaggugccugcuaccacgcccagcuaauuuuuguauuuuuaguagagacaggguuucaccauguuggccaggcuggucucgagcuccugaccuccagggauccacccgccucggccucccaaagugcucgugugaaccacugcaccagacuuuuuuaacagaucauuuuuacuuuacugaaaccucugccucccggguucaagcgauucuucugccucagccuccugaguagcugggacuacaggcgcccaucaccacacccggcuaauuuuuuguguuuuuaguacagacaggguuucaccauguugaccagaggacaaggagagagagaggaauucaagucauauuuuuagguuuuuaguuugaauagacagauagacuggcaacacuauucacugagggagcauucagguggaugugggccagggaguguagaggacaagaguucuguuuugagcaccacaaauaagcaacuagacauacgagucuuauguaaugcuuuaaggggcuagggaagauaagacugucuguuaaacauagguacaacuuguucaaaugccaauuagguagaaauuuacuggcauauugcagaaccuccuuugccuuauuaaaaaguuagaauuuucuccuaaaugcuaauuaccacuggucaugucauauuuuagcuucugcuaaauguuuaugauuucaucuagcauuguuuuuuggguuuuuucguuuguuuguuuguucguuuuuuuuuagacagagucuugcucugucgccuaggcuggagugcaguggcgucaucucggcucacugcaaccucugccuccuggguucaagcgauucuccugucucagccucccaaguagcugggauuacaggcacgugccaccacaccuggcuaauuuuuguauuuuuaguagugacgggguuucaccgucuuggccaggcuggucuagaacuccugaccucaagugauccacccgccucagccucccaaagugcuaggauuauaggugugagccaccaugcccggccuagcauuguguuuuauauucacuaauacccccuuuuacgaacuaggacaugguauauauacucaaauauacuaaguauuacuauuauugaaacuauuauaagacuauuuuaaauauuuugcaaugugaucugguaaauuuucuauuugaauagaacgucucagcuaugggccgggcacgguagcucaugccuguaaucccagcacuuugggaggcugaggcggguggauugcuugagcucaggaguucgagacuagccugggcaacauggugaaacuccgucucuacagaaaauacaaaaguuauccaggcgugguggugugcgccuguaguccuagcuacucggaaggcugaggugggaggaucacuugagccugggaggcggagguugcagugagcugaggucacgccacugcacuccagccugggugacagagugagacccugucucaaaaaaaaaagagaaaagucucagcuauauauccuuugaaagcuuuucaaaagaucugugauucaaaagaaaacuagaacuugugugcguguguguguuuuaauuguuccacuugagauucuuaaccagagaaaccagaugugacuuaccugacuucuggguuuuuauuaguccuguguuugcaccauuuuaggaagcuuugcagaagaugcuggaucaggcugaaaaugagguauuuuuaaaaccuuacauugauaauuugagaccaauuaauguuuccuuagaaauaauaguuccaguaauguuaguuucgugguagguuaguuagaucauguuuggauaucuggacucauguuuaugaugcuuugauuuauacaacaacaacaaacuuuauugaugaacaaauacaaaugguauucaugaccccuguggacuggaccuguuuagaguccuuacaguauguuuaagcaacaucacauaccguuagccuccaguggacgguuuaccuugaaucagaguaacuucuauuucugucuguggugguucccuaauaaguucuuggacccuuuuuuuucucuuuuuuucuuuuuuuuuuuuuugagacggaguuuugcucuuguugcccaggcuggaguacagugguaugaucucggcucacugcaaccuccgccucccggguucaagcaacucuccugccccagccucccaaguagcugggauuauaggugugcaccaccacgcccagcuaauuuuauauuuuuaguagagaugggguuucuccauguuggucaggcuggucuugaacuccugaucucaggugauccacccaccucggccucccaaagugcugggauuacaggcgugagccacugcacccggccuucuuggacccuuuuuagaauggauggaaaccuuggcgacugccccugguggcaguagugauaccagauaaaggaaagugaccaggagccaagagagacauggagcucaugucucaguaccguuguuuguaaagucuugauugccuguuccaacuuaaauguuugcauuauuaaaugaaacaauguuuaucuuugaggaaaauauuuuaauauacuuugaaacauuucgucuuucauggguuuuuacuccaccaguaaagucaugguuauuuucaacaguuggaaaaugguaccacauggcaaaacccagaaccacccguggauuucagaguaauggagaaggaucgagcuaauugucccuucuacaguaaaacaggagcuugcagauuuggagauagguaacuaauuuuguuuuaucaugucagaaugaagugauucaaaaugcugacguuuuugaguuccccuuuugggagaggcgcauguuuccauuucaaauguccgucaucagacaucugcugccuucuugcugcugcucucguuuucccagcugaucauccucugcuuugaccaucccuguucccucuauccuuguucccugggugggcuuagccuaguucucugagggugcuuccuuugcauucugcaucuuuaggaagccacuuugcuuguugguuucuuccugagcuugcauuaguccaugguggacaacuggguuggggaaauaauauauuugaagagcuuagagcagcuuggcuuuauuuuuugaagggcacacacuguccccaaaacaggcuuuuaaaacuuggcaugugccaggaguuccaggcugcaguaagcuaugaccacaccacugcacuccagccugggugacaaaacaagacccugucucaaaaaagaaaaaaaaaaacaaaacuuggcauguguaaagggauaucugugaaagacaggauccaaaugaggagaggaaaaguguuuuaauuucuguugucagugagugugcccagacucagguacagaccguuggguucaaaacgggcuucaguggcugccaguuugggaaaguugcuuaagcucugugugccuucguucucucaucuaugaaaugggauuaaacauagucucaucuuucugagggggcugugaggccgaaaugagcacacacacccguagaacagggccccaggagugcuugcuggcauuuucauuauugugacucuugauguuauucugugagacacucuucuuguucccugccccuuuugggucaauguuuuugaaagaagacguucauguggaaaccuaguguugaucucuucagucauuuagcaagucuucgaacaccuauuauaugccagguaauggugauuuuuauaauuuggccuguuuauuaaugaacaacuuaaaguagguaaauaauuccuaauggugaaugaguccaucugaggcaaaaucugauaauuaucaccauauauucugcagaagagaagaucuaaucauaaccuuaacauccuauuaauccugaaaagggauaugaauaguaaaauucagauguauuuaaucagaaaccauaugucaucugucagcuuuacuuuauucauaaaaguauccaugcugugagguuuuuuuccuucuucuucuucuuugaaaauauauccuucucuaugguucucuccuuuuucuuuuugaauuuaagcguucacaccauuuuucauuuuuuaagaacagugguucccaacccuggaugcacauuagagucaucuagaaagcuuuaaaaaauuauguccuaccucaaguugaguaaaucagaauaucagggccaggcgcgguggcucacaccuauaaucccagcacuuugggaggccaaggcaggcagaucacuugagcucaggaguuugagaccagccugggcaacaugguaaaaccugguaucuauaaaaaaaaaaaaguaaaauaaauaaauaauauauuuauauauauuuauauaaaaauauuauauaaauaaauaauaagaauaccagggacuuggguggccuuaguuucaaaauguccucaggugucucuagugugcccuaggauugagagccacuaaugucaaguguguauguccuuuuguauuuuagaggugggauugcagaugucuggaaugucugugaaaagagucaugggaucugcuaacuaguagaaagccuccucuugaaaaacugggaacuaagaaaaggaaagagacuuuauucccuuugauaccuuuagaaccauuucucagauauccacuuuaucuaaacaagaaaugguaaugauugguguaaaaaacuucccaccaaagaaaaaugcacugugaauuaccuuucagagacaacugagacuccauguaaguucacauuugcauggguacuugaaccaaauugcauuuaagguuuuccagcugcaggaucccucauguaggaucuaucucuaacauuuccuccaaauuuaagacccgugguagccugauucuugauucucaccccccccccuuuuuuuuuugagacggagucucgcccugucaccaggcuggagugcaguggcaugaucacagcucaccgcaagcucugccucccagguucaagcgauucuccugccuuagccucucgaguaguugggacuacaggcgcaugccaccacaccuggcuaauuuuuuuuguauuuuuaguauagacgagguuucgccauguuggccaggauggucucgaucucuugacauugugauccacgugccucggccucccaaagugcugggauuacaggcaugagccacugcucccggccuaauucuccuuuuguugggcauaagugagaggaggggagaugucuuaaacgauuucgagaacuugguugacaggcccuaccuugugggaagagggaauggcccgucaugcucucagaucccaucucuccucaagucauuucaaggaaauauggacaguggucaaauuaguuugcgagcauuucuuuuuuuuauuuuauuuuauuuuauuauuauucuuuuuugagacggagucucgcucugucgcccaggcuggagugcaguggcacgaucuccgcucacugcaaacuccgccuccuggguucgcgccauucuccugccucagccucccgaguagcugggaccacaggggcccgccaccacgccuggcuaauuuuuuguguuuuuaauauagaugggguuucaccauguuagccaggauggucucgaucuccugaccuugugauccgcccgccucggccucccaaagugcuaggauuacaggcgugagccaccgcgccuggcugcgaacauuucuuacaauuuucauaggcauaugaaauuuuaccaucacaacuaucaaaguauaacagcaguguggagauuuucaucauucaagugauaaguugugacaugaaauucugcgaaauuugcaguuacaaaauccagcaccaucccuuuagacaaguagacugcucuguucccuuuuuauggagagccuuggugacuugcuccagaucguacagcuguucuguucugucguuaaguuuugucagagcaucagaggaacacuuccauaaccucagcauuucuuuggcugguuguuuuuguaauuaguacagaguucaauucuagagccaugcuggaauugguauuuuuuggagucacagcuuugaggggaaucuauuuguuuuucuccuaaaagguaauaauuacuaauggaagguaaaacuuaguggucuauuuauaccucacuuacuuccaaaagugauuuaaagaagguucgugaucuagcacauuaaguuagagaaaguaaaggaaauugaaagcaaggaaaggaagagaaagugaguuauuuucuccagguuuuuauuucuccauauuugaauucaucucaagcagauaguaagcugucauucuuaccaaaaaggaagaaugagugguaucucuagaaagacagaaauuuuccuggcaccagauucuaaagguuucucccuuggaauauuuuacaaagacauuaaauaggaagguggacaauaacuuuaauagaugcuuuauaacaguugcauauguaauuuucaugaggauguuucuuacagugaccuucgauaaaugauugcagcuucacuuuaacaugcaaugcggggauucuauguaggacaaagguaaugcguaccaggagcacuucccugagaagaagaaaaagaggaguagucaguuagcuauacccgagggggcauuuggauacccacaccauuuauuggccauccuuggccuaagguaauauccaacaacuguggguuuuugcagcaaacugacuuaaguaucagaauaauggguaaauauuaugcccuaaaccagugguucccaaauauggcugaucuucaggaccagguagggagcuacuuugaaaauaugggucccccaccccuugaggucugaucagauggucuaggguaggaaguaagaaaucucaguucuuuccagguaauucugagaaccacacaggcuuggaaccacagcuuuagacugccuucguaaaugucacuucucuuagcugaguuuucaauaaaagcuauagggcuggccuuuuguauacacuuagauuauaaggacugucuuuaggccagaugggauuuuuccccagacagggacuuugguucuauuccaaaacugacaaaugcuuauuugacauccugggaacuagggccaaguucauucagaucuaggaaucccuugagcagaauuuuaaccucauuaaauuaguuccuuguuuaauucucugcaugcuucauacuuauaacauuuugauucacuguuaguguugccagucagguugagucuuugcucuuuguucuaucaguaguugggaagagggaucuaauuacaaggucucuaauugaauaauccaggaggucauuuggaaaauagaaaauuucacguuaaugaacguugaugaagcauuucugagcugagcaugguguaugcugggcauucuguaagcauuaucucaguaggugcuuagauagacauuacagacauggaaagugaguauuauuaaacauuuagucauuucagggccauuguuguuuuuucccaacacguccuauucuucaacuuucuuucuuccuaaauucuguggacuccccucgccaaaaaaaaaaaaaaaaaaguuuuugucuuaccaauuuuuaacuagcaaccuaaccaggaaaauuuuguuuauuuggaaccuugaacuacauuuuuccuccacauuguauguuaggagaaggaaggaaguaagaaaguaaacucauaugaaggauuuuugaaauauuacucagguacagccuggucagcuuagccuugguccaguuuaaacuaugaaaauaaaauuguucuucauaaugguuggccaccuucauuaaauaagaauuaaaugaugcagguaugguagcucacaccuguaaucccagagcuuugggaggcugaggcaggaggaucacuugaagccaggagugcgagaccagccugggcaacauagcgagaccccgucccuacaaaaauaaaauuauccgggugugguggcauacgccuauggcaugcgccagcuacucaagaugcugaggcagaaggaucacuugagcccggggaauucaagguugcagugaaguaugaucauaccauugcacuccagccuauguaacagaacaagacccugucucaaaaacaaauuguauuuauuacaccccaucgugaacaggcaccagauuguagauuaaugcagaugucuuggaucccucucuuccaagccauaugacugacuugggcaagugugcuuuucuaggucucagcuuccgucuuugcaaaguggugaaaauacuagcccccacuguccuaaagggauaaaaggaccagaggggaaaaauguaaaaaugccaugaaagcuacaagaugcuguacacagaucagauugaauugcuucauuaacuggaaauucuuggauuacuauauugucuaaacauugaguccacugacgauuguacagaaccaggauugcauuguuaguucccaccuuccucucagcagucccgcaugugacaucuucaugccugucaccacauccugucacaccaaucagcgggccuucuuuuccccuaugguucaacauguauaggcuuccugaacuucauucaaaggcagcugaaugguauaugaacuuugaaauguuuccaacuugacauuaaaacagcaagugccaaguuucaacacuuaaaaaaauccucuuaagcgcugaaacuuggcaucugagugggguuuauuaucuuucaguuaagucaaaacaacuaaauuacaugaguuucuaucucaaaauuuaaagcaaguguuuuuuuguuuguuuuuuguuugagacggaguuucgcucuuguugcccaagcuggagugcaauggcacaaucucagcucacuguaaccuccgccacccggguucaagugauucuccuaccucagccuccugaguagcugggauuauaggcacuacaggcgcacgccaacacgcccggcuaauuuuuuguauuuuuaguagaauugggguuucaccauguuagccaggcuggucucgaacucuggaccucaggugauucacccgccucggccucccaaaguguugggauuacaggcgugagccaccaugccuggucuaaagcaguuguuuugugaguaauuuucaacuauuggccuagugaauuuaagcuuuucuuucauacgcagauguucacguaaacauaauuucccaacauccaguccuacccuucuuauuaagagcauguuuacgacguuuggaauggagcagugcaggagggaugacuaugacccugacgcaagccuggaguacagcgaggaagaaaccuaccaacaguuccuagacuucuaugaggauguguugcccgaguucaagaacguggggaaagugauucaguucaaggugggcaugcguguggaggaggggacugguuugcuucacccugcaguacuuaauggcacaagagagcugggacacaggcucagcuggggucaggcacgcuagcacucuauaaaugugacuucccucuuucucucuuuccacccccuaccuuguugccaaugucacgucaauaccacaugaaaucauaaacauauauuagcaugguauuuccugaaugcuaggggucuagauuggaaaggaucuuucauuuauuuaguagcuuugugcuccaguucuuuuccagcacaugaauucucuguaucagguccccugcauauagccauccaguccuucacuuagaagcugcaugugacaaacggugcauucccuuccuuccucuguagguggcuuccgugugcagugugacacaacuucacucacuaaguuuguuggugcauuguguugacagugccgacuuagcuuccacccaagguguauguucuuucuucuggagccacacaggaacauaaaucuagauuccaccaccuaacccccuucuuuuuuuuacacuguuuuuauucauuggauucuuucaauacugaauauaguauuauacaaaccauggucugugaugcagcauacuuggugaaaaaggcauucagaugacacauaauuauuuuaaaauauuccuuaaugcaaggguaaggccagauguaaucucugcugcccccaggacccauuaguugaauucuaauagggugaagcuuccugccuugucugugauuucaucagaucugagcuggaaugccuuuguuauguuaaggcagggaaauugucccauaauuugggaaaagacaggaauagaaccgugauuuuuuuuccugcaaguugcaaaugaugaugaaaaguuggaacacccccccaaaaaugaagauauuccugacauuuaaggcuauacuucuaucaaccgacuucaagauuuuuaaaaauucuuuuuauuuuuuuuuuccuccuuaaccuuuuguuucuggggcauaugccuuccugucuucacauuacuugucagcacaagcaauaacugcuaaaguggaacugccuggucacagccacacaauaccauguuagaagcacuggccgaggaggccaugugguuugacuagccuugucacuucuuccugccuuuuccuuauccugaaagugaggggacuggauuacgucagugguuuuccucguaggguuucuugauuauacugcuucugugaagugguaaugggagggcugcuuucagaacugcagaguaguuaauggaaauugcacccuuacuugcaacaggcugcacccacaaaccacaaccaccacaacguauuuuuucuuuuguuuagaguucucucauccuggcuugcacagcugacauggauucccgaggccuuuuauucuuccuucuaagggugguguuacaaacugucacugaguauggauccugcucguuuugggauacccuaagaaaaauacucuggaacaaauuuguaaaauuauagauucauuuugaacauaaacgcuaaacacuaguaugaauauuugaggaccuuuuuacauacuauuauauaaaaacaaaucagauuugucauuguugaaggcaaaugaucaaauauuuaaccuaacuaguaauaggaacaguacauaugaaaaugggaugauauucacaccuaucaggcaaaaaaauuauaaauucuauuaauaccaagaguagaugaggauguguacauuaguaaaaccacuucagagagcaguuugucaauaccuagugaagguacguguaaccuauaaauuggcacacuccuggcuaugcacaguagagagcucuuuauacccacagagaccuguuuaagaaugcugacugcgguacuguuuguggaugaaaaauuggaagcaucuugaaaaaccaucauucuagaguagauaaguuuuauuauuugguauauccaguauacaguaguuaaguuuaugugacuacaucuugaaaaaagaauauggaauaaauacuauugauauaaaauuuuaaaacauacaaagcaacacuauauguuguuuaucaauacguauuaccuguuucuuugcauauguauauauauguguauacccauuauaaauaauggacauuuauauguaugauacauauguguggguuuuggcaugcauaugauguauguauauaugccuguaucuguguauuuguauuugugucuguguaggucuauguauguauauguguguuuguguuuggaaugugaaggcuacacuccuagccuguggagaguguucaccuaugugauggaggagggagaagaaugggauagaagggcuucaacugagucuuuaauguuuuacauauguaaauauucucauucagaaguggaaaacguuaguguuaaaucuggguagugcauauauaggcugauugauaucuucuguauuuuuauggaugugugaaacauuucauauuugugggagaaaacagaccuggaccaacagggaucaggcacgcugccaugugccaaguacgccuuaaauagaugcaagagucagcuaguaucucuauuuugcaaucuuugauugguaacuacuuuggggaauguuagccuggacaaacaacauuugaugaauggcugguuucuuuuccugaauuuuuuaugauagcauucuucauugcucccuaggucagcugcaauuuggaaccucaccugaggggcaauguauauguucaguaccagucguaaguauucugcuuguggaugucuuccugauuugucacaguuuguuguucuguuucuguugaugucugggauuuuuccacuggauauauaacuuucauguauuuuauuucuuauguuuuuauuuuuauuuuguuuuuuucuuuugagacggaguuucgcucuuguugcccaggcuagagugcaauggcguguucucagcucacugccaccuccaccucccagguucaagugauuguccugccucagccuccugaguagcugggauuacaggugccugccaccaugcccagcuaauuuuuuguauuuuuaguagagaugggguuuuacuaugaugaccaggcuggucucgaacuccugaccucaggugauccacccaccucggccucccaaaguacugggauuacaggcgugagccacuguguuuggcccagcuuucauauauuuuaaaauauuuaaauaaaauuaaaguuuaaauaaaucuaaauauuuaaaacuuaaauauuaagaguugaaacagaaauauagaauggaugugaaaauaauauaagccgggcaugguggcucacaccugucaucccaacacuuuuggaggcugaagugggaggauugcuugaggccaggaguucaagaccagccuggucaacauggcaaaaccccaucucuacuaaaaauacaaaaaauuagccaggcgugguggcaggcaccuguaaucccagcuacuugggaggcugagacaggagaaucgcuucaagagagaccucaucucuacaaaaaaauuuaaaaauuggccgaaugugguggcaugugcugguagucccagcuauuugugaggcugaggcaggaggaucacuugagcccaggaggucgaggcugcagugagguaugacuguaccacgacacucuagccugggggacagagugagaguaagacuccaucucaaaaagaaaaaaauaauaaauuuauauuucauucuuuauauauuuacauaguuuugaauguuuuacaauaugguuauauuauuacucauaauuuuaauaauuaaaauacaaacuaauaagggauaacuagaauagagaacauaaaagcauuuauagugaaagagccggagauugaagcccaaaaucaucuuagugugcauuugaccagcuaagagagcaauuaauguaucauuucuucuuaucuugcuguuugccuaggccauaccauggcuaauggguuaaauuaaccaguguaauaagaagaacagcaauccuaucugagaaagaauaggcccuaauaauggaaaacacuucugcauuuuuaaugguccaaucuuuuggauuaagacgguuucauucaagccaauuuccaugcauugaaaccucuccgaggguuaguaaaaaggguuccugaauaaauugggagcuuugggagcuugaccauuuuaaugacucuucccuagguacaaaaucagugaacuuggugguccuacaauaaauuaauaacgggguuaauuaauaguagagcuaaucuacauauuaggaaguuacuguaaagcauaucauuugauuuuugguuuaaagggaagaagaaugccaagcagcccuuucucuguuuaacggacgaugguaugcaggacgacagcugcagugugaauucugccccgugacccgguggaaaauggcgauuugugguaaaagacaaagugaugauuuuuuuccucaauuguuccacugcuauauaaagggauauucuuugggggaaacccaguauuuucaaguggugaggcauagcuuuuugccucacacaguagaugagcagagaacuuuauauaaagaacaccacaguuuagaucuguaaccgaccucaaugagucacuugauagaugaagugacugaggucacaacguauuggugacagagguggggcuagaauuccagucuuccaaucuucaguccugggcucugugucugacaaaucaggaagccugaggaguuuacgucuguggaagccccauuucccuuguugcaguuucagagguauuuuauauucauuggcucacuucacuugagcuguuuguuuguuucuuucuuuccaucuuuaucccuaaugaaucuucugucaugaccaccuacguuaccuugcccauagcauuuccugccuuacuuggaauaauacauccuucugugcacuagagacuaauuguaggcuugggaucaguuaaacaugaaugcagucagacugacaucggacaguggcaacccaaucaggaaaugauccagucuugugcagaauagccagcaguuuugaaggccuaguuauguucugauuucucucaguggacuguucccuaggugaaaagagaugagcucuaaaugccucuggggagcacuuaucuuaccguuuacuuguguuucuuugcuguauacaugccugccuaacgcaaagucagaaucuuuggcaagcuugucuuccuuggauucugucauucugaaaccauuuaugaagggaaaagaaagauuuuaggauuccuggcuaagggaaaccagaagaaccauuacacuuuaaaggcucgggggauggaagagguggaauuguucgcuccauaaaggcaguuacuuuugucaguuccugggaauccagugugaguucagugaggagcuucugagugugaccuugacuccuccaaagcaggggacuauuucauuaaaaaaaaaaaaacacuuuauuuuccuuauugacuaaagacacugagcaucuuuucauuauuggccauuuguaugucuucuuuggagagaugucuguuuggauccuuugccuauuuucuaacuaggcucuuugucuuuuuauuauugaguuguaagaguucuugguauauucuccauacaaguaccuggucacaaauaugauuugcagauauuuucucccauuuuguagguucuuuucacuucauguucuuuugaaauacaaguuguaaauuuugaugaaauccaacuuaacuauuuuuuuguuuguuuuggugucacaucuaggaugacauugcuuagcccagggucacaaagauuuacuuguauguuuucuucaaggucauaguuucauuucuuaacauuuaggucuuggauacaguuuaauuuuuguauauaguaugugguacggagguauuucacuucuaacuguugugcauaucuggggaauuuacugcuuuuaaaaaacguuugagaaccccaaagaucucaaaauuguucgaauagauuuuaucugugauaagaaucuucuguauuaaaagcacuuagugaauuugaagcauuaguguaauguuuauaaucuuaaaguuuaaagaaaauauagacuccucuauguuuaauaggccuucucuuuuuuuuuugagagugagucucacucugucgcccaggcuggagugcaguggcauaauuuuggcucacugcaaccuccaccuccuggguuuaagugauucucaugccuccgccuccugaguagcugggauuacaagcgccugccaccacgcccagcuaauuuuuguauuuuuaguagagaugggguuucgccauguuggccaggcuggucucaaacuccugaccucaggucugugcccgccucagccucccaaaguguuaggauuacaggugugagccaccgcaccuggccacgccuucucuuuugaccagugguucuggccuguuuccuccaugccaucaaaccgugcuaccacagggacccaaagagcuggcuauuugauguuaaucagggaucaaaaucgucaaucagugggaaggugaaaccuggagaagauaacguggucaccauuugcucaguugcagucugcaccauaauccaacaggggcacaggcuauucugcuuaaugaaaacuucugauuuguuaccuuucagagugucauuuauuagagcacguuugaaaucgugggaaccaaauuaugacaucaauuuauguaagccccuuuuacauaauacacaguagaaaauaguucuagcauauccaaauaucagaaauguaccuucggaaaaggauaaaguagcaucuucagaauaugcagugauaagugcuguuucaucacugugccauugcagguuuauuugaaauacaacaauguccaagaggaaagcacugcaacuuucuucauguguucagaaaucccaacaaugaauucugggaagcuaauagagacaucuacuugucuccagaucggacuggcuccuccuuugggaagaacuccgaaaggagggagaggaugggccaccacgacgacuacuacagcaggcugcggggaaggagaaacccuaguccagaccacuccuacaaaagaaauggggaauccgagaggaaaaguagucgucacagggggaagaaaucucacaaacgcacaucaaagagucgggagaggcacaauucacgaagcagaggaagaaauagggaccgcagcagggaccgcagccggggccggggcagccggagccggagccggagccggagccgcaggagccgccgcagccggagccaaaguuccucuaggucccgaagucguggcaggaggaggucggguaauagagacagaacuguucagagucccaaauccaaauaaacuaguuuuguucuuaaaugauuguauaucuuauuuauuaugguugcuacauacucggauagaaggcuaugaacgcagauggguucgcaagucuggcugaacccuguguagccuggaauucuauuuaaaaauauuuuuauucucuuauaaucaugaaguaugguuaguauagaaaacauaaaauacauaaauaacaacaugaaaauuacuuguaauccuaacccugagagagaacuaaacauuggagcauuguuuuaguguguacacuuuuuucuuuuuuuuuagagauagguucucacgagcaguggcgugaucauagcucacugcagccucaaacucuugggcucaggugaucuucccaucucagccacccaaguagcugagacuacaagguacacaccaccacaccuggcuaauuuuuaaacauuguuuuguggagacagcguuuugccauguugcccaagcugguuuugaacuccugggcucaagugauccucccaccuugucuucccaaagcgcugggauuauaggugugauccaccacacccagcccuauguacacauuuuuuaauacaaagaacacauaugaaugcaguugaauaugcuuuuauucacaagaagcagucauacuucaucaagcccuauucuucguuuuacucacugcacaauauggaucaguuuuuucaaccauauccucauuguuagauuuuuaauuuuguacuauucaagaauccugugcugaaaucaauccugugauggauu

SEQ ID NO: 19225 - RNA, 9390 nt, Homo sapiens
ggcguaccgcaggggcguggcccgaacgagcugacuuuagcccuuacgugaaaggcguggcguagucgcaaggguguaaaaaagaaauucgaauucgcgggacggucggccucaggcggaguagggacgugagcccaagggagggaggugggguaggcagacuaguugugacuggaugaucacugggcgaaggguggaaaaguggccacagauggaaaggcgggcugcggaguagugaccggcaagggagguggcgcgaaaagggaaguagggacaugacguaguuggaacgcagagacgugccucgaacguggggggcgcgguccuuacgugugggcgugccuuguugcucugaggggcguaacaaagaugguggagcaggcggagggcagaggcgucggcaaguuagcgugcaggcgcguggcagcgacaggagauguguagccagagcgcagagcagguguggacuccggcgcuggggaagcguggccagggcgagauuucagccugggucggggacagaauggggacugauaggggcguaaccuggaaugacgaaaugacguuugcugcguagggacguggcuaaacgugagggggcguggccaagauggccgcgugcgggauccucggguaccgggagcgaacgaggagguucuggcucagguaagucguucggguaagggcgggcggcaguaaggagcgugggcagcagcagggcguggucugcuugagagggcaggaacugugccacuugccgcaaacaugaccgcgugccgcuaucggcccuggagccagagaagcuuuuggugcggcgagguuggccggggcccuggcggggcuucucugaggaaugggagugggaggcuggcggcggggaaauagccacuuccccacucuagcccucuuucuccgcuauggggaucaccagacauccuuuuaggauucugucuauuaaaaaguagaacagcuuucccagagacauugcgggaugagaggaguguccagaaaccaaggagcagcaagcugggacucccucgggucugcauuguugauauucccaccugacuaugcuaggggcuauggacagacacagccaccccagaguagaucaaaagcacaguugugucccuuggacaaaucugaguuuuucuguugugccuugccccagagccggaggagaggaaccuccaaaaugcagacauucuugguggcugggauucugugugauauucagcguuaaaugcugcugcucugaggcugcuggaaacgcguuaguauuaauaucuguguacuucucucacauuuacuuuugcuggaaaagcuugggaaaugacuuaacgaagaugcguaaaccuuaauuuguuuauaugcuccuuauuagccacugaauaccacauugcuuucugcuuccccuucuucuuuacugauaaucugaccauuuccacuaugcacuuugaaagucuugcuggaguauggagaauagucagaaaucucugguaagaugcugccccgcgcaucucucagaggagucacuauucauagccugcaucagaguucacaaugaaccaaaguucaccccaccuccccugucuucagggacuuagugaaaagcugcacuguucuugaauauuuuggaaaugaaaaacuuucugggcuauuuuaaaucaguaccugggcuggaauuaaccgaaaggcgaaacagcaagggcaccauucucugugccuauacguagcugcccugugcuuggaaccaagcaaaaaggcugccacugcucacaguugcaauggaauaaagguugagugccuugugauugcauaugaauauuaaggaaaucugauggaaagagggaaauucaucaugucacuggccacacuggggcaguuaguugcaacacacaaaucagguauaauauauuuugaaaccuuuggcaaccucagauugggaucacacucucaaggaagaagugagugagaggaggaagcuaagcuuucuuaagacauagcagcguaaucucuaauuuaaguuucaggaaauugcaaaaggcaggcuuccuuuugaaaucaggaguugagaaaaugaagagucaaucugaugccaaucaaggaauuuuucaauauaauuguaaccuuuuguuaguacuuuuccugucucuuucgcauaaguugcuuaaucaggcagaguucaagcuaugaggcauuuaauaaauacauuacuuaugaaugacauuuaaagacuuuuagaaucuuuucuuuuuucacacauuucuaaggcugcaaaacaacagaaaaagaacauguuaguaauauccaaggcauacaugaauaaucagugacagcaaaggauguguagcacagaaggcuuagcucuccuaggcgguauccagccacacacugguaauuguugaaauggaguauuggauauauagaugauuuauucucaccauuuuuuuguacaaguuugaaguuugcccuaauaaggggaaaacagauucuaaauucaguugacccauggacuauugcuguuuaaaccugcuaagugaauucagauagugaaguuauuuaaaaaccagaugcucuuaccuggcugcaggaacuaucaagauaagauauugaaagcuuauuggcagucugucuuuuaaauccugagccagacuuuuuuacauggcuucaacaaggugauuuuucaucuccuuagacauuuugacauacacacucccacuaaaaacuguauuuacacaaacacagauaaaacuaaacaaaagugauuuuaacuuugguuugagaauugucagcaccuuuuaggcaacgcagacauacuuuaggugucacuggcuguuacgaguucaauugcacccucccaucucaaacucauauacguuuaagucuuaagccccaguaccucagaaugugaccucauauggagauugggucuguauaaagguaauuauggucauuagggugaccacuaguccaauauaacugguguccuuaauuaaaagggaaauuuggacacagacaagaugagaauggcuuacgaaaauuggauuuaaugcugacacaagccaaggaauuaccagaagcaagguuuauuagguguucuccagagaaacaaaaccaauuguguguguguauguguauauauguguguguguauguauguaugugugggugugccugugugugugcuugugcguguguguguguguguguguuuagagagagauuuauuuuuaaaaauuggcucgugaauguaggcucgugaaauuugcagugcaggccagcagacuggagaccagggaagaauugauauuacagccugucuuacucaguuuugugcuguaacagaauaccugacacuggauaauuuauaaugaacagaaauuuauguggcucaugauucuggaggcugggaaguccaagggcauggugccagcaucugcucagcaucuagugagggcucucucuugcaucaucccauagcacaaggcagaagggcaagaacaugugcaugugaggggugggagugguugggggugaagaaggagggagggagggaagggaaagaagccaaauuuauccuuauaucaggaacccacuaccucagaaacuaaccagcucccccuaauaauggcauuaauccauucaugaggggagggcccucaugauuuaaucaccucccaacacuuuugcguugcagauuaaguuuccaaaacgugaacuuuggggacacauucagacuggauugugagcacaaacuggugccauggcacagcuccaguccaaaggcagucuggagguagaauuuccucuuccucaggggaccugucuuuuucaacuuaaggcuuucgacggauuggguagggcccacccacaugaaggguaauaaucuuuauuccaagucuacugauuuaaauguuaaucuuaucuaaaaaauacauucacagugacauuuaaacugguauuugaccaaacaucuggguaccaugaccuacccaaguuggcacauaaaauuaaccauccaaguagaaaggccuggaacagagcgcucauugcccucagaaggaaccaacccugcagagaacuuggaccucagauuucuaaccuccagaaccaugagacaacaaaaauuuuuaagccaaccagucuaugguacuuucuuacgagcuaauacauuggccuaaagaccuccgguagggagucaagccuagagguaaggaaccuccacaggauucacuaacuuccuaccaguccccuuuaauguaauggcugcacaucucuggcucccugaguucagcgcacauuagcaaagugaugcauaugcaaagcaaagcgcauggcacugugccaaaagacuggcuucucauccugcugugcuuuauuucacaaugcacauagagaugauucucgcuccuuucacguagguguagucuucucucuagcuuagauggagcaggaucaaggacagcaguacagaggagaagagcuaguucacagccaauuacuagcaugaaugugcacaaagagaggggaggaugaaagcacguuugccuccuuucucagcaucacugaggaccaugauguggguuuuauaucuuacauucuucuuggaaagaugguguaaagaaauaaaguucagauuuguaagggaaaugugucuuuagugccccucaacuucuacauuugugccuuuugccacccauucccaccuaccccaacccccaccacuaccccaccauggccauacugcugagagccccucuuuuggcaagagaaggcagaaucugagguggcaaaaaacacccugcugcaaacugguuugcucuguguuucucuuacccauacuaugugcauuucaggaggcuccuaagggagaaauuacauaccuggaagguacaguucaagucuuggucaucuuugcaucauagcacccaccacugugcuuggagcaaaagaaaugacaauacauuuugaaaugaaagugcuaacuggcagaaucccagcccugugagacuagaugagguucauacucagggaggguccucuuuuuagaucaggcaggauuugggggguccuuuggaucuuuuagauagggguaugagacccuccucucaaaggagaaauauuuaaaaguguuuuaaaaguauagacaucccuacaaaugggugaugacguuugagaaaaggaaagaccccuaguacugucucagagcaugcuggcagucauggcacaguucuuaguucuugaaaugcggaccaacaucuuugucaccaagggagccuacucgggucaguuggcuaguacucccagcacccauuuugaaugaggcacugugucccuaagagaugcagcucugaccaaggcagacacggucccuaccaccauggggcuuagauacuggagaggaugcagucauaaaguacauuccuggugagguauuaauucgacugugauaagcacugugaccacaaagcaguucugggcugaccuggugagcuuguggucgggggagcuuagaggaagugacgcuggugucagucaccugaaguggggguagggauucaccagucacagauggagggagaguccaggaaaggaagggcaucugcacaggccagagggaaaggcaggaguuggaagaacuaaaguccauguggcuggugggcgggcagaagcgcaaagugaaugugagugaaagcaagugggucugucaucuuggggugaccaaugaguuugaggaacaagaguggauaauugacucccauuugcccuccccuucaccucagggugcguauuacgagucugaauauuguccuacuuagagguuuucucaugaucuuaagucucuauuguuuacagcuuucacuucucugcccucuucccucuagguuauuggguuccugcaaguuaucugggaacugaucaaaguuucaggguaagaugguggugaugaacacccugagggucacucguccuguguccccaugcaaauugcuguggagaagcuuccagauuccaaggcccaggccauucugcagccucuguacuuguacuuacaaaauccagaaauaagccugagaguacaccauuucauuaaagagaggagaaaaggcuuguugguuuuauaaaaaucacgcguguuaagcguuuguagcugugaugucaugggcauuccagugugagauuauaugccuuauggacugugagaauaacuguuucucuauuuguccaguaaaauaaauguggaacauucuuucuugacaaauguuaaaauguuaaaaugaugucaugcagaaacuggagaagguuucagauauucuggaaccuguucuuuauuauuucugguuagcaguugucuuuuuacuaagguugauccacaaacugcagauuauuucugugaaucuuaaauugcuggaagcugcacaugaauguuugcaagcaguucaguggcuucaugcuucagaauauucuguccagaguuaagaauugcagaauuaauucuagcugacugauuugcaaguguguacucugcuguaaacacagaagaucaugugacacagcaaauguucuuccucaagccuuucucaucucguuccccuccuggaaauacaagguacuaucugcagcuggauguugcagggauucuccacuguggcacgauggacauuggggauggaucauucuguggcgugggggcugcccuuugcucacuggauguugaguggcaucucugaucucuugccaguagcacuccccaaaugaucacauucagauacguuucaagacauugcuaaauguccucugggagggagggcaaaauaacccugggagagaaccgcugagaugauaggagagaugucugugaugguggagaguuguguuuaaugaauuggcuaaauauaucuuuuggguuuuuuuaauauauuuuccacuauucacaaugaauuuacauaguuuucaaauacuggcuuguuucaggauuugagguuucucagauugugcucuucggguuuacccuuuuugaaccuccacgcacauaagaaaaggaauuccguuaauaauguugauuuagcuggauccauugccuugaaagugcuucagaagaauuuuuuauuacaaguuuauuuuguuuuaucccaacauugacuauguucucauugaaaugaguuggucggggucauaacaaauuuaugauugcugggugugcccauauccuacccagacuggcuuauuccgaacccugggacugcauucuaaggcuuaacguggaaaaaauuuagucauauuuaucuaguuacuaacguuuugugugagugugggguuuuugccuugauauuuaguuugucuuuauuugcagaaaguugaaaguuaaaugccuaaaguccaaucagucuaugccauuaggauaacuugcugcuuuuagugccaacagaaaccaaauaguggucccccgaggagaugggguucacuugacuaauagcuauauuauaugauguguucuuguuucuaaguuacuagaaaaacacagguggaagucaacauuugauuuuguuugugguauguuucacuguuccaaccuguuuuccccaaggagaauauuguggucuuucuugcccugggccuuugagcagguccuauuccuauauucuggacccucaucugcucaauuguaaacacaguucucauuguuucugacagcucaguaccccagcagaaggcuaguguacgcuuguaaccaagaauaaccccagauucuugaggguuagaagcucaguuaugaggccgggcacgguggcucaucccagcacuuuugggagaccgaggaaggcggaucaccugaggucaggaguucaagaccagccugaccaacauagugaaaccucgucucuacuaaaaauacaaaaauuagccaggcgucguggugcaugccuguagucucagcuacucaggaggcugaggcaggagaaucacuugaaccugggaggcggagguugcagugaaccaggaucuguacucugucucaaacaaaaaaaaaaaaaaagaaaguuguggcagcuacuucuaguacuuuguuaucaucaucguaggcucagugccugccucagauguuuaagucugaacauuuuaagaggaggcaaagcagaauaaggagugaaugaaaguaggagguuguggcaaauucgguaagcagcauuucaggucagcccagugcucugugcucaucauaucuuugcucccaaggcucuccacagauaaucuuuagcugucaacucagauugcuguuugcuguuaucucaaguagcagacaguaacuguugauaguccuaacuuuagggacuuguaauauaacaagauaaaaauaaaagccuacaccuguuauccaagaugaaaauaaaaucaguuucacuuagcguaucaucuagugaaauuuagcgugaugaucgcauaaaaagauuuagguggccgggcaugauggcucacgccuguaaccccagcccuuugggaggccaugaggggcggaucacgaggucaggagaacgagaccauccuggccaacauggugaaaccccgucucuacuaaaauacaaaaaauuagccaggcaugguggcacacaccuguggucccaguuacacgggaggcugugaggcaggggaaucgcuugaacccgggagucggagguugcagugacccgagaucgugccacugcucuccaaccugggugacagagcaggacucugucuccaaaaaaaaaaaagauuuaggcaugagaucuuaggccauaggaaaauuaauuuaauaauguuaauucuuaaugaaauauaaagaguaucagcuauaauguaaauaguacaaauuuaauauuauuccagugauucuuaauguucaugaucucccugcuuuuagaaagaaaagaaacauuuccuuuuaggauaacuuggacuagaauggcgcugucuaaaauguagccacaauuaaauguagccacuguggguauuuaccuguaaauuuaagcacauuaacauuuuauagccucaugugccuacaacuuaccauacuggacauuuucaucuuuagagaaaguuguauuugacagcacugauuuauauuauaacucaacuguguuauaaaguucuauuauuuuuccaauuaauuuugaagaaccaaagccuggagaacaauacuuguuuuuugguuuuuguuuuuuuuuuaacuuuuauuuuaaguucagggguaugugugcagguuuguuguauagguaaacuugucauggggguuuuguacagaugaggacaagaguuuuaacaggcuuguuuugcaaugucuuccuaaagaccucugauauaggcugggaugccucagacuguacugucuccauuaacuuucaaaua

SEQ ID NO: 19226 - RNA, 108747 nt, Homo sapiens
ugagcaucucuucccggcacgagaggcagggaggccaaagggccgccaagcuggccugggagaggcguagggcggagcgagaguggagugacauucccgagggcggagccccagggccuccgagacccguagacucccgccucccgccuccucuaggccgccggccgcgaagcgcugagucacggugaggcuacuggacccacacucucuuaaccugcccucccugcacucgcucccggcggcucuucgcgucacccccgccgcuaaggcuccaggugccgcuaccgcagcgugaguaccuggggcuccugcagggguccacuaggugagggaaugcuggcggucaguuugcaaaauccugccuuccccagcucacuuuagacuccuaggggagauaacaagagauacuuaaauuguacuacgaaauuuggugaaaaugguagacggcuuuucuuucugcaaagcacugagaucuaaguaccucaucaguuguucacaugcauacaauuuaaucguaggagucuggaaggacccagacauaaucuagauggggauaaagauacuuucugguugcuucgauguaggugaugaccggccuguacugcuuugaguauuaagcucguuucugcgccuugcaaccuaucacccaauaaauauuuaucgauuacuauucagggaggauacauuuuaggguaggccuugacuaaguggaggguauuguggaguagagcccuucugaauaacagcagcuaacauucucauagcacuaacugcaccccuuugagguaggcggucuuaucauuccauuuuacagauaaaacugagccacagaaaaccucaggucacacagcugauauguggugaagcugagaugcaaaccuaggcugucugguuccagagucugcuuuuugccaaagcaccucucuucguuucaguaggaaucuuugaaggaauuggguauauuucacuugaagaaaagauuuaagggauuggggguacugucugcaaacacuugaaguggaauagggauagauuauauuccuucugggauaguccauuagaaccuagaccucccaaagaggaaaagacuuucgaauaacaaacucuggcuauagguaaguccugaaauaugagauacauugccaagaacagcugguccaugacuugccuaugcucuaggagacuucaugaguaagcugaaagauuucuugcccaaaauguuggcccugaacuucaggaauagaugggucuuugaauucaaugacccucgaagaucucuuuuaaugccaagaucuucagcauguucugguaagaguuagggaccucuuuguuuuucuccauuuucucuaaggcgccacacaaaccugcccccaucugucagccucauugguagcaacuaccucaugggugcuaccagugaggcugacagaugaguggcacuggggaaggggugggagaucgagagaauucagugaaguaagaaagacaaaguguucauuggagauuuuuaguaaggggccaacagagcugcuaaagucaugcuucacuuaacgauggggauauguucggagaaaugcauuguuaggugauuuugucguugugcaagcaucuuagaguacacuuagacaaaccuagcugguauaaccuagguguguaguaggauauaugguauagccuauuguuccuaggcuacaaacccauacagcauguuccuguacugaauacugaggcaacugcaacaccguggugaguauuuguguaucuaaacauaccuaaacauagaaaagauacaguaaaaauauggcauuauagucuuaugggacuacugucauacauacaguccauauauuguugacuguguaauguugaccugaaugucauuauguggcaggcacaugacuguaucgcuaaccuucgcacaagauuacuguaggauuacaugagauaguuguaaauaauuggugggguacugggcaccuaguagguaugcauacauguucaccaucauuaugguuguuuuaaaucaccuaacccaggcccugcacauaguaagacaucaacaaauuguagcugcuacuauuuugcgcaucuaaucuuaauaucauuuauuuuguaguccuuggauguucccuccuuuaugacuucuuuuuuuuuuguuguccuuccuuuagcccuccauccucuacagcucagcaucagaacacucucuuuuuagacuccgauaugggguccuccaagaaaguuacucucucagugcucagccgggagcagucggaagggguuggagcgaggguccggagaagcauuggcagacccgagguaugcuaguuggguggcugcuccuuguuuucuuuucagaagggacuggugggauguugauggugauuuugggaagagggggccaagauagucgugagcuggccuguggagugcauaagugcaaacuuuaaaguuugcaauugggggcaaaccagccccagcccaaaggggguuucuguaaugugaauacagaggucuugggcagaaagugcagcugagcuucaggaaaugucucugcuucucucugcacacuggugugccacccugggcugacaugcuaucugccucagcaugcauaucgccaaacaugcccaccacacagccccuaaguuuauuugcccacacuucaaagcaccagggaguaacucugauucucaauuccaaauucccaggagagagaaucugauugguugagcauagaucaggccuccacugcuggccaaucugccguugccaaggauuuagauucacugagagacugcugggacccaacucuguagacgucuggugagggacacguguagaugggucuagcucucagagaaggugauuauagauuagguagaugucuuucaacuuuagagaauguuuucauuugaauaugggaaauuugggauuugugggggaaauaagucuuauaugcacagaaagguaucagaugguggucauagcccagggaauacagccccuagcaccauaucagauccccaaaacauuuucuaauagaagaaauacauuacagagauggauuccauuuugaaaagugagacugguuugucccucuuaaacucuacucugauaauuuucaugcuacuuuguugcucaacuuaagcuuuaaaaggguuacuuucucaacuuuuuaaucuuugaaauguauuuauaggguuuuaaaaaacuccuggccuuccucaaugagugcugaucuacauuuuugauggguucaauuuuuuuaguuauguuuuaaauugacaaauaaaaauuguauauauuuaugauguacaaaaugauguuuugauaggugucuauauugugggauggcuaaaucaagcuaauuaacauauucauuaccucacauacuuauuuuuuugugaugagaacacuuaaagucucucuuagccaauuucgaguauacauuguuauuaacuauagucaccauuuugugcaaugaaucucuugaacucauuccuccugacugaaauuuugcauccuuugaccaacaucucuccuuccauauccucccauccccuagccgggguaaccaccauucuacucuuugcuucugugaguuugauuuuuuuagauuucgcauaugagugagaucaugcaguaauugucuuucugugccuggcuuauuucaccuagcguaauguugauuggccacugaggcagaggaaaaacugucaacacaacucuccaucagccccaucaggccauuucucuuuccaguuagcuuccuguuuacaccugaaugucuuuugagguccaucaaacaguguuuucugaaggauaccugcaaacaagauuauucuaauggcuaaaugcacagggaguguuggggagaugcagauggaguugguaucauauucuacuaggcuacaucaccaauagaacaauuggaaagaauuuuggggccccaaacacaccuguuacuaagccacuauuauauauugaggguaacuaacacuuuaauuagcccaucugucaggaacacaucugcugagaauuucuuuauuguuuuuguccugugaaucccuuuggcaguuugaugaaaccuaucaauuucuucugaaagcaauguuuuaaaauacauaaaauaaaauacauaggauuacuaaaauaaaauauauaggauuaccaaggaaaacuuuuauacugaaacaugguuaagaacaauuuuaaaaacuauuucauaaucugguaauuuuacauuaaauaacacgauuugguggcaguucuaguaacugcugaauuucaaagcugugaagaacacgaacaauauuucgauauaucuacuaacaacuguaaugugauaugaaaauaacuuugauuucaauuggugacaaagucacagguacugguaauuuacuguggugcauugacuacauucauaauugaagaaguuaaauuucagucuagagaugacgguaaugguuguacaauguaaauauauuuaaugccacaaaacuguacucuugaaaugguuaaaaugcuaaauuuuauguuauguauauuuuaccacaauaaaaaaaaaacaaaaaaauuaguagagguuagugacaauagagauauaacuuuuuagcaguccaaguuuacaaccccucugaguucuaucaguggugccagguaaaaguccauggcugauaacuuaugcuuuacagauccccauauuuuacugauucagaucuccuguaccccagguaugacucuacccuaaggaaaaauaaauggauaggaaucauuccuaaucccaucagccugguuuaauuacuguugagacaaagggucuuuuuguuuguuuccauauaauuguauauuuuacaucaugggauuauauagaacaaacaauuuuauguuccaauuuuuuucauuuaacaaugguagcauaaggacuucccauguuauuauaaauucuucauaaacaucauuuuaauaguuaugccauaucccauguauaagcauugcauuauucucuuacucgugaauuuuugaccauuuagauuguugccauauuauuuuugcacucuacauacuaccaacuugccagaaagguagacucccuaacccucccaucagcagagaaugaaagcaucugucuaacaucaagagauuacuuuucuuucuuuuucuuuuucuuucuuuucuuuuuuuuuuuuuuuuuuuuuugagacggaguuucgcucuuguugcccaggcuggagugcaauggcaugaucucagcucaccgcaaccuccaccucccugguucaagugauucuccugccucagccucccaagucccugggauuacaggcaugcgccaccacgccuggcuaauuuuguauuuuuaguagagacgggguuucuccauguuggucaggcuggucucaaacucccaaccucaggugauccgcccaccucggccucccaaagugcugggauuacaggcugagccacugcacccgaccaagagguuauuuuucaaacucugcaccaaagcuucugucucuaaagaaauaucucauaaacuuuggacccagagcuauuuuagcauagugucuacaacagcacucaauauucacagccgcaaguguuuugacuccuuugacugcaaauguggagauagaagaggaauauacaaugcucucacugagccuuucugugauuuaauaacaaggaagagauggaguggggcuggcccacacccuucaucacaguuauacaugggccagccuagccagacuggaauuugaauggcugaguagcauaggugcuagggagugguuccucugugcucccagcaggagggaaauccacuacuaaucugcacuugcuucuaugcccacuccugcuaccagacacuccucgguguaaugugauucuccaugggucacucuuauuuuuauuuuguuaaugaagaauuucaaucaucauagaaaaguagagaaauaguaugacgaaucuccauguuccuugcauccacaaugaucaacucauggcagucuuauuucauccauauuaucauccauuucuccccucaaaguauuuugaagagaauuccagccauuauuuuauuucacuuauaaauauuucaauuuguaucucuaaaagauaacuugaaaaaaaaaacuacaaucucauuaucauacuuacaaaaauuuuaaaaaucccuuaauaucaucaaauagccuugacuaaucuuguucuucacugauuuagccucuguagaugaugcuuuucauuaucaaggucucuagauauugaaucaaggaagugggccauauagucacagcucaaguccauucaaggcuguaucuagaucucagucuaggauaugugcugcaguuuccuucugccuucucauuguuauccccagguuccagucuagaggccgaguaaacccagaagguagccugagguguuggagucaaucuugaggagccuguuccuucagcugcucccguauugucuugauguaggcugaccuagaaucaccugauucuuggcuacuaccauagacauuauugcccuuuuaucaguuaggauuagguucaacuguguguaacagaaagcaucauccaaaaccaaugauauacauaaguguuuguuucucuuuuguaaagugccaaaauaggcacuccaggguggccuuccacucuuaucagggaccuguguucauucuauccuaggucauaauucuuaguacauucuuagugcaucgccuuauaguccaagacagcuguuagggaaauggcaaccauuuacccucuggcaaagaaaggaggaagaggggaagggcaaaaugauacucaucuuguguccauccuccucuuauaaggaauuuuccuaaaaguuccacccugcaacuucuacguuguagcuagauucaaucauaugaacacaacuagcuacaagagaugccauggaccuaaaacaaguaccacucaguauauuauggaguaccuuuuauguacacagaauuauuguaaguucaguggagcaucauaaaaaagcauagcaucggccccauccucaaggaacuauuauucuugcuagcuacuuccagugcuuccuguuguaaauaaaauuccaggcuuuauuaugggaguaccacaugccugaggggugguggccacaaguuuugauugaccuucuuuuuuuuuuuuugagacagagucucacucugucucccucggcucacugcaaccucugccuccuggguucaagcaauucucuugccucagccaccacgccuagcuaauuuuuguauuuuuaguagagacaggguuucacuauguuggccaggcuggucucuaacucacagccucaagggauccaucugccucggccucccaaagugcugggauuauaggcaugagccaccacgccuggccugauuggccuuaagagacuaaaagaaguagauuggaagcugccacuugaauucagcagcuaaaggauuuagaacuauuugaaugaaaagaaauucucauguggcucaaaaacguuaaaagauugucaauuugauauguagagagagaaagaugugaaugaguuggggacuuagugaaaacauuuuagaaaaaucagaguuuuguaaauuagaucuugucuaccgauaacacauguuuauuuuacaugcuauugaauuccugcuaaauguuuagagaauguuaggaaguuugacgaggacuaauacccaguacugcaaauaacacuuuaguacaacagucuaaugcaagauauucuuacuuuuuggagggaaagugugucuuacacauaucaccaauuuucuggcaagauaaucaauucauccuucugacucuuaccucaaucagcccccuagcuucuucagucucuuucuugugcuggcuuucuuccuauguguguucauauuucauggauuggugaccagaaggaucaaaugggcaauaaauaugacaaauaguacugauuuggucugaaucuaugugucuucccuacuccuaauuccuaucaugaaaccuaacacucaauaugaugguauuaggaggggaggccucugggagguauuaggucaugagggcagaacccucaggaaugggauuaaugcccuuacaaaugagacccuggagagcuagcuggcuccuuccaccaugugggacacagccagaaggcacugugucugaaccagaaaguuggacccucaccagacaccaaauuuguuggugccuuaaucuuggacuucuuagucuccagaacugugggaaauagauuucaguuguuuauaauccagccaguuuauaguauuauguuauagcaacucaaacagacuaagacagaaaauuggcacugaaauugggaucauucuuccauugucuugaacaauagguccugguuucuguuuugauggcugacaaggcuccuuauuaaauggugaaauggucauuuggccacacccuugguguuuucuccugaacauguuucucauuuuuuauaauauggguaggcugaaaauuucccaaaucuuuaaguucugcuucucuuuugauuaacaauucugccuuuaaauuauuucucucuucuugcauuuuacuauaugccaucaagaggaacccggucucucaacgcuuuguguacaaauagcaucagcuaaacauccaauuucauugcuuacagguucuaccuuccacaaaacacuaggauaugaacacaguucagccaaguuauuugccacuuuauaacaaggguaaucuuuccuucaguuuucaauaacauguuucugucuaagacuucaucagaauggccuuuacuguccauauuucuacaacaaucuguucaggauuacuuagguauucuuuaagaagauugaggccgggcgcaguggcucaugccuguaauccuaccacuuugggaggcugagguggguggaucacuugagcucaggaguuugagacuagccugagcaacauggugaaaccucgucuuuacaaaaaauacaaaaauuagcugggcaugguggcuggcaccuguagucccagcuacuuggggcacugaggcgggcgcauugcuugaggccaggaagcagagguugcagugagucgagaucaugccaucgcacuccaacacaggcaacagaaugagacccugucucaaaaaaaaaaaaaaaaaaaaaaaaaagaaaauugagacuguaucuaccgcucuccucuuuucuuucugggcccucaccagaguugcuuuuaauaguucauucacagcaauguaggcuuuugcuagcaugacuucaagacuuccagccucuacucuuuaaguuuaagcaguuccaaggcuacuuccaguuuuagguauucauuacaucagugcuccaaguucuugauaacaaugaauaacuacuguucugagggugguggauggugauaaggguaggacuaaaaagagagaaccucuugguuuucacaguuugacagcagggcauauuugcucauauaaaacucuucgauacaaagaaacaauaaguauuucuuuaucuugucuuuacccauauuuuaauagaaccacaacaacacagaauuuaaaaguuaucuuagagcuucaaacacuuuguuuuguaccuagggaagugauggcugugauauuuauaggacuggugcaguauaauagauaccacccaucuauguagaaccuacagugcuuugggcacuggaccaggugugcuacauucauuguuuucaauccuuauaaucuuccaagguauauauuaucaugugaggagaaagcaauguauaauaagguaugagaauucucaaccucuccuucuaccaaucccaguucuguuccuggacuuuuaauaagcugauguggaaaaaugaaugacaagacugaaaggaaacaaauuugcuugguugauuuucacuggaaagggcagagacuuacuaguggaagagaaaagaguaaauacagaaggugagaggagaggagaaaaggaaagaggugucuucugaugguuugaagugauuugaagaguuagagugagagaaaauggaaucaugggagacagauauauacauggagagggguaagagggauuuuaagcauaucuuuaaauugaagccucuuuugguguuuuugagaggauucaauaaauaauuugaauuuauuuucaauuacuuuuaaauauuggacuggaugaaacaccagguugagauaggcuacaaagugccccagcuuuauauggguugcaguccacauuuucaaaugaagaaauugagaauugguuagguuaaaaaacuugcaguagcuuguugaauuuauauauauauguauaauguauauguuauguauauaugugugcauguuuuuuucauagaaaguuaaaauaaagauaaaaccggagaaugagaaaguuucauacuuuaauuucuaguaauaugacagaguagacauccugagauaaauaacuuaaaauuaauuagcugagcugccaagagguugcugaaacucuuagaguauaaaacaauaagaaagaaagaaaaaauggaaaaucugaauaguuucauagccauaaugguaaucgaaugaauacuuuaaaaguuuauaacaaagacagcaggaccagaagauuuuauagacaaauuuuacaaaauauuuaagguguaaguaauucuaauaaugcacaaacucuccaggggauaaaauccaaggaagugcuccucaaaucacuucaugaagcugacauuaccuugcuaucaggaccagacgaggacagccagugaaagaauaauuacaucacauuuaugagaauguuugcaagaaucauagaaaauuaaccaaccaaauucaacaauguauuaaaagauaauauaucaugaccaaauuuggauuaucugaggagagcaaauuugguuuaauguuagaaaaucuauuuguguauuuuauuaacauuaagagguuaaaggagaaaaaaucauauaagugucucaaugguguggagaagacauucgacaauucaacauccauucauguuuaaaaaacaacaacuuuguaaacuagaaguagaagggaaacucuuuaaccuuaugaagggaaucuauaaaacaccugcauuaaacaaccagauuaccaauaaaacuuuauaaagcaaucuauguaaaaucagggagaagacaaggaugucuaccaccaccauuucuacucaagacuguuguagagaugcucgcuuguaaaaauacaagaaaaagaaauggaaaauauaacgauugaaaaugaaaaaaaaaucccuucuuauuugcuaaugguuguuggucgaaauguuacuaccaaauauucauuccuucucuauaauaggauuuuacacccgcauccauuuuuagguacauuacccaugagacacauagggagcgauuaagugcccuccucccugacuuugggcuuggccaugucacaugcuuugaccaaugggauguguuaaugugauugugaaugguugacuugccuugcuuuuugcuccugaccuuggcuaugagaacauaaugcccuccauaguggccgcuguuucagcuugaaucccagagugagaagacaugucaaggccagccaggcccauaaaaacccagagaaauugcagucugccacggcuuuaauccaaugcaagacaauuuuuuugugugugaacuauuaagcaaaaguuuauugauaaauacacuggugauaugaacaucuacaaagaaaacccaaaagaagcuacagaugaaucauuaaaauuaauaagagcuuagcaggguucaaaaauugccuagcgcaugucuaauuuccagcagcaaacuguucaaaauauaauguguaaaugcuguuugcaguagaauuccauuaaaaauacaaguuagcuagaaaaauaauuuuuaaaaauauguaagaccuuuauggagagaauugcaaauccuuauugaaauauguuuaaagaccuaaauaaauggggauaaccaugguucuauugaggaaacauugaggaaaacuaaauauuauauaaaugucaguucuucacaauuugauccauagauuaaaacuaauuccaaucaaauguucaaaauuuuucuucauagaauuugauaaauuuccuaaaauuuauauaaaauaacauggucaagaauaagcaagacaaucacaaacauauguugaugacaaccagauauguuucuaccucucauuugagcuugagauugaucuuuaguugucugcuagccuuugcauaauauaaugugcacuuaauaguucuauuuauacagauaacauuuauauggauauaucaaauucaguaugaccuaaaaugaagucaucauagcuauuucaaggcagcuucuucuauuauguucuuuaagugcugaauggcccuaccaucuucccagauaccauaguuaaaaauuugggagucaguuaaugcucuuccuuuuugucucauaaauaucuacccagucacucaaccacucuccaucacuacugccauugccuuaguucuggccuuugccuuugcucagacuauuugagauaaccuucuagauauucuuuguuuccugucuuccuuuaccacagagugauccuucuaaaucugaucauaucaaacucugaugaaaacucccaucaccuucaggauaaaauccaaacucauuuaggacuuguccuccaucgucugcccauguaucucauaauuccauaugcaucuuuugccccaacagauuaguaucccuuaguucuucaagcaugccaagcuguuuuucugcuuuucuaccuggaauaucuuuccuucucuuuuucucccaucuacuugauuaacucaaccauguacuucaagacagagauuaagugccauauuccugaguuuucugaccuucuuugaucccuucccacucucauauguguaaaauugucuuccuccaaagcauuuaucaucuuguugcaauaauugauuuucuagucuguuccccuguaagauuaugaaucuguuuaggauacagaauacaucuuguuuauacuugacuauuuauaucuuagaugauuaugaaauguuuguccacucuuugcgcuucucauaaaaugacaacucucuaacacaauccguaaauccuuguguguguguguguauuaguccauuuucaugcugcugauaaggacauaccugaaacugggcaauuuacaaaagaaagagguuuaacuggacucaaacagcuccauguggcuggggaggccucacauucaugguggaaggcaaggaggagcaagucacaucuuauauggauggcagcaggcaaaaaaaaagaguuugugccgagaaacucccauuuuuaaaaccaucagaucucgugagacccauucacugucacaagaacagcacaggaaagaccuguccccaugauucagucaucucccacugaguugcucccacaacacacgggaauuaugggagcuacaagaugagauuuggguggggacacggagccaaaccauaucaguguguauaagaaguucuuccugaaagcaauuuucauuguaaaaaguugcccauuggcuauguaguuuucaaugaggcuugcuagaucuguucauaaauguagccccugguaguauggcuuaaaagacauaucuaaucugcaaauuuuauuuuuauuucaguuaaaaaaucuggauccguuuuuacuguuugaugaauuuaaaggagguagaccaggaggauuuccugaucauccacaucgagguuuugaaacaguaaguacaauaauuugacugcagaaguguguauuuugaaacauaccucuuucuucuaauagaaaauucaauuuuaaaagcaauaaauaauaggcuaaaaauucauuuauaaguugcaggcuauuuuacauaagauauacucaaauuuaaauauuuacuguuuuuaguauucuuugaauuuaugccaccaaaaacauuccuauuugugcaguuaauaaguuggcuuauuaaaauauuuuuguaauuaaaauaauucauuggggauagaauaaacuauuugugauuaaaauacuuuuuuauauagaaaaccuguuucuaaucaugucacuacgcuccauucugggcaacagagugagaccuugucuuagaaaaaaaaaaaaagaaagaaaaaaaccuguuucuaucuuguuucuauccaagaauguucagauguguguaaccuccuguaauauuauaaacuccaaaaaacaaucuaagaacuacaagaguauuuauacuaacuucuaaggaauuauagaaucaaggggcccaaauauaacauagccuaaaaauuaggauuuuaaggacauacauauacauuuacuaguuuaauugcaaaauuuagagauucuacugaacacuuaauauucagcuuuaguuagauacagaaauaaaauguguaacauaauauuguggcacuuucaaagauucucauuguccacacacauauauucuguggaagcucagggaucguuacuuccuaguuacaauguuuaaccaucuacucaccagaacaaccugcauuaguagggaagagaccagggcuuguuaaaggcucaguguguuuauaaacccaauuagugaaugaguaaauauuuauugaaggcuggcgauaugcaggcguugguguagggugaucuuuuguauguuaggguguguuguguguugggaagugugagcagaaggcagagggagggaggcuaaagaagggugaggcaugaucccugcuugccucauaugcagucuaguuaaggagguuaaagauguuugggaaagggcaccaccacaguguaaagggauaaugaaccaagaaguuucuggaaguaggaucaggguaguuggacucuuuucccuuccucauuuagccauucgccuuccaguucccuucucugcuaacacguugaaggcgcuguggcuugcuuugcagcaauaauggaagccauuccuuucaccuacccuacacucauacuggauucugacccuguuccuggaagaugucuccacucugugcuccugcucgagcuacuucuugugugcuccaucccauagcuccacuuaccaccuuacuaauccuucaaggucuuuucggauaucaccagcuccaucaaauuuugcagacaaucccaagaggaugcacuuucuccuucauuugguccucaucgcauuauauuuuuaccagucucaugcacauuaugccuuuuugaugaccuugauuguauucuaucugucuugcauuagaauuggggauugccucaaccuccccucacauacccaagaggaucauaaauugcuucagcugagaucauucucuguguucucuguguggagauaguaacuacuggcugaauuuaauuggauaauaaaaaguugaagacaaugaauauauuaaauaaaaugaaugauuaaauauauuacuuugauuuccauuauggaaaaugcuuucugggggggggggaauacuuuauaaauuauaagguacucagcuuuaagcaacucccucaaggagugcagcuguagaauauuaauguuuggcucuuuuaagaauuuucuuuaaaacuguaacuguaauuauuugucaguucauuuacuugcuaaaauucauuuguaacccccaaaucaguaccuguggugcuuuuguaguaauuugugggcauguguagaguggcaaaaaauuugagcugcccaaugcacacauucccagcugagguugaaugaagcgaugcucuuuuuuucuuguuucacaagaaagugaccuuucacaguguauuuagugccacuuuguccaccuuuugugcuuuguguggguaauuucacuguuuaaaauggcucccacacacaauacacuaaugcugucuaguguuccuaaguguaagaaggcugaaaugugccuuacggagaaaauaucugucuuagauaaacuuuauucagguaugaguuguaacacucuuggccuagaguucaauguuaauuaaucaacaauauuuguuaaauaaggugucuuuaaagagaaauaaacauaaaacaaagucauguauugaucaacugagcaaaauauugugaccagaggcuugcaggaacacaauccuguauuuauccuaggagcaauggucuaguauucucuaauucagugaucauggcaacuauauagaacauuuuuucuauaaaaaugaugagaaucaacuguaucaguuuuccucaggaguguagguaagccagagacucaagugguaagccauuaucucuuaaugugagcuuuaaaaggcugaaauuuaaagccagccccacuuguacucucucaucaccucccuggagcauuuucuaaauuauacaggcuuguacauuuugaaaaugcugacuaggauaaagaacaaauuuagaaucaccugugauguuagcucaccauccagaaauagcuauuguuuuuauuuugauauauuuucauucaguacuuuuuuucugguaccacacuauguuuugcaucuuuuuguuagcuuaguauuauacuauaagcauuuaaaaaauauuauuuaaaaaacuaauuuuaauggccucauuaagcaucugccaugaugguuguaccaacugauaucaccacagugauguguucugaagguuccuguuuucccucaacaucagcaacauaaauguauuuauucgacuuuucugaccuuugccauuuuuacaagugaaaaauaaugcuuuaugauaguuuuaauuuauauuucucuuauuugagcgagauugauuuuguuuucauuuuaaaacauucauucaccauacauauuuaauauucuuggauuuuuuuuuuccugcuggguugcugguauucuuuuuauuauuuuauagaaggucuucauauauuaaggaagucagaucauuuucagugauaggaauugcaauaguguuaagagggauugggcuuguuuuguaugccuucagagguaaacuuuugaauacaaagcauagauacaaaauagaaggaagaacuuuguaacaauuaguuaugcaaagauagaauaacuaauauaagcaugcacuggaacaacauaagcauguacugaauggucacauacuugauguguuaucaggaucaagguccucaaaauagugaugugcuggagcucccauuuauuuauuuuuuaauaaaaaugaaauuuuacuaacacaugaguauaaaauguaacuaauauacauauuuugagugcacacucacauuuauuuuaacugguagugauacaugaucaaagaaauguggaaaauauuauucuauaaaauucucauuaucucaggugugacccaugaaccagcaguguuaucauuuguagccucagucuccacuucagagcucuggaucagaaucuacauuucuacaucaucaaaugauugauauacacauuaaaauuugagaaaugcuggucuagaucuuccaaaucagaaauacgauucuaugagauaaguaagagagagaacccaauuuuacuggguuaauggcuaagccauuuuuaaacuuaacucuuagguuugaauagcuauauauuuucuauuaaaaauuugccugaaaauugagaaggcguacucuagggaagaggcacagcugguggucacaacacaaaaggagaaaugcauucaguuuuuccuaccaggaguuuguuuucuggggaggauuguuuuucaaaaggccugagugguaaaaggugaaauacuucugcauuuacccuguuucuggucaggccugauauugugauuuguuuagggcaacuucaguuaucagaaacaaagaacaaucagagacaugggaaagucccgcuaaaguuuagcucgaaaaaggagguacuuauagaucggacuccguugaugaaccucucaccuaccuuaggaagaaacauguguugugccuuuugaaaucauccuuaaaugauagccucuggacuuuucagguuuuagcacugaaaggcuccuguccccaggaaccucucaguccuuagcaaacugagaugacuggucacuccuguuuaauuaaacuuaggaacuauuaggagaaaaccauccugccugcuuuucagggacauuuuaggauggccuugucuacuguguucucaguuaggcugagaaguguuuuuaaaauuuuuucacuacaagccucagcaaguucuuugauuuuguucacgagaacaaaaccacccuguuuccaaggguguguccaucagaaaagccacgcucauaauuacuuguugguagccgacaguguuugcgugcaaugccugaacaauacccaggagaggaagggaaagguccuggugauucacaccuaaaacuuaugacccgauucaaaccucccaccucccacauagccuguuuuuuuuuucuagcuugcugugcaccacuuucaaaagcaaacccuaccaucaaggcugaaaaaaaaaacuugauuaaauucaacauccauuuuggaaaaccgggaaaggauacuuuuucaauaucauaaagacucucuauuguucagggagcaucuuuuguuauauuuaacacugagauauuagcuauauuccuauuaauaugagaaagaagacaagacugucuaccaguaccaucacaguuuaauaugguucuggaaacuuugaagcuauuaauaaguaagaguuacaguguuggaaaggaggagaaaaauuauuuguagguaauaaaauaagaaugaaacucacaguggcuuaauguggcuuugguuguugauaugacuggaggagggaggaaggcucaggauuuguccugaaguugugauuacagugaagcacacaaaucuuagcauauauauucauuuggcaugauuugagagugaagguaacagauauaagaaggaagcuaaagccaccucuacucucaagacaccccuuggcaccacuguacuaagaaugucaaccaaaaccuauuaguaaauggcuggauauaaaauaacuaugaaaaaucaauaauucuccugcuuaaaagcaauaaucagauguaauggugguguuaaagcaaacuaaauauggcuugagaaggacucuguauuucuauauuugaguccuuguggacgcaccauaaccuaaauuaauagauagacaauauugaaaaccuaacuuagaaguaugugccuguaacaauagcugggucuuggcuaaucccagcagccauacuucaaccacucauacacugcugaguguucaaacaaggcaaacacuuguuugaaccaguccagcuguuucuguaccucacuucugauuucuguaugucacuuuccuuuuguugucuauaaauuuguucugacaacguggcaucccuggagucucucugaaucugcugugauucuggagacugccagaucugcuaaucauuuuuuuuucuugguccguuaaacucuguuaaauuuaauuuguccgaaguuuucuuuuaacaggggaaagcaucguauucauaauggcaguaagaacccgauauaauucccuagaaaaaaguuauucuccuuuaacccaguaacccuacuucuaugacucuauuuaugggaaaaauccaaaguaagaagaaaggcuuauuaacaaauguuuauucugguacaguuuuuaaaaaauaaaaaacagaggcugggcgcgguggcucacgccuguaaucccagcacucugggaggccgaggcgggcggaucaugaggucaggaguucgagaccagccuggccaacauggugaaaccuugucuccacuaaaaauacaaaaauuagcugggugugguggcaggcgccuguaaucccaguuacuugggaagcugaggcaggagaaucguuugaaccugggaggcggagguugcagugagccaagauugcgccauugcacuccacccugggcaacgagcaagacucugucucaaaaauagauaaauaaauaaauaaauaaaaauaaaaaaguauucaaaauaguagaggaauaauuauauaucuagaaauuaucuauaagaaaauuauauauuugaaagauggaauguuaugcagcauuaucuauaaagacaaauauuguagccaauuuaaauauucgucaaucauaaacuguuuagauuguuuuuuuuaaccuccacaacuagugacuuuuuggaugcauaauucuuugcuaugggggggcuguuccacgcauugcaggauguuuagcaacguccuuggccucuacccacucggugccaauugcaucugccuacacccaguugugacaauaaaaaaaagucuccagacauugucaacuguccucugggggugugagagagggcaaaaucaccccuggcugagaaccaguacuuuaaauauauguguccaauagcauggcuuaccaugcagucauuaaggagaaugacauggcuugauagguccuaauauagaacaaucuugaugauauuuggaaagugacagaggcaaggugcacaauucuuguggcauaguguagcauuuauauaaaaagcaaaaacuaugccuuuuuucuuuuuuaaauggcuuauugccaaguuuauuguggggaagauggauuauuauaaugaaugauuauuucuacagacuauccugaugcaaauaaaauaaaauuacaaaauacauguuauaguacccaaagaagaugguguuuaaagagaaaaugaacacaucauaacagguacaaauauguauuuacaaagcuuuuuaaaaaguagugguuuauguacuuauaggauuacacaaccaucacugcugauuccagaacacuuucaucagcccagaaaguaaaccugaacucauuaucagucuuuucucauucuuccuuccuccagcuccuaggaaccacacuuucugucucuauuuauuugucuauucugacuauuuuauauaaaaggaaucauaugguauguggccuuuugugguuggucucuuucacuuagcauaauguuuucaagguucauucaguuuguagcauauauauuucuuuauaugccugacuaauauucuauuguaucguauggauauucuauuguauggauagaccacauuuuguuauccggucauccauugguggacacuuggguuguuuccauuuacaccuuuauucauagacuugccuggauuaucucugaaaggauccccaagaaacuuguaaugugaccucuagggaagguuagcgggugacaagggaaaguuguggacaagauuauugguuuucgcugaacccuuuuuuucucuuuguaccuuuagaauguucaguuguauuuguuaauuauuuaagaaauucauguuuucaaaauuucuucuucgcauaccagccauucagauauuuaaagaugaacugugcccucaugguuagugaagguccugaugaucacuuguucuccaggaacucuugcugaggccuccuacuuggguuugcccucuccagauaaagugaaccuuaccuguguucuauuccugucaaccagauaagcuaauaauauaugccauuguguaauggggaugaggacuuucucuagaaaacaucugugcaccauuagaggggcgcaugagauuuaggagugccuuaaaucaaaagcauaacuuucuccuccacaacacauugccuagcugaaaggauauuaaaauagugagugcacucaugaguuuagaaguggaggcagaggacuuucaaauugcaugaaaguuagaaaauaauuaaggaggaacaagauggguauaguugaagaaguuucauguuuugaggcagaagcuaucccuucuaacagaaggaucugggagggcuucagggaaaauuugcccauuuaguaaggccuuaaccaauaaguaagauuugacucucuggauaguggagguaaaggugaaagucgcgguauggggauauaguagaaacagugagucaucuaaucgggcuuacaaaugggauguggaaggaugggagguggaggaguauuauagggucuaaaauuuuagguugggccauuauuggggaaggcccaagcuucgaagcccaagcuugaucucuagcuauagaugaaugaacaauauuucacauccugaaacugucaacuuaacacaaucacguuaaaauaaaaccaucuuuagccuaaaaguucugcuuuuuguggagugcugucuaugucagugguucucaacuggaggugauuuguccaucugggucauauggcaauuucuacauuugaucuuagccaaaagcccaagaagugacucauuugcaauuucuguagucauuucugagugucacaacuggggagugcuacugccaucuaguggguagaggccagggaugcugccaaaccuccuacagugcacaggccacuucccacagcaaagaauuaaagccucgucuguguuaacaagcguaggucacaugagggagaguagaaauuuaacugaaauauucuuugaaaguaguccaaauaaauucccaacaaauuucccuauacauccuacccacaccacauugcaauuacaaacaaaaaccauucaugucuuaaaggcuacauuccaagaguuuuuaaguagaaaaauugaguguuggggggguggggggccggggugcgcugggcgcgguggcucacgccuguaaucccagcacuuuuggaggcuaaggcagguggaucacuugaggucaggaguucaagaccagccuggccaacauggugaaaccccgucucuacugaaaauacaaaaaauuagcugggcgugguggugggcgccuguaaucccagcuacucgggaggcugaggcaggagauucgcuugaacucaggagguggagguugcagugagcugagaucacaccauugcacuccagccugggcaacaagagugaaacucugucucaaaaaaaaaaaaaaaaaagaaagaaagaaagaaagaaagaaaaauugaguggggggaaauguaauaaagacuauaagccaaucauuaaaacauuauuuuauaucaccaaauauaaaauaaagcuuuucaagugaaacgagaaauaaguccaaaguaaauuaacauagaucauuaaaugauaaaaagcuucaugcaaauuguccacacuauuaacaaagcugcuucagagucauccaaucaacagacucuuagaaucacaggccugacuacacaggauuaaacuugaaggaaauuugccaugcaacaguauuaacuacugauauaugagaagcuucauauguugauacguuaccuguaagccucaaaacaaucuugaaaaguaaaaauuguuaucucccccauuuuacacaugaggaaacuaagguucagggaggcggugacuugcgaaguucacacaggccauacagagcaagauuuggugggcccauaugaucccaggcccacauuuguccacucuuuuuugcuaccacuccuucuggaacaaaguucccuuucuauauaucugauauuuucucaauacuuugacacauucagaugauuaaaagauuuuuaauaccauuagaaaugagauugugcaggugacauagaccauaaaacuaugaauaaacaccccauacuccuucugccacucacuuacugugggaccuaugcuuucaugguccagggaucugaauuuuccuaucuguaaguccaaaauagugcucucacuuguccucugaacuuccaguauaaugaggaaauggguuagguugauuguaccuggcuauuuaaggacaaucauuuaccuuacuucuuauagcugcaacacuguucaugaucuaguaguaacaugauaauaaauucauguuucagucgcuuauaacuuacuacaaccuaauuuuucccucuuucuguauaccuuuucuccccacccuaccuuaauuuuuucccccaaauuucuucuuuuuaagacccaccugggaggauuccuccuccacgaauuacucccucauuccucuggaaucuuugucacaaucaaucuuucuucuagauuugcuuguacuucucuuuagcuuucauuucucuugucugcauauuuuagugguuuaucuucugcuagagugguagcucccugaagguauggaagcaaugaccacuguguuccuucuaggugauuccugacuuccuguuugugaguuuguaaugacauuuuaucuugggugggccagaacgaaagaaagaaaaagaaaggggagggaggaaugauuagcaaaguagugggccuuuuccuagagauaaauuuauuuuauuuaaaagacuguucuuuauucagauauugcuauucuuccuuuuuuugguuguuagaauggccuuucuuuuaugaaaugaugaccauaguagauaauuuuuaccuuucacaaucugaauuuaaaaguuggcacccccacccaccauugaggaguauucuauaaaauacuucaccaguacucuucaaaauuaucaagcucaugaaaaacaaggaaagagugagaaacugucacagauggaagaaaccaaggggacaugaugacauggauccugaaccaaaaauggauauucauagaaaaacuggugaaagccacauaagugauauacuuuaguuaauggcaguguaucaacauugguuucuuagucuuggcaaauguucugagguuauauaauauguuaauggcaggagaagcuggguggacucuccauacuaucuuuacaauuguuauguaaacuuaaaaauuauuccaaaauuuaacuuuuauuuuuaaaagacuaaggaaggcaaaaaauuggcaucccucucucagaccccuuuauuuuaaaauguuuuauugcuucuugauguccaaaauccuggggccuggggcccaauaacaucaaguucaaugaucacacucacucaaaguuugagaaauuaaaucuacagugaauugaaucagggaaucauaauaauaacguacccauaaaaaggugucagcugcuuaauuaaauauuguuauaaugaaauuuuaacaaaauauuaaaaggaaaaucgacaugagucucugaaaccucuuccucuguaagaccccugugagucccaaaccugcccaagaccauaugugcaaacaaguguuuucaggcacuucauucuuaggcaucugccuuaacaacuuuuaacuggagacuguacuaagcagaagaacuucccucuaugccacaacauagcugaucccuuaaugacuagauggcagccugccacagugacacacagucuuuaagcagagacgccaugcaugugcuacaagacauauuuaguaaucaguggaucuguuggcgagacauaggucugguuuggugagguuugauuuuaggaaaagaaugagcacacauaauuugugucagcagagggcucucuuaagcaacaauaguuccgacuacccguuuauguggaaauuuggguagucauagaaguuagcaaaccauucccuucaggccccuucaguauaacauggaaauuaaaacaauggaaaugaacaucuugagcacaguuuugccagauguagguggugccaguuaagaaguugggcugcugauuacauggcgacccaggcauagcuugucugaagagauuccccaaaacauuuauuccugaucuggguuugaaggagaaggggcaugccugguccugggguucuagaagcagcuggaaguuucugagggaguuuguaauucagcucuuuugaguaguuagguuugggaauaugauuaucauagaaccuugauguccaugucagaaauuuuaaucagagugaaagaaaaaaauagguuugggagacuugagaaugggaacaacguaaaaaaauaagagacaaauaagucaguuguucuuuucuuuguaguuagaugguagguagaacucuuugauacccacaccaaagaaggauuucaugaucaccucaucucaggauccuguagcuuugggaucuuccauaaaccuacucccuucacucagaaaucaugaggccuauuuucagcuuuguguauauuagcaguaggacccuuucuuugccugaaauagccaguuugccugaagccauugaaguuggcaaaguccccuuguuaccugugugaaaucccugcaguucuggcuccuauugcaauugucaugggauuucuccucugagacaagcccugugcucccagcacauacguuacuggcaauaugccgucagcauuugugaggcagcaugggggugggggagugaaaguaguuuuauucucagggacagauaauguuguuuuagaucuuuguucugcuauuguuaacuguaaccuuaaucucacuaagccacgauguuuucaucaguaauauauaggugaucacauauuuccaggaucagaugcuuuguaaaugcugaaaugcuaugcaaauauaagaugcuauucauccauccauccaucgauugauugaucaauucauucauucauugaacaaaucuucagugccagcuguaugcuaggcaccauaguagcuaaguuaaaaaagucccugccuucauggggcuuacauucucuuaaugaagacagacaauaaaugaauaacaaauaauuacauaauauagugucccauggugaaaaagcuaggaagaagaaacaaaccaugguuggaggauacagaauugauugauaaauuagaccagaugggcugguuggagguggccuuucuuaggcaguaacauuugaacagaggccugagugaagcgaggaggugaacuaugagacuguuggaggggguagggggaacuauuccaggaagcgugaaugaagauccacgaaugggaucucugcccacggagcugugguagcugugccaacucuaggacuuacccaucaccuguuaugggccaggugcuuugcacacauuacucacuuaguccuuaccacucucggagagcucaccucccaggucuaugcuguacaugaggagacugagccuccaagaagugaagggacuucacccugcauaccaaaccugguaaauggcaaaccugagguuugcaccagagccccaaagccgguguaguuuuuggaggcagggccacaccugcagggggcagaguggcgggagucucugaagcacuggugcuucugcagggugguggcagggaaauguaaggcaggaccugguagagcuuuaaaauacucggauuuauccauuggccgaauaccugaaccguguugguuaucuuuuccuuuuuguuaaaaccaccuuuuggaacuugugaaggugcguaugugggguugggauugggugagucaauuuagucaauugggugauuuucccgguuucuacucaagucaugaaaacauuuuuguaaaauaacuugaguccuuaauuguauggauucagacauccuugaagaccaguuagcagcuucuauuaugcaauauguuccuugcuggcaucucucaucagccaugaccucaacucguguuuuguuuuguuuuucucuuuuuccuaccaagccacuaguagacaaaaaaaaaaaaaaaaaaaaaacagccaccauuuuaaagcaaauggaaauuaaaggaaaacauaguuuucccuguaauauaaacauuuugcuuuaaagaacaggucuugcaucuuauucccaaacacugaaugagguacucagacucugccuucuaaauaccagccagaaagaaacaacaaacuauauuaucucuugcguuguaauucuucagaauuaauuuauagcuccuugagguacaccuuuccuaaacuucacauggcaagugacacuuuucuuucaucacuauuguguguuuugucuuucugcccccaaacacaaacacacaaggaaauaagaacugacaaggaagcaaaaauauuuaguaaagacccacggaaagaauuagaaggaggaaaagaggaagcaggaccaagaagcacgucaagugcuuuaagaaaacaccuguuucagauuacaaauuucuuacuuaauuagacacaugcaacucuugaguuuaaacauaacacucacaauucgucagccacccacggcaauucuccagguguuugugauuauguaaugcccuaaaaaaucaucuggauugugucaacucucagaaguacugcuucaguuuuuuaaaaaauccucuacagacauuaauuuauauguaaagucucagucuagcauuuacacuacuuagcaaaaaaacaaauaaaagguuauaauaaguaaaaggucagugguuuccuugguuucugauuuuuuuuuccccaaaggcugaaaguauguuuuuugcuucaaguaguaaaagauaggcauuuugaauucaauaaaacuucauugaccagacuucucuaauucagauuuuaugauauuuaggauaggagcaacgagguuuaauuguauaaccagggaaaggagcauccacacugcaaaaguagaggaaaggggggauaacuguuuccugaaucuuuuuaaaaaaguguugaaauugcuuccuaaaaucaaauuuggaaaaaaaaaucuugauguccacuuagauuuuucauccuuaaaugagucauacucaccacaauuuacuuuuuaaaguugcuugacauauuuuuagaugguuagcaaccugaaagcccuuaggcuuggauaauugaaaaauauuuggggauggaaaagaauaugauuugaaagggacuccuuugagagcccaaaagggagcuucagcccaaacagaauggagauugccuuucucaugcaauuauuuuaauuaaaaaugcaugugcagcaggaaaagcaaagcaauucuagacaccacuccuuauaguuuggcugauuguuugaaaucuggaagcuuuuguuuguccucuuaaauuuuuaagcuuuguauuagauccuaaaugcuuuguuccuauucugacauaagcgcucucuauaaaaaaugcaggucuuuuccacacaguaacacauguuaaagucggagcugcauuguccuacauguaauauggagcuacucuucugauucuuaguguuucuccuugugucucacugccuuucuauccagccccaguucaccuaagcagggaacaagauauucaucagcgucuauguaaaauaaacuauaucacuuacuuucauccacugauuagcggcagcaucuuucuuuuuuccaaaacaaaaaaguuguuuccauuguauaaaagucaauuaauuauuacagaaaauucaaacugucagaaaaauggaaagaaacauaucugaaauucuacuaucuggagaugaccacuguucacauugugauguauguucauccgggcaccuccaugcauacuaacacaacucgauaauuuuauuuaaaugaguccauuuaaauacauuguuuuauuuguccccuuuaaauagaauugcuguucuguaaccugcuuuuccaauuaaauaauauuucauuuuuuucugugucaauaaauaaagaucuauaucacuuuuuaacgguugcacaguauucucuuauauggcuacacuguaauuuaguugcguuacuuauuaaccuaucauccagaaugucccugucuuuugcuauugcaguaaauauugcagagaauggaauugugcagaaaaucuuguuuuuuuuguuuccuuagauuuaaaucucagaaguauacuauuugcauuuaaauccuucauccauuuggaacauguuuuuguauguagugggggauuacugucuuuucucauauggucauuuguucuaacaucauucacugggaaauacauccuugccccacugauuugaaauugcuacuuucauauauuaauuucccauacaaaugggucucuucuaucccugugccaguguugcauuguugccauuaccauagcgaguucccagauggggguuuuagacuucaaaccuagaaccucuaauuuuuguagccaucugccugugaccugcugggguaaaggcccugccuaggcuauucuguucacaguauaccucaaugauauuauucugcaggaugaaacguggagaguccuugugucagccagcccugauuugcacuguauuaugugcucuauaaauauuuugauucaagaacuggcauccaauaaaguuagcucaggaagaggagaguuuauuauaaaucugcaauauaaaaacgucaacaacaugacaguagcaaggcuuuuauugcuuuuaguuuagguauuaggaggcauaauaaauaauaacuuguucucccagccugaauucucaaccaauugagaagauaaaggaguaagaaagauggcagacaaaaauaccuuuauuucugauaaagcugauacuggagaagguggcuuauaucugcgggcaggugggcuucugaauacugcaccugaaaauaaggcagacuuacucagaucucaccagcugugcuagaccccuguaggcuaccaccacgggugcuagucccucucacggagacaaagagaaagaggacacuugcuuucuguggauaggcugacucucaagaggagggagagaggagggggcuuggcucugcaaacucaauuucuacuuucaacucuaccaguccuacuuacuauaugucuuccucaugagaauauaagcuucaugaagacaauuacuguaucugucuucuccacuuuuuuaucucccaacacaguaccuaggacauuauaggacuucagugaguauuuguucaaugaauguuguuggugcacuuaccuucucaauauauuauuuuaaaauuauuguaucauagguuuuauauauuugaauugauaucuuaugauuauguccuaaauauacaaauauguagggcaaaauaauaaccauugcuguuuaugauuuuuaaaacaaauuuuugaauuuucaugugaaaaaagacuauuuaggucuacuuuuuaugccuuaggauaaagcaaaaacauagacgacaaaaacaaucuggcuuugacuuauucgaugagugcuuguauagaggaggaaagaacaauuuuguuuguguaaaacagcaauaucugauguauaugcugagaaauucauaaauauuuucucuucucuugccuccugggcauuuuuuuuucuuucuucuuuauaucuuacaauauuuccacucuguuuuuuauuguggauuuagauauuucuugaaggaguuaacagauaaauuucccaaaugcauacaaaauggaugucgaauccaaauagauuacacaaaaagagcccauguccugacacacaacauuuuacgcuuuaagugcuaaauuauauauuucaaauaacaauguugccguguuccugagguaauuuuaaauucuuacuaauuauuugguaucuuuuaaucuuuauuugcuagaguaaucacuauagccuuaaaaugagaaguuuagaguugcuugauuuuucccuuuaguagaauaaugaaauaagaaggguuuacuuuucuucugcuuuuuagaguugaugcaagucuuguucuaccaaaagguacugugauugcagaaaguccugggaagguuuuucuaucuacacaaaaugccuaccauaguugacuacugauuuucaaauucauucuaucuaaaccugugcuaucaaagggaauuuucuguaaagauggaaauguucuauaaucugcacuacccaauaugauagccauuagccggauggggcuuuugagcacccaaaauguggcaggugcaccugaggugcugaauuuuaaauuuuauuuaauuuuuuuuguuuuuguuuuauuuauuuauuuauuuuuuugagaugaagucucagucuuguugcccaggcuggagugcaauggugcgaucucggcucacugcaaccucugccucccgaguugaagugauucuccugcuucagccuccccaguagcugggauuacaggcgccugccaccacacccggcuaauuuuuuuguaguuuuaguagagacaggguuucaccauguuggccaggcuggucuugaacuccugaccucaggcgauccgcccaccuuggccucccaaagugcugggauuacaggugugagccaccgcacccagccaauuuuauuuaauuuuaauuaauuuaaacuuaaauagcugcaugucgcuaguggcuacucuauugggcagcauagaauuucuuuccauuuuuagauuuaguauggacaugucccuggaaaaguugacuuauuuucuaugaauucauuuaacauauuuuauaaacauuuauugagcaccuagugaguuugugugcuuggugucagaaauauguuuccuuuggauuuccugaggcagcuuuuuggugguguggagaccucacauaugccaucccacacaccugugugaacaagccuugguaacagggacccugcugguucaacaggagcugucucucuuucaccccaaucuccagggcccaccaugccaggaccaucaucugcugggcugaaggggugaguggcggcucuuuucacucagcugugagcucuggcaggcucagggaugcaucugcuaggaggaaggggcaccuaggugagauucugucaaagacauuguauggcuaauguggcccagucacagagauucuuuaucucaguuuacuccucuuaguugcuccugacacuuuccucaacaaauuuucuguggaaaaagcaaacacgucuucacagcuacccaauaacacuuuuucuuuuuccuuuuuuucaagcuucauugagguacaguuggcaaauaaaaauuguuuauauucaagguguacaacgugaugauuugauguauguauacauuguggaaugauuaccacaaucaagcuaagguauccauuaccucacauaguuaccuauuuuuguggugagagcacagaagguuacucucuuaggaaauuuuaaguguauaauacuuacuauuaauucuagucacuaugcugugcuuuaggucuucagaacauauucaucuugucacugcaaguuuguacccuuuaaucaacaucuucccauguucccuaccuccugaccccugguagcuacccuucuacucuguuuaugugagaucaugcaguauuugucccucugugucuggcuuauuucacuuagcauaauauccuccagguucauccguguugcugaaaauggcaagauuuacuuauuuuuuaaggcuuaauaguacuccauuguguauauauaccacauuaucuauuuauuggucaacagauacucuaguuauuucuauaucuuggcuauuaugaauagugcugcaaugaacaugggaguguaaaauaacucuuugagauagugauuuuauuuuguuuggauauauacccaggaugagauugcuguguuguauaggaguucuauuuuucaucuuuugaagaaccuccauauucuuuuccauaaugccuauacuaauuuaccguuccaccagcaauguauaaggauucccuuuucuccacacccucaccaacacuuguuaucuuuugacuuuuugcuaguagcuguccuaacagaugugagaugauaucucauuguagcuuucauuugcauuuuucugacaauguugacuaccuuuucauauaccuguuggccauuuguaugucuuccuugggaaagugucuauucaaguccuuugccuauuuuuuuuuuuuuuuuaaugaaaaggcaacucacggaaugggagaaaauguuugcaaaccauauuauccaauaagggauuaaguuccaaaauauacaaggaacucauacaagucaguagggauaauuaaauaauaacccaauuuaaaaauaggcaaaggaucuacuuuuuuuccuguuuguuuuucaaagguauccuaccuccuggaagggggcagcauggcccaugaagacuucuguggacacacugguaaaaugaacccaggagauuugcagguauggccaaggacaaggaauugcuggugguuuaguaguuuuugggugcacgugcuugauccugcccacuuccaguacauucacccuuuccacacucucucuauuauauucuugacuuuuccuuuucuacagauucuuuuacucagccuggaaaccacacaggucucuuauauucuucuuucacacuuuccuugaccccucaaucacuuuuuagcucccaccuagucuuuuucuuacauuucucaaaagaguaaucaggaaugauaucccaacuuccuuaucuuucauucguuuuguacuuacugagaucagauuuggccucucaguagccccuuccaaaucuuuacugaagcuauucagguaauggucacuugugaugucccaguugccaaauucagugauuguuucaguccucaucuuucuagaccucucugcugcauuugagacaauguauuauuuaucuuccaacucauuugcaggguuagguguuaucacuuaagacaaugaccucgagcccuccaucauccuagucuugucugagauauguuacaauuaaaaucccccaaaauacuugggucauauuugccaguuuuguaagucgaaacucuauaccagguacugucugggauuuuauauguauauguuuugaggaaugauaaauucacauauuugaaucauaauauuucaaugaaagugaaauuuaaagacaaaaaagcaaaagaaaaaagucauggcaaaaagucaauaguaaccucucacuggagcagaacaugaaaugaagacugcuugcaaagauacauaugaugacuggaaauguccugaucguggaaguggugacuucugccaucugcaccauggagcugccuagcagccauaugugugagacaguggucaacacuucuucuaccacuauaacuucacauugauuaggaugaugauugcauagugucuuucaguuuauucagaguuuuuguaugcaugaucucuuugcgauaaguaguauuauuauuaucuuuuugagacagggccucacucucuugcucaggcuguagugcaauggugcauucacuauucacugcagccucgaccuccccagcucaagugauccuuccaccuuagcuucccuaguaggugggaccacaggugcacaacaccacaccuggcuaauuuuauuuuuuuguagagauggggucucguuauguuguccaggcuggucucaaacuccuaggcucaagcgauccacccgccuuggccucccaaagugcuuggguuacaagcaugagccacugugcccagcaaaaagaaccauaauauuauucucaucucauuuuuaaaaaugaggaaauggggauuuaaagauguuuuuaaaaacagaugcccauagccucagagcuaguaaaugaugaggauggaaagagaaccccauucuccccuuccagauccaauauauaggccauuuuagguaaaguauugccaaacuagcucauaucuaaaaaggauaaccaagguauugaaaauaugaagaaaugaacuuuaaagggaaaaggaaaaugcuuaaaaaugggaggaugucuuugagggacaccaauaacuaucauuagacagaagaaaugcagcauaagaggguguuuagguauaccuuauacugcauuagagcagggucaacaaauuuuuucuauaaagggcaaaugggcuuuggggaccauauggccucuguugccacuaccagacucugucauugcagcaugaaagcagacauagacaguaugucaaugaaugggcauggccgugugccaauaaacuuuuacaaaaacagguggcagguuagauugggcccccaggcuguaguuugccaacuccuacauuagaagguuuaacaagccuuuucaaaugggaguagagggaaaucuagacuucauggaagaaaaaaaucuuuaaaguaugcacuggccuccuuucagauccuucaacuaauaaugcucauucuugucucagauucuuuuucacaugcuguuguuucucuguggaauccucuuccucuuccccuuccccuggcuaauucuuacuccuuguuuggaucucagccugaagauugcacccucagauaagcugccuugaacugagcaggacacuucacgugcucacagaacccugucauucuucgaagcacaagcacaauuauaauggcaauaaugauaugcaugacauuguuuguuuaaggauuuuucuccugaugagggcuguguggaagaugcuguugauggccugccucauagcccuuuggcccaacugugaguucagguggugaugguccccguauguguacaguaccaucucaagugcuguuacucugucugagggcuuucuccagcccucacugaccauaugugggcagaccauaugugucagugauuuaacacucccaugggaacucuuggucagugaaggaugggaauuagagucuaaauacccuagcuuccccucuucuccaugcaacaauuucaaaguacauauaugguucccagugggauugaauuccagauguccacagauauaaccuucucauuaacaacucuuuuuggcuuucucccuugccucacucuucccuacucucucacuugugcuuucugcaucacuuuccaaauaaacaaccugcacaugucuuugucucacaacuucugugggagaacucaaacuaagacagguaggaaaugcaucuaugauguucauaccuucaucuccagauuccaagauuuagucuuuggggcuggucccuaaucugcuuuuaauacagacaugaacaaacacuugaagaaucugcauaacaguggaggcaauaauuguuucuccaaguagcgaggguuccauuacuggaacugagcaaguacagauacaaguuaaccauccacaguauaguggauacuggggaccuccaaauguauuuguaggcccacauauuuauccuccaaugucugggaacacuggcugcugauggcucacaacggcuucccuuccuaggaacugcccucugcagcagggaauugccucacccaaaguugugcuuuccaccuggggauggcccacagucaaugguuugcugauguggggauauaaaaacuuggccacauugucucaagucgggacaauucugaagguucaucucaacuccagagcucccuguuggauuggcuaaagccucuguaguaacugcauugcuggggagcuucucccccugcccaauccugcuuuuuucacuacuuaaguuguaucuccugagaacacagcccaguauacuaucuuccugcaacuccccaucuuagagcuuaaucuaagacucagggaagucaaagagaggauucuuccauuugugggaauuccaguuccgauguguugauuucaagugaggaagcacaggaagcauuugcaaaacuggaaagggccccagcaauugucacugauguuuauuauuccccucgaugcccaggggcucugauagcagcacugguaagaugucucacuuagugaugguguuguaauuguuccaccuauagacuuauuaggagcuugguuacauuucccucuuguugguuuuguguuugcaguggaugacugcgggccggggcauucugcacgcugagaugccuugcucagaggagccagcccauggccuacaacuguggguuaauuugaggagcucagagaagaugguggagccucaguaccaggaacugaaaagugaagaaaucccuaaacccaguaaggauggugugacaguugcugucauuucuggagaagcccugggaauaaagguaagccaggcuauugugucuauuuaaccugaggcaugcagugacauaaggcuggccccuucuggauuguuagcucucacuagguuuaccaaaauucaugucccaugggauggacuugauucauaguugucagaauaagugcaaccuaagaaaacucagaaauuuuuccugccuacaaacccauagaguuaggaaaauuacaagaaagcaagcucauauaaaguuuggucgaggagcaauuuucaaaguaugucuuaauaugugugcugauuuagccuaauuccuuucacuuauagugcaauuuuaugcuuuaaauuauagcuccuuaguacagcaggauugcuaccuuuaagaaacaaacaaccaaaaagcaagacuaaacuccacuucacaaagauuuauguaaauuacuuauguccaacuuaguaauguaaggaaagcacacuacuacauugcagaaaguuuauuuuuaaauuuuaacuugacaauuuguccaacccauacacgacaugcccuguacauucuuuucaacugggacuuuauauuauuuggauuuauagucucaccuuuuugauuaaauaagucaauuuaggcuaaagauuauggacauauuugugggaggaaaggggugcggcaaaugccauguuaauugcacaccagaacugcuccuggggagcauaagauuccucacaccaaccaaucugagguaguguguuuucuuaggugggguuucccagaagcagacccugagaugaagauucccauccaagagauuuuuaaguaagcguuccuaggagaacaguaaaaggaaucaggacaaauuaggggaggaagugaagcaaggcugccaucucaggcagaguccuaaagaggguggcuuuaccuugauccugcaagggacuuugaaagaucaacgugccucagagauguccgagcccaucccuggcaagggagccgggcuuucaugcucccuuacccaauggucauugguuauggccauuaacuuugaaguggaggcacagaaaugguuaaaagggaucugaggggaucugggagaagccuugacaucggguacuacacauggaaccuggcauugagugcaucaagauagugggaguuacucugccauucucccagugcacaaccagcacuuaaaacuaucuaaaacuaacuucuguaaauuuuaauuuuuugauguguaccaucagggauaauggcuuggcaguggcuacuaaccaaccacucaaugggaugcaugggaugguuaacagauuggucaugguuauugguugggacuuaccaguuuuuguauuuccugaacuauaaccaaaguuuuaccguuuuuauuuuuguuuuuuuguuuuuuuuuuuuuuaccuguacccugccuagguauaugauuuuguuuuguguuucuagugcaaacaaaaguaauugaacaacaacgacaaaaaaaucaaaguucacaaaguuaagcauaccugacugcuguccacaccccuggcagaccuauugcuuacuuugccauuggaaaagacccuuuguuguguuucugugacucguuucuguuuugccaagcauuggucagugagugcccuuuucagcuguuugugaagaguuucuuucccuugagcucugcagaagaggguuaagauccugugaggacuuccugguguagcagcaaaagauauuguucaguauaguaucaggcagagcggucuaaagggagcugaauuaauacagauaugaagcugcucacuccaucucacaugguauuuuccuucccuguuuccaggacucugagguuuuagggacaugccuuuaggggauagugagauggauaguagagggcaagaagcccccuucugcuucaaccaaagcagaagacuuugcccgauuucauauauugugauuguccauaagauuugauuuagaaaaagaguugaacuguuggcaguucaaaagagaaaucagaccagugauuuaguugauuagcaaagccagugauaucacgaauccuuagaguuuacaacuacuucucauuuauagaaaucauaaggcaauuuaaaguuggagccaguaaagcacuuucaagcagcagaccauguggucuuguaaucacagccaaggauaagaaaccagagguaauguuuuaacuuuguaaaauaaugucuuaguaccugccagcuucuguuauuuauuuuuguugaauaaaaucucugaagugaauuauauucuccuaaguaaaugaccagucuuucuuacgagugaauuuuaauaauaacgcuucuuggaaccaugggcagcauuaauuuagauuucaagaggcagcguggugcagugguuaccugcauggacucuggagauagaaugccuggguuagaauccuuaccaugaaauagcuguguggccuugggcaagccaguuacuuucucuggaccucagugucucaucuauuaaauaggacuuuuugugaagauuaagugacuuuuuauacauuaaacucucagaauagugccagacacauuguaagcaucacauaaguggcaguuauuauuuugauuaauuuacgguaacuugaacaggagcugggcugagauuuaugucugccaucuaagcuaaagggauuugcugugauuugggaaggguuauuaaccugcacucaagaaaggacaccaguaagagucauuuuaaagauagggagcaacuggugauuucguugugggucucauaagaaacauaguuuugcacaucugaagccuuaauaucugauuaacaaggaaugacugggucuuaaaaggucuagaccuaccauaaaaagaaacugaagauuguuucgcaucaggaagacaauuuuagguuaaauuacaaggugaggcugagaauauauauuucaagagauuaguguauuuauaaccaauacagagucaacaacaacuuccaucucugcaacuaaaauaccuagaaaauggaauuagcaauaauuccagcacuucuucaacuuuaauauucaugugaauuaccugagggucuugauaaaaugcagacucugauucagcacaucugagauggggucuaagagucuacauuucuaacaggcucccaggugaugccaauacuguggucuggggaccacucuuuggaacaugcauaauggguaugggauccaagacacaggaguuuacccaucuugagaaaucauuugauuaagcuccuauagaagaugucaaaugaucuaguacugugaauuuuggcaaaucuuauuuagcuuuucuggaccucagucccgacauccacaaaaaaggugagggggguuuugaauaagauacugucgcuuuuaugagcaacaaaacugccuuuuugauacuaccaaggguagcuguaugccuguuucccagguuguaugugucugagcauuuauucaacccuuggaaagccaagacagaacaagauucugccaggacagcauggucuaaagugaaggcugaacagggagaaaagguuaaaaugggauaguuugaauaguuccugucacuuuuggaaggucaaaaucacauguuuauuucaugaaaguaugaaauucuccaaaccccauuccauccuuaucagacaacuaaucagcaauauuauugccagcucucuuuggaacacaguucuuuuuccaaaaacacgccucuacuugccuccugcugcucuaaauucuguugucagaagcaaaccuugaggaggccucagccccacugggguuagagaaaggcaaucuggagccagauggccuugguucaaggccagcucaccacugacucacucugaagaagucacuuaagauugcugugccucaguguucucaucuguaaaauggagaagauuauaaugacccagcucagaggguugcugggaggauuagguuggcuauuacuuguaaaguacuuagaacaggugcagaguaagcccucugcaagugguugcuauuuucacuuccauacaaaaucuuugggcaguuuucauguggccuacaaauguaaccaaaagaaucuuucuucugauggacagucuguauauucauguguuggaugauaaccaaacuuuaaaaaauuuaauuuucaaaaaugccugcuaaacaucucauguaauucacucagaucauaccacugugcacuuagcaccggaaacaaugccugagagauaacagaugaucaauaaauauuuucaaaugaguaaaugaaaucauuaaaauauacauggaugcuggaauaagagaaaugaagguaaaguaguaagaagauagacaauauagggauuaagaaugagugaaauaagcuuaaaaugagcuuacuaaaaaguuaagagaacaauaaaauuagcuaaauuauauguuaaaauaaaauaaacuauuuaagggacuaggaaguaaggaaauaaaagccagauugaucuuuuuuuuuuuucuuuaaaugugaacucuuuugcaggacccaaauuguucuugcagguuucuucaagcagugacaauaaugguaaacaaagguucagaggcuugugguuccccuuggaaguccacaggcaggugucuucuuaucugcuuuagcuucuuccauguggcuuuucagggcauggcuugagcuccagaauaguggauauacuuaucagcuuucuaggcauuucuuguggauaucuccccucccuugccgguuuagcuguacaagcauuggaagaccccaugucccucgggcaauucuuuccuagucaacgagcaaccugcccacuaauuggccuguguugguuguggguugacaaguaauuuauaaucaagccuguaauaauccccugugauuuggagagcugauggagucuccuggccacugugcaagccacugugugugcaagccacuggugcacacacacgauuuuuccuguaccagaacuagagagaaauagcugcccacauuuuccagguuuugcuuucauccaagagacuuuuaggggcuggauguuauuugaaacacuuuaucaccaaaaugcaauuuugucaguauuccuucuaccuuaacuugauuaaaaauauauuuuauguggcuuuuaggggaauacuuuuauagcacaugcaaacggcaguggguuuugggcaaucagaauacuggaagguaaacuuaaaacauuuuugcaucuuaguaaacucagaacauuuucaggggaaauuugacuucuuugauuauauugggcacauuuaaggagcuccucccucaccugccuuccugcauuugcuuccguccacugugugauguggagagagcuggacucuucccacaggaggcugcucuuuucuucucaagcucaggagaacaauauuuugaaguagcauuaaaaaaaaacuauuaaaucauggaaacagguaacauauacgcgcacacuuuuuuugccuuugaaauauuccagcaaguucauggaucuagcuaaaaaaaaagaaaaauaacagauacucuccuaauggcagagagugugagaggggcacuggguuucugacauagggagcuugaguaaacaggcuccagcugucccagagagcaagcaaaggaaaaacaacacuugcuugggaaggaauucucccuuccaaagaccucucuuuuaauuuauuguauuuauaaaucagagcgcucugugauagauuuaaaaacuggauauuuaacaaauguucccuuuggggugaggguagcagggauaaggauggaccugaaacuucccucaguaugucuuuuaauuuuuacuuuugaaagauagaaaugcuuacauauuuaaaauaucaaguuaaaccagaaaagaaaaaagaaacaagucuuaaaaucaaaaacaaauagaaacaagugaagaaucuaaaauugguauaaagauauuggcaacauaaccacacagagaaaacauuuauuugaagggcuuuuaaacaugauguccuggcuguauauuuuagugggauauauucuaaagacaaaaagaacagcaaaaaauauuuuaaacuuuacuccauagucuuuguuguuaguguugguuuuauaauuucauaacaaguuaauguguauuaugaaauaaaacaaauuaguaaauuuguuaauguuuauagaaaucaagauuuucaguauaagaaaaauggauacaaauauaaaagagcuaagaaaaauacuguaauauucaauguuaaauucaacauuaaauagacauuuuaaaacauuggauggccauuauuucuuugaggcaguuucuggaaacaauaugauuuuaucauuuuaggaguccaagauuuuugaugaugcaauuuauguuucuuucugauaacaacuccauucuccacugauuauuuccauugauuuuuuuaugguucauguuuaauucaaugcuaugagaagugcuuuaaaaaguuccaccuaagaaauucacaaucacccuaaugaauucuggugaaauuccccuuuuaagacauucuauaacuguauuuuaauggauagauagggggagaaaguaaaggaaauauccgcaugaaucagagagcuuccuggucucuuuuugacaccgggcaagggaggaagcagagcauuuuagggagaaagaauucugcaaaauacuguagaaaaaaaggaguugaggauuuccccaucuuuaucuccuugcuucuaugcaccaagguccaacccagguccccucucuuuggugcagccuucucagcuguccuggccgacaagcaucucaacuucugcccagauucacacagccauucugucuucauaacucaugagauuuuugggcggacggcauuuaauuuacaugucccauuuccccuuaauuccuauuaggcaccugcuguguguacaucaugcaguucccuggagauacaaugugaauaagauacaaccacuguccucaaaaaugcucacagucuagcuugggagagaaaccggcaaacagcagaaguauaaugugacacaggaaauacgaaaacagcaguaugugaaaaucucaugauacuccagaauagggagaaucaauucugcuuguguggauggagcaagggaaagaaagauugggcagggaucacgucuuguaauggcuuguauaaagacuuggauaguaagagugcaguaacuauuuaggcauccugaugcaggcugcauaggcaaccagauacuuguggaguuauggcagggcaagaggaaggaaaugaugcaaaauauggggauggagaaaaacccaaguuugucuaccucuggauuuugccuaaggccaacguuuguuguaugcauauucuugcauccuucucucacaagguuuuaaauaguagggcaugagguuaaggugcaguggccuccccagcaugcuauaugcaguccaucucaucucagguuucaugaagcaguucauucuacgggacgugccugcuacaggccauguagccugagcagaugaucagcaacauuccacagacaagugcaaaacuuggcuuggauucacuguugagaauaggcacaauuaggucugcuagucuuguuuaguaaauaggaagacaccaaagaaauguacccagcaacuucaaagaacuugucuugugguaggcagccauaguuggcacuucauuugcaguuaggaaugugcaaauaaacaguggucaggaucugcucaaaucagcuggacaaaagcuuccucuugcccagggcagcccacucaccccagaaauaccauucuuggugugcacaaagggugccagauguucuuauucauucaagaugucccugcugaccuaaucccuaagaaguacauuucagucguggcgacaagcccucuccuuccagugaaugaagaauggauaggugcacuuuuaaaccagaaguaacacccugugccauucauacuuuguuggcccuagugaucaggauuguaacuuagcagggaaauuuagacuaagagcauaauaaaagcuauuaaaaaaacccaaggugucaacuucaauaaagguuaguggucacuuuagcauauuauuguaaucacuucuauggccaucaagacuuguccuuuuaggauauaguaugucuuuucccaggaacacauuacauauuuuuucuaaccacagaaaaaaaugcaggacagcuucagagagcugucuugagacucuugcauguugcauuaaaagcugagcucuuauggauaugaauaaaguggaugucaguauuuuaaaaacugguaucagcagccgggcgugguggcucacgccuguaaucccagcacuuugggaggccgaggcggccggaucacgaggucaggagaucaagaccauccuggcuaacauggugaaaccccgucucuacuaaaaauacaaaaacaaaauuagccaggagugguggugggugccuguagucccagcuacucaggaggcugaggcaggagaauggugugaacccgcgaggcggagcuugcagugagccgagaucaugccacugcacuccagccugggcccugggcgacagagugagacuccaucucacaaaaaaaaaaccaaaaaaccaaacaaacaaacaaaaaaacaacugguaucagcauauauaaagcuaugcuguugauagcugcaaacacaguacuucauuuugaccaaagcagaaauccuugggaucauguagcuuuugaauaauuugaucaaacucacacucaaauguguugagcaaauucggguucagauaaaauucugauuacuggaagcauuagaaguuuauaguauguaaauuauaucucaauaaaucuguuuugaaaaggaauucuacuccuguggacagguauauguacuccaagauagccaaguauuuagacauuucaacucaaaugagcucuaaaucauugauaguaacgauuaaaggaacagcauguucugucauaaaaaucacagggaaucauuuuuugccauccauugcagauccgggggcuguucaguauuccuuuggcuuaguaaaaugagaugaguucagcaaacauuuacugagggccagcugcaugcaagacccuauagagguaugaggggaaaaggugaaaaaaucagggggcuggauggaugcaguugaagggaaagacauaucaacugauagcaugaguauacuguggugagucagcacgcuagaaaucauggcaggcuaaugggaaagcagaggaggaggcucaguccaaucuggagguccaagaaaacaggccuaagucuaaaggagaaaacugaccuggugaagaaggguggaaugucuagaucaagcuuauucaacucgcggcccaggacaacuuugaauauggcccaacgcaaauuuauauacuuucuuaaaacauugugagauuuuuguuugugauuuuuuuuuucuuugagcucaucagcuaucauuaauguuaguguauuuuauguguggcccaagacaauucuucuuccaguguggcccagggaauccauuuuggccaccccuggucuagauggugcagaaggagacagcaugaguagagguguuucugcacagagaaacaguguucagugguauaaaccaaugcuuuaagaaggccuucaaaacacacguucauuuucuaaaguaugaaaauuggaaaaguucuuaucuuucuuauguaaaauuugguaauuuguguguuucucucucuuaguuuuuuuaaacuuuucaaauuuauucucuuuuguuuuuagaaauaucuugaauaggccgggugugguggcucacgccuguaaucccagcauuuugggaggccgaggcggguggaucacgaggucaagagauagagaccguccuggcuaacauggugaaaccccgucucuacuaaaaaugcaaaaaauuagccaggcgugguggugggugccuguagucccagcuacucgggaggcugaggcaggagaauggcgugaacccgggaggcggagcuugcagugagccgagaucgcgccacagcacuucagccugggcgacagagcgagacuccgucucaaaaaaaaaaaaaaaaaaaaaaaaaaagaaauaucuugaauauacagaugacguuucaccugggcuaguuucucaucuguauucuuuaccuuuuaccucccucccugagccaacaaaacucaagcacaaugcucucacgaugccaucuaauggagucuuuuguauuaauauggcuguuauguuuggaauacaauauggacugauuaagaucuggcuccuccagguuuguugagaaauaaaacaaugacaauuuaccucuuuuucguaaaaccuuaaagcccccuugcucucuuuguuuuauuuuuuaauuauuauuauacuuuaaguugugggguacaugugcacaacgugcagguuuguuacauaggcauacaugugccauguugguuugcugcacccaucaacgcgucguuuacauuggguauuucuccuaaugcuaucccucccccagaaccccaccccccgacuggcccgggugugugauguucaccgcccuguguccaaguguucucauuguucaagaugaucguuuuuaacauuauggaaggaaaccaugauggucauaauuuuucuacccuagaucaacuauaaauagcaauuagagaaauuuaaaugccucuuuuuuaaaggaagccauuuugauguccagaacaaggcucuucugucccacugccuucagucaccugccucugauuaauuuucuucucaucucugggcucuaagaacaauacuggcuuccccacccaaccucccacccccacguguuauucucuaguuacaaagaagcgauacacaggacagagggagagcugggcagugaaaaggaggaagaaaacccgacacuguuucugcaccaucuugguuccuuuaacauugauuuuugggccuuuccacccugucuccaccaaacagauuucuuguaaacugcucccugccucuguuucauuagguuuucugccaauugagucccccagccagauucuuuuccucagcagccuccacuccuggcuguggcagcucugcuugucaggagucaguacccaccuguuuuugucugccuugggagacuuugagugucucuagguaacuaccaagacuuggcugguggauuuucccagcaucagauauggauuugaggccaucuguuacaugucaguccaaaagaaguuuugagcaagaguucuggugacugucauuaaguguuuuuguagguuuuaacugacaaagucugucagccaaacaaaagcagacccguuuauugaagagggccuaaaauucaguggaagucaaauguagggaguugagguugagaagaccaaaaagaacacaggcauaccccagagauauuguggguucaguuccagaucacuguaauaaagggaauauugcaauaaagcgaaucacacauuuuuuugcuuccuagugcauauaaaaguuauguuuacacuauuuuguagucuguuaaguaugcaauagcauuauaucuaaaaaaguacaugccuuaauuuaaaaauacuuuuguugaaaaaugcuaaugaucaucugaaccuccagcgcguccuaauguuucugcugauggagaaucuugucucaguguugaugggugcugacugauuagaguggugguugcugaagguugggguggcuguggcaguuucuuaaaaucagacaacgauguuguuugcugcacugauugacucuuccuuucacgaaauauuucucuguagcguguaaugcuguucgauuauauuuuacccacaguggaacuucuuucaaaauuggagucaguacucuccaacccugccacugcuuuaucaacugaguuuaugugauauuuuaaaacuuuuauugucauuuccacaauguuuacagcaucuucaccaggagacucccucucaagaaacuacuuucuuugcucuuugauaagaaucaucuccucaucuaaugaaguuuugucaugagcuuguagcaauucagucacaucuucaggcuccacuucuaauucuaguucucuugcuauucccaccauauuugcagugacuuccuccgcugaagucuugaaccccuuuaaagucacccauuaguguuggaaucaacuucuaccaaacuccuauuaauguugauauuuugauccccucccaggaaucacaaauguucucaauggcaucuagagcagugaauccuuuccagaagguuuucagcuuacuuugcccagauccauuagaggaaucaccaucuauggcagcuauagccuuaugaaauuuauaauuauaauuauuaugcuuguaauuaauaaaauaauuaauugaugaugauuaauaucaauuaaauuauugaauauuaauuguuaauaugaauuauaauaaagaguaauuuugacuuucaagucugaaauaauaagacuugaaaguugaaauuacuccuugauucaugggcugcuaaguggauguuguguuagcaggcccauuaaucuugcacaucuccaucagagcucuugguugaccaaaugcauugucaaugagcaguaauauuuuuaaaggaauauuuuuuuuucugaauaguagggcucaauaauagacuuaaauauucagcaaaccaugcuguacacagaauagcuuucauucagguuuuguucuuccauuucuagaacacaaguaguguagauuuagcauaauucuuaagggcccuaggauuuuuacaaugguaaaugaacacuggcuucaacuuaaagucaccagcugcauuaaccccuaacgagagagagucagccuguucuuuaaagcuuugaagacaagcaucgacuucucucuagcuaugaaagucauagauggaaucuuuuuucaauauaaggcuguuucaucuacauugaaaaucuguuguuuaguguagccaccuucaucagugaucuuagcuggaucuucuggauaacuuacugcagcuucuccaucagcacuugcuacuuuaccuucuacuuuuauguuauggagaugucuucuuuccuuaaaccucaauaaccaaccucugcuagcuuccaacuuuucuucugcaguuuccucaccucucucagccuucacagaagugaagagaguuaaggucuugcucuggauuggacuuuggcuuaagggaauguuguggguaguuugaucuuccauccagaccacucaaacuuucuccauaucagcaauuaggcuguuuugcuuucuuaucaucuguguguucgcuggaguagcacuuuuaauuuccuucagaaacuuuucccuugcauucccaacuuggcuaacuggugcaagaggccuagcucuuggccugucucggcuuuugacaugccuuccucacuaagcuuaaucauuucuagcuuuuuguuuaaagugagagacauaugacucuuucuuucuccugaacacaucgaggccauugugggguuguuaauuggucucauuucaauauugugucucagaacagggagacccaaggagagggagagagauggagaacggccaguuaggggagcagucagaacacacauuuaucaguuaaguucgaugugucuuaugucggcacaguuuuguggugcaucaaaacaauuucaauaguaacaucaaagaucacagauaauagauauagugauaaugaaaacgugauaaugaaauauggcaagaauuaccaaaaugugacauugagaugugaggugagcacaugcuguuggaaaaaugacacccauagauuugcucaacauaggguuaccacaaaccuucaauuuguaaaaaaaaaaaaaauacauauauuuacaaagcacaauaaaggaagugugauaaaacaagguaugccuguacgucuuucuuuccuucccaaguuccgaacgaauugagagggagacugaggaguuggccagauagggauccaaauaucaucuuucuuaccaguaaaaucuagauaaaagcacacgacuuauaucugagaccuguugggcuucuuaauacuuccccggcuucauuaaccacguccaggcagagguguaccuacagucacaggcaucuucuucagaggcaggcuuaccucuugacagaagaagagagaaagagaaagaaaaagagcucagaagggccugagcugagcauacucagucccuugaauuacucuuaccagcuggaucccaccuccugccucccccucauccucagggauuagugagaaaggcagagagcagcuggcaguauugccucauggggauauuagggaggggucuggaggcuccuucgaacauucccugauuuuuuuucuauuaacauauuagagucggacgcuuagccaugacugccuccucaaggaaagagaugagaaauuuaucaguguggacccccucacauaaaaacuaacuucuguucucuaggaucaauuuuacccccagaaugaugugaaauguauauggagaguuuuuuguuaaauucacaccaaggcauaucugucuucuagacugcacauuucauuuuaucuaaauauuaaaauaucacaaauuugaacauaaaccucuccuaucaucaaacuucuaagacaaaaguaaaguucugaucuaaaaccccuugcccuuauaaaucacauuaaaauaaacuagaauuaaaauugcauucuaaauaagaugccaaagcaucuuuauccaauuuuaacccugcuuugcuuggguagaauaaggauuuucuuuuuucuuucugagcaucguagccugaguugccuccccuggacuggauguggcuccauuaggucugccaaacuugaauccauucaaccucaauucucauucauuucacuuuaaaaauagucccaaaagguaauaaaagacacauuuaucacaauaccgguuuugguuccaugaaauuuuauugcacaagcaaaucuccaagcccuagagcagucauaucuguagaaaauugauguacuugcucaguucagagcauuaacauaguugggagaacaaaaccguguauccauaccgucuccacucucuuggggggagacauuucuccuuuguguaaaguucuaugcuuguguuggugguaacuccaggcaccagaucuuaagaaaauccuguacucaacuauggaaagcugauaagaauaugaagaaauguuccucucaccaauaugcagaaacauagaaauuugaauaauaugcugccacuugacacccuucaaauuaagaaaaaauacaaaguuggguacugugaagugcuggcaaggaugggaagaaauggaaacuucauguuuggcaaguggguguaacuguguucauuguggagagcaaguugacauuauccaaugaagcuaacacugaauauaggguaugccccagaaacuucauuccuaguauuuauuccaucaaaacuucaccaagcagacauaugacaguggucaucccagcaucgugaguaauagaaaggagucagaguugauauagguguucaccacugagagaaugaauaagugaaauauggugguuacauaugauggaauaugguguagccgccagaagcagugggcuguauucacuuguaguuauuagcucucaggaaaaaaaugaggaauaaaucagaaaagaaagcaguuuagcacacaauacuacucauuuuucaaggacacccauauaucuaaauaaauacacuguggguagauuggaaggauguccauuacauaugcucaacugagagccaauggggaauggucuugagaugggggaugauggaggaaaauaacacaaagcaagaggggugcccauggauguaugaugacccugugccauggaauauaguguacagccaauucaauuccaugaacccagggccagagagacagagagagagagagagagaaauuugugucuaacaccagcuuuuaacuugguugguguaggugaccuccuguguggcugauuuaagggauucuaaaaagcccaacauaugacagaaaaucucacugucauguuauuaaaacuguaccauuagaguccauccuucaacaguaugagggacugaaaggagcauaggcuguggagucaagcacaccuggguucaaaucucagcucugaccuugggaaauuuguuuugagcuuuuauuuccucaucugccaaguggggaugauaauacacaguccuugagguuuuuguaggguauuuaaugugccuagcaacauagaggguacuuaauaaauauuucuuuccuuuucccuuaucuaucuuuucuuuucccacauucccuuuuaucauuagucuuuacugacagcaaaucucuagaaauucuugggaugggaaaugaaaguggccaacaucuuuuaugggcuuaugaggugcuaaguucuaagucagaguugucuaauaaaaauauaauggaagcaacauguaacuucaaauuucauaguaaacauuuaaaaaguaaaauaaaacagguaagauuaauuuuaauagcauauuuaauccaauauauccaaaauauuaucauugcaacauguaaccaauauaaaauuguaaugagauaguucacacuuuuuguuaccgagucuuugaaauccaguguguauuuuacacuugcagcacaucugugcagacuggccacauuucacauacccaauagccacaugcagugaguggcaacuguauuggacagugaaguucugaguucuuuauaugugucaauucuuuuaauucugauuuaacuuggguucucuggaaaacaaagcccaaggcaaguauuauuugcaaucccagggcagugggagugaaggagaagggaagugagacagauucuuggccauguaggaugccuguucaggaagcuguaccucagaacuuucuaagggagcaagaauuugucuguugccccacaucuuccauuccucuuuggucaaaguuugcccauggggagcuaauucccugcccuucugguuugugucacccggucccugcagacagccucugaauaggccacaugucccauucuauggcuuggaucuguauccaagugugggcaugaagagaggauccagagccuccguaggucacuuaggucaagcccagacucuggagcuucuggaacucccaccacugagaggacaaucaagacgaugucagaacuugacagucggcuaggacaggccaaggcaucuggcgaugucaacaguugcaacaaugauggcaccuacaggucuccauaagaggccaagggcugaggagcuauaaugaggcugagcgacucugaggaggcauguaaaaugugugcaauugaauucucacaaugagauagggaacugaaacauagugagguuagcaacuugccuaggguuacacauauaguaagugacagaacugggauucuaacuggauggucuggcuccagggucugugcucuuaaucacaugcucacauagguccuucaccaguuuggcacagcccaguagaaaucagauuuuuuguugagagaagguuuugucuuggaaacuuuuaaagacugaaaaggcuuaagaggagagauacauguugaagcguucaaaaggaaaaccuuggcccaucugucauuuugccaaggaucugaccacucccuauuugcacaggaauucaugaaugaucccugaccugaauuggggauauauacugaucccuugcauagugcuccagccuuucagcagaucuggucaauucuucaauuuuucugagcuggugcugaauagcagggaacuacuucuccucuuguuuguggauacacaggaggccauauucaauacuuuuaggaccuauuugaauacuguauuuagauggguugaugugguaaauuuggggauuggggaguugaucaaggaagagacaguuucaugagaagcaguaacauacaaacuuuauuugggcagugcucagacaagguugcguaagagggaaaguucuucauagcuggagauuuuccagagacaguggcacaaggccaccccucagaaaggaaauagggcaagagaccugaaggaguaggggaaaucagagaggaggcuuacauguccaggugauaucacucaacagcaaggugagguuucucuggauuagagaguucugaaggacauuagcaguuugaggucuuauagcuggcuagcagaugcugguaauaguuuaucuuauuucuggcuagcagauguugggaauaguuucacagucuauaugaaguagguaggcucuaaauggcuaaaauuuuguucauuuuggaauauauuuaaagcaauuuggugugcgaaaauuggaguuuggcaucaguguucuuugggcuaaugguccuauccuaguguaaggaaguaaccaacaugggggccauuuucaccuaauauacaggggcucucucuggcccauuuauauaauaguuguacagaaaacuuucaauucauucauucauucagcucuuccauugccauaaugguguauuaauauaugaacaaaguucuuagggcaacacgaaucuagaauuccugauagaaugagaugcuuuucaaagccaaccaccacuuacuguuccauuuucuucugguacuuucauuugaaucagaaugucaggcagcaauggaccccaaagauaagcucuccaacuccaccacuuuguaaaugagaaggcugaaacccaacuaggcaaaaagucuuucccaaggucacacagcucauugugaaagaagaccagacccaaacucagguuuccugaauuuugucccauuuuauuugaacauuuccccugccuuaucacaccauucagcccugaugcauaaguuugcugaguguaucucucuccaguuagggaaugccuuagcucauuuucauggaaggaagcuucaaaaugaccaugucucuuucuacaccaaaaggguaccuucaggcacaugccuguacaagcagacaccccugccugucugugucagaacauccugcaaaugaucacguagaagaagcccuagaccauaauaaauucccccuucauuaauuuuaaucauaaaauugaagaaacauaucuauaugaaaguauccauacccagagcucuaugaaaucuuugccaaugaguuucccguguuacaucuugaugcacuuuccuacaagaacucuuaaaaauauuuuaguaaauagcaaauguaacuaauaaauauuagaagccuugugaggaauauucuagcauugguuaauagauuugcugacucagucuuggaacacauuacccauggauuggaguuaacaaauaggaaggcucuguguuagccuauuugggggccauuugugguuuuauuauacuguugccuuuauaggguuguagauggauuauuuauauaagacaugggaauuuguucuuuuucugguuuuaauuuuccaagaaauuagaacaucuguaacccaaauucaggcaaggaugcugacucaaagggugaagaaaucaaaguccaguuucacaauuaacaugucucugguuaaauuucaguacugugaguccccgucaucaucuuuauucucuuccccuuuaguccuucuuuccucacuacucuucccauaaauaaaaggugagaaagagaaggacaagaguauuacuacugauuaaagggcuacuugaaaaagaauacuauagacugaauuuggcuauguuuaaaauucuuggucagcuagacagcuugauguucaagacuguccacagucuuuuaugguugauagaaguuaaaaauguuuuuuuggcccucucuaacucccacccuacaaagagucauuggcauuuugccuaagaguuccuugucuucucuuuguguaacacuucauguauaugucaaaauaugauuacagaguuuuaauccuucccacgauaccuuuggcacuggggauggaaacuaaucuuucccauugcuuaucagaauuguuuaaaacaaucaagaauucagaauucaaagugcuuuggauuggauacagaagacaucauuuuguugaagagcaucagccuauucuaaaaaugaguuagaaguuugcuuuaaacaguaugguaaaucuacuuuucacuuccucaaagccuuaccaucuccaggagaaaugagaaaguauggcuccccaugcaggggcaaugggaucuggcagugagucuccugaguguguaugguagugcagagacuaggucugugcugaugcauuuuuauccccagugcaaagcccaacagaucacgagagugggaaggugguagaaggaagaugaggacauugggaagccauaagaacuguacuagaugaugacaugagcuccucauggaguagaucuuacucuauuaguugggacuccugagcuaguaaauuaagugaacacuugguuuuccccauugaggcucuuccuuguaagugguagaaggagaaccuaccugaacuagacccaaauauauaugcaaacuuaacagggauaaagaagauuaucaucaauugaggaaaagaagaauaagucaacugggacaauugguuaaccauuuaauaaaaagaaaccagauuagagcucaugaucucacaguuaauugucaaaauaauuccacauagauuaaauaauuuucuuucuuucuuucucuuuucuuucuuucuuucuucuuuucuuuucuuucuuuucuuuucuuucucuuuuucuuuuuuugacagagucucacuggaaugcagugaugcaaugucaguccacugcaaucuccaccucccagguucaaaugauucuccugccucagccucccaaguagcugggauuacaggcgcccgccacuacgcuuggcuaauuuuuguguuuuuaguagagacgggguuucaucauguuggccaggcuggucucgaacuccugaccucaagagaucugccugcuucagccuccccaaaugcugggauuacaggccugagccacuguacccggccauagauuaaauaauuuaauguuaaacauuuugaacuagaaaaauauacacaaacauuuauaugaucuuuggauggggaaagacuuuccagguuuaaaagcauuggaaggaaaagaugaauagauuagacccaugucagaaaccuuguaaaugaaauuaaaggccaaaaacaaacugggagauaauaaccuuacuuuauugaaaaaaaaaaaaaacaaaccucucauguaaauugaugagaagcaccaaacguccuugacuucauagccgccaauuuuccauucccucucacagucacacaucacugaagaugugucugcacauuucaucuccacuguccuaccuccuugauguucucaacuugacauccacccacacugguccauugaaaccagucaccacugacuuccauguggccaaaccagaggugguaaucuccuucuccuucucccucucccucucccucucccugucuuucuucuccuucuccuucuuccuccuccuccuuccuccuccuuuuucguuccuacuccuccuuucuccuccuucuuuuuucuccuccuccuucuuucuccuucccccuccuuuuucucguuccuccuucuucuuucuccuuccuucuccuucuaucuccuucuucuuucuccucuuucuucuuucuccuccuccuucuucuuucuccuuccuccuccuucuucuaucuccuucuucuucuuucuccuccuccuucuucuuucuccuuccuucuccuccuucuucuuucuccuccuucuucuuucuccuuccuccuccuccuucuuucuccucccuccuccuccuucuuucuccucccuccuccuccuuucuccuuccuccuccuucuuucuccuuccuccuccuccuucuuucuccuuccuccuccuucuuucuccuuccuccuccuucuuucuccuuccuccuccuccugcuuucuccuuccuccuccuccuucuuucuccuuccuccuccuccuucuuccuccuuccuccuccuccuucuuuccccuuccuccuccuccuucuuucuccuuccuccuccuucuuucuccuuccuccuccuccuucuuucuccuuccuccuccuccuucuuucuccuuccuccuccuccuucuuucuccuuccuccuccuccuucuuucuccuuccuccuccuccuucuuucuccuuccuccuccuccuucuuucuccuuccuccuccuccuucuuucuccuuccuccuccuccuucuuucuccuuccuccuccuccuucuuucuccuuccucuucuuccuccuucuuucuccuuucuccuccuucuuucuccuuccuccucucuuucuccuuccuccuccucauuucuuucuuucucucucuuucuuucuuucucucucuuucuuucuuucuuucuuucuuucuuucuuuccuccuccuccuccuucuucuuccucuuccucuucugcuucuccuucuccuucuccuucuucuucuuucuuugguuccuucuucaugucagcucuuccucuccauggcuugauugcuuuguccuucuccacagccucucuuucuuugguuucugagauaauacauucuugugucucugguugcucuuugcuccuucucaguuuccuuucuccaggugacaccguuuucuuggccagacccuuaaacacuuuaguucccuggaucucaguccugagucuucucuuucauugagcaucugccuaagugagcuuauuuauuucauggauuuagauaccauguauagucugacaacucccagauugauauucacaguacaagccuccccuuugagcucuauguagauucauaucugccacugccaacuugacaucuccauuugcauggugcccaggcacgucaaauuuaaaauagcaaaaguugaagucuuguucuccccacccucaccugucuugacagcaaacaacuuguuucucuuccagucuucuccaucuuaauaaauggcauuaucacucacugcucaaaguagaaacaugauggccauccuuauacccacugcaucuagucccucagcaaaaaccuuucuaucuccaaauauauuauuucaaaucuaccuauuucucucccaucccucucuggccuacuccagcauccucuucaggagucuccucuccucuauucuuacucccuuccaguucuuuauauaguagcuuaagacaucucuuuaagaugaaaauuggaucugguucuucuucaauguguucucauuguauuuuaaagaaauccuaaaugccauacuauggccuauaucugauugaaucuuuccuaacuuucuaaacuuaugucauucgcuccagcaaccacuuuaugucugccauguugcucuccucucaguuucugaauacuucaagcucuuuauggcuucauggccuucacacaugcuauucucuuuuuucugcccagaaaucucuuacccucaacucuucuuauucaagucuucacuuuaauguaaucucccuagugaggacuucccuuacucuccucauuuuauuuucucucucugcauccuauuuauuucuuuucuagcaaguaccacauuuuaaaguuuuauauuuaauuugcuaaauuaucuucuucacuagaaaguaauacuucacaaggguugagcagaacuguuauucagcaauauauauccaaugacuagcacauuauagauucuuaaccaauauuuuuugaaugaggaaauuaauugauaaaugaaugaaaaguuaaauagguuaaugagcagauaguuuacugaaagagaaaugcaaguggccuuaauuaauacauacgaugccccuaaaauagugccugguacauacuaagcccucaacauauuuaguuauugcuauuuuuauauuaauaauaguuacuauuauuuuaaaauuaauaauaauaauaucacccaaacuaauagucaaauuuaaagaguaaggagauaccaauuucugcuuuuuaaaugaacuacaaugaaaaaaaauaagaugaucaacauuuugaugagaugggcacuuuuuaaagguaguuaccaagugauuugacaaaaccaauuuggaugaaagcaaguuaguuaguauaacaagugaucagaugaugauuuguucaagaacagauacugcuagauguggguuguugagauaaugguauuuauacuguggagguggugccuuuaaacuuuuuucuucagauuaagcuuguuuccuuacuuuuuguccauuuuccaaagguuuucggggggggggugguuauuuuuuaacuuuuaccuuuuuucagcaauuaauuuuuccauucuauguuugugacaaggaaaaaaaaugugcaacaauaggagaucuguuggaauauguuaacuuucuaacaauaggagacuggauggggaaaaaacaauuuagagcacauaaagaguugaaaggcugcccugugguguagcaaaauuaccaagacuaggaaaagcagugacuagcaguagagauuuucagcaaaauugcuguuuaaccagaugauuauguugaacaauuugcuuuuggccacaaugucuuaaccuuuacaucuauaauuucacugugaaggaaaaaaauagaaauguaaucaaagauuuaugugcaaagagauucgucgaaaguuaacaaugacacacaaaaaccccauaaaacacaauguccaauauuagaggaguuguccaaaauggggggugugugucuaggaacaaguagaaacacuguuucuuucucuuauaggauauuggggauuggcacucauuaauaugguuacuuagaguaauuuccuuaagcaacauauuauaguaagauugacaauuugagugcauuuccugagaaauaacuaaaucauaaagagcuuuugaaauaguucccccaaagaacugugaaugcauuuauuacauucacaauuuauuacauucacaaagcauuaugacacuacauugcugccacuugcuuuuagggagagucaaagauggugguaaaaacagcagcauuugggaaucaaugggcagcaguuaucugucaaaggagcaauggcaaaauucaagauacuuccuuugccacacucauacauagcaacguagcaugcugcauucuuuuucuuggggagauguuuuuaagccacauagcuuccauguggaagugauuucaucuccuaauuaagaucacauuuaugaauaaaagcagaggaaggaagccagcuugacaaggguauccuaccaaaagccaggguaaaugggaagucuuugaaggacauaagaugaagguaguuggaguuuggaaggaagugguuuuauagaccuuguuuugucuugguuguuuuguggucauuauuggaguggugucugagacucauuauggguuugguucugacauauuuauagggaaggagagacaagguuuuccuggauuugguagcagcccuguuguagguuagccaaaauguacccuuaaucucuuaugaagaauugaauuacuuaccuucuagaaauauucccugcauaauauuugaaccauaauauuuuaagccauuaggcuuuugaaauauaggcuaaaacuuuaaaggaaaguuuccuaaauacuuucaacacaggauugugaaauggaaagaaagacgaaaggggaagagcuuuggauuuuaguaccucugcaggcauuauuaaucagaacugaaacagaaaaaaaaggaaaaaaaaacaaauucacuaauagaauuugagugcauuagcucugugcaugcugcaacggauuuauaggggaauguuuucuuuuaguuucuuauggaccaauuuguuugacucuuguggaaauagauucauugauagcuaaguuuuaaccaaaaaagaaugauuuaauuaaauuaucauucuauuuugagguucuauuaauaguuuaauacuauacauaaaaauaaacaaaacaacacaggaaacaaugugccuaauaggaagauuucuuuaugguugaaaaucagcaggguauguaauggaaagauggaauccagguuugcucaagguacauuugaggcugacaucaucaccuuuuuuuuuuuucccuugagacagagucucgcucuuccgcccaggcuggagugcaguggcaggaucucggcucacugcaagcucugccucccggguucacgcccuucuaccgccucagccucccgaguagcugggacuacagacgaccaccgccacgcccggcuaauuuuuuguauuuuuaauagagacgggguuucaccguguuagccaggaugaucucuaucaucugaccucgugauccacccaccuuggccucucaaagugcugggauuacaggcgugagccaccgcgcccggccucauuauagauuauuuuaaauagaauaauauacauucaguuuugaaggcuuugggguaguuuauuauucaagacauauguuauauugacacccucaaugauccaguucccaauaugaaaagaauacuagaauuggaauccuguuuuagguuaaagauguugugaaaaacaucugcaaaaugaauuaaaaauuuccucuuagacuuuuucacacugugagacgauagaauauauuuuguggcuuuauuaaagucucucauugguuucuguuuaaaauuuuuaagaugaauacauaaaugaauauagaacguucugugugagugugaauacaccugcaugugugcuugugccuguguaguugcaacuuagagagguagcuacuauuuuuugaacaauauggauuagguugagaagcaagagacaggaaggaagaaggaaaaagagccagccaggagggcagacugaugacugaaguugagggcaagaauacagcgaguuaaccagagcuuucccaccaacucuccacagcucuaguugcccucccucaccccagccacauucucacuucucuuuagcucuagucugagaaauuggaagagaauuuuaaaaauuagaguguggaggaaaacauuacuuuucugaaucagaauuucagaaccagaaauagacuuaaacaacagcaaguacccucacaaaauuuucagaugagcgaauuaacccagaagaagauaaguguuucguuggucagcagaaaaagcaauaccucuagcugggcacgguggcucacaccuauaaucccagcacuuugggaagccgaggcgggcagauggcuugagcccaggaguccgaaaccagccugggcaacauggcgaaaucccaucucuacaagaaaauuuaaaaaagaaagagagagagagacagagagaaagaaagaaagguaaagaaagaagaaaagaaaaagcaauacagcaugaaagacuccugacuuccaguucaagauuauuuuuauggccacauucugggagagugcuagcaaaaauuaaagcaagaaccucuuugugaugcauuucuucucuguuggaagggauacugcaucugccacugaggcagagguugaaaaagaugcuuaaaccaaacagggaucuuuaucugaaggacagcgaaauauugccugaacagaggagucauucgauauuauaugaaguuuacccuuaaucuuuuuagagguaauuuuagaaguccucaucagacaaaaccagccccuuuccagauggugucuuauacaccuaaugauccuagagaaucagauccugugccccuugugugcugcccuucuuuuauguguguuucaagcucucugauugauugugaaucuuuggccucagguugcacuugaugucacaggucuuucugguuucauuuauauauacacgggggaauuugcuuuucuagucuuugaagcuguauuaaugcagcuugaccuucuaagccaugcaaaagucuaccagagcauuuuaaaccccaaagcuucaauuggagacauucagaggaaaggaaaaaaaucuuuugauagucaagauuacucacgauucuuuauuucaaaauuuaauguacagacaauauauuuugaccauaccaaauucaccuguccugaagagaagcauuuugcuacauguaggugaagauguugaugaauaccccauauauauauauauguauacauacacacacauaugcacacacacacacuuguguguguauauauguauguauauauguauauaaaaucccauguauaguaauacgguuauugacaguauauggaauaguaauacaguuauugacgguauauauauguguguguguguguguguguguguguauguacugucaguacauauauucauauauaucuucauauauacauauaucuacugucaauaacuguauuacuauacauggaguuuuccauuaugaaacaucauucaauaaauauuuauugaacaccuagcauuugacagacauaguggguuggcccugagaauucaguaguaacaaaggcagaaauguucauguccucauggagcuugcaucauuauucuccacaaaauuaugccuucaucaaggagaguaaauaauucugggcuccagauucucucuuuuugucuaaaaaugcauguauuuaaugaauguaaucuuuuaauuaacauauaacauauacacagagaaguacacagaucaaguauacagcucaaagaauguuuaccaaguaaacacacucauaaaagcagcagccagguuaagaaacagaacauuaccagcccccagaagccccuuuaaaauccuuuucuacuugcuaaccuucccaagauaacuaauuuugugacuucugacaucauaaauuaauuuuggcuuguuuugaacuuuguagaaauggaaucauacgguguaugaucuucugugucugucuucauuugcucaauauuaugccugugaaauucaccugaguuguugcauguaguugaguucauucauucuccuugguguauaguauuccacuguauauuacauuucauuuauccauucuauuauuaaagacauuuggaugauuuccaguuuggggcuauuaucaguucugucacuauuaagguacuugugccugucuuuaggugacuguuagguauacaccuaugaguuggaauauugggucauagauuaugcauauauucgucugugcuacacauggccaagcagcuucccaaaguguuuauaccaaguuauagucccaccagcaguguaugaaaauuacaguuacuacacauccgugccaagcuuaagguuaugugcuuuuucauuuucauaugcauuuuaaguuuauaaaguagacuggaaccacuggagcuuugugauaaacaaugagacaucauaaaguuuguagcaacaguucuaaucccuugaauuuuagucuaugccaaugauucaggaugguauuauauuaaauuagaaacucugcuuaacucuugauggaauaaaaguuacuguuuauaauggaaaauccugcaaaaguuugccuuucuuacauuuggaguuguggcuuuuucaagcgagcagugucggaccauuuuuguuagccagagggccaaguaagaaaaaauaaaaaauaugugcaggccgcauuuuuaaauuccaaaauggaaauggcuuucuugagacauggggaagaaacauacauuugguugugagauaaccugccauaucaaguggaagacuggaggugggaaaguuggagcaauuauuggccaguaaaauguuacuauuggacuauauuugagaacuggcuguagggagacagcugucauccugaaauuagcuugucaaccacauuguaaagcuaggagggcuaacuuccagaccaagaccuuuaagaggggcuguuuuagcagcccaccucggcuuuaacacuucccuaggaggaacuauauauauaauggauccagguccaggccuauuacagaagggccagcugaaggaaagaagaaccuuauucuuagaaaaaaacacugaugguuuccuuuuccuuuucaguccaagguuuacacucgcacaccaaccuuauauuuggacuucaaauuggacccaggagccaaacauucccaaccuaucccuaaagguaugauggguucugggguuuaguagucacgucaggaaaaaaaaaagaaaagaaaaaaccaacaagaggcuguuuugccuggaaugugcuuguuucugaaacucagcacaaaguucuaagaacucuuguuuauguuuaauuguguuuaaauugacaaauacugcugggaccuuccaaguuaagaaaaucaggaagaggccgggcacgguggcucacgccaguaaucccaccacuuugggaagucgaggcggguggaucacgaggucaggagaucaagaccauccuggccaacauugugaaaccccgucucuacuaaaaauacaaaaacuagcugggcgugguggcgcacgccuguagucccagcuacuugggaggcugaggcaggagaaucacuugaacccgggaggcggagguugcagugagccgagaucgcaccacugcacuccaaccugggagacacagcgagacuccaucucaaaaaaaaaaaaaaaaaagaaagaaagaaaagaaaaucagaaagaacucacagaauguuagggccagaccuugugggccauaccacucaauuuacagguguggaaggccuaaaagaugggucacuugcucaaggccacccaaacacuuacuggaugagguagggcaaggaaaacaccccugucuccugacuuuccagcuccuauugacucacaguguuccugaaggcaaauucggaccuguguuacuuauacacaagugcauacuugauugagauacagguuuugcuugauauagguguuguuauguaaagguuaccuuuagauugacauuugaauccaaagaauaauuaaaaauucccaaguauuuaaggccuauuuuguucuuuuuuuuuuuuaauucuggcuaauuuuuauaauuguuuuuuucuguagacguggggucucacucuguuacccaggcuaaagugcaguggcaugaucauagcucacugcagccuugaacuccugggcuuaagugauccucuugccucagccucccaaguaacugagccuacagaugugugccacuaugcccagcuaauuuuuuaauucuuuuguagagauggagguuucaccacguugcccaggcuggucucagauuccuggccuuaaguugauccuccugccuuggccucccaaagcacugggauuucaggcaugagccauugugucuggucuauuuuuaaauaauuuuuuuaauuaacacaauagauguacauauuuucagggcacaugugacaauuuaauacguucauauaauuuguaaagaucaagucaguauaauuaggauauucaucaccuuaaauauuggucuuuucuuuaugcuagaaacauuugaauuauucuuuucuagcuguuuggaaauauacaaagauuguuguaaacaauagucguccuacugaucuaucaaacaccagaucuuauuucuucuauuaaauuguauauuuguacucauuaaucaaucucucuuuaucccucccagaccccuacccuucaugucuucugguaaccaccagucuucaugagaucuuuaugagauccacuuuuuuacucccauguaagagugagaacgugcaauauuugucuuucugugccuggcuuauuuaacugaauguccucuccagguugcugcagaugacaggauuucauucuuuuuauggcugaauaauauuucauuguauauuuauaucacauuuucuucauucaucuauuacugggcacuuagguugauucuacguuuuguacauugugaauaaugcugcaauaaacaugggaguguagguauuucuuugauauauugauuucuuucuuuuaaauagguacccaguaguugaauugcuggauuauaugguaguucuauguuuaguuuuuugaggaaccuucauacugcuuuccauaaugguuguacuaauuuacauucucacugacuguauacaaggguuccccuuucuccacauccucaccagcauguguuauucccuuuuugauaacagccauuuuaacuggggugagaugaugucucguugugguuuugguuugcauuucucuggugauuaguaauguugagcauuuuguucauacaccuauugcccauuuguaugucuucuuuugagaaaugucuauucugagcuuuugcccauuuuuaaauuggauuucuuuuugcuauugaauuguugagcuccuuauauauucugguuauucaucccuugucagauagguaguuugcagauauuuucucccauucuguggguugucucuucacuauuuuuuuuuuuaagacagagucuugcucugucacccaggcuggaguacaguggugugaccucugcucacugcaaccuccaccuccugggcugaagcaauucuccugccucagcuuuccaaguaccugggauuacaggugugugccaccacgccuggcuaauuuuuguauuuuuaguagagaugugguuuaaccauguuggccaggcuggucuugaacuccuggccucaagugaucugccugccucggccucccaaagugcugggauuacaggcgugagccaccgcacccagccucauguuauugauuguuuccuuugcugugcagaagcuuuugagcuugauauaauaucauuugucuauuuuugcuuugguugcuugugcuuuugaggucuuacacaaaauaucuuuguccaguccaauguccuggagauuuuccccaauguuuacuuguaguaguuucauauuuugaggucuuaaauuuaagucuuuaauucauuuugauuugauuuuuguuuauggcaagagauaggggucuaauuucauucuucagcauaugaauauccaguuuucccagcaccauuuauugaaaagacugucuauuccucaguguauguucuuagcaccuuugucaaaaaugaguuccauugauccaugugucuguuuuuaugccaauaccaugcugauuugauuacuauagcucuguaguauaauuugaagucaggcagugugaugccuccagcuuuguucauuuugcucaggauugcuuuggcuauuuggggucuuucaugguuccauauaaguuuuaggauucauuucugugaaugagauuggcauuuugguagggauugcauugaaucuguacauugcuuuggguaguauugucauuuuaaugauauuaauucuuccaauccaugagcacagaauagcuuucaauuuuuuuuguguccuuuucaauuucuaucaucaguguuuuauaguuuuccuuguauagauuuuucaauucuuugguuaaguugauucccagguauuuuauaaucuuuuuuuguaaccauuguaaauaggauugcuuucuugauauuuuuuucagauuguucacucuugguguauauaaaugcuacuaauuuuuguauguugauuuuguauccugcaacuuuaccaaauuuguuuauuagucuuaauagguuuuuuuugguggagucuuuaaguuuuucuuaguguaagaugauguaaucugugaacaagacuaguuugacuucuuccuuucuuauuugaaugcccuuuguuuuuuuuuuuucucuugccuaguugcucuggccaagacuuccaguauuauguugaauaaaagugguuaaaaugggcaucuuuuucuuguuccagaucucagaagaauucaguuuuucaacugaauucuuucaauuuuuucccauucaauauggugauagcuguggguuugucauaauaaggccuuuauuauuuugagguacguucauucuauacccaguuuguuaaagguuuuugucauaaagagauguugaauuuuauugaaugcuuuuucagcaucuauugaaauaaugauguuuuuucuucuugauucuguuaaugugaugugucacauuuauugauuuguguauguugaauguugaaacaucuuugcauccuugggaugaaucacacuugaucauggugaacaaucauuuuaaggugcuguugaauucaguuugcuaguauuuuguugagaguuuuugcaucuauguucaucagcaauauugacuugugguuuucuuuuuuuguugcguucuugucugguuuugguaucaggguaaugcuggccucauaggauaaauuuggaaguacucccuccucuucagucucuuugaagaguuucaguaggauugguauuaauuugucuuuaaauguuugguagaauucagcagugaggccaucagaucuugggcuuuuuuuuuuuuuaugggagacuuauuauggcuucuaucucauuacuaguuauugcuuuguugaaguuuucuauuucuucaugguucaaucuugguagguuguauguauccaggaauuuaucaauuuuuucuggguuuuccaauuucuuggcauauaguuguucauaauagucucuaaugauucuuuguauuucuauggucucaguuauugugucuucuuuuucauuucugauuuuauuuauuugggucuucucucauuuauucuuaguccagcuaaagguuugucaauuuuauuuaucuuuucaaaaaaccaacuugucacuucauugaucuucuguauuuuuuugucucaauuucauuuacuucuacucugaucuugauuauuucuuuccuucuacuaauuuuggauuccauucuggcuauuuaaguacagaaaaauuuuagauuaauuugcuuaaacauaagccuucacuauccgugauuuuuauaacauuaaguguaugugugcuuuaaccuuuuagugcagugcuuuuaucuuuaaacuuuugaguugcuuuccuccaaucccuuguccucccuuaucuauguccaguacccucacuauauagaucacagauauauccuugaauuauaucuugcuguauuuuucuccacacuuauuuuuauacacugacauauaugugcauucacauauaugcaaauaucagguuauuuugucauuuuaauaaaauggaaucauaacuacucuuuuacguccuauuuauuugacugaaaaauacucauggaaauccuucccaguuuacuuauauagcuccuuuuguuuuguuuuguuuaagagacaggguuucucugugucacccaggcuggaguaaaguggcacaauuauagcucacugcaaccucgaacuccugugcccaagagaucuucccaccccagccucccaaguagcuaggacuacaggcacucaucauuaaugguggcuccuuuuaacagugauauucuacaucaucuaaauacauacuaugauguauuuagcuauuuucuaucaaugggaauucacuuuguuccuagugcuuggcuacagcaaacuggucugcaaugaauaccuuguguaucugccuucccauguggaaauuuauuuugaugagacagguuuccagggauggucaccagaucuaugcaugcuuaguuuuaaaagacauugucagguugcaauccaaagaggcagucacacuuucuauuagcagcauauagaauaccaguuucuccacaaucccacuagcaggaaguguaugguucauguucauuuuugcucugcucucagacaucaccuuauauugccuccugagagagaacguauaucugucaguuuccaaagcuguauuugcauuuuauuuugucaucaugaauuuuaaaccugagauuuguuuucaaucauguuuuguuguuguuguuguugucguuguuguuguuuugagaugaagucuugcucugucgcccaggcugaagugcaguggugugaucgcggcucacugcaaccucugccucccagguucaagugauucuccugccucagccucccgaguaccugagacuacaggcgcaugccaccaugccuggcuaauuuuuguauuuuuaguagcgacgggguuugaccauguugcccaggcuggucuugaacuccugaccucaggugauccgcccaccucggccucccaaaguugggauuacaggugugagccacugcgcccagccucaaacacuuuuuuuuuuuugacacggaguuuagcucuugucgcccaggcuggagugcaauggcaugaucucggcucacugcaaccucugccucccggguucaagcgauucuccugccucagccuccugaguagcugggauuacaggcacccaccaccacgcccaacuaauuuuuguauuuuuaguugagaugggguuucaccauguuggccaggcuggucucaaacuccugaccucagguaauccauccaccucggccucccaaagugcugggauuacaggcaugaacuaccacacccggccucaaaaacauuuuuauagggauacaacaggaaauagcuuagaauugcacauuuagcauugagcgucuguaaacccacuuuaaacaagugcguuaugaacccagcuaugaagcaaaagauccuuucuuuuccaauacaucacuuuuaguuauaguguucucucuuucucagucugucugucuguaucucucucucucucucccuccccuaucucucucucugucuuacacacacacacacacacacacacacacacacacacacacacacagacuuauccaugcuuccacugcauuaggugacaaauacaaaguuugaggcuucucuguuuagugccuaacaauuaauucaaguauuauaaagcacucauuauuugcagcuuugauaguccuggcugccugucaucagacauacuggaugguaaaauuaugcuguauaaaguuuauuaugaaguaauucaaaucaaggucaccauuugucuuuuuuuuuuuuccaccuuuccaggucaaauuccaucauaaacuccaaggacugucuagauucuuuuuauuugggugcuuuguuguaucaaauauuucgugaaauguguaggccauuggcuggguccuggacauguuucguuuauaauguuuugauuguuuuguuacucaugguaaagggauuugacauggaugucuggauuauguuuggcuuuuggcauaagcuuugcagucuaacuaauuuaauguugacuugguuuuaucauuaacagacuaauuggauagcaauagaagcauacacugcuaccauccucucccugauacugggaaaaugcauauauuccaagggaaauccaguuaagggagacugaaaacguuucucaugaaucagacuagguuuuaucugaguuccuucccaugaauacuauuugaaucgauuuuuaccaucucuuuauuuccuucaggcuaggcacguuucucuuggguugugcuaaucuugcagaaaacagauguuucaugcagugaugauuuggaaggcaguugauaucaggaauugagcuggacggugcaucacuuacaaagaaucuaauuugucgaguuucugacaguaccagauuccuuucacauuggccacacguuuuuuauauuagaucuuggcuaaaauaagaguaaguaguuuuuuaauggugacuuuuaccauuucuugcaaggcgcaaggcaaucugacuuuccuuuugcuguaaacugauuuacagauaacacuguuuguuaccauuaauuaugaaggacauaaaucuauauuucuaggaaaauaucagucuuuuccaagaaacaugugccuucuuguccucaugucccccuugucuucugacugacuguaucacaguuuggcccucaacagccacucuguuuauuuuccucauuuccuuuuacagcaccuuugccucuagauacuuaaaggcaggaucuggaauguuaaaaauggagagcuguuauggaaaaaacuugauuuuaugaaccuuuuugcuuuuccucaccuuauaacuuuuccuuuacaguauauguagaucaauaaacaaaauuuauuuagaaaccauauagucuaccccucugugguaggcaaaauaauguccccccaaagauguccacgucccaguuuccagaaucuguguauauguuauguuccauggcaaaaacgacuuugcagaugugacuaaguuaaugcugcugagauagggagauuagccuggaugaugcagguggacccugugucauaaaugagaaucuaaauaagagaaacagggagacagggagucagagugagagaaggacaugugacaauagaagcagaggucagagugaugugauuacugguuuugaaaauggaagggcccacaagccaaggauuaguggcaaccucuagaaguugaaaaaggcaagaaaacaaaugucccccuacagccuccaggaagaauacaguccugcuugauuuuagaccuaugaggcucauuuuggggcuucugaccucaagaacuguaagauaaaaauuuuuguuacuuuaaagcacuaaguuuuagaguaauuuguuauagcagcaauaggaaacugauacaccaauauauuuuugcuucuguguuuauggggaaaaaaaaggaaaggagcuacaucuuccuugauuaaaaaguagauuuuaaugccauacauacaguagcuacuugguaagucacauuaguauacauuuaaauaaaucuuauuguauuaauuaucuauaugcugcauaacaaauuacccccaaaacuuugugccuuagaacaacauguauugucuugcaaugucucucaacuuagcuguguacuguuacaaggccacgaucaaagugucagccggagcuggcgcugcggcucacaccuguaaucuuaauacuuugguaggcugaggugggcagaucacucaaggccaaaaguuugugaccagucuggccaacauggcaaaaccccaucucuacuaaaaauacaaaaauuagccaggcauggucgugcgggccuauagucccagcuacuggggguggaggggggcggggauuggcugaggcaugagaauugcuugaaccugggagguggagguugcagugagccaagaucacccacuucacuccagccuggguggcagagcuagacucugucucagaaaaaaauaaauaaauaaagugucaucugggacuguggucaucucaaggcuugacugggaaggaugugcuuccaagcucacacucaugugguugcuggcagcauucaguuccucaaggguugcuggcuagagucugcucucuuguuuuuggccacauggggcucuauauagggcaacucacaacauggccucugacuucaucagaaggcacaaagaugagcaaguuggaagccagagacuuuauguaaccuaaucucagaagugacauugcaucaguuuugcuauauucuacugguuagacgcaagacucuagccacagcccauacucagagagagggaauuauauagggcaauacgggaggcaggaucaggcagacgucuuagagucgaccuccacacuuaugaucuugguugaaaguaccacacauuuuuccauauggucaaugacucgaaaacaaguagugauuuuuuuucucucucucauuugugacuuuuaaaaaugacuggaguaaaccucgaaaaaugcguagugauuuuuuccacaggcuucuugccuguuuuuucauagucuuucucuacuuuuaaggagaaugccccaaacaugaaugauucauguagaauuuuacauuuugagucuuuucauagaacgcaaaagccgauuuaauucaugaguaauuuuuuugcagagcucucuacuucccaagcaguacauuagacuauucaaucacaguucccuucauacuuagaauauauacauaacaguuauggauguaaaucuauaggucuucagaacagugauuaacgugaaucagagccugaaauaucaaauuauucaggaagaaguuuaacaucauuuuccuuugacuggguugucuuuuucauauugauuuguaagagcucuuuauauauucugaauacuagucauugucaguuauuuguguugcaaaugucuuuccugcuuuuuuuuuuaaccuuucuauacuauguuucucuauuuuaauaaguaaaaaugccuuaaauguaucaauuggcuccuuaaugauuagugcuuucuguggcuucuuuaaucaucuuucccuaacucaagaucauaaaaauguacucucuacuauaagugcuuuguuguuuugccuuucauauugauacauuuauuucaccuggaaugguuuuuuuaauuguuuuuuaaauugacugauaaaauuguacguauuuaucuuguacaacuugauguuuugaaguauuuauacacuguggaaugacugaauuuaacuaauuaacauacauuaccucacauaguuaucauuuuugugauaagaacacuuuauauucccucucuuagcauuuuucaagaauacaauacauuguuauuaacuguagucaccauguuguacaauagaucucuugaacuuauuucuacuauuuaacugaaauuuuguauccuuugaugaaauugguuuucauguaugguaagauacaauuacauuuuuuaaaacaugguuugaaacagaggaaaaaauggcaaaaauccaugauggagaaugccaugaacauuuuaagggguucacaguucacugaaucaucauauaguaauaacaaucauuauagcuaacauuuauuaaaugccuacucuuugccagaaacugcucuaagaaccuucccuauccuaagaauuaacaccuguaauccucacgacccugugagguaaggauuaugauuaccucauuuuucagaugaggaaacugagguacaaagagauuaaguaacuuacucaauaucaauuaguuagugaguaaugggacugaguuucugcuaggacucuuaacugccaucuuguccugcaccaaacaaaaacauggaccuuuagugaacaguacucuauuaguagugucuugggcauauugguaaauaaauccaagauuuuguacauagguuagaaaaacgacuauucuugaaaauuuuaaaugaguaauaucaucucauuguguuguguuuuucuguuaugucaccuuuaggagaaaacagguuaaauugaugaucaauguaaacuaaaaaccuauucuaagaauuuaaauauguuucaauuuuggcagggguguauuuuuuuucauauuuuacaggggcuuuuaaaaaauauuuuucucaggcugggcaugguggcucacacuuguaauccacacacuuugggggacugaggccaggaguucgagacaagccuaggcaacaaagugagacucugucuguaauuuugaaaaaaggccucuuucucuuaaaaacaguuagguguccaaauacauccugaaguaaucuuaggguuauuuaugacuuucccugcuaauuucagguuucuauuauuuuuugaacauguauuuaauccuuaaaguucuguauauuucagaucuuaauagucuauaaacguggcuucaaucuaaguucgaaugccuaaacuaguuucuguuuuagagugcuaaaauagaauuuuaugauuaugucuacauuauuugaauuauuuucugauuuuuuuucugagcaauuaaaaaucaguugugaauacugugugucugaagaggagacaaguucuguucaaauaaaaccaagaaauaguaguagcauauauuacuuuaguuaaaaacuuuauuaaaugucuugaugagaaaaccucaaugcaucauugugcacuuagucucuaaagagcaggauacaauuauuaugugucgauuuuaaacuuuuuuuaaagaacaggauaagcuucuagggcauucuaauaagcuucuagggcauucuaauacauuuguaguacuauuguauuagcaagaaaauaaucagcaggguuugcccuccagcgggcuaggcuucauucugggcaugcagaaggcuguauucugaguuuacauucuagagagcuuauauugcuuauauauuucucauucaaaauguuaaauuucauuuauuucuuagcuuuccuguuagcuucugaugcaaugaguguucaguauuaugaauguggaccaaaccauaagacaggguucuccuauaggcugcaauugugcuuacuuaaaauaugggauccugagggauggcucuuaauguuauaugcccauggcuuauaaacagccuguaguaugaucguucuguaauguauaaagugcauucugagucuauuuuauucuggaaaacuaacugucucaaguguuuugauguguauaccauuuuguuauauaguuuggcauuuuauuauuggugucacucaucaaauuugguaaaacgggcauucucauuuuuuuccaauggaauucucacaaguucagguaauaaccuaucucucagauuguggaguuacaaaguugacauuucuuuaucuugcuguuuauauucaguuauaagauggggguuaaaugccuauucuuggcaagcuaguagaucuuacggugagcuguuacuugcuguaugaucagacaacccaacuuaugucaccaauucuagucugcaguguuuggugggacacagacagcauccuuaaugccaugagguucuugaugaggacguuuugggagacgucgcaaaaauguagacuucuuuugggaaaugaugacccugcugagcuuugcuccgcagucgaagagacuaauuggcuuggugugaggugggugcagcagggagcuuagggccaucuccauagcaaugacccuucucuggccugggucacagccucaucagaauuguguaacgucuccacaugcacagauuugaaggaaaguggaaaaagaagaaaggggcaggaaaaugaacugauauuuguuaaauaccuccuaagugccuggcauuguguagagaagauuaaaaacauauaacacacauauguauguacagauguauaaggacauuuauauauguuuauacagacauacaauagaaacaguauguuugauguuuccucauuagacuguguucaucacaacagcucuguguuauacguauucauuccuuauuuuacaaaccagcaaagaggcuugaagagaugaagagucugguccuagaucucccugagggugaugcacugauguugaaacaggaacuuucugccuguaauggugugugcucauuuuuguugcuguuucaugguugcuuaguugguuuguuuuccgugguucuccacaaagccuccuuuaagguuugcugcugcgcuuuguuuccccacuccccaagagagaguugcauggauagaauuaaauauggaggcggggcaggcagagaggccaugauacuggagaaauguaggaccauauugagaagaguuugucugucagaaguuugggcuuguccugggagaacagggagccauugaaggauuuuaaguggagauucuaaaaaggugcaauuuacgcguguagaaaauggauuggcagcaaccaguuaggggacuuuuuuucaccuguaugguuuuuaucuuaaagaaaagauagauaugaaauaaguauggcaaacauauauguucauuauuucauccuuugugcucuucugaauuaaaaauuaaaguauugaaaauaaaugaaaauucucuaaaucugggagggacagggauuagcaaacaauucagucuaacgaagaaacaucaaauaaacccaaacugagaggcauucuauaaaauaacuggucuguacuuuuaaugaaagaaaaagacugaggaacuguuucaaaugaaagaagauuagacaugacaacuaagugcagcgugugaucgcagguuggguccuggccuagaaauuuauuucuccuuuuccauaaaaagcauuacucagaugacugacacaauuugaauauccguacauagauaguagcauuguaucaauguuaauuucauaauuuccauaagugcacuauacuuuuguaagaaaauaucuuuguuuuuaggaaauacauacugaaaauuauuucaagguaaaggggcuacaugucugcaaauuacucucaaauaguucagaaaaaaaaagaaugacauauauuuauagcaagaagaaugauaaagcauauauguuaacauguuagcuuugggggaaucuaggugaaugguguacaauaauucucuguaguauuuuugcaacuuuuugauaugucugaaauuauuuuaaaauaaaaauuaaaaagaauuugguggaaggaggagcgggagggaagaaccaggcaggucugccucuuguccuaggaggccaggguugagguccuagaugaaggaguuaccugccaaagcugauguggggacuuccgguggcgggggggagguugcggguaugggaggaggaucuuagggaccaggguugcuuugcggucuggcaauuaugugauccagaguuugugaaggguugcaaucucuccuuagcccaguugcccuuaucucuguuaaugguguuggugugucaccaggccguguuuuucuauuuuuucugcacauacagguguaaggaauacuuguaaguucauuggaauaaugaacuccaagacugaggcagaaggaaaaugacccggguuaaggcaaggaauguaggcugaggaaagcucucacuagggacguuugcaagaauuaggagccucucuggaaaugagagcaacugccacagaaaaugauuuacauauuuuuuaaaaguuuuggguuuuuaauguuuggcuaaaggaggucugacuuaaaaugcguugcugacuuaacuguccuaggaggccagaacgaaaaugugaccucccucccagcucauuuuauucaucacugcccaagggaagggaagagcuuuucagcugcaaagagacaguagcuugcagaccauauuuguaggagaaaggaaaauguagcagggugugaacucugacaaagcaauaaaaauugggggaugacaucaauucuuggugcaggacauaaaagugggaggagaggugagggaagaaagaaagaugagaaggaccugaaaaucugacaagagaucucuucuguggcuguuguuaaacauauaguaagcauucaugaaauuuggcauuuguuuucuuuugcagcaagcugaagaaacaaagcuuaguggaaauuaaacaaauuaacagaagcaagugcagaugggcaucaugcuaaaaagaaagaaaaaaguaaauugccuucauuucuauuccaugcccucuaacacucugugcuuuccaaucagcaacaugaguuguguuauuacuggcaaagauggacacuauauccuagcagaagacuuuuacaaggaguaaaaauauaugaacacacuuaguaaauugacuuaggccauuccuuuaagcaaauguuugguccuuccagaucauguaaaaagauaaaaaaggaaaaaaaacagaucuaggcaauuauuuguggacuagauuucugcuugaagggugaacaggaagcaaagcagguggaggagaaaugagauuagaacaaucaaaaugaacucaaauaaaagccugguugaacuauugagaguuuugagguuuugucaaaugugguaaccacuuuuuaauaccuuuaaaccgugaauagaggauucguuguauaaauuaugacauguccuuacaauggaaugcaugcaguuuuucccaaggaugaguuacuucucuauguuuugacauggaaagguauccaaaauagaauauugaguuaguucuaguuuuuuuguuuuguuuuguuuuguuuuguuuuuuuccgagacagagucuugcucugucgcccaggcuggagugcuguggcgagaucucggcucacugcaaccucugccucccagguucaagcaauuuuccugcuucagccucccaaguagcugggauuacaggcacgugccaccacgccuggcuaauuuuuguauucuuaguagagacgggguuucaccauguuggccaggcuggucucgaacucuugaccucgugaucugcucgccuuggcccuccgaagugcugggauuacaggcgugagugaccgugcccaaccugaguuaguucuaguuuuuaaggaaauaacuuauagugcauaaaagaaaaaaaaaacugaaaacacagauaccaaauugcuaacaauauuuaugucaggguaggaaugaagauugcagaaagauuuucaguuuagaugucccacacuuucauauucuuaaaauauuuuuaaauuaauguguuuuuuuauaaucagaaaaaaugaagcuauuggugcucugaaaaagaaaaacaauuguggcgaaacuuuugaaaaagcagagaagaaagggguuugguuguagaguaugauuacaagucaggcuaaauagaaguagaaaagcucagcauucauuagaaaacaaagaaagaagugcuccagcagagccagcccauccagauaagacaugggaucuggcuguaaauuauuaguguguguuuucagcaucuaccauggaccuccccccgccaaaggugcacaauuugcacaccccggcuaugccuuauucauuuuuguaucuuccucuaaaguacaugcccaugguagauguucaguaaaugaugguagacaaagcucggaagacuaaauaugaguggguuaagaugggagaaaaacgccuguaaucccagcacuuugggaggccgaggcggguggaucacgaggucaggagaucgagaccauccuggcuaacauggugaaaccccgucucuacuaaaaauacaaaaauuagcugggcaugguggcgggcgccuguagucccagcuacucgggaggcugaggcgggagaauggugugaacccgggaggcggagcuugcagugagcggagaucgcaccacugcacuccagccugggcaacagagugagacuccgucucaaaaaaaaaaaaaaaaaaaaagggagaaaaacgaguaagcuaugaauaaguaacauuacuuucagagagcuuaaacucauucuaguaaaaucucagagaggaaaaacugugaaauagggggaugggaaaauauucucuggcacuugcucauguguguuuguuuugccauccuucagauuuucuuagugagacuuaauuuauguuuucucaguuauagcuuuucuuuuguauccaguugaacguuucaagccaucugccaugacagucauaucuuuggaacauauuuuggccuccuugcuccuucugcacucgccuuuguuuacccugucaucacgcugacuccuccagagacuccagugugggcucuguccuuccagcauugaacugugcccugcauucucuuuccagaucuccuuuuccacugaaggcacauggagggauaucaugauuccauuucgacugugccuuuucuagguucauaucucucaguggaaacacagcaucucuucugagccauggguacaauauauaaacaucuaugaaaaucaaguguuggugcugagagugcaaauagccuauugugagugauuuugauuucuuggccccaugggucaugguaggaaucuggugaauucuauauacucucuuuccagaaaaguguacacacuugaaaaacugugaacaauuccagggaguucacaggccauccuggagcccauuuauaucccuaagauuauguauuccugcaucccuggaacugaugcauauucuguuaggauagaauaaaagaaggaguucacuggaaccagaaugcaacuagaaugcacuggaacuagaaugcaacuaaguacaaaaaagcaggccggguacgguggcucacaccuguaaucccagcacuuugggaggucaaggcgggcggaucaccugaggucaggaguuugagaccagccuggccaacauggugaaaccgcaucucuacuaaauaauuuuauaaauacaaaaauuagccagaugugguggcgugugccuguaaucccagcuacuaggaaggcugaggcaggagaaucgcuugaaucugggaggcagagguugcagugagcugagauggcaccacugcucuccagcucaaaaaaaaaagcauauuucuagcaucagcuucacacuucagacacacuggaggcacaacaaauggaagauaaagccagacuggaguguugcaguuacuaucauaacauuacaacuggaaggaauaguuuguuugguaauacagcuuguagccuauagauacacagccaagugaauuguacacuguacuuugggugcuucuuaaauauuugggaccaagucauuuagguuuagggguaugucuguguuugugugugagaaagagaaugagugucaguguauauuuuaaacaguucacagaacuuaaaucuuaaaaugucuaucuaaagggaaaaaaaggauuucgucuccaaauuuaucuuuguguuuguaauacguauaugucuuuguuccuuuuggcauuauggacacuaacauguuaauguugcugguccuuuccaggguggacaagcuucauuuacacgauaucuggagauguguauauugguaaguuauggcugugucacuuagggcucaauugcaauuuaauuuaaacuacugaagggagaaaagguaggaugacaccauuuuauguaauugaauacuaugccaccuucucuccuacacuagcccucucuauaucccagcacagguaugcccagggcagggugccuuucagcuuacagaacauucagugagggaagagaauaugaacaccagucaugacacauccugugcacagaugaaaguccaggcaccauuauguguuuugauaccucgcuaagacguuggcaaccuccauacugauaaagggauggagcuacaguggacuccaaggggagcaggaaucugccuaucuccugggagaaggaaauggaaggaggugaauuugcaaugcuaguuuccucugagaaaacucaaaaguggcuuuuuucucuucuuccgaggguuguauauauguugcuuguugagucuaaucaagaaaagauguuugagaccuaaccaaugcucauuuuauagaugaggaacgugaaaucuaagaaaguuguuuaacuuaccaggguuacgcauugguggaugugggaccagaaucaaggucuccucaauccugcucuccacgcuucaccccauaccuuuuguccaaugacaaugcagagauagcaccaucuaacuugucuuuucaagucuaaaucccuuagcgaacccagcagcagaagggacagagcgggugggagagaggggcuugcagagcagccugguuccugccugggucuccuccuccccuucccauccuccuaaaagcagccauggguucccguaaaaggcucuugguagcacugggagaaaacagcuauagcagaugcuguugguaccccacccacaccccugggcccuuacuuccugagugcccacugaccaacuaauaauagccaguaucugugucacuuugcuugaaggcuuuucucugaaaccaaucagggcagcaugaaaguacuggagaauuaacauucccagaagcuaccucacccaucagacaggauaacucugaagccugugugaaaagccauuuacuaguuucccagugggauuacagccaagccaccugagugugcuugaugacauacccuucguugucugucuucccuuuucugucuaacucuccugacucuggacuguuguuuccugagaucaucucccagauaaauuccuuguaccagaauauaugcaucuccaguuauacuucugagacagcucagagaaccagccccucguuuucuccuccucauccccacagacgguuaugggugguguggaugggguggggcaucucaggguacaggccaagaauccccauuucugagacccucugcagcugggugcucuccacccgcuccugcagggaugccagcacugcacuuucuggggcccuaacauggccaccuccuugggcaauacacucccagcuccaggcagcuggcugacagauaacaucugcucagggauagaaggccacacccagagcuauuuaaaccauuccuuuuauucuccaaaaaggauguucaauugccugaaauuauucuucuggaaaauaauuguaaugcaaacucaugcauuuugaauuuauuccuaauaaaguacaaaugggcuuaguucccuuuucagugaauagcauuucaauuaggggucaggagcaaaauucauuuaguuuagcacuggagaaagugugaaaaaaagucuuguaguaguaucauaaguuuauauguacacagcuuaaacuauauuaaccaucuggaagagaugauauaucauuuguuuuuaugaucuucugaaaauccugagaaaaacauagugcuuuauaaaaauagaaaaaaacauuuuuauggagguagugcucccgacuuaugauuucaagagcaacaaaauaaucuacacaaauggaaaugaagaaagcacaugaauuuuaaggugguaaggauaacagaaauguuugugcagaaugagaaaaagcagggagaagcaaacuuucuguaaaaggacagaucacaaauauuuucaucuuugcaaggcauauagucucaguugcaacuacuuagcccugcccgugucucacagaagcggccacagaugauacauaaacaaauuggguggcuauuccaauaaaacuucauuuauggucacugaaaugugaauuucauguuuuuucaugugucaugaaaggcuuuuuuuaaguuuguuucaaccauuuauaauagugaaaauuuuucuuagccugugggcucuaccaaaggugacaguugauuuugguuuaaaugaauugcagggaaugaaggggaaagaaauuaacgaguaauugccaaaaccuguuuuaagcaguaguuagagccuuguuuccugacagaccuuuagccugagaaguuaacaagugaaaugcucugcaguucucgggguaagaaugacccacacauccacuuguuuuucuugagaugaggcaggauuuuccugagucauuucuauuuacugaccugguccccccucgugaccaugggccacagugcaaaacaucuggcaagggaugggucuguagccuuggagcaaaguugcaucugucuagaauaaacuggacugugaagagaauccagcucacacaacuggccucuugggacugugcuuuaaccagugaguggcuggcuaaaugaccucauuugaauuuuaucuccuucccuuccuccuaccaacacccuaaugggggggcgguuaaugagaaaaacaaaagggcaagaacaaaucaucagggaaaaagaaaugacgaaacagaaauagcucuugaauauguacugacuuauaaaaucaauagagaaaauccagaaaauguuuucugacuucacugccucaauuuugucuugcuuauaaaacuagguuggcaccaacgaaccacagauggcaggaagugauaagcaaggaauugucuuuuucgaaaugucaaacauguucaguugaaguagauguaaugaauauauauauacuugguguaucgggcuggaauaaaugggcugcaacuuggguugaggaaauaaucugaggagacugcauaaaauggaaauuuaggagggcuauuaaaauauuaacugauuacaggaagugcuuaaaagacauugauaaauuuaguuugacuacaaacagguggaguuuugaacauuagaaaaugcuccacagccgggcauggugguucacgccuguaaucccagcacuuugggaggcugaggcaggcagaucacuugaggcugggaguuugagaccagccuggccaacauggugaaaccccugucuccaguaaaaauacaaaaauuagccggguguggugaugcacgccuguaauuccagcuacacgggaggccgaggcaggagaaucacuugaacccggagagcagaguuucagugaucugagacugugccacugcauuccagccuaggcaacagagcgggacucuugucuaaaaaaaagaaaaaaaaaaaaaaaagaaaaugcuggauguuuaacuaguugucaaaguaagucagucauuuuaaagguaaagguaaguauugugaggcuauguaauuguccucuaaugacacccugaagaaaaagaguuaacagagcuaaaauaagacuaguagaauucucauuuucuuauucaaagaaaguauucauuugagacucaucugaaaguacucacuuuaugcuuuucaaggaucuucuuaauuuuuaauauauuugcuuuuuccaacaaugaagagccuucuaaacugacuauugaauaguaauuuuaaaaagugugcaauagagggagagaccuuugacaacaaucuuuugcuaaggcaaaaaguucucugaccagcccacagcuggaaucugugcaucauaugauaaaaaaaaaaaagucaaaagaaaauaaaaaauacauugucagaaaaccaguagaucccacagauacuaguaccaaaucucuucccugcagcugugcuggaaauuacuuuacacauuaaugcagagaucaaaaggauagaaaaguuuacauccuguauccuuguagcuugguacaguuuaucagcuugaauucuaguccccuagaaggccugauaucaaguauacuguuggugcuuagaaaauauuuagaaaucuaaaaacauuuguuuguguuuagugaaaugaacuggcuuacaaaggcaguaaaauguuuugaauucauuuaaauaacuaaugauucacgcuuaguuugugcuaacguuuugagcacaaacuucugugcucugguuuugggugauauuaagcaguuugaaacgggcucuggaucuugcaguaaaggcggggaaacacaaaugugcaccagcaggccucauaauugaccuccauuuauccaacuaacugaauugcccagugcucuucauucuauggugaauacuuugaggaaggugcuugaacacccaggaugauccgcuccucccuggucugccugcucauagcugcucccaucagcugaguuguaguggacuuaaaggcaccuauguuuguucucaguccauuuaugcuaguugcaccaauaauugaaauuauguaauuuaauuaaacaguuguaaauuaauuaaauaaaugugaaaagagaguugguauuuccagaacaacuaaggcagaugcuuuguaaaagugaauugcuaaaggaaaugccuuugacacggaaagacaaacaucauauguucucaguucuuugugggaucuaaagaucaaaacaauaugaacucaugaacauagagaguagaaagaagguuaccaugaguucaugaggcugggaaugguaguugggggcugggcagggggagguggggaugguuaauggguacaaaaaaauagaaagaaugaauaagaucuacuauuuuacaacauggugacuauagugaauaauaacuuaauugcaaauuuuaaaauaacuacaagaguguaauuggauuguuuguaacacaaaguauaaaugcuugaggggauggauacuccccaugcuccacgaugugauuauucugccuugcaugccugaaucaaaacaucucauauaccccauaaauauauacaccuacuauguucccacaaaaauuaaaaauuuaauaauaagaaaaugccuuugaauuugugaaagauuuggggaaacucuaauaaucuaauggguggugcauuauggguaugcuuuuaaaagaaaaugcuucaaucaagucaguaaacccaccuuaacuguauuucuuucuuucuuuuuuugcauucaagcacuccucccaccugucuccugaguagcugggaugacaggugugcaccaccacaccuaaaaauguuuuguacagacagggucucccuauguugccuaggcuggucuugaacuccugggcucaagcaauccuccugccuuggccucccaaauugcuacaggaguauuuuuaaacauuuacaaacaaaugcacauuuaugcuuucguuuaaaauaaaauguuugaagcaguuugacugucuuuuucaauuaacaaucucaauugcaucagauaagaaggcuucaacuauacauauaaaauugauaauaucaaaccuaugauagaaguacuagaguguacggaacagagaauaaauaggacagcaauucuuauaaauagaaaaaaaggaaaagaaaaauuggcauuugcagaaaaguuguacagcaauuaaucagacacugaagaugcagcacuaacuuuacaauagguuuugaaguauuucacccuuuuaugacuauuuaggcaaaaaaauugcaauuaaauuguuuucaguuaauuuuuuccuuaacugugcuauuaaauuuaacauucuuggcagugauucccaguggaaacuauuuguuaucugauuuggcucuauuuaucauugaaaguagucagaaacaauaagauauauuuuuugagacuuauuuuagguucaggagauaaccagaugggcgaauaacauaaaaaugaucuggaaauaaagauagaaucaaucuuugcuuucugugaccgugacccuguuuuaaacauuucauguaauaauacagaagcuaaaaguacacuugcaguuauuauuaaccuggaacccugacuccagugucuauaagaaagguuuaccuugguuaggcgcaguggcucauaccuguaaucccagcacuuggggagacugaggugggaggauugcuugagccuaggaguuugagaccagccugggcaacauaauaagauccugccucuaccaaaaaaaauuuuuuuaauuagcuaggcaugguagugcaugccuguggucccagcuacuugggagguugaggugggaggaucacuuaagccccagagguugaggcugcagugagcugugauuacaccacugcacuucacacuuggcaacagaguaagacucugucucaaaagaaaauaaauaaauaaaaauaaagauuuacagcagggcgcgguggcucacaccuguaaucccagcacuuugggagaucgagggggcagaucacgaggucaggagaucaagaccauccuggcuaacauggugaaaccccaucucuauuaaaaauacaaaaaauuagccgggcuugguggcacaugccuguagucccagcuacucaggaggcugaggcagaauaaucgcgggaggcagagguugcagugagcugagauugcgccacugcacuccagucugggcaacacagagagacuccaucucaaaaauaaauaaauauauaaauaaauaaauaaauauuuaccuuagaguggagcauuucaaaugaccucuuuaguaucaacacugagauugcaaagagaaugggcagaaauugcaucccacauacaauuagaguuagagccccuuagacaagcuaaacuuuuuguugcugaauuaagauuuccucacagaccaaugaacaccauagucaagcaagcuccccugauagggggugcagagaaauaccaauucagcauuauuuuugagcacucuuuugccagcucacuccauuaaaacauagcgaagggguuuauaaacuguuuugguauauguaucacgaaacauccuacaugacaaaauuaugggccaggaguggaccacguggguaauggguguuauacaugaauuaguugaagauaaagacauguuucauugcucccaggggaucucaguaaagcacacuuaaugaaaugcugcucuguaucacaguugaaaauauuacucaacucuaaaugagauuuuuuuaaacucccagaccucucuucuauugccaaaucccugcauaaguggaaaaucaauggaguucuaucauuuguuuccaugacguuuguugaccuaaaucuuugauggaggagaaaccuuuaguauuaugcuggggcuggcucuugcuagcuugcaggagcugauugugugccuucccuggccucacaucaguagguugaaauuggccacagugggaguauuuacaccacagauauuggcacacacuacgggaaucagguuaguucuccccuuuacuccugaaagccaacuguuaaacauuauccagcacacuacuuccucugggacagaaguuguuaaucuuuuuacugccauggaccuuucugacaucugugaagccuccugccuccucaaauaauguuuuuaaagucagugcaguuaugaaaauguuaaaagaacagguuucggauauagcuauaugugugcuucuuuaaugacauuugacauaacaugaucuaguagcaggccugcucuaaauuuuaaguaauaauuaacauaaacuauauuuugagauaucuacaaaaccauaaugugauaugaaaauaucuaugauuucugcuggagacaaagucaucagcccagcuaauacuacuguggcuuguuggcuacauucaugauugaaggagaagauacguuucaauuuagguguuagugaaaguaaacauguaauuuaucuccuaucaaaguccacccaugcccugaauuguauccauagaccccccuugggaggacauugacuccacguugagaacuccugcucuguuagaauccuauuucauguuugcaagcaucagaaugaacccugcugccucauauugguuauuuccaaaguggaggugagaaggucuucucuagaaaauauaguuguuuggacuccaacaaauauguccaaaauucacaaauuauguuucuguuuacauaauaauugcucaagcuauuguuuucauuuaaauaagcauuuccuuauugauuauucagcuccaacuugucacaugaaugcccuuauuuacaucccaaaagggcaugcagguguaucucccaagacauuuuaugggcugcucauucaauuugaaaccuucucucuccugcccauuaacauaucaggguuuuucccaacugcaagaccuaauccaaaucucacccccucucuacagccuucuguggugcacuuuggccucuccagucuguagccuucucuugcagaaccacucuugcaaucuucaagucacuacauucuucugcuccuagugagaaucauguuagaauuuucucucuccaacuguugccaaauccuuuagauuucuuuuucaacuccaccugucaaauccaucccuaucuuucuguugccacuuucucaauucagaguguaauucauuuucacuuagacuguuacagcaaacuccuaacaggucauccuaacuucaguguuguccccuccaauucacuccacauucugccaucauagucauuucuccaagacacagaucugguaauuucacacacacacacacacacacacacacacacacacacacacccucccuccucaagggcugucaauuuuauacagauaaacauggguuuaaaggcuuucccugaucugaagacagcuuacauuuccaucguucuucccaaaagacuguuccaagaaugguagaauuuucacugcaaucuuuucucuugucuagaaugcccuuucccccagauuucccucuugugguuuaucuaauccuacagagcucuguucaagucuuaccuccuccacaacaaauaucuguggucccuagaccugcacaagcccccaucaccccuguucucuuauugaacuuugcuuaugaauuuaucguugccuuuaagagacacuuucauuuguauuauuuuauuuguaaaccucaguauagaagagauggaaauguaucuguccugaauauucccacaacauuuagaacagggucuuuuuuuaauacuuuaaguucuaggguacaugugcacaacaugcagguuuguuacauagguauacacgugccauguuggugugcugcaccgauuaacucaucauuuacauuagguauaucuccuaaugcuaucccuccccccuacccccacccaagggucuuauucagaguucaauagcuauuauucaauagcuguccaacuuacuuauuuuucaguugaauuauucucugauuauuuuguguguauagauuuaguuugcuccagcaggauuuugaauuauuucuaugaaaggaaucuacuuugcaugucucuguauugucccauagugcuaggcaauuguagguacucaauuaauacuuguggaaaugaauuaauuauggcauuugauaauuuuucuaacuauuuuuaauucuuauaaacuuuauaauuuaccuaaggaaacaugagcacauaaugccaaggacuuugcuuaucaauuaaaguguaaauggaaacacacgcaggauucaucuccuuguccuuuuucaaaauugaaaacaaacuaguuucaggcuuuaauaauagcaaauauaauuaaccaagagauucaagggaauuacuaaguccauuauuucucaaauuaaaauaaauguuguggugcuauauaguuaaccaaauaaguaaccauauaacaaauguacuauaauggguauuaaauuagugugucauugguuuuguagggcccgaugaugcacaacaaaaaauagaaccucaucacacagcagugcuuggagaaggugacaguguccagguggagaacaagguaaguauguuauuuuccuuuaacuuucuuaacauguacuuucuacugguuuccaagaaaaugccuaaauguuguggauaacugaaaguuuuucucucuuccuuggagaagaaauuauaccagaaguuuaucaugucuuuucauuaauuucugcuauuucuauggguuuauuuuaaaguuuuaucuuuauugauucuuuaucuucagaaaucauauaaagucccuauuguuuaccccuggaaauuugaaucuggaagcaacacaucuuuguugucucuuaauuuucuuucuuuauacaauugauuuauuuuguuuuuagcauaagugaaaauagaucagcccuauagaaguagaaauauaaaucuacaugcauacucacauagagcccuuugaaaagaauccccaccuuggccgggcgugguggcucacgccuguaaucgcagcacuuugggaggccgaggcgggcggaucacgaugucaggaaaucgagaccauccuggcuaacacggugaaaccccguguccacuaaaaauacaaaaaauuagccggacaugguggcaggcgccuguggucccagcuacucgggaggcugaggcagaagaauggcgugaacccgggagguggagcuugcagugagccgagauugcgccacugcacuccagcugggcaacacagugagacuccgucucaaaaaaaaaaaaaaaagaauccccacuuugaacugagaggaagauaggaugcauuucauagucuuuuugugaugaaucccugcucuuuaaguaaaguuucugauauuuuaggagucuugggagguuuuuauucccaaauuuccagguuucuuucucaugucuauuucauucccuugaguaauucagucaccauguugugagucuguuuagucaaucugacugcuuuaugucauucuuauaaagaggauugaggagaaaauugugcaaaagcuccugaaaaaaacaaacuuugaaaacuauuuuaguguguggaugacuagugccgaggcagucggacugacuucuggccuucugacccugccuguuguuauagaacacaguggauuugaggaguuauuagaucuuagcccacuuuucuggcagcaaucuacugcugcuuuaaucaucugcagcaccaccaugaacugugagguaaacggaagaaaaaccugaugagcacuagaaaaaugcauaugucagggucagugcccuuuaauauuagacugagccauaugaaacugcgacuuuugaccgacaaaaaugucuauuuuauaucuuucaauccaauacaggaaagaggcaugaaagcuacacauaggccagaaccuacuaauaucagaaugguuuguaacauuaucugguuuaacuuggcaaccucaguucuuccuauaauacacagagagcacauugcagauaaggaguuggaagcuaaaacagaacaccagaaagaagugaugaagggagucagaagaacaggugcagccaacauagaaaagagucagcugaaaccaucaauucacuggcaagcagcacuccuggcuccaguggcaucguucuguuaugugcaauucuguaauuguugcuguguauaagcauagccugagccaucaaaaccuuagaaagauuucuaugaaaaaauugauauuaaaaaaucagcauuuaaaggcagcaugugucacuuauauccacacaauaguagaaaguccccuuuagauuacagcagaaaagaaauucugaagguuugaaucuuggcuuuacugcuuguuagcuguugugacuuuggacacguuuguaaagcccucugagcuucaguuucuuugucugcaaaauuaaaauaauacugccaacugcaagugauuguuagaaagaauauuugagauuacguauauuacaagucuacuccagauugagcaugggggucaguaaauuauguccaauaggccaaauccaaaccuuuuucauaaaguuuuauuggaccacagccacacccauucguuuccauauugucuauagguucuuuuauccaauaacaguggaauugaguaguugugacaaauaaagccuaaaacucucuggcccuuuacagaaaagguuugguuuacuacguuguagaugcucaauaaugguaacuggaaaguuuaugaauccaaauaucuaauuugauagucauaccacaugcauguuaccuaauaaggauuuauacaguagaccugaaggcuuagggcacauaacaguuucuacagguagaagaaggcuccaagagacccugacucacucacgcuccaagccaguguuauccucacuugaaccuagcauuagccugaggauuugauaaagaaggaagaugugacugcccagugccgcgccaaucccauuuccacuaaacuguggucaagaaugagaagcugauuuuuugccuggcuuuuuuucuggcucuguucuuccugcacuuuuacuacucuuccuuucuguguucuccaccaucacacccauuugacuacugguugaccaguaguaugggcaguaucuccuauaguggccaaucuccaggacaggagaggaggacaaggaagggaugaugcaaaagacuacagcuucuuucugccccagguuucccuguuccaucuuagaacuuuuucagaguucuuagagauuggaaucaacuccagacuacucuggacauuuaauccuggacugguaccagucaucccagaauagcuucuguuucaagggcuaaggcuuccugugcugcuuugaccuacugaugguacucuggacuuucucuuaagaugaugguuucccugauggcuccacgaucaggaguacuagaguuugauaugaaaggcuccaucucacccuuaggcuuauguuuauagugguauacuauugagaaggucuuaagccucauggauuagcaaacucacccguaguggaccaaggaagacaaucaauaccucacuggcugucaucaaagccauacuucacuguaacagugcuuuuuaacuggcacuauucauggaaaacucauuaauauaauaaagauuaacauuugacuauauauagcauuugauuaaaauaaacauugaaagacagaaauaaaacaaaacauccuguuaaaacuagagaaaacuuuuuugcuuguuuaguguaaaaguucaugaugaaauaaaccacuaaauuuuuaagcugauaacaguuacuuguuugaucuuuucauuggcccaagaaguauaaacaaugaagucugguaggaacaaaugcaugcaauaagucaugcuaaagcacaguuucuuucugguaauuuuuuucagguaauauaucacuauaaucaauguuauugaugcaaaaacaugcccuucgaucagcaguccccaaccuuuuuggcaucagggaccaauuucuuggaagacaauuuuuccucagauggggguggcugggaaugguuuggggaugcuucaagcgcauuaccuuuauuguguacuuuauuucuauuauuauuacauuguaauauauaaugaaauaauucuauaacucaccauaauguagaaucaguaggagcccugaauuuguuuuccugcaacuagauggucccauccgggguugaugggagacagugacagaaauaauucuauaacucaccauaauguagaaucaguaggagcccugaauuuguuuuccugcaacuagauggucccauccgggguugaugggagacagugacagaucauuaggcauuagauucucauaaggaguuugcaaacuagguccuucacaugugcaguucacaacaggauuugugcuccuaugagaauccagcaccacugcugaucugacaggaggcagagcuggggugguaauucgagcaguggggaguggcuguacauacagaugaagcuucacuaccucaccugccacucaccuguugugcagcccaguuccuaacagaccaccaauugguacugguccauggccuggggguuggggacccaugccuuagauucauacucagaguccuacugccaucuugaguuuuauauuuauaguugaucaaacugaguagcuacucauaguuuagaaguuaucaacauauuaagugaaccauaaaacuuucaucugggcuuugaucauuuauuguugguaucagcagaacucgagacauaucuuggcaaaaauacuuauggaauaacaagagcaacuuaaaaaaguaaauuauuaaguaaacccagaagagcuuaacucuguaccagaaacucugaaaaggugcaccaaagcaaaagacauggugccaaaagauggugaacguuaguuggggugaaguaguaaguggaccucugcuacuuuuguauggguuuuuaaaaucaaaucccauaaaggcauuuagaaccaugcaaggacuuggguuuuaaauggguauuuaauucucuuggcuuuugcaugauuuucaucauuugacaccauagacaaagucaucauagacaaggacuuuucaagauaacagcaacugagacuuucagccacaucaucacuguauuuucuggaauaucuggaaagaugauuagauuucaccaaagaaggcaaguuaaggaaagaaaaugucaucuagguucauguuugcauauuuugacagcuaguuggguuauggauaaguaaagugaugguacauaaauaaauauaggccuugcaaugguuaaacagagacuuuuuaaaauguaaagaagugaucaaaacaucagcuuugauuuaaaaaguauuaaaugaccccagcccugagauuguagggaguaaaucaagacuuuugaagaaaccauucuacccuacagucccauuuauuuuuuaaguugaaggcaggaaagggaaacaaauuucugucaugucaaauacgguaguuuuuauuaaauacauggaagauuaaggaauuaauuauuaauuuuauugaauccaguaaucuucuggaacuaguaacauuacaauaauuucuaauuaaagagcuuugcauuaauagaaguaugauauaguauaauauugacuuacauauuuagaaauaugcuauauuauuagaauuggggugaaguuucaaaaauuuugaaggcuucauuuuaaagugcguaaucauuuuggcuuuguuuauuguuuuauucuaaauaagauauaccuaaaagaagccugaaaagagauauauaauguucaguuaucuauuagugaguaaccacgcuaaaauuuaguggcuuaaaauaacaaucauuuauuauuucuccaugugguggggaguucuaaugccgguuucucuggggucacucauguggcuggcaggcugggagcugggcucugcuggggcuguuguuuagagaugccugaguucugcucuagguagccccuccauuuggcuaguuugggauuccucgcgagagggcagucacaagacagcuucccagagagggagcauuugcuuaugggaggagcuguggaaaugaagauaggaaagcagaagcuggggaaucagagaagucaccaaccaguuaaucuggaaugccaagcauauucaggcacuaaaaugaggccacaaaagaagucuaguggagaagucuguaguucugcagcuuagugucuagggauggagcugcggccguucuuagcagaauuagcagucaggaagaagagcuggacauggcaugcaggaggaugaggacaagcuaaagucuagcagcaccucugacuaccuguuacaacuaaccgccacauugucucaacuuaacuaaguuaccagggcacaaaacaccacauagaaguguaucuaaguacauauguaauucacuucugacggaacuacaguucuccuuaauuucaaaucaaacacccauuucuaacaaauaaaauuacugaaaaguguauauauguaugauauacguaugauuuugauagauaggacucuuacaauuauaacaugugaauuacuuaaaauacuuaguuuuauauaaugaaaugaucuaaugauuguuaaaccagaaaugcauuugauuacaaaacaauuccccaaacacagacuuuagaaaauauauauuuuauguuuccuuuuaacuuuuaaaauuagcaaauuuuuguagcaauuugaaaauaauacagaaaagcauaaagaagaaaauaaaauuugcuuuaauucucauuauucagaaauaauaaaugcuaauauuuuaguauuuuuaauccauaguauauacauaccauuuugugauauuuacaaaacuuacaagacauuaugaacauuuuauuacacacuuaaauauuuguugagaaaaugaauuuuaauagccacuugauaguuuuucuuauaaacauauaauuauuuaaccaaccccucacuuuuggagaaauguuuucaauuucugcugugauaaauagugcuacgacagugaaauucccuuacacuguauugcuaaaacugucauuacuggaucggaggacauuagcaauauuggggguuuugagucauauugucaaauugcucucuggaaggauuacugcaccaguugaaaaucucccaaacgauauaugaaaguguauuuuucccuguauccauacuagcacuggauauuaugguuaauauuuuuuccaguuucaggaaaaaaauugaauccuuaauucuaagcaaaaacuuuuagagacuuuaacguaauaggacccuuuuggagggaaauuugcuugagcagaugucccuuggaugcucuguuuuuauaagguuccauuuagugcaauauuuccggggcauauuuuacauuauuaguaauaauuuucaaaaguaacaaaaucuuauuuuggauuuccauaacuaaucuucccuuuuaaaaauuauaugguaacugagaaaucauaaaucccaugauaagccauuuaaucacaugguuugucgugaagauauuuccaguuaaagaaaucuuaauuuaaguucuccuucuuaaauuugagaauguuaauauuuugguggcuuggacuuauucuugaguucuacuugcuacuaaacaacguaagaaauaaacaugucuauauugaguguugcacagaaaauauuuuugaaaauuauauucagaauuaggaacaucgccuauuuggcuagcaugucaauuucaaauuguucacaauuugaucuucaaaaauaagccugcuuauuguuugauguuuucuuuguuaacuuuaggaucccaagagaagccacuuugucuuaauugcuggggagccauuaagagaaccaguuauccaacaugguaagaccaaaaugacaaugauuuucuugguugauuuuccuuuucuuugaaaacaguauacauguauacuauuguugggaagaauagcugguuuuuuuuguccugucucuccaucuauaaaucugaggauuguuuaauuuuucugucaucagagggaaauauauaugugauguuuauucaucucuuuuuuuuuaaagaaacauuucuuagauaccuauuauguauaggauauugaguuuggaacugugggaagaacaaaaauaguauuuuuguauuaugucauagggaauuuuaacuugaaaaaagagucuacagucuacugggaacuuuaacauccuuuuuaucuuuaucaaaaauaaaggugauuucaauacuguccuguagucuauugcauuuuuaguaaaaaauaugaaacucuuaggaauaguauuuuuaagaaaauaguuguuauuuuuuguuuauuuaaaaaaaugaguagagguaacugauauagccgaaauaguacuauacuuagaggcagaaaauccuggcuuaaguacccauaacgauuacuucaacucuuuggguuuugacuucuucauaucauuguuguuugauuaaaugaggaacaucuaaaagcaauuaaaacccauuuuauuauuuagauaaaugcuuacaaaacauauguccacuucaccaauuauuaaauucaacgugcauuaaaaucccauugcauuucccugccuugcaugaauucccagguacacacaaugauugcagauaaaccccagcugcucaugaauuuaaagaacacggauugcuuuaaaaauauucuuuuuuguucuacuaacuacuucagggggaacauuaaauuguacccugccuugccuguagcauuugacaaccauuuuguacgcauccgauuuccauuccaaagguuugugguucuuguuuccuuuucucucaacugaaaagcacugcaauauuauaguuuguuuuucuggaaaaagccuucagacaaacugaguagggucauaaucuuuauuccuaguaacuaacauuuaggugggaaaaacaugugugagauggaagucuuauuuuaggcaaucuccucuguaccaauaaugaaaagcaagagucuaacugaauuaggugacagaucaaaggagugggacugcucaaagccacccuacacuggggucauguggauccucucccaguggcuuggaacacagggacacuagguaugccugcacauacaaacucggaguaaucagacaaaauaaauaugucccuugaaaguucaguuacugagaagcaaagcauuuuguuuuuauuuuuuaacuuuuaaaaacucagacauuuaaguuuuucuuuuacuuauguguguuuaaaggcagccacaaccaucucuugauugggaacuugcacagaucucaugaauuaccuaagacccuuucuccucuuaucaucguguguccuuaauuauucauccacagauuaagcacaggaaaucauagaauguuaggauagaaaauaaccuuagccaugauguagucaugccucuuuuauagaugaggaaaauaaaauccagauauuuuauuuauuuacuuaauggaugcuugcauagaauuuacuauuuccuagacauugguuaaagcacuuuccuaauguuaauccgucuaaccuucaaaacaacccuaugagguugguacucucaugcccauuuuacagaugaagaagcagaaggucaaagguucauuggcuuacucaaggucacauagcuggauucacacucaggcugucuguuuuccaaacacccugcccuucugccucuuaccaugcuggucguccauugcucugcccuguagcuucucuaauggaaagcgauuguuagcaguggagcugggacucgaacccuagucuccugaccccaugucuuauguucgcuccacuauaccaaaguucuacauaacaagagguuagacacaccauuuuauacaagaggggggcuucagaggcuuaauuagagaagugaugaaagcuauaauuugaaagagaauuauagguaacuaucaaauaauuuucuuguucacaacccuuguaguugaucaauuuaaaaacaugcuuucuggauucaguuuucuccuugaagauuugaggagauaagcuucaucaguuagcuuuaggggacucuaagcuuccaaugcuucccuguauaacagagguuauacuuguuuccuaaagugugguccauggaccagcaguaucagcaucacuugggagauaguuagaaaugcagaaucucaggccucacuccagaccuccugaaucagaaucugcauuuuaauaagauucccagcugauucaugugcacguuauaaauugagaaacauggcagacuaccccagaaagugucaaaauggaagccuagaagcacaccauucuuacagaaaacaguugggggaugggaguacugcuccacaagucccaaccauagcaaaauuaugaggcacaagaauuugguccuugacucaguaccugcucccaucuuccaaguugcauuucccuuuccccugcguguccuuuaaaaaguugucuuccccaggguacccucuuggguuuauuguuuauucugcauauguuaacucucuuuuucuuuccuaccugauauaguccaaaccuccauuuccagaugaaauuucucucaugagcuccagauccauaguuucaacaauguaccaaaaaccucugcuugggaaaccacuuuauugucucuaguacuucuauguuaaaauacucagaacugggccgggcgcgguggcucaugccuguaaucccagcacuuugggaggucgaggcuggcagaucacuugaggucaggaguuugagaccagccuggccaacauggugaaacccaaucucuacuaaaaauacaaaaauuuagccgggcaugguggcacgugccuguaaucccagcuacuggggaggcugaggugugagaauuacuugaacccgggaggcggagguugcagugagccaagaucgcaccacucaccacugcacuccagccugggcgacagagcaagacucggucucaaaaaaaaaaaaaaaaaaaaaaaaaaaaaaaaagaaaagaaaagaaaaacaaaacaaaaaauauccagaacugaacaccuugcuccauccaaagccucccacguccuguaucucaaauacccuuaacaauuccaccauugacucagccucccaaauuagacaccugcucuucuaccuugaugccaaagucuucuuuaaaaauuauaaaucauauuauauuacucccuacuuaaccuuacagugauucauaaucaccugcaaaaguagguccaaacuucuuccuguagauugcauccaaagcccagaagggucugguuucuuccuauauuucagaucgccauuuuuuccgccuuugaucccuccuuccaccacuguaccccuauccccuccaguauuccuccagcauacuaagccugaacaugccuuuccuccgugugugacugcucaaacaucacucccucugugaauccuuuccuggauuucuccuccucccccuuucuguguugauuuuauaguuuuuacacuuuuauccuuccauauuucaaacaguuuuguaaugauuucuuuucauaucugugugauagauuugaauccuugaggagagggagucugccauuuauuugucuuucaucuuuaugucucuagcuucuagcacaaugucugucauuuaaugggcauucaguacauaauagauagguaauugaaugaauggauuuagaugccuggguguuuucuuucuacuuguauucuauuccccacauccucuccaaagauuucagcaucaucaagacauauuauccugugucuuccuucugaagauuuaaauuauagugaucaccaaauccauguugauaugauaacaaugguuaagaaguuugaauauguuauuuucucuaagcaauacaguuguauauuaaucagaaucucccagagaaagccccuuagagcaggcaguuccauaaaaggaaugucaggaacuucugcaggcuggaugaggacauacacugagugaacaagucugucaacugcucuaaagacacugucaaugccauauaaaagcuggccuuguucaucuagcagaucaugggggugagacaguccagugccucucugccccuacaauauaugaagaaaggggaagaaacacacauugccuccugguagauuaggggaggacuucuuguacauuuuuagcaaaauccgaguucagacccagcaauuagacaaaagggucagcaaacuauggucgaugggcuacaucugcccacugcauguuuuuguaaaugaaguuuuauugggacacagccauaccuauucacuuuugcauuaucuauggcugcuuuugcacuuugaugaaagaguugaguaguugagacagacacuguuugacccacaaaaucuaaaauacauacuaucuagcccuuccuagcaaacauuugccaaccccuagaaaacuuuuaaaaaaugaugcucuucgacuugaaauuuuuauaaucuucuguuuauugucaauaggugcugcugauuuucaaaaaaugacuuagaauccucaaauaaguauacagccuuauaugcugcuuagacaccaaagcuaugauaagauuugucaguucuuuguaucagauggguucaauucuugacaucagcuaauguuauaaaaauaacuacaaaauugguuguaauagaaccaaaucuaagacucuuuuuaauaaaaaagaucaccauugcuggugagaaaccuauacugaaugggugagaugccauugcauuuaucugaaguuucgucuuuauaaucaauaaucauauacaauccuagucaagaaacucaucuuacaguccuuggggauugaacacugugaaaauaaacuuuuacucuucggaugugcuuggauuuuguuuuaaauuaagaacuacagaaauauauaucauuucuagugguagaggaaaauauugccacccagaacuuucugaaugucucuuucugcccuagguccauuugugaugaacaccaaugaagagauuucucaagcuauucuugauuucagaaacgcaaaaaauggguuugaaagggccaaaaccuggaaaucaaagauugggaacuaguggaaagcggaagagcaggucuugauguguccuagaauuuugccauuucugagauugagccauugaaggcauuccauuucuaaagcuuauuuagccggugcuucuaaagaauuccacacuaacgugauaacaugguuuuuguaacaauaaauguaggauauuuccuggcacaugcaaauaaaccuaaucauuguuucuuuaaaaaucaguguuuuucauuugagauaccuaaguuacuaagcuucuguuuaaaaagucguuuuguguau

SEQ ID NO: 19227 - RNA, 65018 nt, Homo sapiens
caacaggauuacagccaagacuucucugcauuuucugccaaaaucugugucagauuuaagacacaugcuucugcaagcuuccaugaagguugugcaaaaaaguuucaauccagaguuggguuccagcuuucuguagcuguaagcauugguggccacaccaccuccuuacaaagcaacuagaaccugcggcauacauuggagagauuuuuuuaauuuucuggacaugaaguaaauuuagagugcuuucuaauuucagguagaagacauguccaccuucugauuauuuuuggagaacauuuugauuuuuuucaucucucucuccccaccccuaagauugugcaaaaaaagcguaccuugccuaauugaaauaauuucauuggauuuugaucagaacugauuauuugguuuucugugugaaguuuugagguuucaaacuuuccuucuggagaaugccuuuugaaacaauuuucucuagcugccugaugucaacugcuuaguaaucaguggauauugaaauauucaaaauguacagagaguggguaguggugaauguuuucaugauguuguacguccagcuggugcagggcuccaguaaugaacauggaccagugaagguaggugagcucaauuuuuaaugugaugaaguucuuuuuauuggcucauacagaggacuuucuuugcccucacuauuuuugaaacaauauaaaaaugcagaaccauccuaguaguggacuggacaggauauauccugcauuucuuggugacuguucuguuucuuagucuuauuaaacuucuggccaugaguauuugaaaaugcugggguggggguugguuguuuuuugaaguuaugguagaacaugagcagucuggaaucuuuuuggauggagaaguuucuccucgguugcauaugcagauggcacagugguuuuuuaaugaaacauugauuuguuuuuaugacugauaacuuugugggccauuuauuuucaggucuuugugagcagcagagguuaguuuauucguuugguaaauugaaaauugcagugcuuucuaugaacauuuucuaucugcuuuugcaaauuaccaauugcugccauccagaaaaauguuuucucagagaguguuugguuuuuucgcuucuugaaagguguaaaauucaacacuaaucaaaucuuugguucugugagcaagcaucaaauagagcuuaacgaacagagaguaaugcaaaaaauuaaccagaauguugcugacugcuggaacaauacuuagcccaauuuuaugcauuucauggauuauauauauuuuaagcuucuauuuugaaaaugauucggauguaauuguuuugacugaaguggugcuaaaucauuauugauuuaggaacuucuggccuugaaaagacaauuaaaugugaguuugaguuuuuguagcuguuguuuaggacgugcauuuucaacaggggugauaucgcccccagcaggggaaaauugguucguggagggaugaaaaaguuuuacccuuuugauacaucacgcacagacguacauacaguacauaugguauguaguuuaaaauacguuauacauucaaauugcauagggggaaagugucuucaaaggcuccuggcugguguugguggccuggcgagggugggggcugauauuuaaaaauguugaacacugagcuggaggugagugggaagucaccuugucuggcagccagcacuuuucuaacuucucaaauuccaaauuuacaugggagaaaucacaguguuuggcuccauuuuacugccaccagccuugauauuggaucucaaggccagauuguagguaaaugggaaucugacuguaagcauagguaacaggagaaaacggucugacuuguuugaagcaaguaagacuuuuccgacuguccagcuuuuucguaaguucaugaaacagaaauccuuuagaugugcugggcuccucgaguuuuaaaauauuuccauuuuccuuguaaaacaucacuuuaucugaugguauaauaaaggagacugaauuguuggacauaagucauauucuuuagguugcucagcucuuucaaagagcacaagcaccaagaaugucucagguguccugggcacugugaaguuuuauuuauuuauuuauuuauuuauuugagacggagucucacucugucacccaggcuggaguguagugaugcaaucucagcucgcugcaaccucugccucccggguucaagugauuccccugccucagccucucgaguagcuggaauuauaggcacgugccaccaugccgggcuaauuuuuuguauuuuuaguagagacaggguuucacuguguuagccaggauggucucgaucuccugaccugaugaucugcccgccuuggccucccauagugcugggauuacaggcgugagccaccgcgcccggcuggcacugugaaguuuuaaaugcuuugaauguacuguuaauauauaaauuuguugaauggaguaacgaaggaaagcagcugaauuugcaugugacagaaaacaaguuguuacacguggaggaugcagcauuauauacuuacuaauacgauuagcaauuuuuuuucagaauauaucagaauuuccuuuaaaaagugaagcuacauauacugaacuuauauccacccuaccccucgcucaauuaaauuauuucugauaugaaggaaaggauugccuauagcuaaacagaaguuuuggcauagauaugacugagugguaagggauaaugagauauauaauauugguuauaguuuucuuuuuuccccaacuuuuaagaaaagaaaaucuaagaggaaauaauguuucuaaauguuaaaguucuucuuguuaaaauuaaaauguagugugaaaacauauucauggugguaaugguuuaggguggugguauuugaauuuuuuguuuuuuuuuuuuuacuuuuugaaauaaaauguuuuauuuauuauaagaaauucauggucuuccucgguacuugguccauauguauuucuuucuccucacccuccccucuucuaaccaccucuuuuccagaauggauggugaugccaauuuugcuccuagguuguccuccagccacccccagcccaguuuucacuuucuagcuuugaagauuguccaguuuuccagcuuagacuagcauugccucuacgauaguucuagguaucugugaagauuuuuuuuuuuccuguagcaaucaugaaauagcuacuagugcucuggacgauugugcuuaaugccauuuggguguaaggccuccuaauuucauuagucuuaccacuuguguuugcaaggauagcuguuuggagucagcagugcauggaacaugugaacugagacaaaucuguuugaaaaucucaacuuaagauuucaaauccacuguguauacuauuuagcuguuaaguuucucagucuaagaagaacacguuuuccucuagaaauaagcuuaacccaguaccuaugcaucguucauuaauauaaucagauuacggccuagauguggaauuuauuucuguuucuauuuucuccagcuuuuuaauacagcucagacagucauauacaguuguacacgaugugcacugcacaacucuagggugcuccaugcauauagacauaucuguaugugacagcccuaaguacaaugugguagacacucuggacauuugguaaauaaguaucuacauccucacucuucucucauucacauuggccuucuggccagcacuauuucugguuuauuuaauaaacaauucuugucccccagaaauucugugagucuucugaagaugcuggggaaagccagccuucauaaaucuuuucaaugucacuaaugaagacaugucacuauugcaacaaaggaauaccaggccauaguaggcuuucacaacuuuuuucugacagaauuuguuucuuucugcuuuaucuucccuguguacugucuuuuuuuauccacccucuuucuuaauuacacugguagaagaauauuggugggugauggagucauucacauucuguguaagacuagaaucaguccaagauccacaggaaugugggauacuucuuucaugagaagccacauggcucacaagacuucuuuacauuuguguuacuugccuucuccugaaauugucucuacagugaaucaaauaacaaggacugagguguauuuuccauauuuaauuccaggaagcagucccacuccuucucccugcccgauuuccaguuccaaagucauguacagggaaguccauugacuuugauguuggucaaauggcccagcaagcuuuuguccacuuuucugucagacacaguccuuggcacaaaagacaucugaaauacuucccauuaauuucuucuuuauuuaugaccuuguaguuaaguguguugaauuauaugcuucuauacacaucuguuuuaauccaguuacucacuuauaacuggugacugaaacuuuuauaucacuauagcguauuauugguacccaggauacaauagaauccucaauaucuuacaucuucaauauaguacuuccuuguaugacuuauuucuuaacauaaaaauccuguuuuagaccuguggauaaaccuuuacuauaaaucccagagacaauuucuggaaugagaauauaguauuuguccacacacaugauuccauguagaacuugagguaauaagaucugggacucccagauacauuuauuauuaccacaauuggauagaggugcuacagaaauaggcacacaaaugacaguaaaauuguuucugagaacauuucuaggcucaacuuuuuucuacaacuuaggaugaacagagagaguggaaacuguauauaauugggaaugugacugagaugagacaaagaugacauggaagcauuucuucuucccuugcuuuucuggugguaaguucacucuucugucuuccuugccacuaguucuugcagucccuaccaagacacuagggcauuauacagcaaacacacccugaggcccccugcuacugcaucaugaaagccuuagcugguugugauguccuaguucauaaagaaucugccuagucucucauuagagcuuuccaauauuugacaauucauucauuuauuuuuuucaacagguauuuauugggcaccaauauaucuaggcauugaucuaggggcugggaaugaagcaggaaauaagucuaggggcugggaaugcagcaggaaauaagacaauguuucaauucucuuggaauuugcauuccaagugugauggguagaggcagacaauaugcaaauguguaacaugucaggugugauaaaugcuaugaagaaaaucaaguagggggagcggauacaguacugaauaaaucagaggagaccuuucugauucaguuaugucucuacagaguccugaagguaauaagagagacagaggcaaccaucagugcaguggccauggugggcgcagcaaguuggcuucgaugucuggguauuagccagggagccggugcagcuggagguggggugaguggaggccagaagugcaguuguugagguuggagaaguagccagagaagaucauguaaggugugacugugcucccauaaaacuuuauggacacuaaaaauugaauuuuauguaauuuuccugcaucaugaaauuaaaaaaaaaauuguuucaaccauuggaaaauguaaaaaauuguucuuagcuaacaggccauacaaaaacaggcugcagguuagauuuggcccaugggucauaguuuggcaauuguguuauauauaaauuauuacacuguuuuaucuucaucaugguacacauccauaccugacauguuuuauuugccuguguauacauuuauugcuuugucaccgucuacuagaauacaaguuuuuugagaaaaggagcucuuaauugucuuguuuacugcagcaucccaaucaccagugaaaagccuguauguaauagaguagauacuaaaaacaguauuuguugacugauugauggacuagaccucaggauuuuuagauacccaggaucaggauaugaacuacugcauuaaaucaucuccaacaucuacucucaugauggcuugucugacuucaugauuuaaaaaaaauucuaaagcauuuuuaaggcaguauauucacccugugcuauuuuccugugggcauaggauaggguuuguguggauguaucaaagacuucuccacuguccuuccaggcacaagccauccuauaaggcguucccuuuuaggagccagagguauagaaggaagucaucugagcccauuauuccagccuguugguaacagaaagagagaugagcaaaguagcauuuggcugcacaggggucuggacaaaacuucaacaucuugauguuuuccuucaucccugagagccuuagaaaugcuaccuaugcuuucauuuuauguuagguuguuuguaaaaucaugguaaauuauggcaaaauacucuggucagauacuuuaucagguuaggccaggauaugcugugaaaacaaacacccccgaaaucuuggugguucauaaacaacagagacuuauuuauugcuuauaccacaugaccagccugguucaucuggggucaaauccacauggggaugaagcuggcugaguauccgaucuugaauguuaggaaucacuaugacagagggagggagagccugagagcgccucacccuggcacuuaaauucucuggcccagaagugacacauauuacuucuaguugcagccccuugacccacugccccaucuagccacaaagggccaggaagugcaaucccaccaugcgcucagaaggcagagagauggaaauauuugacaaaccguauuaaugacugugacacauggugaguucuucacauuggugacuucuaagugcuucugaacacaccuuugacuguagaaugucaaaaacauucucaauuuuacagcagugcuggaaaaugaauuguauugagacaacuugggaggaguagaaggagauggaauaaaaaaaauucacugauuucugucaugugucaugccuccuuuaaugcacggaagaacguauacuuugcuuaggaaaucacauuaccacauucagaacaacuuuagugaagaugggaaacaaccauggcuggucaaugggguaacgugugcugaaggaagacagguuuauuucucaggaggcaucuucucccugggaaaaggaaagacacauauucaucucaguaaauauuuguggaaugucuaccaugugccaggcauaugaguggaaaugauguuuuuauaaaauaaagaugucuuaaguauuugcaugucuuacuaacagucagggaguucaacuuggccagugggaaggauaauuuuaugccugaaacuuuaguaauguaaauuuuuaugcugauucucuuuuugucauucacugaguauuccuaaguaacuauaacacucacauauuggagauaaguauugguuuccugaaaucuagguuuggcuaacauugcuucuggaaagagaaaauaacauguguugaaugucccuauggcaaauucuugcuguuacuuacuguuccauuauggagaguguuagaaagaguguaauuuugauugaaugaauaugcuaaaaaaaacacccuaaauaagaaacucacaaaaagaacagaguggaaugaaaaagugaaaacaacuuugcaauggugugcuucguuuauaaguacauugucacagcaagacuagggaugauugggcaucuuagagagugcagaggauguugauaaggaagaggaagaggagauaaguggauuuugauaugggacacuagauccuuagggaagaaaugugaaagaggguauucugggcugacugccgcuggcauagcaaggcugcuuuguagaagggacaauaaaguuuugcauaaggauccuuuuucccauccaauggauuaugcuauacuuuagcuggaauagggcuguagcaguuagcuauugccacaauaaugcuguguaacaaagcaguccaaauuucaguggcuuaaaacaucacuaccuuauucucacuuaugucuccaagucagcugggagucagaggauuaaggcucaaggcuuagguuuggugcaggucagccccaggugucucucauccuccuuugaucagugggcuagcaggagcaugugcuugcaaugaugguggaaauagaaaaacgugcaaucauaugugaguuucaagccucuccuugcaucaugucuuguaauguccuauuggucaguagggcugggaaauauaucccucccucagagagucaggaguggaaaugaaaauguuuuuaacaauagccuaaucaccauaaaggcuuuggguggcacacugggcccuugaucuuggagaucagugauagacuguaacagaccucagaaaccccuugggguuauucagagcauacuucuagagggucugggguugucuugccauucaagcccaucccacacccaucugcccccacauauccuaagcacaguuaugucaagugagaacagaggcauuugaguggagcacagauuucaaacacauaaaggcagggcauggccaucucccgcagugcuagaugaucuggcugggagaaaaccacaagcagucuucaucaaauuggaggauguggaggucccaggcauuuaguccccuaguauguccuuaaaaaacccagacagccaugcacacacacucacacaaaugcacacgcacacacacauacauucacacacacacucuuuuccugcauuuguaguuccuuuccucagucuaaguuuaauuaaacaacuuggauuucauauauauucauuuaaauauagaauugcauaaagaaaagagccaccagaaccaccaaugguagcaugaggccucugaaaugaaagaugagcccaccccaaccuuaaauggccagguuucuggauuucagagaagcaagaucagacccuuggcagguuccaucugagcagccacagcagccauagcuacagcaauaauuauuagcaagugugcguucucccugcccuaguuaguacacccuauaccaucaggugucaucuguucuaguuaaagucagaccguaauaacaaaacaucaaaauguaaaauguggguuguuuuuuucuuuacacacuucuaaagacauuuaaagccugagcagauaccuuaaaauucaucuucuaucugaaaauaccuccuagaaccauuuuaaaaaggagauggaggcaagguggagagaaaaaguuugucuuugguugacacugggaaaguugucuuuuaaaaaauuuuuuaauguuuauuuacuauggaguugccgugucuugcucuuuucaagcucaccuguccggcuucuaaggaauaucaggggcccuaaaacacagacuucuaaaccccaacacauaggacacaccuaaguguggaaagaaaggaaagaggcaggaaagaaaggaaagaggaaggaaagaaaggaaugcaacauuuauugugugccuaccauauaccugacccuuuccuacauaugaccacauaugaucucuucaugagcuuuaugaggugaccuauuauuaacaaugcugcuuuauaaaugaggaaaccaagccuuaaggaagucaaauaccauauccucagucaaauagcuaaaaaaaaaaaaagaaaagaaaaagaaaagguagugccuggauucaaagacagcuuauuuuuuuaacuuauagaguaaaauggauuuuuucccuuuugguguguaguucuaugaauucuaacacauguauagauuuauauaaccacaaccauaauuaggauacggaacuauuccaucaccccccaaaaauucacuuacguuauccuuuuacagucagaccuuccucccagccucccaaccucuggcaaucacugaucuguucuccuucacugucguuuuguauuuuugguucgcugucauuuugguuuuuugggaaugucauauaaauggaaucauacaguauguagcaguuugagauuggcuucuuucacucauacugccuuugagauucuaccagugucccaguaguucauuccuuuuuauugcugaguaguauuacaucgauugcugaaccguucacccauugaaugacacauaaguuguuucuaguuuuuuggcuauugugaauaaagcuacuacaaacauucauguacauguauuuaugugaacauaaggcuucauuuaucaaggguaaaauccccagaaguaggacuguugggucauauggugagcauauguuuauaagaaacugcaaacacauuuuccagaguguuauaccauucaaagccaguuuugaacaauucaaaucuaugcuuuuucuuuccaguaagcuguuucuccagacgacagagugguuuacuauauuaggcaaagcuucaucuuggggaauguuauuuccaacugagagcuaugggaggcaaagucacaaaccuucagcucagacucaccaaucuaacuugaucugggaagauaccucgacaggugggggagggagaacaucugcugaggaaggccgggaguggagugagacauugcuacuuggaccccaaaaccaggaaaaauuuggugguuuugguugagcuugaaccaucagguuaaacaggaaaugcaaaaugcucuuccagugaaacagaagaagcugcuaagagguagagggaacauggaacuauuuguauugcaaccgaauccaccuccccaaacccacugcaaagggaaauugcugacugcaaugucccugaacuccagggugaguaagaagagaaccacgccccccagggaacacuuguaaauuuuuaagcaaaucuagggaaaguuguguaaaaugugucccuuccauaacucacccuaaagcuucuggguauucuaaauauacaaauucuauucaucacaccguuuuaucaccaagcuuccugaaggcauauugccaacacaauuugacaaagaaaauagcaccaacagcuuuuuaaagccuuggaaggauagucucagacccauggcucucuagagguccagggaugaaucuagcaaagcuggccuccuuuuccauauauauagaacaagaggauuguuaauagcaugggauuggaauggcucaagaaaagcuuuuugaagcucuuugagaaaaguagccaggguccccccuuaaaccuucuuugcugauggccuuacagcucaaaaccagcauuggaaccggcuagguacucccaaaccaaagccucuuccacuuggcauguauauuuauauucucauaucuucuuucaaauaccuuucaguguugccuuuugaaaagauuauaauuuguacuuuuuuguugaauucaguagguuaaagcaguaccuauuaucuuuaauuuuauuuugaaaaauugguugguuuggcuuuuggggaauuugagaggcaauuuagucugucauuuaggauggcaucauauaaggcagccaacuucaucaugcuauuuagccugaaaagcgauauuguugaucuucaaccuugaaaaagucguacagguugggagcugaccugcaaauggucagguaucuugagauaggaaaaggauuuacaaauccaggucagcaagauacucauacaaauauuuugaacccaagguauacaucaaauagauuuaaagacuaagacuauuucugagcaugcaucgacuguuugaagacuaguggacuuguaugaaguucaggaguuaaccugggucuuguaacuuaaaaacagcauuucucaugcccuaaauuaguaguagagagacaauauagagaguuccuauauagcccucaccuaucuuccucuaaggcuaacaccugggaaguuuuuuuuuaaaaaauccugauggcaaagcugcagcccagacccaaaaaaugagaaucugugagauuuaagauucgagcaucaguauuucuuugaagcuuauucccagguagauucaagaagaagccaagauuuugaaugccugcuuuauuauuuuuuuuuuugugagagcuuuaauggcacaaaauguuuauagcuacaaguuauacauguauuguaaauuguauauaacgauacaaagugcuaacuaaauagauggagaacgcauaaccacuuuggcucaguuaauccaauaauuuccacaauggguucaugaaaaaccucaucugacuggcuaagucuucaauucucauuuuuuuagaauaguaaauauuuuuacugcaaucacaggaacuuguugcgcuuuccaaugugcaaguuucugcaguuuugcucuugauucuauuuacaaauaucuuaagccaguuuucaucaaacauaugaaaaaugaagccugccuuuuuguccccaaauuguaaauagguguaaaucuuuuuaagcaucaaucucacaauuucaacaguuaauuguugaauucuccuuuccaauacacgauguuuucguucaacacaaaucuggguaguaguaaaauguucaucccguguguuagggcuacagauacauacuacgugcucucauaauaaauuuuacuguuaugauguauucauuuuuuaaguaauuuuccauaauuucacugaugcuuuaagaaaaagagcaacacuauguuucuuuuuaacguugaaagaaaucauaaauauacccagguucaauggcgcuacugauagaacugcugcugaauuuggaaugagcacaaugcacuagcuguaagaagucaguuuuggguaaugaauaauuuuacuuuucccuccuguaauaccaauuucauacuguagcaguuuaucuagucaguucuccuaacuuucuguccuuuccaauuuuauucaggcuuuucaaaaaucagugagccaucagauuuacuuucuucccaaagaaauucaaauaugaaugcuugaaauaaauagguuauagaaggcaaaucaaguguuaucagguuuaagauuaagacagaaacauggucuaauaaaaagauguccaaaauuaucuagacaucaaaugcuagaaagaaaaaagaaaauuacuugcaaaacuauuuaggauauaucaucuuucuuaaagauugccagcuauauucuugaaaaaaagauaaaaauuuucuuguuuaaccugcauguuauuuuccacuauaacauuaauuuuacaaauguugaugugagagagaagaguuagauaguuucugcaaacuggcaaaccuggcugugauaguguuuuuauucaaguuaaccuggugcacuuuauagauugcuagcuuuaaaauuaacagugugaaccccugcuuuaaacccuucucaaagugcagucagccaaucaacaguauugccaucaccugggaacuuguuagaccccacuuugucaaacucauuuccugguaugacaaugaaucuggcuacagcaacagggugguggaccucaugguccacauggccuccaaggaguaacaccccaggaccaucagccccagugagagcacgagagaaagagagaggcccucagcugcuugggaaucccugccacgcucaguccccaccacacugaggaucuccucuccucacaauuuccaugcagacccccugaagagggaagggccuagggagccccacuuugucauguaccaccaauaaaguucccuguacucagccaaaaaaaaaagaaagaaagaaaaaagaaaaagaaaugcagcauccugucuugccccaaacccacugcgucagaaucugcauuuuaacaagauccccagguaugcacauuaaguuuugagaggcaguacuacauauaaaauaugcaacagaccacacaaaccugggcccaauugcuauuugucagauacauguauguauuuauuacuuauaaauuccuucaucagauauguauuacgugcuuauuacuuuaaaaagaugaaucugacacauauccuacccucaaagagaucucagucuaggaagggaaauacaauguguucauaaauaauauagucuaaguuagggacuucauaaaaugcuugauggaagaaguggcauuuauuuuggaccuggaaugagaacugaaagaagauauucaaaagacaagugauguagugauguaguuuugaauacacgaauaaucucaggguuacuuuuucuauagcuuuuggugaaucaaguuguuuauucauacauuuaauaaauauuuauucagcucuuacuauugcuauaagacagauaccauuacugcucaggugguuuuuacaaccuaguggggaagacaagcagauaacaagaaaugacacaauucauuaguguuacugguagcguugugaaggacaaggauggggugcuagaaauccaugugacggaccagaccuaggcaggggugggaguuauggaggagguuucccugaguagguaacaucuaagcugagaaagauuuaguuagacaaagagugaauggcauuccaggcaaaggaaacagcauggacuaaggucaaaacaagaagaaaugaacgaaagagcaaguugauaaaauggauguccaauaauauuccauuguucaacuaugcaacauuuuucauugccucccaaauuggaucaaaguagccuggucuucaugccuccaguccuuccucuuuuuaaaaauuuuauacaacuauauuaauauagaauuuacauacuauaaaauuucauucaaguauauuaggaaauuuacugaguuguauagcuaucauccauauaagguccguuaugucccuuugcaaugaacccuccauucucacucccagccucaggcagccaauaaucuauuuucugucucuaggggcuggaaacuuaggauuggaauuaguugguuguauaauaaauuuagcuuauuagagaacugcugaacucuuuuccaaagcaacaauacaauuuuacaguuucaucagccuugugugaggguuccuguugcuccauauccauuacaacacuugguauugucaguccuuuuguuuauagccauucuacugggugugaagugguaucucauuucaccagccccucuuccuaacuuauuugccagauuccccacuucuaaacuugcucuaugcccaaccaaagugaaccccuugcuguuuuuuuuuuccccugaggcucguugauauccccaaauuaugccuuucuucauucuuugaauguguuacuugacuggauauguauuuuuggugaaggagaggggcuggaaauugagagaugaaauugguaggaguacagaaggccguugacuuccucacaacgugggacacuuccaaguuucuccuacaaaccccaccacuauaccuuuccaaauaucuugccugccaucuuggucacccgugaccuaaauuaauacuuaggaagcuauggagaugcucaugcuuccucaggggagaaugcugugugaacuuagaaauuagcaaaaggggaaaugacuacccuugaaauuguaccacagaaaggagcauacauucaaaugauggugaagucuuauuaaaaagacuuuaagccucccaauuuagaagcuggcuugugguagccaagaaauuagagaaugauuuguuauuuaagagugaaauugcuaguagucuugaauuaauuaccauaaaaaagcugccgcuguaauaaaaagcagagaucugguaacccugcuucauucacuuucuuccucuugaugaaaaccuuuuaauuauuuugauuuugauuagcacuuccaucagaaaauaggaagaaauuaggagcaauuuacuuggcaaagguuuaguaauuaaaaccacugaaaucaaugguuuaaguauguauuugggauaaacacauuuuuaauuguuauuuuugucuuacccaaguggauaacauaaaguucauuauacaaaaaucaaccagugcagaaagccgauugggaacaaacaaccauucuugaacccuuugaaaauguaugcccuugaugaauuacuugucagguuucuacuuaaguuuaauuguuaguacuuccacuuaaaauagcaaaaugacugucugcaauuucuguuauuucaaacuagguuuuaaauucugggguugaaaguaagcuuaaauaacucugaguacuugaguaaacacugcauuuuuuaugaugaggcaaguuguaugagccauuuaauuacuuuaauucaauccagagauuugauauuuucuccugaguucucacaguuggauaguuuaaaaauauuucuaagauugaauugaauccuguaagaacuauaauaaaaccauacaucugccuguuuucuuucuuucucuuucucuccuuucuuuucuuucuuucuuucucuuucucuccuuucuuucuuucucuuucucuccuuucuuucuuuccuucuuuucuuucuuucuuucuuuucuuucuuucuuucuuucuuuccuuucuuucuucuuucuuucuuucuucuuuccuuucuuucuuucuuucuuucuuucuuucuuucuuucuuucuuuuucuuuuucuuucuuucuuucuuucuuucuuuuucaagaucgugcuccauugcccaggcuggagugcaaguggcgagaucauggcucacugcaaccuugaccuccccaggcucaggugauucucccaccucagucuccugaguagcugggaguacaggcaugcaccagcaugucuggcuaauuuuuguauuuuuaguagagacagggucucaccauguuuccagucugaucuugaacucuugggcucaggcaauccucccaccucggcuucccaaagugcugggauuacaaguguaagccaccaugccuggccuuguauuuuuggauaauauugagugaaauuugccucaauacauaaaaauccuuucaauaugcuucaacucuaaaaucuuuaaaaagcugcuugguuucauuauuuucacguggaagcagcauugucacaaaguuuuauuuugaagacugaauuguauauggaguacuguccaacuagaagagaaugaauaaucaggaaaagagagacuauugacaaauaagacuuaauggagaagcauugaauuucaaagcugccagagacauuagcaauuguucaguuucaucuccagauuucuuagaugaagaagcuguggcaagccaauuucacaaacccgaucuaugauccucaugcuccccacuccucucacucccacaauuuugccuugauucaaacuuuaucgaaaagugagaaaucacagguaugagcucacugagcuucccaggcagucuugccaucuacaaacccaugucauucuguauuuuccucuuguuucugacagugauccucucaucuagucacacuacauccacuuaucucuggcacuuaugucaaaacaaccccucuagguccugccuuagcucuccugcauaugcuuuuucuuucuuccugucuguugccucuuucccccagcuuauaauucucccgcuuuuauuaaaaacaugcacccacagacacacacucacaucuggauucccaagugcgauaaccuuguagauucauauuuucagaucguucuuaguccacagaauauaaaauugauugaaugauggcaaacaucugcagaugacaaucauuuacagaaauggcacuaaagccaugaagcugaagcugcaggacuuauggaucugggcuagaagacaggggccaucaaaaauuuagcuucaguuggaaaucggcucuuuuagugcacuacaucagauccaugaaagaggaaggaagaguuacugcucauugcugccuggagcugugacuucuaugaaauuacuuaacggggcaaaggaggaagcagauacuuccuugcaacuaggacgugagcugagcugaucccugaaucauaaauacucaacaagauucggauucaggacccaggguauuaugggguacaaccauaaaacuucuaaauguuggagaaagaauaaugagaaagaaaaaugaaucucugaaugaaaauggaacuacuaaccaaaauuccaaaucacguuaauauaauuauuacuaagaaugacagcaacaaaaugaauaaucaguauaugucauaccuauaaaguuaaaaucuaaaauaauuugaagaaauacuuaaaaauauuugcaacccucaaagagauaaagaaauaauauucauaaaauugaaaugacaaacuaggggcagggcgcaguggcucacgccuguaaucccagcacugugggaggccgagguggguggaucacaaagucaggagaucgagaccauccuggcuaacacggugaaacccugucucuaauaaaaauacaaaaacaaaauuagccgggcgugguggugggcgccuguagucccagcuacucaggaggcugaggagggagaauggcgugaacccgggagguggagcuugcagugagccgagaucgcgccacugcacucuagccugggcaacagaaugagacugggucucaaaacaaacaaacaaacaaacaaacaaacuaggaagaauauacagaaauguaacagaaaguagauaggaagaagaaugaaguagaaaugcuugaaauuagaaauacggugauugaaauuaaaaccuuaacaaaguaaacucuagacucacaacaauuggagaguuggugauuggaaagaugaaccaauuaauuuacccauaacacauuagagagaggugaagaggaaaaaauagcuaaauauaaaagcacauuuaagagacauguaagaugauuaaaagccuccaacauuuuucaaaaaagagaguagaggcaauauuauagguggaauaaugaaaaugauaauggcugagaauauuaaagaauugagaauaaaaaagacaaguggccucagauugaaacugccaugaaggucucugucucaaauucucaacucugcuuuuguaguaugaaagcagccguagacaauaaguaaaugaauggacauggcugugugucaauacaacuugauuuacaaaaacaggcaggcagcaggcuaaauuaggcugggaggucauaguuugacagcucuugaucuaaagaauaaccauuguuggccaggcgcagcggcucaugucuguaaucacaacacuuugggcggccaaggcgagcagaucacuugagcccaggaguucaagaccagccugcgcaacauggcgaaaccccaucucuacuaaaaguacaaaaauuagccgggcaugguggcaggcuccuguagucccagcuacuuaggaggcugaggcaggagaaucgcuugaaccugggaggcugagguugcagugagcggagauggugccacugcacuccagccuggaugacagagccagacucggucucgaaaauaaauaaagaauaaccuuuguuuacauuuucauguauaugucuccagauguuccucauauauccauauaaguauguauauaugauguacauaagugcauaaguaaaaauacauaaguaauuuuaaaagagguuauaucauagcugaaucacacaugacuuagaccacacuugcucuucugaguacccauuuuuggacaacucucaguguccacuagcaugucuaaaaaaaauuucuccuccuaaaaugcuaaugcaugauguagauuuuaacuacagcuuuugaggcucaguggaggagaguguacaucacacuacccaaugcaaagccuuuuaacagccccuuuugcucaucuuuguuuuccuucacuguuccucgcccugcagcaggcagcugacauucaccuuucccuuccacccuccucucucagcacugguccuuugccuccucccucaucccagcucuacaaauggccucagccugcauauuccaaccacccagcaaaacaaacaucuaguaacuaccgggucagcaagagaaaaucggaggcccuagccauagauagaucaccuuaucauuucuccagcacauuccaggaaggaucucaauucguucugucccaauauaccucuacauccuuuguuuugaugaucacauagaauucauuguaugcauauaucauuauuuauauaacuaagcccccaauuuugaacaagaggcuacauacugaaaaucuuuuaucuaccaagucuuuuuuuucuuacaaacccauccaauacaguugcacuguauccgccaauacaguucaugcaacuguauggaaagcaaacucuagaagaguauuugauagcuccauaagaauauuaaacucuuauacuucuagagcguaaaaccccagaaaaguauuuugucagaaaaaaaucauguuuuugaaauaguagguuuuaaaagaaaacaaagagaguuagaaguaagaaaauucagguuaucaggggcuugauaucuuuuuuuugugacuguagucagguuacccaggccuuuguggaucaauuucucaaacaaauaacagagaugaaaacaacugucaguagcuacugucacaaaaauaauaugauaaacaucuuuucguuuccuauggcugccauaacuaauuaucacaaacuugguggcuuaaaauaacagaaauguauuuucucacagcuccagaguccagaauuccaaaauggaagggucagcaaggcugcacgcccucaaaacacucuuggagagaaucuuuucuugcuucauccagcuucugauggcucuaggcaaucccccgcuugucacugcaucacuccggucucugcccccaucuucaaaugaccuuccucugugucccugucuucucuucugucucuuauaaggacacuugucauuguacaguauuuaggguccacauagauaauccaggaggaucucauuuuaagauccuuaacuucauuacaucuguacagauccuuuguccaaauuaagguaauguucacagguucuguggguuaggauguggacauaucauuuugaggcccaccauucaaugcacuacaauuuucuuuguaaguguucugagaacccaggaagaauaaguaaauccucugauucaaucaaaaaugagcagaauguaaaccaaaaauacuagaagauauccuuuuuccuaggcacuggcauacguuucaauaguaucucuaauuacagauguauuuacacuucuaagugucagaaaugaagauuauuaugacaaauuuaaaauuuaguaacuuguuuuuaaacugguauuuuuguuuuuuuaagcgaucaucucaguccacauuggaacgaucugaacagcagaucagggcugcuucuaguuuggaggaacuacuucgaauuacucacucugaggacuggaagcuguggagaugcaggcugaggcucaaaaguuuuaccaguauggacucucgcucagcaucccaucgguccacuagguuugcggcaacuuucuaugacauugaaacacuaaaagguagguguguggauguggagacaaauucuuucucuuuauuagauagugacaaacacacuuacuuucuccaaaagucugcguagggcagacacgugucagagggagaaugaaagucggucuuugauuuccaguauuagugcagaaucuugauuuuuuaauguuuacuucacagagaaauauauucaauaugauuuugagauaaaaaacacaaaagaacaucucaaaauauagaaauaaauuuaacucaaggaugugggggcaaagaaaacccaggaagacuauuguucucaauagaaaaacaaucaucagguuuacuuagaaaauaaaaccuggggauucauccacaaggaguauucuacugccauacauacauagacaaaaaccaaagauggccaggcaugguggcucaugccuguaaucccagcacuuugggaggccaagaacggcagaucgcuugagcccaggaguuugaaaccagccugggcaacaugacgagaccccaucucuacaaaaaaauagaaaaaaauagcugaacauugugguacgugccuguauucccagcuacuugggaggcugaggugggaggaucggcugagcccaggaggucgaggcugcagugagccaugaucaugcuacugcacuccagccugggcaacagagcaagauccugucucaaaaaaaccacccccuccccgaaccaauagauuagguauagcuuuuuuuuuuauuucugcaaaguugugugauuuuuuaguaaaagugaaaaguaaaaguuagacacugaguuguaauauuggguacugguauugcuaggagaauaaugaagggagaaaauucucaagacaaaaugaucaaaacuccagacuagaaaauaacauaauuugaaauaaggauaaugaucguucccuaguaacguaugaagauucuuuaaaagaaaaucaggccaggugugguggaugacaccuguaaucccagcacuuugggagguugaggcagguggaucaccugaggucaggaguucgagaccagccugaccaacauggugaaaacccaucucuacuaaaaauacaaaauuagccaggcauggcggugcaugccuguaaucccaacuacuugggaggcugaggcaggagaaucacuugaacccaggaggcggagguugcagugagccaagauugcaccauugcacuccaaccugggcaacaagagugaaacuccaucuuaaaaaacaaaaaaacaaaacaaaacaaaacaaaaaaacaaagaaagaaagaaagaaaaccagugugaguagguacugucauaaugaauaaaaugcuugucaaguaaaguucugugguuucugauuaggcacuuaauuuuuugaugucaugucaaaacaacacaagaagcugcuacagcauugcugaucuagcauucuagauuugauuaacaugauuaccugguaacugacuauauauauagcauaauucaaauuaaccacuaggccaaaacuauuuuuuucuuucuaccuaaaauuguauuuguuuuuucccauuuguaaaaagauguugggguugcacagaccucuguuguuggcuguggggagagcugugcauagauggggacauauucuuugguagcaccuugggcaugagugugaagaggauucuuaguguucauguguaugacugugugucuaagugaguugaugugguaggaaccauagccucgagcucacuucagacagaaauuugaagcucuagauguuucuauguggugaauuaauauagccuucaugagaacaaaggguuggcaccucaucuagaggucaaaggccuuaaccagauuaccugacugaaggccugaggugaaccuggagcuauuucaugaacaugaacguuaccauaaaaccaagacuaggugaucuaaaaaaagucaaugacauugacauuuucuaaggagaaaaccauuaaaauaucacggaauuugcaaacccuaugaauuuaucucguaauuucuaggggaucaucugaaguuauuuacuaaguuagaagcagucaauaaugaaaucagcauguuacaccaauuagaauuuguuaucaacucucccuuguggauuucaagguaauuuccugaggcagagcaguccugcugggaagcaguaaagaauaguagaguuaugaagccuuuaaucagugauguuggucauaauugcauaugauuuugauuaaaagcuuaccacuccaauuucaaaacuuaguuuuauaaaaagagaaaaagcaaauggaaagcaaccuuuaaguagaauuuuaaauugggaauauuuucauagguugguuucuuguuuuuucaaggauucaugauuaauuauagugaauuaaauaauaaccauaauaauacuuaauugaguaauuuaucucucauguguucagccuucaggcuuuuuauauaaauauuaauaaucagaaauuuuuaaaaagguuucuugggggcugggcacaguggcucacgccuuuaaucccagcacuuugggaggcugaggugggcggaucacaagguuaagagaucaagaccagccuggccaacauggugaaacuccgucucuacuaaaaauacaaaaauuagcugggcaugguggcgcauaccuguaaucccagcuacuugggaggcugaggcaggagaaucgcuugaacccaggagguggagguugcagugagccgagaucgcgccgcugcacuccagccuggcaacagagugagaccccgucucaaaaaaaaaaaaaaaaguuucucaggauagaauguuuuauuaugaggaaaaaaauaaaaaaaaacaaaguuuagguagacuguguaguauaaugcagugcuccagacaacucauauuauguuuucagugauugaagaagcaacauaugaaaaaaauugguauuaagggaugaaaaaggagaaaggaauggagaagauguuauaagggaauaauuuagggacuagggucacaucucaaaugguaauauuguaucaguauacuucaagcagacguuuucucuauuccuucuauuccccuauaugggaauucaggauaaucucaggagaguucuugaaaaugcaguaaaaauaaaggagaguuugccuauuguugcauaacacauuaccacaaaacuuagcuacuuaaaacaauauuuaucucaguuucugugggccagaaaugcugacauggccuagaucaguuuuucugcuucagaugucucuggaggcugcaguuaagauguuggcuugggcugcaggcaucuuagggcacagcugaagcagagugugcuuucaaguucagucagcuguuguuugcaggacucaauuccucacaggcuguuggacugagggucuuaguuccucgcuggcuauuggccagaggcugccucaaguuccuugucguguggaccuuucuaacauggcggcaaacuaacacaagaacugaaaaccaaacaccgcauguucucacucauaagugggaguugaacaaugagaacacauauacacaaggaggggaacaucacaaaccagggccuguugguggguggggggcaaagggagggagagcauuaggacaaauaccuaaugcaugcggggcuugaaaccuagaugacggguugacgggugcagcaaaccaccguggcacaugcauaccuguguaacaaaccugcacguucugcacauguaucccagaacuuaaaguaaaauaagcuaaaaaaaaaaaaaaaaaaaaaagccugcaaguggagaaggaggagagagagagagagagugugugugagaaagugagacagaguaagaaagaagggagcuugcaauaaguagaaacaagacugcaaucuuuuuuaacuucaucauggaagugguaucccaucacuuuugcuguauucucuucauaagaagcaaguuacuagguucagcucacacacgaggggaaggcauuuacacaagggcaugacuaucaggagauggggaccacuggggguuaguuucaaagcugccuaccacaagagauuuucaccagcaccacaaccccacacauaauaaauaaacucuacaguuccauggcaagcuacaaggaagucuuuguguugucuuuaucauaaaauugaaucuuucccccaaaacaccuguagaaaggcuaugcagcauuaaguaucaaagggucaaaaucuaauuuaaaaaauaaauuaugagagaaaagcaaguacuguuuuacaagaaaguauauaauuuuuuuauucccauaggcuucuuuuuuuguuaccuucaaauuaacuauggucaaaggauugcucauuccaguaauaagaacaggcuuauuucaucauuuacauaaauaucaguaucgggcacuugcaaaugagaaaacucugauuugaguaaggauuaguuucacuucaauuuccauuuaugcguuugccaaguuuaaauccuacuguaguuacuuaagcaaccaacagaaacauauuucuugaugaugcuaaaaccuaccuacaccuggcuuuaaagcagaagaaaugcuauccagcuguauccuauaaauugcuugauaaauaauauuuacauguuauuucuuuacacgcuucuauuuacuucccuauuaaccagcuucuccagauguauucaguguaauuauguacaggacaugguguucuaccucaaagggaaauaaaauacuuauauucuacaagguaugguauaaaugggaaagagcacagagauugguuguaacuucucugcaaacaaucuuugguuaaaggacugacaaaaaauauccaucuaguaaaagaaacaagcaguagaaaugugaaaaugacuguguucagcauaacccuggcacauguuggcacaccaggaccauuccaccugcuagccccagugagcuuucuuucucucugcaguuauagaugaagaauggcaaagaacucagugcagcccuagagaaacgugcguggagguggccagugagcuggggaagaguaccaacacauucuucaagcccccuugugugaacguguuccgaugugguggcuguugcaaugaagagagccuuaucuguaugaacaccagcaccucguacauuuccaaacagguauaaggacaucggcaagccugccgucucuaaagcccugaugauaauaguguugauagcuacaacaaccuuguugcuaaacacuguacuaaaugcuuuaugugcauaaucgcauuuaaucuuugaaacaaaucaagaggguauuuuaugcuccuuuauagaugaggaaacugaggcucagagagguaacuuacuuauccaaguuuacacggcugauaaauagcagagcugggauucaaacccaggucugugggaggccagagccugaacucuuaucaguuauugucucucugaugcuaugaugucaagacucagaaaaccauauggaaguuacuaggacaggauguuaaaaggaaugaagauagcugauggcagguucuguguugcucaaauggagugauugagaaaaauuuaaugaagguugugggcagaauuggggaaagagggaugggacagugaagcaccugaagcuagcaaaaagggugagauuuccccacccuucgacugaggagacaaggggagggagcaguuaugggaacccagagggaaagcggagaagaggguuucuggacuggccacugucaacucuuagccuggcagggaguaggggcaggggcugggagaggcaagaggguuuauagauguagcccauggagggcagcguccuggggcacagagccugauggggaaggaaggggagaggauggugucucuggaggggcaaagagagaauaucuagcacaaaagacauuuggaaauaauucugcaguccccaugaaagaaauaauucagcccucuucaucuuauaaauuucccuuugcuuaguagguaaguuuuccuuucucugguuaccauguuuuuaauaaaugucgcauaugagagcaguaguaacaaacuugggaaagcaauacuaaaaaacuguacaucaaacuacauuauuuuugguaucuguugcaaauucuuugaauguugauauacuuauuuaauugucaguuugccuauaugguuuauucuccuuuuaacugcaaaaagagguaguacaagaaaauuacaugcacugaauauauccauguuagguaauuuucuuaaugcugauuuguuuuguuaauagauuuacuuauccuuaauuuuguuccuccacccucuaaaauauccuuuaaacugcagaguuucuuuuucuaaauucuuuuagagaaucuuggagcuuguguguauuuuaaccucuacuauuugacaauuaggaaaaaaaaaugacccaaguagggcuaagcaucaauucugaguagaaaaaaagcuugcauaacguaagaggguuuaguucaugaucaugugauucccuagagcauagccaaaaaauugugcaagaagaugaaguuuaugcaaaguaaacacuacaaaaacacucucacugagacucauggaaguuccauuacauauugagaugucagaauaaacacaaccuuaauggauugcuuccacuuaauagauaguugaguacuuuauuuugacugcuguacucaacaaaugauuaauuucauacaauguacuuaaguguaaguguacagcaguuuuucuuccaaauaugcauuuuugaacauuuuaauaguaguuuuuuaaaaacuaucucucgccccaaaguuauggacuauuuggcaaaccaccucuuagaaacaaagugaacaaaugaauacucuauguaguaaggacuacauggaauggugauugaauagacaaugcauuaaaaucaacuucaaacucauccacacaucauagaaccacucaagaaaguuguguaaucucucuguacaucuguuucuucaccuguaagauggggauaauaaaaacccaccccauaauguuguuauaagggguaaaugaguuaacaugaaagcacuuacaacagggccuggccuacggaaagcguagaaagaaugauauacauguuagcuauaauuauuuguuugggcaugaugaucuuguaucagucagcuauuaauacacagugcuacguaacaaacacacuaaaacucagugguuccaaacaacaaugauuuacucucacuuauguaucugagguucaguuaguuuaggguggauucagcugggcuugacucuaagcugcagugugaguccaagucaacuucuauguuucccaucgcuuggaccagcaagccugccggauuauguucuuuucauggcuauagcauaaguuugagaaaacaagccccauaaaacaugcacaguucaaauuuguacuucugucaugucugcuaacaucccacuagccaaagaaagugacauggccaaauaaaaagucaagagacaggaaacuauauuucuucaauagagauggugugagaagggaugaauaaauaguuugaauaauaaucuauucuaauaaaauccuaaagaaacugcauagcuuuaaucucauuuaacccuuacgauuuacacucaaauuuaaagcaggagcagggauuaacaguaccauuuuacaagaguaucaaugaucaaaaaguuaaaagauuugaccaaacuuaaacacuucauaaaguuagaugagccuguuuaguuccauucuuaauggacaacuuggcuaaagucauugccguaaaugacaaaggcaaaaauucagacuagaacaacuuuaaaaaugauauauaaaauuaaaaaaauauauugugguuaucuuucucugcuguagcucuuugagauaucagugccuuugacaucaguaccugaauuagugccuguuaaaguugccaaucauacagguuguaagugcuugccaacagccccccgccauccauacucaauuaucagaagauccauccagaucccugaagaagaucgguaagcacuuuuguuuuuuuuuuuauacuggauuaugcuuauuuuugccuugccaaaacuguguguagaggauuuuucauuaauguagaguuaucaauuuaucuucaaauuauucauauuuuagcuucuaaccugaaccuacugguaauaacuggcaaauacauauuuuuauuagauguuagauauauauugugguaggaccaaaacgcucagugguaugagcuugucaugucuacuuguagacacguuuguucuuaauaugcauagucuacugcagguguaaaaccgcuguaaccucaaauuuagcacauguuccagaacaagcauuaaauaaaacuuauuucaggcuguuuguauauuuacauccugaaaugagagaaaacaaagaagauuccuggggucauuggggagugacaaaacuagcagcacgugaguuuugcaacuuucuaaucuuucccccuuaagauuaccaaauggaaaacccuuauuuuaaauuaaaaugacuuaaaauuaauuuggcuuugaaauucucuugagauuaauuuugugauuauuuauaagacaaacgacaaaaccaaagguaaggaucacuuauuugaagaaaaaaaaggauuuaauauaaagaaacaaguaaaggguaacugaaugaaaagaucauuaguuagauacuuagacuuugcaaaaguaaagcaauaaauauauugugugaguggcaaguaaaagaguaagcuggugauuaguuaacauugaaccaagaagacaccucccgccucucuccagcagaaaagaaaacuuguagaaaagcaacauuuauucucaagauguuccugcuguucuggccaaugcuuuuaucuuuauuuuaaagaaaauaaucuuaggggccgggcacgguggcucacaccuguaaucccagcaguaugggaggcugaggcgggcagaucacgaggucaggagauugagaccauccuggcuaacacggugcaacuccgucucuacuaaaaauauaaaaaaaaauuagccgggugugguggugggugccuguagucccaguuacuugggaggcugaggcaggagaauggcaugaaccugggagguggagcuugcagugagccgagaucgcgccacugcacuccagccugggcaacagagggagacuccgucaaaaaaaaaagaaaagaaaauaaucuuaggagguauguuagaacauauuuaauuuucguaaauaaacuguugacagcuauaauuugcauaguuuuaacauauaccuucuuaagaagauuacaauuuccaaaauuacaguuuaguuucuaaacauuuccacguagaauauuuauaauuacagaaucacuaucuaguaagaugcaguucauaaauacaaauuaagcuccuuuaaaaucuuuuuuuuuuuugagacggaguuucgcucuuguugccccggcuggagugcaauggcgagaucucggcucacugcaaccuccgccucccagguucaagugauucuccugccucagccuuccaaguagcugggauuacaggcaugugccgccacgcccggcuaauuuuguauuuuucaguagagaugggguuucuccauauuagucaggcuggucucgaacucccgaccucaggugaucugcccgccucggacucccaaagugcugggauuacaggcgugagccaccgcaccuggcccgcuccuuuaaaaucuuaacucuucucacauccuuaucauuuuguggugagaacauuugaaauuuacucucuuagcaauuuggaaauauaaaauacauuauuauuauugacuauaguuaccaugcugugcaauagaucucaaaaccuuauuucuccaaacugaguauaaaaagcaaaaaauaaauuuaaaaaaucuuaacuauuaucuacucaggaauuuauuuaauguuccaaaguuuugauuauccuugaaagcuuuuaaaucugguucauuguuuucuuuuccuagcuguucccauuccaagaaacucuguccuauugacaugcuaugggauagcaacaaauguaaauguguuuugcaggaggaaaauccacuugcuggaacagaagguaaugauaguaguaguaaaauaauaacaguaauaauaaaaguagcaacaauagcagcaaccguuauugaguacuuaguaugaccagacaauguuguaaaucuuguauauguuuuaacucauuuaauucucacaacaacccuguaauguacuauuguuauuucuuuuuuuacaauuacaaaaugggcacaccaagauaucgaguaauuuccucaaggucacacagcugagagugauagaaguggucagauuccagaacccucuguaccauaaucauauaguaaguccaucaaugcaucacucugcuuuuuaaucucaaagaaaagcccagagugguuggagcauccugaaacacugaaauugaaaggggauguuaaacuugaaugaaagcugcuucagaacuaaauacuagucaacugcaguuuacuaauuuauuuguauaaaagucucacaggaacauaaaguaauuuuggacuugguuucugucagcugcaucauaugaaaacacgccaguaauuugaaaaaagaaauggagaauaagagaaaauuuuucuggaauuagggcaaagcaaaagcaaaauauggcuauuggucuaaggggagcugggagcaaaaugagauauagucaaauugucauugcucauaauccguaauucugugacuuugggugaugaacauuugcuugaaaaugaaugcauuuuaauguauuuuccagagagcuuuacaugguuccaccaaaaaaaaaaaagaaagaaaaaaaaagucacaaguagucaugcaguuuuaaccuugcuuguuuuaaacuauaaucuauaagcaagaacaguaagggcuaaacucuaagaaaucuguccuauaaacuguaaauagcaaccuacucuccauucuucugccucucagcuuccuucuaaauguuuucacgaaagcucagcccagagcauguggggaaauuuaauauuuaugugguuuaaaugcccaugccgaucuugaauguucuuuacacccuucccaccaaguguucagccauccucuaccagaacauacaucaguuauuuggagacucgccauccagugaggcagcaccaaggggugggcacacuccuguuguuauacugaaaugaaaucucucuccagaacagaccagacugcccaauggaauacaauaagagucauauauguaacucacauuuuacauuaaaaagauaaaaagaaacaagugaaauuuaucuuaauauauuuuauuuaauccaaucuauccaauguacuaucauuucaacaugcaaucaauauaaaaaauuuaugagcuagccuacauucuuugugcuaagucuuugaaauccaguguguguuguacacuuacagcacaucucaauuuagacucucuauuucaugcccaauagucacauauggcccauagcuaccuuguuggacagcccagcucaagagcaucaacucauuaguucagguuuuacccuauagaaccauguaaaacaaaucuaauucuuucuccaugugacucauguucuaaaaguguuagaaaauuuuugugggguuggccgggaaugguggcucaugccuguaauccuagcacuuugggaggccgagaugggaggaucacuugagguugggaguuugaaaaccagccgggccggccgggcgcgguggcucacgccuguagucccagcacuuugggaggccgaggcgggcggaucacgaggucaggagauugagaccauccuggcuaaaacggugaaaccccgucucuacuaaaaauacaaaaaaaaaauuagccgggcguaguggcgggcgccuguagucccagcuacuugggaggcugaggcaggagaauggcgugaacccgggaggcggagcuugcagugagccgagaucccgccacugcacuccagccugggcaacagagcgagacuccgucucaaaaaaagaaaaaaaaaaaaaagaaaaccagccgggccaacauggcgaaaucccaucucuacuacuacuaaaaaaaaaaaaaaaaaaaaaaaaaaaaaaaaaaaaauagcugggcauggugaugugcgccuguagucccagcuacucaggaggcugaggcaugagaaucucuugaaccugggaggcagagguugcagugagccgaggucaugccaccgcacucgggccuggaugacagagugagacucugccuccaaaaaaagaaagaaagaaagaaagagagaaagagaaaaagaaaagaaaagaaagagagagagagagaaagaaagaaagaaaagaaaagaaagagagagaaagaaagaaagaaaagaaagaaaaagaaaggaaggaaggaaggauagaaagaaagaaagagaaagaaaguaaguuacugugggaagggcaauauacuuagagcuuaaaggcucuagcugaggauuuccuggcacaaagccucugagacaguuuuguacggaggagguuuguaggcaggcacaaggcauuaaaggguaaagagagaggcagcagaccacagcgcaguugcuaagaggcaucagccuaagccaaugggaaguugaagcugggaaccccugcggggguaagucuuaaaucuaggugaagaggcugagcccuguagaccguucauuggcugccuuggagaggggauguagccuuaggagaggcagcuuauuucugcuggagauaauucuugggaaggcacucagccaguacacguguguagagggugguaagaagaauagggaagaagagaagugcuguucuaagcagcggguauaugagcacucagggcuggaggugagagaacauacuggaagaaguucagcaugguggggauauaauggguggggacauaauggggaaggggcugguuagaugugagagaagaagcuggacaggcucacaggggcaaagcagaaggaccuuguaauucuugcaugggagcuuggaugugauacuaaggacaaagggaaaccacacaacuggcuaaagcaggagagugacaguacccauuagaauuuuaacaaaaucauaucagcaacaguguagaagaggauguguugacucggggcagggaaggaggcaggaaaccuuuugggaaguuguagcaaugauguaagugagaggcgcaggguggacuggaucacaauuguuucucauucucaucuccuauaaguccccaauguggaucaaguucacauucauuucuccaguggccccaucaaauugaugggauuuacugagcuuacugcucacuauacuuuuuuuccgcacaugugacuguuaagccaacugccuuuucuacagugacuucucuugcccagaugagcacauuuagguuagugaauccaagucuaauuuaauugagucuuguuagagucaggucauugcucuaaauuguuaaaacaaacgauauacacaaacacacacacacacaaaagaauaaauugaggaggucccaauucuguauuuuaaaauacuuaauauaucccuuccuucuugaagagagcuacaauuucaagaauuuauuuugaaaaaauucuaucaguuuauugauaaaaaugguaaaaggaacaaagcugagaacagaacauaucaucagacucucuagggacggaaaucaauacauaauacuucaagauaucacccucagcuacuugcuguuccaccaccaguucucuugcauccaguuuuuguuucuuuuaacuuggcuauaaggaugugagcacagacucugccaaacagccugcugaaguucugcaaacaccuuguggauuguguuucccugaacaacccuguccaacaauggccuugggccugucugaaguauucuuagugaacuucugcugccaccuagugaucauugcgaauuuuuaaaaagccucuuuauccuuuaacaaguuacucuugucuuaccccaaagcggcaucugccucacuggcauaugacuuacagagcucacauuuucccucuccacaaaguucaaaauggagacuucucagauuuagccuuccagcacccauucucaaacgucgugcauuacagaaaaguuuaaacuauaaaguugaaccgcacgagauucucauuuugauaugucauuaaagucagauauuggcaagaacauaugguuuaacccaauggcuuggaaugcuggaugggauucccagaagcuccauacaucggccugcuucaggacccuuuuauuacaccaaauaaacccaacaaacauccaucgagugccuauuuuauaucagaacaaugagaccugcuccuucuccuucaggacauuuuacuuaaugggggaaacauacaaguaaacagacaaauguaaucagugcaagaaagaaucggacagcaauaugcacaggauaaggacacuuagcuaaaccugcagacauugggaaagaugucagggaaaagggauggcagaaggaaagacaaggccaaaggcaugggacugggaggcacuggaauaucagggcaacagaaagugcugucauuugguauaaauggaacacacaggauauaugaaagcaagaaacagaagaugagucugugagguuacuaugauccaguucauggagggccuuguauguccuggugggaaaauugguuuuuauugugggaagggaaccuuuuaaugcauucaaagcaguggaaugaagugauuugguuugcauuuguuaaucaugugaagaagaauagguuggagggauaaaacuugugguggugagaugagugacagagcgacagccaucuacaaaagaaacacaagguacagacugaauugugggagugguaguggggauggaaaauaaagaacaaauuuagagaggcagaacugaguggacaugaugcucagacuuaccagagcaggugagucaagaaugaugucaccauucccuaaaugaggcaaacugggagagaagcagauuuggggagaaaacuacuaaacauguacgucccuccaaaaccuucaagaaugcuaaagggacagagucaaguucuuccaaaguuucugucucuuccauuuauuuugcaaugaauuucaacuuguuaaucagaaauggauuuggaguaguagcuauucaauuguuuuauacaccuucuagaagaaauauuugucagaugaguaugucaaaaacuucucagacccuccccuuuacuugaauguaucuuccagcagauguugguggaaucaaaguucauuauuacuccuauaucuuuuauacuaguguuaugaucugcagugaggacaugcauugcuauugcuacgccuggccuggaaugucugagguguauuucuacaacaccaauuauuuugugugucucuccuuuuaaucuccaccaaaaaauggagacagcuagauucauaacccuuagacauccuauauuuuauuacuaauacuugguuguggaaguuugcauucuaaacaagucaucaacauaaaaaucucuaaaaauauuuuaugaaaaauauucagcuuaugauauuuuaaaaaucacaaaccuaagaaaacacacaaaccuguguuuguauugugaaaucagagguuaaucuuccucacccugugaaaaaauuaggggcauaaaucuauaggaaggagauugggugaauccaaguuacuuacggaugacauaaaagauacaaucaacuuuggugauccaauugccacacuacaacuaucugaccaacacguuucuguuucucuuuagaccacucucaucuccaggaaccagcucucugugggccacacaugauguuugacgaagaucguugcgagugugucuguaaaacaccaugucccaaagaucuaauccagcaccccaaaaacugcaguugcuuugagugcaaagaaagucuggagaccugcugccagaagcacaagcuauuucacccagacaccugcagguaaaugccuugaguugucuugccuuuacucaugacauuuaacguagaugccauuuuaauuuggugggauuccuuaguaagcuaauuuuuccccuuggugccugagucccuuuuggauaauagaacagagguuuagcagcuaaggaauaagcaagaguauaccgagucaugauuaaucaugaaaauaagaaaaucaauccugccuguuauuauguguguagagcuuuuuuuuuuuagacggagucucgcucugucuccaggcuggagugcaguggcgugaucugggcucacugcaaccuccgucucucugguucaagggagucuccugccucagccucccaaguagcugggauuacaggcacgugccaccacacccagcuaauuuuuguauuucaguagagacgggguuucaccauguuggccaggauagucuugaucuccugaccucaugauccacccgucucggccucccaaagugcugggauuacaggcaugagccaccgcgcccacccgggguuuagagcucuuaaacaacaaugaaauugguaaaauuuaagcaguuauuaggauauugcuuaauaauaauauuuuaggaaggggagguuucagaucaucaaccuguuuaguucaaucucucauuguuuaugucuauauauguuuguuuuuuucuuuaauggagggaauaucauuggauuuauauagcaaguaauuuauucaugaauagaacacuuggagguuacugauucacuucaguagauuuugaauccaugugggauaaccaugcaggauuuuauacugacauuuuaaauacaugucuggaaaacuuaaucaaaucagagcagaguuauucuuuugaauccagucauugauucugaauucucaucuuuauuuucuuuugcaacagcugugaggacagaugccccuuucauaccagaccaugugcaaguggcaaaacagcaugugcaaagcauugccgcuuuccaaaggagaaaagggcugcccaggggccccacagccgaaagaauccuugauucagcguuccaaguuccccaucccugucauuuuuaacagcaugcugcuuugccaaguugcugucacuguuuuuuucccagguguuaaaaaaaaaauccauuuuacacagcaccacagugaauccagaccaaccuuccauucacaccagcuaaggagucccugguucauugauggaugucuucuagcugcagaugccucugcgcaccaaggaauggagaggaggggacccauguaauccuuuuguuuaguuuuguuuuuguuuuuuggugaaugagaaaggugugcuggucauggaauggcaggugucauaugacugauuacucagagcagaugaggaaaacuguagucucugaguccuuugcuaaucgcaacucuugugaauuauucugauucuuuuuuaugcagaauuugauucguaugaucaguacugacuuucugauuacuguccagcuuauagucuuccaguuuaaugaacuaccaucugauguuucauauuuaaguguauuuaaagaaaauaaacaccauuauucaagccauauaauuuuauguuauuuaauaugcuuccacucuauauuuaugcuaaagaaaaaguguuuuaaagaaagaaaggaauuucaaaguggaaggugcaggaagagacacaaacacuggaccucaguuuugggaaaccaagggaauagcucucagaaagguuaagauccuaaaugaggcuaagcaaaugugacccaagaauccacugcgaaucacucugugccuugagauuaaauugaacuugaccugauccccaucccauggcagaggggaacccauccaugcccuugaccucuuugagaguuugcauuucuucuagccaccucuggcuccaaguuucugcacuuacucaaaucucagugucauggacaccccaacucucauggcaacacaguucuucucucuguucuacagcuaucacuuuuuguuuuguuuuguuuuguuuuuuguuuuguuuuuuuuuuagacggagucucacucugucgccaggcuggagugcaguggugcgaucuuggcucacugcaaccucugccucccagguucaagugauucuccugccucagccucccgaguagcugggucuacagaugcacaccaccacgcccagcuaauuuuuguauuuuuaguagagacgggguuucaccguguuggccaggauggucucaagcucuugaccuugugauccacccuccucagccucccaaagugcuaggauuacaggcaugagccagcgcgcccggccacauaaagccuuuuuccucaaaguacuccuacaucuaauuuguuaaugauguagacuuuauugaaauuuugccauaacagagagaauuuagcagcauuagcagauuuaaguuauguauuaaauaacuuaaaauuaaucccugcauaguaucuugcauagauagauauguauauagacacacacaacccauuaugguacuuacaacacauuuguguaaauaguaguguuccuguuuaucuccccaccauacugugaccucauuaugauuggaaacgguguccugaucaaauuuguguaacccaacuuucucaggccagaacacccuggaacaguacaaucaaaaggagaaagacaaugauaaacaauggaauaguaaacaaauguagccccaugguaguggcauuguuugauccuggcccaaaucccuacccuuccucugccaggguuucuaagcaguuccugaauucucccuucauucacugaaauucucugaagccuggggcuccagguccuuugaugcuucccuggcuuuaacucucagucccugcccuggggacaugagcuaaccuucaccuggccuuggaaccacuccccacugugcugccauugucauugcucuugucauuuacuggugccaacccagucacuccucuuuugccacuguucuuuuugcccucacuuuaugaccuugaugucaacaggcuucuuccuucucauuuuacuguauuuuuaaucaggcuucugaaaaugcuugcacauaacuuaguuuuuuaaaacauacuuggcauucgacucuuugcuuugccuuuucguucaguuucuaccacucccaacuucuccaugauauuugcuuaaauuccuuugagaucuggggcagaagacaauucaaggauaccacacaauuaaaggaguuacuuugcuuauccucgacugguaaaaagaggggauguaucacuaaggagaaaagaccugaauuuaaggacagacucugccaccuaaacacauuguaagccugaacaaugucaucgagccucaguuuucucaucugucaaauguaaaugauaaucucauuucccuaaaucucagaauugauaauuucauuagaguuacgauuagugaaaaaaaaaaauugaacaauacaauguaccuuauagcucaaaggaauuauucugaaggaaaaaagcaagacugagcaaaucucagaagcuugggaccucugagauguucuuggcuuauacuggauccuuggaucuguccuaaaaccaacucaaaccauguuuuggcucgaaaugccucuggcuucauaauugccauuuagauggagauuaucauagggaauucuaagcuaagccaaaacucaaugugaucuggcuuugugcuucuaaaaccccucccucuucuuccuccuuaauucccaauuaccaucaagaucugcacuuggaucccugacgcugggucaggaugggucugguccuugagggcggaggugggguaacuggccuguugcuuucuuagaguucacuagacauugcacaggaauauuugucauacuaacagcccuggaacgugaguugaaaauccucaacuuguugcaaaauaaaaguaugugagaaacuccaagagcuuuaagcaaacacaauaaaugccagcaaugcaugaugucccugauuacgccacagggccagagaauuauuaaugugacagcacacgucauaaaucuaugacuaaaacaguguggcaggaggcccuuuagagauggaaacagauuaggcagcaugaugaucagaguugaaugaagauuaaaauacugucugagagacuugauaaaggaaauuauacaaacauuacguuuuaaugcccuuaagaaaagccauaguucagugaaaauugugagcuuaauagauuuggucagcaagagcuggacuuugccuaauuuagucuuaauccucagugugagaacaaugucuugcauauauuagguacucaauaaauauuuaauaaauaauaaguuauuacauugauuuuguggccagccaaugaaauuaucucuuuaaaaagugaagaguaauuuuacauagcucauguuuuucaaacucagcuaaauuauaugcaugucugaauuauucagauguugcaacucuagaaaggaauuuaaucuauucucaaaauauuuaugaaaugaaaaggagcaaaaaaauucuguuauuugacccuuauuaauggcuucaugaaagaaagucugccuuugguaauuuuaucacugauauuguucugaaacaguggucaguaagcuauggcccauaggccacuuucagcucacugccuguuguuuugguaaauacugcuuuauuggaacacaguuaugcucauuuguugauguauugucuauggcuacuuuuauucuacaacagcagaguugaguaguuggggacagagacuguuuggcuugcaaugccuaaaauauuuacucuuugguccauuacagaaaaaguuagccaaccgcuuguguaaaaauauuucuuauuuuaucacgucaucaaugaacauuaaauauaaugaauuagacugcuucuugaaccccuauaagaaauggcacuuuuaccuggccuugaucgauuguuggaaucaacuggccucaccuuauuugagucauuguguagugugcaacccaaugaagcuaaaaaguuacagugauuuaaauuucagguuuccacaauucaaauaaagucauggauacauuuauugauggguucuaguuauguuugugguauagcucuaaaauguuaguguugauggcguggacucuaaauagagauagugcauaaacauauuaguuuuuuuuuuguuuguuuguuuuuucucuuuuuuccaaugcccuggguaaaguaaauacuccuaaagaguaaggggauuuuuuuuuuuuuuuuugagacagagucucacucugucacccaggcuggagugcaguggcacaaucuuggcucacugcaaccucugccucccaaguucaagugauucugcugccucagccuccugaguagcugagauuacaggcuacaggcacccgccaccaugccuagcuaauuuuuguauuuuuuaguagaaacggaguuucacuauguuagccaggauggucucgaucuccugaccuugugauccacccgccucggccucccaaagugcugggauuacaggcgugagccaccgcacccggaccaggauuuuuuuuuuuuuuuuaaagcauaagcccgcaaggacaggguaaaugauaaagucaacagaaacaacaauguucugaaagcugaaaagcacguagauaaguuguaaaugauguggccgaccugaaaaaaaaaauaauuuaagccaacagucuggaaagaugaguucccaaaaggcucagaagugggugucccaagcaccucuagaaaugggagggaugagaggggugcuaaaaugagguucauuccaaaaaucuguauaagaaacaguuugaucccaaaucuucucccacauucccugugguggagugacugcuccuuccaaccccaggcaaaagauggguuauuagucguuuggcuaagguaaaagagagagcauccugaaugggggaugccugacauccaugagggcagggugcugaacuaacaagaggauuaagugaacgcguacauacuaggugcaaccacaauucaggcaguuggaucuguacuggaaaaguauuucucuagggggaaucuuaccagccuaagagaaaagaccuaaaaaggacugaaauuagcugggggagggacuaucaaauggaacagcccaaagaggucaucaagccccauuccugggcucagaccucagaucagcuccuuugucccuuucuuuuaaguaugagcaagcaagcaugaauucccagaccuccagggaaaauuucuaacaugaaagacagagaguaaaacacacagaaaaaggcaauuuggaggaaacagaagaaaacuucaaaucauuaauagccaggggaugagggaagaaggugagacagugcaacuaauaaauaaaaugaagguguuauuaaaaaagaaaaugucagaggacauaauugagcccuaggaaacuaaaacuauuauaauaaauugaaaauucaauagaacaaaaaaggaagacagaguugaagaaauuuccuaugaaguagaauaaauaagaaauuaaaagugaaaagauaagaaggucuaacaucagaauaacugaaguuacaggaaaugagaagagacacaauaggagauguaaucaacaauuuaaaaauucaagagaauuucgaagcacaugaguuggcaagugaaaaggcucucugagucccuaguccaaaaggugaaacuaugccuauaccaaggcacaaaaugaugaaauuucaggacacgggagacuaagagauaauguauaaguuuccagaguaaagaaaaauuaugauaacuucaaacaaagggccaggaauccgaaugaaauuaguuuucucaauagcaacaccaaaagcuagcaggcuagagcaaugcugcuaaacuucugaaggaaaauaauuucuggccuacuauuuggcacccaaacuaucaauaaaauuggagggcugaaaaauaaauuuucagacauuaaaguucuuagaaaaucucccgaucucccaugcagucuucuuuaggaggcuacuggaggacggucuucaaaaaagggugcuaaaacgaaaaggaagacaucacucaaacaaaucccaauauccugugauuuuccuugucucucucuuuuuuuuuauugccacgagaaaacaucagguccucauugccucuagucuagagcuaguuucuuaagcuauaaugugcauacuaucauuccagaucuuguuaaauugcagauucagauuuagcaggucuggagaaucugagagucugcacuucugaccagcucccaguugcuguugcugaucugcagccccuacuuuaaauugcaaggaggcuucuggacuacuggaacagccuaacuggucucuucuccagcugugccacucuuucaccuuccuuuucuccaguucuuggaacaauuuuccuaggacaaagcuuugauugugguuugacauuucaucucauauucugcaucaaaaagaaguaacugccuuaguuacucuuuuccaccacacuaaccuuuguuucaacaguguguagccuaaagcuuaucaauaugaguuuuaaaaaugcuaguaacaucuucauguucaagguaucuaauugauucuuuuauauccacugguguuuguuuaauuucugcauguuuuuauuuccaaauucuuauucuuuuaaaaaugucauuucaaaaauuauuugaauugcgucuagagugaauucuucuuccauuguuacauuuguguguugucuuucuuaauauuauauaucuuccauuguuuuugaauuuugguuuauaaaccaaucuugagagcucucucucucucgcucucacucucacucucuccucuccccguguguguguguguguaugugugugugugugugugugugugugugugugugcuuauaucccccagacuagcagugauaguggaaaauugcaaauuauguugcuuggcucaguucuguuagcaaaguuauauccucagacuguuggcaaaaaauucuuucaaugucuauucacaaguaggggagaugguuaagcaauaaggcuugguuaucuauugcuauguaacaaaucacccaaaaacuuaauguuuugagacaauaacgauuuauuauuucucauaauucuguggguuaguuaggaucagcuaagugguucuuuccacauaguauaggcugaagucacuccagugguuauauuaaauugggaacucacuuacugcuggaaugcccaagaugaccucucauucuucagggcuucucuccauguggcuugccauuauccaauaucuugucugagcuucacagcauggucauuggcuuucaagaggaaagguuccaacaagaugcaucccaguaaauaaacacuuauuaagcaucuguggcaucucauuuggccauuccagucacaugcucaaacccagagccaaugugggagaggauuagacaaggcugccaauauggaauacugguuuauugaaggucaccguuguaacagucucucacaaaacugguuccuguaucaagccacacauggaacccuguuagucuauuauucuacaggggcugaacccugguucacaucuuccugcugccacauacagaauccaggaccuagguggcuuuguuccugaucaccauuuugcguauugguucuguuucugauacacggaaauguuuaucuucuuguuuaaaucacagguaaaacauuaaauuuucucauuuauauuguaucacuuauuguuauauuugaagcagaaucaggaguuaggagucucaaaauacuaauugaaaaugugaucuuggcuggaaguccgccucaacaucaagcccauuuuccuuaguaauaucuucuaccaguuugcucuaaccuucauugauaaugccacucuucuucugucugcccacuuucccuucucuuuuccuuugugauuacaaagcaguguuugcuggacagcaccugucuguaccucauucauguuguucuuggaauuacccuguucccaagaguugcaugacaccaucuacuuauucuucuagcuaaaugcuggcagcuagaaauacucuuccccuuugaacucccaauauuuuucuuauauuucucuuauggcauuuaucacuuccugcuuuuuaucguagauauuuacauaugccuuaacucuguauuguuuccuugcaaguaaagcucaugccagguuuucucugcaucgugcuuuguacacagauaguaggcucucaagacauguuuguugccuucgcacuccaagauuaucccaaagagcuaauuuacauaugaaguugcaaaaacugaauuucaagggaagaugauaucuacauuuauuuuacaucuucaucaucucaggucguuuaauacuaaaacugguaccaauugcccucauauuuuauuaagugcaaucagaauauaaugcauguaaguaucuuagucuaauuuuagugguuccggagaaaauucucucaagacauaccuugagaccauacauuaaggcaggacaccauaauuagaaucaucuccagauuuauaucuuaaucuugcuacuacaaauuucuuuugacuuuuuagaauauagccuuaaauggagaccuuuacuuaacugacuauaaaugaagucauguacccaggugagauuaugaacccuugggagucggaaucaugauuuauuuaucuuuuaaugcucagugccuaggacagaagcuggagcuuuaaauaaauguucaauguuuucagacuuuguuggaacagccugcaggcuccucaacgcccucccccacagagacucagcaacagugugccucuauuaauaucuauuuauaaaggucagccuauucuauauuugaaacacaaagaaccuuuuaagaaagguggauuucuuuugacuauugauaacauguacaggaaaagcuagaaaaaauaaaaagcuguugaaacacagggacuaugcuuaauauuucuuguauuccccacaaggccuuuuacagagcagacauccaguaaauguuugaugauaaaaauaagaaauauuuguuauauuuugaaaaaagauucaugguggaauuucaaacguguacugugaucagaacuauggcaggggcaaaccaggggcucaauaagugaggcuuaacccucauuuauaccuuccaggauuucuacccccacucuuugucuuaaaaccuauuacaaaaauggaaaggaggccaaaugcuguaccuaucugguaaugucgcuguuaucugugaaaccaacuacaaauuauaaagcuuaauuaaguguccuugagucuucaucacuguaauucuccgaugcuucaucaauauuaacacagggcaaaguaucgauugcuacucuagucuuacucaucaacucauuaauucgcuucaaaucucacaacuaaaaugcucuuucaaugauguuauugcacuguaauuuguauaagguacacuccacgaaauacugucaauacauuuuauugugagcaucuaauaugugucagggagugugcugacauuggguaaagaaauucauguauuaaacuaaaacuuccucaacauccauuaccaagaacagauccugccucaguuuacuaucuggcagggaaggcagacauuuaacaagcaaauacaauuuccguuuucagaaagaaguccaugugagaucucaagagacaaguaaucaaggaucagggugaggagggagaaugcaaucaggcaaacaacuugaauaucaucugauaaauguuauacuuuggccagcauguggccaaaguacuauuaaaauuaaaaagugagaguauuucauucucuggaggcuuggggaaagcaucagaaaggagcagacauuuucagggaugaauaggcuuacacuaggcuuaauaaaaugggugccaguaacgguggcugugaugguacucagaaaggaauuucuucucgaaaacgcacguauggcagggaugggggauuccaaguaccagcugugacgcauggaugaccgucauaccacucucacugauucuuuagcuuccuagucaagcaccaucguaacuaguugaaccagucgagugggaguugauauuucagaucagaccucguauguuucccucagaguguagaauugccauauaaauaacaggaugucuaguuaaauuuacauguccgauaaaaaacgaauguguagugaaguccccaauauuugguacaugcuuguauuaaacaucauuugugcuuuaucugaaauuaaaacuucauaguuucaucuguuuugacuuuuuguguauuuuuauuuauuuaucuggcaaacgucccagagcgguaagaaccggcacgguuuugccguggcacagcugauuacaaacaaaaagucucuccaaucagaagcaagcgcgcagagaacuggcguccggaauagagacgcuguaaccaggaaaccagggugagcacccacccuaccgucggccgcuucuaggagacgggcgcaggcgcgcgcugacguuacaucucgcgcuuaaggguggggacgacagagcgucucucucggacgugaccucagcgccucuuugugauuggcugccucgggggcgcggcccuugggcgcggacgcccuagauuggugcugcggaacagcagggagggacuccggcugcagccgcgggagguccggacacuggcggccauggaacucaccggugagugcgcgucgcgccgccccucuccagcgcucugggccgcuuucggauggggcuguucugcgcgcgugggaucguggcgggugguggagggggugaaaccgacccgguucgaagcccggaaguugggucggagggucuccagaguagguuggggcugagggugcguuuagggcggacgcgcuggguuccuuggcucaggcgggugggucgagggacuggggucuccggaaccccgggccugagaccaacguccacucuuugguuguuuucuuucucucuuugggccuggccauccccgccaugaacccagcggggucgcugucugagcagggguauccccuccuuggcccgagcguuuccccagcgaccucucagggaaucagggaaugaagcucagacagugcccaggaauugucgguggaaguaccauucucuugacccacaacuccugccaggucucccuaagguucuucaggaaccucuacugcuaaugauugcccagggcucguuggucguggucgagaauuuuacgguaaugucuuugccacuuuaaguggcugggugggaaccuuggacaaaucacucaacuugucuggguucucauuuguaaaacgagagagguauucacuagagcuccaagccucauuucggcuuuaagagcuaagauucugcgauugugcagcauaaugaacuuuuaugucaaagauguuuggacugaaaaccuggcggaagugggcagacuccucacagaacguugcaggcuaaugacaacauuuuaaaugauaucauuugguucauuacucacuguuuuugcuaucguucaucuuuuaaaacugguagaacuggaaguucggguuuaggugaccacaguaagaaaauguuaguuaagccaccuaaaaguacaaacuuggggaauuucaauauuugguaauauugaaucuuaauuaguaaacucagucaacaaacacuucuggggucuuuccgagaguauauuuaaaauguagaugaggccgggcacgguggcucacaccuguaaucccagcacuuugggaggccgaggcugguggaucaccugaggucagggguucgagaccagccuggccaacaugaugaaaccccgucucuacuaaaaauacaaaaauuagcugggcuuguggugugcgccuguaauuccagcuauucaggaggcugaagugggagaaucgcuugaacucgggaggcagaggcugcagugagacgagaucgcuccacugcacacuagccugggcaacagagugagacuccgucucaaaaaaaaaaaaaaaaaaaaaaaguagaugaauuuguuggagagacuagacaguuaagccuuugcacauacaguuaauuggcauuuucugaguuugcaggugaaaccggaaacucagagcuuuaggauggcuucucauuguauaguuguuuguuuucuggagccuuggaaaucucauuuguaaagcugaggaagauuuugacuagauauccaagauucuuuuuagcuuuaagugucuaagaauguacaguaguacuaaauauugagugggcauuucacauuaauaaagcuuuaggggaccccugagauaaacauuucgcacuuuaaauugagaaaauggucccagauacagcccaucucuaguuuagccuuuaucuuuagacaccgcacugaagggagggacacucauugaguuugaaaggccugcauaacugauagaaaaguuuaaaaagugaagggagcaguuacauaaucacccucuuugguuuuuguguuucuguuuuuuguuuuuguuuuguuuuguuuuuuugagauggagucucgcugugucacccuggcuggagugcagcggcgcgaucucggcucacugcaacuucggacucccggguucaagcgguucuccugccucagccucccgaguagcuaggaccacaggcaggcaccaccacgcccagcuaauuuuuguauuuuuaauagagaugagguuucuucauguuggccaggcuggucuugaacuccugaccucaggugauccacccaccucagccucccaaagugcuaggauuacaggcgugagccaccgcacccggccuaaauaaucacccucuuugaauaaggaaggagaacaugugugcagcaugugcucuggugacauuugaaaaaggugcucucaaaaagauaguucgagcuccggguguguuuuaguguaaaccacaaagguaaugcuagcaaaacuuugagaguaauugaaucaguggcuaagcuauagagcagggguuggcaaacuuuaguagaggaccagaugguaaauauuuucagcucugugggucauauggucucuguuguagcuacucugcucuuguagcacaaaaguagccauucacauaaaugaaugggcacaccuaugagccuauaaaacuuuacaaaaacaggcaguggaccaguauaaccgaguuuggauccuggccuguuuuaguugucuguuauuuuuuaccaaaccaccccaagacgauguaaaacaauagccauuuugguauguuucaugauacugcagugagcuaggcucagcugggugguucucuuggucuugccaguggucacuaggaggcugcauuuagcugguaaguuggcuggauggcugggccucuggcucuuuccauguagucucagagcucuuccuucuccauauuaucucuucccuugucccucuagcacaguagauggauuccuuacacuuuggcuuaggauaucuaagagugcacaagugaaaaccaccacaccuuggaaaucaccacaccuuuuuuaggccgaggccaaaaauuugcacaucacuuucacuaccuucuaugggcuaaaccagguccaaaugcaacgggaagggacuauacuauagaagggcauaaauaccagaagacaugaccgcuaaugaaucagacugcuacauuguguuaccucuaagcacugaauaacugaacaaauuucuuaaccccuuuaagcuuuagacuuuccauuuauaagauggaguugauaacucauggaguuuuggugaggcugcaauaagauauagaagagucuuagcauguaguagcugauguauaguggccauuuaauaaguauuaauagaagcugguaaaguauaagaguaaaggggaaauauauaaauguguguauguauguguguauauauacuuaauuauuggaagagacugguuuguuaacgugguaaaccaugauaugcugugguguaacaaacuuacuauuuaaaguuacauguagcaguauuuuuagggcaaaauuaagacaugguagaaccuaguuuuguuguauguaaaugccaagcaaguaaaugucaaaugaguaaauugaugauuugcuuuauuuuuaauucuggggaaagcuaacaaauuuacauuaacauuaaaacaauaucuauaucuggauuuguaauauggaauguguuuuguuucugagcugagauccuguuuuacucuuuuucagguaauagaggacacaucucuuaacuggguugcucuaagaacugaugucuaaaccgucucagcauggccuguagaggaggagcugggaauggccaccgugccucagcuacacucucucggguuagcccuggaagucuuuacacauguagaacccguacccauaauauaugcaugguaucugacuuuuucuacccaaauaugggaggcguggaaagccacauuuaccagcucucucagugccugauugaaagagggcauaagguuauaauugucacccaugcuuauggaaaucgaaaaggcauccguuaccucaccaguggccucaaagucuauuacuugccucugaaagucauguacaaccagucuacagccacgacccucuuucacagucugccauugcucagguacauauuuguucgggagagagucacgauaauccauucacauaguucuuuuucugcuauggcccaugaugcucucuuccacgccaagacaauggggcuucagacagucuucacggaccauucccuuuuuggauuugcugaugucagcucggugcuuacaaacaagcuucuaaccgugucucuuugugauacaaaccacaucauuugugugucuuauacuaguaaggaaaauacuguacuaagagcagcacugaauccugaaauaguguccgucauuccuaaugcuguagauccuacugacuucacuccagacccauuuagaaggcaugauaguauaacuauuguuguugucagcagacuuguuuacagaaaagguaaugaaaugauagcuauaauugcauuguagacuuuuuucccuauagaaagcuguugaauacuuguauauaaugauuguuuggcuuuucauuuuguuuuaugguuuuauaaugcuauaaauuauagcaaagaaaguucuaauauugguuuauauauccaagaagagcgauuuuucaggaugguggugaaugcugucccccaaccuuugauguuuuaaugguuacuaaaaauaagaauaaccugaugcuguuaaauuucagaucuuuuuaaaaauuaaaacagcccugcacaugugguaaagaaguagagggcaggccguguacgguggcucacaccuguaaucucagcacuuugggaggcugaggcaggcagaucacggggucaggagguugagaccauccuggcuaacauggugaaacccugucucaacuaaaaauacaaaaaauuagcugggcaugguggcaggcuccuguagucccagcuacuccggaggcugaggcaggagaauggcaugaaccugggaggcggagcuugcagugagcagagaucgugccacugcacuccagccugggcgacauaacgagacuccgucucuaaagaaaaaaaaaagaaguaaagggcagagcucacagauggcuuuuuucuucugauugccaaaguaaugucuuuucauugcagauauuuuggaaacuaagaaaagcacaaagaugaaaacuaaaaucagcuguaacuguauuauucagagauacccuaaugaguauuuugauuuauagcuuuccugucuuuuuuauguguacguacauauacugaaaaucagugggcuugcucugcacguuacuguauuguagcuugcuuguuucauuucaucauguauaagacauuaguaacauauuggcagguaagugaugaagaaaaggggauuagauguccugggaucagaugaugggucuguccugcugugugaucgaggacaaguagcuuaacaucucuaagucucaguuuuuucauuuguguaauguaagcaacauugggaaccucgcaaggguucagugauaguuccuauaaacuauuagccuaguuuguaacuguccacuauuaucaaggagguuuuuggguuuuuuuuuuuugagacggagucucgcacugucaccccccgggcuggagugcagugacgugaucucagcucacugcaaccucugccucccagguucaagcgauucuccugccucagccucccaaguagcugggauuacaggcgcccaccaccaagcccagcuaauuuuuuguauuuuuaguagagacaagguuucacuauguuggccaggcuggucucaaacuccugaccucgugauccaccugccccggccucccaaaaugcugggauuaacaggcgugagccacugcaccuggccaaggaggcuguuuuuuguaccucuacagcacuuaauggacacugcaguugaauguguggaggcuuguuuacuaaaagucugacacagucugguuauaaaaaacagugucuucugagugcuauuugaaaaccuguccacuaaucaaaagugucauuuauaguagggaaucauuaaaaaaaauacauaaauacauacccccuuaaauaguuaauauuugaauuaaacucaaaauauuaauacacacugaguugcccguaguuugauguaggauugcaggcuuugagugcugggccacugguuucagcugcaucuugcacacccuccuucauaaaacauaaucuaccauugcuacuuugaguuucuuuuggguggggucagaacuuaaaggcguaugaacugauaugcuucaggaguuuuaauuuguuuucaauuuuauacaguaguuuaggacaccccucaucugccaagaacuuuuuucugugacauuccuuuauuggauuuuucaaacuguucagcuuaguuuuuguggauacucuuuuugucaguuuauaugauaauuaaauuacucaacacgacgauaacaaguacaacugacaucaaacagaugugugaacaaacaauugauucuugacaagcacugaauucaguggugugccagugugcuagggaguggccuaaaaucuagaugugggccuuggucaguuuacguuuggaauggagaaucuugauugacccagcaguccauuuaaguggagguuggcaaggaaacuuggccugaacuucauuuucugguuugaaggcaaugacaugcuuucauucuuuaaucaggaacaugugaaccgacuggcauucuguauucugaauuccuccugggacauuagugauguguuuuuuuguaacuuaggaauuguaccuaauuuauuuuuuaaccaaauagcauaucuucuugagauggcuagcugagaaagaguaugacacaagugugaucaaggaucagcaaaauuaacuacccaugcaaagauuaaaccuguuaccuuuacuucccuaaugugguauuuuaacuagcugagcuaaccaccaauggagugaugguauggccuuuccuguacucaauucaguaauugaacaguuauuuaucgaacccucuccagaugccaggcacccugcagaaaguaacauucugaaaaggaacagccaugccuguagcccaaaagugaguaguuguauuaaugguccauuccuuauuaacaaauuaauuuccucaggaguuuauuggaccagauaucaaagucccacuggaaugucuuaagugagagagaggauaaaucaaaguuuuccuuauccaggcuuuuuggaugucuuuuuccugagccuccucuuccaagccuguuuugcucucagucaggauuuaccagcacucugcauguguaggcacgcucaccugcuuccuucuguagugguaaugacaaccuacauuuguauucugcaguugauaaagccuguucgugguacaauaccucauuugacccucccaacaacuguaggguagauguuaucuacaugaaauugagucucagagaggguaaguaacucacccagguuacacaguaaguaacagagaugacacacgaguucagcuuuucuggagcuaaguucuccucuuccuccacccaugcccagccacucauauccuagguguagaucagaagguucuuaaaaauauuguuagacugagcuuuaaaagcaguuuggaucagagauuuucauugucuguuuuguguucacauggcagucgaaagucucuagguuccauugcauuauacccuucuuagaggcuccagaauaaauuuuuuuauagugguggggaaaagcccuuauucuuagaauaagaauauagaucauugguaauaguaaucaguuccauuucuuaugagauacuugucaggauuaaaugacauaaugaauuuaaaguauauugccugucauagcaagcacucuguuacuguuagcuauuaucauuuaugacuauugcucuauguuguuuuuuguuuguuugaagaaugggcucuuaaccuuguacgagaaagaaaagggugaggaagaaaauggauugaaggaauuguaggagacuaaauguuaaaagucauuaaacuaccuucugguuuaucuagaaauccaauugagugauuuguuaguagacaugaaacaaagauagcuaugauuuuaaugagaagccuucauauucagaaaagcugcgugggaauuuuugauacauacaauaacaguuugaaaguacuagcagaguuuacuuaaugaauucuacuuuguauuauuuaauaaaaaugacccuauaauauauaugucauuucuccuauuuuauaucugauauaaaauaucaucuauuuuauaacugaucugccuauuugggguggaagauuaagaaauacaauucuuaugugugugugcauuuuuaaaauuaauaaacuuagcucuagguggauuauuuuauauuuacuuuuacuuuuuuuuuguuuuuuuuuuuuugagacggagucucgcucugucucccaggcuggagugcaguggcgcaaucucggcucacugcaaacuccgccucccggguucacgccauucuccugccucagccuccggaguagcugggacuacaggcgcccgccacuacgcccggcuaauuuuuuguauuuuuaguagagacgggguuucaccauguuagccaggauggucucaauuuccugaccuugugauccgccugccuuggccucccgaaaugcugggauuacugggauuacaggcgugagccaccgcgcccugccuacucuuacuuuugaauauguacguuuuguaauuguuaaugaacuagauucuuaaauaguguugacauuguugggacuuuggauagccacucacuuuuucagacuaauagggcauaauuuacuuuauuguuuucuauuaccugagauuguguuuauauauuauaagaaaaucauuuuggagaaaaaaggagccaagaugcauccuuuuguucuauggacuguagugaucuaacaguugaugcccugcugccuucauuuacccucauuccaggaaagugggcuauagcugguuugaacuuaaauuuugcgauaauguaguguucacugcaaaauucucuguaccagccacauuuuaaacaaaguggaggcagcaguuagauuucguugcuuagccuuuuccuguggcaguaagugggaucacagacugauagaauuuuauagcugaaagagacuuuagguacauagguaucuuuauuuuauagaucuugaaacuuccccacgaucaaugggcuugcugguuaaaaaagcugggaaaagacccagaucuccaaucagcugccugcucuggagaaaacgaacucaaaccuuagccaccuuaaauauaccuuuuuuagaaguacgcaauguauaaacacaagugaauaacuuaaagaauagucuguugagaugaaacagaauaguccauauuuuggguguguggaagguaaugcaugucaaggucuacgucuucaagaauuguaacucuugggggaccacugccaguuugcaaacaauuccacuccuggaaaagguuuaagagaguuucucuccuuuauggagugcauagcuaauacuuuucaaaauaaguggauucucagucguucuggugaauuuuuuuaaguuuaaauauuaauaucuccaacauucaacuuuauauuuucagggaucgauuugcuuagugguauaauaccugaacucugucagaaauauccagauuuaaauuucauaauuggaggagagggaccaaagagaaucauuuuggaagaaguucgggaaagauaccagcugcaugacagguauugaugaauuucauguugucuugagggagaagaugucaauuaucucuauuugguuuuaacugcaugcguaccuuagguguguugcuucuccugcauguaauugauauacauauaauugauauaaaucuaaugcaaggacuguuuucaaaauuuuuauauaaauaggaaaccuaguuaauucacuauuuuuuccauuagcccaauauuauuugacuuuggggggccauuguuggaggcaccaugaaaggcacaaaaaacagcugcuuuaacuggaagcguuugcagauuuccaggccauacuguguagugauuuaaguaauagggcucaaaucauguaaauugcucugcacauacagauuuggacaagucucuuccucaguaacuuacacaacacaaggcuuguacguguaaagcaucaauuuuaauaaaaaggccauuuuccuguuuacaaauggcacuuuaacauuaaauuaucaaaguuuauuaauauuauuacauacagacuaguuuuggagaagauaaaguuugauauguguaacaaaaguuagaaauaauguucgcuguaugaguuuuaacccaacugcuuuauaaggcuguuucuauuagaucaguguuuggugauacuaaucuugagguggagaacauuagcagcaauaagaauuuaaguguaauauaaauagcagacuugguuuauaaauuaaauuucuuuuguagcaugaguuuucacuccuuucuuccccucucauuuaaaaaaucagggugcgucuuuugggagcuuuagaacacaaggauguuagaaaugucuuaguucaaggacauauuuuucugaauaccucccuuacugaagcauucugcauggcgaucguggaagcagccaguugugguuuacagguaaaaagcuuugagggcauucaugguugggauuucuguguauuuugaaaaauaaugagacacauuccauaauaauguuuuaacugguuuuguugaucuuccugagguaugauuaugguggaguauguguucuuucuuucuuuuuaagguuguaaguaccagaguugguggaauuccugaggugcuuccagaaaaccuuauuauuuuaugugagccuucaguaaaaucuuugugugaaggauuggaaaaggcuauuuuccaacugaagucagggacauugccagcuccagaaaacauccauaacauaguaaagacuuucuacaccuggaggaauguugcagaaagaacugaaaagguaugucacaugcugagaaaagauugugucugaacucuuacuugauguuucacguacacauuugcuuuuucuuacauagauguuuaccauuuuuguucuauugcuuaaguugaugaaaucucuuccaggugaaaagaaacagauuuugguacacacaccgggcuaagugucuggucaaauuauugcguuugacauuugaaaauagcaguaauacagucuagcccccucauuaaacugggcauaaagaaguuacaaaauuuucuaaaagucacaaugaguagagacaagacgaguauuaaaucuacucuuagauauuuucuugaagcuguugauaauucuaaagcaaacaucucuauuaggaaaugcaugguuuugcugauugcagcaacuuuauaacuugugaauauuuaauucaggcuacuuccuaaaccucuuguagcccuuuugcuaacuacugugauuuucuccaggaaaaggauuuuugcaucuuugggcugauugagaacauaguaaguuagaauucaaaauguacgugacaaacgugggaaaaaucacaaauaaaaagcagcaacagagaauuuccaaaaggacagguauaggaaauagauuaacacccuuagguaggagauuacaguugugggaaaugcuuccugaauuugaauuagggacugcuuucauucucaguuucauccuuuacguccuuuucaugauguucucugccucaugccucuuauuaccauguaacaagcugaacagaaacaacucagcuucuuaguauguagaaauugugaaccagaaagauaaccagguggaacauggagaagguaguaguuuagaguaaugcuaccaacgugauauucaguggagcaaugaguuuuuagccuagaguagauagcaaguuggagcugaggagaauagcucuuuacuguaaggcuuucuuacuugguuugaaugaugaauuccaguauauaagaugaacucauaugugaauggaaguucuaaaaacuuaucucuaaaaauugucuuauacauuuuccauugaaacaugagauguuugcgacagucaaacauuuuugacugaagcauuuugagacauucugaccuucuacaagucuuguacuaucucucccauaugaaacauggaaaguuggagucuagugcuuaccuguugggaguacaugucagaguccccgggcagccuuuucagacucucucuacuccaucuugaugucccccugccuccccaaccacucccuagauuccaguguuauccuuuaggagcagagauagaauuggggguauaauuggcagggauauuuggucagacagguuauuuugaugauaccauccugaucuccacucccuuugagaaccauggcacuguuaaguugugacuugaccuucuucauugacaucguauaaaccccagaagccugagccacuguagguaauaaguuaacagggaaagaacuguggugacgguuugucagcauauaguaaaggggcuaauugggauuuuuuugguaaccacauuuuucuuuugguuaaaguaauaguacagcaucuguauuuuuuuuaauucuauggugauuuauaauacacuuuuagaaaaaaguaaauccuugccuauaauggauugucaucgcuaacauucucuucauaauaguaaauuguuauuuuaucacuuaaaacuauaaguagauuaauugaccugaaauaaagcuggacaaaaaagucaguuuguaguuacucuuuuaacccuaugacauuuuaauucauuucaacuccuccuucuuaguuuaacugugcuauuuaggaaaucgaucaugaaauuaauuuggaguucaugcuguaaacauacuucuucaauugcaauucaccagucucagcauaauucucaacauaauucugauuaaaauguuuguauucagaauguccucaggguaaaagagcucgaugaaaacaugccguaccuuucaagggcuguugaccuguacaacaugcacugcauguuauaacuuccuugaguucaaaaggagacgguuuaaaggucuaauauaugagacuaagcacaaguaauacucaaauuacaaaauaugaauguuggcccauuugauguguucugaacaaguauguuuaaagaucuucguuuuuugauauuuuagagcuuaguacuuagcaguguuuuaaaaagcaagccaccuacuugcucagcaaaaaacguuauuucauuugccagcauuugaccuauacuaucuacugaaauuucccccaucucuuuaucuucuuuuauuugaaauccaugaaaugcuucugcauguccucaccauccaugcucagcaacauguacagccucauguggcuguugaaagaggaggcucuguguucccagaaguaugcuagauuguagcucucugcuugugguugaugucugccagaugccggugagagcaucucagcuuagucaaggaaucuucaaaggcaaauccugcuucaguacugcugaagucacugcugaauuaaauauugacccuacaguggugaccccaaaagcuguucagacuuugcgggacuuuggaauucuaguaguuggcuaaaauugauggugacucccuaggggagaggaacuguggcuuauucuuuguaucacacagccucuagcccggugucuugcccagaauaaguacccaauaaguuuugaaucaaauggcaauaauuaucgugauuaaguucauuaaggauaucauuacuaugacaacaacaacaaaacacaagcaacuuuuguuuguauuuguuuauaaaauguuccugcaggaucgggucauuguuuaucaugggacaggugauggggugaugggugaaagugcucacacuuggcuucucucccuccagguauaugaccggguaucaguggaagcuguguugccaauggacaaacgacuggacagacuuauuucucacugcggcccaguaacaggcuacaucuuugcuuuguuggcaguuuucaacuuccucuuccucauuuucuugagauggaugacuccagauucuaucauugauguugcaauagaugccacugggccacggggugccuggacuaauaacuauucucacaguaaaagagggggugagaauaaugagauaucugaaaccagguagaaggaagccuagauuguaagauuuuaaacauuuguaauaguucuauaaagacuauggaaaauaaccuugcuuuugggggguuuuuguuuuuuuagaguuaauuuaguaaguuaugcuaccucuauaucauucaauauuuucuguugaggaaagauaaaaauguaugcaauuccugaguguagaaacuucuugcacuuauuuaaaauuuaggagagaacauuuaagccacucagguaugcaauuuuucagacuacugaaaucccuguagcagagauguuuuaacauuauauuuugagagcuuugggugcugaagggccaaacguuuucugggcauuuuuuggccaguuuuuaauguaacaccauuagacacucaccagauguuuacaaguuuucuuuaggggaacuacaacaauuauaugaacuguuuuauaucauguucauauacauuuauuaggaaucuaaaucaugucuuugaacauuuauuagguucacucaguagguguuacauguaauuaacagguuccuugaguaagauaguccaucaguuaccagcacauuuugaaccccugcucuguguagaauguugaacuagaugcuucccgccauuaaggaccaggggugcauucacucuuuguuuaccauucaaauggcuuacuucaucauaauugugguugauaugagaucaauauccaacaugccaaaaaugcucaugccaguuaaugccaggaaaaaaaucaccgacacacuacuaguacuuuguuccuguuguaugcauucuccuagguagagccuccaucuucaguuguguuugugaagguauuuuuugcuuuuuaaauacuggggaccgauaucacuguugauagugcagagaaacccuccacauuuuucagugcauaauugaguuuucuauaaaugccuucguguuuucugagcagaauguacgaggugugccaucccaaaaccagcugcuacccuguccuuuuaauguaagucacuccccuucacuguggccucgcugaugucugauaaguauugucagugugcaaaaggcuuuacuucagaaugguuuauuuauagcaaacuaaguugaaaauuuuagaaacagucuuuguggguggauguuauuaacugucauuguuguugcccagagccauggguuuuuuaaccccaaauuauccacaugguguguauuaugaauucuuugaacucuuaagguuuuugugagaaaaggacugugaauucaaaacaauaaggcacuugugggugcacuacauagauucugacaguguugugauucuguauaggauuuuuaaaaaugacaacauucacaaaauuuauuacuuuuuaaaaaauaacaugccuauuaacugguugcacugauauaaaagaaauauauuuguguuuuguuuguacuaaaaugcaaaagcaagagugcaauuuuuaaaaucuagaaguuagggguuuuguuggagaaaaauggacugaucuuuaaacuauucagucuuacugggauuuuuaugcauagaaacucacauauaaacaugaaauaaacagugccaguauucauaggaaagugagaaacuguaauauuuggccauuauucuauucaacagguuuuagaggcaugccaccauuuuuuccuuauauuuuugcuuaauuuuuuuaaauugucauuuaauucuuaaacugucauuuauuugagauggaaauaagaucuaaaguuaguugccuuugccuguaaaacaugugauuugcaaauuauuauuuuucuuuuuuuuaacaaauggaaguaaauuuguuucacguaaaucuuaauuuucaaccuuucuggauaccuuaauuguaacugucaguuugcacuggucgguauauggaaacacauugcucuacccugcuacuuaguugauuuuaaagugaauuuacagugaugagaaauuugugaaaaauauauuguauuucuuuugauguuucaaaagguugccuaugaaaaacugauuuguuaaaacaugcuacauguccaaaaauaaagaccagaaugacauuuugauaauuu

SEQ ID NO: 19228 - RNA, 49163 nt, Homo sapiens
ggggaguguugugaaagcagagagcccgcgagcucucuagggcggagcuccgcgggggaagcgccggcgaucucgcggcuggcgggggcgggaccgcagugcgggggaugucgcggggcgaggccagacgagaaucgaaugggaccuaggcugagggccuggucccgccuccagacccaggcguccgcauuggauugggcggugcggcggcgcuucuguccgccuuccggugucacgcgaccgccucccccucccacccuucucugucuaccucugggcgggacugccgggugaugagauacucggucggcgacgguagaacgggcgacggcgacaaccgcaaucacauccacgacggugaucauggcagaggugaggagccuauugcaccgccgcuggccccccggacccggaagccgccucugaggcccggggaccgagcgcccgugugcaggugggcuggguugaggguaagcggguugaugcaaguaguaucuaaggucccaucgugucucccauccagaaucacgcccagaauaaagccaagcucaucucugagacccggaggagguucgaagcugaguaugugacagguggguacucuguuccagguauuaagaaaggugugcagugagcauccccaacuuugcuggaguguuugugaguguauuugugggagguguuagggacccuuucgacccucacaggaaugaugcugggcacgucucaaagguuuuccucuccaugacaagccgugugcacugcuucaaauggucaaguggugugucccaugcucccuuuaaaggguuaauguaaguuggaaaucgguuaaguuuuuagcaugcccucguguuuauggaacuugcaggauacuuguuaggcccacaacacgggugacauuguccaguccacgguuccacugcuggccuuucaccagcaacacuagcgaaaauguaccuggaaacugccauaauacuauugauguguacuuaauuggguauacaaauuccuuggauauuuuguuugauuuggcuuucauacaacccagcaugcuacccacaaaauaggcccuccaaugcuggaacaaguucuuaucccaaacuguaucuugcaaaguaccuaugaguccagaauugauuuauugguugaacauucuguguccagaugucacagauacuugaguugucagguacuuaacugaauauuuaaugcuuguacaguaauuuuguaaaacauacggaauaacuuauuguaaauauggaauuaaauaaggauuuauauguugccuaccuuaagauugauuguaauccuaacccugccacuacauagcuuacuugucuauucugagcccguuuucauaucugugaagugcaaauaauaaaguuaguaggauuaaauuuuuuaaaaaaacauaaaccaucuagcaugucuuaaaauauaguggauucucagugaauauuuugccucaguugucauuuugguuacugugaaaggaguuaagcuucuacaucuugacuaguacucagcagagguucccugcaacuuuaaaccauccuagauuauacaucaguugaugacauagaacaaauauggaaaucgguuucaaauacuugucaguaaaucuuuucauaccuccuugccaauuuucuucacaccccaaacuuuguuccagagaguugcaaaagcacuugauucacuuuucacccagaguucccauuucuaauaauauagcugguuccaauaaagagauccuucuucaauugcuuucuacagaaauguaacuauuauagcuguuaauacaugguuuauaauauuuuaagaaguaacucagaauucgaccuaaugagcuaguaacaccccaauagucauuuauuuaugcccaagggaggaagcagaauacaggcagaaauuaggcaauaaacaagaucuuaaaggucaucuuggggcaaccuccucauuuuuaaaaugaagaaagugaggucuagagagauuaagagauuugcucaaaaucccugauguuauuggcuaggccaggacuagugcucaugucuucugauuuucacuacaguaaucuuuuggcaauaccaugaugucaaguuagaucaugucacucuccagcuugaaacccuucagugccuuuccaacugcguuuagaauaaaaucccaauucuuuaugguggccuguaauucaaggccaugugugaucuggcucuugccagcccccacccgccauccucaucuguuacuacucugcuugcuuagugcagauuugaccaccguucaaaguaagauacguguuauauguugcaacccaggacaaacgugcacacucacauaacugaagcaaaauuucauuaaagaauacuucugaaaacaugugacucucgauguauuuuuuucuauuugacuuccuuuuaaaaaaugaaauuacccacaaacuuaacaucacaauuuaaaaugugacccccaguugaaaaaccacgacuagccacacugccuuguguuccucaaacagaauggggcuguuucaauuucggacuuuuccacuucucuuugccugggaagauuuuacccagguauugcgcauggcuugguccuuuuuucucuucaguguuuaaauguauccgagaggccuucacugauuauuaaaugucuccgucuuguuuauuuucucugcuuuacagcccuuaucguaaucuguaauuaucuuguucauugguuuguguguuuuucauuuccuccaguagaguguacauggguuccguagcagccuauagacauugagaguagaggccuugugugucuuacucaccuuuguaugcccagcacaguucucaauauauacuuacugaaugaauauagcaauacuuaaauauauacauaagaagauugguccaauuuuaaagauuugcauggaaaaagaaaauagaagccuuugaagaccuucuuaccuuaagguuucaguuguuuccuggaauaugacaacaaauaaagguagaauuggaaagugauaauaaaagggguguuuuguuuguuuaauuugccuguguuuuccccuuagaauuugcuuuuagaaauuaacucagguguuuagaacauccacuuuccuucuuuuucuuucacccuuucuauugucauuaacaauauuuuguuucagaagaggcugaaggcagacuuaagcaaaguugauguuuuuccuaaaggaaaauauuuauuuucugcaagugugucacuucaagcacaaacuguauuccagaaaugcuuuuggaguuagguucuuaggaaucccaagcacauuuuuguguccauagaaacuaaguuaccauuauguauagauuuuuagcuggcaaaaagaaugaaguauuagccccuaauuaugguauuuuuuuccuuauuguuucugagaaauuccaugcugaaucucaaauaagaaacguuucccauucuuucuuccucuuucucaugcccaaggaaagagacuaaucucuugugacaauaauuuauuaaguuccuugaguacucuuuauaugccuaauucugggaagcaguguaucaguauuagagaaagagcggaggaaggguagagccccuucugaaacuacuacaaccuaguagaggcauuaaaacagagauagcuauuaaaauuaaggcaaauuguauuaaggguaauggugcugaaauauuuucuguaaaagucaaagagagaaauaacaucuggcuggggugacuaguuuagcacagaguuagaaaaaaauucauuaaaaaggugguguuucucaugaacuuuggaagaugguagaacucagccagguagagaaggugauccaggcagauugaauagucugaacugaggcacugaggucaaaagguauggggcauguuccaaaguaauaggaagucuacuuugauaaccuuaaggaggguaagcacacauggcuaaauacagugggaauauaguguagagagccuugggcaccagagucauguguuuguacuuuaguuaauauggagagccauugagagguuuguguguuuuguaauuagguuuguugucuggcuuuacaaguauaugaauucauuuaaauuaauuugggucauaccaaaaauaucugaagaaacccccauaaacuuaccauucagagauaggugucauaacaguggauacauuguuuacagucuuuuuucuuuuuuuucgagacggaguuucgcucuuguugcccaggcuggagugcaauggcgugaucuuggcuccacacaaccucugccucccggguucaagcaauuguccuaccucagccuccugaguagcugggauuacaggcaugugccaccaugcccagcuaauuuuguauuuuuaauagagaugcgguuucuccauguuggucaggcuagucucgaacuccugaccucaggugaucgccugccucggccucccaaagugcugggauuacaggcgugagccaccacgcccggccuacagucuuuuuucuauacacuuaagaaaacaaaguuagaagacuauucuggguugggcgcgguggcucacgccuguaaucccagaacuuugggaggccgaggcggguggauuaugaggucaggagaucaagaccauccuggcgaacacggugaaacccugucucugcuaaaaauacaaaaaaaaaaaaaauuagcugggcgugguggugggcaccuguagucccagcuacucgggaggcugaggcagaauggcgugaacccaggagguggagcuugcagugagcacagaucacaccacugcacuccagccugggcgacagagcaagacuccaucucaaaaaaaaaaaaaauuccguauauaauuuuguguauuauaaaauacauuuuuauugacaugauuuuauuucuccguauuuaugaaguaagcaacauuguauauugccauuuaauauuugguucuauaaauaaaagauaguuuucuuaucuuuugucuuagauagucccuuuguggacauuuagauucuuuccaguuucauuuaauacaguuuuuugugcaguaguugagauuauuuccuuaagauucauguucagaaacugaauuauugguuuuaagaguguuuauauuguucaggccuuugcucauaugugcuaaacuuccuccauggaaguugcaccaauauucauuccugccggcuuguaggagaguguuagucuuaccacacccuuacucauauuuagcguuguuauuucuuaacugaugguuguuuuaguuugcuuuugauugcuaauaaggguaaauuauuuucaugcauuuacauccauuuguaguuuaaacauuuuuuuauuaguaugacuuuuaauauuggucugggcuuuucuuguuuaugucacuuucacuuuuuucaguuuuugaauauauucaaaauuacccauuccuuugugguuucuucuauggcuauuaaguuaauagguuggugcgaaaguaauugugguuuuugccauuaaaagugacuuucuagucuuuuaauuuuuguuuuguuuugguuuacuauuuuuuuucuucuuuuuuuauuauacuuuaaguucuaggguacaugugcacaacgugcagguuuguuacauauguauacaugcgccauguuggugugccaacaguuuacuauuuuuuaauuuugaguuuuggaauucuguuuauguacaaaauguauaaaacgugaauaaaauaaacacucaugugcucacuacucagccaaagaacuagagccucccaguaccuuagaagccuccuguauauacccaugccugcuauucagggaacaguuuucugcauuugguguuacucauucucuuacuucucauuaaauuugcaaccuaugacauauuccucaccaguacuucauuagguuuugccucuuuuugaacuuuauauuaaagcugaauauauuuuuucaugauuugcuucuguugcucaaaauucaguuauauucucagauaugacuaauuuauuccuuuuuauggcuguguaguaguucauagaauaaauauaccaauuaauggguuugggguuguuucuagguuuuuguaucauguacaguauagcuaugaacauccuuauacaugucuggugcacacgugcaagaauuugucuugggcagugguucucaaaguuaguucaagaacugggguuccuugagacguugcaaggaguuugagagguuaaaacuauuuucauaauacuaaacuaccauuuuccuuuuucaccuucauccucucacaagcguaugguggcauuuuccagaggcuggguggcaugugaugaugacauuguucugauggcugauagacugugugcuuuauguucucaugucuaauucuuuuucucaauuuucauaccuaauacaguaacuagcaauaaauauaacccauaucaacaaagaaacuuuuggggggucugcaauuauuuuuaagaguguaaaagguguccugagaccaaaacguuugagaacugcugcucuaggguuuguuuccaccaguaaaaugaguaggugguagaauaggcacauuguuucacauucaacuucaguagguaaugcugaacuguuucccaaagugauuguaccaguuuucauuuuaaccagcaguauuugggcauccuuguuuuucuacauccuaaaaauaggcacuguaacuuaaaaaaaaauugcccaucugaugggcauguugggagaucucauugugguuuuaaugccuuugaauaccagugagauugagcuuuuuuuuucauaccuuuaugggaccuuugguuucugcuucugugaaaauuacuccuuccaacucuucuuggcccuuauuucuuccauguaaacuucagaaucagcuuauguuucugcaaaacaaaacaaaaaccacuuuuguugggauuucagugguauuauguuaaaucagaauauaauuucauggaaguugacauuaucaugguugagucuuuuuauccaagaaccugguauauauuuguaucugcuaaagucuuccuuguugaaagauuuaucauuuuccuuauagugguuaacacagucuuuuguuauauuucuucccaaauacuguauguguuuuauuuuuguuguuguuauuuaaaugguaugucuuaauauauauuuucuaaaugaugguugcugguuuaugggaaauauauaugacuuuuuuccauuaauauugaauuuacucuuauaaauucugauaauuuaccugggauuuuuuuauguacauaauaaccaccuugaaauauugauuguuuucuuucuaacuuuccaauucuuaaaucuuucaauacuuuuccuuuacuacauuggcuggaacuuuuauaacacuguugaauagaaccagugauaauagccuacuuaucuuauuccuaaugauagaaagauagcucugaacaugucaccauuaaguaugaucuuuguauauacccuuuaucaaagugaagacauuuucuuccacuuuugguuugcuaguuuggguuuuuuguuuguuuuguuuaguucccaucaugauugaugauugaguuuuaccaaaugcaguuucuucaucuguugcacacauuuauuauauuugaugacauuuugauuugguuuuucuccuuuacuguguuaauaugguagauuacauugauuagguuuuuaaaauaaauugcuaaauucuguuuacuaauaguuuaagaauuuuacauuuguauucuugaauuggccuauaauuuuccuuucuaguguuuuucuugugcaauauugacaucaagauuaucuaagcuucagagugaguguuaccucuuuucuauucccuauaagauauauugauuguuuagcacaaccuaauuccccaaauucaccacucccccaauuuguuauuguuguuuuauauaucaguguuuguuuaucuaccauauauuuacuacuauuuugauuuacccuuucuuccugaguuucagaucuuguauccugggucauuauuguuucaucuaaaguauaaccuuuagauuucuccuggugggaucuguugguaguaaacuuucuuggucuugaaaauagcuuuauuuuguccuuuuuuuuuuuuaauuaagcaauuagcuuugaggaaugccuucauuuuguuaggcugaaggagacaaagugguuagagaaguaggagaaccaggaaacuuuauuauuguagauaacaaaaaaaggagaauuucaaggacaggaagauaagcaguaaauggaaaaaacuccuguaggguaaagggaacauauaacagggauuguccuuauugauuacucuuucuugaaaggaaaaugacauuuaaaauguaacuauacuacuggagaguuugccuaugugucuagacuaugaaccacucagggaccagcucaggcuccacucaucuuugcaucugcaauaccuggcucuuuuaggcuagcauguggcaggugaucagagauuagugcucauagguaaugaguuauuauuauuuccaagugaggaagccuuuaaaagauugauaaauaaacagacacacuuggauuugcuuaaauucuacuccaucauuaacauucucaagaucaaccuuuuuaaaguugucaucaucagaauaagaggaaaagaucuuaagagguuaucagaugaauggauaaagaaaaugugguauauaugcaacuauaaaaaaugaugaguucauauccuuuguagggacauggaugaagcuggaaaccaucauucugagcaaacuauggcaaggacagaaaaccaaacaccgcauguucucacucauaggugggaauugaacaaugagaacacuuggacacaggguggggaacaucacacaccagggccuggcauggggugggggaaggggggagggauagcauuaggagauauaccuaauguaaaugacgaguuaaugggugcagcauaauaaaaaagaaaagaaagaaaaugugguauauauauacaguggaauacuauucagccuuuuaaaaagaaggaaagccuaucauuuguagcaauuugggugaacuuggaggacaugguaagugaaauaagugaaauaaaccaggcccagaaagacaaauaccacaugaucucacauaaauguuaauguuuuagauuuuuaacauugaacucacgcaaguagugaauagaaugucaguuaccaggggcuggaggggugaggguugaggcgggagauucaagagauaugagucaaaggaaacaaaauuucaaucagacaggaggaauaaguuccagagauacauuguacaacauggagacuauaguaaauacaauguauuacauacuugaaaauugcuaagaguguagauuuuaaguguucucaguacaaaaauaaguaugugaaguaaugcaugucaguuagcuugauuuugcuauuccacaguauauaaacaucauguuguauaccauaaauauaauuuuugucaauuaaauuaauuuuuuaaaaaguuaccaauuuuuguccuuauuacauaucuaaaaauaucaagacugcuuuggagaauaucagauuguaacuucacauuggagaccaaauuugguaaaccuauuuauuuuugaauguuucuuuucaguaaugacuuuuugcaaugccugaugaauguucuuguuuuuuucuuuuucuuuuuuuuuuuuuuacucaucucuuuaaguuguuuauaccuguucuucauauauccucauucugaaugguuagggaaaugugcagcucuaaagaaucuguuacuaggugcugggcgcuguggcucacgccuggaaucccagcacuuugggaggccaaggcggguggaucacaaggucagaaguucaagaccagccuggccaagauggugaaaccccaucucuacuaaaaauacaaaaauuagccggucgugguggugggugccuguaaucccagcaacucgggaggcugaggcagaggauugcuugaacccgggaggcggagguugcagugagccaagaucgugccacugaacuccagccugggcaacagagugagacuccaucucgaaaaaaaaaaagagucuguuacuagaauacugucauuucuaagaugugaauuuguuuuuagucauugucauuuggaaagcuugcaugagaggaguggucuguuuaccaaaucuacugugugcucuugauaguaguacucuaucauaugaauguuuuucauuacugaaaauuuacccucuaacaagaauuuugguuugauaagaucucuaggagauugaguagugcucacagaaauuccuaaaggauuuuuucuuccuguagccauuuugcaaggaauaggaggacaaaaauuugcuacauuucaaucaaaacuaguuuaagcugaacuuguagugacuauaaagauuuggcauauauguguagaauuuucuuugauauuagauacuaguacuuacuagcugggccaugauuugcagaagcuuuucuuuacccauuauacugcuauauauucacaacugacauaggacauucacagacuauuuuaaaguuuuucuacaaguacuuacucuauacccagaucauuggaggaagaaaacagauaaaaauguguaaggaaaaauaaaaggcaugagaaacacaauauacauuuaaucaaacuuccagaaggaaaaaaagagugauauuagaagaaauaaucauugacaguuacccagaauuuauaaaagauaucaaauccucagauuaaagaaccauaagaaaaucugagcaucauagggaaaaagaaauuaaucucaaugcuuauuuuagugaaaccaaaaaacaccaaggacagagaaaaucuaacaacccaaagagaaaugacacauccacaaagaaacaaaaaucagacugauacuugauuucucaucaguaacaguauugccaggaaacagugaaauaauuuucugaaagugcugagggaaauaacugcucacuuagaacauuuauucaaaagugaagguaaaacuuuuuaggcaugcaaagauugaccauugcuggaaaaaaaaaaacuacuugucuacuucacuaauaaguaaauaguacaccaaaggaagcagagggaugcaagaaguaaugaaaagcaaagaaauggguaggcaaauuaguaaauaaaaaaucuaacuguggauaguaagaaaaaacaaauaauaauaagaguagaagaaauggagguaaaguauuacaaggaacuuucagaaugaggauagagauacuaacugcagauuuuguuguuuucagugugaauacuuaaaauaaggguaaucauugaaagauagaaauaaaauguuugacuuccacaccaguggaggaaugaaaaggggaauggaggaaaaguccucuccaggaagaagcagaaaaggagaaaaaaagcagcuugguuaccagaaaacacagaggaagacagcagaaagaauuccaacuuuaucaauaguuacuauaaauauaaacugauuucugcauauuagauaucagauuagauuuuuaaagaucuuaacugcaugcagucuaaaagagacuaaccuaaaauaaauuaauguagaaagguugaaaauagauggaaaaagauauacaaaacaaauauuaaccaaaaguaauguuguuucagcaguacuuuagguaaaauguuacuuagggugaaagacauuaauacauauaaaaagggauacuauuugugauaaaaggaaccguaaaaggguauaacaccuaggaacuaacaacauaaaaaacuaccuaaccauauaaccuuaaaauacucaaagcaaaaagcacccagaaucauaaggggaacucaagaaaucuacaaacauguugaaugauuuuaacaacccucuuucagaaauagaacuagcaggcaagaaauauuuaagauuuagaagauuuuaacacuacaaugagcaaauuugauuauacauauauauguauguguguauguauaugaguauauagacucuccugcccaacuaguacagaauauauacuuuuugaauauauauuuguacuuucagagcuuuugcaaacauucaccacauacuaagucauaaagggggucucagaaaauuccaaagaagcuacaucauacagaccaugcccauacauuauuaagcaacuacaucagaagucacaauaauagguacuuaaaaacaugucauaugauaggaaacuagaauaacacaccucuaaauaauccauggauuaccaacuucucagcaaugguguaaauucuucugcuaaauaacccguggguuaaagaggacaucacauuggaaauuccagaguacuuaaaguuaaguguaucuucuaaaaaccuacagcaaaugugauguuuaauuggggaacuuuagaauaauuccuauaaagucaggaaaaagacaaugauuucugcuauuauuucaauaacucuacauuauauaggauaacuuaguuaugaacguggcaggaaaauaugagguauaaaguuugccaaucuugucauaggcuuaugauaacaacacaaaauccucuaaacugccuaaucuagcaaagaaauguaaggcuuuuaugggaagauuaaggguaacuucagcuuuaucuaugacauucuaguccuuuuauuaaaaaaaaaacugaagcgaauaacuuaauauuuguuaauuuuggguuacagcuacauaaauauuuguuaacauuauuuucuauucuauaauuuuuuaacuuuucaaaagggaaggaaauaaaacaguuuauuagugaaguucuggguccucaaugaacucaagaucuacuaggggauagacuuguacauggcuaaucauucaguaacaaagauuuagcauguacuuacuguguauugggcagaguuggagggagcagggugugacuuuucaaagucccugacuucauggagcuuauuagaggagacagcaucaguccgacuccucucaugccauccccuauuugaggagcuccucucaaaaugacugacucuuacuauuauccuauuaguuuugaugaaauuggguuuacauucucccauuugaccaaaaugagccaagggaaugauuguagauagugugcuuaugcgaagaccuugaggcagagucuguaauauacaggaauagaccaagguccauuauaucuaauuaaccuggauaacuggcuggugacugaugaggaccuggagaacaguuuugaaaguuuagcuuuguuuguucaaguguacuaaggaauccagcucuugaaggauaagaacugaagcagaaagcaccuccccuuuuuagaguagaccagagaucagcaaagucuuguuuuuguaugacccuugagccgagccuuuuaaaggguuguuacauacacacacauacacacacacacacacacaugcacgcacacacacgagagagagagagagagagagagagaaaucagcaacagagaauauaauaagaauauaauauggcccucagagucuuagauauuugccaucugggccuauacagaauaaguuugccagcuccugcaguagaacaacaguucucaaaguguggucccugaccagcagcaucagcaguauguaggaacugguuacaaauaccaauugucagaucccacccagaauuagacagucuagggguggggcccaguaauuucaguuuuaauaagccuuccuaaucauucugauaugugcugaaguugaagaaucacugcuauaaaccaauggcuuaaucccauuauaaaagauuaccugucucucagucucaccaguuucacaagaaaguggagauucagaauagguuguggccaacuagcagagaauaaucuugaaggaauauuuuguucuuuugucuugaucacacccauuacugacauuuaugcaguccagcuaauagaaauaguccauccaauacgaaugcucucuuaaugccccagaaggacuuucaguggaucuaugcucagagucauggagaaauaagagauccuaagauguuuuaaacuacuauaaugaucuagaguuauauguuugcugcuuuggaauauuaacuguucucuaguuuucguuauuagaauacuuuauauuuuuucaaccuuuaucugaaauuuaggcacauuuguaacaacaauguacuuccaagauuuuccuuacugguaaacuaauagguaaauuuaaauuuagucuucuuuucauaguuagcauucuaucguauguugauggaaagucauuuguauaguguuuaaguuuuucaguguucuugaucuuucugagacuguagguagacagaccucauuuucauuuuacagagaagaauagaaagccuagagugacuugcuuagcuucacuauacauaguggcaugggucuuccaaguccaucauucuacucuauauccugaauguggccagaaauuuucucacauuguuagccuuaaaacacaguuucagaccuguugguaacaucacuggccaacaaaugcaagagaaaaaaagaaaaguuaauaauaaaguuugcuauuuuacaaguaagagcuauaguuucuuuaucuuacaauuuuuaaaaaauuuuauuuuuuuauuuaaaaaauugugugugagagagaaacagugagugagagagaacacacauaugcauguguauggagagacaugaaaagcugagacaggucaucuuuaccuuggaauauuuaauacuguguguuccuagagacauaucaccauugucauguaucuuuaguucuuucucucccaaauaauggacuuuacaauuuguuuggugguaauacacuuguauaaauagaagaacaauuuacagagcaaaauucauauuagaacaaauaaauaguagaaagggccaaugaaccauagggugcugauaguucauuaagaagguuucuucaugaaggauuggcugaaauuagcuauuuuaaagaaauacagagaugaggcuuaaaaauccaccacuuggaauuacuguuguuuuugaugugguuuucacugguauuaugagacaagcuaucauuuguguaugaggacaaguauugggagaauauauacacacacacgcacacacacacacacacacacacacacacacacacacacacaccuuuuuauaaaacugaacccuucugauaugguuuggcucucuccccacccaaaucucaucuugaauuauaacucccacaauucccauguguugugggagaaaccuggugggaggugauugaauuaugggggcaggucuuuccugcgcuguucucaugauagugaaugagucucacgagaucuggucguuuuaaaaaugggaguuucccugcacaaccucucucuuugcuugccaccauccauguaagacaugacuugcuccuccuugccuucugccaugguugugaggccucccuagccauguggaacuguaaguccauuaaaccucuuuuucuuuccagucucagguaugucuuuaucagcagcuauuaugaaaacagacuaacacaguaaauauauauaucuauccuauuaguucugucccucuauagaacccugaauaauacaccuucuuacccucaucucuacauuuuaauuguugauagguaaaguuuuucaaaaaaauguccuagggguguguguguguguguguguguuugugugcaugcauguguguuuuuauaucuuuagauaaucuuuuggguguacaucuuuagcaucuuucuguaacaucuugucuuaguccguucugugaugcuguaacaaaauaccugaaauuucaucagucuuaguccguuugucuugcuauaaaggaauaccugaggcugagugauuuauaaagaacagaacaggguaauuuaugaagaacagaaauuuauuuucucaguuuuggaggcugggaagucuccgaucaaggugccaguacuuggugucuaguaagggccuucuugcuguguccuccugugacagcaaguggaagggcaagaggaggacacugccgcaugaagccucuuuuauaagggccauaaugccauucaugagggaggaacccuuauggccuaaucaccucuuaaaggcccuacucuuaauccugucacauuggcaacaccugaauuuaggagaggcuugcuucaaaccauagcacaucugaacuuacccaaggacugguuuucugaaauuuccaaucgcuugagggcucaguugucugagggcugugugugaaagcaacaaauuguguugauaaaagcacaauuauuuaucacccuuggccuugugcuuccaggcuauguuuuucuuaccuucaaugcucaguuuauucuguuucuuucucugccucuuuuaucuuuaccucccucaccuuucuuuccucugugucucauucuaucugucucucccccucucuucccccucaacccucuccucugucccauuguccucugucgucuucugccucuacuuuucuccugccucucucccccaacccccaugugccuagcugucaaaucuuugucuucucuuuucuuuccccuacucugauuucauuucuauuugucuagggguaaauggucaacaacuagcauguuauauguaagaacauuaauaaaaaucauuuuaauauaaauggggcuuucuaauuucaaagaucaacauugcugaaagcuaucaaagagccgugggcuuuaaauuucuuaguaauggacauucauuuguuuaugguauucccuagugaugguacuagcaguggugguaaaaaugacaacaacaacaauaguguuuuauucuucuuaauauggcuaauauuuacugaguuuuuaccacuugccauauauuguucuaaguaauugguuuuuagaauauaucuggggauccuaggagaugcccaagacuuucagaaagcuaugaggucaaaacuauuuucauaauaaugcuaagauaucauuugccuuuuucacuuucuuuacauuugcacugauuacacagaagcaaugauguguaaucaguacuggcugcuucgcccaaaucaaggcagguagucauuguaguccucauugucagcacucuuaguuuaaaaaaaaaaagacaauuuuauuuuagaaagucccugaugaaacaguaaauuguauuaaguuuugacccuugaguacauguccuuucaauguucugugugacaaaaucgggaagugugcauaaaacacuucugcaugcuaaguauguuugaguugccagcugaauuagucaccuguuucauaggccacccuuuuuacuugaaaaaaauuguaaaaaauguguuuugaauacugaugaauuuucaaauagcagagcuaaacaacaaucucuaagauuaccuaccacagaaccacucauuuuauagauuagaaaaauacaacccagcuauuaaaagccauauccaaagcagcacucuuacaaaugcaugauuuauggccucuucuuauauuuuauagugcuuuaaauuuccacuaaauuuagugcuuuaaauauauaaaauuagugcuuuaaauauauacuuuuucauccgauccucacacagcauugugaguauauaaaacagcuuaaagauaaggaaauugagacucaaagaagacaauucucugaaugcagucuauauuuuccuggccuuucagcuauuaucucugaggaccugaaauaaggcagugcaaaucaagaagagauaggauccauaaaaccuggcaacuaacuagaugcagaagaaaaggaaaugaaggagccagggaauuuccugaaguuguuuugcuuuguuuuguuuucuuuuguuuuuuguaugaaccuuaggaggguaugacaacugagaaaaaaaugagaaggaauagauuccaucaacagauguuuauggaaggccuuuucauuggcacuacuguaaucugcuuuggaggaugcucagauguauagacuaucugucucuacugucuauuugggaaauaugucuuccgugcuaguaacuguauuucaagguaaaagugguaagcaccuuaagaaaagcuuaguucaaguuccauaaaaguaauugcuuuugcaccaaccuaauacuucuggacucagggaaaauuuuauggaauagggagcauuugaaaggagacuugcagaaugguagcauuuggaugugcagagacaaggaagguucaguuacagaauaauaaagcagggcaaggaaggaggaaugucugcuauacaaguuagugggaauauagugugugugugagcaacugaugagaaauuauuguuauuagaaauaauuauuccaagaaauuauugaaaauguguuggccagagucugaaaauaguaaauaccguaauauggcauacaugaucaguuuuccaucgguacuuaguuaauuuuuuuuuuacuguuuuuuauuguuguuguuuuuucuuuuuuugucuuuauuuuuauauuuaauuuauuuauuuauuuuuuuuuuuagacagagucucacucugucaccaggcuggagugcaguggcacaaucucagcucacugcaaccuccaccucccggguucaagcgauucucuugccucagccacccugguagcugagacuacagggugcgccaccacgcccagcuaauuuuuguauuuuuaguagagacgggguuucuccauguugcccaggcuggucucaaauuccugaccucaggugauccgccugccucagccucccaaagugcugggauuacaggcaugagccaccacaccuggccuacuuaauuuuuuuuuaaugacacuugccaaacaaaugucuuuuuaaagcacaacuuaguuauuucuuuacauaugaaauuucuucauuuuucauugacuuaagaauuucaaguucagauaacauaauuaaucuucccagauguugguguauaguuuuagagagggcuauaccaaauacuuuacucugguguaauuuuuaacaucuguaguggcuuacuuaaaccugcagucuuuagauaacgcauucuccucacacuugggaauuccaucagucuuaguccauuuguguugcuauaaaggaauaccugaggcugagugauuuauaaagaaaagagguuuauuuggcccaugguucugcaggcuauacaagaaguauggugucaauaucugcuucugaucaggaccucaggaagauuccacucaugacguaagaugaaggaaagcaggcaucacauggugagagagaaaaggcaagagagaaaggaggaggugccaggcucuuuucaacaaucaguucgugcgggaacuaagagcaagaauucagucguugucaugagaaugauaccaaacuacucuugaggaguccuccccaugacccaaacaccucccaccagaccccaccuccaacacugggcaucagauuucaacaagagacuugggggaaccaagcaaaccauauccaaacaauagcaccaucaaucuuuuaaauggcgcuuuuaucugaacuacaucccugagucuauccucaaauagcuuaacuuugucuuggaagucuuucuucuccuuugccauuagugguuauuuuucacugcagaauuaaucugacuuggauguuuauuacuguuuuuucccuagauaagucagauaaauaugaugcacgugauguugaaaggcuacaacaagaugauaacuggguugaaaguuacuuaucuuggagacauaauauuguagaugaaacacugaagaugcucgaugagaguuuucaguggaggaaagaaauuucugucaaugguaagcuguucaauuuaaccuugacuguaauauauacuguauaaaugguauuguuuuacauuuaucuaaucauguauuugcacauauuccuagcagucaucauaaacaccagaauauaauuauuuauaaagacccaguaauauuuucaaaggaacagcuuauaagucuuuuaagugggaucauucauaaggaaaucagaucaccagagagcagaaucacacucagauucuucauucacagcagaguuuccuaaucuguguuuaauucaguaccauuaagcaauagcaagacaguaucuuugcuacuaggccuagaaauaaggagauacuguccauuuuucucaguuguugccuaugccuuucucuguccccacaguuccuugugcuaauagguuaauagguacgccauauagaauuguuaaaugaaugagagucaccccaaaaaugcaagcuuauccccaaggaagccuaucacagucuucucuguauauuguuuuuauuuuuguggguacauaguagauguacauauuuugggguacaugcagccuuaacuucuuaauuucuaagucugcuacuagauagaauuuuuuuccaaaaaugagaguuucaagucuuggaguuuuauaauggucuucaaguauaugaagaccuguuaguucucuccaccaaaaaauugaacaagaagaaacuggcauaacuucuguuuucaguuaggcauaaagcagaauuuucuguccuugaggauuauaaccucugaagugacuucaaucugaagacuuaacacaaaauagucaacaauaaauccagagcagauacucuccucacucuucaugcuugcagaaggaaucccugaaagggggauuaguaaaaaauaaugugauuggaaauuuaacaaauguagguaauuucaacagugaagcauuuauuaaccaaagaaagaaauauaaaucugauauuuuuaaacgauuuaaguacugaauaaauauuuaaacucaacaauguuuguuuucuuacacagaauugcuauuuccuggugaaaaauagcagagauaugguaaaaggggauggggaaagauaaaucuuugaaaggucuuaagguacugcuggugaaugaaacaaaaacauuggcauuugcugccuugcuauguugguccuuagccuccccaaaaacuggagaggcacucuguuuguuccuccugcugaaguucaaguucucacauuuuuuguuuucuuuucuuaucuucucuuuucuuucuuucuuuauuuuauuuugaggcagggucuugcucugucacccaggcuggaaugcaguguugugaucauagcucacugcagccuucaaugccugggcucaggugagccucccaccucagccuccugaguagcugggacgacaggcaugugcucccaugccuggcuaauauuuauuuauugauugauuuuuuuuuuuuuuuuuuugagauggaaucuggcucugucacccaggcuggagugcauggcgugaucucggcucacuacaagcucagccuccugagugcacgccauucuccugccucaaccucccaaguagcugggacuacaggcgcccaccaccaagccuggcuaauuuuuuauauuuuuagcagagacaggguuucacuguguuagccaggauggucucgaucuccugaccucgugaucugcccuccucagccucccaaaguucugggguuacaggcgugagccaccacacccagccuaauuuuuauauuuuuaucuuuguagagagguugucucacuguguugcccaggcuggucucgaacuccuggccucaaaugauacucccguguuggccucccaaagugcugggauuacaugagucaccaugccuggccauuuuucuugaaguauuuuccacuuuccuaaagguuuuuaaaugcauuaaagucuacuagauaacaaacuuaauauuagauuggugcaaaaguaauugcagcauuugccauuauguuuaacugcaaauaccacaguuacuuuugcaugaaccuaauagaaaaauaccauuuuacuaaagaaaccaaagugauuuuuuucuacuaauucugaggcugcaauguggauauuuacuagaauguucucuugaaacucugacagugauauuuguuugcaagucauuaugugaaacaaucaaaauguggaaauguauccacauaaauaaugaccugucaagggaaauggaguuuguccauuuugguccccugugucauuauuuaguuuguuugcuugguaggaagcaccacuuuauauugccagagauuuuuuuuugaauguuuggguacauuauaucauuuuuaaagcucagaacuacuacauaacauuaucuuuacauuaugaguuuuauuuuuaaaccccuaaauuacaacuacugaucaaagcuuaccacuuuuuagaccuuaaugaauccuccauucccagaugguuauuggaaauugguguuauuuaucuccaugguuaugacaaagaagguaacaaauuguguaaguauauuuaauuuauguucuggcuuuucaagauuuugagauugagauaucuaugucaacugaauuaagaauuggcagaacuuucuccaucuguagcacuccucaggucuucugcaaugagggauuggcaggaccauuuuuacagaguguuagauacuuaguagcugugcauacuguuugcauuauaauaaaguaggcaauaaaggcaaaaaauaaaugcugcauccuacagcauaaacaaaguuauuuaauucagagucauuaucuucuuucuaaucugacugugauauuaaaacucgucuuaguauuuuuauggagaauuuuuuugacagucgcuaaagguugcuaaauaggccuuuuccuuuucgagucucccauaaucucacucuagcuuuuucugaaauguguauuauaaugaaaggaacaguaacaaucaucucuuuuguuccaaugacuccccuguuauaccucucucccacuugccccaaauccagccugguuuuauaccagggaugcaacuuggcaggcauguucaagccccauacugaacagauguccugcacucaucuucacuccuccauagcaugugguccgucucugagcaauacucuuuuugcauuuuccucuuacugccaccuccuccuuuucaaccuuuuuuuucucauuuuucuucuuccaccugucccuuaaagguguuucccaggcuuuauuccuuucuugcuucuuuuacuuuacagcugauacagucuccuugggugaucaaucacgagcaucuuggcagcuuuagcuaccucccccggcacaguauugaccccacaccauccccaggccacaugcacauaccuagcuacccacugacugcccccuccugacugucagcagccuuuagcacaacacacuacugaacauccaugccuguccacuugcucacuuucuguauugcccaccucaggcccacucauuggcucuuccucuaauauagcuucaauuuggccuuuuauccauccucaccagcuacuuccucaauucaguuucuaacuacuacaccuuugccccagucccuucccaggucauaaccugguggguuuccuucucugccuccuccagucugcccucugugcuauugcccgaaagguguucuaaaauaggaaaaugaaagugcccuagaguuucauucacaguccuucaaguccaguucuuucuuauuuagcuucuccucucaccacucaucacauuucaucuuagcuaccaccaccugaacaguuuaccgugcuccacacacacgcacggcacuggcucaugccuccaucgcccugugucaguaucuuuccucuggacggaacauuuuuuccagugcucgacaaaagcaaugacuuucuuuuuuguuaagcacaaugcagagcacauuuagauuauuaucaaauaguguuuguucaccuguauuuucuuuucccucuuacaagugaaauuuguuuauuuccuaagggaaacagucuaucucucugcuacucuucaauuuaaggcacccaagugcaacaguuucucauugaaaauaagaaagagauguuuuugaucuaagaaauaaaaugaauuguaaaugaaaaaugucaagggaaaggcaauauauauguauaauaauauuauaaugccauaagucuuguucuuauuuuuaucuucugcuuaaagucuggaucagggugaaguaucauguaaaagaccagaaaaccauauuggacaaaaagaagcucauagcauucugguuggaacguuaugcuaagagggaaaaugggaaaccuguaacagugauguuugaccugucagaaacuggaauaaauagcauuguaagcauuuuuucauucauuccaaaucaguguuuaucauggcuuccucccuuucuccuguccuugcugccaaccacauauugcuguaaaauugagguaacuaacuuauauuagggauuuauuuuuucaccuugcagugugaguguagucaaacauggaauaggguuugcagagaauuaaauuuguuucuguauuuggcguugaaacugucgauuuccuagaaauguuccuugucugagacacaggauggagagguagcaugucgaggcuggcaagguaugaaucgaugugauaacugugaacuuugauaucaaagcuaauauccuauagcaccugccccggugugugccacauaguaauauauucaggaaauaucaaguaagguaauauaccaucucgaauuuguuauauucauaccauguuuuacaguugcaagauguucacaugaguuuugcacauauaacacuuugugauuuuauugaguguuuuuguuugcuuguuuggauuuguuuucuaucuguuugauuugguuagcuuuggaaaccaguuuucuucaggugauuuugccaagcuugaaaaauaaguaaaaccuaccugucuuuaauuuggguccuugugaccuuagugauaccuacaaacccuucagcagcaauugagaucacuuggcacauuuauucuaacuacugucucuuauauuuaaucuguggcuaauucugauagcaguaaugucguauucacaaacgugcucagggcaguguugaaaucuuuuuggaauuccauuuggcaaauuauguuaagaaccuuaaaguguuuguauuuauauucuuugccugguaaccaacuucuggaaaucuauucuaaagaaauaauccugaguacagaaaaagcaucauacaucaaaauauuuucccagugucauuuaaaguaaugaaaaauuagaaaaaaauauaaauguucaacaugaugaaauggcaaauuaugguauaucuaguuaguugauggaguauacauauagcuauguaaaaugguguuuuuaaggaauuuauaguaauauuggagagaacacuuuuuucugagaugaaaaaagcuguaugauuauacauacuauaauauguauguauucuauaccauggugauacauagcccaacaaaggaaacuguagacauaacacaaaaccagcuagagagaacugcuaacaagagcuuucuugcagugguaggaccacaaauuuuuuucauguuucuauuucucuuuuuauuuuucaaggauccgaugcccuggaguuuuccaaccuaguuuccaugucagugguuuuaaauuagagaaaguaaauuauuuuauauccaaaaucaaaaucaauuugccuagauaaauaaauauuccauaaaaauaaauccugauucuuuuguccuuuggauaugauaguuuccuaauuauuaacccagaaucaugaagaauaaauguuaauauuuuuguugccaaguauaaggacagagaauugacuugaacuguuuuauuuuuucaagcuacuuauaucucaccaucuuuaauuuguaaauaagguguauuugcacuacuaaguauuuaagucauuauuguuuuaaaauacuugaaucuuacugaauaauuuauuuucauaaaugacccuuucaugagucacaaagaauuuaagugagcuuauaaacaugucacaaagaauuuaggugagcuuauaaauuucaaggcaaaaaauaagaaaaucauuuguuagaguugggacaccaguuuggcucuaagcuuucagcugccugccugaaagaaaugcaaucauuuaaaauuauucagcggccauccuucacaaccagugucuuagaaguauauccauuccuaauacuugaacuagaaagucuuucauggguccucaaaaggacguuuuacaagauaauaacagccuccucgaaaacauccuuauagaaugcugagcaauaggguugauggagcuauuucuuguaguccccauuaauagaauacaccagugacaucuuaucauauccacuugaauuagcaguaacucacgauuuuacgaagaaggauauucaauuaaauaaaugauagaaacaagaauguuauuccaagacuauuuagacaaagucucugggggccauaaauucuagacuagguaaccacauuuuuauauaacugguucuuuucagcuauuuucuuugacuguuacuuaacugccaauuaugaaaacuccaugcacaguggcuauaaugauuaguuacaaagguauuauuauauauauauauacacacaaagguauuuuauauauauauauuauauacauacacacacacacacacacacacacacacacacacacacacaaagguauuauuauauauauacccauaacaaauacuuaagauaguuaaggaugcuuacuuuuaguuuacugcaauuaaagaugcugcaacuaacauuccagggaugaauuuauagacacuuaucucuaggaaaacccaccuuuccaguaauugugauggauuucaguuugcuugguuguaucuuucaucccacagucuuuauaagauggccaaucagaauuagugaaucaguauguggccauggagugaaaugacucauggaaauaaccuuaaugaccuaauuuccuguugcugugcucaaagcaguagaaccaaccagauagcuauguuuguagucucccagaaaucagaaucagugaacaacacuggaauauaaacuaaaaaacuaauucuaggucucuaaauaaaauuuaaaaagccagaaauggaguagauacagcaggccaaugugauuagauuaaguauuguguuuaaaaaagguugauaaaauauauuuuauugacacuauuaugugguguaaaaauuaggauuaaaaagcaaauauaugagaauuuacauacauguguauuauuaucccaaguagucugauuauaaacuguauacuuguuucaauaauucuuuaguuauucaacagauuuuuagaauuucucuauggagauugcuuuuagauccauuuuaugcccuguugccuuaguagccugaaguguguaacuaguuugagguaaugugaauaauuuuaaaacaucacuaagcaucugguuucuucaagucaguuuuagggcugauuauuauaaauagcuuaaugaccuaaaaccuuaauccuugagaauauagauauuuacauaugagcuuacuuuuuaaagaauuuaauaauugucucacuuguauuuaauaauuuaucaccuuuagaaaugugcaauuuuaaguucucuaauguggacagucuuaaagauuuaaucuuuauuuuaggacauggacuuuguacgcuuuaucaucaacugcuuuaagguuuauuacccuaaauaccucuguaaguaacuuacuccuuuauaaaaaauauaacauauugaaacuguagacaaugucugagaauuguggagccuuauguuauuauagacuuucauaccugaaacuuuguuuucugaugaagaauuuuaaauguguucauagacauuauuguaacacauacagaggaaaguuuuucauaaguauucauuguccuucacaguuaauuuuaagaguuuaaguucuaaacuauauauauggcauccuauaacacacacacccacucacacacauagguacauaaaagcauacauuuauuucaaaauuaucucauuuuuacuaauauuucaauuuagaaauucauuucaaauaguauuuauuauaugaaacuucuugcauacaagaacagauaagcaguauugauagaguacacuguauaauaagcaauauugauauauaaaguacacuguuaccaacugcuacuuaaaaauugucauuaagaaaauacuugacuagaagguacuacauuugaaucuggcauuuggaguuuguuuguuuuuuauugugacuauuccauuaauuaccugaaugaagaacuccuaaaccuuauauaguccauuuuuuacuuguugaauuuguaugauggguucacccuagggaagccgagaugccaacucacauaaacagucaaguauauuuaaccccaaugguuuaaaagugaaaagacagcagagaggcaacagggaugucagaaaaugggaauuuacagaucugccugagcguacuccuagaaaacagcaaauugggucuuuugggacucgugacucaggugacuuuagcauaaaaucccuaaauuaucuuaauuuggcauguuaauuuuauuguuaaugugaagugaggaauagacaaaaagcauaauggauaucaagagucagugccaccccuagcuguauacucucaucuuuucagagagaguauucaugaauauuuuuagguaaaaagaaugaucaauaguguccaguuuggggaaccuguacuaucuucuguuccuuauggauuuuuccuguaucuggcauguacccugauuccuuaaggccuccagagcagugccagucauuggucaguagggaaucacuaccccauaguuuuaguuuguugcucuuauggacaaaaugaaaaaauauccacuugaucauugaaauaucuaaaggaguuugugaagagccacuuaucaguaguauaaauauuauuauuacuuuguaaaauacaucugagauucuuuugagagaacuauuaaaaaguuaauagaucuauauaaagaugaguuguaauacuauucaucuuaacuagagauuuuauauauauauauauacacacacacauauauauauauucuaccuacauaauauaguuuugcagacauugaauuucguggaaucuuaauugauuaugcuucaaaaucugucaugaagaauaacuauuauaucuuaaaaucuugaguccacauuauuuuaagcauaucccagacgaagacugagguauuaagcaccagggugccucuuuacagaugccuuuuuccuuauauguacuuuacuuguccuacauuaaugcaacaacucuaagagguucucugcucagagaagagugaaauuacauuuugauuccucuggaauagaggaaugaauugaaucucaaaaaucuucuuugcaguuucugguucuuucucacaguugucucaguuguuaauagggcuguuuaguaucuucaacucaguguguaaauaauacuuaugcauacuuuggaauuauuagcuuccuggagcucaugauauaaaguagaaauaauuuuuguuucugaaaacguagugauguauuaaaaggggagggggcaacugugagacugguuuaacaauagaaucucuagaaaauuguaauugaaaccauaaauuagaccuggaaaugauuuuaaaguucaguggcuucagcacuacuuugacaugccacauccaaaaacuccauuuauccacuuaacuguuuucuuuuguaccucccugcaaacaacaaaagcagugagugacaaaagaauaggcuguuuaccagaggacagugacagugcacuauugauuucccacaagucuuccuccugggcuggcaccucaccauugugacaugcuaguucaguuccagcaccacauggaauacuauucaugauacuauacacuucacugaauuagagcucagacaacaagcucaguuuuuacuuaaauuuagaugaccaguuuuuucuaggcugguaugagugauauuauuauagagguacugauucacauucaaugaauuuuuuuucaucuuucagcaaaaauagugaucuuugauaugccuugguuaaugaauggugaguauauuuauacuuucuuaaaacaaaaugucuaauuuccuuuacuuugccgauuuagccauauuucuacaauuguuuaaaauaauguuuauauuguccuuugcaugcucucuuaagagacuggagcuagaacacucaaaggcuauuccuaagcaaacagggcuaaaauuuuauacccaggaucugggggcacccauuagucuucuuuaaaaacagccuugccaggcaugguguugcacggcuauaguccuagcuacucaggaggcugaggcaggaggaucacuugaacccaugaguuugaggccagccugggcaacauaaugauacccaucucuuaaaaaaaaaaaaaaauuaacaacagccucaaauauucaaccauuaagguaauacucuagucagaagccucaauuugucaugcacagauaagguaugucacagaacacaggccuugucuagguuucucaugggcuucagguguugagaaagaagguggaaucagucugaaacucaccccaaaucacuguagugacaugacccuuuugacagucaugauauauuuuuugguaaaauuuuuuugaaaaagccauugauugauaaacugucuugaccaacuuuaaaauuacuguaaauugaauguuauuuucagaauguacauucucauuuguguuugcaaaagucaguuguuacauagaaagcaauagagaaaaucaacaaauccaaaauuugguucuuuggaaaaugcaacacaauugacaaaccuuuagcuaauaaagaagaaaaggaaagacucaaaguauuaaaaucuguaaugaaagaagggacauuacuauugaccuuaaagaaauaaaaaggacuauagggagauacugugaaugauuauaugcaaagaaauuagauaaccuacaugaagugaacaaauucuuagaaagacacaaacuacugaaacuaauucaagaagaaucagaauagaaauauaaaaaaggaaguugaauuaguaaucaaaaaaaacuucccacgaagaaaagcccaggcccagauggcuucacugguaaauuaugugaaauauuuaaagaagaaucaacaugaauccuucacaaauucuuccaagaaauagaagaagagggaauacuuuccaacuuauuuuaugaggcaaguauaaccauaauaccaaacaucacaggaaaagaaaacuacagacugguauuccuuaugaaaauagaugcaacagcccucaacgaaguacuagcaaauugaauccagcagcauauaaaaaggauuauacaccaugaccaagugggcucaacauaugaaaaucaacuaauguaaucuaccauauuaauauaaugaaggggaaaauuaugugaucaucucaagagacacagaaaaagcauuugacaaaaucuaguacccucucaugauaaaaguacucaacaaacuagcaacguaaggugcaaagaguugaaacaacuaccaaguuagaccacaguaguccacacaagaccacccccauuucugacacaaacugcaaguucaggaggugcucaaaauugcccuuagguuugauaagucuagugaaggacucugagaacucacugaaaacuauuauacucacaauuaugguuuauuacagggaaagaauuuagauuaaggucaaccacagaaaguaagguguagggcagaguccaaggaaguaccaaauguugagcauauuacuucacuggcaucaauguguggcaaugugcauggaguuagucaaccugggaagcucacccaagccucaguguucagaguuuuuauuggaacuccauuauguaagcaugauugauugcccaugugguugaucuuagucuucagucucccccaaggucuacugauacuguguaacccaaacgccuacccugaaucacacuguuggucuuucuucuauggccaguuccuacccuaagucauauugucccauugucacuuaaggcccccagacaaacaaagacaauccuaucaggcaugaagauuaccucucagaagcugagggcaaagugcagaucucucuuuggguaaggcuaauccuucacagaaaagaacuuccuccaccuguuuauaaagggcauauaugaaaaaccugaaucuaugaaaacccacagcuaacaucuuacuuagcagggaaagaauggaugcuuccccccuaagaucaguaacaagacaacacugucucucuuaccacuucuauuaauaaaagaaguucaagacaaggacacggaaaauuacaaaaccccauuuuaguaaauucaagccuuacauaaaugaaaagacauguuguucauggauuggaagacuuaauacagucuuucuucaguauccaugggggacugguuccagaaccccucccccaccaccaccacagacuccaaaauccuuggaugcucaagucccucauauaaaaucguauaguauuugcauguaacugacacacgucuuccuguauaccuuuuuuuuuguuuguuuuuugagaugagucucauucugucaccuaggcuggaguacauuaucacaaucucagcucacugcauccucugccucccagguucaaacgauucuccugccucagccucccaaguagcugggacuauaggcaccuaccaccacaccuggcuaauuuuuauauuuuuaguagacacaagguuucaccacauuugccaggcuggucuagucuugaaccucaagugcucugccugccccgcccucccaaagugcuaggauuacaggcauaagucaucauaccuggccccuccuauauacuuuaaaucaucuuuagauuauuuauaauaccuaacacagugugagugcuauauaguuguucuacucuauuguuucuuauuuauauuuuugucguauugguuuuauuuauuuuuuaauauuuucaauugugguuggugaaucaaaaauccauggaugugaaaccuguggauauggagggccgacuguauuguuaagaggucaacacuucccaaauugaucuacugauucagugcagucccuaucaaaagcccagcugccuuuuuugcagaaauggauauguuugucccaaaauucauaugaaaaugcaagaaaccaagaguagucaaaucuugaaauagaaacacagaguuggaggacuuaacacuuccugauuucaaaauuuacuacaaagcuacagcaaucaagacauugggcauguaugggcauaaggauaaacguauagaucagugaaaucgaauugaggguccagauauaaacccuaauguuuauuauggucaguugauuuuuuuuuacaauggugccaagacuauucaguagagaaauaaggcuuuuuaaauaaaaggugcuaggacaacuggguauccacauucaaaggaaugaaguuggaccccaccuuacaucauauauaaaaauuaauucaaaaugaaucagaaaccuaaauguaagagcuaaaucucuuagaagaaacacaggauuaaauccuugugcuuggauugggcaaugguuucuuagauaugacaacaaaagcacaagcaacaaaauaaacagauaacauuggacugcauuaaaauugaaaacuugugccuucaaggacacuaccaaguaggugaaaagacaauucucagaauggaagaaaucauuuacaaaccauacauuuuauaagggacuuauucuagaauauauaaagaacucuuacaaugcaauguuaaaaagacaaguggcugggcauggugacucacgccuguaauccuagcacuuugggaggccgaggugggcagaucaccugaggucagaaguuggagaccaaccuggcuaacaugguaaaaccccaucuugacuaaaaauagaaaauuagccaagcaugguggcacacgccuguaaucccagcuacuugggaagcugaggcaggagaaucgcuugaacccaggaggcagagguugcagugagccaagauugcgccauugcucuccaaccugggcaacaagagugaaacucugucucaaaaaaaaacaaguaacccaauuaaacgagugaaauauuugaauagauguuuuucuaaagaagauaaacaaaugggcaauaagcacauaaagagaugcugagcaucaguagucauuagagaaaugcaagucaaaaccaagugaggugugauuucacaccuacuaggguggcuagaauaaaaaagacauaauaacagguauuggcaaggauauggagacauuggaagccucauacacugcuggugagaauguuaagauggucuggccacaucagaaaacaguucgguagcuaaacauagaauuaccauaugacccaaaauuccacuccuuaguauaugcccaagagaagugacaacguaugucuacagaaaaacuuguacacaaauguucauggcagcauuauucauaauaacaaaaaguggaaacagccuaaauauucaucaguugcugaauggaaaagcaaauauugcauaucuauaaaauggacaauuauucagucauaaaagggaauuaaguacugauacaugcuacauuaugaaugaaacuugaaaaugugccaagugaacaaagccaguagaaaaagccauguuguaugguuucauuuauauaaaauguccaaaauaagcaaauccaugaagacagaaaauagauuaguaguugcuaaggacuuggagaaggaggccuaaagagagauugcuauaugaagguucuuuuuggugugaugaaaauguucuagauuagauuguggugguggugauggugguugcacaauucugugaauauacuaacaaccauugacuuguauaaaggggggauuuuauggcauguaaauuauaucucaauaaaguuaugaaaaaucagauuuaucagauuaaaguagcauaguuucaaacaugucaacucacauuuuaaauugaaauuaaugaaaauuuaaauguuauguaaaaaacuuauaguuagcuaaaauaaaaagauacuucuccgaaccauuuaauguuuaucauacuguucuuaguuucuguuuuuuuaauugacaguuuugcaaauuuaaugcaguauuucucuuuuaauuucuuaaaaauguacuuagauugucacagugaaaaugagguuuaaaaauuaagcauaaauaagaaaugacaugacagaacaagauuguaauuaccaaacagcuguguuugauaacagaacagggcaguucgugccacugcacuccagccugggugacagagugagacucugucucaaaaaaaauuuaaaaaccaguuuauuuuugagauuucguaaguuucccacaauuauauaaacugcaaggccugggagagaggcagagaaguguaggguuagaaaggaaggcuggauccagcucacacucauaauaagaagggcuauuucuuucuuucuuuucugacucgcuguuugagaagguuuuucagauagagaguuuaucagaaccauaagguaaaugacucuuuccauacuauugugcaguuauuuccugaaucauauugcuguuugauucagugucuggaaaucuaaauaguugggaucauugauggauuuguucagaggccaaaacccugauaaguuuauuaaugaacaucaggguaauuuaaucuuccugaaucuucauggaacauuugaaacccauaagggagagccacaauguaaacgccuacagaaauuagagaauguuaauuaaguacaucacguaaagauaaauauuaacagauuauagcccaaacugauuucagaagaccuggguuagcauuuaugguaaauuaauugagacuaggaaugaugagaauuuuaaugaagugacugguuuuucuucagcugcuuucaaaauugugaaaaccuggcuugguccagaagcagugagcuuguugaaguuuacaagcaaaaaugaaguccaggacuaugucaguguagaauaccugccuccccacauggguggaacuguaaguauuugaaacuuguuuauaaaacaauacuggauaauggcacauuaggcuguauacuuuccucaagggaaaaagaaaaguaguaccauaauaugcaaagaaauaucacagauacccccaaaauagcaaguaguguuacacacauuuuuaaaguuuuaaaguuaauuuuuuauuuuuuaauagguaauauauuuaugugguucuaaacugaagaguauucagaagaauaaugagaaauaagucuucaguaaaaauaucaccuccuacuucuguuuccaaccaccauauucccuccccagcugaauuucuuguauuaauuugcagggauauguauuacccauauaaacaaguauaguauauaauuuuuccucccucucaucucuucuaaagucaguguauuuaugugcuagugugcauccugcuuuucucuucacaguacgucuuauuccaaaucaauauguagcaggcucucauacucauuuauggcugcauaguauucuacuaucuagacauaaguuagugaauuuccucuugaugugucuuuagugugcuuccaauuguuugcuguucaacagucuuuuuaguuaaaaagauacuauuaagcauauacuauccagauuuuuuugagcugauuuuuacuacuuauaaaaaaacuguacaacuuauggacuugguacgcuuuggguuaacuucauaauguuucacuuauuugauuuuuuugcaaucuauuuuuuauacugccugccuggcaaaauuguauucaaucagaauuagcaagaggaauaguuucgauauguccuucuguuuauugucuuugauuagaaaagaccugaacaaauauuuuuaauuugaagucugcuucuuucuuauucuaaggcuuuauauuucacauuuucaccuagaaaaaccaaauauacuucauuucaggugcuaugcuugauuuaaaaugugauuuuauuuauuuuuaauaauuugcucauaaaauuguuauaucuuaaauaauuauaauuaauauaauucauaacauuuuaaauaauguuaauuuuauguauagaaacgguuauuuuauuuccccucucuguccuuagugauauguuucuucagaauuacagucaaaauuauaguaggacuacuauuuuuuaacauuaauuuuuaaguauuuuuuuucaaaaaauaauacauauacaugauuuuuuaauaaaguaaauacaauaccagagauugaaaaguauaacaguaccaugaaaacuacaucugccuucccagguccaugcccacugccacucccuaaaggcagucaccaucaaguuuucuaucccucuggaguuaucuauuacaguuuuuuacacaauggucacauaccauauauauuguccauuuguacuuuuuucacaucuuuuauuuugcagguuacaccauauugauucacagaggucuaucucauuuuuaaaccaaaauauuccacuguauggacggguauaacauaauugauuuaaucacucuucuuuuaaagggcugcacugauaguuguauucuaauuuuuugccauuacuaguuuugcugcagugaauauccuuguaauaauucuuaauauaugugugcagcgagaaugcauacagaauaaacuccuagaaaaaaaucugugaguauaguuuuuaauuuagauagcuguugccaaauuuccucuaaagagauugugcccauuuaccaauaaugugugagaauucuugaaccaccuccuugccagcaucgcauauucucauuuuuguagucauugccagucucagguaaaaaauauuucacugucauuuuaauuugcauuucuuuaauuauaggugauguugaaaacuuucuuaugauucaaaagacaauuuucauucuuuuucaguguauucuguaucccucuucuguauuguuacagaacuuauauaguucuuuaaaaauacacacacacacacacacacacacacacaaacaacauauacauuuaaagcuuuuauccaucugaaauucuuuuugguguagagagcgagcuaaagaucuaaggugauucuguauagauggcuagccaauugucccacaccacuuauugcucuuuuucuuucugguuugaaaugcuuccuuuauuuuaaauuucaugaucuaauuaagucuguuuucuuggccaaaguaaugaauuguaaaucuacuaagagaguuauuucucuacccaccauuuaguaggcucaugugaaauuauuuucuuguaggauccuuucaaguauagcuauccaccacuaguagaugaugacuuccagaccccacugugugagaaugggccuauuaccagugaggaugaaacuucaaguaaagaagacauagaaagugauggcaaagaaacauuggaaacaauuucuaaugaagaacaaacaccucuucuuaaaaagguaacuuuauaaauaaaaugaaacugaaucacaagauguggucuauccccaauucugacacuagccagcugugugauuuuggguaauucacuuaaccugcuacccuuccacauuuuuguguguaaaaagaaagaggaaggaugggauuagcugaccagaagcaccacuuuaguguauuuaagucugauuccaggccagggccugugucuuauaccuguaauccuagcacuuucugaggcugagguggaaggaucgcuugagcaccggaguuugagaccaucccgagcaacauagggaggcccugucucuacaaaaaauaaaaaauuagccagaugugauggugcacaccugucaucccagcuacucuggaggcugaguugggaagaucgcuugagcccaggaggucgaggcuguacugagccaugauugugccacugcacucugaccugggugacagagugagacuuugucucaaaauaaaauaaaggcugauuccaugcuuuuguauaaagacuagcaaaacacaucuagaaguaauuguuuuaucuaaaauuuuuuuauuugucuaaaaguaauuaauuuaaaacuuugauuuaguuccuuucucuaauuuuuaaaagagcacuuaguaguugucacuuuuuacaaguaaucaggaacuugauagauggauaaauacaauguuauaauuuagaaaaauuuaaagacucuuaagggaaggaccauauuguauuuucuagaguaaccuauguuauguauaauaguaggcacuaaaauagauguuaauggucauguuaauauaugcuaaauaguuauccuuuuuuuuugucuuuagauuaacccaaccgaaucuacuuccaaagcagaagaaaaugaaaaaguugauucaaaagugaaagcuuucaagaaaccauugaguguauuuaaaggccccuuacuacacaucagguaaucgucaaagauuuuauuagcuauaauuuuauaacauaucuugaucaccuugagggagccacaaaauuaagaaaacuucuauuugguuuuugaaacuguagaaauauaaaaccaagaguuaucugaagacuuaccuugguuuccagacguagugcauauguuuagcuaccuugcuuucuucuauuauguugagugucuuuaaaggguucucaucacacaucagauaauaaaacuaaauauuuauauauuaauaaaucugaauggcauguauuuuccucacauuacugauacuauuagacuugcccaaguuugggaaugccagaaaugacacuaaaguaaggauuuguugauuuuacuuuccagaagccaaagaugaacuggaaaaauagguuugugacuaaagccaaacuucaggacaucucuauuuuucugcuagguuauuugauucaaaagauuccagguuguuucuuucagcauuguauaaagaccuuuuucucacugaugauguuuuugguugguaaauauauuuugccuuacguuacauugcuacaccaacuuuaugaucucauguagcauuuucugucccuuuacuugaaaccuuucuguauagcuauguuuuauguauaucucuuaugaacaauauagccagacuuuuaaaaaaucuaaucugacauucucuaauugauaguauuagcuuguuuacauauauuuugauuacuguuauauuuggauuuaucuccgccaucuauauguaugaaagacagcaagcaagagagacauagaugcgcaugcauuuucuguuuuucaugguuuuucuuucccauuuucccccuuuggaguuuaucuuuuuuguuuguuuacuuguucccauuuuucucccuacuuauuuggaaguuacacauucuguuuucacuguaaaccuguuacaucauagguccuugccuguaauuguagagguaugacaggaaaagcaggcuagggagaaagccagacagcuuuucaccugcacauugggcucugcuccucccuuccuccgcccccggugaagucccagagcugcuccuacacagacacaaggaccuaaccaaccucugucuuccuggagcugcucacaguuguugugcugguuacuaagaacaaugagauccauaaccuugugguuuucuaugacuuacuuaagauuaggcucuagaagaaagccagcaaccaugcaaauuuaccaccuuauccaaaacuaggcaaagcccuucugggagagcucauucuuaaaaacauguguuaguuagauuaaaaaacacucccaagguacagacauuccugauauaaaauuaaccuauuuaaagauguaucucaaaaucaacggcuugcugaaaauucacuuuaguuaaauuauucaccuuuuuauauaaaacaaaaacacuauucuucccauuguuuugagccaccugauacaauuuggcuaauguaacuaaacuacacaaacugcuugaaucuuuuaaauuuuuuuuuaggucauaggcauuacaauggaaaguaauaguaaaauuuaaauauugaagcucauugauuuuacuauuugauuaguucuuccuacagcucccaucccaaacuuacuuuuauguuuacuuuucuccuucccuauuacuuagaaaagcugcuauauaguaagaaauuauucuguuaaauacauuccuaaucaucuuucuuuuuaaguuaugcucuuuucuguugguguauagaaauaugccucauucuaauuauuuguaauuagguaaaguugaagcagcaauaucuucuuugcuuuauuaucuauaaccuuccaaauaguuuaaauaagcgcaccuuaagauagugcugauuauaggauuaaucagagccuucauaacucucucuucuguucuuccugguuugcuuuugaucuuggggaaaaccguaggacuuuuuaaauagugugcauugaaucaguaagauuaaaauacaaaauuguauuagguaauuguuuuguaagucuuuuuuggugaaaugucuuuauacaaaugagcauaagauauuaacuaaauauuuuucuucaagcuaaaugauuagauugucauuuauucugauuauuacaaaugucuuauguuuuugucacucccuagcccagcagaagaacuguacuuuggaaguacagaauccggagagaagaaaaccuuaauaguguugacaaauguaacuaaaaauauaguggcauuuaagguaaauaucuuaaagauacaauaaauuauguuugagaauuugacaugggaagugauuuuagacauauucuaauugaaagauugaaaauuuugaacuuguacaguguuuuuauuuaugacaauuuuuaggcauguuguacuaccuucugguucuaaccaagucgcauagcuuuaucaaaaaauuuucccugaggucuguaucugaaucuuuuacgugcaguaauagguuaaugucuaaguuaauacaaggguuuaauguuuguuguaaauaacaacccaagaaaaauuacucuuuacuaugugaauaauuuaauuuauaauaacagugaaacauaaaacuauaaaauugauagugcauuuuccccaagugugguauauucuggaguguaguuuauaucggauauuaaccugauacugagcauuaaguguaacaagacuaaguccgucacuaccccguauuguagguuuuccugccuuaaaucuucuauuuaauuuagauguaacuaccaggauguuccugaugugcuuugauuaucuacuguuuuuuaauuucugaacaccaugguauuaauaacaugcaaucuaaugugcauucuguuuuugugaauuuaugucauuaaauucaggcaauuaacaggauaaauauuuaacagauggauuguuuuauuuaagagggagucugaaugacaauuugacuuauauaugaguauguuuuuagauaggucgagaugcuuuuuuccuguuaguggggaaaaaauaccuucuaugcauaaucgucaauguuacuuuguaaacucuuuguucauugauuauucacugcuaauuuuuuuuuuagggagauauaccuaaugcuaaaugacgaguuaaugggugcagcacaccaacauggcacauguauacauauguaacaaaccugcacguugugcacauguacccuaaaacuuaaaguauaauaaaaauaaaaaaaauaaaaauaaaaauaaaaauaaauuuuuuuaaagucauucuuaagccauuuccccccaaaaaagcauaaagguuguuaugugacuacuguguuuauaaauaggugagaacaacagcuccagaaaaauacagagucaagccaagcaauagcagcugugacccgggugcaucaguggauauaguugugucuccccaugggggugaguugucacuuaguagccacagcagguguugggugugguggggguaaggggaccuggaccuuggcucugagucagcagagaugucaggcuagaaucuagaaauuagcagaguaucacgagucaccucaccucgcuguagacaucuuuuuucccacaugugaaaugggguggucaaagaggucucuaaagcccuuuccagcauuaaaauguauuguuucuaacaaguaaaauuguuuaaacugacaccaauugaaauugaauuucaaaagagaaauuuccucacuuuuagaacuuuuuccuuuuuaaagacauuuccauuuucuucuuuuuccuuaauguugaguuccagaauaaugcuuuaaaccacaugcauauccaaccgcuuugaagguuccuguuuauaugcugaauuacccuuuuggaaugcagguuuaacagucucugcccaagaccguuuucugauaauggcugcagaaauggaacagucaucuggcacaggcccagcagaauuaacucaguuuuggaaagaaguucccagaaacaaagugauggaacauagguaagcuuuucccucacauucuucucaaauguagugggaagaaucagaaagagaaaagugccuccauggaccagguggccucccuuucuucuugcaucugcugggugcccugcaaggcucuggggaugcccagaugaaagagaccugguguugcucaaggaggucacugauagcagaaacucauuugcaggccagugcaagagucuggaucuguccagaucacaaacacagauugucucagcaguucucccuguaggagugcuuaccuuacauacuagaauguuuuuugcagcauuguuuguaauagugaaaaacuggaaagaaagaaucuaaaucguaaccaguaaagcaauagugagauacauuugaguauauccacacuaaagugugcugcaaccacucauaaagguacagcaagucuauuuguucugacauggaaagacaucugugauauauuuuagaaaacaaaucuagugagaaaaauugguuauggacauuauucuauuuaagagggggaaaaacuugcauauauagauauauacauguaugugcauguauauagauauaucagguugugacaaauuucuugaaaagauauguagaaaaggagaauagaaggggcuguauuguaguuuugcuuuuuuuaaauuggaauuaugguuuauuggaguguucacauuuuuccccccaggggacauuugucaaugucuggagacacuuuugguugucacaacugggggaugggguacagugggcaucuaaugggggcagcauagggaugcugcuaaaccacuagcaguacacaggacagccccaucccccaaaaaugaucuggccccaaaugcccauagugucgagguggagaaauccugcuuuauaggguaguuaaggauggccacuccgaugacauuagaguaggcccugaaggaaaugagagagcaagccacauagauaacuggacagagaccuuuccagacagaacaacaaaugcaaaaggagugugcuuggccuuugggaggaacaacaaggaagucacugucucuugacuccaguaagggaggagcauggugagagauggggacagagauaguaggauaucagaucaucccuauggugaggacuucugagcgagaggaaaaacuauuaguuggcacuaagcagagccaugaggugauccgggcuuauuuuuuuaaaggauucuucuggguacuguguagaaacuagacggugggcagugauaccaaguucacacuaaaguggaauuugcuguaugccagcacuguucuagaugcuuuagacauauugauucauucagucaugaagacagcccugugagggagaaaggcauuuuuccuacuuuauagagaagcugggaaaccugauaauggcuaugguugaaugaaaccuucagggcugggcgcaguggcucacaccuguaaucccaacacuuugcgaggcugaggugggaggacugcuugagcccaggaguccaagaccacccuuggcaacauagggaaacuuucuuucuacaaaaaaucaaaagcuuagcugauagaucaugaaaauagauuaugaacagugaaauuccugagaaggcugaaagugcggggaaccaaagcaggggagauuagccuuaguccggaggagggagaagcagauggaagucagcagccugccuuguuuuuacguguaauauuuaaauuuucaaauuguauuacaggagggccuacuuucuguuuuuaucaagaguuuuucuuuuguucaaagacacugguuaugggaauauuuugaaaggguaagaaacgcugguauaaaagguguugcagauuaauuugaaguucuuacgaaacagucccucaaaaugaaggguuauuuuugguuuuguuauguucgaguugcuuuguuuucuuuguuuuuugcuuuaccaauuacugauggcuugcuuuucuauaacugugagaggagaucacuguucuccugcagaaagugggagggaggcuugauggugggguacugaagcucaaggaaaguaccuuucuccuaucuagaaagggugauuuccuucaaaucauaagauauuuggaugaauucuacugaauaccauauaaacacuuucauuugaauuuuaccgaaugguaucugcaauauguuguguuccuuauacaugcauuaauuaacgaagcuggaagauacauauacacagagcaacugucuuaggugaaccuggggaagaggaaugaggacuuuuaccucuguuacauagacuucuguguauaacuguuuucauuuuauauuuuacuuuuauaagaaaauuaacuuuuuaagaaguuauguuuucuuuggauuuuaauagguuaagaugccauacuguugaaagcaguaaaccaaacacucuuacguuaaaagacaaugcuuucaauaugucagauaaaaccagugaagauauaugucuacaaguaaguauacuuucuuccuacccaaacaaaguuguuaaugcugaucaacauuagaaaucccuuuuuuucucacggacauaaagaaaaacauuuggcauagacacgauagaaauacugucuucuuugugaagagaugccaaaucagaaaugguaagcaggccaaguguggugcugccuguaaucccggcacuuugggaggccgaggcaggaggaucacuugagcccaggaguuugaggccagucugggcaauauagcgagacccugucuguacaaaaaaauuaaaaaugagccaguugugguggcacacaucuauagucccagcugaggcaggaggauugcuugacccugggaggucaaggcugcagugaaccaugaucaugccacugcacuccagccugggcaacagaacaagaccauuucucaauaaaaaaagaaaagaaaugguguaagcagugaguuauuuuuggagaucuacuaaccauuugaaagcucuggccauuuuuagcaaagcacaagguacuuuggggaguaucaaauaauucagucuugcagaaaaaaguaccaauuagugcauuuaaauuugaaagagacagaggggcucucugaguagcugaaggcugcuuaaggguuucuguaccucuaggaacugacugcucugcuccugucucaacuagaaauucagaccucucaaaaugagaauaagcauagacauaucuguccaccaaacaaaucuaaugcccuguugcacuuccaccuccuuccaccagccuuacagaguagugggccccauccuuucaguguuuggauuucuaguauuccuguuugucaugcccaugauuaauggcuguuuuauugauauaaaucuuucauccccucuucccucuucagcucagucguuuacuagaaagcaauaggaagcuugaagaccaaguucagcguuguaucugguuccagcagcugcugcuuuccuuaacaaugcucuugcuugcuuuugucaccucuuucuucuauuuauuguacaguuaaagaaguggugccggguaggaaccacgguuccuucguccauuaguuggaaaaaguaacagaccuaaaacucuaccaagcuacuaaaaacauugcacaucugugcuuccuaaaaggaaauaugcagcacguggaggggaacacauacaugucuugaaaauaaacugcuagaauaaagaaaugcuggagaaauugauuauaagagacuauagcuauuuaguaaaguaaguaaaggcauauccauuguguaaauuaauaguuuaaauauaauuuauuuuuuccuuuugaucugaauacuuuuaaagcuuaaguuuuaucguguaaauacauuagcuaaacugaaaaguauaaguaacaugcuuuguugcagccaaaaaauguaaucugcuuuuuuaugacagaauuauuauagcugagcugacuuacuagcuuuucuauacuauguauauagaagaacauguauauugagaaagaaaacauacuuauauagaggaauuuauguaaccaugacuuuguaauuuugagaauuccucccagugauggucaguauucuuuuggaauguaaaccgauuuaaugccaaaccaccuuaaccuuuguuucucaguguuccuuaacagccugccuuuuauuaaucucaggcuuuuuuaugaacacucucauuucaguagaauuuggaaaacuaagcgugguuggaauuucuuugaauucuguuaguaaugcccaaaagaaaagucucaagcagucccccuauccagucauuuuuauggaguuucauguuguccacuauagcuggacacugaaccuuuugccuaauuuauuauaaaggccugacccucuauugucccaucuucacccccauuccagagcagaggagucucuguggaccaugaauugcacugucucccuccucauuucuaaaugaaagguauuagauauaaauuuuuuugaaagguuaguuguuugagaugcuaagcaggauaauaaauuuagauuuuaaaauguucccuguaaaagucagcccaugacaaggaaauuuacaaaauacuagaguaucuagaagggugaaaacaaaaaaaaauaaaaagaaacacagacgcccaggugucagcucuccguuuaaagaaugaaaaauguaacucaugaugaucugugaaaccuucaaacuaggaccaauugacuuacuugauauucugccuuugauaugguaguacccacccgguauuccuaaaauccuaaaaagauacaccuugcaguagcagaggcaaugacaugaguuuguuuucucauuaauaugaccaguuugggucuauguugguucacauguacaucuacuuuauaugaaagaaaaaacaguugucugccuguaaaauguugaguuucgauugagccauguuuggagauuuuauuacuauucugaaggguaguguuguugguuuucaucuucaagaaguugauuccaaaacugaguuaugaagaaugauauaacaguuccuucaaaauuggccuaggaaauaaaaccuuaaaaggacacuggugugcuacuuugucuuaauuugggcuuuucuguuucaguuugccaccuccagcugugaaauggacugcaguccacccuaaguacugugcacaguaucucccugugugugugcacaguggcuuccccuuacaugguagauuuuuggccuuaauauaaucuaaucccaaaguaguuguguauguuuucuguuccuuggcaaauaaaugaagaaauaauuagccaagauugaaaauguauuguccuaacggugucccuuuaauguuucauaugaaaaauuauguugacccacuaaaauauccuugcucaaugucuggucaguugaauuuaauaacauaucuuguuaauguuugugugucuauuaaaugugacuaagcaggauuacugaaaauucacuauaaaaucaaaggcaucuaaacguuuguacuugucuugauuaaucauauauuuacacuugauuuuuuucugucuucauuuguuuuuauuuaaucauaauugcaugauuuuuuugguacucuaaucaguaauuuuauuuuuaaucaugucauuaccuauucaugaccaaauuaccaaggaaccaacauuuagauuuagauauuuguuuucacuuaggaauggaaauuaauagauuuuccaugaaagcauuagugaaauaucauuaccuugaucugcaaguagccuaaaaaugcgauugcugguaaaccuggccucaaauuucauacuaccauaacuguuuuuauauauugccacuaauuuugacuggauuuaauagcacuuuauuguacaacuacaaaaaaaaauauauuccuagaauuguugccaguguaauuucucuaauguucuggugcuuuucauauauuuucaguauuuuuauuacuauauugguauuuucuuuguauaaauugauugauuaaaagaacauguuuucuauuuuaauauguuuuagaaaaauaauuacauuuaugaaauaaauaucaucaggaaaaaaac

SEQ ID NO: 19229 - RNA, 29671 nt, Homo sapiens
gggccccgccuccucagccucccuuggccaccucuccuggcuggcuucuaggcuccgccuccucugcguucgacgcagccuccgcccggccucccaggaugcagcgcgcuggcgggagguuuggagcagauggauaccguaucgacguggggccuccgguauguugccgcugcguugagguaggauggggcuggcgagucuucccuucccaggacuucgcagagggggcgauggggcuggauuuccuccccuuguccccgcauugcgggagagagggaaggaagcgggcaucccgagaccugggucugucauuccuugcaaugauaauuggauuuuaagugcuacauucgcuugaaguuuuuuucaucccuucaguauccuuccaacuuggagugugagaugcuuaaugagcaaaauaucucugaaaucuuuaaucucaaauaauuauauaaaguuaaaaaaagcguguuucggcuuauuaagguaguuguguucagccggggggguggggggguguguguggggggggcgguuuuaccacccaggggaccuuuggcaaccucuggagacauuuuuagucaccacugcuaggggccgggggcaaaagagaugcucacuggcuacuaguggauagagaccagggaagcugccaaacauccuccaguguacaugaaaauucacaacaguuauccagcccaaaaugucaauagugucaagguugagaaagauuuagauuuaaagggacuggaacaaauuuuauucgucaguuaaaaacaauugaaagaaaauaguugcgcauacaauauugccuuuuuuaaaguugaaagauacugaaaacuacaaacaaguuguaagaauagucccccauauuuccaucaaccguagucauccaugacagaauggcauguuagcaucuuuuguccuagacuuuuaaauauauuuacauuuuuuaugggaaaaaaugaacacauuguuuaaacguuguuugacuacauccuuaaaagauauuucagauauaacuaaagucuccuucuaccucuacucaccuauccuggacacuuccuuguccagaaucaacagcauucagaauuuggcaugaaauguuuacaguuuuacauuuuuuuauuuuggaucauacugccuggguuugaauccuggcucugucacuucuuaucugcaagccuuugagaagauccugaaacuccuugccucaguuucuccaucuauaaaaugggauaguaacagugccuaugucauaaggauguugugaggaagaaacgaguuaauccaaagugcuuagagcaguaccuggcacuguuucuucaggaaaaaaaaaaaaaauaguacauggcacuauuucuugagaaagcacucagggacuguagucauuguagguaaauagaacauauauaaugcuguuuuauuuguuuuacauaaauaauaugcugcaguguacauuugucugcaacuuaauuuuuaauucauuuuauuuuugaaauuuaaccaugauuauauauauauauacacacacacacacacacauauauagauagauagaucuaauucauuccuuuuaacucuuguuugauaguccaucuauacucauuccccuauugguguucauugagguuuuuacuuuuuuuauauugcaaauaucagcacagugagcuucuagagcaauguauucauucauaugugggauuaugucucuggguuuauaucuacaaaugaaacuacuggguauaugcauuucaguugacugccaaauuaccuucagagucaucucucccuuuuauuuaaguacucauaauuuucuucuaauuguuagcucuuuuuccagucugaucucacucacaccuuuaacacugucaccaggaucuucauaacucaaaaguacaguccugugauuucuguuuuugaagucuuucaguggguuaucauuacuuauaugagaaauuuauaaguccuuaauaugacauaaaaaucuucuuuagcguaaucuucccaaauccucuaauuuaguugaucacgauucucccgcauuuacucacauuucaggcauauuagauaauguugaaaaaggugagaucaauucuguauaggacccaauaaauaacuuauguagggagaaaaaaacuuuuaacaguggcccuauuuuguaggaaaguuaauuuacuuugguuaacaaugucauaugucuuggaaaaacaacaucuaucauuauuaucuucauaaaauuauguucaguauuauuaggugccauuuuaguugagugucuuaauuuuacuuuuuucccaaggauacuuucucuuggucacaguuaauaugguuucuuagacuuuuuggaugucaucugcucuucuaggauaaucuggaaccacacugauaguuuauuuaaagaauugucacauuuauagggccaaaaugauuuaugagcauuuaaaaagaaugaacaacauauuuauuaagagggggggcaguaaagaguagaugaggaugauaauuuuauugccagccuacuauuuuuauguuagcauaugcuuguauauauuaucauuuuucuaguauacacacacaucuguuuuaauuuuauguauaaaauagauagucaacuuugauguaugguaauauagaacaggaaaagcucaaauuaauuauguaguauuuuauaaauaaucuacuuucuggucuccacgccccgccccgcaccgccacccugccccgcaccgccaccccuaguuacuucuguaucuucugcagccacuguuauaauguuaauaaguaaaaagucaaauagcccauaggcuagaauaguaaaccuggggcccugauaagcagaguuuaaaauagugagggguugcuuauaauuggacuaagaaccuguaaauugaaccuuaguuugauuuguuuccagauauguuucuauuuuuuuuaaaugccaguuauuucauggccugcagguuuuaugaacauaucccaagaacuuuaaaaauagauguugcagcagcaauacuuaauaucuacugucuuagcaguuacaccucaauaaagcugggaaaaaaguuaaaauucauuuuagcaaugaauuaaauuuuaaugauugaguauuacuuagauauaauaaauagcaaacauuaaaaacaaaugagauugaaaacauguugcaucaguauaaaauauaguggauaugcacauauauguaaauucaauaagucuugcaaaaacuuuucacucaauagucauaaauagucauuuauguuuuuagaucaguuuaaguucaugagaauaaguuugcuuucugccuggagaucguauugaaagcaggucgaauuaggauuauacaacagaguuuugaaugccaugcuaagcuucauagcaaugauuugcaagcuuuuuuucucuacaccauucauauguucaauucacaguguuuagcaucuauuuuuccagguaguaauucaagaaucacaggucuauugagaaaggcaaggggcauguaagcuuuuggauuaggggguggacagugacaggaucaaguguguguuuuagaacaauuaacugauguauuaaauagcauaaaugaguugauauauuggagggaagauagauuagauuaaggaagacuaauuaagaagcuuuuaccucagccugagagaucacagccugaacuauaguaguggcaacuggaacagagaguuggaagauagauguuucuaacuuagggaacuugaugaugacauuuaaagaacagaauguaaggagccuaacuuucauaaauucugaccauuuuauaaucagguuuuccuuacuccuaucacacuuaaguuauugguaagugaaccagagcauuguacugauuaaacauuaguugugauauuuaacauuaaaauaauaaaauucauacagaggugauuuuuguuuuugauauuaagaaaucugaaaaacuuugaauagguaguaaaagaugaugaauucuuagagcuuuaccucagaauguguaauuuucaugcuuuuccuuucuagaaaucuaggaaaccugacaugggaccuuugguaaauacauuauuauucauacauuuugauggaauauaacuaauauguuuauuuucucuaaaccauaguuucauaaguacaagccagaccuuugauuuaccuacccuaucuucuuuacugaugaagcugaaacuacuuugugaugccuauugucccagaucuuucuguuaauugccuaacaacaaaccaguaagccaaugacuucuuuuuuucuuauuuaccuguuuuuauugacacauuguaauuguauauaucuagagagugcaauuugauguuuugauacauacauauauuguauaauggucaagucagaguauuuaguguauccuucccucaugaauguauccuuucuuccugguaagaacauucaaaaacaucuaguuauuuuguaauaaguaauaaauuacacuuuaguguuaacuaucuuuacccuacugugcaauaggacacuagaacauauuccucuuaucuaauuguagcuuuguacccuuugagcaaccccuccccauccucccauccucucuccuuuccccagucucugauaaccaguauucuacucucugcuucuaugauagcaacucuuuuaaaaaaaauuuuagauuccagcuauuagugagaucaugcgguauuugucuuuuugugauuggcuuauuucacuuaacaugaugucuuccaaguccacccauguuguuacaaaugacaggauuucauuuaauuuuguggcuguauuaauaguauuccacgcuaugcaccaaaaauugguauauacaccaaauuuuuuaauccauugauucauuguuggacacuuggguugauuccauauuuuggcuauuguaaauagugcugaauaaacaugggggugcagacaucucuuugacauugauuucauuccuuuggauauagacccaguagugggauucuggaucauaugguaguacuauuuuuaguuuuuugaggaacuuccauacuguuuuccauaguggcuauacuaauuuaccuuccuaccagcaguguguaaguguuccuuuuucuccacgugcuugccaaccuuuguuauccuuugucuuuuuaauaauagccauucaaacugaaauuaggugguaucucauugugguuuugauuugugucucccugaugauuagugauauugagcauuuuuuuuguguguguaccuuuugaccauuugugugucuucuuuugagauaugucuauuaaguuauuuuguccauuuaaaauauugggauauugcuguucuuuauauauucugauauuaauccccugucagauguauaguuugcaaauguuuucuuacauuuuguagguugucucuuuacuuuuuuuuuuuuuuuggcugggcaaaagcuuuucaauuugauguaaucucauuugucucuuuuugcuuuuguugacugugcuuuugagaucuuauuuaaaaaaauccuugcccagcccaaugucauaaaauguuuccccuauguuuuguucugguaguguaauaauuucagguuuacauuuaagccuuuaauccauuuugaguugauuuuuuauauggugagagguaggagucuggucucugcauauggauauccaguuucccagcaccaccauuuauugaacagacuguccuuuccccaaugugugguucuuggcaccuuugucaaaaauuaguugguuguuggugcaugaauuuauuuauggccucuccauuguguuccauuuguccaugugucuguuuuuaugucgguaccaugcuguuucaguuacuguagcuuuauaguauauuuugaagucagguaguaugaugcuuuuagguucauucuuuuugcucaguauugcuuuggcuauuaggggucuuuuguggucccauaugaauuucaggauuguuuuuucuauuucugugaagaaugucauugauauuuugcuagacauugcacuaagucuauagauugcuuuggguaguauggccauuuuaacaguauuaauucuaccaauccaugagcaugggaucuuuccauuaguuugugucaucuuaauuuuuuucaucaguauauuauaguuuucauuguagagaucauugaccuuuuugguuaacuuuauuucuaguuaucuuauuuuuuuuuguagcuuuuguaaauggaauuguuuucuugauuucuuuuucagauaguucgcuuuuuagcaaauagaaaugcugcugauuuuuguauguugauuuuguauccugugacuuuacugaauuuauuaguucuaacaguuuuuugguggagucuuuaggguuuucucaguauaagauuauggcaucugcaaacaaggacaguuuugcauucuccuuuccaauuuggaugucuuuuauuucuuucucuugccuaauugcuuuggcuaggauuucuuguaugcaguucauagaagacugaauaaagagauaucaacaacuuuuuuuuauacauguguucaauauugaggauauucuuuuauccuuuauuuuacuaauucucucaaguuaccuuucuuacaaugaguuuguucagaauaagggaaugcaugccagggcagagugguaguuaaaaguguagacuccagagucagaaggccccuuuuccaaacuagcaccauugcugauuucuguuaacuguggauuaguguuguaaccuuggaaaauuuucuuaucuucuuuaaaauaaggcuuucuugcuuaaaagguagaauaauaaggguacuuauuuuaagacaauaguuauuagaauuaaauaaugcauguauuguaccugccauauaauaagcuugaaugauugauauuauuuaauucuuguguucauuguaauaaauuauguuaauccucuauuuuuucuaauuugaauaagaauagugacuuuguugggucauacaaaugcauacaaaugcauugccuuuguaaacuaagauuuauuuuuauuaauccuauggagauuuuuuaaagccuuguuacagcaucuccuauuuuuauuccugggguuucuuuuuugucuuagagccuguauaggcuccugucucuagaaagcagaagcccaauugccugggcugugggagaaguauaauugaaaaucaacguauuuggggagagugaguugcaagacaaguaaaccccuaauugaauugucauucuaaaggggcuaaggcagagagugggaaaccacauuagaguuguuagguuugaaacagagaaguauaacccuuaagcaauuuucugagccagaacaaauaucugaagucacuuuuaauagagcaucuaaagcuuuaaauauaugccguugacacauucaguuaucuuuuuugauaugguuauuugaauucuuagcaaacuuuuuuaaagcgucuacagaaauaauauuuagaauuuuuuuuauaaguaugauauugucaaaauaguauaaaaagcuuaaaauguuuacuuaauaaaauguguaguuaccuauguuguaguucucuaacagaaacguguuuucuuuucaacccuuccuacuucauggcaguuuuuccucauuucuuuuuuagguuuagaaacaucaacuggaaucaauuugcauuugaaaauuagaucagcacaaagacuugauauuguggaaugacuagcaaacaagcaaugucaucuaacgaacaagaaaggcucuuguguuauaauggggaaguccuuguuuuccaguugucuaaaggaaauuuugcagauaaagagccuacaaaaacacccauauuacaugucagaagaaugguauuugacagaggaacaaaaguauuuguucagaaguccacuggauuuuuuaccauaaaggaagaaaacucucauuuaaaaaucauguguugcaacugugugucagauuucagaacuggaauuaaccucccuuacauugugauagaaaaaaauaaaaagaauaauguuuuugaauauuuuuuacuaauccuucacaguacuaauaaauuugaaaugcguuugaguuuuaaacuaggcuaugagaugaaggauggccuaaggguccuuaauggcccuuuaauuuuauggaggcaugucaaagcauucuucuuuaucucuucucaaacuggcaaaguuguuagugugucagguaacuuuuccucuauucagugggcaggggagauugaaaauuuagguaugguuuuauugggacuaaaggaauguuguuuaucugaggaagaauguacucaagagccuucaaaaucagauuaugcaauuuggaauaccaaauuuuguguauauucucuugaaagucaagaaguauuaagugauauauacauuauuccuccugcuuacagcaguguggugacuuauguacauauuugugcaacugagaucaucaaaaaccaguuaagaauaucucucauugcccuuacucgaaagaaucagcugauuucauuucagaauggaacuccuaaaaaugugugccagcuuccauuuggagauccuugugcaguucaacuuauggauucagguggaggaaaccucuuuuucguuguauccuuuauauccaauaaugcuugugcuguauggaaagagagcuuucagguacaacacuuauuguaauaauaauucaguugguggucucagaccuuuuaaacauuuguauaguucauagaguucauucuggagucuuauugucuaagucaauuuucaguucuguacaugaaaugauaaauauuacauuguucuuuuuucuuaagguuaucugaguacaaccugaugguguuuuuuuugucuugccauuuugagucauaaagccuuugaguuguuuggaaauguguaaauacauauguaacuagaauuauguauuuauuuuucuauuauaacuuucuaauuuuuauuaauaugauaguagaugugcauuuucacuuacaauaagauuauuagugauuugacuagauagauaagccuuccuggaaaauucaaaucaguuuuucaucuuuuuauuuuuauuuuuuuauauuuuuuuugagacagagucucgcuuugucauccagguuggagugcaguggcgugaucucggcucacugcagccucuaccucccagguucaagcgguucuccugccucagccucccgaguagcugggauuacaggcaugugcuaccacaccuggcuaauuuuuauauuuuuaguagagaugggguuuuaccauguuggccaggcugguuucaaacuccuggcuucaagugguccgccugccucggccucccaaagugcugggauuacaggcgugagucaccaugcccggccaacuuuuuaaacauuuauaauuaucuauuuaaauuuacuuguugucucugauucauuucugaaagugaaauauagagaaauuccuugaaaucuggagagacaaauaauuguucuccauagacaagugguaagcauuacuuuuucuaaaaacuuacucagagauuuuuauuauguuauauuuugaaaugcagaacugaccuuugagcaaguauucacuuuuuuaaguuuggaaauuguucuaaaauauucacugguauugaguguuaaguaacagguaaaaaggcacagaaaaccaauaggaaauuagaguuuuguaacugggugucuccaccaauaauauuucucugacucuguauuuuuggguaauguugcauccuccugguugaaaauguauucaguuaugugauuugaaguguuuaugaauuaagacaaauuaucauuacuaguuagaaaugucucuuccaaaaguaguacacuauacaacuuuaguuuuugugcuacuuaggagagaaaagcagauauugccuuauuuugugugcccuauccauuuaauuagaagcucaaugaaaauuuuuaucauuauauuaucaccucuauguggaauauuguuaaauguuuuagaaaguuugaaauucauuuuuaaaugugaaucauuauuguuuguguggggggaggaaugucaaguuggaauuaugaaucaggcuuugccuuaccaaguacuuuuauauuaauagggauuauuuugaauuucuguaauacguauguauccucuauaauacauagagaaugcaaaaggaaaauaauuugaaagcuauccuauuuuaucuugaaagcaaucuuuuaaaagcgcauuauacauuuauuugaaaguuauuuggaauugucuuuuuccauucucuuuuccuuuaaagaaaugguaggggaaaaacaucugguauacccuauaguguuuuacuguagucaagguaauauaauagaaagaacacacguacccuggguuugaaucccaacugagccacuuaccaguguuaccuuaaggaauguaauucuugugaacucauuuuccuccuuuaugaaauuugggaucauucugacucugagaggggagaauuaagucaaaugacauuguaaagugucuugcacagagcuugacacauaggaggaacucaguuaguaguagcuauuacucuguuauauuacuguuagacaaaagccagggcugucaucaguuacuuacacuuacucaagauccccuauucaccuagauaaggaaaaaacaauuccuuuaugugucauuaauugcaaucgucacucucuugaaguggguccccugcuuggacccuguaaagcuuugccacuaacauguuacccaaggcaggagacugcaucauucccuguagguggaccuauaauugcugcuucccugacccgaaguuguauucuagugcacucucucuacaauggaccacuaucuuuuccacacguuacuuaccuaagucccuacugacuuacccccuaaggugcuucaggaauucuguacuucuaaccugcucucaaaugcccuguuuuaaaagcucuggaauucacccugauaucuacaaguaagugcuucaaaguugccucuaacccugccacuuugggcguauucagguccugcuucuaucuugguguuacauuuauacucaacuucuuaaaaaaaaaaaagggaaauauuaguuuaggguaaaauauucaguuacuuuaaaaacagaaauaaggcugggcacaauggcucaugccuguaaucccagcauuucagacugccgaggcaggcagaucacuugaagccaggaguucaagagcagcuuggccaacauggcgcaugccuguagucccagcuacucaggaggcugaggcaugagaauggcuugaaccugggagguggagguugcagugagcugagaucgccccgcugcacuccagcugguugacagagcaagaucugucugcaaaaaaaaaaauuaauuuaaaaaaacagaaauaagagcuaagaaucuagaaauaaagugggaguagaaauaauuaugccaaaaacucagguuaagagaaguaacuacacuugaacaauuaccuuuaguuuuaacaguuaaggcaaaaaaguaaauaugauggguuuuacaacugaagggaacauacuacaagggaaaagauuuuuuucuaacauuaaguucugagaagaauuuacuguuugugguauuuuguaaaagguuuugaguaauaaggugaauaccuuauuaaauaauaaggugggucuuugauagcaguuuucccccaaaauagaaagcaauagaagcaguuuuccuuuggguuggcuauggauccauccauccaucuauucuuuuauuaccucauuccaagaaggaauuaagccagcuuacaaagauagguaaaauacaaacaagcauaaauuagaguaaauaaugaaaacaagguuaguguuuucccagaucaacacuucauaaaagcccgaggcaugauguuuaaugugguaauaggacuugaaacagagcugaaucuaaaggaauacaugauuaacuuuuuucuucuuaggcuuucucucuuggguaggaauugucucugcaaguuuugacaagaaucuauguggcaggcauuucaaaauugaggucauuggccggguguaguggcccacguuuguaaucccagugcuuugggaggccaagguaggagaauugcuugagaccuagaguuugagaccggccugggcaacauagugagacccccaucuguacaaaaaauuaaaaaauuagcugggcgugguggcauaugccuguagucccagcuacuugggaggccgaggugggaagauuguuagagcccaggaguucaaggcuguagugagcuguaauugugccacugcacuccagccagggcaacggaaugggacccugucucaaaaaaaaaaaauccaucugucaauaaaauugaggucauugucaaguauaccugaagcauagcuauugguguguuguugauagagguuaauguauucuggugcugugcugucugauaugguagcuacuauccagauguaguuauucaacuuuugaaauguggcuagucugaauuaaaacauguuguaaaugucaaccaucaaauuucaaagaugaauagaaaugguaacaucucuuaauuuuuuaaugauuacauugaauuaaaaugacaauauuuuagauauauuguguuagauauauuaaaauuucaucuuuuuacugcuaccagaaaauuuaaaauuauaugccuuauauuuggggcucacuuaccuuucuauuggauggcacuauucuagagcuauagauugcaaauauguguguguacacaugcauacauacauaguucugugcuguuugccugccaaacacauucuuauuacuaaugucuuuucccauaguccauuauacuccaugauacuggugggagaaagggaggauauggguuuacagaaaagcugucucucugcacaagugaagaaucaacuuuggcaauuagccuuauaggggaagauucauauuuggguauguggguugaagagccuuacuuucauucuugcucuaaugugagcuaccuuccuguaucaucuagaugauguaucugugcugcuggaauucugagaagggguuuuagauuuuuugucucagggaaaagggggauuugauccucaugguguuaguuuacccugggaccaaucuugaggcuuucagcuauauguaccauuaagaaguuguccucuauuuuaaacuugaggucucagguucugauauaaacugaccaaaucauuccgugaggcuaggaugguucuggcugucccacuuuuaggaccccucaccuguguacccgauacuagcuguauuccccuccacacccacaucaggguuuaagguuuuaagcucaucuugacucuauuauagguuauuuuccauuaagagcucuuaaggugucuacuaguacugucugguuaccugacaguacugcagcugucagguaugcaacagaaugcaacugaauuccuuggguaauuugucugaucauaaauacauauacacuaagacuuaaugggaaugaaggucauccuuaaauuagcugugcgagagaaggaaucuucacuagaguuugacucaugauaaauguuagaauuuccaaagguuagucaugaaaaguguuagaacuuauaaauagauuacaauaaaauuuugauauagaaaucaagaaugugacagucccuggacaaaccugaauaaaauauuaaaucuaaguaccuugcuauuuauaaaguuuuuauaacucuuauauuuccucauccccuaauaucuuuauuuuauuuuaguuuuuacuauuuucauuacucauuuauaagauugaguuuuacaaaugacaacuacaugaaacaaaaggacuuaauuuauuuauuucacauucgauuuuuucuugucuacuccuccuauaaugcucccuuucuuuuagguugcugcuaaaugggaaaaacuuagcuuaguacugauagaugacuuuauuggaaguggaacugaacaaguacuccuacuuuuuaaggacuccuugaacucagacugccugacuucauuuaaaauaacggaucuuggaaaaauaaacuauucgguaaguucuauuuacuuauuauaugguauuuuaagaaccauuuuagaaaauuuaagugcucaaaagcuuugaccuaucauuuaaauauuggugguuuuauacuuaaaauuuugaacuuuaaaaauauauagauugaaucuuuuaaauauauacauugaaucuccuuucaacaaauguuauacaaauugaccaugcuuuugauauaaauuugaauuguaguacauuugguggucacuuaagugacagcaguacuauaaauuaacuuuauuuuugcuucugaaaaucacauuuuauaccaauaaauauaauauuggauuaaauaaggaauaaaaugaagcaaaauugcuuuaguaaaggaaguaacagcucacaauaucuugagauauuggacauaagggaaauuaugccccugaaguuucagaucaauacaaaaucucucuaagccucaguuuuuucauuuguaaaauuagcauaauuuuaauuuucuccaguuaugggauuuuaggauuuuuuaaaaagcuaaugagagcccaggaauucaaggcugcagugagcuaugauuauuauguugcacuucaaccugggugucagagcaagacacugucucuuaaauaaauaaauggaaaaauguuuacucuuuaaaaagaaagcuaaccagcugauacuuuguaaagcaguauauaaauguuaggugguaguaguaggaaucauaauaauuuuuuucuaguuacaagaagaugauggggaaaauauauaguuugccuuuguuuauuuuuuuuuuuuuggagacagagucuugcucugucaugcccaggcuggagugcaguggugcaaugucagcucacugcaaccuccgcccccuggguucaaacgauucuccugccucagccucccaaguagcugggauuacaggugcgcgccacuaugccuggcuaauuuuuuguauuuuuaguagagacaggguuucaccauguugugggcaggcuggucuggaacuccugaccucaggugaucugcccaccuuggccucccaaagugcugggauuacaggcgugagccacugcaucuggccuauaguuugccuuuuauaaaauaguguguauuuuauacacacuagggaaacuguucugacuggauauacuuuaauuguauuuuguuaguuuugugaauuuucaauuguugcaaaauuucagucuuaguguauuuauuuauuuauuuauuuauuagagugaaccaucagauugcaaugaagaugacuuauuugaagacaaacaagagaaucguuaccuggugguuccaccucuagaaacaggacugaaaguuagugucuguuugcuucuuuugcuuuucgauuaguguuauucuaaaugaaggaaagaacauugaaagaaagguccuuaaaguauaagcaacuuggugcuuggguaaaaaugguauuucaaaggaucuuuaucuuuuuggcaccucuguacaaauauuaugauacuacuuauaaauguaucaucuaaacauaccuuuuuuguaguaagacuauauagauuuaauaagccucaugagacaaaauagaagcagcucacuuuugaaaacacauucuuucugggaucaguauaccacaguaucuuuuuagaguagcagcgaauaugauaaaucauaaugcauuccagacaugaacaguuuacucucauauuuuccauaaaaagcuccacaaaagaguuuuuauuuuuuuucccaaauguaccaagguaaugaacauucccuguaaaauacugaggcuuugcaaagaaaugucaaaacaaaacaaaauaaaaaaaaccuaaugauugucugugauuccacuauuuugcaauaaccaauuuuaacacuuugcccuguauauucuugcagauuuuuaaaugaauauacgcauuacauagaaaugugauuauaagauguauguucuuuuguaagcugccuuuuuuguuuauagcauuuucaaauauacagaaacauuccaggaauacagugauuaucucuguauccccaauacauucaauucuuguuacuuuuaaaaaucuuauuggccucauguguuuguguuuguguguguauguguguauauauuuuuguagaaccauuuaaaaguugcacauguuauauuucacucauagguauuucagcaggaaucuccuaaaaauaaggauauucuccucaugcaacuauaauaccauuaucaaaguuagaaaauuguuaaugaucccuuaaucuuauuugcuaucuuguccauauucaaauauauuuaguuaucacaaaaauguuuuuauaacuguuuuuuccaggauccaaucuaucaaaguuuuuacucgcauuugauuauaucucuuauuggucuuuuuauguagaauaauucccccuucccccuuuuaaaaauuaugcuaaagaggaggccacgcuaguuguauccucucuuuuggauuugucucuuuucuugcuguguuauugaacuuuuucuucuuugccuaggguuggaaaacuuuuucuggaaagggccaggugguaaauauuuauacuuugcagguuguuuuaaaauuauuuugcaacuauuucauuauuagagugaguucacuuuaauaaaugcuuauugaacacauauuagacaugaauuugaacaauagauaaacaucauaacagacagaaccaugaaugaagacauugaucuauucaaaauuuuuguacccugaacaaaguaaauguaauaagacaaauugugaaaaaagaaauuguaauaccugacaaaauauuaauuuucuuaauauaaaaguacauucuucuauaguauuuuugugaauguauagugagugacccaaccuucucagaggaaaaguuauuauaguugcuaaaauaugaauuacuuaugucuuuuuacucuugcaguuucacuucuagaaaucucuucuaaggaugaagaugauuuuacaagaauguuuauguaguauuuauaaacuacaauauugguccaaaucuaaacauacaucauuaggaguaugauaaguaaauugugaugugccugaacuauggaauacuauguagcugucaaaaagaauaguguauauuuuuauacugauuuagaaaugaugccaaaguacuuuaauuuaugaaagcaugacuuuaugaaaggcuuaauuuaugaagcaggaccaacucuccugauuaaaacugaaaaugauagaugaagucuccuuuaaaaacauucuuagaagcuucaaaaagcugacacucuaagaauaaauuaucaaaucaaacuuucaaggcuggaacccagagagauaaggagaacacugaugcuacuuuugcccugggagcauguguauugaacuuaaauugguggugccccaggcaucugacagaaacaaacagaaaauccugucuggaaacacacauucauccuagcccucauaaaucucacaaguaauuuuucaaagaaaaugagcuguccacagaauaacuaagcacauaaagaaaaaaggcaucgugaguaauuauucacagaaaauaaccaaacagcaucucuuucaagcaaaaacacacugaaauaaaaaacucaauagaugacuuuaagaguuaaagagaugaaagagauacagagcaaauuagugaccccgaauauaugagaaaaauuauccaaaauguagcacagagacagggaaaauaugaaaggcuuuaaacaacauuaagggaaggaagggaggaauggaggugguggauaagagauaguugaauauccauuuuguuucaaguauccauauuuuaacaguagcuuucaauguagguaauaaaguucuaaaugcuggaaggccuuuuagagaugaacaagccuaccuuugcaccauuuugcacaugacguaacaaauagccagaaagguuacgugacuugcagagcuagaacuagaguccauuucacuguucuuucuccccugaaauuuguauucuaaucaguuacuggaaggggagauggggagaccaggaccuuagagaaucuuguacacauguacacagauguucauagcagcauuguuuauaacacugcacaacugagcauaacccaaauacccaucaauuggagaguggagaaguaaaucguggguagucauaugauggaauacuguaaagcaacggaaggaaugaacuacagcuacuagugauaacaugggcaacucuaaagccugauacaugcagagugauuccauuuauaaaagguucagaagcaaaacacacaaaaaacuuaaaauacuccuuaagaauucauacaaagguuguaaaauuugaagacaggcaaggaaauuaucuuaaaaggccaggguaguauugacuccaggggagaaagggcaauuaugauuguggagggccccugggcagcuccuggaaugcuacuuuuugauuugaguggaauuacaugggugucggcuucauuauuagucuguaaaauguuauuuuguacugugcauucuucugcacguaugauagagaucacaauaaugaacaaaaaagcaagguucagugucgugcaguacgauaugcuccuguauuugguuuuggguggguuuuuguuugugcaaaggaaaaagcauuccuuaauaugcacauggaaaaguucugggaagguacacaaucuauugguuuugcaaacgggauugggcaucuaggaagagaaggugagguguacuuucacauuguuuaaauuucuuaccaugugucuaauuuauuuuuguaguuuuauagcaaaacuucacagccaagauuauuuaacuacucuacucaaucacuauauuguccuggaguaaggggcauguuaaggaggaaggaagagugaacacugacaauuuucgagggugcauuucaaucugcccacauaguuuuuucuucuacuccccaccccuccaguagcucaguuguggcuacauaccuuugauggguacaucugccucccccugucacgaauuacugagugauggagugugaaucaugugcaucccacagaacuaggucaacauaagaaguuuuaaaauauuagcuagacacuuuacauacuuugugcaauaagguaacauauaggaauaauucagucuucacucuccaguuucuauuuguugauuaaaauaaaaagaauuuacuugcuuugaaauguaauuuaaaagaaaagaaucccaaauaaugaugcauuuuguugcauaaaucuagaaaaauauguuuuauuaaaagccagaugaauacuuaaacagccucagauauccaccugaaaugaaacaacuucuaucaguucaaugacaugacucuuuaaauuuucaguagcaaacuauauucugugaauguuuuauccuuagugcugaaaucuaguuaucugguaucauaaaaggaauggauugcuguaugcccaguucagagccaaauuguuauuuuuuucaguaguuuucaguagacucuagcacugaguuuauuagcacaaaaauaaacauaguuugggggcuguuauaauuuuaauuuuauuuaaaaauuuugcuaugaagguuacaugaacagaaaauuucgagcaguaucugauuaaaagugauauuuucuauucauuaugcugucuuugcuuauguggaugccuuguuuuugaagcagaaacuauuucaaaaagaaaaaguuauuuuguguggggugaguguauuuguaggccuugauuuuuauuuacauugauucgaaguuacuuaauaacucacuagugaaacaugcuaauauauugccacucucucaauuugauacauaagcucuauguugcaguuauuuuuuauauuuucuuuugaaagaagauacauuuuuuaaacuuagagacuuaaaaucuauaaacaaaacuguuuugcucugagaaguauuuuauuuucuauagaaaaaugaauugauaagcacauuuggagaaaguauuuccugaauuauugguaugucugguuucauuugaaaucauguuucuugccacuauuuuucuuucuacuuuacagguuuguuuuucuucuuuucgggaauuacggcagcaucuguugcuuaaggaaaaaauuauuucaaaaucuuacaaagcuuuaauaaaccuaguucaaggaaaagaugauaauacgucaagugcagaggagguaaaaguaaucaugugaccauuuuaucauuuuaugaauugaaaaucuauaagcuauugaaaaguuauuuaaauuggaauauuagaauauauuagaaaaugcugcucaguggaucaagaagaaaaguagcagagguuauaaugguggacuuuuaugacauugaaaaauauuugauuaaggagccaauauuuuaucaauuuauagguaauucuguagcauauuaaaauuucaguuaucaggaaccuuggggaacaaguccuuuuguuuacagauuuaaccauuaaacuuuuuuauuuguauuguuuggauagaaauuacucauaagugaauuauguauuuacugacuuaaauagaauauacugaguauuauuuaacuuuguauuggugaugagauaauuuuauuauuaggauaaugauuguucuuuuagucuguuggauuguuuguuucuaagguuauuuuuuccucuagcaaauguuccuacacugcuauggguuuuuuuaguccuucuaucugcuuuucauaauuuuacucucuuuuuccuuguggcugaucaucauaagauccuccucagggccgggcgugguggcucaugccuguaaucccagcacuuugggaggccgagacgggcggaucacgaggucaagagauugagacaguccuggccaacauggugagacccugucucuacuaaaaauacaaaaauuagcugggcaugguggcucgugccuguaaucccagcuacuugggagguugagguaggagaauaacuugaaccugggaggcggagguugcagugagcugagaucgcgccauugcacuccagccugggugacaagagcgaaacuccgucucaaaaaaaaaaaaaaagaaccuccuugggucucuuaugugguaacuuaugucaguacauuaauguaggaaguuagcaaaaacugcugaaacuucauaaaaauaauauuuaugcacauuaauuucauacagagaaaggcacagcacagcaacacuauaguaaaucaguaagagcugaacuaauguugcauuuuauucccucaagucacuguagugccuagcucugacuuccuucuggauugaccauucuugucaugggcuaugcuuuguguuuguauuucagucuuagccauguaaggguuuggguccaaaauaugaucuuguuaauguaauaaaacguaacaaaaaaacauuguguugcauuucuauauuacuguucuaauuuccugggaaaccucaugaaagucauuguuaaaauuguuucaccauuuccuuuccucaccucaaugauuuugccaauuuuagaaaggggaaggguuguuuagaaauuaauauauugaaaccacuaugugcaaggccccauuuuuggcucuuuacauuguuaguuuuaaaagcaaaccuggcggcagguaguaaaaauuuccccagguuucagaugaauagccugcuucagaacucgcagcuacuggcaguagugucagauuccugggaacauauuuagucuccuauugagugaaugccucuaucuuuaguaauuaccacauggagaggcaguauaggguaauaguuaaggaagagcaugggcucuggaacgaguuggcuucaguucaaaucccagccuugcuacuugcuaacugugugacccugggcaaguuacauaacuucccuguaccucauuuuucuaaucuguaaaauguagaugauaauaccacagaccuagggcacuaggguuauuguguggguuaaaugaauugauacacaaauggcauuuggaacagugccuggcauaaaguaaacacucaauagauguuguauauuauuauuaucguuacuauuauucuuauuacuacucuuucgaauguuauauauccacauguguguggaaaugaauauggcuuggacuuuaagaauaaaauuuuagcaauaagcuauaaguagucuaaagauaguuuaaucaguuuuauucauacaaaaguuuacaguuauaggcuuagugcaagucacugauaaaauacagacuggauuauuuucaguauaacugggguacauauuaucagacuuuuuuuuuucaaaauggacuccagguuuaccucccuuuuggcucuuuguuggauaccccaucuugccauaccccagucaugccaugccucuugaucugaauagauagggaauuuuauauauuuuauacauuucauuuuaguaaauuguguauaaucuauaauaugauauguuauuuguuuuuaaauguuugggccauaagcccuagccaaaagcacacuuaacuuuuuuuuuuuuuuaguuuugcuacagacgguacguauuuuauaaucaguuauuuaaacuuuuuuuuuuagaaggaaugucuuguuccucuuuguggugaagaagaaaauucuguccauaucuuagaugaaaaguuaucagacaauuuucaagauucagaacagcuaguagagaagauaugguaucguguaauagaugauagcuugguuguuggagugaaaacuacaucuucuuugaagcuguaaguaaauuccaacaugauaacacugucuugaugcuccagaacaguacuguccaauagaaauuaauguaagccacgugcaauuuuaaauguucuagaggccauauuuaaaaauguaaauagaagcaagggaaauuauuauuacuguuuuuuuugagacagagucucacucuguugcccaggauggagugcagugggaugaucucggcucacugcaaccuccaccuccugggaucaagcaauucuuaugccucagcauccccaguagcugggauuacaggcacgcaccaucaugcccggcuaguuuuuguauuuuuaguagacacggaguuuugccguguuggccagguuggucucaaacuccugaccucaagugauccacccaccuuggccucccaaaaugcugggacuacaggcaugagccaccaugccuggccauuuuaaugauauguuuuauuuaacccaauauauccaaaacauuauuuuaacauguaauuaguauaaaaauuauuaauaagauauuuugcauuuauuuuuucauacaaaguuuuaaaaauuugguguguauuuuacauguauaacacaucacaauuccaacuagccacauuucuagugcuuaauagccacauguaucuaauagcuacucucuuggccagcacagcucuagaaguaucucuuuuacacaaaugcauugaguuaauaauaugaagaggaugagguuuaugaaauuaagaugcuauagucucacggugaagauaaucaaacagcauacagaacuuucuaaucaaaauauuuagagguauuagggauacuuagagacuauugaccaaagugaauagguaaaaauuucguuaaauaacaaaguaucucucccucugauaacagacgauauucucuuuugggauguugaaaucauggauagagaaguauugugcaugccaucuauaucugcagucuaacaaagagcuuuuuagccaaaacaggcuaaauacaggcauuacaguaacuacauugaauuugaaccacggguacgcagagaaaccagguagugccuuguaauaggugauggcaguauauuugagcagcuuaacacaguaagggagccagacuacuuaucuaguggguuugagauauggauuuauuguuuuguuucagugaauuucuaagcuguuuugggcugguugaucaucuggguuuuucuucucucuucuuuaaugugguacucuauauuaaucaauuuugucuuauaaaaucagucuugcauucuugugauaaacaguuugucacuggauuugguuugcuauccuuuggucaagaauauuugcaucuaaauucaugagugaaauuggcuugaaauuuucuugaaugauacuugccugauuuuaguaucaaggcuauacuaguuuauaaaugaauugaggaauauuuccuuuuuuccuguucucuggagcaguuuguguaaauuuggaauuaccuauugcgggaucuggccagcagcccgcaaugcaacggggcucucucuuuguuccuaggcagaucggcagguugagaaauaacacacacacacaagauagugaaagcuggguccgggggggucacugcuuucuggucccacacugccaacaaugcacuggauauaccagcauuuauuauuaagguuagugagggcggggguagguuagugagggauuuagggucguuugauuaugaggugagauggucacguggggaugaaguaauucuuuaacauaacauuuguauguagaaguacaguacauuuuuguauguagaaguacaguauacagagauaagaauuuacaauauagugugugugucaguaauuucuaacagagccuuaaaacagaaacacaaucuuucgauaaccuaugauuagcaagauauuaaucagcaguaacaauugcaacaaaagcugguuacuaacaauccauggaaacaggacgugaagcuagacaaccgguuagaccagaaauucucagaagggaguaugccuuaacccuaaagaggccuagaagagccguggcaagaugaggguguuuauagcccuaucuuauccauauggacaggcgcccccugugcguccauuuauaggcucucuacaagggucgcauuccauucccagagcuaugaacaucugcuuuucugggauaggaaucuuggugaugugaaaccucccugacugcacguccauucauaggcucucuggagggggaagcacaucacgcgcuguuggcucguucuggcaguccaaccuggcauugucuuuaugcaauccugcaugcaauuuuguauuuacaauaaucaggagcauuucaucuuuuauuccauagcaauaguuucagggggucucccuacaauuaccuacucuuugauauuugguuguagucgccuggaaugcaguagaaaucuggcauuucuuugugaggugacuuuuaacuacugauucaauuucuuuaauaguuacaggauuauucacauuuuuauuuauucuugaauacauuuugcuuauauuuuucuauuaauuauuacauuuauuagcauaaguuguuccuaagauccucuuuagauauuuaucacuguguuguuaguguuugucagugucuuuuuauuccaaaucuuauuugugucuucuuuuuccuugaucuugccagaguuucauccauuuuauuagaucuuuucaaauaauuaaauuuuuuguugaucuucaauuguguauucccuguucauuucugaucccuuauuauuuccuuuuacuuuauuuggauguauucuguuauucuuuuucuaaauauuugacaaugacaugauuaagugcagauuucuuuuuuuuuuuuuccuccuuuagauuguugagcuuccucaaacuguuuuguuuucuucuggcaauucaaacaauucuuaguucuuaauucucaagauacugaugcuuccuuacuuucucuaguaucugucuccuucuggaacuucaguuaguccucuguuagaucuucucauuccauacucuaugucucaacaucucuuucauauuuucuauucaccuggauaauuucuucugaucuauauucuuuucacuaauuuuaucuucaguucuuucuagucagcuauuuaauccagucauugaguuucuaaguuuuauuauuauuuguauuaucauaaauuuuauucuuucuuuuuuagaucugccugguaauuuuuuauucucuauuuucugucuuuucuuuuuuucauaugcuaaauagaauuacuuaaaaauguuuuuauauauagaacauuugaaacauacaaggagaauaguguggugaacucuucugcccgucacucugcuccaguaauuaucaacucauugcuaaucuuguuucaucuauaccuccaugcacuccucacccccaucccccagauuauuuugaagcacucaaaggcauuauauuauuucaucuguaacaauuccaguguauguaucuaaaaaauaagaacuuauauaauuacccccccaaaauuaucaguaauucccccaguaaauggucaaauuucccauuucugaauuuaaaaauauuuuuucaaaucgugagccagauaaggacuguaaauuggacuugacuguuaucucuaaguccuuuguaaucuguagguauccuuuuucugucuuuuuuuuuuuucaugcaaaguauauuuuauagaagccaggcaguuuacccugugaaguucuauagacuggauuuugcugauuacuuccugugauauugcuuaacauguuucucugucuccuguauuuccucuaaauugaugguuagaucuagagacugggucagaauaaugccugaauuuuuguuaacagaauacuuaauaguauuguuuucuuccacugggagguauguaaagugugaucaguuucauuuugugauauuagcagcuauugaugcucauuacuuaguuccauuguuucauuagauuuuauaacauggugguauucuaauucuauuacugcuucuuuauuuauuagcuggaauacuucuauaaagagaaaccucuucucaucaauuauuuaguuagacccucaaguauaguuuguaauuuagaaaucagaauuugagugcaagaggugcuuauuuauccucaguggguuguuguuucugggccuuuuuaguaagcagagguaggaaauauguguuuuguuaguuuggucuguugugguuuugguaaguccaugcugauacguccaauucagauuaaggacuucagguuuuuacuuaucaccaugauguaaaaacuucaagguuuuuacuuaacaucaugauguaucuucuuucuguaucuucugucuccgcuauugauaaucccaauucucuguugcaccuacuacauaauuacucuacaguauauauguaguguucauaaaacagcauucccaacaaaacaauaguucaauuagugcaaauuaagauuuuugaguucuuuuuaaaucuuuaguguaacucauuagacauauggucaaauuccuguauuaaaggaguuuucaguauuaaauuucuacauucaaguucuuucuuuggucaugucaccauucuuaccuguuuuacuugauaaacuuugacaaugcuggaaugugcuacaguaagccuguauauauuuguaaauuauuauaaauguagauauggaaagaauugcugagggaugaacaauauucugacugaaaaagauuuuauucaagucguuuagaggaacgaaaaauacaauuuuuaguuuagagcuguuugcauucuaacguaucaccaaaauaaacucuuaaaaaauaaugaggagguuuuuucuuguuuaaaaagaggagaaaaaaaagaccaaccugaaagauaaaauccuggcauuauuuugccauuccuuuaucuuaaaaaaauuuuugucuuacuuuaauuucucuuacuaucauuccuaauaccauuccucuaucuuaaaaauuuuacuuuccuaaaaccuagcauaguuacaguguuuuugcuugccuuuugagaagugcuaucacaggaccuuuaaaaauguguuuggcuuuuacucuuaacuuuuugauauauuuuacauuugaaaugauguuuucuaggaaaggaaagaauaaacauuuuuuacuguuguuuguaugacauuuaaucaucaauuugauuuuaaagaaugagcuuuuagauuaaaccaaagucuggguuuuuuacaggucccugaaugaugugacuuuaucauuguuaauggaucaagcccaugacuccagauuucggcuucuaaagugucaaaauagggugauuaaguugaguacaaauccuuucccagcaccauacuugaugccaugugaaauaggauuggaagcaaaaagggucacguugaccccugauagcaagaaagaggaaagcuuuguuugugaacacccaucuaagaaagaguguguacagauaauuacugcuguaacaucucuuucaccacuuuuaacauucaguaaauuuuguugcacuguacugcuacaaauuauggagagagaaagugguaacuguccuaaagaucguuauguuguguguggcagaguuuuuuuaagucuagaagaucuuucaacugggaaguaccuacugacauuuccaaagaagaaaccuauagguaauuuuguuggcacuuuuagauuauauauuuaauugaauuagaaaauuuuaagaauucuguuuaucugauaaugggcagaguuuaaugauagagcuugugacuuuuuuuguagagcacauggaagaucuuuuugcacuucuugcagcauuccauaaaucuuguuuucaaaucacaucacccggcuaugcccugaauucaaugaagguguggcucuuagaacauaugaaaugugaaauaaucaaagaauuuccagaaguguacuuuugugaaagaccgggaaguuucuaugggacacucuucacuuggaaacagagaacaccauucgaagggauuuuaauaaucuauuccagguaaugcauauuaaauuguaauugguccagagaagugaguguguaugagugugaucaaugugugguucaacagcgauccgcauguguuuuguauuauugccauggcaauaauacagagccauggccuagcaugaaugaacgcaucggcuucauuuagaaacugaagaucucuguuuuaauuuuauauuuguuuuuggcuuuuuuuagugccuaguaauuauuuugagauuucccguuaccucuccuccacaguaaaauuuaaaaaaauauuauauugaccuuauuacucagcaaaaaaaauuuuaauuggaaacaaucugauuaauauuaacugauucgauauggaauauguauauuugauugcuguagucugaauuuuaucaaugcucacguacauaauugguucuguuuaucauuaugguguuuauaaaugaauauuaauugauuacugcaguauauuguacaugacugcuuugugcuguccuaauuuuuguaauauuuuguuuguuuuuuuauuuuaggaaucaaacaguuauguuccagugccuucauaaucucaucagaauucucccuauaaacuguuuccucaaaaaucuaaaaucaggaagugagaauuuccuaauugauaauauggcauuuacuuuggagaaggaacuagucacccuuaguucucuuucuucugccauagcuaaacaugaaagcaauuuuaugcagaggugugaagugagcaaaggaaagaguagugucgucgcggcugcuuuaucagacagaagggaaaauauccaucccuacagaaaagaacuucagagagaaaagaagaaaauguugcaaacgaaccuaaaagugaguggugcccuuuacagagaaauaacuuugaaaguagcugagguucaguugaaaucagacuuugcugcacagaaacugaguaauuuauaauuauaauuucaauuugaucauauuuuaaaauauguuuucaccaccauauaagauuuugguucuacuugcuaua

SEQ ID NO: 19230 - RNA, 21886 nt, Homo sapiens
ucccccacucccccucugucucuccaaggaaaacuaggccccugcgcggccaacgcccaggauccgcaagcugcgcgcccacgaggugacuucggggacggcuggguuuccuuuggggagugagggaggagcuuagacgccccgggcccuggcuucuucugaugcgcagagagccgaggucuuggacgucacguugcucucauaauuaucuuaaucccgcgacaaaagguggggccggaggcccaugagauuccuaaaucauugcagguuaauugugagaggggaccagucccagaggcucucagcucugcagugcuuccgaaucacuggacgacucuuuaagaauucugauccccgggcccccaucccggaccaaugaaaucagaaucucuaauaguggggcccuggcaucgguaguuuuuaaagcugcccaggugauucuggggugccgagaaccaccguguuaaggucuguaggugaauucggauuuugcccauccaguccaguaucugaauagaagaucgcccaggacagccacauacuugaaggaugucuaggauauugcccucucugcucaaaaauucggguuucuuucuuuucucuugcacuuuaaccucugcaggaggucagcuuuuggugggaguuaucuugagacaucuggcgccuacaguuuaugggccuugugucucugcccacuuaucaguaaugagcuguaauugaaccaguggccaacgaagugcauuuuagcucugaaaucuugauguucccuuaguacagaucagaugguucugaacaauuuuauuuuuuucaggaaugauguuuuuaaacucguuugacaggcuaggcuguguauucagcuguucuucaucucaaaucagaacaauauuacuuaaaaaaucuagacuaaagauuaguaacgcaacacuucuaggauuauuuaugcucacagcccccaugaauuguaggaugagagcuacccuuuaaaaauacuauuuuugcuagcauaauuuaucggaauaacagucucuuuguaauuucaaugugaacagaaaccauauauuuuuaaagacugcugguuaguaacuuggaauaagcauaacugaaagcaaguucacagguguauaaauccccucuguguguucauugcugugcuggggaaguauacaaacuaaaguuccagagagaaauguucauucugaaacuguucuauagauggugauuaaucauuuuggguuuuuuuuuaaaggauagggugagaugagaaugacgggggaaaguuuugaacaguuaaggcuagaguguaaauuggagaguuugcaaaguagguacagaacuuuuuuugaacaacuucucuacaagaggaaauucagccacggaacagcuggacaagugaaaaaagaauguaguugaucaaauaucagaugaauugaaaagaucuuugaaaacauaauguauuuaaauauuugcuuccugaaaagauuuggugcuuuauagucaguuuuuugaguuacuagguccucagagauuuuggggaguagaugcaggaggagagaacguuaucaggaaacaacagacaagcucaacaauuucagcagcaucuaagagcaugaaauauuagcuauuauuuuuaugcuggaaggaaaauaggaaacuuaaaaggaguagauuguagaauccaugccuacagguaacugaguaagugcccaaguaaaugaggcauagugagugccuauaaauucagaaaagagagauuaacauggaauuaccgugaauauguuuauagaaaaaaguaaauuugaaauaagacgccugaaauguacuagcgaucuuaacuacuuuaaacuagccaugguuuuugcuguuaugcucuuaauuugcagaaccugccuauucaacccuuauuaccuuauggucacacuagguuuugcuuaugaaggacaugcuugcugugaaacaaacuuaucuguuuccucuuuugaacuauguuaucauuaugucauucucagucaucccauugcuuguuguguuccugagucagaggguaacuuuguuccuggccucauauuucacuuuugauucugauauuagucacaaggggauucagagaacuugcaaauaaacccauucacaaauucaucacacuugcugacaaauuaaacaaugcccuucuguggguggaaugucauuuguaugaaaaaaagaauuguuaacugcauccuuucagccuuacuccuuccccaugcuaugccuucuuugugacaguacuuauuacaacauccagaagaggguaaauugggguuggggauugagggaaugaaaagaaaauaaaacucaguuuuuuggcucccuugccuaucaguuuuaacuguagcuauuauagacggggagaugcaggcuuucugaacacaguggcaugugcacuugaguaggccuguguccugcccaagauggagcuuggaugucugcagguggaagaaggccauuuggacuugagccaucuuugauguccaaaucacuaagcagggaccaugcaaagacacaggagggaggccaugagggcaucaagccagaugagcuugccagccucagcaaccagccagggaugggggcagggcugcccaaguagguggggcaggaagcccagcccucaacaaaacccuauuauauucuuugucuuagugaggaaguucuuacuguuguguguauuauuggaagacaucuucugugauaggguuauuauugcauguacagagagauuccuuggaaccgcauaugacucaaucuaucucacucagauuucucaccauaccuucacuuauuuugcugcaguguccagcagaucuccuugaaacaguguguacugaagaccuaacuaaauccuccaaauuaccugguugguucagagaaccaaaucacuggagcuuuguagggaagguuugacuuucagggcuuuagccagaguaacuuauuuaaugauuggcuuuuaauguguuucugugcaaagaucaaagcaggugaauuuucauguauuuuuagaauucuaguagaaaaggaagauaggaaaaucuaguucaaguauacauucuaguuuuuaggggaauuuguguuuuuauuuuacuuuuuugguugcuacgauuuguccuauauucuauauuuauaagaacauaaauauguaauuaaaagaauauauuugauggcacuaccugucaacaaagccacuuauuugugaaauuuuuugguaacuugauggaaauagucacauuuuauccauugaaaacuacaaagcucuuaucuauuguucuuuguguauauuuaugcauuaaaaauagauccugcaggaugagcagauguacugaaguguaaauccguuuuuuaagagaggcuauauggaaaaauauaucauucaagacucagucucugccuugccuauaggccucgucaguguuuagugaaugaccucaacccuguuuuuuuccuuccuucuuuggugguugaggacagacaaugaauggucucuguacucgccugggcucagcugggugguggccauuaugccauugugcucacuggagagggcugccggguuuguagagcugcggaucccggccuucccugacauugccaaucucuuuucuuucagcuccaccagcccauuggagaaaaguuacuguucagucccugaaggcuugugccauaaaagagugggagacauucccagggaggugaggaaugaaagaucgaauuaaagaccauuaaagaccaaagggcaucuaaaucugcagcaaccaucagcucucuuuucuuugagagguaguagucucugaagguguugcuguaaugucuauaauuauuuagauguuggcuuuucagaaacccaggcauucuuauuagcuccuuaaguucuccaugcgugaagaaaauaaccagcuuaaaaaagcuaaucggaccuaucucuagaagaggaccucuucuucccuugggagcuaacugauauuaacugacuaacugauugcuuagcaggaaagaauauauauucuuuccagggaauagagauucagagcucuguccuguuugcuuucuaagcccugcugauugauaugguuuugcagaauuuuuauuguuauuuuuaguuaagucuuuaaauguuuauauggauauuuaagaaaagauccaauuuccuuauuuagucauggagaguguuuuuuugucccacauauuagcaaccggucaacaugauugcuauuggucauagucaguuuucuugccuccacuagucuuucuccaaaccuaaucauuuaugaaacgugugagaaucgugaaguucgucuacugauucccaaguggaaacugaggaacaauuaggaugcucaguauauucagagagaaucuauacaacuucaaaauguguuaacaugaaacaggggugggcaaaauaaaagcccacagccuguuuuuuguacuucaggaagcuaagaauuguuuuuacauuuuuaaaggguuguuugguguguguuuuuuuuuuuuuuaaagcaaagaacgugaagacuaugcgacaaagacuguauguggcccacaagccuaaaauauuuaucucgcccuuuacugaaaaaaaauugcuggcauaaaguaauaauacuggaaagaccuagcuaaaaauaauuauaaagcucuaugcaaguugcuauuccuuuaaacauguuuuucuaugccuuauuugacuuuugagagacgaauguguaauucuucaagucaauuauucaaauugguuaauuugaauauaggauuuuaggaaucuuaaaaagacuuaaaauguaaaaggcuauuacaaguacaaguacauuuugggauuuagggagagaaaauaauaaagccaagagugagaugagcacagucuacauacagccucaggacuuuaaacuugauggaagauggcagcaaguuugauuauaaaugucccaguggucaaaacugugaggaaagcauaaucaaagcaaagcaaaauugccuacagaguuucuugcacuccaucauuaacauaaauucauccuuucauaauguccugggucuuaagagucuagcaccuuagcugaugaauuaauauauuuaauuaauguagauagugggcacucugggcuuauucugaacugccucugguucagaagcuggaacuggcuuucuucagucaucucaaaugauucucuuggcuucuuucuugcauaagugcucaggauguaccugggugaucucugaggccuucuaacauagcagcccuucuaccagaugauuuguuggaucaaaguuaccucuccucaaacuagugcucccucccucuucuuuuuuuuuuuguuuuuguuuuuguuuuugagacugagucucacucugucacucaggcuggagugcaguggcacgaucucagcucacugcaaccuccacuuccuggguucaagcaauucuugugccucagccucccaaguagcugggauuacagaugugcgccaccagacccagcuaauuuuuguauuuuuaguagacaugggguuucaccauguuggccaggcuggucuugaacuccugaccucgggugauccacccaccucggccucccaaagugcugggauuauaggcgugagccacagugucuggccccucccucuaaaucacagccauugacauuugagcagccuggagaacaucaucaauuacccuugaacuccuuaaaaugguagucuacuuuaucucacaugccuaaacuuccagcuuugcaaaauggagccucucuuagccaucugguggauuuucagaauauuggugcuacaaccuuuaauaccacacuggauuuucccaauuauaacuaaaaacaagauuuugucuauaguaguguuugaucucaaugguguuuauuccauauuugaggcuaucacacuucccaguuuggaauaauugauauuuuaguugaccugguucuaaaugccuuaugaugcguagaaagaagucuggauucaaaacacuuaauuuccagaacacaugcagaugucuccuagacuuuucuaauuuaauuccugugcugcuuguuaaucuauaaaacaaauuugauuaagauacacaugcaguuugcguuaaugucauuaugugcugcaggcucucagaaaauuauucagauuuuagugauaaaaauauaaaaccugggccgggcacgguggcucacgccuguaaucccagcacuuugggaggccgaggcgggcggaucaugaggucaggaguuucgaccagccuggccaacauagugaaaccccaucucuacuaaaaauacaaaaauuagccaggcauggugccacgcgccuguaaucccagcuacucgggaggcugaggcaggagaaucgcuugaaccugggaggcggagguugcagggagcagagaucaugccauugcacuccagccugggugacagugugagacuucgucucaaaaaaaaaaaaaaaggaauauaaaaccugguucuagugaauuagccacuuaaaggcugcaccuuacaguuuugcucuuaaguacauacuaauuucuacauaauuucaaguauguuuuauuucucugagugguaagccaccuaaguauuaacuuuuauauuucuucaguggcccggaaagcacauagcaguuagcuagguuuucagguacuuguucauguuuuaaaccuuuaaaacauuaaaauuauagauuaaugugaacuuaauuuacacugcauuuguuaacuuuuucaguuuauauucguugcauguaugcauaguauugaauuuaagacaaggaacaggaacuaugggcuauguuuaagauaaauuuacagaagguuaugucagcccucuuagaaauacccuauuugaaaguuuauuauauucaaaaagaaugugaaugauucucuuucagcuaaaucuuaaaauauagaagugguugauuuagcaucucaguucuuaauauaaccauagcaaaacaucugauagagauuauaaaacaaguaaaguuuguuucuuaaggguuggggaauguuuuaauucuacccuauaguuaagugaaaaggaaaaauaagacugcuuugguaucugauuuccaaaguuucaaaaccuaaguaguuguuugcucagcauuacauuguguuagugguuuugucucacagaaacuuaaauuaucaugcauuuuuggauauuuuuguuuaacuuuuuaaaaguacauucugguguagcucugaaccucugaauagaaaaaaaaaaagucuauuuuaaauagauugaaaaagcuacagcugcagauuagccauuacuuuuggguauuucaugcaucgaaucagcaaaucacaacagguggguagagagaaaaggaguaaaucucagcagagcaaugcuauuugccagaggcagucuaucuggugccucaguagagacuccauggaguguuuuuuucuccugugaagagacagggugguuaggcaaggagagugugaugucacaugcuggcugagaaaugcauauugcaaucaaaaugaaaacaaagcccauuuggggaacuuaaagcccagggcacaacugaggcuggagagaugucuuauucuccaagucccaaaccuaaggcaagacccaacagagguuucuggucauuuggaaagauguguuccccucaagccucaggaagacccaggguuaauuuaaguaagcauuagcaugaguuaaggauuaguaaauaaaguaauaacuauaaauuuuuaguucauguuuuguauauuguguguguguguauauauauauacacacacacacauauauauacacauuauauauacauguguauauauacauguguauacauacauauauguguauauauacauuauauauacacacauauauauguguauacauacauauacauauauauguguguauacauuauacauuauacauauacauuaucugggacuuggagaauaagacaucucuccagccucaguauauauaucaguauauauauacuauauauauauauauauauauauauauauacacacacauuaacuacuaaauauuuauauggucauuuucauagacuuuacuuccuauagggaaauaaguaauugaaccaugcaggaucuuuugacccacuuaaucaaaccuaaguggaucccuccuuuucagaccacaaaguuauagcccaggaaccaacgucauauagauagguugcaugaaaucaggcaugguccugggaagaggcaguuccuugggagcugccucacaaaccauagaauagccacaaauaucacacagccauacugaucagacguuugcacugugauucuucuuuccuaguuucagcacccauuuggacuuucacaaucagagauggcagcgguaaagguaagauuuuuauuuuuuuauuuuuuuuuugagcucguaaguaaaaaagguaaacuuuagucuuuuuuuuuauacuuuaaguuuuaggguacaugcgcacaacgggcagguuaguuacauauguauacaugugccauguuggugugcugcacccauuaacucgucauuuaacauuagguauaucuccuaaugcuaucccuccccccuccccccaccccacaacagucccuggugugugauguuccccuuccuguguccauguguucucauuguucaauucccaccugugagugagaacaugcggaguuugguuuuuuguccuugcgauaguuugcugguaaauuuuagucuuuaaaguuugguauucucauugcacgauggagaagaccuaagaaauacaaaaguaaaagcacuauugggugcauuccuagacaucucuuaccccaggcauuuagggguggcucaggccagcaaguuaguuuagggggcagaaagggaaaaacuaaagucugucaugcuugucagucuagugugguucuuagcaggccguugcucaguuggcaguagucauuuaauuacaguggguagagagggcuaaggugauaaacauccagucuucucucucccugcgucucaucuagaaacgaucacuagccuucauccccacauuauaaugcuccauagcuuuaauuggcuggcuugugcauaccuuauguacauggacuuagcaagugugcauacacuugguguccacugugggccuggaccuaucucacacaauauuuugggcccaguagccuccucauguagguagguauuuagcaaauacuaaguaaauaccuguuggguagcagauuaaacauuugaagauuucucuugaggauaauaaacacuuugguguccacccuccaccuccuuucauuuuguaggcaucaacaucgaaagcuaccaggccuugguauucucauccgguauaugcaagauacuggcaacauuaucaucaagcaauggcuuggaugcaaagccaucacaaugccuacaggaaggccguggaauccuguuucaaucuuccaugguacuuaccuucugcgcuucuuccccaaagcucuuacgauaaugaggcugcguauccucaguccuucuaugaccaucauguggccuggcaggacuaccccugcaguucuucacauuucagaagaucugggcagcauccacguuacagcaguaggauccaggcauccacaaaagaagaccaagcuuuguccaaagaggaagagauggagacugagucagaugcagagguagaaugugaccugagcaauauggaaaucacugaagagcuccgccaguacuuugcagagaccgagaggcauagagaagaacgacguaaguucaggccucugucucuucaugcuuccuuuccuugcccugccuuuuacauuuuuuuucucuaauauauaaaguaauuuuauaauucuucauuggcuaggguaauauuccaaauccaguccuaagccuggaaaagcuauggggaugcuguaccuugcuuauguuaguuucuggaguuguuuuaguauaagacauuuuuuuguuccagaacaaagcuuauccuaauaguaguucuacuauuuauuaaccauuagacacucuaccaaauggaguguguaugcaugcaugcuugugugugugcgugcucugaucuacacagcagucccucagaguauuaaacucauuuuauauaugaggaaagugaaccuuaaaaagguuaauugacuuguuccgugguacacaacuaguaauuugcuguuaggauccaaaccaaaucugccuaccucuacuuccuguacugcuuucuguauacuaggacuugucccugagacugcuagguuccuaaaauacuuuugccauuccucugggacacaucuuggagauguccuuggugcuagaggucccaaaucuuaaauagcaugaaccuaaacagaguaacgaaaugccuggcacuuacaacuuuccuguugguucugcauugaggcccuguccauggggucagagaauuaugauaaaggucuuauaucuucagucaaaaacaggaauuuucuuuuuaaauuucuuaccaccuuacuagaaagaacuagaacagcuuuugugcucuccuauuaaaauucaccagaccauuucuaaguaccucuaacugagauacaaaugcuucuuucccuauuauaaccaguauucauucucaauuuuguuuuaagugaggccuaauuguaugacauuuuaccuacaauuuuccaaugacacagaagcguagaaaccugggaaugggaguuucauuccugucugucauugucagcauuuuccuaaugaugaauuagcuuuuauugauccccacuggaugccaagaacugagcacugggcuuuguauaaaauauuauauccuuuaguaucuucguccgugauucuucacuaaacuacuuguucagauuuuuuugacuuccuuucuuuuguuuaaacuguguacuucuuuaagcauauuagaaaguauauccagccaggugugguggcucacaccuguagucccagcaacucgggaggauggcuugagcccaggaguuugaggcugcagugagccacgaucacaccacuguacuccagccugggugacagagcgagacccuggcucaaaaaaaaaaaaaaaaagaaaagaaaagaaagaaaagaaaaagaaaagaaagaaagaaguauauccaaacaaauacuuuuaagacaguacuuucuauuacacacagaauacuuuugcuugaucuccagaaauaaauuuuacccuuuuuaaaaauauagauacgaaacaaccauuagucuaauauauacaacaaaugagaagcauuggagcauguccauguuuggguuggaaugcuguuuguuacagcuuuugacagagaaaaugggauggagaucgaguuuauuacucuuguccuuaccagaaaguagaauaacauguuuugcccacuagagguugauacuuuuaugauggaaauuguaauuauggauggaagcaaaucccagucaucucaaaggugacuuugaauuaucugcugguuuaaaauaaacuugaguuagucaauaaaaaguggauaugaauaaaauaaagauaaaacaaugaaauguguccuugcaccaaagaaaaaaugugaacgguucaguuacagauauuguuaacaaccaucccuauuccucccucuugccauuguuagguagaacucuagguagguaaacaaaaucaugaaaauuaccugcuaagucauacuugccacuuaauauuauuuugagugaauaaaugaagucuuucagugugaauuagaagccuuaaaucagagguuggcaaaucuuacccauagagugcuacacuugcagugauucugugggacauuuuacagaaugagcuaggccuugugugcauuauaaacuugauaagcuucaucucuguguuucauauuauuuccaaaucugucuaguuacuuuacggcuccaaauugcacuuucaucaucuggguugaauuguaucuccccaagaaagauacaguggaauccuaacccccaguuccucagaaugugaccuuauuuaaagacagggucuuuccagagguaauugagguuaagugaggucauuacagggauccuaauccuaugugacucagguccuuauaaaaagggcaaaauccggacacagagacagacacacaugcagugaaaacaccaugugaagauugacauuaugucgccacaauccaaggaacauccagaaggugggagaggccuggaacagauccuucccuagcaccuuuagaggguuuauggcccugccaacaccucgauugcagacuucugaccuccagagccaugagacaauacauuucuguuguuuuaaaccacccaguauaugguacuuuguuauggcagcccuaggaaaggaguacaaucacccugggagaauuuucuuuguccccaaaugcaaucugugacugggacauaaaguaaacccacaguucuugucaucugucugaaaaaacuguauuacuuauuuguuuuacugugaucuagauagcaaaccaucauaaaagggaauuuuaugaaaacccuugcaacuuccaucuugaaccucauuuuccaguauucauauuauugcuggcaacaguguauggaggcagcuguggcagaacugcuugaaucacagagguccagccucacucuaccacucgcugauuagagguucucguccuccuguaagcccccugccuucaccauucuuugccucaguugccucaccuaugaaauaggauccuaauuaguggguaguaauuaugaagaaucccuaauggguaguaauugugaagaauccaugagauaauaugagaaaaguuauagaauggugcuugguaccaaguuggugcccaauaaauguuauuguuacaguuaguugcuaguaacccauccuuuaacauggauuauuaaccauaaauugguuuuucucugauaccguuugccuugauuagugcuugauugagauucuguacauauauauauauauauauauauauauuuuuuuuuuuuuuuuuuuuuuugagacagauucuuacucugucacccaggcuagaguacaguggcgccaucucagcucacuacaaccuaugccucccggguucaagugauucuccugccucggccucccaaguagcugggauuucaggcgccaaccaccacacccagcuaauuuuuuuauuaguaguagagaugguguuucaccauguuguccagaguggucuugaacuccugaccucaggugauccaccugccucggccucccaaagugcuggauuauaggcaugagcuaccgcgcccagcuaagauucugcauauuuuuaauaagauguucugugacuucagaaaggucauauuucugcucuggguggcaccuuucaaacuuuuaaacugauuuagaauauuaaagacaugaaagaaugaaaguuuuggugucuaucaaauuuagcaauuaacacaguuuuuaguucuguuucaaggauauucuugcuugauaaaauuuaaugcaguaaaguacauggacugggaaaauuaacccacuucaauauuacuaauaaugucccuaaacaagcuuucaauucuuuguauuuuuaaaauguguaguuacagcaugauucaaaacuacuuuucuuagcgucugugucaugcuccuacagccuucccugaaugcauuagcuggucccagggagaugugagaauugucuggugagggugagaacagacuguggugucagacuggaaucuaaagacuucgucuauauuagaagcagcugccagggcccgaucuugcaccaguaagaaaauaaugggcaauagaucacuagcauuauuuuuuucagcagcacuuuuggugaguacaggaugaacaacuguucuucaagcgguaaugaaugauggaauucauauguaaguaaucugagugcccauggcgcuuuccaauucauuaccuucaccagaaauuuucauggaggguuaguuacauacacuguuggaaaaagcuuuaauaaagagauaagggaccuggguaguaugaauaauugguucaaguuuuuuguuucauuuugcucucaaaaccacuagaagcuacuuauucaauaaggacauuuucagcuuugaacaugaaugcuuugaagaacacaggauuuuagaaaauguuacuagcaagaggaaaugucacuaaauuugaaagauuuaacuuuucaguauuauucacuuccacaggaacauacaaguuaugcaauucaucaucgccugagucuuguuuaauauuuucuuaggauaaaggccuucagauuggacaguauguucuuuuuugugauugcuacucagauuccagauagucucuacuuuaacauauuucaaggauaaaaaacaccaaaagcuugacuaggauaagaacuccuuuuguacagugggaacaugcaugcuuuugauuaugucugucaucauuuccuaacaagauauuuccguuacuuaaagcuucaauggaaaauaacuuaugagaaaguuuacaguuaugaaguuuuaaaggucagcuguguuuucaauuauuucuuaggaaaaauguuuauuauuagguuaagaaaaauaccauuuuguagucauaagugaccacuggucgagacugcaagguuauauugcuaauacuuagagggaaaaugaguggaagucacccucaaaagagaguaaggcccucugaaacaaacaccaccacuguuuucucggguuugagccaaucagguauuuaugaccuauguuuugaggguguuggcucaaaacagggacauauucuaaaagcuuaaaccccauugggaagaggagacaaaaugaaauguaaagugacacauagaagaagagugucuauggugugguucaugguuauacaugcacaugagggguagagccagugacccaggcagucaaaggaggagcaccgcggggcagcugucaagaaguaagguaugcacuaggccaauuugagggauagggucaauuuggaaugagagaaaaaaggacuuaguucacucccggcuuagacacucaaagugcuguucuuaccagagagcccagaugugguuuucauaugcccagaugugguuuucauacguuugaggggagacaucugcuccauuacacuguguccaucugagugggaaggcugagacuguaguuuucauagugagccuuuagucagucaaaccuagagagaacccggugaaguuuauggcccaguauuuagugagcugucuugcuuuagucaaugagguugaaggaugaaauugcagugauugagcacaauccugacaugcguguguguuucaucuggugcagauauucacaggugcacaaaaccgaucagugagaugauacguguuaauggcuguagaaaaguggaaaggaacaugaaaaugcacuucuguuguaaaaguaaaaauggcgguuguccaguaacuucaggauuacauuugucauggggcaagggaugugcgacgaagagagaagaccagucugaaauggcuccaguucugcuggcauguaccuguguucugggugguugcugacaagccagaaaugaggcauucauggcauacaucaaguuugugcuuucccucgguugugcuacaauuauucauuuuggcaaaauagcagaaaauauaaucagaaagauguacuaguccuaggaaagugaggggaaaaaacauucuuugccacuugcugccuccaugcuuuauccucuaacauguucugccuuugggcucuauguguggaauaaucuuggaugaaaguuuuccugcuauauaagauucucugaaguccugguaacuuuccaugauuuuuuuuuuccuuuauggacuauuacgugaugugacauuggucacaucauguagacaaauagauugaugugaaaaauaccaggauuauguauccugaacccagauggaauccaguaaagcuuuuccuuaauaauacaugccuauuguucuuguuuuaaccuauaugcauauuaacccuuguauuagccucccagggcugcuguaacaaauuacacaaccuggguggauuaaaaaaaaaaaaaaaacagauuuauucucucacaguucucaaaucaagcggucaacaggaccacacgcccucugaaggcuguagggccucaccucuuccaacuucugguguuuccugguguuccuuggcuuguggcagcaucauuccaucucugccuccaucuucauguggccuuuccccugugucuguguguccuuuucugucucauacaaggacuuugucauuggaguuaggguccacccuaauccaguaugaucucaucuugauccuuuaauuacaucuacaaagcccuauuuccaaauaaggucaccuucugugguuccagguggacauggauuugaagugacacuauucaacccacuacaauccuauuuugaagcuggaauagaaucaaaaaagauuucugauucauauuaaaacaaauuaucuugccaaaauacccuauaaaaguguauggcaacauugaguccuacagcuguuuccaauaaaaaugaccaaacccuccaugacaaggcaacuguucauuggcaucugaagugugauguccguacuggucugcuuuggucagaugauuuuccaucuggcuggcugagcgcucaccuuguuuugacagcaaggaaaacugccagugauugagaauccguuuucguuggaaggaaggaaggaagcaauaaauagaaaacagaaugaguggaugccuucaaacucugauacuccauucugagguuuacuugguccccuaagucaguacacgcuaaaguacuuucacaugcuggcugugaccaucagugcacagccugucugcaguuauuugguuuuaaacugacugguuuucaacuuguagccuagccuuaggacuuuuuaaaaaauugugugaguaaguagaggcaaagcaauucgaauguaagagaacaggguccgaccccaacucauuggugcccccccccauagccccucugccugggaggcucugaggaacccacagggaagggaguucugcccagcaccuagugagauuugagcaucuguuucucaauccccgaguugucauuauuguucuuuaacagcaucuggaaggaaaagagcuguuuacaaaaaaaucaugcauggccuuugagcauucauuugacagucacuuccugagcaucugcuuugugucaggcauuguguccucucaggucuggggguacagcugugaguaaaggugacagugcccuuccaccauaaaugacccccacaggguaggucgcaggugacaggcuucuugcccuuuaguucaguguuuuagggccacuguucacuaugcaggaaaccauuaaaccuccaaaucucuugagaggcaaggaggggauaaggguugggucuuaaauuuucaugaggggccaggcacgguggcuuuacgccuguaauuccagcacuuugguaggccaaggcagguggaucgcuugaguucaggaguucaagaccagccugggcaacauggcaaaaccccaucuccaaaaaaaaaaaaaauacaaaaauuauccaggcgugguggcacacaccuguagucccagcuacucaggaaaccaaggugggaggaucgcuugagcccaggaggcagagguugcagugagccaagauugcaccacugcacuccagccugagugacagagcgaaaaaaaaaaaaaaaauucaugaggaagccugaaugggaaugaaaaacaaauaagaaucaaaagcagagggcugugucuuuuauuuuuguauucuuacaccguaugaacuuuauuaagaacuaaaaucaugugaugguaacccaugggcacacgcugaguacaaaguuggaaaauuguaccagcaucauuaacugggguugcuuuguguuaacauuguguaucauucacagaugucaacaauaagagaacacaucucucuauauauaauuguuacaaacauuuuaaauuauaaggaaaagaaaaaaaaagaugcaaaaguucaaagacuaaacucacaacauccuaccgacagagaauacuuaggauagcuaagaucucaguguucauucaaacuucuaaacucaaagacucggauuuaugcaggaaguugaacaugucuugugucaccagaucugucagugaagcugauuauagucuugggauaaauuugagaguaaugugacaguggucugggaacucugacugugggcucugcccucuggaugcagagacuccaaggcacucagcaaacccaccugugggaucgucuccuccagauagaccaaaaaaaaaaaaaaaaaaaaaaaaaaagagagccauaggauugguaauggguacaaggcugcucauagauggcagagggacuguguugugcuaauguggaaaugccaagccuucagaaaaguagcccuugaaugagagauucuuuagccaaauucuaccuuuccuggaaagccugggcagugccaucagcccacccacugccugcucaagguuccuagaaagaggcaagugggaaaggccuguaugaacuuagugacugaauauaucucaccagucuguacugcccauaccaagacccaguguccuaggucacccccgcucuuccuucuaaaagcacgaagcuaagcuuuccuucaaagucagguucaaucaucccaggacagaggcaggagaaaaacagagaugcccccagggagaagcuaguccccagcggggcuuucacccugaccugaguaccaggaacacacagaacucuugcggaaauaagaagcugucauggcgguugucgagugcuuucucuaacccacuguuuggcucauccacucccacgccacuccaacacaacucaguuuagggggcauagaauuuaaacacuugugagaacugaacaacuuauaugcugauguuucaaacuuggcagaaagaccaaaaauuagaaacaaaugcuugguggcccccauucauuugcauauuaggccaauauuuugguuucauucugcauugcccaaugaguuaaucauacauuuuuuccaugggugagguagcaguuacgcagcuuuuauuguguuugauagucauugggcuuauucauauaagcccuuagguaaaaauaaacuguggauguuccaagacagcaauggccacauacauuuuuaauaauguuuccaaguuuauaaaacuccuucccuccaaugccaugaugaugcuuauaaagagcaggauuuaugcgagcgacuaugcauggccuuauaaauaucuuuccauucacacuugauuagcucacuaccauguucuguuccauguauuaguacagggaggaccaacaauggaagaaugauuuauaugauucuuuuauuucccuacaaccaucuucacuccuuaucucgugguguuucucuugauagccauaguagccguggauauguguucccugcugucaauuucucucuugacagagucgcuuacaagagcuauggaaauuggcuaaauuuaaccuuaugcagcauugucuuacugauacuuuuauguuguugcaguuuacauaagaauaaaaauuaugauauugggacuugccauaguaaaaaacagagggaagaguaaauugaauagauacuucuugcuuuacaagaauccauuuaaauuaguaggauuaaaaguauguaaugauaccacuugcaguuuaaccuaggccaaccuaugaaguggaaagucaaaucccguagugagaaaaccaacccauuauugcagauuuuuugauauagcgggaagauuagaagucagaggccuuaauuccauuuguagaauugcccuuuccucacccuucuuccuucagcaaguguugacucauuuaacuuuuccuugcuugguaugauuugcauuucgaaucuguggaaggauaaucaaucauccaucaucauugcauacugugcuugcuagcacuuguucuuuuccagguuaccuaaaaucaauaccucuuccaaaggagugauuuuuuccccccacaucaccucauucauggugguaagcacugcucgcaacacuggacuuuccaggaagcuuuuuguuucccugcuggccuggggcaguguuugaaaccaagcaagcucuaucagccauuccuagcugggcagguggugagugggccgugcagaugaaaagagagaaccucagguggguucauuucuuuccuguguuuucagggcuuguugcagagguuugguaguuuggagugaugaguuuccuuguggcucuucaccauuucuuuuucuuuuuuuuuugacaccgggucuggcuuugucaccugggcuggaguauagugguacacugcaaucucugcccccugggcucaagccauccucccaccucagccucgcaaguaggugggacuauaggcacucaacucuuugccauuucucucaguguauaauaaccccuugguaggugaaugaugauaauaaucugcaggucuugccucaaaaucugguaagcaucucaucuggaacacuugggccugguuucacaguuggaaagggaaagaugagggaccuuagggggcugcagauggcauggccagcagcagcagcacucacugggcuccuucugcagugcacacacguguguuuauguucauguucacguucguguuuguucucagggcggcagcagcagcuggaugcagagcgccuggacagcuaugugaacgcugaccacgaccuguacugcaacacccgccggucgguagaagccccaacugagaggccuggugagcggcgccaggccgagaugaagcguuuguacggggacagugcugccaagauccaagccauggaggccgcggugcagcugagcuuugacaagcacugugaccgaaagcagcccaaguacuggccggucaucccccugaaguucugagcucagggcacaggguacccagccucuccuucuuccuuuuggguacacgcucuuuaucucuccuucuguacauuucuuagggaaaggggacuuuguacugggguacaggcauguucaccacagucccagugggccugucacgggguggauguacuaugccagccacuuggaggucugcaggacauguucuguugccaacaugauaaauuuucuccugacauaaaauaauuuugcauauacuauacugguuuuuuauguuguugguaacaguucaauucauuaacguucuugccuagagauacugccugguguuuugcuuuuuuaucuuuucuugucuuuaaccugucugaacuacacaaaugccuuuaaaaaaccagauauccucucugacucuagcuccauuagcccccacuaaaaaugagccaaguguguagugagacaaauaccacuaccuguaguggagagggaugcauguucuauaaagggccagagagugaauaucuuuggcacugcaagccacacggucaguguugugacuacucaacccucccuuuguagugugaaagcagcuguagacaguaaguaaacaaauggguguggcuguguucuaauaaaacuuuauuuauaaaaacaggcggccgggcgcaaugguucaugccuguaaucccagcacuuugggaggccgaggugggcagaucacgaggucaggagauggagaccauccuggccaacaugaugaaacccgucgcuacuaaaauacaaaaaaugagccgggcaugguggugugugccuguaaucccagcuacgugggagacugaggcaggggaauugcuugaacccaggaggcagagguugcagugagcugagaucgcgccacugcacuccaaccuagagaaagagcaagacuccgucucaaaacaaaaacaaaaacagacug

SEQ ID NO: 19231 - RNA, 22424 nt, Homo sapiens
ggccggaagcuccgccuacguaucgcgagagcacaucccaggguaucgcgagaacugcuucggcguucuggcuacagguucggggcgcgggucucuuccgcggaaacugacauugcguuuccguugucggccucccacugcagguagggaauggagcaagugcggcggggggcggguguuuugagucccuggaggacuucguagccccugcgugacgcggauguugguccuguaccuccaccccuccccgggguggccgggccggaccugccagcccuccgcuggcucauccgcgcagcccuuccaccugcagacguccgcccucucgggggcugugguuucgcgguucacugggucauucagcuaacccaggguuucuuaacggcugcacuguugccuuuuggagccggaagauucuuuguuuugggaggcuguccugugcauuguagguuuagcuguauccuugcucucuauuuugucaguaucaccuucucccccaagugugacaaccaaagaugucuccagauauugccagauguccucuuggaagcaagaucgcuccggguugagauccacagagcuaaacguuuuagaguaccaaccauugugugcugugagguaaaggugagccaguccucaugaugcuuaaauguaauuagaaaggaaaggaaccaaaccucucagaagcgauaaugaaaauguuacagccagagaauugaacaagaacuaagauacauuguagacuggauaaagaguuuaaaggggaggugguugaagauggaagugauccagaucaucucuguggaaaaagugugucuuuaucggggccuugauggguaggauucggguggugagcaaaaaggagaacaucacaggaaggggaaaaaugagcaaaggaaucauuaaaagaaaaaaaaaagccacgaccuucuugggagcagugaggaaucuagccugacuccagaguugugugcugggaauauaagccuuauaugguaucuaaguccugugaggacagaauuggaugucagcuuuguguacagcauugaagaugaguacgaugaguuuugaucucuggcugugaaaaacuuaaaguauuuaagaggcaguaagagugacaggacuucauaggagguggagaaccuguaaguuuuuguuggaaacaauggaaaaggaggagaggcuuaguuggauuuuaaaggauggguagugguugcagacagaauaaaggagaacauuccaggcaugaagagagaaaugauaguagcucugaacucgauauagucaaagugaauuugggagaaaaaauaaguaaacgagucaacgcuagcagagguggaacaauagggcugagaaaagacacguggagcaaugugggaaucuugaauacuaguacaugauccuguagcugagaugcaucaaaggcuuuugaguggaaugaugaaaacaguguucuaaaaagauguugauauguuguaaauguuguuaaguagaaucacuuguccacuguuuaaaaaaaaaaaauguuccugaagacccccuuacucccaccuccaccuuuggucccacaguugaauacaugaauauaauuagauaaaauguucuccaaaaacuagcauaacuucuaggggagggagaauugcuuauaauauuaauagaaaaaugucacauuaaagaccuaucaguaguauuccuacugccccuccucauuguaauagacaugucccaugccauaccaguuuagucucaugaccccagguuuauggaacaacugaaaucacugcucucgcgagcacagggcaguuuuucuagaagcucuucuauagagguuguaaagaggcaugcuacaaaaauggaugucuuuggaacuggaguccaugaguuuuaucuugcauuugucuacaacuuaagagacuuccaaguucacugagcauccucccacucuggcacuguugguguuccacccaccccuuaguuucuaguuucccagugacuucaaaugagcagcccugggcuuggccuauggaacgguuuggaauaagucuguguaguccagagucagcaaauacuuggcccuccuguagguacugcacuuccccaaauucauagcagacauggauaauugaucacagcauucuuuccuggugaccacauuuagucucagaaucuuucucagcgccaguuccuggcagucacuaccaguugauuagaauucgcuuaugaaaggaaacucauuugccaucccuagccaagucccuuuuucauuagauagcuuaucguauuuaaagauaguacugugcuguaccccacucccuuuccaccccaaaaaggucuccccuacuccguuuaaacauccucuguuacuucaguugcucuugucugguuuccagagcauuuccuagccuagauccugcccucccuuccccuguaacacacagaguuauugauccuuuuacaauaugauucccagaacugaguaccuuccccaaagaugauaauauuauugaagaggacaucagcauucucccugaccuugcucuuaaugccaccuagaauugauuagcuuuuuugacaaaccuaucagacuuuugccucuuacugagcuugcagaacuuuuggguugauguagaugaacuguucuuaaucuagguuucccuuguccuuuuguacaguugauuuuuaagcccaaguacagggcuugcuuucuuauccucuuaacuucuaucuuguuaauuucaccuuacucuccuagccauggagaucuuuuuuaauccuaacuucugccuucuaauaaguuagcugcccuugguguuaucuuugaaugugauaaguuaucuucauucaaguuauugauucaaauacugagcuagacuagguuaaggucaaccucaaagccuuacuagagacccugugccauaaauugacacggagcacccaauguucuccgaguauugacacucaagucggcuaugagccaucccucauucagcaaauaaugagugcuuucugggucccuggcacuguuguagcucuagguauaccauagugaaugagacgaaugguguaucugcucucauggagggcaacauucuagcaagacuguauuuucacucaggcuccaggacuccaguuuguucuuagguagauaccaaaauauuucguaaaaugacuuucuguuuaccuaccguaucucccuucagaaacaaaaaauguaaauuugguaugacuuguucuaguacaaccaggaguauaugaaugaauaaucuguuuuuaucuagggauucacauuaaaugaguuaauguauaauaaaagugccuggcauggcaucugacugaaaauaaacauuuaauacacguuucuguugguguucuagucgcucugaauguacccuguuauagacuaggagauaagccuuuuuccuguuucugaaaauaggaauagcauuuaaccuagcggaugauauggcauuuuucuugcaauuucucaaaugucacugaucagcaguuaugcaaucacauuuguuaauccaagguauauaauuugucaggaccugaugacuuggauuuauugaaaugucuagauguuuucuuuuuucuuuaguuauacuuuuaaguucuaggguacaugugcacaacaugcagguuugauacauagguauacaugugccauguugguuugcugcacccauuaacucaucauuuacauuagguauuccuccuaaugcuaucccucccccagccccccacccccugacaggccccagugugugauauucccugcccuguguccaagugaucucauuguucaauucccaccuaugagugagaacaugcaguguuugcuuuucuguccuugugauaguuugcucagaaugaugguuuccagcuucauccaugucccuacaaaggacaugaacucauccuuuuuuauggcugcauaguauuccaugguguauaugugccacauuuuccuaauccagucuaucauugauggacauuuggguucauuccaagucuuugcuauugugaauagugccacaauaaacauacgugugcuugugucuuuauaguagcaugauuuguaauccuuuggguauauacccagcaauaaguuugcugggucaaaugguauuucuaccucuagauccuugaggaaucgccacacugucuuccacaaugauugaacuaauuuacacucccaccaacaguguaaaaguguuccuauuucuccacauccucuccagcaucuguuauuuccugacuuuuuaaugauugccauucuaacuggcgugagaugguaucucuuugugguuuugauuugcauuucucuaaugaccagugaugagcauuuuuuucaugugucuguuggcugcauagaugucuucuuuugagaagucucuguucauaucuuuugcccacuuuuugaugggguuuuuuuuuuucuuauaaauuuguuugaguucuuuguagauucuggauauuagcccuucgucagauggguagauugcaaacauuuucucccauucuguagguugccuguucacucugaugguaguuucuuuugccgugcagaagcucuuuaguuuaauuagaucccaucugucuauuuuggcuuuuguugucauugcuuuugguguuuuagucaugaaguccuugcccaugccuguguccugaaugguauugccuagguuuuccucuagaguuuuuaugguuuuaggucuaacauuuaagucuuuuuuuuguuuguuuuuuguuuuuugagacgaaguuucacucuuguugcccaggcuggagugcaauggugcaaucuugacucacugcaaccuccaccucuuggauucaagcaauucuucugcuucugccucccgaguagcagggauuacaggcaugugccaccacgcccggcuaaguuuguauuuuuaguagagacgggguuucuccauguuggucaggcugaucuugaacucccuaccucaggugauaugaccaccucagccucccaaagugccgggauuacaggcuugagccaccgugcccagcccuaacauuuaagucuuuaauccaucuugaauuaauuuuuguauaagguguaaggaagggauccaguuucagguuucuacauauggcuagccaguuuucccagcaccauuuauuaaauagggaauccuuuccccauuucuuguuuuugucagguuugucaaagaucagaugguuguagaugugugguguuauuucugaggccucuguucuguuccauuggucuauauaucuguuucgguaccaguaccaugcuguuuugguuacuguagccuuguaguauaguuugaagucagguagcaugaugccuccaccuuucuucuuuuggcugaggauugucuuggcaaugugggcucuuuuuugguuccauaugaacuuuaaaguaguuuuuuucaauucugugaagaaagucauugguagcuugauggggauggcagugaaucuauaaauuacccuugggcaguauggccauuuucaugauauugauucuuccuauccaugagcauggaauguucuuccauuuguuuguauccucuuuuauuucacugagcagugguuuguaguucuccuugaagagguccuucacgucccuuguaaguuggauuccuagguauuuuauucucuuuguagcaauugugaaugggaguucacccaugcuuuggcucucugucuauuauugguguauaggaaugcuugugauuuuugcauauugauuuuguauccugcgacuuugcugaagcugcuuaucagcuuaaggagauuuuggacugagaccaugggguuuucuaaauuuacaaucaugucaucugcaaacagggacaacuugacuuccucuuuuccuaauugaauacccuuuaguucuuucucuugccugauugcccuggccagaacuuccaacacuauguugaauaggaguggugagagagggcauccuugucuugugccaguuuugaaagggaaugcuuccaguuuuugcccauucaguaugauauuggcuguggguuugucauaaauagcucuuauuauuuugagauauguucuaucaauuccuaguuuauugagaguuuuuaacaugaagggcuguugaauuuugucaaaggccuuuucugcaucuauugagauaaucauguggauuuugucguugguucuguuuaugugauggauuauguuuaucgauuugcguauguugaaccagccuugcaucccaggggugaagcugaccugaucaugguggauaagcuuuuugauguacuacuggauucgguuugccaguauuuuauugaggauuuucgcaucaauguucaucggggauauuggucuaaaauucucuuuuuuuauugugucucugcuaggcuuugguaucaggaugauguuggcuucauaaaaugaguuagggaggauucccucuuuuucuguugauuggaauaguuucagaaggaaugguaccagcuccucuuuguaccucugguagaauucggaugugaauccaucugguccuggacuuuuuuugguugguaagcuauuaauuauugccucgauuucagaaccuguuauuggucuauuuagggauucaacuucuuccugguuuagccuugggagaguguauguguccaggaauuuauccauuucuucuagauuuuccaguuuauuugcguagagguguuuauaguauucucugaugguaguuuguauuucugugggaucgguggugauauccccuuuaucauuuuuuauugcaucuaucugauucuucucuguuuucuucuuuauuagucuugcuaguggucuaucaauuuuguugaucuuuugaaaaaaccagcuccuggauucauugauuuuuuaaaggguuuuucguguguuuaucucuuucaguucugcucugaucuuaguuauuucuugucuucugcuagcuuuugaauuuguuugcucuugcuucucuaguucuuuuaauugcaauguuaggguguagauuuuaaaucuuuccugcuuucuguugugggcauuuagugcuauaaauuucccucuacacacugcuuuaaaugugucccagagauucugauacuuugugucuuuguuuucuuugguuucagagaacaucuuuauuucugccuucauuucguuauuuacccaguagucauucaggagcaaguuguucaauuuccauuuaguugagcaguuuugagugaguuuuuaaauccugaguucuaauuugauugcacuguggucugagagacaguuuuuugugauuuguguucuuuuacauuugcuggagugcuuuacuuccaauuauguagucaauuuuagaauaagugcaauguggugcugagaagaauguauauucuguugauuugggguggagaguucuguagaugucuauuagguccacuuggugcagagcugaguucaaguccuggauauccuuguuaaccugucuuguugaucugauauugacagugggguguuaaaagucucccauuauuauugugugggagucuaagucucuuuguaggucucuaaggacuugcuuuaugaaucuaggugcuccuguauugggugcauauauauuuaggauaguuagcucuucuuguugaauugaucccuuuaccauuauguaauggccuucuuugucucuuuugaucuuuguugguuuaaagucuguuuuaucagaaaccaggauugcaaccccugcuuuuuugugcuuuccauuugcuugguagaucuuccuccaucccuuuauuuugagccuaugugugucuuugcacaucagauggguuuccugaauacagcacacugaugggucuugauucuuuauccaguuugccagucugugucuuuuaauuggagcauuuaguccauuuacauuuaagguuaauauuguuaugugugaauuugauccugucauuaugauguucgcugguuauuuugccuguuaacugaugcaguuucuucauagcaucaauggucuuuuacaauuuggccuguuuuugcaguggcugguaccgguuguuucuuucuauguuuagugcuuccuucaggagcucuuguaaggcaggccugguggugacaaaaucucucaucauuuccuucucuguaaaggauuuuauuucucuuucacuuaugaagcuuaguuuggcuggauaugaaauucuggguugaaaauucuuuuaagaaugcugaauauuggcccccacucucuucuggcuuguagaguuucugcugagagaucugcuguuagucugaugggcuucccuuuguggguaacccgaccuuucucucugcugcccuuaacauuuuuuuccuucauuucaaccuuggugaaucugacaauuacgugucuugggguuccucuucucgaggaguaucuuugugguauucucuguauuugcugaauuugaauguuggccugccuugcuagguuggggaaguucuccuggauaauauccugaagaguguuuuccaacuugguuccauucuccccaucacuuucagguacaccagucaaacguagauuuggucuuuucacauagucccauauuucuuggaggcuuuguucguuucuuuuuauucuuuuuucucuaaccuuguuuucucgcuuuauuucauuaauuugaucuucaaucacugauacccuuucuucuacuugaucaaaucaguuauugaagcuuguguaugcaucaugaaguucuugugccaugguuuuuagcucccucaggucauuuaaggucuucucuacacuguuuauucuaguuagccauucgucuaaucuuuuuucaagguuuuuagcuuccuugagauggguucaaacaugcuccuuuagcucagagaaguuuguuauuaccgaccuuuugaagccucauucugucaacucaucaaagucauucuccguccagcuuuguuccauugcuggcgaggagcugcaauccuuuggaggagaagaggcacucucauuuuuagaauuuucagcuuuucuguuuugguuccuccccaucuuugugguuuuaucugccuuuggucuuugauguuggugaccuacagaugggguuuugguguagauguuguuuuuguugaugaugaugcuauuccuuucuguuuguuaguuuuccuucuaacagucaggucccucagcugcaggucuguuggaguuugcuggagguccacuccagaccccguuugccuggguaucaccagcagaggcugcagaacagcaaauauugcugccugauccuuccucuggaagcuucaucccagaggggcacccgccuauaugaggugucugucggccccuacugggaggugucucccaauuaggccauacgggggucagggacccccuugaggaggcagucuguccguucucagagcucaagcaccacguugggggagccacugcucucuucagagcugucagacagggauguuuaagucugcagaaguugucugcugccuuuuguucagcuaagcccugcccagagagguggagucuagaggcaguaggcuuugcugagcugcagcgggcucugcccaguucgagcuuccuggccacuuguuuaccuacugaagccucagcaauggcggacaccccucccccagccaggcugcugccucacaguucaaucucagacugcugcgcuagcagugagcaaggcuccgugggcgugggaccugccgagccaggcaugggagagaaucuccuugucugccgguugcuaagaccuugggaaaagcacaguauuugggugggaguaucccauuuuuccagguacagucugucauggcuucccuuggcuaggagagggaaaucccccgaccccuugcacuuucugggugaggcgacgcccugcccugcuucagcucgcccuccaugggcugcacccacuguccaaccagucccaaugagaugaaccagguaccucaguuggaaaugcagaaaucacccaucuucugcguugaucacgcugggagcugcagaccggagguguuccuauuuggccaucuuggaacggaucccuagacguuuucuuaauauaccuaucuugagguucgcagccugccuaaccuuguuucuuccaugcuugcuauuugaaaagucauuuaacagagaaaauggaaguuaaacaggucagcauccaccauuauuucaguguguagcaagcgcuugaagcaguugacccuucucccuugcuuuuuccugaucguagccuaaaaagccucuuuuuuuuuuuuuuuuuuuaaauauauauuacacacuucaacucauuguaggccuuugcccuucugaugcuagccucacugauuucuggucccguuuuuauguucauuacuaguuaguguccuacuucuuacaucuuccauguggccucuuuaaauuuaagguagucagagagcucuuuguaucaccaaguuuauuucuuuagucuucuccuucucaaaagcccagguuucccuagccacugaagacagcugcuguuuccaccacaagugagaguucuggcucucacuugagagccaaacaagaaucuguuuccuuguacuuuccagcuucugggggccuccugcauuccuuggcuguggccccuuccuucauuuucaaagcugucaagaucacauugcugugaccauucuucugucacuucccccugacuuuccucuuuugcuucccuauucuacuuuuaaggcccuugucaugacauuggguccaccuggaugauccaggacaauguuccuaucuuaaggucagcugaugagcaaccuuaauuccucuuugccgugggcccuaacauacucacaaguugcagagauuaggauguggaugucuuaggagaggggccacuguucugcuuguucaccucagcuagacauauggaaaccauccuagauucuccucuuguccucaauuucccaguuuaaucuauucccaaauucuguguagcuaccuccucaacaccucugggccaagccucucuuggagaugcuucaaaggccccuauuuaaggcgaugggaaaaucgagcagaccauacauacacagucaugucaacgcagguaauucaguaauggcaguugcuuuaucuguauuauauauuggaauucuaaguaauacuuguuuuuguuggugaagggaagguggaggaagucacagaacuuuuauaaaacguuuggaaucaggccgggcaugguggcucaugccuguaaucccagcacuuugggaggccaaggugggcagaucacuugaggccaggagugugagaccagccuggccaacacggugaauccccgucucuacuaaaaauacaaaaauuagccgggcaugguggcacaugccuauacuccuggcuacucaagaggcugaggcaggagaaucuccugaaccugggaggcggagguugcagugcgcuaagauugugccacuaguuuggaaucauugaucuagagcugugcugucuaguacuguggccacuagccacauauggcuauuuauguuuaauuaaaauucaguucuacauucucacuagccacauuuuuuuuuuuuuuuuuuugagauggagucuugcucugucaccaggcuggagugugcaguggcacgaucuuggcucacugcaagcuccgccucccggguucacaccauucuucuggcuccgccucccagguucacaccauucuucugccucagccucccgaguagcugggacuacaggugcccaccaccacacucggcuaauuuuuuguauuuuuaguagagaugggguuucaccauguuagccaggauggucucgaucuccugaccucgugauccgcccaccuuggccucccaaagugcugggauuacaggcgugagccaccgcgccuggccuacacuagccacauuucuaaugcacacuagcucacauauuggacagcacagguguagaacauuucuguccucgcagaaaguuccauagauuggacagcgcagaauccuagcgugugucuuaccuuugcuccauacccucaaguauuugcuaaguguuugcagcuguuccccucccgagacaaugaggucauuuucucccaggguuuucaguucuuccacuucaccugucaguuuuuccuuggcagaacugaaugaaaagcuacagcccuucuugcuucuucagcuguuuacaaaaucaaauaauuggcagcugaagucaagcauggaauguauauaaagaaagcucugucucaucuuuugcgcagcuggguaguugguaacagcauccucaugcagucggucuuugaguucccuuucugucuuccugcugacuuagcgccaugcugcuugcccauucguggcuuuccauauaggggugaguguggggaugcauguuaucuugcuuauacauauguguacauauauuuccuucugcugcugcuuuugcuuuuuuuuuuuuuuuuuuuuuuuuuugcugcugcuuaaauguacugaagaaaguaagaagcccuucccuuggcaaacuccagcucugaaaucuaguccagcaagaauucaugauaucauuguuuacuugguucaaauuucaacucccuguccuucccuucacuuuggagaauuauugccaguucuucuaguuuugcauagcuuuuuuaucauuccagcucgucuuuguuauccacuuuuucuguuuggaccuuuuucuuaucuuuccccuaaaacaggggcaaacauuuucuuuaaagggccagauaguaaauauuguuggcuuugugggacagcuggucugugucacaggugcuuaacucugccauugaagcgugagagcagccuuagauggucgcaaaaugaugggcaaggcuagauuuggccugcagucuauagucccccaccccuccaccccugccccaaauagcauuuuaaaucuuacgucaucaugccaggaguucugaucugccuuuucuuccauagucauggccuuccaauucuagaguuaaaagugccagcugugccuugauuuccuuuauaaaaugugucauucauuagcaaguacauaucagauuucuucugauuucauuguguguucugugugaaucagcagaaggcccaaugaggcuugcuaagucuuggcuucuaacacaccucagauguauguucuaggagacugacuguaacucccgguuuacuugauuuccacuccguguugagaaguuacuagucaccacaucccagugugcauacggucucccauguuauuccacuaacauuaauugagcauguacugugggucagacacuguacuggguacuuuacaugcauuagauugugugauccucauaagugcaccauaaggugcuacaguguuagcacuauuuaacagaugagaaaacggacauuaggaaguuaaggacugccuguggucacacugccaguaaguagcagagcuagaccugaaccuaacuuugacuccaaaguccuuguguuaaaaauacacaccgugggguuaccuugggguaaauccauccaugcccccacccauccaucauucaucuagauuucaauuaucugugcuaaaagccauggaaucacuuauauuuuuccccccaguuucucguaguuucaucucuucugccaaucuguuuuuuuuuuuuuuuugagacagggucucauuuugucacuuagacuggagugcaguggugcgaucuugguucacugcagcccugaccucccugggcucaggugauccuccugcgucagccuccugaguagcugggacuacaggcacauaccaccaugccuggcuacuuuuuguauuucauguagagauggaguuucaccauguugcccaggcuggucucgaaguccugggcugaagcaaucugcccaucucagcccuccaaagugcugggauuacaggcgugagccacugcaccgggcccaacauguuaaacuuaguuccaagaucuuucagugccucagaaugucuuccuuuauggauuauuucuuccaucuuuucuagaauacaaaacucuuccuuucuuauaaauugguauauaaagaggcauaucauaggcucuuagauuugcaaagacuuacauuuauagcacacauacuucaaguagaaagaagacaaauacagcacacgcagucugcgaaucagugauacagugucuguccuuucuagguaagugacaugagguagaguugguuuuagcuucccccgacggaugccuccuggaaauuucuaaggcaagguaauuacuuccuuggucuucccacuacucuguauuguccuugacuuaccaccaccuucuguuaauccuucuagguguccgugcugcuacuaacugguccaguccaaaugaagcccagcuuacucuaccagacacuuagggccccuugagcugaaugagccauauuuucagaucaugagaauguugucuuugugauuucauguuagaggucuuccaguuuacuuaagaaaauacauuagauucacagauucauaucauagauacauaauuuguuuauuccagaagcuacguaucuucgcuaguauacuggaaacugccaagcuuaguagcaucuuccucuacaaugucagguuuaaauuuaaaaaagaauucuacacuucccauuagucauuuuuuaauuugaagauugacuacuaaaaauauguacuauuuuucacuuaauuaggagccauauauugaagaccaugucugggagcuucuacuuuguaauuguuggccaccaugauaauccaguuuuugaaauggaguuuuugccagcugggaaggcagaauccaaaguacguaagaauuuuuaugcuauuguaaugauaugguauaauaugauuuuagaacuggaagaucuggacagauaagguaacugaaauccaccacaauuaaaugaggcuugcucaggagcccacagacugauagaagccagccaggguauguccuuggagauguuuauucauccuuuaguucagcacagacuagcaugacgcucuggcauucccaucauacucaguucacuaugucacccaccaugaauugcuguugcuuaagcacauaaagacauaguucaccuguaguggauugccgccuugaaauaccaugaaaguccaggcuguuuucaugaaucauguuuuucaucaggaccuacuggguuagaaaagacccuuacuucccugucuuccugcugccacugggucugcagcaccucacuucaggggccuucugcagcacuuccuggcuggguugagccuguaugcuccccuccccagugacaccuuggccauacacaggaagcucaaaagcagcaccagaggugauaccacccaacuugcuugucaagaaugguuccaaaaaccaagcuuagcucgaggacauauugccauucagacccauagaguauuuuuuuuuuuugagacaaggaaauggaccauauauuuuaagaaagauuaccaucccaaaugcuuaaaauaaaaccauuuggaucuuauuuauuuauucuuuuugagacagagucuugcucugucgcccagacuggagugcagugacacgaucucagcucacugcaacuucugccuccuggguucaagcaauucuccuguauuagccucccagguagcugggauuauaggugcgcaccacugugccaggcuaauuuuuguauuuuuaguagagacaggguuucgccauguugcccaggcuggucucgaacuccugaccucagguggucugccugcccucggccucccaaagugcugggauugcagacaugagccacuacaccuggcccagaccuguagaguuuugacacgagaagagcccaguucuuuccaauuucuguuucuaauaaauugcugacaaguuugcuauguuucucccaaccuccaaaaauuggcuuuaauguccuuuaaggaauugauguuuuaaguuaauuguaaugcauaauauaugguauuuuucaacuauucaggccuugccaccaaaauaagauaggcauuuguuuacgggauucucuaugagguggaguugugacauuauuuucucauauuaugagaacacuacucauuaaaacuuguuuuugagguaucucuguaccaguacugcuuugugggaugcagcuacuuguauguaauuucugugcacuccacugcccuuguguuggacaaagcacacauaaaaauacuuuguugcauaacuugauuuuaguucuuucuccugcuaccacucacuuucuuaaagcguuuucaguuugcuccuaauucuucaggauugaucaucauuguaaaagaaaacacugcugugagccagacacaaaaacauccauuucucuaaggauucacuuagcuuugucauggcaacaugagugaaguaaaacaugcuuuaacuaugcaugggauuccacggcaacgggccgcccuccuccagcccaggcaugagaacagccuccuuggcaaggaagccgucucaguuuccuauggcuguuguaacaaaguacgaaaaacugaguggcuugggacagcagaaauuuauugucucaguucugagggccaccaucugaaaucaaggugucaguggggccaugcucccuaugaaggcacaaagacaagggucuguccaggccucucucccagcuucugggaguuccuuggcuuguggcagcauaacuccagucuucauguggcauuuuucucccugugugcaucucuaaauguucccuuuuucuaaauacaccaguccauuggauuaggggcccacccuacuccagugugaccucaucuuagcuaaccacaucugcaacaacccucuuuccauauaaggccacauucugagguacuguugcuuaggacuucaacaaaggaauuuuagagaggaaacacuucaacccauaacagguauucuuugaaaaauggcuuggguuuuuuugagacggaguuuugcucuugucccccaggcuggagugcaauggcgugaucucggcucacugcagccuccgccucccagguucaagcaauucuccugccucagccucccgaguagcugggauuacaggcaugcaccaccacagccggccaauuuuuguauuaguagagaugggauuucaccauauuggacaggcuggucuugaacuccugaccucaggugauccaccugccucagccucccaaagugcuaggauuacaagcauaagccaccgcgccuggccaaaaaauguauuuucaaagaacuacauuggaguaagacugcauuccaaguucugaauuccgucuucacauuauggucagacagucccaccuucuguucacuuaagccauuucagcccaggaaaaggacacucccagcucugacaggacuguguccugcuauugacacaggcgacugcucacagcuggggcugagcaucaccucccacuacuccuaggucccgcugucauguaagcuccaugcacuggaaagaggccucuggcaggccguuauaagcgccauuucaacugucucuacugcuuaccuggugccacugugcaggaagccccgcccucucaguuuccucccagaccuugaggccuagugugaauggcaccucuucuccacaggaucuuguuuuuuuuuuuuuuuuuuuuuuuuuuuuuuaacauaguauccuuuuuuuacauguuuagaugguuacagaauucgguaacuuccuucuugaaacaugaaaaaaaauuuauaugaaaaagauuuucaauaaaugauuuuguauaaauccucuauauacacauuucauuuauuaauuggcuguuucuguugagauguagauaucaaauuuaaaaauagaauauaauaugaaaacagaucuuuuauaagucucaugacaauaacaaaguauaaaagcaaacuguuuuuuccccacaagaaaaccaucuauagaauuuacagaaugaaaugucagcauucucgaugccauaugcaaauguuaaucugugguugcucacacugucaucuaggacgaccaucgucaucugaaccaguucauagcucaugcugcucucgaccucguagaugagaacauguggcuaucgaacaacauguacuugaaaacuguggacaaguucaacgagugguuugugucggcauuugucacugcggggcauauccuuaccuucuuaguaaagguaacuaacuaaaguuugggcucacaaaccagaagaacauggaacauagaugccaggcucugagucuguagacuucacagucaggugaaaauguaaguuuccauuuauggggcuacuuuucuuuuuuuaggggggaaaaacauuuuguuuaauagcuaauuuuaaaacuaagucucauacacaaaaagaguuuaucuggacccuaucaagggugauuuuacuuuauuuuacaguuauuuucuaacuuugaaagcuuauguucucuuuaugauaaaacuaagcuaauuuuaaacccaguuuauauauucaacuuuuccaucacaaauacacugcaugugacuaauuugaagaauacuguaucaacgaacugguugcuuuuuguuuuucauuucuaagaaagauuaugccuuaauuauuucacauaugagguuuauuaugcuucaugacauaagacaagaagauggaauaaagaacuucuuuacugauguuuaugauuuauauauaaagguaugguauguucuauaauuuuuaaauucugaugagaaaggauucgaccuuugucaggaaacuggccuauugaaguaacucccuuaggcugcaguuuaccuuucagacuagcuuucccccaucagaacuaucucuggcaacucccuccgcagguaagucuucacagccaggugaauauguauuuaggaacacaacuucaugguaguuaccuuuagaugauugugaagguaaauugguuucauucuucaccuuguuguccucauagcugauuuuauuagggaucccuaaagacagcaagaaagcagccuauauaagggaaaauuacuucauaauuuaaucuaaaauguuuccaucuacuuuacaaauaaguuacagugcaauagagaucauaaacuggcaggaagugauuuuuauaugaucaaauagccacucaagaagaauggcgccacuugcauuucuugauuuugaaaaauaaaauaauaauaggacgucaugguuacacugcagugauaacaauaguauguuuuguuuuggagacagucuugcucugucacccaggcuggagugcaguggcgugaucucagcucacugcaaccucugccuuccagguucaagcgauucuccugccucagccucccaaguagcugggaccacaagugugcaccaccacacccagcuaauuuuuguauuuucaguagagacgagguuuugccauguuggccaggcuggucucaaacuccugaccucaagugauccacccgccuuggccucccaaagugcugggauuacaggcgugagccaccaugccuggcccauauguuuuuaauaauuuaaauaaguucuguauuuggacagaauuucuugcauaucagcacaguaauacaauuuaacaguauuccuagucagagguaguaaguaauauuuagcccucuuauaaagaugaacaaugucaagugauuaagguauaaaaaucagcaaugccuuuccucauuagugauuccauuuaaugauuuucugucaugcguuaugauacacuaauuugagaagcugaucauuuagcagucuuguguuaaaggagaguauuaaaaaccugauuguuaaaagauuaccacacaagaauagcuuuuucugaacucugagcacauggcagauuuuuuuguuuuauguagccaaagggccauagagauuaauccauuuauuuauaaugaauaugaguauuucacacacacgguaaauucugaaaguuaacugacacaggcaacauuuaucauacugccauuaguuuugccacagauacuucucaaaaccaaaacaccaaaauaaaaauuuccuuaagaggauguuauuaacaaugcagcauuuucaauaaaacuuaaaaauguggucuuuagacuuuggaaugucuuugguuuuuaauuuaaaacuuuaaaaugauuuccuuucagaaacuuaagauuugucagcuuuuuugcuucacuaauacuuucuucuuuccuaguuuucaaugaauccauuuuaugaacccaauucuccuauucgaucaagugcauuugacagaaaaguucaguuucuugggaagaaacaccuuuuaagcugaaugcagaaaauuccaaaauaaaugaugucaccacaaugguguauacucaggaauguguacauuguaaguuacuugauuaaauagccuggaaaacuuuuguguauucucagcuuaucuaaaccuaaugaaauuccuuuuauauuuaaaaauaguacauucugucucaugucacguaucaauagaucaauugguauuuccuugugaacaguguuauuuauaaagaguucauuaucaauaaucauguuuuuuuuuuuuuuuuuuuucugauacagagucucacucuguugccaggcuggagugcaguggcgcaaucuuggcucacugcaaccuccgccucccagguucaggcgauucuccugccucagccuccaaguagcugggacuacaggcgcgugccaccacgcccggcuaauuuuuguauuuuuaguagagacaggguuucaccauauuggucaggcuggucuugaacuccugaccucgugaucugcccgccuuggccucccaaaguacugggauuacaggcgugagccaccgugcccaaccaugaaauauuuuuacuuaaaaauugggaauaagcucgcuuuuuuuuuuuuugagauggagucuugcuccuguugugcaggcuguagugcaguggcacgaucuuggcucacugcaaccuccaccucccggguucaagcaauucuccuucuucagccucccgaguagcugagauuauaggcgugcaccaccacaccuggcuaauuuuuguauuuuuaguagagacaggguuucaccauauuggucaggcuggucuugaacuccugaccucgugauccacccaccucaggaagugcugggauuacaggcgugugagccaccacgcccggccaugaaauauuuuuacuuaaaaauugggaauaagcuuuuugguuuuuuguggguuuuuguuuuuguuuuuuguuuuuuguuuuuuugagauggagucuugcuccuguugugcaggcuggagugcaguggcacagucuuggcucacugcaaccuccaccuccuggguucaagcaauucuccuucuucagccucccgaguagcugggauuacaggcaugcaccaccacaccuggcuaauuuuuguguuuuuaguagagacgggguuucgcuauuuuggccgggcugguuucaaacuccugaccucaguugauccacccgccucagccucccaaagugcuaggauuacaggcaugaaccaccgugcccggccaggaauaagcuuuugacuuacccaauucagauagguugaucuuugggguuuuuuuuuuuuuuuugagauggaguuucgcucuguuguccaggcuggagugcaauggcaguuguuucaccguaaccucugccuccugacuucaagcaauucuccugccucagccucccaaagugcugggauuacaggugugagccaccgugcccggcccagauagguugaucuuaauguaacaacccaaaaauaaaugucauagucaagauuugguagauaaauuuaaaauuaaaauauucugcaguugggagugaaaugugauagcacauacguugacauuaugcauuuagagauguuauaaaaauguauaggcaguauacacagcacuacucaagaagccaaagaaacacuugugcagugcuaagugucacaugucugcuuccaccagaggcuaggaauagugauccugcuauaaugugagaacccaaaucauguuuauaaaauaggacgcugggagcaguugcaggccacagugaaguguguugcuucugucacuuuauauucuuauauuuccuuucccucagacaguaaacuguugauacucguacuuguaaaaaauuguaaggcaauuuuuaguauuguugucaaagaaaagcuuggauuacauuaacauuuguauucagucuuuuaggugauacaccagagggggcugggaauugucucuuuguuccuauaaguagaucuuaauguaaaauaguaaauguccauugaaaagcaaguaauacagccugugcuaauugggagcacuugaacaauuuuguuccauucugaguaacuuuugagcaaguaauucuaagcuuugucuuguauccuugugugaaauugcauaauuuuuacccuauuugauuucuuaaauaaagauguuugcucaag

SEQ ID NO: 19232 - RNA, 20818 nt, Homo sapiens
cacgauccaggccccgccugccucggcuccaccuuccccgcgcccgucccccagggucucggccgcgggaccccgccuuccaggccccgccccgcuuuuucccuggccccgccccggcccgucgccauguuguucccuccgcgcuggacgggagcagcuggagcgggagccuggcugcgcuaccgcggcugccuccugcugugcagguccccgacccucucucuguccucauugcgcccagacgggccggcccagagcucccgggucgucuuucguguggccgcgaggugagcgggacucgggacuccuucgggaccgggcggagugcgcgggugucggggucugagggggcggcucgggccucgggcagcuggggcggggugcggugcgcgcggggcuagcgcgggucacaaggccgccccgggagagaggacggcugguugucucccugccuccucucugacgcaggaggaaagacgguccccacacccuuggggagagggacucacagaaacacacacaaacacuggagaaagggagauacaaaagcccggacacccgugcacauacacacggagaaauacacccggucaccugggaacacacguacacgccagccuuucccccaaccacuccgggacacacauccacagaccccaaaccaaauccuacacccgaaugauuaauguagggaaaacaaaggcgcucccaugacuugauuuuggcgaccucugaaguuccaccuagcagaacguguuugcucgaugucuuacgaccacucgggugaggaauucggaaaguaaagccaaucuuagaggcugcaggcguuuugggggcauuaucugauucagacgcuggcuaacguuucacaaucgcguucccuuuuuucuuccaacuugguaaguaaaaaggcaaaaugagaaauuuaagugcugaacuuaauaaauaguugguggacguauugcuuuuuuuuuuuuuugguaagggaugacacaucucgugacuacaguucuuuugaggaauaacuuuucugcuaguuuccaaaucggcacgugaccacaaucuuuucauaggauuuuagcguccugauaaaaaucaaugggcagaauuugauugcuucuuuaaaaauguguuuguccuucggucucuggcaccauuguaauggaaaaucccuacauugccuguacucucagaagcuguccaguguagcaaaacuagagauaaagaaaccuggaacgauucaguuaggaacuuuuaagaagccagccuuuaguuuuuccuuuagaagauuaugaaguuaucaugauugcuucucuagaacuuuaguaguuauuuggauuccuaaaucuaagacaaugcuguggcagucuggugcuuuuaguauuuuugugucugcugugguaaauuccucguuuauacuacaaaguuucucuucuggagacuuuugggaucugggcauauuuuuucguuuauuauuuggaauguuagaguagauaggcaaacacuaaguagaacaucauuggcuuugacuccaagccggguuuuagagauaagggaaauaauaccuuagugcuaucacuucuuuuccaaccucucucaucucuuuuuguuucuaucucaaccauuucuucugucuggacuacaguacucuggaggccuaaagagaagauccuugaguucucgaaauuauuuuuuuuuagccuccccucauuucugaccauuuauugagcacucacucugcggcgaauauuccguacguguaaauccuguacguacaucauuuuauuuaauuuccauagcauuucuucaguaagagcuccauguuacaguugaggaauuugggggggcauaggaagguucagucuguuuuccaagaugacccagguugugaugggguggagcggggauucaaagcaggucuggguaauuuuagaguaguaguuuucaacuggaagagaggacaauuuuguccucguaggagacauuuggcaaugccuggaggcaucuuugguucacaccugggggcaagggaggugcugcugacaucuaguggguagaggccagggaugcugcuaaacauucuuuuuuauuuuuauuuuuguuauuuaauuuuuaaauuuugcugcuaaacauucuauaaccuacaggacagccccccacaacagaguugucuagcccaaaaugucacuagugccacgguugagaaacccuccuuuucagcaguccaaguaaccccagagcuuacauuucaacugcuuuuguaguuuuucaaaugcaaugucguuuuccuauuugggauaccucaucauuuuaacagugagcaggggaaaauucucucuacugagaagcauauucacuugaaagauuaaagagugaguggcugggcacgguggcucacgccuguaaucccagcacuuugggaggccgaggugggcggaucacgaggucaggaguuugaaaccagccuggccaacauggugaaacuccguuucuacuaaaaauacaaaaauuagccaggcgugguggcggaugcccguaaucccagcuacucaggaggcugaggcaggagaaucgcuugaaccugggaggcagagguugcagugagccgagaucacgccauugcgcuccagccugggcaacagaaugagacuccaucucaaaaaaaaaaaaaaaaaaaaaaaaaaaagaccaaauaauuucugguagcagaaucuguuuuuuguuguaaggcaaaaaugacaaaaagaacuuuagagcuauucagagccauuaaaguggacuuagaaaguuuaguuucugcauuauuucaguugucugagcagccuguggggcacugauacaaaggugcugaugagaagggcgguggggagucccaaccuuccugaagcuuacaguccaaucacagucauaagauuagguucugacaucauccuagaacagaauuuauugccugggcuacucaaggacaggggccagguguucauuaaaaaaaagcaaaacaggaaaaaaaagcaaaacaggcugagugugguggcucaugccuguaaucucagcgcuuugggagacccacacaggaggaucacuugagcccagaaguuugagaccagccugggcaacauagugagacccccgucucuacaaaaaauaaauuaaaaaaaaaauuagccuagcucagugugguggugcaugucccagcuacucuggaggcugaggcagaaggacgacuugagcccuggaguucaaggcugcagugagucaugaucacaccacugcauuccagccugggcgauagagugagaccuugucgcuaaaaaaauaacaauaauuaaagaaaacaacuccacacucggcacagaaguaccugugucaugguguuuacugugggcagacuuaaauaaaauggggaaaacuugauguguguguuauaguuuuguacgguuaaccacgugugaauauuuacaagaaucaaauugagaagccauucuuguugagcauaaaauucauccuuaaauuucaccucaccagacaaauaguuaugccugcauuuuaucacuggaaucgagaaagaaaugaugaauuuuuuaauggcuuuuccauaacuuucugguguuuucuggucucuuuuucaugccugucuaagaucaggccuuucaaaauauguacugcuucauucugguggcaguauuaacuguuaggugaacuuugggagggagugguugacuggagcagucaaaaaggaucgcaucucuuuuuaggcaucacugaguguuauucacgcaaucaacauggcaucuuuuugucgguagcuuugguuuuugacucaugccaaugcacagcacguucuuugcugaugaauagauuucucugccucuuaucaggaguugucugcugugggguagggaggauguugaguuacacaccucaaaaugauugcuagugcauacacauggaaucuaacaaaagugacguguuuuauucugggaaaggucgagauaaauuggugcuagaguugucuuguuugaucauuaauuggcuugcuccuccagccaacuuaggucaccacauuuccuucuggguaaaaugagauggcugugcuucauaaucucuaggagauuauaugucacaaaguagaggcagcaaauuauuagcuuccaaguaguucugcccaggcaauguguuaagcagcaggaggaggaaguaagccaaauggaaguguguguguguuugggcaacgcaucuaacuugaaagguguauagauaauagacucuucagucagaaccaagcauaagagaauaggauuugugacuaaguaggccaucaacagagaacauuuauuaaggacuuuuuuguagaggagugagggugaacucaaaaaauguuucagggaguuugguggaaagcuaugaugcaauuggaaggcgaggaugccugagggaggagacguggagccaccuagguguguaggcagaggggagggaggucggaggcggucccaggccguguugccagagagcccaggggugccagggcuaguuagauaacuuggaggagaaaucucuguuucucaccaugacucuugguacugugcauguugugaagcugugugcucuggguauuuccacauucuggauuuuucaaauccuuuuguuaauuuuugaccauggugaguucaggcguuguuauuauguugcuuauuaugaauacagugaggaugacuagguguaaaugaauguaagguaacagcuagaucugccugagguggagagagacuggguguguauuuuggaaaaaaaauggagaagugaaacaggcuguucaggcuucacauucuggcugcauggaagccagcucauugcauucuccaggaguucucugggagucuguggacacagacuccacuuuugucuuaggccugacucguacaaacauauucuguuguuugacaggggauggagaaacacuauagaacaacuggacacauucauuucauugccacauucuuuauucaagugugacagagagcaaaacaguauaaaggaguugaacugacuacuguauuuuaauuucaaguuccugugaauuggauuagauuuuuggguacagaagcuaagguaauuuccaaaagguuagugcccauaagacugucuauguucucagaguuagaaaaaccugggaaaaaaaaaagccuuacagaccucuguuucuacaacuugcugugcagaacucuaacagauaggaguguuuaugcagcuaggugacugcucuggucugugcaguuucacaccuguguauuugaucagauguauauaccuggaaauacauacauaaugugguuggaagucagauuagaacugccugaggacuacccauuggugaaugcagaacauucuuuggaaugagugcuaguauucuuaaauaacauuuaaaaauaguuguuugggagcaaacaguugccacccucauaauccacuuuaauuugugcccaguacuugauuuuuaucacagcaguccuggaaaaccuagcuucaugaagauaugaugucaucgaaaggaaugcagugcaaucuaauuaacuccccuccaguggggugcccuacaaaugucaaguaucuauguuucccucagaaauuuaaaauagcccacccugcccuugugaauuugccgugaugcuuuggggcaccucagcaugcaguuugggaaccucaggauuagaaguugguauuauuggcucuaguuuauggacuacaagguauaguggugaggagaaaaggcaucaaaguccguuuuuaauucuccauccccccuuccaguaucuguaagcuuuucccuugggccccucauuucccccagagcuuugcaguuuugggaugcuacccuuuuaguugcuaagcugaggggagggacagacaggaaagagacugcaguucagguuuccugugcaaaucgucccuccagcuccacuuuccuuugugcuuucucuccauuuucugcugggugcaauuccuuaggaagugggucugcuaggguagcacagggaugugggucauggaaucuacagccuuucagggaccccucgagccuccggacccggccugucuggagaagucucgagaagugcccgugugcuguucaguucuuuuccaguucucuggugggaaucagcuuucucauuguuggcugcugcuuuccgcauuagguuucauugucucuucacucugucacucccggaccauuugcuuuccacuuucuaaauuuuguugcugucuugcaucuacaguuguucuuucuugguguccuuuuuggauuuguaccuuacguagaccuuuucugucacugggugggagugaagauaacacauacuugaccugcccuauuuaguuagaccuggggaaguuuguggacuucuguuuauugaucuauaaaacauggaugauaguguccaacuugcagguaauuuuaaggugcuauaugccagguaccuaguagauauucaguuaauaguggcugcuaauauaauuacagccauagcauuuauuauuugagcaagcaaggcaauagcaauagguagugcgaaaaguggacauauuucauguguggcugaaugaagugcguaagagaaaagaaagagauuuucgaaauggagaaaauaauuagcucaguuuuagauauguugaauuugaacuaccaucaggguaccagaugaacauacuauacaagggguugcaaauucuugucuggcucagacaugcggauguagacuuuaggaaucacugguuuuuauagcccagggagauaccaucuggaaacagguaaggguuucagucucgugaaauagcuucaugaagagcuugucaggaaagggagcugucuauguugaagaaagcuaaggggccaaggaggagagaaagcagaaccuauuaucagagugguuuuauggacaauuaggaaacauuuucaagaggauuacugccaggcuguuuggaccugauagaagcaguaaugggugguaaguccuggcucagacuugaaggucuccccugugccucuagcuagaugugugauccuguguaagacacuuucccaguuagaccuguuuccuuauuuguuuuuaaaaaacacuugaggccaggcacgguggcucacaccuguaauccuagcacuuugggaggccaaggagggaggcuugcuugagcccaggaguucaagaccagccugggcaagauggugaaaccuugucauuacaaaaaaaaaaaaaaaauuaaaaaaaaaauuagccagucuuggugguaugcaccuguagucccagcuacucuggaggcugaaaugggaggaucacuugagcccgggaguuugaggcugcagugagcuaugaucaugccacugcccuccagccugggugguagagaaagacucugucuuuuaaaaaaagaaaaaagacuuggguacccuuccaagauuuuaguucaugcacauucagacagauggcuacaccugagagaauucacuauauacuagcugggccucagguggagaugcuggucaaacuugcagguguuuucuagaaacauacacaaugaaguccugagagaagaacuuuucccuguauucaccuuaggguuguaugugccguagggcauucagaugaggacugagaaaaagccauuggauuggccauuaggaggucuuuggugacuuuugcugacaaucagggggaaaggauggggugggagcccugguguccuauaaacugagcagagaguuaaucagguuugcaggcacauugagaaauggguagugaugggcagagugagguugggcuuggaaagcuuuuugugagaaaagucaguuucaacacuucgauaggggcagaccuggggggaucauugacaaagugacaguuacauuggauaaacugaacuugaugaagagcugccugcaguguugagcuggugacaacuucccugcagagugguauuugggagccucuagucuagucgaguccuauauaccggacauagcugccccucuuuaaauauaucuucuuaggaaauccucacuccuuguaauuaacuucucuaacagucgagaaguuuccuuuugcuguggcuccaugccuuguggagccccucacucagugaguuuguauaguuccccaaccccuagcuuugucugcuguaaauuaaagacauuugguuucuuaucgaacuggaagggaggccucagaaccaauguuucuuuaggugauagcagaacguugcagaucauuuuugauuuguguuuugcugcuuuaauauauuuuucugacauauauguucaaauucauuccuuucauaauuuguuuuucuuccugaaauaucuaccuuuaauuccccauguucucaucuugugacuuuuaucuaugucuuugcauuuuaauucugucuuccaaagugcacucuauugucaaaaaguauuguaaguaccuuuuacagguaagugucaucgcagguagauuuaugcuugguucuuaaaacuuaagcaaaacaaaaaaaaauuauucucacuucucaggacuagcaguuucccaugaguaaggcuguucacugaacuaucacaguuuauggucaaagugugauauucauaaaagucucaugggugagggagaaaaagaggaaauucugcuaaagacagaaacucuugaaggguguuaugagcuacagaaauggaucacacauaacauacaaaugaugcaggcauguagcaaucaguucuugguguccaaacuccuuaagaucugaugaaacauuuuuuguucuuuccagaaaaaaagcgcaagcacacaagcuuccaccaaugcucucauccuuauuucacaugugauucuagggaguguauuuucucccugaagcucauuucauggacucccaauuaaccacacucuaggccugcacuguccaacacaguucccacuagccucauguagcaauuuaaacuaguuaaaauuaaaugaaaaauucaguucuucaguuagaccagcuacuuuccagugcucaguagccacaugugauuaguggcuaccauauuggacagugcagauuauagaacauugucgucauugcagaagggucuguuggauuuugcugcacuauauaguuucaugaugguuuaagauuuaguuccuuaacuaagucuucuuuuucuuuuuuuucuuuuuuuuuuuuuuuuuuuuuuuggcccuucucacuuccuccuuucccacuccccccaccacuguuagugauuaguuaacauaccuacagaggugccuuguuuuaagaaaaauguuaacauauuucuuaaaaguuaaguuagcugauucagcuucaaaaaaaguuacuuaauugaaauaaguucuuucaauaggggaggugcucugacauagcgauaguaugguuugauaauacaguuuuucuccucuagcugccuccuguucuugagguaaugcucagugauuaacuagauaggacuagauaauuuauuucaccuuggcaggucuugccuccaaguuggccuauuccuaugguauuuccuuuucuuucuuuugcuucuuccugcacacuaaguaugguauuuucugacaguauuuuucuuaauucuuuauuuauuuuucuugguaauuucuugcuguagagcugguacccauuagacauaaugacuuuccuugacuugcuucuugcucauaaauuucuguaagacaaucaggaaguuuuuagaaacaaacaguggaaccaauuaggcuguuaagugagacacgccuaaauuaagcuaugaggaaauaaauacagcuccagcaaaaauagaaauaauuuucagauuauccaugcuuuuguuucccugguuuucuuugaaccucauuuccucaagcuaugaagugaaaugaagugguaaguacaccucuaaguaggacauucagggugaauccaaaggaacuugugaauuugaccaaaaaaaaaaaaaaaaucuguuccuaaauuuaaaccaggagugauaaauucauuuuaaguuuuuggagggguuacagaguauguguuuuaaaaucucaaguuuugagaaggcaguuuacaaaugaugccugcucucccuuuggcagcuuauuaaggaauguagucguuuuucagcauuugccagcucccugucgcagucagucaauaguacuuauuuuaaagugggauucucauugggauugcaaguaagaaucaauguuuuuguuccuacccacacauuuuaauagaccucaaaaauagaaugcggggagaacugauagagaaacaaagaauuuuagguacagaaagcacaaauagaauaauaauagaauaacaagaauaaaagaggaaguaauauacucuucguucucaauguagcauuuauuugcaccucaccaaauguagagcauuguacgagaaguggcagaacaaaaaagggacaagugaauggaugcaauuagguguugugugucccucccagggaguugacauuguaauuaggaaacagacacauacacaacugaaggugauuagagcauaaguaaaugagagcuguaaagagguggaaaugaugagagcaaagaaaagagaaagauuagguugcuggggcgguccuggcuuccuacaugagguaaucuggacuaggcuucugaugacuaagauugucauagcugucgaaguagggaggggccucccaggccaaaguaacagcccgagcaaagauauggacagaaaaugccagugauaggugcggggauggugaguaguagggauauaauugggacaggcuuguaacugacauugaauagcucuuugaaugccaugcucaaaauccuguauaauaaaaauaauaaauaaaugaauuuaguuaucugucagaauggagacaauuagauccaggaccaauaaaaaaagucuaacuucagucacauacacagucauauuagagauuuauauucuuuuuuuuuggagacagagucucacucugucacccaggcuggagugcaauggcacaaucucggcucacugcaaccucugccucuccaacaauccuccugccucagccucccaaguagcuggaacuacaagcaggcaccaccacaccuggcuaauuuguguauuuuuuguagagaugggguuucaccauguugcccaggcugguuccugaacucuugggcucaagugaucugcccaucucggcuucccaaagugcugggauuacaggcaugagccaccgugcguggccagcagauuuaaauucuugaugcuuggaccuugaggcuuucuauucuuccccuugguuuauuguaggauguggcuuuggaagccagcaagggguuggagaaggccagagaaaaggguacuacugauaaacuauucaugaacaauugauaguauaagauaaaaguacauaauggaaaaguugggaaaauaguguuauaagaaggaaaggguuaacauaaaauguucuuuugucuuuugaauuuugccguaucugcuggcaaugugguucauuuguuuuccugccagugaccugcuuauccaacuuuacauucggauuaguguaugacacauacagcauauguugguaccggcacguggugugggaauccuaaaguagugucuguuguacauguaaaugauuuauuuaaagggaugcugcugaagggacaaggagaacauuuguagcucuaguaguguaaaucuaauucuagggucauauuuuuaauucucaggagauuugcacauauauuuucacauacaguaaaaauuuuuuuuuuuuucaagguagggucucacucugucacccaggcuggagugcagugaugugaucacagcucacugcagccuugaccuccccaggcucaggugaucuuucuaccucagccuucugaguagcugggacuacaggcaugcgccaccauguccagcuaauuuuuguauuuuuuguagagaugaaguuuuaccauguagcccaggcuggucucaaacuccugagcucaagugaucugccugccucugccucccguaguguuggguuuacaggcgugagccauggcgccuggccgaauucacccuuuuaaaguauacaguugauugguguuuauaguauauucacagaguuguacaaccaucacuacuaucuaauuccagaauauuuuuauuacccccccaaaaaaaccccauacccauuagcagucccuccuccuuuaccugccacugccccccgccccauccguugacaaccaugaaucuaccaucuccauauuugccuauucugaacauuuuauauaaauggaaucauacaauagguagccuuuuguucugacuuccuucacuuagcauaauguuuuugagguuuaucuacguuacaacauugcauggauguaugaugcauuuuauuuauccauucauuaauugauggacauugucuuucuuuuuaggggaaggugguuugauaauaguauggguaugcauuuuuuuggugcaaucuaaaacauugacaacucagaaauguauggacauuucuguaauuggauaguacacauccauguaauguggguuaagagagcauguuucacuuuuauuagacauaguaggcaugucaauuacagaauuccuuaugguaaaugguagaggcacgcacaggaugguuaagagugucgaggaaggggguucaguuggagauguccaguagguguucgggaggaggugaggucuagcugcauccacacggcugacuaggaguuagacagguaaagggccagggauuugaaugugaacaagguaaaacacgaagucauauaguaaauaucuuacuggaggaucaagugugagguauaaccaccucaauuuucauucguaagcccagcugacacuguuaguggagagggaucauagcagcauccaucccagcuuguccaaggccuuccuccccaccucacccacagcccuucucccauugcauccaguuagcuuucuggacuccuuaucugaccaggucacccacugcugaagcuauuucagaggguccccaucauuccuagaguacaggcagaaauccuuuccauggcuucuacucgccucccugcuccugggccucuuccuucagucuugucuuuguagcauacucuucacucucuagccuccgggugcucaggccuaccuugaguucucccaguucaugccagggccaggcuucuuuggcagggcuuuggcauggauugguuccacuuucugguuccugcucccuccucuuuucucauaguuuucucuuucuccugcugagcuuagccuguggucaaaccuacuuccccugggucaaaucucccuccagcagaaucagacuuuagugagggcuguguucucauggcagcacguggcuaaaaugaucauggagacauugcuuuggaacacaucacacuagaaaccgauguacagucucucauuaacacaguguaacacagccuaguuuaccucugauauuagaaguuaccucuuuuuccuuaacuguagcucagcaagugaaauaguuggccuguguuacaggaucauguuugcauguaaauuaagucccccagguggcuggacucucauggacucaggcaacuccguaagauaguggcauggggaaucugagugugauugagagagccccagguuuacacauugugugucucacucacugagggagauggugggcagaaucccuugcacuauuuuaagguguucuucgauuuuugguugagugugaauaguuguacuuuguaccauauaccucucauuuugugagguacaguugugacuuaaaugcauuuuuguguggaugucacaaacuugggacuguauguguggcuuguauccucagggucuggcucauaguaggcacucacuaaauacuuauugaaaaauuccuuucccaaucguucuaccaaaugguaagcuucugcaaaauuugacucauuucauguaaaacauuuuuuaaacuacuuaaacucuaauaaagcauagacacucacaugugcuuuaugcuacaugucaguaagauuggagauuacuaguucugucagguuaaccuugcucuugagcagauuuugaaauaaagcaagugguugaaagauucuuaccauuugcaauugcuuauuuucauucuaccugcagcaacaacaguagaaucucagaaacagaugcauaggcagcugggauugacguagccuaguggguuaagugccugggcuuuagagucagucggccauguucauaucuuacucccaccuuuuacuaggugugugaccuugagcauguauguaaccucucugagucaguaucgucauguguaauagguacuaagaaacuugugaggaauaaacacaguguuguagcuugcauaccauacugggcucaaggcuagcugcuguuguuguuguuucaucuucaaccccaaaugucaggauuuugaagucucauuuuauuauugauugaauuuauaaguuaaggacugcuguauguaagucccacaaaaaugcccuuugcuuuaaaaagugguugguggggagagugguugaaaccuuugguucagaccaauagaggcuaguacuuuagcacaguuccacauagugaucacugggagaccuugacauugaauuugaucuguaggacuaggauccuucagcuuccuaauguaggccuguaucauccucuaauuuguucugccuguugcccuuacugaagguugauguaagacaugaccauagaaagaaccugucuguaaaacugccagugaagacuucuucauguauucauuucacagacacucuugcacuccuguaaugagccuggcacugugaugaaacacuuuucccgugucguuugagugcaucuucucaacaacccuaggagguagguacuguugucacuguuguucccaugaggcuucaggauguuaaauugcucguccauggggcugugcucauggcauuuggugccaggaagaaguuuucuuuucugacagugugcuuugauuugcacagaaacaagagcguuuucauuuuugccuuggcugcccuguaggugggcuaccuugagccuuagcuugaccuuuccuauaucacguuggugccccucccucacauggcccuuuucugucuucccuuuuguguuaucuuuauuuuauucucuggaauaugacucauucugagccaccgaaaauuugggcaaguuuugaagaaugaaugaaauauuacacauuuccucuugauauaauuucauagcuaucucugaauauaaaacuuagaaaagaagauggguagaugaaaaacuuuuugaaaaaugcaaugauuaaaguagaauauugauuguaugacuuuuuugggcugagaaaggucauggauaguauucagguuuuuaaguuaagaaucuggcuguuaauagaagucagauacuguacuuuaacauuuuaauucuucauuuuacucuuaaaauuaugaaaacauacacugcuaaggugagcuuucuaacuuuuuuauguagauaaugaugcuugaauugaacaauuaaauuaagguaaaauuuaugaccuauguaauaugcuuuucuuauauagauuucuuucuuucuuuuuuuuuuuuuuuagauagagucuagcucugucccccaggcuagagugcaguggugcaaucuuggcucacugcaaccuccaccucucagguucaaguaauucucaugccuccgccuccugaguagcugggauuacaggcaugugcuaccacgcccggcuaauuuuuguauuuuuagcagagaugagaugaggucucaccauguuggccaggcuggucucgaacuccugaccucaagugaucuguccgccccagccucccaaagugcugggauuacaggcaugagccacugugccuggccccuuauucagauuucuuuauagaauuuagcagaauuacuaauguuuaaccuuggugaaaauugccuuuggacagucauuuuaaacugugaaguauaagagacuucacguuaccuuuuuaggcaaauuuugaaaauaacguaguaggaucccuuuauuuauuuaacuuauacuaaagaaauuucaaaggauuuuacuguuuuuaaagaaaaaauaauauuuuuaauguccauaagcugauugugguuauauuaauguauagaucaaaugaaacuggcuuuuguuagaugucacugguaaauaagaugguguguacaaugauuuauaucaccauguguguuuuuauacaacucuagaguuagagagauauucauguagaaauuaauuauuuuagcaaaugcaaauauauucccaaauaggaauaucugguaggccucaaacuguagaugggaaauguaaaaaauuguacccuauacucuguuuccuggugggcuggcauaccccaaauucauuuggucagaaugagacaaacuaagaagucccacauuauuaugaaaaaagaacugucaaagugucuuggaaaaauuacaaauuaccacuuucaaggaauuucuacaacuuaauuuaguagauauaugcaaccaauagucugggugggguuuguuagauugcaugaucuggcuuauaauuugauauaaagaugcuaaaaauucagugauguacaguaaaacuuugugucugguaaggcuguuagaucaguagagacuuauuaaaauacuggaauaaauuaugucuguuguacucucauaacacaacauggaaauugugugaaaggaacaacauugggagaguugcuggggcaggguucccaguggaggugaccaugcuaagcaguucugaaggcacagcgguucauugggggggucaccagcaaggagcagcauaugccaggguggaggcaagaggguguggggugugcugagugaguggaauugaauuuuaguuccgggugauggugcauucagaaugacugaagcagagacugugaggggaagguggcuagagugaggcuggccaagagcaggggccaggugucuugccuuagaaguuggacuuaguccuggaucucugggaaacaacccgcugaagaauucugaggagacauuagauagaugguuccccuaugucaaaauaguugguuugcuuuuaugguuuucaaucuuuucuuuuuaaguuguugaagcaagaugccaaagaauuaaagcagccaauuuagcacauuguuaccuaugucaggaaaguaaggggcuugggacuguugcaguuuccucuuuaacauuaauagucuggauauugagcaauacauuugaaauugaaaaagucucucaaaagguaugcaccuuaacugccacacacuuguguuggacaguuuaaauuguauuaauauuaauuauaguaguaauuacuguaguauuaauuuguuuuguuuuuugagauggagucuugcuuugucaccuaggcuggagugcaguggugcaaucucagcucacggcaaccuacgccucccagguucaagggauucuccugccucagccuaguaccugggacuacaggcgcuugccaccacguccagcuaauuuuuuuuuuuuuuuuguauuuuuaguagagacgggguuucaccauguuggccaggcuggucucgaacuccugaccucaagugaccugcccgccucagccuccccaagugcugggauuacaggugugagccaucgugccuggccuguaguaguaauuugaaagaaccaguaagagguagggacuaagguaugucccaucauuuuuuaauaguauuucccauucacuugauuucucacuauacaagccacuacaagguuuuuaucagaacaguggagcauguggcuagaagugcagaauuccuacauguuacaguaaguguucaguuacacuauaguugcucacauugcauauaaccaggagacagccagauaauguuuacugcagugauuuuacaaauucauccuggucaauauaacaauuauuguucaugucuuuauugccuucccauggagggauucauaauaccuacuuuccuauuaagguuauugaccaaauuugcucuagaucugugcucuccaauuggcucauuaaauguggcuauuuauuuaaaauugaauaaaauuuaaaaugcgguuuuucacuuccaucagccucaugucaaguguuccacagucacaugcggcuaaguggcugcuauauuggacauuuccauuguugcauaaaauucucuuguacagugcugcucuaauaguuaucuucuuauauacauuuuaguauacuuaaaaaccauuuaauacuaaaguacagauuaaaugauauaaucugauucgaaauaacuggggagaagggagaguuggagggguuauggaggaaacaagauuugccauaaguugauaauugugaagcuggguuuagaguucaugggagcucauuguauuguacucauuauauagaaauuuuguacauguuuuacauuuuucacaauaaaaauguaagcagaaggauuaaccaggaacugugcucccaccagcaccuagaaguagcugucugucaacgggcaucugaaaucucaccccccacaggcuggcucuuguaguguaguaaaguuuuuaauccugccacaggacuucuaaagaacacauauaguaccacauuuucauuuaagguuuauuucauucuaccugaaaacacacaaguagcagcagucucauguuccuuaaguguuugaacugcccaagugaaucuuguggauagaaugugcuagauuauauuaaaaauuccauugcugcugacauuaauuugaacaaauucaaaauaauguucuuaaugaagagaauaaaguccauuuacucagugguugguucauacuuuauuucacagccagguaagucaguuucugucucuggcuuuccugguuaacagcaccugugucugaagagagguggagggaguaguagagaaagucccugguaggagagaggccuuaagugaacaccaucacugugcacugaagggcuguuugaaguuguuaagagaaacaugugggcugggcauggugucucacgccuguagucccagcacuuugggaggccaagacagguggauugcuugggcccaggaguuugaagccagccugggcaacgugguugagacccugucucuacaaaaaaauagaaaaauuagcaaggcaugguggugugcaccugugauuucagcuacuugggaggcugaggugggaggauugcuugagccugggaguucaaggcugcaguaagccaagauggucccaugcacuccaaccugggugacagcgagauccugucucaaaaaaaaaaacaaaaccaaaacaacaacaacaacaacaugcgaacuuuggucuccuacccaucucuaacaaaugguggggcuuacuaugagcagagaggggcuuaucauagaguaacgguucagagcaagggcuuuggggucagacuugggcuugagugccagcuucacagucaacugugaccugagaaaagggaagagugagcccuucccagcuguuucagagaauaaugguagaauaguagccugcacauggcuaagugcucaguaaacaacaagucuuauuauuagguauucccuggggccauauguuuuauuucagcuaaaugcugauauucguagaaucauguagaagaauguguagguauaaaggaauguaauggugccuuuuuauuuuacaggguucuugaagcuuuugagauuaacaauggcaggaaaaucaucacuuuuuaaaguaauucuccuuggagaugguggaguugggaagaguucacuuaugaacagauauguaacuaauaaguuugauacccagcucuuccauacaauagguguggaauuuuuaaauaaagauuuggaaguggauggacauuuuguuaccaugcagauuugggacacggcaggucaggagcgauuccgaagccugaggacaccauuuuacagagguucugacugcugccugcuuacuuuuagugucgaugauucacaaagcuuccagaacuuaaguaacuggaagaaagaauucauauauuaugcagaugugaaagagccugagagcuuuccuuuugugauucuggguaacaagauugacauaagcgaacggcaggugucuacagaagaagcccaagcuuggugcagggacaacggcgacuauccuuauuuugaaacaagugcaaaagaugccacaaauguggcagcagccuuugaggaagcgguucgaagaguucuugcuaccgaggauaggucagaucauuugauucagacagacacagucaaucuucaccgaaagcccaagccuagcucaucuugcuguugauuguuagauuguugaugcauucuaaccaacucacacauauacacaaaaucaacauggggauggagaagagaauuagcguuugcagcaguguaucaucuacuaauaaaauuaaacuaauguugcugcuucauuaguuggugggagaagggacacauccacucuuggaggaauauauuuacucaauaauggcaccuuacauuuauaaauuguaacaguugucuaauaacguuucuuuaauuuaaauauguaaguugcagagcuaauaaaugaaaugaccaagacuuuaauuauaauaaaaauaagaaacuugacuauucuagaaguuauacuuggauuuuuuccugggaaaauggagaacuacuuuuuauauguguauguuuuuaugcaauuagcauuguauucuugguucagggaaauacuuuccuaaagcaauaauguuagauauuaaagauuaaaaucuaauguau

SEQ ID NO: 19233 - RNA, 2077 nt, Homo sapiens
uaacauaucugucuuuugauuuaauucuguuuaaaauuaacaaaagggagucuguuauaaaagcuucuuuugaacaaaaaaugcaaauguuauuuaaugaaagcgauuaucguuuaaaaaaacaaaagaaaacaaaacaaaacaaaacccugcaacaugacacucacuucucccuuuagggauucuuugauauuccuguggauaauuuguaugcggagcccgcaguccugcaguggauucgggaaaacauugccgaguggaagaacuguaucauuguuucaccugacgcagggggagccaaaagguaucaugcaggcuacaccuugcagauuucuccaucugcugauugguuuuuccuuuuccgauguauuagauaaggaagcaugcuguaaauuacuuaaagcuuuauuuugcuaaugagcaaguaaguagaccgcaggcuucacuuccagagcagaaacccaucaucuuuguuaauauuucgucauucaggaaagaagaaaauacagagacacacauacacaauagguauauauugguuuauuuguuuucagcaaaggguagauguguuugagguuuuuuuaaguuaucguuuucugauuauaaaaguaaugagccuaauuggaaaauaagucuuuuaauuaacagcacuuggaaaugguagccaaaauagaacaauuuuuuuuuaaaagaaaucucuguacauagaauaccaagaaggaaauaucugagaccaagaaauaaagcagaggcggaaagccauguccagguggcuugggggaugggcaucagauccagcaagagccugguggcuuggguuuuaauacucaccuggaaacccccauaaagaagggaguuaaagccaggcacggugauguaugccuguaauccuagcaccuugggaagccgaggcgggagaaucacuugagcccaggugcuccaggcugcagagagcuaugaucacaccacugcacuccagccuggguaacagagugagacccugacucuaaaaaaaaaaaaaagaagaagaagaagaagagaagagggcugaaggccagauuucuagccaaaagccagggggaaagcccaucuuuaccucggccuuugguuuaggggaggaaauagucaccuaugagaagucaaaccacgagccugugccacauucagauguggaguggaaugcacacgaaaaugugcuccaggcugcagagccccugcagagggagaauuucacaauccuagcugcucggugagugcucccugcucaaccugacccgaugccugauccaaaguuagaaaaccaagagaacacaguccacgcaggcccagcaugugcagacaacagggcagcaggcagccaauacuuggggauaagauaauaauuacuggacuaucaaauaaguaaguuuaaaaggaaacugaggugaaggagaguuaacaacaaccuggucguaacaguacggcagugaugaggcacccaguggugugagaacgugguacuaaguagcaccucugaagggcuucacagagauacucgaggcguuaacaagcaaucaggguacaggguguucagaaucaaggaugagcacaauaagagaaugcugcaagcugaggcuuggugacccaaugaccuuguagagcuuugcagaugcuaucugggaagaaaaaaagcugggaagggaguuuuauuguguagguagagaccuccauaagggagaaguaggagagacuucuaccccccaguccagugaggaagcaaggaagcucuaaaugugcacuaauagaggagugaugagagugacaagugaucagccuuuggaaugucugacaucaaaagccugucccucauuuggcacccucaucugccugcagcccagcugaggaccuaggaucuaacacaaaagcuuagaaguagcccagaaaguugucuuaacacucuugcagggaaacacaggcccugauucuuagaagagccuuguucauucugcucaaagcugccuuccaacggcugcugggguucccagcacagaagagaaggaacggaccaugcagcuggagaucggccucugccagcagc

SEQ ID NO: 19234 - RNA, 18173 nt, Homo sapiens
gccuccccgcccccgcccgcccucccccaccgcgcgcgcuccgcccgccccggagccucgcccuccgccacgaugagcaaaugagcgcgagcgagggcaugaaauuuaaauuccacucaggggagaaagugcugugcuucgagccugaccccaccaaggcgcgagugcuguacgaugccaaggugccgccgcggagggacagggaggaggcgcgggcugggggacccgggaccgggggcgggggcgggggcggacggccgcgcggagcugagggaccggccgggcuccucggccugcgaggagcggugcggccggcagggggcgcucacagggcgcuacgcccgggagucggggcggggucugggaugcuuccacuuccuuccgucaggccgggcggcgcacgcgcgguugggagccucgcccaugcuuugucgcguuaccggggcuaccguuugcgcccccgacugcaacgguggccgcugagggaggaggcuucucgaauacgguuucugucuucgcguuaaaugucuccuucugugcggccuggugccgggugggcuccugugggacgcccuggccguccgauccagguucuaauucauaguuacacggcgcuggccgcugacuugcgacguugugucccugggacccuaguccaguuuaggccccaucccgccuguaggccgugaaccccaucccgagggcaagguuggcccaguguuuucguaccccagggccuugcagcauuuacguuuucaaacucugaaggauuuacgugggucugaccauaguugaugggaaucgcgccccgggccgguccaccuaagucuccgggagcugagccacaucuugcagcuccucagauuuggguggcgggcaggaguuggcaccaggucucccagauccccaaggaaagcacccaggugcuuucauuucagagaccuggguuccuagggccaccugggcgaagccuuaggcggcagggacaggggcagucccaggugugucuuuggcgaugucuggacagcucuguccauuagagaugcuaaaggacaucccuaaagggaugagcauauucugccuucaguucccuccccugcugcuccugucuuuuaaccgcgucugcuaucccucuuucuccucgcccuccagccuccucggggcggaggggggggggcacgccccaucauuaguuuuaguuguucccucuagggacacaacagggagggauuccagagucuccagcuagccauccuggcacuggacauaggggagcccaggagacuacaacucccagagcucucagggcugcagcuuucaucuagccuggagucucuccuuagugacaaaucggcuggccaauggcuucagaagccucacacugucucacgcucagagaccaaucacggggugguuggacggauguuuccuauuuugaaggcguccacuugggggaaaaaaaugaaaggaaaaauauuucaacccggcugucggucuaaaagaggagagaaugcuuucuuuaaaaaagggucugugaauuaguuuuccugaucuaacuucuaauuuucuguauguucugccauuugugggaaauauuucuucguuucagauuguugauguuauuguugggaaagacgaaaaaggcagaaagaucccagaauaucugauccauuuuaaugguuggaacagaaggugagugaacuuguuaaaccagacugaaaauugauugucuuugcugcauagaaacauugcagacuuaaguuucagaaacacuuguagagaaguuuguuucauuuccugcuuuuacuuuguagcauugcaaacuucuuuaaguuuuugaaacacuuguagagaaguuuguuucauuuccugucuuuacuuuguagcguugcaaacuucuuuaaguuuuagaaacacuuguagagaaguuugauucauuuccuguuuuuacuuuguuaccagaacuugccuauugugacgaauaguuacuuuuaagucgauuguauuuggauucugucugggugauucuggaaaccccaguuguuucugugucugaaugaguuacuuuuucaguuuauuugccuccucuuugugauuuuaaaauauuuaaaucguuuucuaaaaauguaauucuggggcauuucuauugcuuugagguacuuuuagucguuguuucauaucaaacuaaaguacugaauuuuccuuuuuuguucaauuagcugggauagaugggcagcagaagaucaugugcuucgugauaccgaugaaaaucguagauuacagcguaaauuggcaagaaaagcuguagcucgccuguaagaauacaaaaaucaagauauaaauguuauccaauguguuuucucuuaguguuuuagauuuuuaugauauaaaaguaauacaaugacaaauaucauuuauuaaauaauuuuaaauauuuaaaguguguaaggggaagaguguuccuaugguauucuaaauaacaguguuuucagagugguuauuguauaauuuucugaaauggaaauuaccauuuauguucuaaaguuuaauaauuuuucaaauguauuucauuguuuauuauaucuuguuuugaucucaagacucacgaguucaaugucaaaacuuauuucaguuguuugcuacucuuuuucaggaggagcacaggaagaaagaagaagcgcugcagguugccugguguggacucugucuuaaaaggccuccccacugaagaaaaagaugaaaaugaugaaaacugugaguagcuucacuucauuucuuuuggcugaaagaacuuccaccuagacugagagaaggauucacugaaauucuagacagggaaacacuucaagcucauuauguauaauauuugccccauuuauuuuugacaauuaaaguagcagucaauauaagucaguaaaucaguaauagaacguuagcagagucaugcuugugacuacugcccucucggccagcaucuuuguacaaaccccucauggguguguucucaugggaucuguucucuuuuuggcaccucccaggccuuggucccauuuaugaaugcaacaggaaacuguaggauccuaacugacaauacacuuuccgaucauuagcuagugugauuuuugcauccauugaaauugguugucaaaauaaauuucuauugugaaagauacaguauuuguguuuggcauuuaaaaauacauggaauugcaguuuauuauuuccaguagcacccacacuacacgugaagaucuguagacauaaggguuggugaaguauaaaaugcgaguuuaccggaugcuuuuguuucaccuagcauuaagcaguuccucugacuguagugaaaacaaggaugaagaaauaagugaagaaagugauauugaagaaaagacugaagugguauaaaguuuuuauuguaaaaacuuucucuuuguuauauauuuuagugguaaaaauucacagugaaauacuccaguugugaauuguuuucuaaagauacaucuuuuaaaccaauaauguaaauuuuuauuugacauuuaaagaaaaacaacccuuauuuauagucgccguaugagucucucaguggcucuuuaugccccuaaaauguuuccacaaauuauaguuaucuuucuuuccagucaaauuauuuguuuuauaaugauuaauuuuuuaauggagccuacagacugugaugucuucugccugcauccaaaguuaauauaaauccgagugguaaacugaaaugggaaagaaaugaaauacauauuugcauuguguuuagugcccccaaacaaguuaacuuuuggccuuuaacauacuuuuaauuagaacacguggcauacuaugauuguugaggauuagcuggguuuguuucauagcaggccuuccuuggauauugacucuucuacuguuuuaaauaguuaaaaauggaauuuugauauugcagaaagaagaaccagagcuucaaacaagaagggaaauggaagaaagaacaauaacuauagaaaucccugaaguucugaagaagcagcuggaggaugauuguuacuacauuaacaggaggaaacggguauguagggagaauguauaaaacauuaauuuguuuggcauuuucauuuugccauaguuugcaaucauagacguaagcaauagcgaaucuugguggaacgaaauuuauauuuuucagcuuuguauugagucagguuuuaaaguucucugccaguggugcugugcagcugauaaaaauugaaacucacacagcucuggcugcccauuaggguuguguugggagcuuuccagaaugcugcugcuugugcuucagcccagaaauuaagaauuaauugaucugugguggaguccaacugcagguauacuugaagaaguuccccagguuguucucacagaucacugagauuaagaaucacugcuuacaucuauucaaaaaaguaauauuguaaucuacauaagguuaugaucaguagagaaaaaaagaucaaagagauugcgaacauauuuaagaaguucuauucaaacagaauuggcuuugguuuauuuuugaguuaaaaaaugauacagacaugaccaguguuucuuggaauaugugguuuguuacauuaggaugcauacaucagaugucuauguuuuuguuaacaguuagugaaacuuccaugccagaccaacaucauaacgauuuuggaauccuaugugaagcauuuugcuaucaaugcagccuuuucagccaaugagaggccucgucaccaucacguuaugccacaugccaacaugaacgugcauuauaucccagcagaaaagaagugaguacuggcauguuugguguuuugugguucucucuguauuagagagguggcuuccauuuagaacaggugacacuugucucuauuccguuauuuugaauucauuuaauauuuaauaauuuauugauaauucauugaaucaucuaauauuaaaaccuugucacuuuugugaaaucuucaguacuucaauaacuauuuacacaucuuacauggaugcauugaaagugcacugccucagcacugagacaguuuuuucagugauacuguuuagggcgagaacuuuccuugagaagcaccagaaugggcagugaggauuucucaaagcuuguuuacaaacagguuuucauuccagucagagaaagcuuccuuguauccugccugguacacaugacccagcuagaugagaggcagaaagguggaguguuggaguuaaagcaaggguuagggauucacuagggucaacccguuucagcuugcagugauagggguguguccaccuguccacuuuugcagcacaggcugcuggacaccucguguggccucaaacauauuuauuuguguuuaaugggguaaguuaaagugacugcuguauuuucugcacuuuauguuuuccuauguaaucuugacaguagcuacaaauccauuucauuuuguguguauguagguguaguauauaaugauuagauuuaaaacugcccuauuaaaaaucggcaacuucauugugaacauuuggaaaguaccucuuacuugugucucuaaucucuucuuuuuaauccucccaguguugaccuuuguaaggagaugguggauggauuaagaauaaccuuugauuacacucucccguugguuuuacucuauccauaugaacaagcucaguauaaaaaggugacuucgucuaaauuuuuucuuccaauuaaggaaagugccacaagcacuaacagguaaguuauauagccugcacuuucacccucacaugucagcaguacaaugaucagauccuuguuuugaagaguucaaucugauggugugggccaacauguuuggaggagggaaggaaaugaaaaguguguguccuggugguuuucuuuuuuccuggguaagcuaagucaucauucacuuucauauggcucuggcagauuuuaccaagugaagaccccagcauagagaacuuaggugggaugaugagcagcucucccauuuuggggaagacgguaguggguggggugaagagagcacaggccggggaggguggaaggggcagguuugaauugaguccccucacuggcuguuuguguuaguugcagagguuucuuaggagccuccuucuuuugcaggugugggauggacggaaggcaggccuagcuaguaguauuaaaugggaauguucacacagggccugcaaacuuuggccuucaguaaaaguuacuucucuucuugcucugcgaugucaccacuuuuccucccucaguuaccgagcaugcucuguucuuuuuugagggggcagggagggggauccugcaaccuaaagucuuucccuuaaucucuauaagguauugugcucgcucccucuucccucucuuccugagagaguggucuguucucaugauuuccacucaucugucuccucuguuaaccacuuauuaucugccuucaucuacugcugugcugcaaaacuuugccugcacgugaacugauaaccucccacuugcagugugcugcccuuuuucucggccaccuugcccugcccucccuuucucccucugcuucauggcugucagcuccccagcuucucuuuccgccuggccgccaucuccucucagccauccuuccuuugguagcuucucucucuccuuucccuuuccccaugucaguuucaccccaggugagaggccugcaggacucacuggggaccuaugucaaaguccccagggccuacuucaaaccuugagacuccuccgggguggguuguguguuuucacacagcaaccccaaugcuuuucuuaguccugccaguaguuacguuucaacgaggugguaggguauucuuguucucuagaccagcguuucucagccucggcccuauugauguuuugaaucagaucuuucuuuguuguggggcugccugugcaauauaggauguuuagcagaauuaguggccuucacccacuagaugcggauaacaccucuuuccucaguugcagcaaccaaaauugucuccagacauugccaucuguucccugucagggcaacauugcucccacuugagacccacugcucuaagacacauauaacaggggcaucacaaucuuuaaugccagcgugccuugcagaguuauggagaggguccaagugacuucgguacauauuuacgacccuccuggaguagagagagcauuucgugucuucagaagcacuccauguucuggaaaggcccuuugagccaugugugacauccuccaucuucccuaggagccaggaggaacucucucccaguccgccuuuguugaauccauccacgccacaguccacagagagucagccgaccaccggugaaccagccacccccaaaaggcgcaaagcugagccagaagcauugcagucucugaggcgguccacgcgccacagugccaacugugacaggcuuucugagagcagcgcuucaccucagcccaagcgccggcagcaggacacauccgccagcaugcccaagcucuuccugcaccuggaaaagaguagguucauucucgggugccccaggccggggagagccagcguguacuuuguguuuagucagugccaggcauggugcugagguuacauguguguguguacagugcgugugauucccauguccaaagugcugucaugcugccugcuuucuggagcuguagaaaguugaaacaccuggcgcagauugcagcgcagcuguguuggaggcaggacugggcuguuuccucagccuuucuuuuuugccaucacucuaccacuugugagcaaauugaguuaucagaauucuauguauuguguagcuaggccuaaugaagcauucaaaaugagcaaugcuaauggguuguuuagcuuuuuguuuucuuuguacucugucucuguagucucuccauucuaaaguuuaauuuggaaaggucuguccugaauuaucaaaguaagaauacucagauuuccauaagcucuucucaccuccucuuagcccaacucaaacuccaucagaucuucucaccuugauuuugagcuggaauguuucaaugagcaaaauaaauuagacaaaaguuuacuuucuuuuuuuccaaaauacacacagguugauuugcuguaauauaaaacuuagaaguaaaccacugcuaauuaaucauuuuaaacuuucaaaaacugcuaaaacaggugccaugaaucagguacaauuacuguagaaacuaacauuagcuauuauacacuaaccaggcauuuuucccaaauuaauuacaaucugguuguuuagccuaugcuaauuaagcccucuuaguaguaguauucacuuuacauugaagaccucauucacaaauacagggugcucugugcuuauauccuuccacccuugacugccaaaaaugugugaaauggaaaguugauggcagcagggccgacgaugucaccuggugccucgcgggcucagugaguuaggaagucagcagcaggggaggcagcuugcaugccugucccccggcacacuguguggagguggaaacagagcuacgccagcaggcgccaagcacccaacuccagagauggaagccugguggccuuccuuucacagagcucagcugcucgcaggcugugaaaucuaagacaccccucauaaauaucaaaaacaccuccaaagcuaacgucaggguaaaacuacuuggagucgaauccccaugccccaguagguguaucuuguguaugaccugugcccuguucuucccucagccucgccugcugugcugacuccuucagggguccuucuaagcaucauccuguuggaacucccaaaagucaucccagugccauucuguguucaggugcccauuuccuuguguacauccugucccugccacauccauaagcuccugagagaaaggucugacuuguugauugugucaccccaucacagcucaguguugguggcauaguuccaggugcgugaaaguauuugcugauucuuugaagauugggaaggcucagaagggcagaguugaagaaggcauaccuuuaagagaagcccuuugaauaaucaagugcuaaaacaaaaucaggugcuuuuuuaaaacagcuugauugagauauaauccacauaccuuaaaauucacacauuuaaaguuuuuagugucuccagacacagugguucaugccugugagacuggggcaggaggaucacuugaggccaggaguucaagaucagccugggcaauauagugaaaccccaucucuuaaagaaaaaguuagccaggugugaugaugugcaccuauagucccagcuacuugggaggcugcagcuguggcuguggcugaagcuggcggaucgcuugaggcccagagucuaagacugcagugagcucucauugggccacugcagucgagccugggcgacacaaagagaccacccugucugauagauaacuaacaaaauaguuuuaguugggcaaaauuaaagaguugggcaaccaucacugaaaucaguuucagacauuuucaccacuccaaaaaagaaaccccacaucgacuagcaguuacucauuugcuucucccuauguccccugacaaccacuaaucuauuugucucuauagauuugccaguuuggggcauuucauauaaauggaaucaucuguauguaagugguuaauaaggauugguugauugaagauugaaaagggucagcugggaaaauuuuuaaaaagacuguuuuuaaaaaggugcuacaaaauaaagugcuaucuuuuucuguuucucuuuguacuuuuuauuuuuuauuuguauuuauugaugugaaauucacauauaaaauuaaccauuguaaagugaauaauucaguggcacuuaacagcuucauugacacauccacauauacaguucaauccaguaguuuuuaguguauucacagaguugugcgaccaucugcacagucaauuccagaacauuuucagcacccccccacgagaaaccccauacccaguagcaaucacuccccacuuccccuucugcaagcuccuggcaaccacuaagcugcuuucggucucucuggauuugccuacccuggguauuucauauaaauggaaacauaguauguggcccuuugugauuggcuccauucacuaagcauagucuuuuaagguucauccacauuguagcauaugucagugcuuuauuccuuauuuuuuuaaccaaauaaaauucaggugcuaucuguuaggaaagucuuaucguuaaagguugguaauuucugagaaccaaguuuagauuuauguucugcaguuuuuaacagucuugaggcagucuuuaauucaguugcugugugaauaauuucaucuuuuucuuuggaagagacaccugugcauagcagaucaucuucaccuauuccucugacuccuagcaaggaagggagugcuguguuugcuggcuuugaagggagaagaacuaaugaaauaaacgagguaaagaauguuugauguuuguucccaaugguuccuuuauuugugauuacuucaauucuauagguggaagucaagguucuuaaagcaucauguugcugcuauuacuguaaacauuaucaaaauuguacguaauuuuaugcuuaacacuguggguuuugguuucuaaagugagaaaauuguuaggauuccagcccuacacugacaaucaucuuuuaaauaagugcaauuauugaaauaccaguauuuuuacuuuauagaacagaugucaauuuccacagagggccagaggguaaauacuuucggcuuugugggccauauggugucugucaaggcuacuuaacuccaaaaguagccacagauaguauguaaauaaaaugagugugcuauauuccaauaaaacuugauuuauggacacugaaauuugacuagcauuuaauuuucauguguuugaaaauuuuuuuuguuuuucaaucauuuaaaaauauaacauccacucuuagcuugugggcaauauagaaacaggcaguaguugggcgggaugugaccagcaggcuguaguuugcugacuccuacuuuaaaucccugauuccccuccaucauuaacaguaauaccaauagccgucccuucagggaugggcucuaggccaccacugugccagacacuugaaccaaauacuuugaauucucgagaucagccuugccaccagauuuccacuugauagaugggaaaacuuuucauuuuaaaacuauuuuuaaggcccauuaggugaucuguagguggugaguuugucagggauucugaagacgucucaguuuaucagcauauucugugaacgucuccuaggaggugagauuuccucuuuuuuuaaggugaguaggaguugcacaagggaaaauggcuuugcuaggcaaagaacauuuuuuucuuuuuuugacacagggucucacucucaugcugucacccaggcugcagugcaguggcaggauguuagcucacugcagccucugccuccugggcucaggcgauccucccaccucagccuccugaguagcuggaacuacaggcucaugccaccauggccuggcuaauuuuugcauuuuuuuguagagacuaaguuuugccauguugcccagccuggucaccaacuccugagcucaagugauccucccgccucugccucccaaagugcugggguuacaggcaugagccacugugcccagccuaggcaaagagcacuugaugaugggaagagaagucacaaaacuuucuuccagacgauaacugucuucaguaguguguacccuaaggucucuugagagacugcucaacucugcuguuccagcaggaaagcccuaaacaaagggacguggcucugccauaaacaaagggguguggcucugugugcugcccccuuaauucauucauggacacugagaauuuaaugucaugugauuuucacauaucacaaaauauuauucguaugauuuuuuuuccccaaccauuuugaacauaugagcauggggcuggauuuggccuaggggcuacaguuggcugaccccauagagaaucuagaaagccuaauuuguguuaugaugauuguugaggguagguuaggaaaucccuaguucaagcagucccugacaugcccauuuuucagauaagaaugcacuacgaauuuuauuauugaggggaaaucgugaauuuaaggggcaucugaguugucaaguaagggcuauucccacuccggucugcagugcgaaugcgccaucuagugguuauagguacagcugcaacuuauaguuugaaagugcuuucugggaaaugguugggguucaggcggcucucacaaggacucaugagaccuucguggauucccaccuucuuacguacgucuaccaccguguuuuuugaccagggcucuuucucucaguuccaaucgcugcuccacaguacuaggggcuggucugggccagcacaugccaguaaagguccaucaaugauucccaugcauaccccacugggaaucccccgacuagaaaccuaccauuuuuccccggaaaaugugucuucauaaauagaagauuauaaacugccuugaaacacagaauugagugagugagauagagccagaugaccugcuuuuguacgugccaagugcuguucaugccucugagauugcaaaguccuguauguuuccuuugagucacuuucagaaugguuccaaagcuucagcugugugcacugggcaggugcuggggaugcuguaaagaugcuggaacgaucccuucccucagugcuccacagugcagaaguggggcgcuggggguggagaccuaggcgagagucuaggccugucuaggcaggggccaaagugaagcuaggccuuuguucuggauccuucagggccaccuuggugcuuauuagcuucuggcaguuccauguuguuaaacugacuauaucaguguuucugaguuugugggggcaucuuucuuucugcuuugucugcugguggacuuccuccagucugacuguuuccauauugaauaugacgucccaaaagccaaaguagcagcucaguagaguaggcucugguucuauaauuugcugaaguacuuuuacggaaauucaucagagaguuuugaaaugcaacucucccuuuaacaaaagccccagguccacccacaguucugaaauucagaaugaagacaaaucaguuaucagguuugaagucuauuucaguugauucaagggguuaaaagauucaaauucguuuccauaaugaaucuaacagcaagaaauuaaggaaucuugaaacaacaguaauauuauucagaacaucuauggauuacuuuuuaaugcuucauucucucucuagugcagcaggauuuucuuuuuucuggguggaggggaagggggccagaguuucacucuuguugcccaggcuggagugcaguggcacaaccuugguucacuguaaccucugccuccuugguucaggugauucuccugccucagccucccaaguagcugggauuacaggcguccaccaccacaccuggcuaauuuuuuguauuuuuaguagagaugggguuucaacauguuggccaggcuggucucaagcucccgaccgcaguugauccacacaccucggccucccaaagugcugggauuacaggugugagccaccgcgccuggccaugcagcagaauuuucaauaaagagaaaggacuaaagaaccuaaacaguuacaguuauuuauagagaauaacuguugcgaguuaagaaauuaaagacuuucuugaucuauuuuaaguguuuuugccuuucaucuuuguuuuuuguaagcuuguguuuauuuugauccaaucacuuauuuuuuccccucuacguacaauuuacugucauaauuguuaggugguuggaagugucuccauuaagaauaacaaaagcauucaauucgugcuuuuuccagguccucuccuggaagcuugugccugacaauuaccccccaggugaccagccgccuccacccucuuacauuuauggggcacaacauuugcugcgauuguuugguaagaauccugguuccugccuucuuuccauuuuucauuuuguauucucuuguuagcuuucuguacaccuugugguuugggcuauaauuaucuaacuaagaaauuuggggauccaagaaaaauuaaaaguaaucuaucaaagaaaaggcauugaaugaaucuuaaauuucauaaaaauuauguuuguaauauuuguacugcuacucugucuuuguucaguaagaguuuggggauuuguuugauaauguggauguuaauuucaguuccaguagagauaaggaggggcccagaccuucccugagugaauccuaugcauugucagauucugcuaauuguaaaugguuuugccuuuauuuuuaaugcagugaaacuuccagaaauccuuggaaagauguccuuuucugagaagaaucugaaggcuuuauugaagcacuuugaucucuuuuugagguauuuuuauuauuuugucaaaacuuacaccuguugccauauauguggcuuuucugaacuucucuuuagcacauggggaagucagcucugugauauuuuaaauaguagaaguauuaccuaagcaugguugguucuaaccguaaugggaauuaggaguggguuuuuuugguauuucuuuuuuccauaauuucucugguuucugaguuaggggcauucauuguacagaggugaaguuuuuuugucucacuagaagaauuuaauuuaaaaaaaccuuauaaauagaaaauaaauuuucuaaaguagaagugauugagauugaugauaauuuaguuuuacauuuuuuuauucaacaguaccucaaguaguggacuuuccuuuguugcauguacauaaacuaacuuaaauaguagcauuuauagguuggauuucgguguuuacuuuagaauuaagagaaaagaccccuugucuguguugucauguaugaauucagaccaagguauuguuuccugcagcugacaaagccagucauuuuuuuaucuaauaggaucauuugaucugaggcucugcuguguccucucccuuccagaugaugucuauggaccacuuucucuccuuggccuucaaggcuaguugucccccugccucacccagcucauccuagcuaccugacuuuguuucuuccuucucuuuaaggaguaucucuuccuuguauccaggccccacccugacuuaucaaguaggauuuaccacagaguggagaguaucccagccagggaaaucgucuugugguuuuaagagauccuuucauguaggcauuuugaauaaaguguccaugaguggaauuagacuucacaacauuuucuuggaaacaaguuuccaaaagacccucuucccucccagccucuuccucaacaaaacccacaacucuguuuggcauaaaauuuuguaaacugaaaucaaauagugccaagaaaauaugaagagucaguugcaggauagcauaggaaauccugcuaauuuugaugcaugccuaauacaaaauagaaauuagaauuuuaggaaguaacuuaggaggacuuacuaauaaaccuaguaagagguuuuaaaaacguauucgaagauaucaaccagaaucaauggacucaauaaugaucauaaaaagaguacacucauagaagaaaaagaguuagcuauccaaugaguuuugacucaauuuauacugaagaagguuugcacauuuuuaggaauuugggcaggugggagucacugggaagcaagcauaaggcaaaugugcuuauuagugaauauugcacaugugagaaugucuuagcccuccauggcaaaaucaguugaaguuugagucaagauaucauauguauauugaagauucuugaaugaccagcacauuuuuaacauccgucuucauacauaugagucuuuccugugucuugguacuguuagcuagaacuguaacauguuuuggcauggcaaauuaggacaccaaaugccauuacuaguuguucuguucaauuuuuguaugacuuugcucauauaaaugauguacauuucugaagugagauuuauuguuuauaaucguuuuuuauuuuuuauuuuguuuauuuauuuauuuuugagacggagucuugcucugucgccugggcuggagugcaguggcgugaucucggcucacugcaagcucugccucccagguucaugccauucuccugccucagccucccgaguagcugggacuacaggcacccgccaccacgcccagcuaauuuuuuguguuuuuaguagagacgggguuucacuguguuagccaggauguucucgaucuccugaccucgugaccaccugccucggccucccaaagugcugggauuacaggcgugaaccacagugcccagccuauaaucuguuguuuuuaauaguuuguuugaacaacagaaaaauguagaaacauucaugggcuuuuuuuuuuccgcccccaacagaaguguuuauauaaccagacugccaccuaguggaguguagguucuguuuccauuuguacaccugaugauggugaaggcauucagauaaguaguaauucacauagaagcuggauaagugcagugaaaauaaucaguauagagagaucaaaauuauagucauuuuuuucuuccuaauaccaaaaaacaguugaaauguuaguagguugaaagucaauauuuugcuugaugguauuuaguccuuaguauggugcucauuggggcuauuuuuuuuuuccagguuuuuagcagaauaccacgaugacuucuucccagagucggcuuaugucgcugccugugaggcacauuacagcaccaagaacccccgggcaauuuauuaaaauguuguugguucuguaagagcaacugcucugucuaguuuggcgcucuggguuccaggugaauaacuaacaagguggugggucuuuacccacagcgcaaacacaaugcccaccuuggggcucuguuguuugaguugcccacauacugcaguuauucuguuaggaaugauucccugggugccugaaagugcucugacacgacacuuguuacuuugcaggccaucugugauggcaaggaaaaagcaacuauguucacagugaaauauucguggaauagguuaggccauuucaguagacauugcaguuaguuagcaagaaccacauugucucuuuauuuguuagcauuaaacaaauuuuuuuuugcaaauugguuuuauuuuuuugaugaagccgagcaacucuguccaaaaagguuuaguuuguacucggaaaccacaaaguagucucaaaguauuuuagagggaaucgauauugauggcaaaagaaaauuugcagcuaugcauuugcuucuaacgguucccucucugugaaacauuauuuuuggugaucuaaagaaagcauugccuuucuuauuugagauuuuacagcuauacuuuguuguguaauguuaugguucccuuucuguaaaauguuauuuuuggugaucuaaauaaagccugucuuguuugaaagaaccaggagagagaguuuucacucuggccuuguccucuuuaaugcaggguaacagugggguaaccuuuugacucauaacuuuagguuucauuuuguuuuuccuuugugccuuuuuuuguuaaaucccucuuugguuuugccucacuuggcagcaggaccagacagugguuccuagaaguuccugcaguucugugcugucuuguugcugcauuguggucucaucuggggcuaacaccagcuuauccuccuccucccucauuaccaacugacagucucugcagucacuccucuaauccuuauuuuagucgcacaugccuccccuaucuucagauguuuuagaaaguucuaacuucguagaaaugguaucaguaccauaccagcauugaauauagcaccugccuuguaacucaacucagcagaccuuaacuuccaaagaucacugguugugaacaagggccacaaagauuuuuuaaaaaucuguagaugguuucaucaaagugacuuaugcauacacugaccaaugagaauuaauacugugcacuuaguugcuaaguuagacguggguuuuggugucucauccggaguaguacucagguuccugguag

SEQ ID NO: 19235 - RNA, 12419 nt, Homo sapiens
cugcuuggaguagggagacuauagcauuguuuuuuuuaaaaaaaaauuauuauacuuuaaguucugggguacauaugcagaacgugcacuuuuguuacauagguauacacaugccaugcugguuugcugcagccaucaacccgucaucuauauuagguauuucuccuaaugcuaucccuccacuagccuccuccccaccccccccaaccccccccacccccccccggccccgagacgggccccagugauguucccuucccuguguccauguauucucauuguucaacccccacucuugagaacaugcgguguuugguuuucuguucuugugauaguuugcugagaauuauaguuuccagcuucauccaugucccugcaaaggacaugaacucauccuuuuuuguggcugcauaguauucuguaguauauaugugccacauuuucuuuaucuagucuaucauugaugggcauuuggguugguuccaagucuuugcuauugugaacagugcugcaauaaacauaugugugcuggguuauaaaucauucuaucauaaagcauugguuuuauaaagauaauacgucugaagaaacaaucguuaaguguaaaauuauuccaaaaaauuuucaaaaccugugaacuaaucagcuuuauuuuaaaauauacaaguauuuugaaauguagaguuuaaggcuguucuauuucuuaaacuccacacaaaacugacaaauccauaccaaauuaaucacccacagacugccaauuucauccacuaauuuaacacuacagcauucaggauaaauuaaaggauuuaauaguauagacaguuaaaaaaaaaaagcagucauuuguaacaugcugcuauaaauagaacaaccaguuuauggauuacugguacaaaaaguuucaauggcaaacuuagagcuuccuuaaaacaaacaaaaaaaaucuagacugaguugaagcguucuccaucugggaaaaaaaugcucaucuugugaauuuuaacacucagccaaauauaaaaucauguuuuagagggggaccaucacugauacugggacuuaagccaggcuuucaagguuuggauuaggccgacugauguggggaaggguggaggcugccagcaaaggaagaaaugagauucgaaguugggauaacuugucaaaugccaaggacaaugaggagaccuguuuguugggagcagaguuacauauuagaauaacaggauuuaaagggaacauuuuuuaaaagguauguuccaaaggaagguauaguugaaaguacucuauccaguccaagaaauucauauaaaucagaauuuggagagaauuuugcugaguaccuuuccaguguauaccuuugcauuuuguuaaaggucacaaucauaccauaggggcuuuagaaauaaugguaacuuuuuuuaaaaaagguauaaucaccucuuauuuauaaugaacagcuuuaguuaaaauauuuggccagaugaaagcucuugagcaucaccauggacucucaggcuuuacaucucuggaguauuccugagaaaauaguaagaaaaaaaagcaacuuucaucacuuuuuaaaagcucuuuuucagagguuguucaggcuuuucgagaugaaauauacagacaauacugcagguaaaggaaaaacugagagacugcuucccacuuaagcuaaguaggaagaaaacaaaaugaucugcuauaaacugcaagguacaacacaagucaaaagugaacagugcauaguauccuucguuaagugaaggaaaaagugugauuacccacuugaaguucccauuacaucaugagugcaauucaaucuggggaaaauaguuuaauguaucgcucagaaaaaaauaguuuauauuuuuccaucugaaacagugcuuuacgagguccaacgccaccaagcgacuuucauucugucccauacugccgaaagugaaucuaaggcaggacggacguccaggauggugaacugguaguccuuguugacuucaccaccaucauaauaaucaaucacauaucuaacuucugucccgcaacgguuuaugauccaaucgugccuaucaaaaggcaacucauaccuggaauaaaaacaugccacugaguguuaaaaugcuugcaauacauucagucccgguuuaagccaugagaaaacucaagaagcacaugcaaacaccugcucccaaacaccuaacuggggaagucagacuugaagaauuacacagugaacagcacuaagggaagauggcacugaagaacugugauaaguccguaucagaugacagcucaucugucuacaaaggaauaaggccaauggggaagagaccuaagccagggaggucagcugagauacugcagagaugcaggugugagcaaaaaaucucaaguaugcuagaaaagaaagggaggauggcuaagugcauaaacccaaagacacagaucacgggaagaguaagagggcagauccaagaacauugacaauaacuccauucaacccuaugauauauaggaagcaaucuacuacacccuaauaaaucugcccauuaaugggcaaaccucagggagagaaagacaucuacaguugaauaugcauuaaguuuugcaagauggcacugcaauucuuagacugguuuuggugugaagagaaaguugacccugaccugaggauggugaaacaacacuucugcgcugacacucaccccauccaggaacgaauucgugcccuuggugaauacucuuuugcuuucccuccaaaccggaucaaugauggaccacaaggacacucucuagaauuccccaaauaagaaaagucuguuaaaauauuuucuuuucuuugacaaagaugauguucuaauuuuuuaguaauauccauuuuuuuccuguauacauuucacauaauauaacauuuacagagaaagguaaguucuaaaauaauucaaacaacaagugccuauuuguuaaaaauguuccucuuuccuucuggacuggugcauuccauugccuccccuuccuucuggauaucuacacugcacuuugaggagucaggaaacagggccuuuccauuugguggaggaggaaaggcaaauuaaaaaaaaaaacagccucaaguauugugcaucaugcuucuuuuuggcacagagcagcugggguuuuucagacaaacaagaaaauccuauacucuucuuucauuucaaaccaaugaacagccuuuaugaagaaaagaaaaugauggauuaaucccuagaaauggauuguaauuaauguuggaccagcuccuuaauaacuacacauaagaugaggaguggcagaguccuagcuggcaaaugcacucccucuacccgcagaccccugcugaggacucucuaggugccagcccucuguaggcaccaggguauagcagggcacugaccugcuauacaagacccucugagcacuguccucguggaguucacagcccaccuacaggcuagacagacagcuguuaccgagacagagggagugguggccaagucagcaggccaccuauauuguuagcugcucccauggauaacaagauaggugucuaaguaagugggagggagaaaaauuuccaaaguauaaaggacuucuauuugaggacuuaugaguuacuuuucuucuccuuuuaggaacuacuccucuccuuaacaucucuucucaagaggaucacaggcaaaaagguaaacucaaucuaggcaaaacuuucuucuggagaucauagcaugaguuuuuaaacggucuacuuaauuuugaccguccagaaaauaacuggagaaggaauugaaacugacaaacugaaauucccuuuucucucuucgcuuugcuccauaaucacacaaguaauuagcagguggucuuaauuagaacacacuuucaaaguaggucacugcaaacacuuguggcuccucucaguccagagauuacugagggcaacacgguugcaguuguuccccucucacaugcacccaccccaggccugaggcccagccugugacagccagggagugcaaccaaugaacuucagagugcaaauauuaaaaacaaacaaaacaccuuaaaaaaaucauuaaguggacuuuagccaagaaauuaauuaaucgcauugugcaaugaauuuaaaaccacuguuuaugacauaaucuggcucaaaccagcagcauaugcaguguucuagauacacccagucuaggcaccacccgaaacagacucagucagacauccugcgggugggacccagcaugcuggguuuuaacaaaccuuccccaugauccugaugcacgcuccagugugagaaccacuacucucaacagacugaaguccugucuccuuuaacacacacagcugcauuuaccuauucuccuugagaaaaagagcucugaguuaagacaucucuuuguguuuaguccuaauggggauucaauaaaugcuauugagggaacaaaaaugucuuucccaccucccuuggggcagauggcauuuuagcaucucccuucccacaugcucugcuuucgaagggcuguaaugcuccuucugcugagaggcagggucucuguccccuccccuugaaucugggcaggcuucugacacuuugggacuucccaggcugggucagaaaauggagauagagaugcuuuuuggaacucuagcuauuggaaccuagccaccauaugacgaagccgaaaacagccauauucagaggccaugaccacucgccagaggaguaaaccagcaggccgucagaagacucuagcccacggcucggaagccauccugaccacuaagucuuugcagcugaggccccagacaucaaggaccagagacaagccauccuugcccuguccuuggcuacccagacccacugaauccacaagccuaauaaaaugguugcuauuuuucaacuaagaaggguggccugucaugcaacaauugucacugagccaugccugcuacauaaaauguuuuauuagaacaaaugauuugaauguuaaaacucuagaaagcugauaugaaauaacaaagaugcuugaaacauuuaagaucucaaacauacuuacgcagcaugaagggcuucccacuucaaaaucuccuuccaagccugcucguuauucugauugugaauucuaaugauauuauacauauccuucugacugauauccucauccuuccacuuccaccuaggaaagaauauuugguaaaauuugacaacuguuccugauaaugccauaaaguuaauccacauauuuucauaagaugauuuauucaacauuccccuuugagaaagaacuaagaaugcucauuuucucugaauuuaacagaucuaaggcucauuuucaagauuuacccaugaucauggagcagcacuauaaauccaaagcuacuauagaagcauugaaaacaaauauaaaagguucaccuuagucucauuuuacugagucacaguaaaccagacuuacagaaucaucuauuuuuaaggugacaauuguucagauaguaccacugaucaaugauccccuaacuuuuucuaaacauuuuaucuaacaguguuuucaguuuuuuaaaaaaccuauuacuagcugugaugguuaauuuuaugugucaaccugacuaugccacaggaugcccagacauuuggucaaacauuaugcugggugugucugugaggguguuuuuugaaugugaguaacauucuaaucaguaggcuaagugaagcagacugcccuccccacuccgugugggugggucacaucugaucagcugcagaccugaaugacaaaaaggcugacccuuccaugaguaagagggaaggccuucugcaugacugcuugagcugggacauuggacuuuuccugccuuuggacuuaaacugaaacaucaguucuucuugcaucuugagaccgcuggcuuucagaccagaagugugccaucggcucuccucggucuccagcuugcugacuacagaucuugggacuccacagcuuuauauaauuguguaagucaauucccuacaauaaauaucuuccugccuuccuugucuccugccccccuacacauauccuauugguucuguuucucuugagaacccugauuuaauacacuggucucgcacuuacauucugacaggugugaaaaaucaggugauuauaaacugauuaauacauaaaaauguacuauauuguuuugaagguaaaaaaucucuuuagcauauaacucuuggauauucugacaagaaauuuuuaucuuaaauaauauguucacucacccuuucuuuaacauugcauuccagaacaucugcucagaaggguaaacccacuuuuucucugaaucugcucucggaauggaugacucuucucugacaguagacaaugcaaauggcugaucuggagcugguguuugauuuggugguggcaucuaaauaaaaugaacagauuugcuuuuauaggauauaaaguaaaaggcaauauaauuaacuacuuccuggaaagcaauacaucacacaaaaagcacagauuacuuauuaaaucagugacaucaaaauuucagacuucucacauaauuugacuguuuugaagagucacauuacugagguuguguuucuucacugauuaaguucucaaauaugguaaacacugugguuaaauuuuuggccucuuucuccuuugaacaaauuuagaaguaaugucaccaaggaauaagaaguagaaacuaacgccacgaucuucaggcauuucuaaaaacuuuacgacaagcuuuucaaaaaugacuauucauucucuggggaaaacucucauagcacacauguacagcaaugcuuuuuuaaaaaaauauucucagauuuuuuagguuucugcuuaugcuucaucccuuaggcaaaauauauuacagaugagucuuugcaucucaacgcugcgaggucagaaggugggaagaaucccuucucccagacaugugggucaccaauacuguuaugcuagcacuuagccuuagccagggucucucauccguggcacuauugacauuuggagcuggacaauuuuuaguuaugguggucuaagcacugcaggauguucagcaggauauuugccugaggggcaaaaucacccaagguugggaaugacuggccuugaacuuucuguguuagaaguauaaaggauuuccuaguaaacauuaauuaaaagucuccaucacaacaaggcccucagaauaccgacagcaggaagggcuauguguaguaggcacugcagaguauucuaccugcauuaucaccacaguguguuuaagaacaugggucugagguggauaaggauucaguuuuggcucugccauuuccuagcuggugaugugggaugaaugacuccuucacucucaguaucuuuagcucugaaauggggacacuaagaauacuggcugcacagaguuguuaugaggauuaaaggggagaauguagggugcuuagcuuaaacgcuagaaaagugaccaaaagaggcuggucugaguacaguaguguuuacgacuaauugaucacaaccaguuacagauuucuuuguuccuucuccucucccacugcuucaguuggcuagccuugaauaaaaaauuuuuaaaaagugaccacaagaaaaguuagcuguuauucacauucucacuacauaucaugaucccaugggguaagugucuaggucuguaagguuccaaaaggcccauguucugaaccacucaccuauuagagaucaucuaggccaguggucugccaggggcuucggauaaugcugccugucgcugcuuucaugcuacagagaaagcagcagcagcagaacuggguagugugacagagacccuacggcccacagaaccaaacauauuuacuaccuggcccuuuauagaagcaguuugccaaugaccucugguguaaauauuugaaggccuaugugcaagauaaucuuggugcauuguccaaaacuucauuuucaaaaacaggcagugggccauaguuuguugauuccugagguggacgcugcuauuguaucccccacgcccuuucuuuuccaggcuaaauauuucuaguuucuuuacaggcugucugguucacuaaaauuucuauucuugauaauccuguggcccucugaaguauaugccugagccucccguuaaaacacgauuccaaacuuuagaccacaauuucugauguugucuaucacaaaauguagugaugucacaucaaccuugcccucacuucucaauggcauuaaauuugcuggcagucacacgacagugaaccacccuagugacucgggcaggcuggcacccuauuguaccugaagaaguuccccaaucauguaaugugucuacaaaguuuccccagaccaaagauaccuuaacuaacucuagcuaugguucuuacagaauuucccaucuaccaccuaguaacugucccagaagaaaauauucauuugguauggcuuauucccaguacaacuaugcuggcuccucauaaucacucugguuuuuuucccaggcacucccugaaacuacacuuacuaacacauucuagauuuucacuguagauagaauaucuaacuucucuguuuucaaaggacagaagaauucauccuagccauuugcaacuugucuugggagucuguauaagcaacccugcauaaaaagcuccagaaagaaaagaugaguguggauuaccagauuugaaggaucuagguucuccuuauucucagccgcagugccccuaaugggacacuccacguacucauaggcgcguuccuggugggcaggcacagaguauguuuucuucucacagguugggccagauggcucuguauucacuggacagccugaaauaaucaaguauaaaaauggugucaccaugaaggcaggacaucuaacucucucaauuggagcacuaaagagcugaauuucugaccaaugauuaccaccauaggaaaagccagguuucuucuguuuaaaucuaucaagaacugaacuagcuaacauuccaaaauccuaaagaugagaagguucuaaaauuuacauuuccuuugaaagaaaaaugaguauacauucucuaauugugucacacccccagcaaaaauaagccaaaaaaccuuggcaguugcaagagcauguguuaucugugccaugguuugaguaaccuggcuggaugagcagcuggggagcuguuagaggaaccuaagaggggaccagccacauuucacagggucuccuugacuuuccauucacuaguuccagagaagcccagauccaaucaggacacaguugcaauccaggcuuucauuacugaugcauuaucucagguacaaggaaggggaggagaaaaugaacagaggagacaucacagaggcuacugcaaaaaaaucugaaugccacucugcuuugucucaagacugaaacaaggcacaggaaaaccacguggccuauggccuauucccaucagucaauggcaagaguuuaacaggaaaagacagacaauaaagaaaauauuccacaacccauacaggaucaagaugcccauuacgagggaaggucugagccuaaugagaugagcaauagcaagggcuaugcccaaagacccaggaugcugaucccaauuagugagggacugggaaacugguucagagaaugagcaggcacuuggagagcugagacacagaagacagcugcucauguaauggaaucuuggccucaggcagcagcagcagcaacuacagcaauacacaugaaaaagcugaguuugcuuucacuuccuucccugcacuucuccucccaagcccucauuuccuggugcccugugccacugcccacuuuaggggugaaggaagacuugcuaugccuuuccucucuaccacugaaagcaccaauccuuuccaagucauagaucccagcuggguguuacaaagaaaauaacauuucaacuuuucacgucauauaaccaguagccccuucgaucuccuauagacacccacauucuuuauuaauguaguaagucuggcagcucuccaagauauacagcaaaugaaauaaaaccaaaguaaggguucuagaaucucccugaggacacucagaacaggagcacaccugcuuuggcugaucugucucaauucuuccuguacaaagaaaccccagaagaacacugccuguccuuguccaaggucacagaacuuuugcuggcuuugccacuuacuaugugacuuggagcaucaguuacuccaagucuuaguuuccuugacuauaaaauagggagaaaacuuagcuuaugaagucguaagaccacauagcuuaugaagaugagaauguaagcucuaucaggcaaagcuccauuuuguaugauguuauucucucgugcagaaacaaacaaaauccagcaaugcuugguacagaaugggcagugaccucucagaauaggcuggcugacugaagaaaugaauaacagcgcaaacauuaguacucaguaagcacaccauguugcuucugcccuucacgacuuacugauucaagccacacuuuaauauaaaaaaucuaaaguagacaugaaugaauuaaaaaugaaagacagcuuuuccauuuucauuuucuuaucuaaagaauggacagcaagcccguuaagugauggcuuacuuuuauauacgaaaauacugaaauggcuauacgagcaaaaguuauuuauuaagacagcuagaucuagacuaagguuucucaaccuuggcccucuugauauuuggggccagcugauucuuuguuggggggcuguucuguacauuguaggauguuuaggagcacuccugcccucuauucacuuuccucucaguugugacaaccaaaaaugccuccagauauuggcaaauguccccugugggaaggggggauugccccccuccaguuaagaaccacugauguaggcacaaguaaacuuugggaaguuggggcugguuuagaguacucacuacguucucauguacuaccucaaucaucaugacaggccugugaaacauuauuauaucuucaucuuacagaugacagacugaggcuaacagaguuaacuuguuuagagucacaaaccucaauaagacgcaaaauaacgaccagacccagggugccugacucccaugccuaccagccucagcagcauacuacacugccucuuccuuuagaggcuuuccagacuuuuuuuaagacacagucucacucugucacccaggcuggagugcaguggcacaaucuuggcucacugcaaccuuggccucccaggcgauccuacccaccucaaccuccaaagucgcugguacuacgggcacccaccagcacgucuggcuaauguuuguauuuuuuuguagagggagguuuuugccauguugcccaggcuggucucgaaguccugagcucaagcaauccacccaccucggccucccaaagugcugucacaggcgugaaccaccgcacccagccgugaauuaucuuuuguuuuuauuuucuaggcaaagggccgauuaccuuucauuuucccuucaugcaucgggcauccugaagguggggacgcugaagcauuugaggccugaacugcaacagcaggagcagauggagacaaacccauggcuggaaacaguguugacuguaaacaauuuuaaauuuccaccugccaaaacaaagagacagauuaaugucucuggacucagacuauucucucguuaguccuaaucuggucaacccuuguuccuccucuuugucaucccaugggcaucuaccaggcaggguacuaacuucgaaggacagcuuuaauauauugcccccuuagggaaauacugugaaacccaggccaaccucugggggcacguauguaucuaaggcagugaggauuuugggacugaggugaggcagucgcugagaaaccacgucacagccaggagguacaggccugaggcgggaguggggcgaggauuuccgaggaguggugacccggguggaggaggggagguccauugagccuagacuugacccccauccccagagccuuagcgaggggcuggggguccgagaagggugcggcgcaugaauaggaauucgaagaaacgaagggacaccagaggucgagaagcugccaagugucuuccccacaccgucccggcgcuugcccaccugcuccagcccgugguccccagaccaaaccggccgcggccagccugcccuucugcaccuaagcccucccccgggcuguuccgggaggccgguaccgccuucagucgccaacccgaacccagagcagcagugacuucacgccgccgccgccgccgccgccgccuuccucucacucggucaccgcuguggcugcggucaccgccggcguucucacgcaccccuacuuccuu

SEQ ID NO: 19236 - RNA, 12419 nt, Homo sapiens
aaggaaguaggggugcgugagaacgccggcggugaccgcagccacagcggugaccgagugagaggaaggcggcggcggcggcggcggcggcgugaagucacugcugcucuggguucggguuggcgacugaaggcgguaccggccucccggaacagcccgggggagggcuuaggugcagaagggcaggcuggccgcggccgguuuggucuggggaccacgggcuggagcaggugggcaagcgccgggacgguguggggaagacacuuggcagcuucucgaccucuggugucccuucguuucuucgaauuccuauucaugcgccgcacccuucucggacccccagccccucgcuaaggcucuggggaugggggucaagucuaggcucaauggaccuccccuccuccacccgggucaccacuccucggaaauccucgccccacucccgccucaggccuguaccuccuggcugugacgugguuucucagcgacugccucaccucagucccaaaauccucacugccuuagauacauacgugcccccagagguuggccuggguuucacaguauuucccuaagggggcaauauauuaaagcuguccuucgaaguuaguacccugccugguagaugcccaugggaugacaaagaggaggaacaaggguugaccagauuaggacuaacgagagaauagucugaguccagagacauuaaucugucucuuuguuuuggcagguggaaauuuaaaauuguuuacagucaacacuguuuccagccauggguuugucuccaucugcuccugcuguugcaguucaggccucaaaugcuucagcguccccaccuucaggaugcccgaugcaugaagggaaaaugaaagguaaucggcccuuugccuagaaaauaaaaacaaaagauaauucacggcugggugcggugguucacgccugugacagcacuuugggaggccgagguggguggauugcuugagcucaggacuucgagaccagccugggcaacauggcaaaaaccucccucuacaaaaaaauacaaacauuagccagacgugcuggugggugcccguaguaccagcgacuuuggagguugagguggguaggaucgccugggaggccaagguugcagugagccaagauugugccacugcacuccagccugggugacagagugagacugugucuuaaaaaaagucuggaaagccucuaaaggaagaggcaguguaguaugcugcugaggcugguaggcaugggagucaggcacccugggucuggucguuauuuugcgucuuauugagguuugugacucuaaacaaguuaacucuguuagccucagucugucaucuguaagaugaagauauaauaauguuucacaggccugucaugaugauugagguaguacaugagaacguagugaguacucuaaaccagccccaacuucccaaaguuuacuugugccuacaucagugguucuuaacuggaggggggcaauccccccuucccacaggggacauuugccaauaucuggaggcauuuuugguugucacaacugagaggaaagugaauagagggcaggagugcuccuaaacauccuacaauguacagaacagccccccaacaaagaaucagcuggccccaaauaucaagagggccaagguugagaaaccuuagucuagaucuagcugucuuaauaaauaacuuuugcucguauagccauuucaguauuuucguauauaaaaguaagccaucacuuaacgggcuugcuguccauucuuuagauaagaaaaugaaaauggaaaagcugucuuucauuuuuaauucauucaugucuacuuuagauuuuuuauauuaaaguguggcuugaaucaguaagucgugaagggcagaagcaacauggugugcuuacugaguacuaauguuugcgcuguuauucauuucuucagucagccagccuauucugagaggucacugcccauucuguaccaagcauugcuggauuuuguuuguuucugcacgagagaauaacaucauacaaaauggagcuuugccugauagagcuuacauucucaucuucauaagcuauguggucuuacgacuucauaagcuaaguuuucucccuauuuuauagucaaggaaacuaagacuuggaguaacugaugcuccaagucacauaguaaguggcaaagccagcaaaaguucugugaccuuggacaaggacaggcaguguucuucugggguuucuuuguacaggaagaauugagacagaucagccaaagcaggugugcuccuguucugaguguccucagggagauucuagaacccuuacuuugguuuuauuucauuugcuguauaucuuggagagcugccagacuuacuacauuaauaaagaaugugggugucuauaggagaucgaaggggcuacugguuauaugacgugaaaaguugaaauguuauuuucuuuguaacacccagcugggaucuaugacuuggaaaggauuggugcuuucagugguagagaggaaaggcauagcaagucuuccuucaccccuaaagugggcaguggcacagggcaccaggaaaugagggcuugggaggagaagugcagggaaggaagugaaagcaaacucagcuuuuucauguguauugcuguaguugcugcugcugcugccugaggccaagauuccauuacaugagcagcugucuucugugucucagcucuccaagugccugcucauucucugaaccaguuucccagucccucacuaauugggaucagcauccugggucuuugggcauagcccuugcuauugcucaucucauuaggcucagaccuucccucguaaugggcaucuugauccuguauggguuguggaauauuuucuuuauugucugucuuuuccuguuaaacucuugccauugacugaugggaauaggccauaggccacgugguuuuccugugccuuguuucagucuugagacaaagcagaguggcauucagauuuuuuugcaguagccucugugaugucuccucuguucauuuucuccuccccuuccuuguaccugagauaaugcaucaguaaugaaagccuggauugcaacuguguccugauuggaucugggcuucucuggaacuagugaauggaaagucaaggagacccugugaaauguggcugguccccucuuagguuccucuaacagcuccccagcugcucauccagccagguuacucaaaccauggcacagauaacacaugcucuugcaacugccaagguuuuuuggcuuauuuuugcugggggugugacacaauuagagaauguauacucauuuuucuuucaaaggaaauguaaauuuuagaaccuucucaucuuuaggauuuuggaauguuagcuaguucaguucuugauagauuuaaacagaagaaaccuggcuuuuccuauggugguaaucauuggucagaaauucagcucuuuagugcuccaauugagagaguuagauguccugccuucauggugacaccauuuuuauacuugauuauuucaggcuguccagugaauacagagccaucuggcccaaccugugagaagaaaacauacucugugccugcccaccaggaacgcgccuaugaguacguggagugucccauuaggggcacugcggcugagaauaaggagaaccuagauccuucaaaucugguaauccacacucaucuuuucuuucuggagcuuuuuaugcaggguugcuuauacagacucccaagacaaguugcaaauggcuaggaugaauucuucuguccuuugaaaacagagaaguuagauauucuaucuacagugaaaaucuagaauguguuaguaaguguaguuucagggagugccugggaaaaaaaccagagugauuaugaggagccagcauaguuguacugggaauaagccauaccaaaugaauauuuucuucugggacaguuacuaggugguagaugggaaauucuguaagaaccauagcuagaguuaguuaagguaucuuuggucuggggaaacuuuguagacacauuacaugauuggggaacuucuucagguacaauagggugccagccugcccgagucacuagggugguucacugucgugugacugccagcaaauuuaaugccauugagaagugagggcaagguugaugugacaucacuacauuuugugauagacaacaucagaaauuguggucuaaaguuuggaaucguguuuuaacgggaggcucaggcauauacuucagagggccacaggauuaucaagaauagaaauuuuagugaaccagacagccuguaaagaaacuagaaauauuuagccuggaaaagaaagggcgugggggauacaauagcagcguccaccucaggaaucaacaaacuauggcccacugccuguuuuugaaaaugaaguuuuggacaaugcaccaagauuaucuugcacauaggccuucaaauauuuacaccagaggucauuggcaaacugcuucuauaaagggccagguaguaaauauguuugguucugugggccguagggucucugucacacuacccaguucugcugcugcugcuuucucuguagcaugaaagcagcgacaggcagcauuauccgaagccccuggcagaccacuggccuagaugaucucuaauaggugagugguucagaacaugggccuuuuggaaccuuacagaccuagacacuuaccccaugggaucaugauauguagugagaaugugaauaacagcuaacuuuucuuguggucacuuuuuaaaaauuuuuuauucaaggcuagccaacugaagcagugggagaggagaaggaacaaagaaaucuguaacugguugugaucaauuagucguaaacacuacuguacucagaccagccucuuuuggucacuuuucuagcguuuaagcuaagcacccuacauucuccccuuuaauccucauaacaacucugugcagccaguauucuuaguguccccauuucagagcuaaagauacugagagugaaggagucauucaucccacaucaccagcuaggaaauggcagagccaaaacugaauccuuauccaccucagacccauguucuuaaacacacuguggugauaaugcagguagaauacucugcagugccuacuacacauagcccuuccugcugucgguauucugagggccuuguugugauggagacuuuuaauuaauguuuacuaggaaauccuuuauacuucuaacacagaaaguucaaggccagucauucccaaccuugggugauuuugccccucaggcaaauauccugcugaacauccugcagugcuuagaccaccauaacuaaaaauuguccagcuccaaaugucaauagugccacggaugagagacccuggcuaaggcuaagugcuagcauaacaguauuggugacccacaugucugggagaagggauucuucccaccuucugaccucgcagcguugagaugcaaagacucaucuguaauauauuuugccuaagggaugaagcauaagcagaaaccuaaaaaaucugagaauauuuuuuuaaaaaagcauugcuguacaugugugcuaugagaguuuuccccagagaaugaauagucauuuuugaaaagcuugucguaaaguuuuuagaaaugccugaagaucguggcguuaguuucuacuucuuauuccuuggugacauuacuucuaaauuuguucaaaggagaaagaggccaaaaauuuaaccacaguguuuaccauauuugagaacuuaaucagugaagaaacacaaccucaguaaugugacucuucaaaacagucaaauuaugugagaagucugaaauuuugaugucacugauuuaauaaguaaucugugcuuuuugugugauguauugcuuuccaggaaguaguuaauuauauugccuuuuacuuuauauccuauaaaagcaaaucuguucauuuuauuuagaugccaccaccaaaucaaacaccagcuccagaucagccauuugcauugucuacugucagagaagagucauccauuccgagagcagauucagagaaaaaguggguuuacccuucugagcagauguucuggaaugcaauguuaaagaaagggugagugaacauauuauuuaagauaaaaauuucuugucagaauauccaagaguuauaugcuaaagagauuuuuuaccuucaaaacaauauaguacauuuuuauguauuaaucaguuuauaaucaccugauuuuucacaccugucagaauguaagugcgagaccaguguauuaaaucaggguucucaagagaaacagaaccaauaggauauguguaggggggcaggagacaaggaaggcaggaagauauuuauuguagggaauugacuuacacaauuauauaaagcuguggagucccaagaucuguagucagcaagcuggagaccgaggagagccgauggcacacuucuggucugaaagccagcggucucaagaugcaagaagaacugauguuucaguuuaaguccaaaggcaggaaaaguccaaugucccagcucaagcagucaugcagaaggccuucccucuuacucauggaagggucagccuuuuugucauucaggucugcagcugaucagaugugacccacccacacggaguggggagggcagucugcuucacuuagccuacugauuagaauguuacucacauucaaaaaacacccucacagacacacccagcauaauguuugaccaaaugucugggcauccuguggcauagucagguugacacauaaaauuaaccaucacagcuaguaauagguuuuuuaaaaaacugaaaacacuguuagauaaaauguuuagaaaaaguuaggggaucauugaucagugguacuaucugaacaauugucaccuuaaaaauagaugauucuguaagucugguuuacugugacucaguaaaaugagacuaaggugaaccuuuuauauuuguuuucaaugcuucuauaguagcuuuggauuuauagugcugcuccaugaucauggguaaaucuugaaaaugagccuuagaucuguuaaauucagagaaaaugagcauucuuaguucuuucucaaaggggaauguugaauaaaucaucuuaugaaaauauguggauuaacuuuauggcauuaucaggaacaguugucaaauuuuaccaaauauucuuuccuagguggaaguggaaggaugaggauaucagucagaaggauauguauaauaucauuagaauucacaaucagaauaacgagcaggcuuggaaggagauuuugaagugggaagcccuucaugcugcguaaguauguuugagaucuuaaauguuucaagcaucuuuguuauuucauaucagcuuucuagaguuuuaacauucaaaucauuuguucuaauaaaacauuuuauguagcaggcauggcucagugacaauuguugcaugacaggccacccuucuuaguugaaaaauagcaaccauuuuauuaggcuuguggauucagugggucuggguagccaaggacagggcaaggauggcuugucucugguccuugaugucuggggccucagcugcaaagacuuaguggucaggauggcuuccgagccgugggcuagagucuucugacggccugcugguuuacuccucuggcgaguggucauggccucugaauauggcuguuuucggcuucgucauaugguggcuagguuccaauagcuagaguuccaaaaagcaucucuaucuccauuuucugacccagccugggaagucccaaagugucagaagccugcccagauucaaggggaggggacagagacccugccucucagcagaaggagcauuacagcccuucgaaagcagagcaugugggaagggagaugcuaaaaugccaucugccccaagggaggugggaaagacauuuuuguucccucaauagcauuuauugaauccccauuaggacuaaacacaaagagaugucuuaacucagagcucuuuuucucaaggagaauagguaaaugcagcuguguguguuaaaggagacaggacuucagucuguugagaguagugguucucacacuggagcgugcaucaggaucauggggaagguuuguuaaaacccagcaugcugggucccacccgcaggaugucugacugagucuguuucggguggugccuagacuggguguaucuagaacacugcauaugcugcugguuugagccagauuaugucauaaacagugguuuuaaauucauugcacaaugcgauuaauuaauuucuuggcuaaaguccacuuaaugauuuuuuuaagguguuuuguuuguuuuuaauauuugcacucugaaguucauugguugcacucccuggcugucacaggcugggccucaggccuggggugggugcaugugagaggggaacaacugcaaccguguugcccucaguaaucucuggacugagaggagccacaaguguuugcagugaccuacuuugaaaguguguucuaauuaagaccaccugcuaauuacuugugugauuauggagcaaagcgaagagagaaaagggaauuucaguuugucaguuucaauuccuucuccaguuauuuucuggacggucaaaauuaaguagaccguuuaaaaacucaugcuaugaucuccagaagaaaguuuugccuagauugaguuuaccuuuuugccugugauccucuugagaagagauguuaaggagaggaguaguuccuaaaaggagaagaaaaguaacucauaaguccucaaauagaaguccuuuauacuuuggaaauuuuucucccucccacuuacuuagacaccuaucuuguuauccaugggagcagcuaacaauauagguggccugcugacuuggccaccacucccucugucucgguaacagcugucugucuagccuguaggugggcugugaacuccacgaggacagugcucagagggucuuguauagcaggucagugcccugcuauacccuggugccuacagagggcuggcaccuagagaguccucagcaggggucugcggguagagggagugcauuugccagcuaggacucugccacuccucaucuuauguguaguuauuaaggagcugguccaacauuaauuacaauccauuucuagggauuaauccaucauuuucuuuucuucauaaaggcuguucauugguuugaaaugaaagaagaguauaggauuuucuuguuugucugaaaaaccccagcugcucugugccaaaaagaagcaugaugcacaauacuugaggcuguuuuuuuuuuuaauuugccuuuccuccuccaccaaauggaaaggcccuguuuccugacuccucaaagugcaguguagauauccagaaggaaggggaggcaauggaaugcaccaguccagaaggaaagaggaacauuuuuaacaaauaggcacuuguuguuugaauuauuuuagaacuuaccuuucucuguaaauguuauauuaugugaaauguauacaggaaaaaaauggauauuacuaaaaaauuagaacaucaucuuugucaaagaaaagaaaauauuuuaacagacuuuucuuauuuggggaauucuagagaguguccuugugguccaucauugauccgguuuggagggaaagcaaaagaguauucaccaagggcacgaauucguuccuggauggggugagugucagcgcagaaguguuguuucaccauccucaggucagggucaacuuucucuucacaccaaaaccagucuaagaauugcagugccaucuugcaaaacuuaaugcauauucaacuguagaugucuuucucucccugagguuugcccauuaaugggcagauuuauuaggguguaguagauugcuuccuauauaucauaggguugaauggaguuauugucaauguucuuggaucugcccucuuacucuucccgugaucugugucuuuggguuuaugcacuuagccauccucccuuucuuuucuagcauacuugagauuuuuugcucacaccugcaucucugcaguaucucagcugaccucccuggcuuaggucucuuccccauuggccuuauuccuuuguagacagaugagcugucaucugauacggacuuaucacaguucuucagugccaucuucccuuagugcuguucacuguguaauucuucaagucugacuuccccaguuagguguuugggagcagguguuugcaugugcuucuugaguuuucucauggcuuaaaccgggacugaauguauugcaagcauuuuaacacucaguggcauguuuuuauuccagguaugaguugccuuuugauaggcacgauuggaucauaaaccguugcgggacagaaguuagauaugugauugauuauuaugaugguggugaagucaacaaggacuaccaguucaccauccuggacguccguccugccuuagauucacuuucggcaguaugggacagaaugaaagucgcuugguggcguuggaccucguaaagcacuguuucagauggaaaaauauaaacuauuuuuuucugagcgauacauuaaacuauuuuccccagauugaauugcacucaugauguaaugggaacuucaaguggguaaucacacuuuuuccuucacuuaacgaaggauacuaugcacuguucacuuuugacuuguguuguaccuugcaguuuauagcagaucauuuuguuuucuuccuacuuagcuuaagugggaagcagucucucaguuuuuccuuuaccugcaguauugucuguauauuucaucucgaaaagccugaacaaccucugaaaaagagcuuuuaaaaagugaugaaaguugcuuuuuuuucuuacuauuuucucaggaauacuccagagauguaaagccugagaguccauggugaugcucaagagcuuucaucuggccaaauauuuuaacuaaagcuguucauuauaaauaagaggugauuauaccuuuuuuaaaaaaaguuaccauuauuucuaaagccccuaugguaugauugugaccuuuaacaaaaugcaaagguauacacuggaaagguacucagcaaaauucucuccaaauucugauuuauaugaauuucuuggacuggauagaguacuuucaacuauaccuuccuuuggaacauaccuuuuaaaaaauguucccuuuaaauccuguuauucuaauauguaacucugcucccaacaaacaggucuccucauuguccuuggcauuugacaaguuaucccaacuucgaaucucauuucuuccuuugcuggcagccuccacccuuccccacaucagucggccuaauccaaaccuugaaagccuggcuuaagucccaguaucagugauggucccccucuaaaacaugauuuuauauuuggcugaguguuaaaauucacaagaugagcauuuuuuucccagauggagaacgcuucaacucagucuagauuuuuuuuguuuguuuuaaggaagcucuaaguuugccauugaaacuuuuuguaccaguaauccauaaacugguuguucuauuuauagcagcauguuacaaaugacugcuuuuuuuuuuuaacugucuauacuauuaaauccuuuaauuuauccugaaugcuguaguguuaaauuaguggaugaaauuggcagucugugggugauuaauuugguauggauuugucaguuuuguguggaguuuaagaaauagaacagccuuaaacucuacauuucaaaauacuuguauauuuuaaaauaaagcugauuaguucacagguuuugaaaauuuuuuggaauaauuuuacacuuaacgauuguuucuucagacguauuaucuuuauaaaaccaaugcuuuaugauagaaugauuuauaacccagcacacauauguuuauugcagcacuguucacaauagcaaagacuuggaaccaacccaaaugcccaucaaugauagacuagauaaagaaaauguggcacauauauacuacagaauacuaugcagccacaaaaaaggaugaguucauguccuuugcagggacauggaugaagcuggaaacuauaauucucagcaaacuaucacaagaacagaaaaccaaacaccgcauguucucaagaguggggguugaacaaugagaauacauggacacagggaagggaacaucacuggggcccgucucggggccgggggggggugggggggguugggggggguggggaggaggcuaguggagggauagcauuaggagaaauaccuaauauagaugacggguugauggcugcagcaaaccagcauggcauguguauaccuauguaacaaaagugcacguucugcauauguaccccagaacuuaaaguauaauaauuuuuuuuuaaaaaaaacaaugcuauagucucccuacuccaagcag

SEQ ID NO: 19237 - RNA, 2459 nt, Homo sapiens
uuaccagagcugucuggggggaccaggaggccugaaaucgcauggugcaggcuggcugggugcuccaggcugggagugaccccguacagaacgaagugcagguccuccuccgugaacuggaaccgagcaggggacuucccuucuugguuggaggguuugggaccauccucugacugcuugcugggugagcaagguaauaacugggagguccucagccccucagguaacagagaagcauccgcagggggcgguggaauuaaagugucagguccacaacacgggccacucucguugucgccaccaaugauuugguggcccagaucuucacugcuggcacccgcguacucguggcugcugcucaggaagggcggcacuucccuggggacguggggaauuggguaccacgguggcagcuugcuguaccagggcagaucguagagaggcucccucuguaggcccagacccgggcucagcaagggaggcgccauccggaaggggaaggggggcauggcgggggcagcagacgcugcggccuccagcugccggaaagguuggaagucuuccuccacgguggccaggcuguuucuguaguguccauaggacgggaaaggcguguaguacgcggccagguucugcgggcugcucuccggcggguagcacaccuuguccugaggcacggccucacuuggccgggguagagccaucccgggaccgcacgcucggcggcucugcagaaaagcgggcgccgcugaggacaccgcgcgggagcuucccgggguccgacccgcgccuccccaccagccuccuccaccccagccagccccagauccaagggaacaggauaaacgcccccaguccgaucccgccagcccgcucccacaauuaagacaaaacgaaaaaacagcaauagaagcaaacacaaaaaagccccaaacggaaaucugccgggauccugcccuacucuaaauuccggguuaguguugccuuccccuucccucuccaagcaccccuucccuaagcccggccgccuucccacacccgcucuccgcuuucggcccccaacccgguuccugcaaaacccauugaaguucccuuuccuuccuucuucucaguccuacaaaacucguugguagggucugugggagccgcggggcccugccaaccucggggcugggccgggagccgagcgcaggcggucggagggcaauggagcaagcgacagcuccaggcgcuccugggcccucggcugggagggaagagccgaggacccugggucgcaccgcgcagauggagacgcgcucccagagcccccgggcagguccagggaccccgcgaccugcucuggcccagcggugugaccccgcggguccuggcgguccugacugcccgcaggggaggggcgcgccacuuuuggcugcccuaggaugcgccgccugaaccucuuuucccucgcgggcagcguccgccacauuccccggguuccucggaaacuccaaucauucuaccaggacuauuggggccugggguagccccucgggagccgcguggacgagcccuggccaggugggagcgaagagccucggcgacugccaguccucccgcccccgcaccgccgggaaaggauggcguuuuaauagacaggcagcaaguucaccgaggcugaagaaugaagccccuucagggccggcgggucuugagaucaaugagcccaauaagaaaaccaagcagggucaugacucagaaauuaaagaacacggggucaggagaagaggucagccacgacacaggcagcggcccgucuccucccgauccuccaaaggcgcccuucuccuagccuccuccgaccucagggaucugcaacuugggauucaaagcccccgagagggcagaacgaccauccaaaacgaacugcgccagcgagugcugccgcccuccccaacggcccuggaagaccaccgccccgggccccaggcgcguccugucccgugccuaccuccgacaccaccuccaagagcgccaccgcggagcgggcgccuccuggacgcugcggggccacucgggcucgguaggccacucgggcucgguagacuucgggcgggcccugagggcugagccaggcuuaagagggcgggcggggccgcggggcaucgacaggucgaggguagggaauugacccggcccacgcagauccccgcgucgucuucuccccgcccaccgcagccauuggccgacucucgacucgcccucuguccccuggggucgcucacuuaacucaucaguuuuccaaacccucccugggacccuaguggcgagcacucgccgcuggccuucuagggcaggcaguauugccgcuccaggcgugcggagucggggagaaaaaaaccgaacacgugugcuacccagggcccccagauaagccccuccgcgcgcacacacacccugaaccggaguccagaagg

SEQ ID NO: 19238 - RNA, 2459 nt, Homo sapiens
ccuucuggacuccgguucagggugugugugcgcgcggaggggcuuaucugggggcccuggguagcacacguguucgguuuuuuucuccccgacuccgcacgccuggagcggcaauacugccugcccuagaaggccagcggcgagugcucgccacuagggucccagggaggguuuggaaaacugaugaguuaagugagcgaccccaggggacagagggcgagucgagagucggccaauggcugcggugggcggggagaagacgacgcggggaucugcgugggccgggucaauucccuacccucgaccugucgaugccccgcggccccgcccgcccucuuaagccuggcucagcccucagggcccgcccgaagucuaccgagcccgaguggccuaccgagcccgaguggccccgcagcguccaggaggcgcccgcuccgcgguggcgcucuuggagguggugucggagguaggcacgggacaggacgcgccuggggcccggggcgguggucuuccagggccguuggggagggcggcagcacucgcuggcgcaguucguuuuggauggucguucugcccucucgggggcuuugaaucccaaguugcagaucccugaggucggaggaggcuaggagaagggcgccuuuggaggaucgggaggagacgggccgcugccugugucguggcugaccucuucuccugaccccguguucuuuaauuucugagucaugacccugcuugguuuucuuauugggcucauugaucucaagacccgccggcccugaaggggcuucauucuucagccucggugaacuugcugccugucuauuaaaacgccauccuuucccggcggugcgggggcgggaggacuggcagucgccgaggcucuucgcucccaccuggccagggcucguccacgcggcucccgaggggcuaccccaggccccaauaguccugguagaaugauuggaguuuccgaggaacccggggaauguggcggacgcugcccgcgagggaaaagagguucaggcggcgcauccuagggcagccaaaaguggcgcgccccuccccugcgggcagucaggaccgccaggacccgcggggucacaccgcugggccagagcaggucgcggggucccuggaccugcccgggggcucugggagcgcgucuccaucugcgcggugcgacccaggguccucggcucuucccucccagccgagggcccaggagcgccuggagcugucgcuugcuccauugcccuccgaccgccugcgcucggcucccggcccagccccgagguuggcagggccccgcggcucccacagacccuaccaacgaguuuuguaggacugagaagaaggaaggaaagggaacuucaauggguuuugcaggaaccggguugggggccgaaagcggagagcgggugugggaaggcggccgggcuuagggaaggggugcuuggagagggaaggggaaggcaacacuaacccggaauuuagaguagggcaggaucccggcagauuuccguuuggggcuuuuuuguguuugcuucuauugcuguuuuuucguuuugucuuaauugugggagcgggcuggcgggaucggacugggggcguuuauccuguucccuuggaucuggggcuggcugggguggaggaggcugguggggaggcgcgggucggaccccgggaagcucccgcgcgguguccucagcggcgcccgcuuuucugcagagccgccgagcgugcggucccgggauggcucuaccccggccaagugaggccgugccucaggacaaggugugcuacccgccggagagcagcccgcagaaccuggccgcguacuacacgccuuucccguccuauggacacuacagaaacagccuggccaccguggaggaagacuuccaaccuuuccggcagcuggaggccgcagcgucugcugcccccgccaugccccccuuccccuuccggauggcgccucccuugcugagcccgggucugggccuacagagggagccucucuacgaucugcccugguacagcaagcugccaccgugguacccaauuccccacguccccagggaagugccgcccuuccugagcagcagccacgaguacgcgggugccagcagugaagaucugggccaccaaaucauugguggcgacaacgagaguggcccguguuguggaccugacacuuuaauuccaccgcccccugcggaugcuucucuguuaccugaggggcugaggaccucccaguuauuaccuugcucacccagcaagcagucagaggauggucccaaacccuccaaccaagaagggaaguccccugcucgguuccaguucacggaggaggaccugcacuucguucuguacggggucacucccagccuggagcacccagccagccugcaccaugcgauuucaggccuccugguccccccagacagcucugguaa

SEQ ID NO: 19239 - RNA, 2809 nt, Homo sapiens
ccucauucccaccucccacagccugaacucaugccccuucuuuggacuacucagcuuguagcugccacacucugucugcauuauguguguggacauugacuauuacuggcaggccuggccacagagccuaggccaaggauuuacuaguuugguccuugucuagcucacacuaaccaccucuccuuuuuuuuuuuuuuuuuuuuuuuuuuuuuuuuuuugaggcagggucuccgucuauugcccaggauccaggauagagugcaguggugugaucaaaacacacugcagccucgaccuucugggcucaagugauccucccgccuccgccucccaaagcagggauuccaggcgugagccgccgcucccggccucaccuggccuucuuuguugggcuagguggggacugggaaaugcacagggccacuuucaaaucaaagucagaagcacuuugcucgcuccacagaguccucagugcucugcugaaagcaaggaggcuuuuuccaaggcucuaguuuugccuccagggaaacugaggcacaaggcagcaaugauuacugaggguccugccuccgcuccucuaggugaggagccuauuccaggggcuccagucugaaagccuagaggcgaggggcgcgcacuacaauucccagagguccccggacucaagggcgguccccgccccccgccuucuccgcgcgacgaagccgggcuuaccaaugggagcccggaguggggcgagcaggggcgggacggggcgggacugcggggagguggccggcgggccgcgccgcgagccaguaucucagagagcgcgggguccggacagccgcgcgcugagggucucggggcgggcgccgcgggaccucuccgggccauggguaagcggcucugcggcgcggcccggacaggggcucggcggcccugcagggagguucaaggugccggcgccggguccccuccagcccucguggcagucggugcgcuguguggggcggagaggggcccgggguggguuucggggcgcgggccaaggggagcgagcccggcccgcggcuucagcgcuccccggccggcgcggaaggggugaggcugggcguccgcgcgagcuucgagaaaaggaaagacaaaaaguuuuggcggccaggggcuucccgggcguuuaucucgaaacucuuuucgccgucucuugccugaaauaugccgagcccgguacggcucugucgucccacuuccugcugcgguuuccaccucgagcugggcucagcuaauuuguugugacagcugucggcagccgccccuccgccccgugacaucccgcagguuucagaaccgcggcgccgccgggcacagacuccggguccagagcgcgcggcccuuuccucugcggccgccguuuccugaaaggggcugcgcgggugugaagaacuugcucaaugcgcuuuguaggauccacuguuccucuuucggccgcgggcugcgccgaugguccggggagcccggcuucucgcccccugccccuuccuucucuucccuuuucucuuuuccucuccugucucuccgcccacccgccgcagccccacaggagaggggucgcuucccugguugcucuccucuccugucccuuguguguccccuugucuucccucggucugcagaagggacgggguggcggcuggggagcgucaggggaagagggcaagagcgugggcuacgagcuugcaggcgaugcccggcuucgcgcucggcgggagcugcgggccaacccgggcccgcgcuccgucccuccgcggugucuaggggucgcccgggcuggggucgcgucacccuccgcccagcgccggcgugguggggcuugcgcggugcaggacccccgagggcccagggggucccaaggcgcugcggguccagugucccuuuguuugcagagucuugggccaguaaggagugcuccgcgggccccaggggaggacaacaggugccucuugccccacccgggcuccucuggugggagcccacacgcacgguggcgucacugcgccuacaggcaacgcuagagcacaggaggggugggaggucggggcucgagggcuucaccccgcagcagagcucagagcccaauccaggccuuagggacccgccuggggccuagaacuugguguggcagagguagaaagggccuccgauaaucugcuucuacaguugagagacgucaacuggcaccucugagccucugccccguaggugaaaugggaacacacgaaaccaucugaggagcucucacuguccgucaccaccaaauguggcccagacuccguggggagggacagucccauccuggaacuggggcuuuuaggacaucccagagcccgguaagagggacagggagaauggggcuuggaaguugguagccucacauucagugucccccgcaccuccuucccuuucuguacccucugguggcucuuguggccucagcugcccccagacccugucucucucgcccucccccaagcugagguacugagguugggcuguggcuugagcugcaccugugcccuguuagggagugggggucccaggcccaucgcguuucuucucacugcuggcuccagcucaacacuuggcaggccccccuccccaaacugcuggagcaagcucgcguagacucggccuggccgccgcucccgggcugccgaguggaccggccguuucgccgcuucaaaggcugucuuuguuuugcuccagcucaagcuuagagaaacuuaagccaacaaccucagccgagggggcggggcggcgucugcugguu

SEQ ID NO: 19240 - RNA, 2809 nt, Homo sapiens
aaccagcagacgccgccccgcccccucggcugagguuguuggcuuaaguuucucuaagcuugagcuggagcaaaacaaagacagccuuugaagcggcgaaacggccgguccacucggcagcccgggagcggcggccaggccgagucuacgcgagcuugcuccagcaguuuggggaggggggccugccaaguguugagcuggagccagcagugagaagaaacgcgaugggccugggacccccacucccuaacagggcacaggugcagcucaagccacagcccaaccucaguaccucagcuugggggagggcgagagagacagggucugggggcagcugaggccacaagagccaccagaggguacagaaagggaaggaggugcgggggacacugaaugugaggcuaccaacuuccaagccccauucucccugucccucuuaccgggcucugggauguccuaaaagccccaguuccaggaugggacugucccuccccacggagucugggccacauuugguggugacggacagugagagcuccucagaugguuucguguguucccauuucaccuacggggcagaggcucagaggugccaguugacgucucucaacuguagaagcagauuaucggaggcccuuucuaccucugccacaccaaguucuaggccccaggcgggucccuaaggccuggauugggcucugagcucugcugcggggugaagcccucgagccccgaccucccaccccuccugugcucuagcguugccuguaggcgcagugacgccaccgugcgugugggcucccaccagaggagcccggguggggcaagaggcaccuguuguccuccccuggggcccgcggagcacuccuuacuggcccaagacucugcaaacaaagggacacuggacccgcagcgccuugggacccccugggcccucggggguccugcaccgcgcaagccccaccacgccggcgcugggcggagggugacgcgaccccagcccgggcgaccccuagacaccgcggagggacggagcgcgggcccggguuggcccgcagcucccgccgagcgcgaagccgggcaucgccugcaagcucguagcccacgcucuugcccucuuccccugacgcuccccagccgccaccccgucccuucugcagaccgagggaagacaaggggacacacaagggacaggagaggagagcaaccagggaagcgaccccucuccuguggggcugcggcgggugggcggagagacaggagaggaaaagagaaaagggaagagaaggaaggggcagggggcgagaagccgggcuccccggaccaucggcgcagcccgcggccgaaagaggaacaguggauccuacaaagcgcauugagcaaguucuucacacccgcgcagccccuuucaggaaacggcggccgcagaggaaagggccgcgcgcucuggacccggagucugugcccggcggcgccgcgguucugaaaccugcgggaugucacggggcggaggggcggcugccgacagcugucacaacaaauuagcugagcccagcucgagguggaaaccgcagcaggaagugggacgacagagccguaccgggcucggcauauuucaggcaagagacggcgaaaagaguuucgagauaaacgcccgggaagccccuggccgccaaaacuuuuugucuuuccuuuucucgaagcucgcgcggacgcccagccucaccccuuccgcgccggccggggagcgcugaagccgcgggccgggcucgcuccccuuggcccgcgccccgaaacccaccccgggccccucuccgccccacacagcgcaccgacugccacgagggcuggaggggacccggcgccggcaccuugaaccucccugcagggccgccgagccccuguccgggccgcgccgcagagccgcuuacccauggcccggagaggucccgcggcgcccgccccgagacccucagcgcgcggcuguccggaccccgcgcucucugagauacuggcucgcggcgcggcccgccggccaccuccccgcagucccgccccgucccgccccugcucgccccacuccgggcucccauugguaagcccggcuucgucgcgcggagaaggcggggggcggggaccgcccuugaguccggggaccucugggaauuguagugcgcgccccucgccucuaggcuuucagacuggagccccuggaauaggcuccucaccuagaggagcggaggcaggacccucaguaaucauugcugccuugugccucaguuucccuggaggcaaaacuagagccuuggaaaaagccuccuugcuuucagcagagcacugaggacucuguggagcgagcaaagugcuucugacuuugauuugaaaguggcccugugcauuucccaguccccaccuagcccaacaaagaaggccaggugaggccgggagcggcggcucacgccuggaaucccugcuuugggaggcggaggcgggaggaucacuugagcccagaaggucgaggcugcaguguguuuugaucacaccacugcacucuauccuggauccugggcaauagacggagacccugccucaaaaaaaaaaaaaaaaaaaaaaaaaaaaaaaaaaaggagaggugguuagugugagcuagacaaggaccaaacuaguaaauccuuggccuaggcucuguggccaggccugccaguaauagucaauguccacacacauaaugcagacagaguguggcagcuacaagcugaguaguccaaagaaggggcaugaguucaggcugugggaggugggaaugagg

SEQ ID NO: 19241 - RNA, 2486 nt, Homo sapiens
ccgggcugacggugugugucgccgccacgcaccgcugccuguucgaacgcauggcugagcugccgaccggcucgcuaccccaaacaccguacgccacccaacuccucuuguaacgccaucgcgcguggcauuguguuggguucugcguguguggcaucggagucguggaauuuagggggaacaaggcuuuuccccccguccccccggggucucccuugggugggggcgacacggccaaggcggcgcgcccugggggugcccgggggcgcuucuuccccagggcguuacgcaccggcggcccggcgcggaggugcgcgggggcgaucgggagaugcggggcgggcgagggguggugggaugggcgccgccuuaacuucgauccugcggcggcccgagagaagccgucgccgccccgcccgagcugggugccgcggcacucugcucugcgccgcgcgucuccgcggcugccucuuuaaucaggaacacagaaggggcgggcccugagccggcgcguaaucggauagcucugccgcggcucugacauccacaugcugcucggccugaaaaggcaguggggagccggaggggaggcagagaucgcgagcgaggcaccagccugcagccggcccccagcacauccucagccgcacagacacucggcgagguggaggugagggcgggcgccagcgaacucggagaggggcucgcucacucccaggcgaucccagccgccaccgccgccgcaccagcagcagcaacagcagcagcagcuuccuuccucagacuccccucgagaggcuggccaagcggguguagccguugggggaggcucccgccgggggaacccggcgaggacaagagcagggcggccgccuuccacucgggcuguccggcggcggcugccuccgcccguguguccgucaagggugccgcgggaugugugucaguuuacgccucugagaucacacagcugccugggggccgugugaugcccaaggcaagucuugguuuuaauuauuauuauuaucauuauuguuacgcuuggcuuucgggaaauacucgugauauuuguaggauaaaggaaaugacacuuugaggaacuggagagaacauauaugcguuuuguuuuuaagaggaaaaccguguucucuucccggcuuguucccucuuugcugauuucaggagcuacucuccuccuggugagguggaaauuccagcaagaauagaggugaagacaagccaccaggacucaggagggaaacgcugaccauuagaaaccucugcauaagacguuguaaggaggaaaauaaaagagagaaaaacacaaagauuuaaacaagaaaccuacgaacccagcucuggaaagagccaccuucuccaaaauggauauguuuccucucaccuggguuuucuuagcccucuacuuuucaagacaccaagugagaggccaaccagguaagccacugaaaguuuuucuauuuauugcaacaugguuuccccuuuaaaagugaccgcuaaagcaggaaggccacgcagaacggcacagaagaaggcucccucaguacucaauaauuuaaagagagaucccagccggcccuuccuacaccaccacggcugcuaaaacccaacuuuccucuccugcuaggagugugugugugugugugugugugugugugugaguguguuuugaaacagaauuuggcgguguucauaugucacauauggacugaaucaaagguuuaaaaauacuacaaagccuuugcauuacaguuuuugggaauuuuuuuucccugucuugaagcagaacacaucucccuugaguuucuccaacuagccagugaaauauaaaucauuugcauucccuccacuuagcuacauugagcaauguuaacugaagggcuugggaaagacaagaguuuaguuuugguuuucagaugcuguagauucuuuggagaaugacugguuaugcuucagaaucauaaggcucaggcugguggagcaaguuggcuuguggcugagauaggggcuugggguugggugcugcuggcaaccaagacgguuggucucuucucucuucauccauguguugucugggaaaguaaaucguacguucuuuuagaaauuauuauuagcuaaaacaaauugcaggcccucgaaggucucucacucuugugaagugguuagaaacuuuugaguggaauuuguucucaaccacugccaaaaaggguguguggacaggcugcuguggagauaagcauuucgaggcccagaacagucuggggaccgcauuuguggggagcggcaagggguaugcucuggaaaggggaauccauggggaaugcagugggguuugugcuuccuucucggaccacucucuagagugagccucccuaccccucugagaacagugucuggaaucuaacaacaaaacucuuagcagcugcuacaggugauuggagauggagaaaccaucuauggaggaaaug

SEQ ID NO: 19242 - RNA, 2486 nt, Homo sapiens
cauuuccuccauagaugguuucuccaucuccaaucaccuguagcagcugcuaagaguuuuguuguuagauuccagacacuguucucagagggguagggaggcucacucuagagagugguccgagaaggaagcacaaaccccacugcauuccccauggauuccccuuuccagagcauaccccuugccgcuccccacaaaugcgguccccagacuguucugggccucgaaaugcuuaucuccacagcagccuguccacacacccuuuuuggcagugguugagaacaaauuccacucaaaaguuucuaaccacuucacaagagugagagaccuucgagggccugcaauuuguuuuagcuaauaauaauuucuaaaagaacguacgauuuacuuucccagacaacacauggaugaagagagaagagaccaaccgucuugguugccagcagcacccaaccccaagccccuaucucagccacaagccaacuugcuccaccagccugagccuuaugauucugaagcauaaccagucauucuccaaagaaucuacagcaucugaaaaccaaaacuaaacucuugucuuucccaagcccuucaguuaacauugcucaauguagcuaaguggagggaaugcaaaugauuuauauuucacuggcuaguuggagaaacucaagggagauguguucugcuucaagacagggaaaaaaaauucccaaaaacuguaaugcaaaggcuuuguaguauuuuuaaaccuuugauucaguccauaugugacauaugaacaccgccaaauucuguuucaaaacacacucacacacacacacacacacacacacacacacuccuagcaggagaggaaaguuggguuuuagcagccguggugguguaggaagggccggcugggaucucucuuuaaauuauugaguacugagggagccuucuucugugccguucugcguggccuuccugcuuuagcggucacuuuuaaaggggaaaccauguugcaauaaauagaaaaacuuucaguggcuuaccugguuggccucucacuuggugucuugaaaaguagagggcuaagaaaacccaggugagaggaaacauauccauuuuggagaagguggcucuuuccagagcuggguucguagguuucuuguuuaaaucuuuguguuuuucucucuuuuauuuuccuccuuacaacgucuuaugcagagguuucuaauggucagcguuucccuccugaguccugguggcuugucuucaccucuauucuugcuggaauuuccaccucaccaggaggagaguagcuccugaaaucagcaaagagggaacaagccgggaagagaacacgguuuuccucuuaaaaacaaaacgcauauauguucucuccaguuccucaaagugucauuuccuuuauccuacaaauaucacgaguauuucccgaaagccaagcguaacaauaaugauaauaauaauaauuaaaaccaagacuugccuugggcaucacacggcccccaggcagcugugugaucucagaggcguaaacugacacacaucccgcggcacccuugacggacacacgggcggaggcagccgccgccggacagcccgaguggaaggcggccgcccugcucuuguccucgccggguucccccggcgggagccucccccaacggcuacacccgcuuggccagccucucgaggggagucugaggaaggaagcugcugcugcuguugcugcugcuggugcggcggcgguggcggcugggaucgccugggagugagcgagccccucuccgaguucgcuggcgcccgcccucaccuccaccucgccgagugucugugcggcugaggaugugcugggggccggcugcaggcuggugccucgcucgcgaucucugccuccccuccggcuccccacugccuuuucaggccgagcagcauguggaugucagagccgcggcagagcuauccgauuacgcgccggcucagggcccgccccuucuguguuccugauuaaagaggcagccgcggagacgcgcggcgcagagcagagugccgcggcacccagcucgggcggggcggcgacggcuucucucgggccgccgcaggaucgaaguuaaggcggcgcccaucccaccaccccucgcccgccccgcaucucccgaucgcccccgcgcaccuccgcgccgggccgccggugcguaacgcccuggggaagaagcgcccccgggcacccccagggcgcgccgccuuggccgugucgcccccacccaagggagaccccggggggacggggggaaaagccuuguucccccuaaauuccacgacuccgaugccacacacgcagaacccaacacaaugccacgcgcgauggcguuacaagaggaguuggguggcguacgguguuugggguagcgagccggucggcagcucagccaugcguucgaacaggcagcggugcguggcggcgacacacaccgucagcccgg

SEQ ID NO: 19243 - RNA, 2548 nt, Homo sapiens
cauaggcgaggaaguugaaagcucugaaucucacauccccuuuugccucccagcccuauguccaccuuucauccuagguaaaaucugaauuggagagggggaaaaggaauuagauucagaaacgaacaccaggcacagaauaccaaacccuuccuuucuacucuuccccacccccaccccgcacccccgcacuccuaaaguauuuuuuucccuuccugggauaaaauaaaagucauuuugcaguuaaauauguuuuaccaucuaccacaggcaaucaucuucaauaaaaagcaaugguuaugcacaugggaggggcuucagggcucccacccgaaaggcauuagcuaccaaggaugugggguguuugugguguguguguagggguggagggauagaaacgucuggaggcacggggguggaggggccaagagggacaaagguggaauuagcucagaagauagguaaugccucucucuccaggccgcaauuaaaauaauauuuuaacaaaagagauuuuuuuuccaaguucagaaaaaaaccuaugcggggcgcgagggggguggaggagggaguugauaauguaacauacacucuuucagacuguagauaggguaccaggggauuuggaccuugugaccgaauaagagcucagaaucaguauucggacagaguagggggagggggcgggcaacguguggguaggaggaaggagaaagagcgaaagcugggauagacucggcuagacaguucccccggguagcaggauccuccagggcuccaauuccggggugcaaggacccuccccgacuacucccgagcugcaccccagcucgaagccacuugcugcgcaaagcgcgcgggcccagccggucucgugucccccgcccgugcgccgcguaacugacuggcacacugagcgcgcucaccgaucuugacuugcucgcgguagcucuuuucguugaggcaaaccccgcggccgugcagcagggcgugcagcggcuucuccucguccugccgggggaggcagcgcagccccugggcgcagcgcucgguguagacgccgcacgacugccccucggccagggcgcaggucaugcagcagccgcagcccggcuccuugaccagcucgcagcccagggggcugggggggcacauggagagggcuuucucgucgcagggcucgcagugcacgaaggagcccaggcucugggccggccccgcauaggcggccagcagcaggaggaccgcggugagcaacaccaucuucucuuagucgcccccuuuaccucgggguggggcaggagagcgagagugcagggauaaaggggccaagagggcccccggagauuuuuuuguuuuuguuuuuguuuuaaaauuucuggcagguagagcaggugcccucccccagacacuugcaaaaauguagagagagguggagggcuggggugccugcgagcaggucccaguugcaagaauuaaagccuugcaacagguugggggaagcagggcagcgccaggugcacgcagugagcggaggccggagaaacccucaagccugagcgggucagaauuauaggggaaaaaaagccacaaaauuguucacccccaagcaaccaccgaaauaaugagaucggaugcaguggagauggcguugggggugggagagaaaaauggauuuaucuuuaaaauuuuugcuuaaaaucuaaaauacaccccgcuuucuaacccucagcugccagcggugcgcggcgccgcagaacagguaagaggcguuggcugcagccgagagggugggagaaaauguugaaaucaagaaauuaaaaaacaaaaacaaaaacaaaaaaaccccaaacccuaacaccucuuuucucccacuuugccaccuccucuucgaaauucgcagguucuacgcgaaguccggagaagggugaaaacggaggagggguaaugaaaaggagcaaaaaagggaaaaagcccacacugcuuugcagcucuuuccuagcucuuuuccccugcagaaguuuccaaagagacuacggggcuccgggagagcaggcgcuuuuaaauagccggccccuggcugccagccaguuuguagcugcaauuugagcuucccaacacccaacucaggcaaggaugccaaggagcuuugcaguacaaacucacacgggguggggguggggagaggccuucuagacacaagggggcuccccuucgcucccugaacagcgcccuccuccccucugaacagcgcccuccuccccccggaauguaagaaaggggcaagggggacaggcuggggcuaccgagaauggggaggagguggaggggccaguggaagacagaguucuucggagcagggugaacacaaugaggagaguaacuucgucuccccuucccuccuauccuuuaaguagucaaggcacaggcugaagggagacguauuuucuuauuagccaacuggauauaccgugcccaagaaaucuuccuaagcuucugcaauugacuguaugcuggugucuguuuccauguggggugugugugugug

SEQ ID NO: 19244 - RNA, 2548 nt, Homo sapiens
cacacacacacaccccacauggaaacagacaccagcauacagucaauugcagaagcuuaggaagauuucuugggcacgguauauccaguuggcuaauaagaaaauacgucucccuucagccugugccuugacuacuuaaaggauaggagggaaggggagacgaaguuacucuccucauuguguucacccugcuccgaagaacucugucuuccacuggccccuccaccuccuccccauucucgguagccccagccugucccccuugccccuuucuuacauuccggggggaggagggcgcuguucagaggggaggagggcgcuguucagggagcgaaggggagcccccuugugucuagaaggccucuccccacccccaccccgugugaguuuguacugcaaagcuccuuggcauccuugccugaguuggguguugggaagcucaaauugcagcuacaaacuggcuggcagccaggggccggcuauuuaaaagcgccugcucucccggagccccguagucucuuuggaaacuucugcaggggaaaagagcuaggaaagagcugcaaagcagugugggcuuuuucccuuuuuugcuccuuuucauuaccccuccuccguuuucacccuucuccggacuucgcguagaaccugcgaauuucgaagaggagguggcaaagugggagaaaagagguguuaggguuugggguuuuuuuguuuuuguuuuuguuuuuuaauuucuugauuucaacauuuucucccacccucucggcugcagccaacgccucuuaccuguucugcggcgccgcgcaccgcuggcagcugaggguuagaaagcgggguguauuuuagauuuuaagcaaaaauuuuaaagauaaauccauuuuucucucccacccccaacgccaucuccacugcauccgaucucauuauuucggugguugcuugggggugaacaauuuuguggcuuuuuuuccccuauaauucugacccgcucaggcuugaggguuucuccggccuccgcucacugcgugcaccuggcgcugcccugcuucccccaaccuguugcaaggcuuuaauucuugcaacugggaccugcucgcaggcaccccagcccuccaccucucucuacauuuuugcaagugucugggggagggcaccugcucuaccugccagaaauuuuaaaacaaaaacaaaaacaaaaaaaucuccgggggcccucuuggccccuuuaucccugcacucucgcucuccugccccaccccgagguaaagggggcgacuaagagaagaugguguugcucaccgcgguccuccugcugcuggccgccuaugcggggccggcccagagccugggcuccuucgugcacugcgagcccugcgacgagaaagcccucuccaugugcccccccagcccccugggcugcgagcuggucaaggagccgggcugcggcugcugcaugaccugcgcccuggccgaggggcagucgugcggcgucuacaccgagcgcugcgcccaggggcugcgcugccucccccggcaggacgaggagaagccgcugcacgcccugcugcacggccgcgggguuugccucaacgaaaagagcuaccgcgagcaagucaagaucggugagcgcgcucagugugccagucaguuacgcggcgcacgggcgggggacacgagaccggcugggcccgcgcgcuuugcgcagcaaguggcuucgagcuggggugcagcucgggaguagucggggaggguccuugcaccccggaauuggagcccuggaggauccugcuacccgggggaacugucuagccgagucuaucccagcuuucgcucuuucuccuuccuccuacccacacguugcccgcccccucccccuacucuguccgaauacugauucugagcucuuauucggucacaagguccaaauccccugguacccuaucuacagucugaaagaguguauguuacauuaucaacucccuccuccaccccccucgcgccccgcauagguuuuuuucugaacuuggaaaaaaaaucucuuuuguuaaaauauuauuuuaauugcggccuggagagagaggcauuaccuaucuucugagcuaauuccaccuuugucccucuuggccccuccacccccgugccuccagacguuucuaucccuccaccccuacacacacaccacaaacaccccacauccuugguagcuaaugccuuucgggugggagcccugaagccccucccaugugcauaaccauugcuuuuuauugaagaugauugccugugguagaugguaaaacauauuuaacugcaaaaugacuuuuauuuuaucccaggaagggaaaaaaauacuuuaggagugcgggggugcgggguggggguggggaagaguagaaaggaaggguuugguauucugugccugguguucguuucugaaucuaauuccuuuucccccucuccaauucagauuuuaccuaggaugaaagguggacauagggcugggaggcaaaaggggaugugagauucagagcuuucaacuuccucgccuaug

SEQ ID NO: 19245 - RNA, 2472 nt, Homo sapiens
cugucacaucaaacuauccagauuuaucugucacugcuguucaucuguggcauaaacaugccuuguuuacuuggggaacauaugauggauauccuucgaaaauuagcuuuucaauauauaaaucaagagugauuuguauagauauauguggcagcaauguuuuuuauucauuugggcuaaaagaaugggaaaugcaaacugcccucuugaaccaaguaccaacgagcuagcaaugaagagacaguguagccacggggcaaaccucgagccauuuucugccugaugacaaucccauuuucaugcuucucacuuguccagucacacaacacugccuaaccugccaccgggcuggagagcuccuccaggcuacagucggcuucccagucccagccauaguagagccuccuucggauccgggcacucagcuucugguguccugggaggaacugaaacagggcaggggcagcggagggugaagggcacggaaagguaugaugcagauccuggcucugggcuggaaggcggggcaggggacaggccggccucgcugcuagggggcccgugccuuacccagacccgcguucuguaaaucgcuugccaauggcagccugguccauagagggaggaaugcccccacccccaucgaggguuccccgggagaaguucuccgagaagggcccucguguggccaccccuacgcccauuccuauacuccgcggcucucccucccggcccaagcagccgcggccucaaggaagcacugcucgagcagcugccgcccagucccggcacagcagucaggcgagcucgcagcgccgcucaggccgggaggggcgcgccgggaggccggggagggggcgggacccccacucaccgugaaguccuggaagccggcgagggagaaggugccuucuucguccagcaggagcccggucagguccaucgcgccgccagucgccgcccugcgaaggugaacggaaggaaacgaguuguagggggcucgcggagcuguccuugcccgccuguccaccugccagccugccuccccggggcgggccgccguccucgcccucgcccucgcagcucccuccccccggcggcggaaggcggggcccgggcugaacugggcgccucuuccuguuccgccccgggcuuggcgcggcgcgcgggggcccuaggcccgggaagggaggugucaagcguccgugcgacgcucaccucgcggagcagaaaggagaugcggcugcgaggcgcguacuccgccugugccgcguccgcccggcguuuacaagccgcgggggugccgccugcaagucagcgccuggcacuuccugccgcccaucuggcccagccucccgccccgacccgcgggcaggaaccggacucgaacuccuggucucacggaacguggccaagccccaggcgccucugagaaauggggacaauucguaggggggaccacgccgcacugaggaugaacaagccaggcguagcaauggagaaguuaaugugaauaagacgaaacgcacaacaggaaguuguucccaguugcuuuuuaggagagauauuauacauacucagcaaugcauaugaaaagcgucugaaaggacacacaggaaauuuagcagugggugaacuaugaaaaggaagagaaacucaggguguuuuuuuuuuuuacuguaauuugaacuuuuaaaccuaaggcuacugaggaaauucugugaucuuaagcgaauguaaggccucaaaacgugucaacacguccacccaaaaguaaacugcaucuacccaagguuuuguguugaaacccaccucccgccuccgaucucaugcuugaguaggccgaggugggaagaagcuccgauauguggaagugggaaaguuuaaggagauaggaaagaaacaacuuuucugaguagauguuguuuucgagucugucgagucaagcgcugguguguguuuguuuacccacugaggggagggaacugggaggaccagugcguugaggguugguugaguaaugggacggccaccgcccuucccgagcgagcagaagcagacccuaccggggauacugggaaucuggaagcccacuuccugccccacacggggauaccggggcagcaccacacucccuagccgcccugccuacugugggauaagaaaacgggcucgacugccuggaccuagacccggacucggaacccgggguacuucgucaaccagaaaacgaaccuguguaggcgcagugucagcggcagccgccggggcgcaugcgcggcccgcccuauccggggggggggggguuaggccgcgucacgugacgggcucagcgcuccgcagucacgugacgcucguccgcaaccucugcuguccuccgcggcgcccccuuccgccugacgcgcccccggcggcggccgcgcagcccuggcuccucgcgggcucgggcggcggcugcggcggggcuauggc

SEQ ID NO: 19246 - RNA, 2472 nt, Homo sapiens
gccauagccccgccgcagccgccgcccgagcccgcgaggagccagggcugcgcggccgccgccgggggcgcgucaggcggaagggggcgccgcggaggacagcagagguugcggacgagcgucacgugacugcggagcgcugagcccgucacgugacgcggccuaacccccccccccccggauagggcgggccgcgcaugcgccccggcggcugccgcugacacugcgccuacacagguucguuuucugguugacgaaguaccccggguuccgaguccgggucuagguccaggcagucgagcccguuuucuuaucccacaguaggcagggcggcuagggaguguggugcugccccgguauccccguguggggcaggaagugggcuuccagauucccaguauccccgguagggucugcuucugcucgcucgggaagggcgguggccgucccauuacucaaccaacccucaacgcacugguccucccaguucccuccccucaguggguaaacaaacacacaccagcgcuugacucgacagacucgaaaacaacaucuacucagaaaaguuguuucuuuccuaucuccuuaaacuuucccacuuccacauaucggagcuucuucccaccucggccuacucaagcaugagaucggaggcgggagguggguuucaacacaaaaccuuggguagaugcaguuuacuuuuggguggacguguugacacguuuugaggccuuacauucgcuuaagaucacagaauuuccucaguagccuuagguuuaaaaguucaaauuacaguaaaaaaaaaaaacacccugaguuucucuuccuuuucauaguucacccacugcuaaauuuccuguguguccuuucagacgcuuuucauaugcauugcugaguauguauaauaucucuccuaaaaagcaacugggaacaacuuccuguugugcguuucgucuuauucacauuaacuucuccauugcuacgccuggcuuguucauccucagugcggcgugguccccccuacgaauuguccccauuucucagaggcgccuggggcuuggccacguuccgugagaccaggaguucgaguccgguuccugcccgcgggucggggcgggaggcugggccagaugggcggcaggaagugccaggcgcugacuugcaggcggcacccccgcggcuuguaaacgccgggcggacgcggcacaggcggaguacgcgccucgcagccgcaucuccuuucugcuccgcgaggugagcgucgcacggacgcuugacaccucccuucccgggccuagggcccccgcgcgccgcgccaagcccggggcggaacaggaagaggcgcccaguucagcccgggccccgccuuccgccgccggggggagggagcugcgagggcgagggcgaggacggcggcccgccccggggaggcaggcuggcagguggacaggcgggcaaggacagcuccgcgagcccccuacaacucguuuccuuccguucaccuucgcagggcggcgacuggcggcgcgauggaccugaccgggcuccugcuggacgaagaaggcaccuucucccucgccggcuuccaggacuucacggugagugggggucccgcccccuccccggccucccggcgcgccccucccggccugagcggcgcugcgagcucgccugacugcugugccgggacugggcggcagcugcucgagcagugcuuccuugaggccgcggcugcuugggccgggagggagagccgcggaguauaggaaugggcguagggguggccacacgagggcccuucucggagaacuucucccggggaacccucgaugggggugggggcauuccucccucuauggaccaggcugccauuggcaagcgauuuacagaacgcgggucuggguaaggcacgggcccccuagcagcgaggccggccuguccccugccccgccuuccagcccagagccaggaucugcaucauaccuuuccgugcccuucacccuccgcugccccugcccuguuucaguuccucccaggacaccagaagcugagugcccggauccgaaggaggcucuacuauggcugggacugggaagccgacuguagccuggaggagcucuccagcccgguggcagguuaggcaguguugugugacuggacaagugagaagcaugaaaaugggauugucaucaggcagaaaauggcucgagguuugccccguggcuacacugucucuucauugcuagcucguugguacuugguucaagagggcaguuugcauuucccauucuuuuagcccaaaugaauaaaaaacauugcugccacauauaucuauacaaaucacucuugauuuauauauugaaaagcuaauuuucgaaggauauccaucauauguuccccaaguaaacaaggcauguuuaugccacagaugaacagcagugacagauaaaucuggauaguuugaugugacag

SEQ ID NO: 19247 - RNA, 2349 nt, Homo sapiens
guaagggcagggcgcaguggaggccccaauccaccugacucccaggcuccuggucuuacuguucgccagcuguaauggaggcgcugggggaggccauggucccucuucggagcugucugcucaccuccacuugggccugccuccccauccaccucucaggcaucucaccaggaccguuccucuucuuccccucccagcgaagccgggcagggaugaggggucugagaugagggaggaagggaaaugggauugagcccagggguaaccugacucccugcagugggucgugugggggccaggcacacuacggaggggaaagccuggaacaaauaccgagggacucccuuaagccgggccggcgaugggggcuccuggagggagagaaggagccaaguggagucaagucccuccccugcugcccccucccuccacggcucccucgcaacccgagccggggggccuaaaaauagcccccaggcgcaaucgccggccgccccggugaccuucuggguagcacaggccgaaggcgggcgggcagcaggaaggcaggccgccggccccccagacuugucuccuagggcaccgucccgcgggugcccccguggccgcccaguuccggcguccccccagcccagcucucaguggccaugcagaaagcccggggcacgcgaggcgaggaugcgggcacgagggcaccccccagccccggagugcccccgaaaagggccaaggugggggccggcggcggggcuccuguggccguggccggggcgccagucuuccugcggccccugaagaacgcggcggugugcgcgggcagcgacgugcggcugcgggugguggugagcgggacgccccagcccagccuccgcugguuccgggaugggcagcuccugcccgcgccggcccccgagcccagcugccuguggcugcggcgcugcggggcgcaggacgccggcguguacagcugcauggcccagaacgagcggggccgggccuccugcgaggcggugcucacagugcuggaggucggagguaaagggcaggugggggccgcgcccggcaggggcggggugcucagagguagaaaagggcugcccaggccacgcggguaagguacuggauacugguuccgccgccuucuucccaggugcccuggcuucucggcugcccggccccagaagugagacgaagagccaagugcagggaauggggugucaagguagagaggcuccccacaggaaggucagaggucaaggggcagcaagcgguugauaagccaagccugagacccacucccaccucucagggaauucugggguggaaguucuucuccuccuguggagaaaagccuccugggggaaaggguguccuucaguuccaugauuuaaacuugagauugacacuccgaucagcuccuuaacaggggaguccauguccgaaggagggggccagcuccucugguccaggcugcacuguugaagggauggcucagagcucccugcaggccauugccguggcaggguugauguggucagcucuaggugggguguggaagaggccuaugguuggccacgugugaacaggguccaggguaggaggagguggagcccgagccagggccccaugggcaugaauggaggugagugcuugagaauccacaugcaggugugugccugcaugggugcuguggagggcccuggauucugugugguggugcaaacaggugagguaugggcacguggagcuggaaugggaagcuccuggaccaugucuaccugagcuuccagaguggauguuuccagagcauggaagggggaugcuauggaccagugcuugucccccgcccauagauuuccaggugcagugugaagaaaaggcugagggucugaggcagaaggggagggcaagaggcugggcccagugcucaugguccagcuggggcuaccauggaggccaggccagggccguuagccuuggauccauuugggggcuuccuuuuugauuuccucaguccuugaguaagccaagugguacuucucuagccaaaggcagagccuugggcaggcugcgccuugagaaacagaauucugaggaaguaggcuacagcugggagagauggcaaggagcuggggguucacucccuuggacguuucuaagagggacaugucacuccccugggugcugcuguguagggguaaauccuuggaggcuggggaggaggcacagggaggaaagcccucagcagcaggugggcaagaagucucuaggacacagccaagucaggagagggagccgggcuggccucccuccaucggcaucuccuccccccagcccugcucugcccac

SEQ ID NO: 19248 - RNA, 2349 nt, Homo sapiens
gugggcagagcagggcuggggggaggagaugccgauggagggaggccagcccggcucccucuccugacuuggcuguguccuagagacuucuugcccaccugcugcugagggcuuuccucccugugccuccuccccagccuccaaggauuuaccccuacacagcagcacccaggggagugacaugucccucuuagaaacguccaagggagugaacccccagcuccuugccaucucucccagcuguagccuacuuccucagaauucuguuucucaaggcgcagccugcccaaggcucugccuuuggcuagagaaguaccacuuggcuuacucaaggacugaggaaaucaaaaaggaagcccccaaauggauccaaggcuaacggcccuggccuggccuccaugguagccccagcuggaccaugagcacugggcccagccucuugcccuccccuucugccucagacccucagccuuuucuucacacugcaccuggaaaucuaugggcgggggacaagcacugguccauagcaucccccuuccaugcucuggaaacauccacucuggaagcucagguagacaugguccaggagcuucccauuccagcuccacgugcccauaccucaccuguuugcaccaccacacagaauccagggcccuccacagcacccaugcaggcacacaccugcauguggauucucaagcacucaccuccauucaugcccauggggcccuggcucgggcuccaccuccuccuacccuggacccuguucacacguggccaaccauaggccucuuccacaccccaccuagagcugaccacaucaacccugccacggcaauggccugcagggagcucugagccaucccuucaacagugcagccuggaccagaggagcuggcccccuccuucggacauggacuccccuguuaaggagcugaucggagugucaaucucaaguuuaaaucauggaacugaaggacacccuuucccccaggaggcuuuucuccacaggaggagaagaacuuccaccccagaauucccugagaggugggagugggucucaggcuuggcuuaucaaccgcuugcugccccuugaccucugaccuuccuguggggagccucucuaccuugacaccccauucccugcacuuggcucuucgucucacuucuggggccgggcagccgagaagccagggcaccugggaagaaggcggcggaaccaguauccaguaccuuacccgcguggccugggcagcccuuuucuaccucugagcaccccgccccugccgggcgcggcccccaccugcccuuuaccuccgaccuccagcacugugagcaccgccucgcaggaggcccggccccgcucguucugggccaugcagcuguacacgccggcguccugcgccccgcagcgccgcagccacaggcagcugggcucgggggccggcgcgggcaggagcugcccaucccggaaccagcggaggcugggcuggggcgucccgcucaccaccacccgcagccgcacgucgcugcccgcgcacaccgccgcguucuucaggggccgcaggaagacuggcgccccggccacggccacaggagccccgccgccggcccccaccuuggcccuuuucgggggcacuccggggcuggggggugcccucgugcccgcauccucgccucgcgugccccgggcuuucugcauggccacugagagcugggcuggggggacgccggaacugggcggccacgggggcacccgcgggacggugcccuaggagacaagucuggggggccggcggccugccuuccugcugcccgcccgccuucggccugugcuacccagaaggucaccggggcggccggcgauugcgccugggggcuauuuuuaggccccccggcucggguugcgagggagccguggagggagggggcagcaggggagggacuugacuccacuuggcuccuucucucccuccaggagcccccaucgccggcccggcuuaagggagucccucgguauuuguuccaggcuuuccccuccguagugugccuggcccccacacgacccacugcagggagucagguuaccccugggcucaaucccauuucccuuccucccucaucucagaccccucaucccugcccggcuucgcugggaggggaagaagaggaacgguccuggugagaugccugagagguggauggggaggcaggcccaaguggaggugagcagacagcuccgaagagggaccauggccucccccagcgccuccauuacagcuggcgaacaguaagaccaggagccugggagucagguggauuggggccuccacugcgcccugcccuuac

SEQ ID NO: 19249 - RNA, 2652 nt, Homo sapiens
ggguaaaagagagaaaaggaaacgugaugggaauagaaagcaacaaagugaauuaauuuuuaagggggaggugggggaggggaggggaacagaccucccucccuccccuucaacauuagccuagggcucucagagccuuuuugucuugggcucccaaguuuuucucccccccccccaaaaaaagaggggguuuaaaaaaaagaaagaaaacagucucuacaucuggggcgagagaggucucaggggacguccuaacaagugugugaaguggccaggagaacgcgggauccacgauuccucucaggggaaugaauaacccuagggaccgaggggcggcgacggccgagauggcaccagaaccaccagaagccacgucggaaggagaugggagauccagagggcgagagagggccccuuuccucccaagcgaugucugugggcagguguauaaaucucucagagccuccgucuggagggcuccggguaccggcugcccagccaaggcuaaguugguuuuuggcucccuccuucggaacagagaaaacgauagauuacacagggauggauggacggaugucuggagagauggaaagaugaauggauggauggauggguggauggauggauagaugaauggguggauggauggagggauggauggacggacggacggacagauauauggauggaugcauuauggauggaugcauggacggacggacggaugcacggagagauggauggaugcauggauggauagauagacggauggacggacggauagauagauggaugccggaaaggagaagaaugagagacggaugugagacuagaugcacgcaggccagagcaccagcauacgcuggaacagagcacgagcauacacucgaacacacgcgcacacacucaggacaucugcgcacagacauacaauccuccgcguccgcuuccacgcaggcauucgcgcaccuacauacacgcaguugcacgcgcgcgcacacacacaggcacacacacgcagacaugcacacacacgcagacaugcacacacaccacacaugcagacaugcacacacacgcagacaugcacacacacaccacacauacacacacacacacacacaguucgccucucccuggguuucucagaaacuaaaugaucaccgcccccccgccccgccccaccucccgacacagacacacaggcacauacaauccucccagcacguccgaacggaugcacagaaaacugagcacccagacgggucccgucgaccccgcacguuagcucuaaacugugugcaauucuggggcgaaaagcuaaaacucgacugcguucaacuugccggcggguuccccaagucugcggggcgaagagcucgggccccucaggcccgcaaucgcacccucggggcgcugggcuuggcgaggagaaaggugucugacuccgggugcuagaaaucaggucacuggcgccugacgagcggcgccacgaccgcugcgcugcggagcaggccccgcagcccggucccgagaagcgcagggcucgggaaacuuugcagaaaccagagcucgaaaggcuuucgcuagaauccgggagcaccaagccuucacugugcuccaggcugcguuuuccccucgccccgggcuggcucaggagaggacgugguucuuguaauuuuuuuuuuaaaucccggcguugucucccgugcauccccucagggcgccucgagcgggccucucuggcggaugcugauaaacuuuggccuuugguuacaaacuuggacagacccgccgcgugcacgggucaccgccucggggcaggcuguccggcgguuccccgcugccccuucgccgauccccucgccucagcccccuucucccgaaucgggacgcaccauucacacugggcuccccccgcaccaccuggcccugcgcuccugaggaccccucacccgcgauggccccucgcuguccccgaccacagaaaggccgucccgcucuuaccuucauucgcgggguauacccuggaaccugugacagcgucgcaaaucccgaagagacacgaaaauagggcgaaauagaaaaucccagccaugguucgccggugccaacgcugcuccugccgcuucuaucccaguggaauaaaugcuuaaguuaggagagcagcgggcugaagacauugccaagggggcgggcccggccggugacgugagcccgccaguccggggcccgcggccaauggcggcgcagacagggcggccgagccccgccuucaccgagcagggcccgccccaggguuccgcccccuccgggcuccacggggcgcgcggucucccggggcucuagggggcgagcacggccgguccccgcccccgccugccggagggagccagcgggaucccccacguuaccucgaaggucgagccccuggacggcggagggacuuuggaaaagcucggaauugaccgaggggagccagagaagagguuggaaaccuuuucucccaccacgggcgguuuaagauggaggaaaacgcucuuuuauugaaauaaaagaagucuaagcugaccugcgguugcuucuuuaggagagucgacgugucugcguccagcgcgcccgggcugagcugcagacucgcgccugccaccg

SEQ ID NO: 19250 - RNA, 2652 nt, Homo sapiens
cgguggcaggcgcgagucugcagcucagcccgggcgcgcuggacgcagacacgucgacucuccuaaagaagcaaccgcaggucagcuuagacuucuuuuauuucaauaaaagagcguuuuccuccaucuuaaaccgcccguggugggagaaaagguuuccaaccucuucucuggcuccccucggucaauuccgagcuuuuccaaagucccuccgccguccaggggcucgaccuucgagguaacgugggggaucccgcuggcucccuccggcaggcgggggcggggaccggccgugcucgcccccuagagccccgggagaccgcgcgccccguggagcccggagggggcggaacccuggggcgggcccugcucggugaaggcggggcucggccgcccugucugcgccgccauuggccgcgggccccggacuggcgggcucacgucaccggccgggcccgcccccuuggcaaugucuucagcccgcugcucuccuaacuuaagcauuuauuccacugggauagaagcggcaggagcagcguuggcaccggcgaaccauggcugggauuuucuauuucgcccuauuuucgugucucuucgggauuugcgacgcugucacagguuccaggguauaccccgcgaaugaagguaagagcgggacggccuuucuguggucggggacagcgaggggccaucgcgggugagggguccucaggagcgcagggccagguggugcggggggagcccagugugaauggugcgucccgauucgggagaagggggcugaggcgaggggaucggcgaaggggcagcggggaaccgccggacagccugccccgaggcggugacccgugcacgcggcgggucuguccaaguuuguaaccaaaggccaaaguuuaucagcauccgccagagaggcccgcucgaggcgcccugaggggaugcacgggagacaacgccgggauuuaaaaaaaaaauuacaagaaccacguccucuccugagccagcccggggcgaggggaaaacgcagccuggagcacagugaaggcuuggugcucccggauucuagcgaaagccuuucgagcucugguuucugcaaaguuucccgagcccugcgcuucucgggaccgggcugcggggccugcuccgcagcgcagcggucguggcgccgcucgucaggcgccagugaccugauuucuagcacccggagucagacaccuuucuccucgccaagcccagcgccccgagggugcgauugcgggccugaggggcccgagcucuucgccccgcagacuuggggaacccgccggcaaguugaacgcagucgaguuuuagcuuuucgccccagaauugcacacaguuuagagcuaacgugcggggucgacgggacccgucugggugcucaguuuucugugcauccguucggacgugcugggaggauuguaugugccugugugucugugucgggagguggggcggggcgggggggcggugaucauuuaguuucugagaaacccagggagaggcgaacuguguguguguguguguguauguguggugugugugugcaugucugcgugugugugcaugucugcauguguggugugugugcaugucugcgugugugugcaugucugcgugugugugccugugugugugcgcgcgcgugcaacugcguguauguaggugcgcgaaugccugcguggaagcggacgcggaggauuguaugucugugcgcagauguccugagugugugcgcguguguucgaguguaugcucgugcucuguuccagcguaugcuggugcucuggccugcgugcaucuagucucacauccgucucucauucuucuccuuuccggcauccaucuaucuauccguccguccauccgucuaucuauccauccaugcauccauccaucucuccgugcauccguccguccguccaugcauccauccauaaugcauccauccauauaucuguccguccguccguccauccaucccuccauccauccacccauucaucuauccauccauccacccauccauccauccauucaucuuuccaucucuccagacauccguccauccaucccuguguaaucuaucguuuucucuguuccgaaggagggagccaaaaaccaacuuagccuuggcugggcagccgguacccggagcccuccagacggaggcucugagagauuuauacaccugcccacagacaucgcuugggaggaaaggggcccucucucgcccucuggaucucccaucuccuuccgacguggcuucuggugguucuggugccaucucggccgucgccgccccucggucccuaggguuauucauuccccugagaggaaucguggaucccgcguucuccuggccacuucacacacuuguuaggacguccccugagaccucucucgccccagauguagagacuguuuucuuucuuuuuuuuaaacccccucuuuuuuugggggggggggagaaaaacuugggagcccaagacaaaaaggcucugagagcccuaggcuaauguugaaggggagggagggaggucuguuccccuccccucccccaccucccccuuaaaaauuaauucacuuuguugcuuucuauucccaucacguuuccuuuucucucuuuuaccc

SEQ ID NO: 19251 - RNA, 2232 nt, Homo sapiens
augauguguucaggccaugauuuuucuguaaaaaauuaccagcaugcugcucuuaauuuuuuucagccugucuaguuguugcccuuuugcucucaugcaaacuuuuccucagaggugacccuagaagaugggacccuuugugauggacuaccccaaggcaauaugccccaaaaggucuucauuuggggcauaacccgugccaacacaaagguacuuucucaauuguguguauggugccucacccaaacaauauuacagaugcacuuggcuuucaucaaccuaauuugauaugccccaagcacagcaauaggacaguuuugcguggcccuuuggaaacgcuuuucuuuacauuuccaggaccuaccauaguuggagaaccacguuagggcugaagacaguccuaguauaucauugaccaaccacauaaccccaaggucuguccucagccuucagaaggaacaugcuucuuacaccgauuucagcucagugauaugggauucaaauguaugaccuccaaaauauuaagagaauaacguguguuguuuuaagccaccaaguuuggguaauuuguuacagccaugauaggaaacgaaugcauccacuuugccagguuuaccugcuuuuauaaagccuggguuuaaccuuuuaucuaaauaauggucaacucuuccuacaucacgagcauuuaugugcaauuaaaagccaucauuaaauuaagccagaguauuaauauauucauagauuucaccaccacacaguaaaacauugaagucaaaugauuuagagcaaaccaccuggcucacacuuucccaacggaaaaagguaaggcucaaagugcugagaugaacauucuguccuagcacuaggaaauaaucauugucugccucaggcuuaaguuuaauaaauagcaaauugcauacagauauuuacaaugaucgaaagacaaacagagguccuauccgugcagucccaacaauaaagacaggcauuggcauaaaguguuuauaaauucuuggguacagcuguucugaaaguaaaguucacuuucaauccuaaaaaaaguccgcuauuccuccagaugugcuuaaaggcaaauguggacuggaauuacuuggugucaauggggagcaacugcucuaugccguuuauuaugaaggacuuuaacucaacucuccaucuuccuccacuuccacccuuucuuggccauucucaaugauucucuugguggugauuuuuuuaccaucaacuauuucaguggaagucgacauggacuugaagcugccugucccaucacuaccguaggacaugcagaaggaagaaaggcccccacuucccagggagccaaaggaacgaaauccuguaucaaaagaagaaaaaccacccucaaaagcuggaaauucacugaaggcagagaaaaggggugcagacccucugcuucugcuucccagggaguuccucugaccccccaaaauauucuccagcggguuucccaagaggucaaaggagaaugggucccggccgccaaagaacucccugaagaccucggcggggucacggaagcugaagaccuacucgaagggguccuugaagggccugccgccugcgcagccgcccuccgcccucgccucgccauagcggucauagauaucgcguuucuacgcguccgacaacaccucguaggccucagccaccugcuugaaucuucucaccgcuuccucccuguccucgggguuuuugucggggugccacuugagcgccagcuugcgguacgccuucuugauacccucggacgaggccuaccgggguacucccagcaccucguaguaguccacuaugcuggacugccaaagagccugcggggcacuggcacagcgagcggcaaggcugccagcacccgcgcacaggucagaggcuuggcgaccugggccgccuggagggccgccccuuaugacgcagccacaucucauuggccgaggccugugagcgccucgcaucccaagaugcagugcuccugggacuggcccugcucucugugaggcucugugaggcccugugaugcuccaagaccaggccccgcccacuccggccuccaaccagccauggucuccaaaaaggaugggaaaaagagguuggggaaaagagagggccuugacuuuggcugccugaagaacuguuuuucuuaaaguaggcuuuauaucagucuuuuuccucggccacaggagggaagagggu

SEQ ID NO: 19252 - RNA, 2232 nt, Homo sapiens
acccucuucccuccuguggccgaggaaaaagacugauauaaagccuacuuuaagaaaaacaguucuucaggcagccaaagucaaggcccucucuuuuccccaaccucuuuuucccauccuuuuuggagaccauggcugguuggaggccggagugggcggggccuggucuuggagcaucacagggccucacagagccucacagagagcagggccagucccaggagcacugcaucuugggaugcgaggcgcucacaggccucggccaaugagauguggcugcgucauaaggggcggcccuccaggcggcccaggucgccaagccucugaccugugcgcgggugcuggcagccuugccgcucgcugugccagugccccgcaggcucuuuggcaguccagcauaguggacuacuacgaggugcugggaguaccccgguaggccucguccgaggguaucaagaaggcguaccgcaagcuggcgcucaaguggcaccccgacaaaaaccccgaggacagggaggaagcggugagaagauucaagcagguggcugaggccuacgagguguugucggacgcguagaaacgcgauaucuaugaccgcuauggcgaggcgagggcggagggcggcugcgcaggcggcaggcccuucaaggaccccuucgaguaggucuucagcuuccgugaccccgccgaggucuucagggaguucuuuggcggccgggacccauucuccuuugaccucuugggaaacccgcuggagaauauuuuggggggucagaggaacucccugggaagcagaagcagagggucugcaccccuuuucucugccuucagugaauuuccagcuuuugagggugguuuuucuucuuuugauacaggauuucguuccuuuggcucccugggaagugggggccuuucuuccuucugcauguccuacgguagugaugggacaggcagcuucaaguccaugucgacuuccacugaaauaguugaugguaaaaaaaucaccaccaagagaaucauugagaauggccaagaaaggguggaaguggaggaagauggagaguugaguuaaaguccuucauaauaaacggcauagagcaguugcuccccauugacaccaaguaauuccaguccacauuugccuuuaagcacaucuggaggaauagcggacuuuuuuuaggauugaaagugaacuuuacuuucagaacagcuguacccaagaauuuauaaacacuuuaugccaaugccugucuuuauuguugggacugcacggauaggaccucuguuugucuuucgaucauuguaaauaucuguaugcaauuugcuauuuauuaaacuuaagccugaggcagacaaugauuauuuccuagugcuaggacagaauguucaucucagcacuuugagccuuaccuuuuuccguugggaaagugugagccaggugguuugcucuaaaucauuugacuucaauguuuuacugugugguggugaaaucuaugaauauauuaauacucuggcuuaauuuaaugauggcuuuuaauugcacauaaaugcucgugauguaggaagaguugaccauuauuuagauaaaagguuaaacccaggcuuuauaaaagcagguaaaccuggcaaaguggaugcauucguuuccuaucauggcuguaacaaauuacccaaacuugguggcuuaaaacaacacacguuauucucuuaauauuuuggaggucauacauuugaaucccauaucacugagcugaaaucgguguaagaagcauguuccuucugaaggcugaggacagaccuugggguuaugugguuggucaaugauauacuaggacugucuucagcccuaacgugguucuccaacuaugguagguccuggaaauguaaagaaaagcguuuccaaagggccacgcaaaacuguccuauugcugugcuuggggcauaucaaauuagguugaugaaagccaagugcaucuguaauauuguuugggugaggcaccauacacacaauugagaaaguaccuuuguguuggcacggguuaugccccaaaugaagaccuuuuggggcauauugccuugggguaguccaucacaaagggucccaucuucuagggucaccucugaggaaaaguuugcaugagagcaaaagggcaacaacuagacaggcugaaaaaaauuaagagcagcaugcugguaauuuuuuacagaaaaaucauggccugaacacaucau

SEQ ID NO: 19253 - RNA, 2432 nt, Homo sapiens
auuucgcacacuggccuuccuuucuccuucccaccgucauuuggacauuccgcgccccccgccccccacccuuuagcggauugucuuucuaugacauuaacacauugugauuuccuggccuuugagggguagaggagggguggggggagcgugagaaagcucaaaggagaggaggcaguacaggcgacggcccuuugcccagaaccaucacucaaagggccgccaugccucccccgcacccucccagccucggcagcgucaggagaaguagcaggaggcgcgaggcccaagagauugcccgcuuugucccugggguggggacugguugaggacugauggggggauucacgauucauccuccccccaccgccaccaugaaaauguagugaaccucaauugcuuccuaaccggaguggaggcguagggacgugcagaucccagaccaucuuuuuugagacagacaacguuggucaaagggauguuuuguggccuuauaaguucccaccagacacccccaacacaaacacacaggcacagccucccagcaguccguuucucccagacaaguagcaagaccagcgaagggguuuaaaaagucugggcgccccugggcacacgcacggcugagacgcgcagcccaacccgucuccccuagaggcugcaaccuacccggaaccccaggucaccgcggagcggcagaggcggccucggccaaacgcaucgucagauagauauguggcccagggcagcagcuggucgccgggcgcuaaacgcccccccucccgagaccccgcuuguuggguggcucugaaugucccccggaggcccagcggcacagccgggccucauccuccagcuccucccgcgggggucgagcgggggcgcggccucgcccccuuggucucccgcgggaacccggcgcuggcccgcccccgccuccucccgcccccucgucccggcugcgcgcgccgccgacucaccgagcgaagccugcaccgucucggccgcggagaaggcgagcagcgagcccucuuuggccaggaagccuuugccguccuccgcgucagccugcagcgccuccgccuugucgaaguuaccgccgccgggcagcggcugcggcgcgaacuugcgggccgcugccgccuccuggugcuggggcgacgcggagaagccgccggggagcguggccaugagcguagaggugagcgccaugcccugcgccaggcuggagcagaagccugugggcaggcuggggaucugguggugagggugugcgggcggcagcgcuggcugcagcgcggccuggggcagcgcgggcggcggcggcggcggcggcggcagcacuaccggccgguagggcaugaacaugggguagccgguguagacgaaauggccggggcugggcugcggcgggcugccgaucagcgagucuaugcugaaggcggugcuacuccccagcgggcgcugcaucaucaucagcgacggcgggaacgcugcgcucauagacgcgcucgguagaggccagcgagaggcgaaaaguccccgcgccgcgccgccgccgggaagcccgccggacgccgggagcaccgccgggagcgccgggcaggggccgagcgggacccggagagcagacgccuccgccccucaguccugggcccgcugcaugccgggcgggugcagggggugugcggggugaggccgugcgccccggaguggagagggcgcccgggccccgagggcucgccggagcccccguccgccgcuugcccgucggagcccgcgcgcuucgcggguuuggcccucggccccgguaagcugccguccguccguccgucccgccguccgucgccucccgcgggccgcuggggagcgcgcgaagccggcguacuuaucuccggcgggcgcagccagcaccuuuaaaucgcgcuccucuuucucauucacauuuugccugccgccuggcccggcucgccucacguggggcugggcgccucuggccauuggcugagcggggcggggguggggcgaaagcggggccccgcccuuuccacccaagcuggccucgagcgggcugcgggcgccaccgucggagcgcgcgggccggggagccggagccugcaugccuagcccgugccgcgcaaacuugagacgggcggauggcaccuccaaggcucggaccuuggggcccugcagccuugucgaggccaccucgaaggguagccuccggggcccgcacccccacggcugggccgggggcgcuuuauuucuuuuacuguauuugccauggaaccaaccugccugcggcucacuccagcgcugggugcuccggcugcgccugggguccgggcgaggguccuggaguugggggcaggguccugccccuccggagccacccccggggcgaaggcugggagcuggcagcgccugcccgc

SEQ ID NO: 19254 - RNA, 2432 nt, Homo sapiens
gcgggcaggcgcugccagcucccagccuucgccccggggguggcuccggaggggcaggacccugcccccaacuccaggacccucgcccggaccccaggcgcagccggagcacccagcgcuggagugagccgcaggcagguugguuccauggcaaauacaguaaaagaaauaaagcgcccccggcccagccgugggggugcgggccccggaggcuacccuucgagguggccucgacaaggcugcagggccccaagguccgagccuuggaggugccauccgcccgucucaaguuugcgcggcacgggcuaggcaugcaggcuccggcuccccggcccgcgcgcuccgacgguggcgcccgcagcccgcucgaggccagcuuggguggaaagggcggggccccgcuuucgccccacccccgccccgcucagccaauggccagaggcgcccagccccacgugaggcgagccgggccaggcggcaggcaaaaugugaaugagaaagaggagcgcgauuuaaaggugcuggcugcgcccgccggagauaaguacgccggcuucgcgcgcuccccagcggcccgcgggaggcgacggacggcgggacggacggacggacggcagcuuaccggggccgagggccaaacccgcgaagcgcgcgggcuccgacgggcaagcggcggacgggggcuccggcgagcccucggggcccgggcgcccucuccacuccggggcgcacggccucaccccgcacacccccugcacccgcccggcaugcagcgggcccaggacugaggggcggaggcgucugcucuccgggucccgcucggccccugcccggcgcucccggcggugcucccggcguccggcgggcuucccggcggcggcgcggcgcggggacuuuucgccucucgcuggccucuaccgagcgcgucuaugagcgcagcguucccgccgucgcugaugaugaugcagcgcccgcuggggaguagcaccgccuucagcauagacucgcugaucggcagcccgccgcagcccagccccggccauuucgucuacaccggcuaccccauguucaugcccuaccggccgguagugcugccgccgccgccgccgccgccgcccgcgcugccccaggccgcgcugcagccagcgcugccgcccgcacacccucaccaccagauccccagccugcccacaggcuucugcuccagccuggcgcagggcauggcgcucaccucuacgcucauggccacgcuccccggcggcuucuccgcgucgccccagcaccaggaggcggcagcggcccgcaaguucgcgccgcagccgcugcccggcggcgguaacuucgacaaggcggaggcgcugcaggcugacgcggaggacggcaaaggcuuccuggccaaagagggcucgcugcucgccuucuccgcggccgagacggugcaggcuucgcucggugagucggcggcgcgcgcagccgggacgagggggcgggaggaggcgggggcgggccagcgccggguucccgcgggagaccaagggggcgaggccgcgcccccgcucgacccccgcgggaggagcuggaggaugaggcccggcugugccgcugggccuccgggggacauucagagccacccaacaagcggggucucgggagggggggcguuuagcgcccggcgaccagcugcugcccugggccacauaucuaucugacgaugcguuuggccgaggccgccucugccgcuccgcggugaccugggguuccggguagguugcagccucuaggggagacggguugggcugcgcgucucagccgugcgugugcccaggggcgcccagacuuuuuaaaccccuucgcuggucuugcuacuugucugggagaaacggacugcugggaggcugugccuguguguuuguguugggggugucuggugggaacuuauaaggccacaaaacaucccuuugaccaacguugucugucucaaaaaagauggucugggaucugcacgucccuacgccuccacuccgguuaggaagcaauugagguucacuacauuuucaugguggcgguggggggaggaugaaucgugaauccccccaucaguccucaaccaguccccaccccagggacaaagcgggcaaucucuugggccucgcgccuccugcuacuucuccugacgcugccgaggcugggagggugcgggggaggcauggcggcccuuugagugaugguucugggcaaagggccgucgccuguacugccuccucuccuuugagcuuucucacgcuccccccaccccuccucuaccccucaaaggccaggaaaucacaauguguuaaugucauagaaagacaauccgcuaaaggguggggggcggggggcgcggaauguccaaaugacggugggaaggagaaaggaaggccagugugcgaaau

SEQ ID NO: 19255 - RNA, 2647 nt, Homo sapiens
guccggacaccgagaccccugcccgcgcagcuccccagaccccaggccuaagcuugcgggccgcggugcagacuagcugugcgcccgggggcggccaagacccacacaggucgaggaggcuccuggcugcguccucaucuucugggagcgcaucugggacuggacucgccucucuagccccucacgcccagagagagaaccccccaaagcccagugggggccgaucucuacguugaggcguagacaaagccaggcuuggccgggccuagggcucggggcggccugagagugcccugcguucggggugggggcgcgggcggcgggcgaggacccggcccccgggaugcccuccgcgccggggccgaagggggaggcaaaacugaaagugccgcgccggggggcgggggcggccggcgaaggccccagaacuuguccugcccccggccaccgcggccaaucagcgcgccgcccuagcuccugacaacuauuuagcaacccagcccagcuagaguuuccaaaaaaguuagaauaacuuccucucccggagaccucgguuuugcacaagccggccuugaaaucagagccuuuccagcaacuccgagagcgugugcucggcgaccgcgggcuuggccagcggcgcgcgcucggcgccccggcgcccccagccccacgcgcgccgggcgggcgccauggaggagggcuccagcucgcccgugucccccguggacagccugggcaccagcgaggaggagcucgagaggcagcccaagcgcuucggccggaagcggcgcuacagcaagaagucgagcgaagauggcagcccgaccccgggcaagcgcggcaagaagggcagccccagcgcgcaguccuucgaggagcugcagagccagcgcauccuggccaacgugcgcgagcgccagcgcacccagucgcucaacgaggccuucgcggcgcugcgcaagaucauccccacgcugcccucugacaagcugagcaagauccagacgcucaagcuggccgccagguacauagacuuccucuaccagguccugcagagcgacgagauggacaauaagaugaccagcugcagcuacguggcccacgagcgccucagcuacgccuucuccguguggcgcauggagggcgcgugguccauguccgccucccacuagcgccgcgccacccaccuccggaccggcgcgccaggguaggugcugcgcgcgcgacgggcgcccuccgcugcggggggcgggcggcaggggcgcaggggcauuggggccugcucgugucuccucggcgaggccccgcgggccgcgggggcuuggaugccgugcgcuuuuccucuuagcaaggaaggcgggcgggcgggacgcucacagucccagggacaccccugagugcagacuuccacgcgagggugucaguugggaaccggcggaccggugacucccccggcggguucugaagauacuuagacagauggucgcaguuuucauucucggugguguguggguguccgugguuggcgguggaaggagcgagcaucagaaaaaccuccuggggccggcuggggacugggauaugaggaccagcugcccuuugcguccgccgcagcgcaggccgcccgcgaagcugcccgagccggguguugccgggcgaauggcuucgcuuucuuccugggcaaggguagagcgcguccgucgggcggacacucagaucuacccagcugcucgcgccugggguccccggccgucggcgcccuggccugcccagugggcguagaggugcgggccugcggcuccaggguuugccuggggaggacgggaggaaacugcccugcgcuucggggccagagcagccacagggccgggugugcccgagaagggcccugggccgagagcgcagagccuggagcgcugaggcaggcggguccgacgcagccgcgcggagccccagggcgcccgcaggcagguggagcugaccuaggaacugggagcccugagucccaaccuugacccuggaguacccgggaggggccccgcccauccagccccgcagggaugggcgagggguccaggcugggaaacgggucugggggacagggaggcugugcgcgccgggcccugcgcgaggagaaggcucgggggacacagcugccaggagcacuccaaguucugguuuccucuggaagagcgauuagggcguccugcaccggguccuuuucaccagacaccuuccaagucccuuuagacaagcucgagccacggaggcgccguccuuaggcucugugagcaggcgagccccucucucauccgccauccagggccauggaggggcacagaguucuuuuugcuggggccgaguuaaaaauccuucccccuuaguauguuuuaguuccucgcacaucuugcgauguuuuuauaaaagacucuacuucacacagaaggaauuuagauuaaucaagagcacccggccgccuauucucccaaacauaucuauuucuuuuuuuaugugguucuauaauaucugcgaauguuguugcugaggccacgaaaagcugauccagcacagguggguuuuauuucauuuuuuuagcuuuuauuuuggugucacugaaaauucuguagcugcagagccuccugagaua

SEQ ID NO: 19256 - RNA, 2647 nt, Homo sapiens
uaucucaggaggcucugcagcuacagaauuuucagugacaccaaaauaaaagcuaaaaaaaugaaauaaaacccaccugugcuggaucagcuuuucguggccucagcaacaacauucgcagauauuauagaaccacauaaaaaaagaaauagauauguuugggagaauaggcggccgggugcucuugauuaaucuaaauuccuucugugugaaguagagucuuuuauaaaaacaucgcaagaugugcgaggaacuaaaacauacuaagggggaaggauuuuuaacucggccccagcaaaaagaacucugugccccuccauggcccuggauggcggaugagagaggggcucgccugcucacagagccuaaggacggcgccuccguggcucgagcuugucuaaagggacuuggaaggugucuggugaaaaggacccggugcaggacgcccuaaucgcucuuccagaggaaaccagaacuuggagugcuccuggcagcugugucccccgagccuucuccucgcgcagggcccggcgcgcacagccucccugucccccagacccguuucccagccuggaccccucgcccaucccugcggggcuggaugggcggggccccucccggguacuccagggucaagguugggacucagggcucccaguuccuaggucagcuccaccugccugcgggcgcccuggggcuccgcgcggcugcgucggacccgccugccucagcgcuccaggcucugcgcucucggcccagggcccuucucgggcacacccggcccuguggcugcucuggccccgaagcgcagggcaguuuccucccguccuccccaggcaaacccuggagccgcaggcccgcaccucuacgcccacugggcaggccagggcgccgacggccggggaccccaggcgcgagcagcuggguagaucugaguguccgcccgacggacgcgcucuacccuugcccaggaagaaagcgaagccauucgcccggcaacacccggcucgggcagcuucgcgggcggccugcgcugcggcggacgcaaagggcagcugguccucauaucccaguccccagccggccccaggagguuuuucugaugcucgcuccuuccaccgccaaccacggacacccacacaccaccgagaaugaaaacugcgaccaucugucuaaguaucuucagaacccgccgggggagucaccgguccgccgguucccaacugacacccucgcguggaagucugcacucaggggugucccugggacugugagcgucccgcccgcccgccuuccuugcuaagaggaaaagcgcacggcauccaagcccccgcggcccgcggggccucgccgaggagacacgagcaggccccaaugccccugcgccccugccgcccgccccccgcagcggagggcgcccgucgcgcgcgcagcaccuacccuggcgcgccgguccggagguggguggcgcggcgcuagugggaggcggacauggaccacgcgcccuccaugcgccacacggagaaggcguagcugaggcgcucgugggccacguagcugcagcuggucaucuuauuguccaucucgucgcucugcaggaccugguagaggaagucuauguaccuggcggccagcuugagcgucuggaucuugcucagcuugucagagggcagcguggggaugaucuugcgcagcgccgcgaaggccucguugagcgacugggugcgcuggcgcucgcgcacguuggccaggaugcgcuggcucugcagcuccucgaaggacugcgcgcuggggcugcccuucuugccgcgcuugcccggggucgggcugccaucuucgcucgacuucuugcuguagcgccgcuuccggccgaagcgcuugggcugccucucgagcuccuccucgcuggugcccaggcuguccacgggggacacgggcgagcuggagcccuccuccauggcgcccgcccggcgcgcguggggcugggggcgccggggcgccgagcgcgcgccgcuggccaagcccgcggucgccgagcacacgcucucggaguugcuggaaaggcucugauuucaaggccggcuugugcaaaaccgaggucuccgggagaggaaguuauucuaacuuuuuuggaaacucuagcugggcuggguugcuaaauaguugucaggagcuagggcggcgcgcugauuggccgcgguggccgggggcaggacaaguucuggggccuucgccggccgcccccgccccccggcgcggcacuuucaguuuugccucccccuucggccccggcgcggagggcaucccgggggccggguccucgcccgccgcccgcgcccccaccccgaacgcagggcacucucaggccgccccgagcccuaggcccggccaagccuggcuuugucuacgccucaacguagagaucggcccccacugggcuuugggggguucucucucugggcgugaggggcuagagaggcgaguccagucccagaugcgcucccagaagaugaggacgcagccaggagccuccucgaccugugugggucuuggccgcccccgggcgcacagcuagucugcaccgcggcccgcaagcuuaggccuggggucuggggagcugcgcgggcaggggucucgguguccggac

SEQ ID NO: 19257 - RNA, 2771 nt, Homo sapiens
aggguacggaggcgccgggagagcguucucggggcgcgcugccagggugcaggaagccggagcgcgcgggagggagcggggagcgggaugccgauuucggcugggggcggggaggccccugauuggggcgcgggaggcgugaugucacguccggcgggggaagcccugccucgcgcacccuccgcccccguccccgcccccacagguggugccaccgcccugggcgcugggcguggggggccgcccucggggaccccggccgcggccccgcgcugcccggcuccgccgccucccgccggggaucgauagagucgcgcggccaggcgggcccucugggucccuaagagccagaggagcgcccagugcgccccggcccgcgcccccgcgccgcgccccgccccgccccgcccggugcucccagucccucccccaccccugcgcucccacccugccccgccccucuccucucccgcggccgccuaggggccgggccggcggcgggggaggcgccgagccgggacugcgcuagcccgccgcgcucugggcugcccgagcgagcguucggaccucgcaccccgcgcgccccgcgccgccgccgccgccggcuuuuguugucuccgccuccucggccgccgccgccucuggaccgcgagccgcgcgcgccgggaccuuggcucugcccuucgcgggcgggaacugcgcaggacccggccaggauccgagagaggcgcgggcggguggccgggggcgccgccggccccgccauggagcuccgggcccgaggcugguggcugcuaugugcggccgcagcgcuggucgccugcgcccgcggggacccggccagcaagagccggagcugcggcgagguccgccagaucuacggagccaagggcuucagccugagcgacgugccccaggcggagaucucgggugagugagggcgcggcgccgggaacccgggccuggccgggcuuugggcuccggacccuggucuucccgacgcggcuacucgcccccggcgcgggauccugccgccugcgccccgccgcccgggccccgaauggcucccugcgcugcggcuccucugcaaccccacggcccucgccuccaagccccgcgccgcacucccucgccagggucuccuccgccccgcucggucguccuccgccccuccccgccccccgcacgccggcuucuucccugcggagcugaucucgccgggcugcgggcucggggcgcuccucccgggccacggcuggagcugggcgucuucugcccgccgcucggcccagcgcgccugcaggccgggagucccagccccggggccggcugucggggcgcuguggggcucggcguggccgggcuuucggggcgccgcugacgguggccgcggaccccuucugcucuguacagaccucucugggaggcgucuccgguccugcccggggauucucguagggucuccagcaaaggcagccuagguggguuuuauaagcugacccccucgggggguagugcggagggguggggagggagcugggcacuuauccgcgggcggaacgccgccgccucguagagauuccugucgaagaacuuguacgcgccggcccccgccuggcgcuugggcagccucgugccgcgaguccagcugcagguggucggcgcguuggaucccgcccaggggccgugucauuucuuuguaagaacagcggcccucuuggcgcccccuaagcccugcagccgccugcggcucugccucuucccucccuguggucccggaggagcuuuggggacagaaguguacggguggguggaacggugggcuccgugugcuaaggaacucuuggaacccaagcuucaccuuuccacgugugggaaccaaccucggucuguaccgcgugccagggacccagugggcaagaacaaaacagacuagguuccugcucuggggggcuccucugaaaccaggggagugggagugcggguggagggcuacucagauggggacucagcgcagaaaugcccaugguccuggggauucugagcaagaaggauccgugcaucugggugaggggggucuguggccaugccuugccgcggggggcggaguggugggaggaggcagucgggcucuggaccccugccccuccaggaggaacagaacccacagacagccccuugcccuugguggaucucccgaugcccccagccugagguucuuguaagggcccccugaccgccccccacagaaggaacagaacccgcagacagucccuuggcggaucucccgaugcccuccccaccagccugagguucuugcaaggaccccuccaaaguccccaggacaggccuuccugugccucugcagaggcaacccugucauuuccaggcugccccccucaccccacugggcucugucugucccagguagggggcacaccuggaugccaggcagcacaaggcccucggcacaguuggguucguucucugccccucuacucacacauaaagaggcaucccuggccuuccuggugaaucccuccccaggcaccaggguagcagaguggcugaguggcugccccucccagcccagagucuugaacccugcuccuuuggaaaccauuagcccccagcccuucuuagcaccuccauguccucugggcaguugcauccuuaggagccaaccuaaccuuccuugcauccacaggccacuguugccaguuagagagacagaguggcagaguuuggccaucucccaagggugagaagag

SEQ ID NO: 19258 - RNA, 2771 nt, Homo sapiens
cucuucucacccuugggagauggccaaacucugccacucugucucucuaacuggcaacaguggccuguggaugcaaggaagguuagguuggcuccuaaggaugcaacugcccagaggacauggaggugcuaagaagggcugggggcuaaugguuuccaaaggagcaggguucaagacucugggcugggaggggcagccacucagccacucugcuacccuggugccuggggagggauucaccaggaaggccagggaugccucuuuaugugugaguagaggggcagagaacgaacccaacugugccgagggccuugugcugccuggcauccaggugugcccccuaccugggacagacagagcccaguggggugaggggggcagccuggaaaugacaggguugccucugcagaggcacaggaaggccuguccuggggacuuuggagggguccuugcaagaaccucaggcugguggggagggcaucgggagauccgccaagggacugucugcggguucuguuccuucuguggggggcggucagggggcccuuacaagaaccucaggcugggggcaucgggagauccaccaagggcaaggggcugucuguggguucuguuccuccuggaggggcagggguccagagcccgacugccuccucccaccacuccgccccccgcggcaaggcauggccacagaccccccucacccagaugcacggauccuucuugcucagaauccccaggaccaugggcauuucugcgcugaguccccaucugaguagcccuccacccgcacucccacuccccugguuucagaggagccccccagagcaggaaccuagucuguuuuguucuugcccacugggucccuggcacgcgguacagaccgagguugguucccacacguggaaaggugaagcuuggguuccaagaguuccuuagcacacggagcccaccguuccacccacccguacacuucuguccccaaagcuccuccgggaccacagggagggaagaggcagagccgcaggcggcugcagggcuuagggggcgccaagagggccgcuguucuuacaaagaaaugacacggccccugggcgggauccaacgcgccgaccaccugcagcuggacucgcggcacgaggcugcccaagcgccaggcgggggccggcgcguacaaguucuucgacaggaaucucuacgaggcggcggcguuccgcccgcggauaagugcccagcucccuccccaccccuccgcacuaccccccgagggggucagcuuauaaaacccaccuaggcugccuuugcuggagacccuacgagaauccccgggcaggaccggagacgccucccagagaggucuguacagagcagaagggguccgcggccaccgucagcggcgccccgaaagcccggccacgccgagccccacagcgccccgacagccggccccggggcugggacucccggccugcaggcgcgcugggccgagcggcgggcagaagacgcccagcuccagccguggcccgggaggagcgccccgagcccgcagcccggcgagaucagcuccgcagggaagaagccggcgugcggggggcggggaggggcggaggacgaccgagcggggcggaggagacccuggcgagggagugcggcgcggggcuuggaggcgagggccgugggguugcagaggagccgcagcgcagggagccauucggggcccgggcggcggggcgcaggcggcaggaucccgcgccgggggcgaguagccgcgucgggaagaccaggguccggagcccaaagcccggccaggcccggguucccggcgccgcgcccucacucacccgagaucuccgccuggggcacgucgcucaggcugaagcccuuggcuccguagaucuggcggaccucgccgcagcuccggcucuugcuggccggguccccgcgggcgcaggcgaccagcgcugcggccgcacauagcagccaccagccucgggcccggagcuccauggcggggccggcggcgcccccggccacccgcccgcgccucucucggauccuggccggguccugcgcaguucccgcccgcgaagggcagagccaaggucccggcgcgcgcggcucgcgguccagaggcggcggcggccgaggaggcggagacaacaaaagccggcggcggcggcggcgcggggcgcgcggggugcgagguccgaacgcucgcucgggcagcccagagcgcggcgggcuagcgcagucccggcucggcgccucccccgccgccggcccggccccuaggcggccgcgggagaggagaggggcggggcagggugggagcgcaggggugggggagggacugggagcaccgggcggggcggggcggggcgcggcgcgggggcgcgggccggggcgcacugggcgcuccucuggcucuuagggacccagagggcccgccuggccgcgcgacucuaucgauccccggcgggaggcggcggagccgggcagcgcggggccgcggccgggguccccgagggcggccccccacgcccagcgcccagggcgguggcaccaccugugggggcggggacgggggcggagggugcgcgaggcagggcuucccccgccggacgugacaucacgccucccgcgccccaaucaggggccuccccgcccccagccgaaaucggcaucccgcuccccgcucccucccgcgcgcuccggcuuccugcacccuggcagcgcgccccgagaacgcucucccggcgccuccguacccu

SEQ ID NO: 19259 - RNA, 2744 nt, Homo sapiens
gggguagggagaaacaggccagcucuuagagaugaccugcaaugcuacaaaaauaagcucaacccaggcuucugucuuucuucaauauggaauuuuuaaauccuacgauauuagcuggagaggggcaaagguaaugaacacauccuauaauaaaagugagagguuuuguuccaugcucgugauguccccuguccucaccucuuaaauggcaucuaguuaugugagaacagggggagaaacugcaacagaggugcagaauucguugccacuggagcagcuccaguucucgcugagcaucuaggcggauucucugggaacugccguuuccaugucauuuuauuucacaugcuacaguuuagaauuucuaaggagaaagagaucgugcauccgaacacuaaaccggaauaaaaauguacaggagauacuaagaauaggacagaaaccugcuaagucuaaaauauauaaacccgccauagccaacaaaauaaggcuuccaagaaaaggggguggaggugcaaaagagccggcuuccccuaaagggccuggcugcaagaaucccucuuuggccacuaaacgguuuuagcagaaccacagauucguucugagggggacaauuuggauucggauucagcaagaaguagaaaaggugcagacgcggccaagaacagggcucccucugcaaagaauccaagcccaaaggaaacgcggaagggauggagaagagagacgcgggaacgagcagggagucucucccguccuacacuggcgacucaagggggcaucggcagucggugggaggcagaguguggucucccagcagaggcaagugugcugaccuccaggccagugucaguggaggggagcucugaagggucugcagacgcgcccuccggaaacaucagguuucaguggcauccauccagaugagguugguggcccaaauccaaaugucccauuccucugccccaucaugagacgacggggcagggacccacugugacccgcguccgcgauuagaaucggggacugcccgagaccagaggccgcccgagucccggcucgcuccccuccuugcgcccuucgccggggcgggcagccgggcggccgccgagggacaucucgcggcuacacccgcagagggaaguucucccaggcagccggcggagccgcaggggacuacggaaaggaggaugcaacgagccugggucccuccgagcugaguagggcccggaguggcccagaagcgcucgacuccgaacgcaaaaaaugccucccgcaaacuuuucccgugggcgccggagggccuggagcuggcggagaggagggcgcgaguccaggcggggucggccugaaggcagcuggggucugggcuucgagggaaggaaccgcagccgaggcggugccggccgcagaagguggggcugccgcucucggcuagcggcguucucgccgggaagucggggcuccgcgcccccgcgcgcuccgagccccgcgccucgcccagcgcggcccgcgaguggggagaggcgggccccgagcagccaccccggucgccggccgggucgggcagcucgcgcucaccucgguccuccagcccgucgcugaacuggccgcucucgcugauccgcaccugccgcuccuccuccagcuggggcggcucgcgcaccggggagcucagcggggccgggccgggggcggcagccgguggcgcguggccccggggcggcggcgggacggugggccccugggagcugcggcgcuggaugcccgcggccggcuccauggcgcggggcugcggaucccggcggcggcgacgacaagcgcggcggggacucgagucagaagugcgaggcgccgcggcucuggcgggggcaggagcggacggacuggccgcguggacagggagggagggcgggcgggcgccgcggaguggaggugcacgggcgggggcggggacgagcggagagccgcucggcuccgcggccgguggcggaggcuggggccgcguuguugccgccgcgcuccgccccugggggcaggugcgggcggcagggacccgccccaaggcccgggcgcgggagccggcgcaccgaggcggacgagagggaggaaccagcgugaggacccacaggcggcccuggcagagcuuggcuagggcguagcggggacccgccccaccugcgccgcgggauggugcccagaggggaccccucccacuggauuccucugggguccgcgaagcccgcggccgcgcguggguagcagacagcgccccuaauuuggcaucuuucucuucuggagcugcacaggcuucagaggcuguacagggucuucgccugggccuccauucucacugcucauccagggaaaaaggguucaucuguccccaagcccgucgcucuccguccuucucggagcuuuaacuccccucccaguuucucccuggagcacccauuuagccagggaugggguaucuuuaggacagcgggcgcuauagaagaugcuugaacuccgaggcuuccccauuucgacucuuccugggccuuugucccauacaguucgcuccccugcucaucuaagucuugugugaucuucagaaauccauggaagccucccuucuacgagaagucuccccuacucugaccccugcagcucuuaauucauuuugugcgguggggcugaucucaccagugagaguccaccgcagggcacacgccagcucucuugaugcccagagaggagca

SEQ ID NO: 19260 - RNA, 2744 nt, Homo sapiens
ugcuccucucugggcaucaagagagcuggcgugugcccugcgguggacucucacuggugagaucagccccaccgcacaaaaugaauuaagagcugcaggggucagaguaggggagacuucucguagaagggaggcuuccauggauuucugaagaucacacaagacuuagaugagcaggggagcgaacuguaugggacaaaggcccaggaagagucgaaauggggaagccucggaguucaagcaucuucuauagcgcccgcuguccuaaagauaccccaucccuggcuaaaugggugcuccagggagaaacugggaggggaguuaaagcuccgagaaggacggagagcgacgggcuuggggacagaugaacccuuuuucccuggaugagcagugagaauggaggcccaggcgaagacccuguacagccucugaagccugugcagcuccagaagagaaagaugccaaauuaggggcgcugucugcuacccacgcgcggccgcgggcuucgcggaccccagaggaauccagugggagggguccccucugggcaccaucccgcggcgcagguggggcggguccccgcuacgcccuagccaagcucugccagggccgccuguggguccucacgcugguuccucccucucguccgccucggugcgccggcucccgcgcccgggccuuggggcgggucccugccgcccgcaccugcccccaggggcggagcgcggcggcaacaacgcggccccagccuccgccaccggccgcggagccgagcggcucuccgcucguccccgcccccgcccgugcaccuccacuccgcggcgcccgcccgcccucccucccuguccacgcggccaguccguccgcuccugcccccgccagagccgcggcgccucgcacuucugacucgaguccccgccgcgcuugucgucgccgccgccgggauccgcagccccgcgccauggagccggccgcgggcauccagcgccgcagcucccaggggcccaccgucccgccgccgccccggggccacgcgccaccggcugccgcccccggcccggccccgcugagcuccccggugcgcgagccgccccagcuggaggaggagcggcaggugcggaucagcgagagcggccaguucagcgacgggcuggaggaccgaggugagcgcgagcugcccgacccggccggcgaccgggguggcugcucggggcccgccucuccccacucgcgggccgcgcugggcgaggcgcggggcucggagcgcgcgggggcgcggagccccgacuucccggcgagaacgccgcuagccgagagcggcagccccaccuucugcggccggcaccgccucggcugcgguuccuucccucgaagcccagaccccagcugccuucaggccgaccccgccuggacucgcgcccuccucuccgccagcuccaggcccuccggcgcccacgggaaaaguuugcgggaggcauuuuuugcguucggagucgagcgcuucugggccacuccgggcccuacucagcucggagggacccaggcucguugcauccuccuuuccguaguccccugcggcuccgccggcugccugggagaacuucccucugcggguguagccgcgagaugucccucggcggccgcccggcugcccgccccggcgaagggcgcaaggaggggagcgagccgggacucgggcggccucuggucucgggcaguccccgauucuaaucgcggacgcgggucacagugggucccugccccgucgucucaugauggggcagaggaaugggacauuuggauuugggccaccaaccucaucuggauggaugccacugaaaccugauguuuccggagggcgcgucugcagacccuucagagcuccccuccacugacacuggccuggaggucagcacacuugccucugcugggagaccacacucugccucccaccgacugccgaugcccccuugagucgccaguguaggacgggagagacucccugcucguucccgcgucucucuucuccaucccuuccgcguuuccuuugggcuuggauucuuugcagagggagcccuguucuuggccgcgucugcaccuuuucuacuucuugcugaauccgaauccaaauugucccccucagaacgaaucugugguucugcuaaaaccguuuaguggccaaagagggauucuugcagccaggcccuuuaggggaagccggcucuuuugcaccuccacccccuuuucuuggaagccuuauuuuguuggcuauggcggguuuauauauuuuagacuuagcagguuucuguccuauucuuaguaucuccuguacauuuuuauuccgguuuaguguucggaugcacgaucucuuucuccuuagaaauucuaaacuguagcaugugaaauaaaaugacauggaaacggcaguucccagagaauccgccuagaugcucagcgagaacuggagcugcuccaguggcaacgaauucugcaccucuguugcaguuucucccccuguucucacauaacuagaugccauuuaagaggugaggacaggggacaucacgagcauggaacaaaaccucucacuuuuauuauaggauguguucauuaccuuugccccucuccagcuaauaucguaggauuuaaaaauuccauauugaagaaagacagaagccuggguugagcuuauuuuuguagcauugcaggucaucucuaagagcuggccuguuucucccuacccc

SEQ ID NO: 19261 - RNA, 2861 nt, Homo sapiens
gcccggccugcaggggugggggaggaagaagcuccggcugagggucugccccgaccgcagagggcgcacgagggggucucccggcaccggcgcggcgcccacgccacuacaggggcccccugaaacccggguagaagcuugugauaggcguugcgaccccgggaaggcgcgaggcuguggagguggcucguggggccauggagggaguggggggcggcgagacggaguccgucuaaaugccaguucccagaaguucagcguaucgauuauuuccuaccuuaaugcauauuuaugccgcgccgaaauaggcuucauaauuaacucccggagucauccgcagagguuaaagggaccccgaagauuugugcauugauuggguaccucggcggggugugugugcgcgcgcgugugugcgugcgccccgugcuaacccauugaagaauaauuauuuuucuccacuggaagcuacagcagagaaucggacaaggagggaagaaagagauuggugagggggagagagagagaaagagagagagagacacaaaggaagugagugcaagaggagccggcuuagcaucuaaacugugaguacugagcgaaaacaaacaggcagaaagugccgcgaguuggcgaccccuuggccggguugggggcccgagugcggcugagggggacuuuccuccccgccccgggcuuggcugggcgaagaggggucccuaaggcaugggcgggaugcggguucaggcacucaccugaaagcugaccggcggcgggcugcgucagccgccgcccuaggucgaccaaagaggaagcccccuccccgcccccauugccuuuguuccuuuuaaaggauuuugccgcuggugggauuggggggagugugagagggagccuuggcuccggagguagccgauccuccuguccccgcugagugaaacccgcuuggagugccuccuccguuuccuuuauaccccaugguauggagugguaugaggaaggggcuguaaagggguuagggaucagggguuugugacaccugugcauauguuugucugguacccuuggaacagagggccccaggagaccccaguuuggggccugggagaagccauguccgugggccaaaccaccaacuccaguauauguggaggcaaacauggucccaggcuuagaggagacaccagcuacuccccacacacaucagaguccuuccuagccauugugucuguggggucuaggucuggccagaccucuuggccauaagccugccucccacugccuccccaucccuggggcccuugcaugccuaagaaaggccggagcuaggagcccaccuggaggaggagcucuggccggguaggggcccaggaaggcagcuagacaaggauaggugcucccuuuccugagaaaggguccauaacagggugcccccggggaacaagagcuggccagcccugccagugcugagcuggucaggagagggcgucugggggcccaagggagagcccucccuuccgaccaacauuccacagccuccguuuggaagugcuuguauacugccuuccuuuccucaacccucauuaacaaauucuucuuuuggucugauuuaaucuuuccugacgauuuuuuuuuuuuuacauaccuuaaucugccagugaacaacuuuucucaacuugagccuuaagaagggcuaacuuuggaggaaaagucagcucuuuugaggcugggaugggaaccccuggugaaagagcucugaauugaggggaaagggauuguccucuaagaaacccccuuuagggguaauuuugguggcuuaugcccuccaggaggacacaacggaggccuggggcugcaaacaacuucuaucucucagucauucaaugccggcuuuccauugcuccacuggggcugccacagaggcaggaaaagaggaucucucucucucucucucacacacacacacacacacacacucacaccagauaacacuuccuccaaguaguauugggcacucucugagacucagggccccucccauugcccauacaccaccaccccccacccccaucccacgcaccccacacacacaaagagaacauccaggagucucagagcuggggacuaccauccuaaaggcaugaagaggaaggagagacccucaacuagggaggaucaaauucaguguaacccuggaagaggugacaugaagacuggguggcaggggagaccacaguccugcugacgugacugcucugaauugcagucauaugcauaugggccugucuucccacuggacugccugcugggccucccugagugcugucuccuggugccuagcacggugcccaucccacugucugugcucggugcauauuugauaaaugaguggugucccugaagccauucuccccacccuucaucucugucugccuccuccuccaagagguacuccacaggggcuugggagagcccaguuccauaguucuuugggcuggggcaccaucaccccauggggguugaggaggggcauggaagaaaaggggugggggcaggaauagugcuugggcagacacugagacauuucgauauucauaaauugcucagguugaaaugcaugugaguuugccaaugacccauucuuauauuuuucuuuaacagcuuuauuggcugagaggcaaaacuguggccuggguccuggacuuggggaggcuagauucuuguaacacaagaaccucccuguguccucccucccacagcccaaccuuggagcuuauuggagaucagaugcagaggcuggggguacccaggcugcggagacucccccagcuucugcccguguuugcucuccugccccugggucu

SEQ ID NO: 19262 - RNA, 2861 nt, Homo sapiens
agacccaggggcaggagagcaaacacgggcagaagcugggggagucuccgcagccuggguacccccagccucugcaucugaucuccaauaagcuccaagguugggcugugggagggaggacacagggagguucuuguguuacaagaaucuagccuccccaaguccaggacccaggccacaguuuugccucucagccaauaaagcuguuaaagaaaaauauaagaaugggucauuggcaaacucacaugcauuucaaccugagcaauuuaugaauaucgaaaugucucagugucugcccaagcacuauuccugcccccaccccuuuucuuccaugccccuccucaacccccauggggugauggugccccagcccaaagaacuauggaacugggcucucccaagccccuguggaguaccucuuggaggaggaggcagacagagaugaaggguggggagaauggcuucagggacaccacucauuuaucaaauaugcaccgagcacagacagugggaugggcaccgugcuaggcaccaggagacagcacucagggaggcccagcaggcaguccagugggaagacaggcccauaugcauaugacugcaauucagagcagucacgucagcaggacuguggucuccccugccacccagucuucaugucaccucuuccaggguuacacugaauuugauccucccuaguugagggucucuccuuccucuucaugccuuuaggaugguaguccccagcucugagacuccuggauguucucuuuguguguguggggugcgugggaugggggugggggguggugguguaugggcaaugggaggggcccugagucucagagagugcccaauacuacuuggaggaaguguuaucuggugugagugugugugugugugugugugugagagagagagagagagauccucuuuuccugccucuguggcagccccaguggagcaauggaaagccggcauugaaugacugagagauagaaguuguuugcagccccaggccuccguuguguccuccuggagggcauaagccaccaaaauuaccccuaaaggggguuucuuagaggacaaucccuuuccccucaauucagagcucuuucaccagggguucccaucccagccucaaaagagcugacuuuuccuccaaaguuagcccuucuuaaggcucaaguugagaaaaguuguucacuggcagauuaagguauguaaaaaaaaaaaaaucgucaggaaagauuaaaucagaccaaaagaagaauuuguuaaugaggguugaggaaaggaaggcaguauacaagcacuuccaaacggaggcuguggaauguuggucggaagggagggcucucccuugggcccccagacgcccucuccugaccagcucagcacuggcagggcuggccagcucuuguuccccgggggcacccuguuauggacccuuucucaggaaagggagcaccuauccuugucuagcugccuuccugggccccuacccggccagagcuccuccuccaggugggcuccuagcuccggccuuucuuaggcaugcaagggccccagggauggggaggcagugggaggcaggcuuauggccaagaggucuggccagaccuagaccccacagacacaauggcuaggaaggacucugauguguguggggaguagcuggugucuccucuaagccugggaccauguuugccuccacauauacuggaguuggugguuuggcccacggacauggcuucucccaggccccaaacuggggucuccuggggcccucuguuccaaggguaccagacaaacauaugcacaggugucacaaaccccugaucccuaaccccuuuacagccccuuccucauaccacuccauaccaugggguauaaaggaaacggaggaggcacuccaagcggguuucacucagcggggacaggaggaucggcuaccuccggagccaaggcucccucucacacuccccccaaucccaccagcggcaaaauccuuuaaaaggaacaaaggcaaugggggcggggagggggcuuccucuuuggucgaccuagggcggcggcugacgcagcccgccgccggucagcuuucaggugagugccugaacccgcaucccgcccaugccuuagggaccccucuucgcccagccaagcccggggcggggaggaaagucccccucagccgcacucgggcccccaacccggccaaggggucgccaacucgcggcacuuucugccuguuuguuuucgcucaguacucacaguuuagaugcuaagccggcuccucuugcacucacuuccuuugugucucucucucucuuucucucucucucccccucaccaaucucuuucuucccuccuuguccgauucucugcuguagcuuccaguggagaaaaauaauuauucuucaauggguuagcacggggcgcacgcacacacgcgcgcgcacacacaccccgccgagguacccaaucaaugcacaaaucuucggggucccuuuaaccucugcggaugacuccgggaguuaauuaugaagccuauuucggcgcggcauaaauaugcauuaagguaggaaauaaucgauacgcugaacuucugggaacuggcauuuagacggacuccgucucgccgccccccacucccuccauggccccacgagccaccuccacagccucgcgccuucccggggucgcaacgccuaucacaagcuucuacccggguuucagggggccccuguaguggcgugggcgccgcgccggugccgggagacccccucgugcgcccucugcggucggggcagacccucagccggagcuucuuccucccccaccccugcaggccgggc

SEQ ID NO: 19263 - RNA, 2519 nt, Homo sapiens
aaucagacuguuggguucagcuggaaagcccuggaaggaacagcuggcuagcacagagauaccuggugaaugagagagccaaagcgugccuuugggaagccugccguggucuggcuggagaagcagcacuccugccccuguugugccacccucaguauguucccaccccacccuaacucucuucucugccucuuccucuuccucuucccugggacuggcagagcucagcucauuccuacccagcacucacugugaccccaucuuaguggcucuuccaaaucucccaccuccaccccaggccugacaggcagccucagguucccuggcugcaagagcuucagcucugaggucaugggcacugguaaguucacaguacaguccuccagccacccaucccccuccuguuucucuggcccugcagagcggagcacggaaaggcagagugaggacuggagcacgauggcccaaagaacaucuggcuuacuuggggucuuaugcucuaccuuuuuuccuuucuagauggcccucaagccagccaucauguggugcugcgaguaccuucggcgcuguggacucaccggagagggaucuugacccggagguagcgguccacagcaauugccagcagggccaggauggagcucugggugaggaugaggaccggacaggcaaccaugaggcagguguggaaguaggucuguggcccaauguugaugaggauggcgagggggaugaccagggcacccacggccacaucagccaccgccagcgacacgaugaagcagaagguggcaucccgcagcgccugguucaccuucaccgcccagaucaccagcacguucccgggcacagagaccagggcgaugagcaccucgaugccgauguaggcggccuggaaagcugagauggagggcggcauggcgggcacaggcugggcacaucagcagacgggcaccaaggggcacgaggcaagcaccuguguggucagggaagccugggauggggagacccgucugggaggggcagggagcucaggcugcccuggaacuccagguacccugugaugugucccacuugucacaugcagcuccuacccaggcuggaggggcacccggacccuucucugccuaaucuuugucccuucccuuuaucauucccagagguuccauucagcaacuuaaaauagcagcgcucacuccuccacuggcuuuuuuaucaggugugaggcagcucccagcgcgcgcgcacacacagacacacgcacagaggggucucccaugacuggcucugcccaccccugugcacagaacaggaugcagggagcucaccauccugccugcuggccggcaggggucccagaggcagugcccaaaguuccagggaacagagcuccgggccgcgcgcgguagggcugggcugggcucuggacaacgcgcggcagcucauaguccuccggcucccgccgcagcgcucccagcccggccuuucaagcaaucacaugguacggcagagacucagccccggacgcuuuuaaagagguagcgccccuguuucgcaccugggacugggguggcagacgugggucuggggacggagcccaggacaaggcuggggcguuucucccuauuccccagcgugcccgcaccugcccugcgcccacccacuugagacccgucuggugccuggaucuuagcaguccucuggucccguuccagcucugucggggaaccuugcccauggccugccccaagggggcauuccggucucuucuuucaacccucuccugcacccccauuggggagccccaggggugaaccgagacucagacuuacccaaggucaccaaagcuggcagagcucccggcugccugacuguucuguccaagugcccccacaccucgacgccuucagcagccgcuagcuccagggauuccuggggaagccaaggccggccgguaagcuccagagggaugguagcuggcugggacucgacucgggcgccugcggcucugucgcccccggcgcaggagcugagugacaaucgggcuccgcacaccgggagggggcgggggcggcggcggcacccgccagccccucccuccucauccuccgucuccucccccacccccuccucuuaacaaaggaagugauacugggugagaaaagcuggaaaaaaugugagcuuuucgaagggccuggugugugcgcccagccucaggacuggacagaggcgcauccuuccuguguccacucucucccuucucaaugcaggacuccugggagcccuggucuggccuccagcgaccccucaccccucacggcacagcaucucuucugcaggacuucagaaugcccccucugggaucucccaaagcagucgguagcccuggcacccucccccaauccuaaaacccugcucucuccaugaaaccagucccugcaucuucucaucccauauuguuuugcaggcucuacccugagucauuauauuccuuucucauccaucuuucagaauugccu

SEQ ID NO: 19264 - RNA, 2519 nt, Homo sapiens
aggcaauucugaaagauggaugagaaaggaauauaaugacucaggguagagccugcaaaacaauaugggaugagaagaugcagggacugguuucauggagagagcaggguuuuaggauugggggagggugccagggcuaccgacugcuuugggagaucccagagggggcauucugaaguccugcagaagagaugcugugccgugaggggugaggggucgcuggaggccagaccagggcucccaggaguccugcauugagaagggagagaguggacacaggaaggaugcgccucuguccaguccugaggcugggcgcacacaccaggcccuucgaaaagcucacauuuuuuccagcuuuucucacccaguaucacuuccuuuguuaagaggagggggugggggaggagacggaggaugaggagggaggggcuggcgggugccgccgccgcccccgcccccucccggugugcggagcccgauugucacucagcuccugcgccgggggcgacagagccgcaggcgcccgagucgagucccagccagcuaccaucccucuggagcuuaccggccggccuuggcuuccccaggaaucccuggagcuagcggcugcugaaggcgucgaggugugggggcacuuggacagaacagucaggcagccgggagcucugccagcuuuggugaccuuggguaagucugagucucgguucaccccuggggcuccccaaugggggugcaggagaggguugaaagaagagaccggaaugcccccuuggggcaggccaugggcaagguuccccgacagagcuggaacgggaccagaggacugcuaagauccaggcaccagacgggucucaagugggugggcgcagggcaggugcgggcacgcuggggaauagggagaaacgccccagccuuguccugggcuccguccccagacccacgucugccaccccagucccaggugcgaaacaggggcgcuaccucuuuaaaagcguccggggcugagucucugccguaccaugugauugcuugaaaggccgggcugggagcgcugcggcgggagccggaggacuaugagcugccgcgcguuguccagagcccagcccagcccuaccgcgcgcggcccggagcucuguucccuggaacuuugggcacugccucugggaccccugccggccagcaggcaggauggugagcucccugcauccuguucugugcacaggggugggcagagccagucaugggagaccccucugugcgugugucugugugugcgcgcgcgcugggagcugccucacaccugauaaaaaagccaguggaggagugagcgcugcuauuuuaaguugcugaauggaaccucugggaaugauaaagggaagggacaaagauuaggcagagaaggguccgggugccccuccagccuggguaggagcugcaugugacaagugggacacaucacaggguaccuggaguuccagggcagccugagcucccugccccucccagacgggucuccccaucccaggcuucccugaccacacaggugcuugccucgugccccuuggugcccgucugcugaugugcccagccugugcccgccaugccgcccuccaucucagcuuuccaggccgccuacaucggcaucgaggugcucaucgcccuggucucugugcccgggaacgugcuggugaucugggcggugaaggugaaccaggcgcugcgggaugccaccuucugcuucaucgugucgcuggcgguggcugauguggccgugggugcccuggucaucccccucgccauccucaucaacauugggccacagaccuacuuccacaccugccucaugguugccuguccgguccucauccucacccagagcuccauccuggcccugcuggcaauugcuguggaccgcuaccuccgggucaagaucccucuccggugaguccacagcgccgaagguacucgcagcaccacaugauggcuggcuugagggccaucuagaaaggaaaaaagguagagcauaagaccccaaguaagccagauguucuuugggccaucgugcuccaguccucacucugccuuuccgugcuccgcucugcagggccagagaaacaggagggggauggguggcuggaggacuguacugugaacuuaccagugcccaugaccucagagcugaagcucuugcagccagggaaccugaggcugccugucaggccugggguggaggugggagauuuggaagagccacuaagauggggucacagugagugcuggguaggaaugagcugagcucugccagucccagggaagaggaagaggaagaggcagagaagagaguuaggguggggugggaacauacugaggguggcacaacaggggcaggagugcugcuucuccagccagaccacggcaggcuucccaaaggcacgcuuuggcucucucauucaccagguaucucugugcuagccagcuguuccuuccagggcuuuccagcugaacccaacagucugauu

SEQ ID NO: 19265 - RNA, 2782 nt, Homo sapiens
uuuuuuaaaaagcuauguauguaugugcugcauauagagcagauauacagccuauuaagcgucgucacuaaaacauaaaacaugucagccuuucuuaaccuuacucgccccagucugucccgacgugacuuccucgacccucuaaagacguacagaccagacacggcggcggcggcgggagaggggauucccugcgcccccggaccucagggccgcucagauuccuggagaggaagccaaguguccuucugcccucccccgguaucccauccaaggcgaucaguccagaacuggcucucggaagcgcucgggcaaagacugcgaagaagaaaagacaucuggcggaaaccugugcgccuggggcgguggaacucggggaggagagggagggaucagacaggagaguggggacuacccccucugcucccaaauuggggcagcuuccuggguuuccgauuuucucauuuccguggguaaaaaacccugcccccaccgggcuuacgcaauuuuuuuaaggggagaggagggaaaaauuugugggggguacgaaaaggcggaaagaaacagucauuucgucacaugggcuugguuuucagucuuauaaaaaggaagguucucucgguuagcgaccaauugucauacgacuugcagugagcgucaggagcacguccaggaacuccucagcagcgccuccuucagcuccacagccagacgcccucagacagcaaagccuacccccgcgccgcgcccugcccgccgcugcgaugcucgcccgcgcccugcugcugugcgcgguccuggcgcucagccauacaggugaguaccuggcgccgcgcaccggggacuccgguuccacgcacccgggcagaguuuccgcucugaccuccugggucuaucccaguacuccgacuucucuccgaauagagaagcuacgugacuugggaaagagcuuggaccgcuagaguucgaaagaacuccguggauauuccagcuuucccacaagcacugaucauuaugagccaguuacuuaaccgaucugagacacucucaccuccuaaauagggauagaugauacuaauuugcagguugucauuaugauaagacaggaucugaucaauauaugugaauuguuuauauuuggaaccuuuuuauugaguggaagaaguuguuuuaaauauucuagucaguucuuuccugcucccaggaaagcccggauuauguuuuaagauaagcaaaaugucuuaaaaguaagcuguuuuacuuugaauuuuucccuaaauguugauuaguguacuagauccauuuuaauuuggaaagugaagugcuacuuauuugaacuucuuaaaaaugcuaauuuuaacaucuaaagaguuaacuaagaaaagcuuaguaacaugauguaccaaguugaauaugcuguuauccuuauuuagaauagaaaauugguauuucuacguuuuauccauucuaaggcagguuaaaaaauuguauuuccaugacuaccuauauauuucuugaauuuauuauuguaaaguugauucauagucaaacaauuaaauguuuaaauuaagauuaagacacuagagaaugauuuauuugcuguccuuuaauugcagcaaauccuugcuguucccacccaugucaaaaccgagguguauguaugagugugggauuugaccaguauaagugcgauuguacccggacaggauucuauggagaaaacugcucaacacguaaguuuguccuuugguugccucauuaggaguggggcuggauacaguuaucauuguauagauuugugucuuauaaugagucccauuaauuucucccucccuuucuucgucuucuugcagcggaauuuuugacaagaauaaaauuauuucugaaacccacuccaaacacagugcacuacauacuuacccacuucaagggauuuuggaacguugugaauaacauucccuuccuucgaaaugcaauuaugaguuauguguugacauguaaguacaagugucuuucuaagguuuuuagccuucucaaagaaaaauaugcuuuauaauacuguaagccuaaucuaaaaacauauuuccaagcuuaucaaaaagacuuuaagauagcuuuuaaguuugccuuccaucuuaaucgccaaaaauauugacauuuagucccauccaguuuauacagucugcucacaacucuguauaccucuucuaaccuuuacuguuuggucaguuuguggagguagcaugguccagcuguuuauugaaugcccaugggccacagaauuguucugaacauguagcacccauuaaaauaaauuuggauuuggaucagcaagaaaauaacuuuccaugauucuaaagugggugccauacucagccauuccuuucauaggccucuuggauagugagcagauggcuaccugaaaaaucaauauugccagauuauaaugugcagaguauauguauuuuauuaaagauguauuucaaguggccauuagacuauaaaguguaguuguuuaaaaauagauuuuuuuuauuuuggaguuacauucaaccucaggugccacuuuccacauuuuacaauaaaaauaaugguugauuuacuuaacaaaugagaauaaauaaaacauuuuuuucuuugaaaauuucagccagaucacauuugauugacaguccaccaacuuacaaugcugacuauggcuacaaaagcugggaagccuucucuaaccucuccuauuauacuagagcccuuccuccugugccugaugauugcccgacucccu

SEQ ID NO: 19266 - RNA, 2782 nt, Homo sapiens
agggagucgggcaaucaucaggcacaggaggaagggcucuaguauaauaggagagguuagagaaggcuucccagcuuuuguagccauagucagcauuguaaguugguggacugucaaucaaaugugaucuggcugaaauuuucaaagaaaaaaauguuuuauuuauucucauuuguuaaguaaaucaaccauuauuuuuauuguaaaauguggaaaguggcaccugagguugaauguaacuccaaaauaaaaaaaaucuauuuuuaaacaacuacacuuuauagucuaauggccacuugaaauacaucuuuaauaaaauacauauacucugcacauuauaaucuggcaauauugauuuuucagguagccaucugcucacuauccaagaggccuaugaaaggaauggcugaguauggcacccacuuuagaaucauggaaaguuauuuucuugcugauccaaauccaaauuuauuuuaaugggugcuacauguucagaacaauucuguggcccaugggcauucaauaaacagcuggaccaugcuaccuccacaaacugaccaaacaguaaagguuagaagagguauacagaguugugagcagacuguauaaacuggaugggacuaaaugucaauauuuuuggcgauuaagauggaaggcaaacuuaaaagcuaucuuaaagucuuuuugauaagcuuggaaauauguuuuuagauuaggcuuacaguauuauaaagcauauuuuucuuugagaaggcuaaaaaccuuagaaagacacuuguacuuacaugucaacacauaacucauaauugcauuucgaaggaagggaauguuauucacaacguuccaaaaucccuugaaguggguaaguauguagugcacuguguuuggaguggguuucagaaauaauuuuauucuugucaaaaauuccgcugcaagaagacgaagaaagggagggagaaauuaaugggacucauuauaagacacaaaucuauacaaugauaacuguauccagccccacuccuaaugaggcaaccaaaggacaaacuuacguguugagcaguuuucuccauagaauccuguccggguacaaucgcacuuauacuggucaaaucccacacucauacauacaccucgguuuugacaugggugggaacagcaaggauuugcugcaauuaaaggacagcaaauaaaucauucucuagugucuuaaucuuaauuuaaacauuuaauuguuugacuaugaaucaacuuuacaauaauaaauucaagaaauauauagguagucauggaaauacaauuuuuuaaccugccuuagaauggauaaaacguagaaauaccaauuuucuauucuaaauaaggauaacagcauauucaacuugguacaucauguuacuaagcuuuucuuaguuaacucuuuagauguuaaaauuagcauuuuuaagaaguucaaauaaguagcacuucacuuuccaaauuaaaauggaucuaguacacuaaucaacauuuagggaaaaauucaaaguaaaacagcuuacuuuuaagacauuuugcuuaucuuaaaacauaauccgggcuuuccugggagcaggaaagaacugacuagaauauuuaaaacaacuucuuccacucaauaaaaagguuccaaauauaaacaauucacauauauugaucagauccugucuuaucauaaugacaaccugcaaauuaguaucaucuaucccuauuuaggaggugagagugucucagaucgguuaaguaacuggcucauaaugaucagugcuugugggaaagcuggaauauccacggaguucuuucgaacucuagcgguccaagcucuuucccaagucacguagcuucucuauucggagagaagucggaguacugggauagacccaggaggucagagcggaaacucugcccgggugcguggaaccggaguccccggugcgcggcgccagguacucaccuguauggcugagcgccaggaccgcgcacagcagcagggcgcgggcgagcaucgcagcggcgggcagggcgcggcgcggggguaggcuuugcugucugagggcgucuggcuguggagcugaaggaggcgcugcugaggaguuccuggacgugcuccugacgcucacugcaagucguaugacaauuggucgcuaaccgagagaaccuuccuuuuuauaagacugaaaaccaagcccaugugacgaaaugacuguuucuuuccgccuuuucguaccccccacaaauuuuucccuccucuccccuuaaaaaaauugcguaagcccggugggggcaggguuuuuuacccacggaaaugagaaaaucggaaacccaggaagcugccccaauuugggagcagaggggguaguccccacucuccugucugaucccucccucuccuccccgaguuccaccgccccaggcgcacagguuuccgccagaugucuuuucuucuucgcagucuuugcccgagcgcuuccgagagccaguucuggacugaucgccuuggaugggauaccgggggagggcagaaggacacuuggcuuccucuccaggaaucugagcggcccugagguccgggggcgcagggaauccccucucccgccgccgccgccgugucuggucuguacgucuuuagagggucgaggaagucacgucgggacagacuggggcgaguaagguuaagaaaggcugacauguuuuauguuuuagugacgacgcuuaauaggcuguauaucugcucuauaugcagcacauacauacauagcuuuuuaaaaaa

SEQ ID NO: 19267 - RNA, 3155 nt, Homo sapiens
guccaucaugguaagagccucguaaaggguacuuaucaguauaaucagaugcuguuuugcccagguuugcacccugugcgccuguccucaggacccagcaggcucagacuugccugcgaucaaagaaagcccugugugccucccagacccaccacccccgugcaaacucucucaacacgacaccgcugcgugacuuuccugcuguuacuagaggucggcagguacuuuucccuaggaaacugggugugcacgucucauccccgugccaauucucuugccgcuuuuccuuccacacgcggcguccucugggcggagggugcagcuccgcgugcuccagcugccgcgaaaguugcacccggcccagucuggcugcgggccccgccuccgccuucucagcgcccagccccacccuccgauuggucagcagugcccagccccgccccgcuccuccgaggggauuuaaagcagcggccgcucagucugggcgcuugcaggcugcuaaacccaaccgcaguugacuagcaccugcuaccgcgccuuugcuuccuggcgcacgcggagccuccuggagccugccaccauccugccuacuacgugcugcccugcgcccgcagccaugugccgcacccuggccgccuuccccaccaccugccuggagagguaaggggagguuguccaacugcuugggggaagucccaccaacucuuagggaguggagcggcaggccuggggaccugggugggcgcggggauggggcgcuagaggcuugaguagagagguagaagcgcacuugaugccacgugcucagauuccaggagcagggagaaagcaaggggaagggaagcaagggcccgcggcuugcugccauccccauccucugacaaacugcagucgugcucaggugaccugcugaagacccggcugcgggaaggccacguugacauuuccaggcagcacugagccugcccauuucuuaagcauuuguuuuucauuccucagaccagagcuaggggcauugccuccucugccccuggaagacagggagauuuuuuuuuuuuugguggggugugugggggugggggcucccacuguugaggguguguccauauuccagagagcuacucaacagcuuccaauccuuacuggcugggaaggaaaaaguaaagaugaaggcaggaaucaguuucccacacaguucagaaauacuucugaaaagaaugcugaguucuuuucugaaucaacaggcacgaagagagaucagugugacuuuagggaaaagcccauauaugcagcguguguauuacccagaaaguguaagaccuaccacagcauagcucaaacauugcuuuuguugcuuugggguugaugaugcugauaagagaagcacucuuggccuggggacagccaagaguuuccaggaacucuugaggcuaaaguuuggguggcaccacccagagcucuucugggacccauaaaccucuccacacuggcugagcaaaugagagaaugcuuucauguuccugauuuguuuuucagagccaaagaguucaagacacgucuggggaucuuucuucacaaaucagagcugggcugcgauacugggaguacuggcaaguucgaguggggcaguaaacacagcaaagagaaguaaguguugcugaccagcucagggcuccgagagggaagggagugggaagggagucaugaggagggaaauacagggagaagccaggacacgcuaaguggaccuuggcaacaccucccuagagauuuuagugggacuuguugcuggucuguuaugacuacuuggcucaugggugaguggguagguggcuccagggcuccaaguccauccacggaugagggcacacagggcaugaaugccuaguucccagacucucccaccucgggauucauugcacgugcauccagggcuaggacagaauccaagaccacuugaaguuuucuaguaugcaccuugccuagaaacucuuucauauuggcuaucaacuguaccaaacucuggaguuauguguagauguaaucucuauuuaugaggaccuuauuuccuugggaagguguacaaaacaaaucuuugagagucaggggaauugaaauaauuuuuggacagagacgagacaggcuuagagauauugacugaggacuaaagagucccuggcuuugauuucugguugcugaauugugcucuagaaagcacuacugcuuacccuaaguccaacuaagaguuugaggugucagcuucagcaaucaccaagcaagccuuucugugaauuuuaugcaguuuuccaucagaguucuggcuagaauuuguacuaugcuuugguuuguugauuuuuuuucuuacucuuuuuuuuucuuuuugucuuuuaguagaaacuucucagaagaugugcugggguggagagagucguucgaccugcugcugagcaguaaaagugaguaggagccuuuugugucugucucuggguggcacauguguacucaugugcuuuggagccagccccaggacugcugagagccugggcagaauaauaguaguaguaauaauaauaauaaugauccccuagugugccagccucuauucaacauauaaaggcaggucauuguucaagaaaauuauguucuaaaaauagagccauuaauugcaauugcuuuccuuucuucuuguauucccugcugucccuccagcugaccuauuuccucuucuuucccgcaaccccagauggaguggcugccuuccacgcuuuccugaagacagaguucagugaggagaaccuggaguucuggcuggccugugaggaguucaagaagauccgaucagcuaccaagcuggccuccagggcacaccagaucuuugaggaguucauuugcagugaggccccuaaagagguuagagcccccauaugcccagugaauccucacgacccugccugcuccuuccccucugagaaucagggcuagaggggaggaagggcuagguguagagguagaagggccuuacuuggcacaggggugacugggcuucugugaccagagacuaggaaagccaggcccagugccacuccugggugcuuaacccuaagacucaugauggggcaggauguguuggcagguuuuucggcuucuguccauac

SEQ ID NO: 19268 - RNA, 3155 nt, Homo sapiens
guauggacagaagccgaaaaaccugccaacacauccugccccaucaugagucuuaggguuaagcacccaggaguggcacugggccuggcuuuccuagucucuggucacagaagcccagucaccccugugccaaguaaggcccuucuaccucuacaccuagcccuuccuccccucuagcccugauucucagaggggaaggagcaggcagggucgugaggauucacugggcauaugggggcucuaaccucuuuaggggccucacugcaaaugaacuccucaaagaucuggugugcccuggaggccagcuugguagcugaucggaucuucuugaacuccucacaggccagccagaacuccagguucuccucacugaacucugucuucaggaaagcguggaaggcagccacuccaucugggguugcgggaaagaagaggaaauaggucagcuggagggacagcagggaauacaagaagaaaggaaagcaauugcaauuaauggcucuauuuuuagaacauaauuuucuugaacaaugaccugccuuuauauguugaauagaggcuggcacacuaggggaucauuauuauuauuauuacuacuacuauuauucugcccaggcucucagcaguccuggggcuggcuccaaagcacaugaguacacaugugccacccagagacagacacaaaaggcuccuacucacuuuuacugcucagcagcaggucgaacgacucucuccaccccagcacaucuucugagaaguuucuacuaaaagacaaaaagaaaaaaaaagaguaagaaaaaaaaucaacaaaccaaagcauaguacaaauucuagccagaacucugauggaaaacugcauaaaauucacagaaaggcuugcuuggugauugcugaagcugacaccucaaacucuuaguuggacuuaggguaagcaguagugcuuucuagagcacaauucagcaaccagaaaucaaagccagggacucuuuaguccucagucaauaucucuaagccugucucgucucuguccaaaaauuauuucaauuccccugacucucaaagauuuguuuuguacaccuucccaaggaaauaagguccucauaaauagagauuacaucuacacauaacuccagaguuugguacaguugauagccaauaugaaagaguuucuaggcaaggugcauacuagaaaacuucaaguggucuuggauucuguccuagcccuggaugcacgugcaaugaaucccgaggugggagagucugggaacuaggcauucaugcccugugugcccucauccguggauggacuuggagcccuggagccaccuacccacucacccaugagccaaguagucauaacagaccagcaacaagucccacuaaaaucucuagggagguguugccaagguccacuuagcguguccuggcuucucccuguauuucccuccucaugacucccuucccacucccuucccucucggagcccugagcuggucagcaacacuuacuucucuuugcuguguuuacugccccacucgaacuugccaguacucccaguaucgcagcccagcucugauuugugaagaaagauccccagacgugucuugaacucuuuggcucugaaaaacaaaucaggaacaugaaagcauucucucauuugcucagccaguguggagagguuuaugggucccagaagagcucuggguggugccacccaaacuuuagccucaagaguuccuggaaacucuuggcuguccccaggccaagagugcuucucuuaucagcaucaucaaccccaaagcaacaaaagcaauguuugagcuaugcugugguaggucuuacacuuucuggguaauacacacgcugcauauaugggcuuuucccuaaagucacacugaucucucuucgugccuguugauucagaaaagaacucagcauucuuuucagaaguauuucugaacugugugggaaacugauuccugccuucaucuuuacuuuuuccuucccagccaguaaggauuggaagcuguugaguagcucucuggaauauggacacacccucaacagugggagcccccacccccacacaccccaccaaaaaaaaaaaaaucucccugucuuccaggggcagaggaggcaaugccccuagcucuggucugaggaaugaaaaacaaaugcuuaagaaaugggcaggcucagugcugccuggaaaugucaacguggccuucccgcagccgggucuucagcaggucaccugagcacgacugcaguuugucagaggauggggauggcagcaagccgcgggcccuugcuucccuuccccuugcuuucucccugcuccuggaaucugagcacguggcaucaagugcgcuucuaccucucuacucaagccucuagcgccccauccccgcgcccacccagguccccaggccugccgcuccacucccuaagaguuggugggacuucccccaagcaguuggacaaccuccccuuaccucuccaggcaggugguggggaaggcggccagggugcggcacauggcugcgggcgcagggcagcacguaguaggcaggaugguggcaggcuccaggaggcuccgcgugcgccaggaagcaaaggcgcgguagcaggugcuagucaacugcgguuggguuuagcagccugcaagcgcccagacugagcggccgcugcuuuaaauccccucggaggagcggggcggggcugggcacugcugaccaaucggaggguggggcugggcgcugagaaggcggaggcggggcccgcagccagacugggccgggugcaacuuucgcggcagcuggagcacgcggagcugcacccuccgcccagaggacgccgcguguggaaggaaaagcggcaagagaauuggcacggggaugagacgugcacacccaguuuccuagggaaaaguaccugccgaccucuaguaacagcaggaaagucacgcagcggugucguguugagagaguuugcacggggguggugggucugggaggcacacagggcuuucuuugaucgcaggcaagucugagccugcuggguccugaggacaggcgcacagggugcaaaccugggcaaaacagcaucugauuauacugauaaguacccuuuacgaggcucuuaccaugauggac

SEQ ID NO: 19269 - RNA, 4026 nt, Homo sapiens
acuaacaaucccuuugugcgucuauaugagggacuccugggccaguaguuuaaaaggucuugacgggcaauaacaaauguuggugaggauguggggaaaaggaaacccuuguacacuguuggugggaauguaaauuagaauaaccgcuuuggaaaaaaauuuggaguuccucaaaaaauuaaaaauagagguaccauaugauccagcaaucccacagcuagguauaucccuaaaagaaagaaaaucaguauauugagagaugucugcacuccuguguuuacugcagcacuauucacaacagcuaagauuuggaagcaaccuaaguguccaucaucagaugaauggauaaagaaaaugugguauauauacacaauggaguacuauucagccauaaaaaaugaaugggauccugucugucuuugcaacaacauaguuggaacuggagguuauuacgugaagugaaauaagccaggcacagaaagacaaacuucacacauccucacuuauuugugggagccuaaauggaaacaauugaacucauggagacagagaguagagggaugguuaccagaggccaggaaggguaguggggggacuugcaggggaggaguggggaugguuaauggguacaaaaaauaguuagaauaagaccuaguauuucauagcacaacagggugacuauagccaauaauaauuuaaguguacauuuaaaauaacuaaaaguauaauuggauuguuuguaacacaaaggauaaaugcuugaggcaauggauaccccauuuacccugauaugacuauuaugcauuguaugccuguagcaaaauaucucauguaccccauaaauguauacaccuacuauguacccacaaaaauuaaaaauuuuaaaauaaguaaauaaaaaguuuuuuaaaggucuugaacuuucgggcuucugccuaacuuuacuacuaguguaagugggccccuugagauuucagcaccccagcauuuguuagugacugaaauaaugaaaauucugaucaggcccuugcuugcacauguugacaacucucuuuuugcccaauaucccuuguuccuacaacauaaucauaaacugcugauguacuguuucuuuaucaagcaggaggagauaauaacuucaggguuacgaaaaaguuugcaggaggaauaaguccuuugaaguacuuugaggccagcuucugucgcccagaagucugauuguucaaggaauuaucugagacugaagaaacacagacuuuuucccucgauucccugaaacucccccucccugacucgcuggccgcauaaacacucucugcuucuucuuuuuguuagggcggauuugagagaucuugcccucccgccuucucgcuuuggccaaaucgaauaaacuuuuaucuccaagcaccuauaugucaguguuuggcaucagcuacacaugggguacacgagccugagucugggcuucuacaacgcugggacccucgcuguucuuuggagcugaugguaaauucaacagaaaagaggcgcauggguagaaaaugcagcauuuccucucagaugccagauauucaucuccaaagguauuaaaaggagggggugugugccuguguaaagaggcuggucuuuuccuagcaguacgauuugggcaaguugcuugauuucuucaagccuuucuuuuuccgccugucaaacaaaacaaaacaaauaucccguuuaggacaaauucacaauccuuaaagagggcaggcagagcgauuggaaugcagaugaaccaaucccuucuccugcagguugcggagcugcagagggaccccgcccccugcauugugcuuagcucugauuggcgccucgcggagggggcggggccugggcgcgccgagcuccggcugggucccugcaggucuuggggcccgggacucuuccuggagacaccgccauggccgggcuaucccgcggguccgcgcgcgcacugcucgccgcccugcuggcgucgacgcuguuggcgcugcucgugucgcccgcgcggggucgcggcggccgggaccacggggacugggacgaggccucccggcugccgccgcuaccaccccgcgaggacgcggcgcgcguggcccgcuucgugacgcacgucuccgacuggggcgcucuggccaccaucuccacgcuggaggcggugcgcggccggcccuucgccgacguccucucgcucagcgacgggcccccgggcgcgggcagcggcgugcccuauuucuaccugagcccgcugcagcucuccgugagcaaccugcaggugagcuggggcccgcggcuuccccaggcgggcugugggcggggcggccacagagcgagccuucacucuccccagaauucuucccgggaaguggagcguggcucgaacggcuguugcuucucugccgcgcaggcagguaggugggcguugcagcgucccagauguugggcagcuggguaccaggaauuucccacaagccuccgccacugggccacgcaccugggguaaauucucugccagcagcccgaggacuucucauccgugagugguucucagucgucuuggggcccagugucucuauuaacugugcuccuauucucuuuuuuuuuuuuuuucccuuugagacagaaucucacuuuguggcccaggcuggagugcaguggcgcuaucucagcuuacugcaaccucugccucccagguucaagcgauucucgugccucagccuaccgaguagcugggauuacaggugcgugccaccacacccggcuaauuuuuguauuuuuaguagaggcgggguuucaccauguuggccaggcuggucucaaacuccugaccucacgugauccacccaucucagccucccaaagugcugggauuacaggcgugaaccaccgcgcccugccugggcuccuauucuuaaagguuuuacagggcauagagauuguuagguacuuaagcacuuuaauaugugacuucaggguuucucacucucuuacccuuccugaauuaagcuuuucccuccugcagcaagacgcuaacguacaauaucauggacgauuacaaugauuacugcagucuuuaggccuccacaggcauaguggcuccucaguaagaugcagagcugauugaagguguaucucuuccucgcccuuugcccaccuucuggugcagggccacacuuacaacucugauggaucucugcugucucagggauggggucacagacacccagcuugggaggccggagacacacagaguccaggaauggagccugauuugauggagggucuuuuugacaaagcucucacauuugaguucaacucugaaaguacaacauuguugauaaagacaggaugcaagaaacugaugcuugauuaaucacuuuuccauuugccuuccauucguugucucuucuauuaauucuuugaaguagguauuauauaccccauucugcagaugaagaacuugaggccuaccuagguuaaguaacuuguuuaaagccagcgggcaaaccccuaguuucaucucagguucaucuuucuucaaaccaccuaucacaggcugguggcccaucagcugaauaugucccacagaccgguuuggccuacacaaaguucuguuuuguuuuuaauaaauuugaauuuguuaccaacauuuuaaaauuuagauuuuacuuuaaaauguaaaucucuaacuuuucuugaaaaaugggaagauccagugacacugugggccugcacucuuugagcaaaaacagaagcagugcccucuuuuagcuaaggcagauacaccccaguucaccauuuucuuauucccagcccauuccacaccuuuaggcguuugcucaaaacaaacucacuccacuccaucaguggugcucaacuuugacugcaaaucauagucaccuaagaaggcuuuaaaaaugggaugccaagguauuuuauugaaagcacauuuuauuuuaagacaacaccccuucccgccuccccacaaaccacucccugaugauucua

SEQ ID NO: 19270 - RNA, 4026 nt, Homo sapiens
uagaaucaucagggagugguuuguggggaggcgggaagggguguugucuuaaaauaaaaugugcuuucaauaaaauaccuuggcaucccauuuuuaaagccuucuuaggugacuaugauuugcagucaaaguugagcaccacugauggaguggagugaguuuguuuugagcaaacgccuaaagguguggaaugggcugggaauaagaaaauggugaacugggguguaucugccuuagcuaaaagagggcacugcuucuguuuuugcucaaagagugcaggcccacagugucacuggaucuucccauuuuucaagaaaaguuagagauuuacauuuuaaaguaaaaucuaaauuuuaaaauguugguaacaaauucaaauuuauuaaaaacaaaacagaacuuuguguaggccaaaccggucugugggacauauucagcugaugggccaccagccugugauaggugguuugaagaaagaugaaccugagaugaaacuagggguuugcccgcuggcuuuaaacaaguuacuuaaccuagguaggccucaaguucuucaucugcagaaugggguauauaauaccuacuucaaagaauuaauagaagagacaacgaauggaaggcaaauggaaaagugauuaaucaagcaucaguuucuugcauccugucuuuaucaacaauguuguacuuucagaguugaacucaaaugugagagcuuugucaaaaagacccuccaucaaaucaggcuccauuccuggacucugugugucuccggccucccaagcugggugucugugaccccaucccugagacagcagagauccaucagaguuguaaguguggcccugcaccagaaggugggcaaagggcgaggaagagauacaccuucaaucagcucugcaucuuacugaggagccacuaugccuguggaggccuaaagacugcaguaaucauuguaaucguccaugauauuguacguuagcgucuugcugcaggagggaaaagcuuaauucaggaaggguaagagagugagaaacccugaagucacauauuaaagugcuuaaguaccuaacaaucucuaugcccuguaaaaccuuuaagaauaggagcccaggcagggcgcggugguucacgccuguaaucccagcacuuugggaggcugagauggguggaucacgugaggucaggaguuugagaccagccuggccaacauggugaaaccccgccucuacuaaaaauacaaaaauuagccgggugugguggcacgcaccuguaaucccagcuacucgguaggcugaggcacgagaaucgcuugaaccugggaggcagagguugcaguaagcugagauagcgccacugcacuccagccugggccacaaagugagauucugucucaaagggaaaaaaaaaaaaaaagagaauaggagcacaguuaauagagacacugggccccaagacgacugagaaccacucacggaugagaaguccucgggcugcuggcagagaauuuaccccaggugcguggcccaguggcggaggcuugugggaaauuccugguacccagcugcccaacaucugggacgcugcaacgcccaccuaccugccugcgcggcagagaagcaacagccguucgagccacgcuccacuucccgggaagaauucuggggagagugaaggcucgcucuguggccgccccgcccacagcccgccuggggaagccgcgggccccagcucaccugcagguugcucacggagagcugcagcgggcucagguagaaauagggcacgccgcugcccgcgcccgggggcccgucgcugagcgagaggacgucggcgaagggccggccgcgcaccgccuccagcguggagaugguggccagagcgccccagucggagacgugcgucacgaagcgggccacgcgcgccgcguccucgcggggugguagcggcggcagccgggaggccucgucccaguccccguggucccggccgccgcgaccccgcgcgggcgacacgagcagcgccaacagcgucgacgccagcagggcggcgagcagugcgcgcgcggacccgcgggauagcccggccauggcggugucuccaggaagagucccgggccccaagaccugcagggacccagccggagcucggcgcgcccaggccccgcccccuccgcgaggcgccaaucagagcuaagcacaaugcagggggcggggucccucugcagcuccgcaaccugcaggagaagggauugguucaucugcauuccaaucgcucugccugcccucuuuaaggauugugaauuuguccuaaacgggauauuuguuuuguuuuguuugacaggcggaaaaagaaaggcuugaagaaaucaagcaacuugcccaaaucguacugcuaggaaaagaccagccucuuuacacaggcacacacccccuccuuuuaauaccuuuggagaugaauaucuggcaucugagaggaaaugcugcauuuucuacccaugcgccucuuuucuguugaauuuaccaucagcuccaaagaacagcgagggucccagcguuguagaagcccagacucaggcucguguaccccauguguagcugaugccaaacacugacauauaggugcuuggagauaaaaguuuauucgauuuggccaaagcgagaaggcgggagggcaagaucucucaaauccgcccuaacaaaaagaagaagcagagaguguuuaugcggccagcgagucagggagggggaguuucagggaaucgagggaaaaagucuguguuucuucagucucagauaauuccuugaacaaucagacuucugggcgacagaagcuggccucaaaguacuucaaaggacuuauuccuccugcaaacuuuuucguaacccugaaguuauuaucuccuccugcuugauaaagaaacaguacaucagcaguuuaugauuauguuguaggaacaagggauauugggcaaaaagagaguugucaacaugugcaagcaagggccugaucagaauuuucauuauuucagucacuaacaaaugcuggggugcugaaaucucaaggggcccacuuacacuaguaguaaaguuaggcagaagcccgaaaguucaagaccuuuaaaaaacuuuuuauuuacuuauuuuaaaauuuuuaauuuuuguggguacauaguagguguauacauuuaugggguacaugagauauuuugcuacaggcauacaaugcauaauagucauaucaggguaaaugggguauccauugccucaagcauuuauccuuuguguuacaaacaauccaauuauacuuuuaguuauuuuaaauguacacuuaaauuauuauuggcuauagucacccuguugugcuaugaaauacuaggucuuauucuaacuauuuuuuguacccauuaaccauccccacuccuccccugcaaguccccccacuacccuuccuggccucugguaaccaucccucuacucucugucuccaugaguucaauuguuuccauuuaggcucccacaaauaagugaggaugugugaaguuugucuuucugugccuggcuuauuucacuucacguaauaaccuccaguuccaacuauguuguugcaaagacagacaggaucccauucauuuuuuauggcugaauaguacuccauuguguauauauaccacauuuucuuuauccauucaucugaugauggacacuuagguugcuuccaaaucuuagcuguugugaauagugcugcaguaaacacaggagugcagacaucucucaauauacugauuuucuuucuuuuagggauauaccuagcugugggauugcuggaucauaugguaccucuauuuuuaauuuuuugaggaacuccaaauuuuuuuccaaagcgguuauucuaauuuacauucccaccaacaguguacaaggguuuccuuuuccccacauccucaccaacauuuguuauugcccgucaagaccuuuuaaacuacuggcccaggagucccucauauagacgcacaaagggauuguuagu

SEQ ID NO: 19271 - RNA, 1987 nt, Homo sapiens
ucugagcacgggcccggaugcucaucccugcagacuggauuggcccuuagagcccuggcguugccugagccauucugguuccugucaguuguuugguugcagcaaggaacaagacucuagguccacuuaccagcagcugggggaacugagccucuugcagagaacgagagccccaccucuacucuaggaaaugagcuuuuuaauuuaacuggucaggccucaacccacauuagggguucaugaccauuguauagacagcuguagccagcuguucacagcccagacagacuugcccuaucuagacagcccccuccucccagcucagggacucgucuggcugugagcuuccaggaggucucaggggugugaccucccucccuccuucccuccccacucccuaccuccucccuccaccccaggcuauaaagcugcccaggcuuggcucucagcacauccagcugccugagacccuccugcagccuucucaagggacagccccacucugccucuugcuccuccagggcagcaccaugcagccccuguggcucugcugggcacucuggguguugccccuggccagccccggggccgcccugaccggggagcagcuccugggcagccugcugcggcagcugcagcucaaagaggugcccacccuggacagggccgacauggaggagcuggucauccccacccacgugagggcccaguacguggcccugcugcagcgcagccacggggaccgcucccgcggaaagagguucagccagagcuuccgaggugaggcccucccucccugcugccccuggucccauggggcaggucagaugugcccacuccgguggugucaaagggcuccuggccuugcagaggucugugggaggcugagugagggccacggucuaaggggcagugagguggggccgggccugugaggauggcggggccucagcaugcagcggugcaugcagucaggacuccgggggucuguuuucguacugccacucuggucugaguucuacuuggagcauauugcuuuaaaaucaucucacaaccauuugcucacauggaacugggguauaacuaugucuugcccaucuuccagcauugugaacaucaaaaugagucauuguaaauagaagcguguuuggguaacugaaaaauacugcacuugaguagacaaccuggguuauaccuggcugucaggggugcagcgggccugaauccuccugcagccggccugaauccuccugcagccucucgccucccuagcuccucagugcccagagcuagacccaaugccaggcaccugggugaggauucugcucccagcaucucagcugaggcaaacuugcuagccagggucccacaggcgccccugccugcuggauggaaauuguuacuaaacaaggcccagauccaaggaagauuuguaaacuggguuugccccagaaauagaacagggccggugucuccuggccuggcugccagcucaguggcccugccauccucagagcuccccuggagucgggggaggcccugcugacccugcucuuguccccagagguggccggcagguuccuggcguuggaggccagcacacaccugcugguguucggcauggagcagcggcugccgcccaacagcgagcuggugcaggccgugcugcggcucuuccaggagccgguccccaaggccgcgcugcacaggcacgggcggcuguccccgcgcagcgcccgggcccgggugaccgucgaguggcugcgcguccgcgacgacggcuccaaccgcaccucccucaucgacuccaggugggggucgcgggggcgcgcaggguagggggagggcgcugcuaggcccggcuugggggcggggacgcgggggggcggugcgggguccucggggcccgucccaguccccgcccucaagcggcgcugggucucugugucaugucucaggcugguguccguccacgagagcggcugga

SEQ ID NO: 19272 - RNA, 1987 nt, Homo sapiens
uccagccgcucucguggacggacaccagccugagacaugacacagagacccagcgccgcuugagggcggggacugggacgggccccgaggaccccgcaccgcccccccgcguccccgcccccaagccgggccuagcagcgcccucccccuacccugcgcgcccccgcgacccccaccuggagucgaugagggaggugcgguuggagccgucgucgcggacgcgcagccacucgacggucacccgggcccgggcgcugcgcggggacagccgcccgugccugugcagcgcggccuuggggaccggcuccuggaagagccgcagcacggccugcaccagcucgcuguugggcggcagccgcugcuccaugccgaacaccagcaggugugugcuggccuccaacgccaggaaccugccggccaccucuggggacaagagcagggucagcagggccucccccgacuccaggggagcucugaggauggcagggccacugagcuggcagccaggccaggagacaccggcccuguucuauuucuggggcaaacccaguuuacaaaucuuccuuggaucugggccuuguuuaguaacaauuuccauccagcaggcaggggcgccugugggacccuggcuagcaaguuugccucagcugagaugcugggagcagaauccucacccaggugccuggcauugggucuagcucugggcacugaggagcuagggaggcgagaggcugcaggaggauucaggccggcugcaggaggauucaggcccgcugcaccccugacagccagguauaacccagguugucuacucaagugcaguauuuuucaguuacccaaacacgcuucuauuuacaaugacucauuuugauguucacaaugcuggaagaugggcaagacauaguuauaccccaguuccaugugagcaaaugguugugagaugauuuuaaagcaauaugcuccaaguagaacucagaccagaguggcaguacgaaaacagacccccggaguccugacugcaugcaccgcugcaugcugaggccccgccauccucacaggcccggccccaccucacugccccuuagaccguggcccucacucagccucccacagaccucugcaaggccaggagcccuuugacaccaccggagugggcacaucugaccugccccaugggaccaggggcagcagggagggagggccucaccucggaagcucuggcugaaccucuuuccgcgggagcgguccccguggcugcgcugcagcagggccacguacugggcccucacguggguggggaugaccagcuccuccaugucggcccuguccagggugggcaccucuuugagcugcagcugccgcagcaggcugcccaggagcugcuccccggucagggcggccccggggcuggccaggggcaacacccagagugcccagcagagccacaggggcugcauggugcugcccuggaggagcaagaggcagaguggggcugucccuugagaaggcugcaggagggucucaggcagcuggaugugcugagagccaagccugggcagcuuuauagccugggguggagggaggagguagggaguggggagggaaggagggagggaggucacaccccugagaccuccuggaagcucacagccagacgagucccugagcugggaggagggggcugucuagauagggcaagucugucugggcugugaacagcuggcuacagcugucuauacaauggucaugaaccccuaauguggguugaggccugaccaguuaaauuaaaaagcucauuuccuagaguagagguggggcucucguucucugcaagaggcucaguucccccagcugcugguaaguggaccuagagucuuguuccuugcugcaaccaaacaacugacaggaaccagaauggcucaggcaacgccagggcucuaagggccaauccagucugcagggaugagcauccgggcccgugcucaga

SEQ ID NO: 19273 - RNA, 3389 nt, Homo sapiens
cuccgggcuuucacgguccggccuucuacagcggcgggggagccguggccucuugcagggcgcuccgcgcgguucccgacuacccggagccgaggugcgggcugaauccugcugagcuccccaugcuaccacccccgcaaccccacucucccggggcgggucuaagagcucuucggggaaauucaaagcacuacagggaccaacguuugcagaugcucucccugcgccgcgaccacccugugcuuggcccaguucucccggaggcguccagagacugggcucgugccgggggacggaagagggugcgccccggcggaucccuucuuggagccuggacgugagcuggccgguccggggcuugcagaccuccgggaggagcugcggggcugagcggcgaccaggaggccaggccggggcagaggaccgccgagggccaccgcgggaggcgcagucagcugcguacaggcuugcgccgccgcgggccaagacuccaaauugggaaagggguggccgcagcucugcgcaugugcaggaggcgccggaguuucacuuuguaacuuuuaaguggucggaacacgccccgcgcugcugggucccgccagacacgccgccgccgcagguacaggggacagggggcgugaggaggggcaaugcacccuccgccuuucccgggacgugcgcgccagguguccgguuccggaacggcucccagccuacgcagaccccagagcccccgaccccaagcagggggugacgacgcgggauugggugggaggagaggguccgggcagcgccuccauuccagcccugcgcuccuugggaauuccuggcggcuuuucaggacuuuccucuccggcuuuucgcuuucagggcugguaucuccuucuuccccaccccucucuuugggauuugucggcggaguccgaccucccaccuaacuaggagugcagcuaugggcuccucggacccuauacgaggccgggcugggaaagggccaagcguccgacucuccugacgccaggaaggcagaggccaccccucgggcuguuccugggugaccacuuccugcagccuuggcggaguccugaggagggaggcuggggacucggggacuggggggaagggcgggggcggaaagggugaggcgagcucugcuaagaaaccaaauccgcaaagguuccagcaccugauaagacuagcuaccugaggcccuggaggggccuuggucauucagccccaggcaggugguguccucuucaagggcagggguggacagcguggcggacccacugacccucccuugacaccucucaggucauccucaagucugcugugccuucaagggggauaugaacggaagccgaggcuccuuuucccuucacacgccccucuccuuuguuuagugugggggcaaaggucucuccuagcuguucguugggcucuaacagagaagacgucaggugggauccugcccuuguguuucccauuagcuggaggggcgacuuaaaauaaaggcagacagcuucuaauugcuugcuagggccggguccugggcuaagugcuuuacagguguuguuugggaucugugccucccaacagcuccgugagagaaagucaucacucgcauuuccuggcgaaggaagccaaggcacagagugguuaggcugcuugucugaacugcguggugcugagacccuaacuccagagccugcucacauaaucccugagccacacugccucugguuucagccaggggcugugucauuuccuuugugcuccaggguaggagguaaacaguuguccagguuacuggguccuguuugguguugccauaaggagaaguuuguacuuuacuuugcaaccuuauucugcaucugaaagaccagaguuagcuccugaggcagaaggccuggagcugcuuguaguuucgcuauugucaucacaggauugaaagauuuggugaugauaaaauuacccugaauuuguacgggccuucuugcaagaacgaacaauauccauauacuuccugcaacauucugcugguauuucuagagcuugucaaguugaccaccaggccaguccuugcugccaauggagacuggcaguggauuagcauagguaguuuacuuuggcaaauuuagaccagcuguuggauuuagcccucucccacuggccacaaucagacgcuugccugcacauggguugaacuuuggguugggagcgugaagucaccugcugcccacucuggcucuugggccucagcaguaauucuuggcuuuccuacccucggcauauugaguaggaauaaggggaugaauggagaauuucuggaaggcacagguaagugcuaggcauucacauacaucuaggaugacugaauauugccagggguucucagccaggcagugccacuucaaccacagugccuagcugcugguuuggccuccucuauacagcugccagcugggugcuccccucccccugccuucuccucagccuggcagcacugucccauggugucuguguucccagcugccugcucagagcgugccuguuugugaaaaugcagaggagcugucccauggagagccagagggacggagcuguuucagggggaucuggacuuuaugugucuaaugggcagggacaggcugggacugagcugaaaggucugagagagauuguggguccccagagcucuacccuaaccugggugcucaucggagagggcagacaggacuggccaccugaccuuaccuccgucucaggcugauaguauuugcuagccaccucccugaguucauaucaaacuuugucaaaccacccugggaagccuauuuggcaagagacaaguaacuuagaggcaugacuggggcuggagggagggggaagaggagccgcagguguuucccuccgcagaggccucucuccucugcagcacuggcgaggguaugccacucccagcaccaccacagcacccuccccuuuccagggacaaugcucucucugugagcauuuuauggggauguuuuuucuuuccacuucacauuucaagccuuccuuguucaugcugcuguguucccuuuuccugauucuagcucuuggggaacccuggggagccuccccaguagcauuggcccuuggggcccaggugaaguccuuugcuuggggcccuaccgugagcccacaaccuccaggguuucugugggagagggcugcuccccuagacccagcaggucccugagccauuggcaaagaggagagaggcuggggccacagguggugcuggccgaggaaggaggaguagggucgcacagaggagcacugauggauggagaaccaguucugggaguuuggggagagaucaaggcaggagggagcccacuggg

SEQ ID NO: 19274 - RNA, 3389 nt, Homo sapiens
cccagugggcucccuccugccuugaucucuccccaaacucccagaacugguucuccauccaucagugcuccucugugcgacccuacuccuccuuccucggccagcaccaccuguggccccagccucucuccucuuugccaauggcucagggaccugcugggucuaggggagcagcccucucccacagaaacccuggagguugugggcucacgguagggccccaagcaaaggacuucaccugggccccaagggccaaugcuacuggggaggcuccccaggguuccccaagagcuagaaucaggaaaagggaacacagcagcaugaacaaggaaggcuugaaaugugaaguggaaagaaaaaacauccccauaaaaugcucacagagagagcauugucccuggaaaggggagggugcugugguggugcugggaguggcauacccucgccagugcugcagaggagagaggccucugcggagggaaacaccugcggcuccucuucccccucccuccagccccagucaugccucuaaguuacuugucucuugccaaauaggcuucccagggugguuugacaaaguuugauaugaacucagggagguggcuagcaaauacuaucagccugagacggagguaaggucagguggccaguccugucugcccucuccgaugagcacccagguuaggguagagcucuggggacccacaaucucucucagaccuuucagcucagucccagccugucccugcccauuagacacauaaaguccagaucccccugaaacagcuccgucccucuggcucuccaugggacagcuccucugcauuuucacaaacaggcacgcucugagcaggcagcugggaacacagacaccaugggacagugcugccaggcugaggagaaggcagggggaggggagcacccagcuggcagcuguauagaggaggccaaaccagcagcuaggcacugugguugaaguggcacugccuggcugagaaccccuggcaauauucagucauccuagauguaugugaaugccuagcacuuaccugugccuuccagaaauucuccauucauccccuuauuccuacucaauaugccgaggguaggaaagccaagaauuacugcugaggcccaagagccagagugggcagcaggugacuucacgcucccaacccaaaguucaacccaugugcaggcaagcgucugauuguggccagugggagagggcuaaauccaacagcuggucuaaauuugccaaaguaaacuaccuaugcuaauccacugccagucuccauuggcagcaaggacuggccugguggucaacuugacaagcucuagaaauaccagcagaauguugcaggaaguauauggauauuguucguucuugcaagaaggcccguacaaauucaggguaauuuuaucaucaccaaaucuuucaauccugugaugacaauagcgaaacuacaagcagcuccaggccuucugccucaggagcuaacucuggucuuucagaugcagaauaagguugcaaaguaaaguacaaacuucuccuuauggcaacaccaaacaggacccaguaaccuggacaacuguuuaccuccuacccuggagcacaaaggaaaugacacagccccuggcugaaaccagaggcaguguggcucagggauuaugugagcaggcucuggaguuagggucucagcaccacgcaguucagacaagcagccuaaccacucugugccuuggcuuccuucgccaggaaaugcgagugaugacuuucucucacggagcuguugggaggcacagaucccaaacaacaccuguaaagcacuuagcccaggacccggcccuagcaagcaauuagaagcugucugccuuuauuuuaagucgccccuccagcuaaugggaaacacaagggcaggaucccaccugacgucuucucuguuagagcccaacgaacagcuaggagagaccuuugcccccacacuaaacaaaggagaggggcgugugaagggaaaaggagccucggcuuccguucauaucccccuugaaggcacagcagacuugaggaugaccugagaggugucaagggagggucaguggguccgccacgcuguccaccccugcccuugaagaggacaccaccugccuggggcugaaugaccaaggccccuccagggccucagguagcuagucuuaucaggugcuggaaccuuugcggauuugguuucuuagcagagcucgccucacccuuuccgcccccgcccuuccccccaguccccgaguccccagccucccuccucaggacuccgccaaggcugcaggaaguggucacccaggaacagcccgagggguggccucugccuuccuggcgucaggagagucggacgcuuggcccuuucccagcccggccucguauaggguccgaggagcccauagcugcacuccuaguuaggugggaggucggacuccgccgacaaaucccaaagagagggguggggaagaaggagauaccagcccugaaagcgaaaagccggagaggaaaguccugaaaagccgccaggaauucccaaggagcgcagggcuggaauggaggcgcugcccggacccucuccucccacccaaucccgcgucgucacccccugcuuggggucgggggcucuggggucugcguaggcugggagccguuccggaaccggacaccuggcgcgcacgucccgggaaaggcggagggugcauugccccuccucacgcccccuguccccuguaccugcggcggcggcgugucuggcgggacccagcagcgcggggcguguuccgaccacuuaaaaguuacaaagugaaacuccggcgccuccugcacaugcgcagagcugcggccaccccuuucccaauuuggagucuuggcccgcggcggcgcaagccuguacgcagcugacugcgccucccgcgguggcccucggcgguccucugccccggccuggccuccuggucgccgcucagccccgcagcuccucccggaggucugcaagccccggaccggccagcucacguccaggcuccaagaagggauccgccggggcgcacccucuuccgucccccggcacgagcccagucucuggacgccuccgggagaacugggccaagcacaggguggucgcggcgcagggagagcaucugcaaacguuggucccuguagugcuuugaauuuccccgaagagcucuuagacccgccccgggagagugggguugcgggggugguagcauggggagcucagcaggauucagcccgcaccucggcuccggguagucgggaaccgcgcggagcgcccugcaagaggccacggcucccccgccgcuguagaaggccggaccgugaaagcccggag

SEQ ID NO: 19275 - RNA, 2602 nt, Homo sapiens
guuucucucuccugacuccguagccucccgccccaauugugagauugcgacaccguggcagcccuggaggcgucaguccugagauuucugacuguuagucggcucgcccguuaggcaguacucuggaguuuuuccguaccuggaaacgugucuuggaacugaugcugaacugaauuucuuggguucgaguuuaagggacucaggauugcagaagccucguuaaugggaucuagagaugcgaagaacuggccggccgagggcugcaggccugagaggugcaccccggcgggccgcccaccgguuagcagggaagugagaucuggggacaagggaaaaggauagcagguuacaucucgggcacacucacacucuccgcugauuuguuccuccccuuccccuugcccuggauucacuuuuauugagcgaagucaagagagaacccgucuaggcgcugaaaccucucucucccaacaguugccaaggagcgacgcacgaaaaguuccugugugucccucacguccauaugcauguauauaguaaguaaaggcuuuacauaaaucggcuuacggccucacuuucacgugucuuccaagaacgccacagacgcaaaaccuccgccccaagguggccccacucugcccgcucaucuaggcgguuuuguuuauuauuuacauuuccugggugaaauuuuuacuagaaaucagauaagugcgaaaguguuucccaaaaaugcuuuagcugucagaaaauauaauucugucucuagauacauuauuaaagagaucaaagucauguuagcagauaauuacaccaaccacuuuuauaaauauugauucuaagacguguuuuuaaagaaucccuggagucauuuuuuguuuguuuuacauagaacaggugaguuuuagaccuaauguuuuguaguuuucuuacaauucguuuucuucucucccguuuuaccgauuuguccuuaauuguaaaaacacucaaaggcaccccaagccagcccgggguccggggagugggucaguggucagaggccugcagccucccgcccaagaccuaccucucagcguguugccuucuuugacuuuugggucaaauucugcagauaaaaugcggucaauuccaaauuugaggucuuugcuggagggggccggggcagagccacugugguggggguucggaaccacucgcguccccgaggccgggggcugcagggcgccagcccggggcggaggcggaggcuguugcugcugcggcuguugcugcugcuguuguuguugcgggugaugguggugguaggcggcugagagcggagacagccgcugcgggaagccagccgggacuucggagggcgccaccacuggggugggucgaagcggggaucuggccgccgcuuggaaagaggcgugcgggugaaccgagcccaagugcgcggugagggcggcggccgaggccccugccaggcccuccggggccgcccccagaucccccacgccggcgugcagaaugucugcgaugcagaaggagggcuuuuugacggcggcgggguccaaggggaaggagcagccgccugggccggccgaggagcaguaagcggccgaccagaggcugaaguuggaggcguagaagggagccagcccggcugcgaacauccugccggggugagccgcgcggcugccgcaguccagccggacugggugggugggcgcgcggggaggggcgcgcgagucccggagaaggcggcggcagccgaggacgauccgcuuucgcuucuccgcccgcacugaggaagagaggccgggagcccuagcgccaccgagggaggaggcgagggccggaucucggccggucaccgccucgcucccuggccucgcuuuaaaggcggcgcggcgcccgcacuccucgcgggcuggaugagagcgaggggcgcuggggccgcagggcgggcgggggagccagggagacgggagccggacaccgcaagaaaacccaaauagcuaagcccuaagagcuaaauuuaaaacaacaacaauaauaguccguuaguuagggggggggaaaaguaauagaaaaaaaaaaaaacucgucucuaaaaacucccaaaguuuuggcaggagcuuucgagucaggcccgggguaggaccucgauccgagcgcucauuggucauccucgugaccaaugggagcggggaguggaggggaauuaggaacaagggggccuggccggacccuagccacgccccggccacgccaaaguuuuugcugcggccgcgugggcuuaguagcgcacaucgcagugcuucuugcuacucugcguaggggccaggcagccgcuccggagggcucugacucucuucuaacuucugcagcuccgaaccgccacggggcaaggaggguugaucacaggagcuuuccugaagcgcuugucacccggggcgaguugggggcguggggaagggacgguaaucucacucuuuagggcucugcaaagcccgccucccgguggagagcggagcgcgcuuuggccccuuugcuucccuucucuugaccucauucugcuuuuauuccaggaguccguguccucggcaaagccccucau

SEQ ID NO: 19276 - RNA, 2602 nt, Homo sapiens
augaggggcuuugccgaggacacggacuccuggaauaaaagcagaaugaggucaagagaagggaagcaaaggggccaaagcgcgcuccgcucuccaccgggaggcgggcuuugcagagcccuaaagagugagauuaccgucccuuccccacgcccccaacucgccccgggugacaagcgcuucaggaaagcuccugugaucaacccuccuugccccguggcgguucggagcugcagaaguuagaagagagucagagcccuccggagcggcugccuggccccuacgcagaguagcaagaagcacugcgaugugcgcuacuaagcccacgcggccgcagcaaaaacuuuggcguggccggggcguggcuaggguccggccaggcccccuuguuccuaauuccccuccacuccccgcucccauuggucacgaggaugaccaaugagcgcucggaucgagguccuaccccgggccugacucgaaagcuccugccaaaacuuugggaguuuuuagagacgaguuuuuuuuuuuuucuauuacuuuucccccccccuaacuaacggacuauuauuguuguuguuuuaaauuuagcucuuagggcuuagcuauuuggguuuucuugcgguguccggcucccgucucccuggcucccccgcccgcccugcggccccagcgccccucgcucucauccagcccgcgaggagugcgggcgccgcgccgccuuuaaagcgaggccagggagcgaggcggugaccggccgagauccggcccucgccuccucccucgguggcgcuagggcucccggccucucuuccucagugcgggcggagaagcgaaagcggaucguccucggcugccgccgccuucuccgggacucgcgcgccccuccccgcgcgcccacccacccaguccggcuggacugcggcagccgcgcggcucaccccggcaggauguucgcagccgggcuggcucccuucuacgccuccaacuucagccucuggucggccgcuuacugcuccucggccggcccaggcggcugcuccuuccccuuggaccccgccgccgucaaaaagcccuccuucugcaucgcagacauucugcacgccggcgugggggaucugggggcggccccggagggccuggcaggggccucggccgccgcccucaccgcgcacuugggcucgguucacccgcacgccucuuuccaagcggcggccagauccccgcuucgacccaccccagugguggcgcccuccgaagucccggcuggcuucccgcagcggcugucuccgcucucagccgccuaccaccaccaucacccgcaacaacaacagcagcagcaacagccgcagcagcaacagccuccgccuccgccccgggcuggcgcccugcagcccccggccucggggacgcgagugguuccgaacccccaccacaguggcucugccccggcccccuccagcaaagaccucaaauuuggaauugaccgcauuuuaucugcagaauuugacccaaaagucaaagaaggcaacacgcugagagguaggucuugggcgggaggcugcaggccucugaccacugacccacuccccggaccccgggcuggcuuggggugccuuugaguguuuuuacaauuaaggacaaaucgguaaaacgggagagaagaaaacgaauuguaagaaaacuacaaaacauuaggucuaaaacucaccuguucuauguaaaacaaacaaaaaaugacuccagggauucuuuaaaaacacgucuuagaaucaauauuuauaaaagugguugguguaauuaucugcuaacaugacuuugaucucuuuaauaauguaucuagagacagaauuauauuuucugacagcuaaagcauuuuugggaaacacuuucgcacuuaucugauuucuaguaaaaauuucacccaggaaauguaaauaauaaacaaaaccgccuagaugagcgggcagaguggggccaccuuggggcggagguuuugcgucuguggcguucuuggaagacacgugaaagugaggccguaagccgauuuauguaaagccuuuacuuacuauauacaugcauauggacgugagggacacacaggaacuuuucgugcgucgcuccuuggcaacuguugggagagagagguuucagcgccuagacggguucucucuugacuucgcucaauaaaagugaauccagggcaaggggaaggggaggaacaaaucagcggagagugugagugugcccgagauguaaccugcuauccuuuucccuuguccccagaucucacuucccugcuaaccggugggcggcccgccggggugcaccucucaggccugcagcccucggccggccaguucuucgcaucucuagaucccauuaacgaggcuucugcaauccugagucccuuaaacucgaacccaagaaauucaguucagcaucaguuccaagacacguuuccagguacggaaaaacuccagaguacugccuaacgggcgagccgacuaacagucagaaaucucaggacugacgccuccagggcugccacggugucgcaaucucacaauuggggcgggaggcuacggagucaggagagagaaac

SEQ ID NO: 19277 - RNA, 1796 nt, Homo sapiens
ugaaaucuuaacucauccuucugugcccaguuuucaugucaccgugauuugaaaacuucccugaguuuacaagcucaccgcugaggagugaacugccugagcucugugcccugaagcccccccgggggcggggggagccagcuaugucagugucucccugggaggcugugcccuucucuagggcagggcugcacuguauucauuuucgcaucucuacugcucagcacaaugccugacgcauaaugagugcccccaaaauaucuucaaguccuaguccuugagcugagguuucugcaguaucaguucaccaauggagagggacaugauggcuucuuugugcucaacugggacccaaagcagagaugaaucguccuagcagggcucuaagccugaaagacccaacuuuauaguuuuaccccugccuguauucugcuccagaagcugcugacauaccuuuaaagaggaugauaaaccuaagcucccaggcauggagacugaauggcuucagguguaagacggcauugggcaacacagauaaauagacaauaaaucagauggggcccguggccuuuggccaggacacaguaacuucugugacuuuauucuggguggccuuguccaggccagcagagcuuccggcagcagcuucgacuguuuccaugcagagacaccugggaacugcaucugcgcuuugauuuccgcgaaggaaacugucauuuucucccauauucauucuuccuaaccccaucuccccgagacaaacggcagaauguuuugaaggccccagaguacacugauaguuggcuagacgagaaaaauucaacgagcgccuauuuauguauuuguugcgcucccaggcucgggaaauaaccuugggaauauuugggagaguaacccaaacauuucucaacuagugggauauccuggaggggauguuacuggaaaacaaauacacuggguugcaauuucuuucuuuccaacugggccaccuucuccaagucaccugccgcgcuaacgcuucaguauucccaucuguaaucaggaaacugauuccugaucuuacauaaaaaccaccgcgguaggagccccuugagaauguucuuaagaagccaggagcgcaauagcaggcacagcagggaccacccagcgcaacccccgauuuaaguuucuaucacgacucgcaacucgcggcuucccuccggcgagggaaugggagcgggggcggaggggucgcaggugcagcccggagaaacugggugagucgaugguaaggacccggcucccgcucccccgcgggacaccacacccgcgccccccgggcagugguggcgcagggccccuaccuugccguacuucuucagcuuccuccgguaccucuuccugggcugcucgcucggcgccggcuccuccaguggcucguagcgcucgggcaggagggcgaagugcacccuccgcgcgccccggguccccgggccccgcucguccgccgcgcucgucccgcucucggccgccgccuccgccucguccgcguacuccaggugcuccaggauggcggccgccuccucgucccccucgguucgcccucgcccucggggcccgcggcgcaggaggcugcucuccgccuugcuucggagccuggcucccaccgucaugaugucccggccccucuggcgaagguccgagcgcaaagacaccaaccuuugguccccgcccgcuccuccgccccagcccggacggggcgggggauugggggggccgcagcgcccccuggccguggggcccgggauagcguuggc

SEQ ID NO: 19278 - RNA, 1796 nt, Homo sapiens
gccaacgcuaucccgggccccacggccagggggcgcugcggcccccccaaucccccgccccguccgggcuggggcggaggagcgggcggggaccaaagguuggugucuuugcgcucggaccuucgccagaggggccgggacaucaugacggugggagccaggcuccgaagcaaggcggagagcagccuccugcgccgcgggccccgagggcgagggcgaaccgagggggacgaggaggcggccgccauccuggagcaccuggaguacgcggacgaggcggaggcggcggccgagagcgggacgagcgcggcggacgagcggggcccggggacccggggcgcgcggagggugcacuucgcccuccugcccgagcgcuacgagccacuggaggagccggcgccgagcgagcagcccaggaagagguaccggaggaagcugaagaaguacggcaagguaggggcccugcgccaccacugcccggggggcgcggguguggugucccgcgggggagcgggagccggguccuuaccaucgacucacccaguuucuccgggcugcaccugcgaccccuccgcccccgcucccauucccucgccggagggaagccgcgaguugcgagucgugauagaaacuuaaaucggggguugcgcuggguggucccugcugugccugcuauugcgcuccuggcuucuuaagaacauucucaaggggcuccuaccgcggugguuuuuauguaagaucaggaaucaguuuccugauuacagaugggaauacugaagcguuagcgcggcaggugacuuggagaagguggcccaguuggaaagaaagaaauugcaacccaguguauuuguuuuccaguaacauccccuccaggauaucccacuaguugagaaauguuuggguuacucucccaaauauucccaagguuauuucccgagccugggagcgcaacaaauacauaaauaggcgcucguugaauuuuucucgucuagccaacuaucaguguacucuggggccuucaaaacauucugccguuugucucggggagaugggguuaggaagaaugaauaugggagaaaaugacaguuuccuucgcggaaaucaaagcgcagaugcaguucccaggugucucugcauggaaacagucgaagcugcugccggaagcucugcuggccuggacaaggccacccagaauaaagucacagaaguuacuguguccuggccaaaggccacgggccccaucugauuuauugucuauuuaucuguguugcccaaugccgucuuacaccugaagccauucagucuccaugccugggagcuuagguuuaucauccucuuuaaagguaugucagcagcuucuggagcagaauacaggcagggguaaaacuauaaaguugggucuuucaggcuuagagcccugcuaggacgauucaucucugcuuugggucccaguugagcacaaagaagccaucaugucccucuccauuggugaacugauacugcagaaaccucagcucaaggacuaggacuugaagauauuuugggggcacucauuaugcgucaggcauugugcugagcaguagagaugcgaaaaugaauacagugcagcccugcccuagagaagggcacagccucccagggagacacugacauagcuggcuccccccgcccccgggggggcuucagggcacagagcucaggcaguucacuccucagcggugagcuuguaaacucagggaaguuuucaaaucacggugacaugaaaacugggcacagaaggaugaguuaagauuuca

SEQ ID NO: 19279 - RNA, 2932 nt, Homo sapiens
gggcacaaugaagaucuccuugaccagcagaguaauagaacacuguaacugacugcagcaggaaguuuagaggcucugucacuucuccaaggacacacacagcuuucuggccugcaggcucagaugcucagcugucaccaggcuggggaaucaaccagauggccuuccgggucucaagucuggcauuccuagaccugcccaggaaucuucucagccguaccagcguccccaggguccaggggaaaccauccgccacgcuauaaccccgaggcucggcagcauuucuccccaguuugcauuuugauguuucauauaacguaucuacucccaccaggguacaucucccucccucgguaaagauauccuuagccaccaaacccaaauggcucacuggcuucucuccaaggcaaaaagagaguuucacuccucauccucuuuuucuauccagugagacuaauucaucauguguacuggaaagucccuuuuaagucucagccaaaagucuuucuuuuuucuuggagcacaaauaagcugggaagagagagagagaguucaccguuuugcaaguuucagaggugaaagucacugucacacacacacacacaaaaaaaccagaaagaaaagaaaaaaaacuggcaaaaagucuggaaauuauucacacugagaagucugacugguugauuucaaauucauucacagcuuaauaaaucauuugcugggggaagaggggagcagaggaggagcaagacacuccaaagagaacaagcagggugggaucccuggggucugugcauucuuuggcaucgcugguaccugguggcucuagcuuuugcugaaggaggauguaugugggggugaguaaauaauagaguuuggcuggagcuucaaagacaccuuggcacaauccaauuacacagucccaggauagcaagcccgcuaccucucccuuccccauuucuuaggcuuccaaucuaaauaucucaauuagaaaagggcuggcaggaaggaauggggagaggaagggaguuuguagcaggacuaggaaaauggagauugccuguguuugcuauguauaggcugaaacggucccaucgcugccuaccuacccccagccccccaacuccgcccuggaagccacugaccuuugccaagaaggcggcguuccugauggcgcccaccauuucuccccccuuagggugcaccuuggccacgugcauccacaugcgcucccagguguggcugucgauggggaagccgcucuuguugacguggaacagcaccccgccgucuuuguccuccuccucugagcccccgcugguggcgaggcucacgggccgcgcguggcugcuccgggaccgggugccuuuggcgccuuuggggugggggcagcggugagugucggccgcggagccggucaugguggggccugggcggggagcgagguacugggggcgcgcggcggcggcagcggcggcggcggcggggggcgugugcgcgcgggcgcggcgaggggaucagcgccccgcgggggcggccuucuccaugccucucgcugcggcaggacucaccaagggggagcggcggcgggagcuccgcggaggcucccugcuuaccggcggugccugaaaucagcggagacacagcugacaccacagcuaaguggacgcacagcggaaccgagugaggggucccggagugucuccacgacacuccccgcuccccccugcacgcugacagccucccugagaaucgaugacgggcuuccagcccugcgauuaccuagaaaggcagcucaaaaugugccacgaagcuucacacacaccuaaacccgggggguuggggauggaggggcacaaggagcuugggggaugcggagcgcaagauguggggagaagaaagacagcuuguguagcaugaaggaacaggagguucccgcaaggcuccacacauuccuggguccucagauguggccaagagaggaggggagccacgaacgugcuggcaugugagcgcccagagcuggcgcgagggcgcugcagcagccuuggcuugcaaggcggcccgcuuucuuccaggaagcccucccggaccccggcggggaucuaguggaaagagcuccauccgcccccuuuuccccgaguuccagcgccuaucaccgggagggacuggcugcaggcgggcggcgcgcaggaagggcgcgcggcagcuccaagauccuaccucgggacgguuggcuucauggcugcagagccucuccgggcggcgggagagcaggggcugcugcugcugcugcugggccuggggcuggggcuggggcugcuggggcuugcuggggccgucgccucauuccaugucccauucucgaauguuauucugugacauauaaccaagucacccgggcagccgccgauguuccgaaugcgucuauuggccaccgcaacaaagaggggcgggucccgggcucgggacucuacaaccccgggcuccgcgacgcucugauuggcuccagggguucucuggcgggaggggacaggaguagggggagccuggcggccacgcgaaauccgaucgcugugguguccugagagccccgcgggcuggagcguuuggccaugggacuuaagaucgaguuuccccaggggucguggcacuucgaggguuugcaacuguggaagcagaggagaaacaaaaccacccgagaagugaccccgcggaagcagaggguuuggcaucagaagagcauucccugagggacgcuggacacacuuaccugccucuacccgggaugaugaguuguucauccucuaccugggaugaugaggggcuguucauaccuaugcgugaaauuaaaucuuuuuuaaaucccgcauuuaaaaauuccucaaaauuaacaagugggugcagcuuuggauccucugguauuagucauggu

SEQ ID NO: 19280 - RNA, 2932 nt, Homo sapiens
accaugacuaauaccagaggauccaaagcugcacccacuuguuaauuuugaggaauuuuuaaaugcgggauuuaaaaaagauuuaauuucacgcauagguaugaacagccccucaucaucccagguagaggaugaacaacucaucaucccggguagaggcagguaaguguguccagcgucccucagggaaugcucuucugaugccaaacccucugcuuccgcggggucacuucucgggugguuuuguuucuccucugcuuccacaguugcaaacccucgaagugccacgaccccuggggaaacucgaucuuaagucccauggccaaacgcuccagcccgcggggcucucaggacaccacagcgaucggauuucgcguggccgccaggcucccccuacuccuguccccucccgccagagaaccccuggagccaaucagagcgucgcggagcccgggguuguagagucccgagcccgggacccgccccucuuuguugcgguggccaauagacgcauucggaacaucggcggcugcccgggugacuugguuauaugucacagaauaacauucgagaaugggacauggaaugaggcgacggccccagcaagccccagcagccccagccccagccccaggcccagcagcagcagcagcagccccugcucucccgccgcccggagaggcucugcagccaugaagccaaccgucccgagguaggaucuuggagcugccgcgcgcccuuccugcgcgccgcccgccugcagccagucccucccggugauaggcgcuggaacucggggaaaagggggcggauggagcucuuuccacuagauccccgccgggguccgggagggcuuccuggaagaaagcgggccgccuugcaagccaaggcugcugcagcgcccucgcgccagcucugggcgcucacaugccagcacguucguggcuccccuccucucuuggccacaucugaggacccaggaauguguggagccuugcgggaaccuccuguuccuucaugcuacacaagcugucuuucuucuccccacaucuugcgcuccgcaucccccaagcuccuugugccccuccauccccaaccccccggguuuaggugugugugaagcuucguggcacauuuugagcugccuuucuagguaaucgcagggcuggaagcccgucaucgauucucagggaggcugucagcgugcaggggggagcggggagugucguggagacacuccgggaccccucacucgguuccgcugugcguccacuuagcuguggugucagcugugucuccgcugauuucaggcaccgccgguaagcagggagccuccgcggagcucccgccgccgcucccccuuggugaguccugccgcagcgagaggcauggagaaggccgcccccgcggggcgcugauccccucgccgcgcccgcgcgcacacgccccccgccgccgccgccgcugccgccgccgcgcgcccccaguaccucgcuccccgcccaggccccaccaugaccggcuccgcggccgacacucaccgcugcccccaccccaaaggcgccaaaggcacccggucccggagcagccacgcgcggcccgugagccucgccaccagcgggggcucagaggaggaggacaaagacggcggggugcuguuccacgucaacaagagcggcuuccccaucgacagccacaccugggagcgcauguggaugcacguggccaaggugcacccuaaggggggagaaauggugggcgccaucaggaacgccgccuucuuggcaaaggucaguggcuuccagggcggaguuggggggcuggggguagguaggcagcgaugggaccguuucagccuauacauagcaaacacaggcaaucuccauuuuccuaguccugcuacaaacucccuuccucuccccauuccuuccugccagcccuuuucuaauugagauauuuagauuggaagccuaagaaauggggaagggagagguagcgggcuugcuauccugggacuguguaauuggauugugccaaggugucuuugaagcuccagccaaacucuauuauuuacucacccccacauacauccuccuucagcaaaagcuagagccaccagguaccagcgaugccaaagaaugcacagaccccagggaucccacccugcuuguucucuuuggagugucuugcuccuccucugcuccccucuucccccagcaaaugauuuauuaagcugugaaugaauuugaaaucaaccagucagacuucucagugugaauaauuuccagacuuuuugccaguuuuuuuucuuuucuuucugguuuuuuugugugugugugugugacagugacuuucaccucugaaacuugcaaaacggugaacucucucucucucuucccagcuuauuugugcuccaagaaaaaagaaagacuuuuggcugagacuuaaaagggacuuuccaguacacaugaugaauuagucucacuggauagaaaaagaggaugaggagugaaacucucuuuuugccuuggagagaagccagugagccauuuggguuugguggcuaaggauaucuuuaccgagggagggagauguacccuggugggaguagauacguuauaugaaacaucaaaaugcaaacuggggagaaaugcugccgagccucgggguuauagcguggcggaugguuuccccuggacccuggggacgcugguacggcugagaagauuccugggcaggucuaggaaugccagacuugagacccggaaggccaucugguugauuccccagccuggugacagcugagcaucugagccugcaggccagaaagcuguguguguccuuggagaagugacagagccucuaaacuuccugcugcagucaguuacaguguucuauuacucugcuggucaaggagaucuucauugugccc

SEQ ID NO: 19281 - RNA, 2648 nt, Homo sapiens
cgccucaagggaucaaccaacaaggcaaccagagaacagagccauuagccagguagauaaggggucaagaguccuggcaccugguaccaaucacagaggagacuuugacaggacugagauagggaggggcuaucgaagaaaacggccauggagaaaaaggaauucuauaauggcuaaagggcaaggaggaagagagagagaaaaagaaggcucccaucacugccacagaugcugggugcuguaucuuauccccacugcgggcguggggugcugccuucuuugcugucucugaaaccauuccgacaguaacugcaauccucaccccaucccaucuuugcccaggauauccucaaagcaggagccuguauguuguagcauuauucuacaaccaaugcuaacugcaaaacaauggggacaguaauaccaauuuuuugccuucacuuuaaguuacagagacagaaacuucgaacagaagauaugacugucaccuacaacgaaagggguacacugagagaacauccagauuuucuggcucuccuuuucuuucuggguucaucaaggauuuaguaacuauuuuauuuguaagaaagcauaugugaccuaugcaaugaaauuagggaaaagaaaauguuuaggaggaaaggaaguagaugagaaaugaaaaugggaguggggggagcagagaaggagaacgaauccaguggaaagaaagcuggugagggaaaagaugcccugcagaaaaguccccuuucccccacugucuggacacuggugaaugacauuagauagagacccaccccauucaaguccccucacuggcuccuuuucuccccacuacaccacuccaaaaucugaaaaucuccagacagaaaggaccuuaguaguuaucugguccaaccacugcauugugcccuccaacacgcagagggggccgguacugcccaugugcccuuauuucccggcuccgcauacugaggcccaacgacaucgauugcaguguaagcgcucagaguccuggcacuagaccacaaagccauucucucaaauaucugcacaaguggcuccacacccucgcuuccccgccacggugggucucccgcggacccgccgaaggaaaagccagagugagagucccaggugugugggagucccgggcucgggguccggacaccagccguugccgggagcccuccccgucuuccgccccgggacagcgcgacaccagcgcucgccacuuccaagcuuaucccagcuaacuuuuucucgggguugccuucacgguccugccgccagugcugcgggguacccagggcgacccccagcggccgcgcccgggacgccucccgcccucucgccccuuccccauucauuccucucggcgcguggggcagcccucccgcaagccuccggccuucgugccucucugcgcccccccccccccacccgggaaggaucggcucccacagugccgugucucgaagcgagggauggagcgggacggcgagcgaggcagccucggacaccccaacgcacccgcccacccaccuuacgcccucucccagccgggcaagccagcgccgucggcggagagaagcggcgcucgaggcuggcggcagaguggacgcccgaccuccgucaccaggaaccuuucgcgccccaagucaaaagagaaaguuaguucuuucgcuuugcgggaaacuuuucgaagcgccgaggagcagcgguggcuuagaagaaguuuaagccagaguuauuuccaagccggaggcugggggcgcggauccggggugggucaggggucggcggacugguuacuuagaggggcgcgaagggaaugaaggcgagcagcccucgucgcgcucacucccucggcuuccagcgcucaccuccaggcuccgcucggggcggccagggucgggacggggucgggcgggcuguuugucuggccggcgggcgagcaccgaggacucacggccggcgcgcgggcugaagggugcgcucgggcggcggcgagagaagagagcugugcagugcgcgccuggcugcgugcgacuguggcuuggagagcguugcaucaccccuuuuauagcccucaggcuggcggcgcggucguuuacuccguguugccagucccaggcugacguaaugcuauuaauagcuucccgggagaaccggccgaacggagcggaggaagggggguggaggaggggccaaggcggggccgaaggcggguggagagagggggcacuggugaugcaaguucggggaggagccagcccaggcgcguucccccagccucgcucacugagacacacaccagcccgcccucucucuccauaucaggaccggagccgcccgggauagccgccagaugugcguacucgcugcugcguguuccaggcaugaccaauggugcccaagccagcggcaugacuccaccgcgcuggcaucugucccuccgcuagguugaagagcggggggggcggggaagguggggaggcgggucccggccccagcccagacuaggugaggcugggaagcgggcacgaccuuucucuaaaaugcguggucauuuucuggagcuucaggaaaauacccccucccccacuggccuccuacuucucuagcaggggcggaguaggggcaga

SEQ ID NO: 19282 - RNA, 2648 nt, Homo sapiens
ucugccccuacuccgccccugcuagagaaguaggaggccagugggggaggggguauuuuccugaagcuccagaaaaugaccacgcauuuuagagaaaggucgugcccgcuucccagccucaccuagucugggcuggggccgggacccgccuccccaccuuccccgccccccccgcucuucaaccuagcggagggacagaugccagcgcgguggagucaugccgcuggcuugggcaccauuggucaugccuggaacacgcagcagcgaguacgcacaucuggcggcuaucccgggcggcuccgguccugauauggagagagagggcgggcuggugugugucucagugagcgaggcugggggaacgcgccugggcuggcuccuccccgaacuugcaucaccagugcccccucucuccacccgccuucggccccgccuuggccccuccuccaccccccuuccuccgcuccguucggccgguucucccgggaagcuauuaauagcauuacgucagccugggacuggcaacacggaguaaacgaccgcgccgccagccugagggcuauaaaaggggugaugcaacgcucuccaagccacagucgcacgcagccaggcgcgcacugcacagcucucuucucucgccgccgcccgagcgcacccuucagcccgcgcgccggccgugaguccucggugcucgcccgccggccagacaaacagcccgcccgaccccgucccgacccuggccgccccgagcggagccuggaggugagcgcuggaagccgagggagugagcgcgacgagggcugcucgccuucauucccuucgcgccccucuaaguaaccaguccgccgaccccugacccaccccggauccgcgcccccagccuccggcuuggaaauaacucuggcuuaaacuucuucuaagccaccgcugcuccucggcgcuucgaaaaguuucccgcaaagcgaaagaacuaacuuucucuuuugacuuggggcgcgaaagguuccuggugacggaggucgggcguccacucugccgccagccucgagcgccgcuucucuccgccgacggcgcuggcuugcccggcugggagagggcguaaggugggugggcgggugcguugggguguccgaggcugccucgcucgccgucccgcuccaucccucgcuucgagacacggcacugugggagccgauccuucccgggugggggggggggggcgcagagaggcacgaaggccggaggcuugcgggagggcugccccacgcgccgagaggaaugaauggggaaggggcgagagggcgggaggcgucccgggcgcggccgcugggggucgcccuggguaccccgcagcacuggcggcaggaccgugaaggcaaccccgagaaaaaguuagcugggauaagcuuggaaguggcgagcgcuggugucgcgcugucccggggcggaagacggggagggcucccggcaacggcugguguccggaccccgagcccgggacucccacacaccugggacucucacucuggcuuuuccuucggcggguccgcgggagacccaccguggcggggaagcgaggguguggagccacuugugcagauauuugagagaauggcuuuguggucuagugccaggacucugagcgcuuacacugcaaucgaugucguugggccucaguaugcggagccgggaaauaagggcacaugggcaguaccggcccccucugcguguuggagggcacaaugcagugguuggaccagauaacuacuaagguccuuucugucuggagauuuucagauuuuggagugguguaguggggagaaaaggagccagugaggggacuugaauggggugggucucuaucuaaugucauucaccaguguccagacagugggggaaaggggacuuuucugcagggcaucuuuucccucaccagcuuucuuuccacuggauucguucuccuucucugcuccccccacucccauuuucauuucucaucuacuuccuuuccuccuaaacauuuucuuuucccuaauuucauugcauaggucacauaugcuuucuuacaaauaaaauaguuacuaaauccuugaugaacccagaaagaaaaggagagccagaaaaucuggauguucucucaguguaccccuuucguuguaggugacagucauaucuucuguucgaaguuucugucucuguaacuuaaagugaaggcaaaaaauugguauuacuguccccauuguuuugcaguuagcauugguuguagaauaaugcuacaacauacaggcuccugcuuugaggauauccugggcaaagaugggauggggugaggauugcaguuacugucggaaugguuucagagacagcaaagaaggcagcaccccacgcccgcaguggggauaagauacagcacccagcaucuguggcagugaugggagccuucuuuuucucucucucuuccuccuugcccuuuagccauuauagaauuccuuuuucuccauggccguuuucuucgauagccccucccuaucucaguccugucaaagucuccucugugauugguaccaggugccaggacucuugaccccuuaucuaccuggcuaauggcucuguucucugguugccuuguugguugaucccuugaggcg

SEQ ID NO: 19283 - RNA, 2935 nt, Homo sapiens
caacaacuucaagccuuauuugacagcuuguuggccuuuuucuuuuuuuaauuuacaagaagaggaaauuugcucccacaaauuccaagacucuagucucaacccuaccagacaagccccguuccuccccacucaccccucacucaaauuacagaugaagagggaggugugcaggaugugugcggugacaggugaugcgaaugggggggauucccugucccuacugcccucacccacucuuccuguguucugagcuccccccuaaccccaacgcuagaccuucuauucccccgggggccaagccagcugggcucgcaaggcccgacucgaauucccgggcccuggcagcauuuuccuugcccccuuggcuacuuaagguggccgauggguccgggcugagcugggcgcaggacaggcagccgagcggccuccggaugccaaaccugcuucuccuuuguugacagcuugcggaggaggaaguccgcgcgggcgggggagggggcagggugcuggcgguggcgggcggugccagcagcgggcgcggccccagcccgggcggacgcggccggcggggaggggguuaacgcgcgcggccucuaugauaaugagcugcauggugaaauagggaggccggcgcucagggcuccuccgccgccgccgccgccgccgccgccgccgccaccgcgggagccagagcugccgggaggagcggcauccgcgccagacuggagcgggagggcggcggagggcaguugcugggaauuuuucagccgagagggcgagcgauccggagagagaccccgagagcuugggagcgguagggcgugcgagcgccgcagccagcggagcaaaccucgaaauagaucuggaaagccaggcucccggaggaaaugggacugugaacgaaccggagagcaagaagggaaggaagcgccgggauugcugaugucagaggagcccggaaagucgcgcuggaaaaaucugaagacagccggggcucugcuucuuccucaggagagacaccgccggccgcccccacacgcccccucggcgccuccgggugcccccugagagccggcgacagcgcccagccgggcugcugcggggcgacggaggacugaggggcgcgcggagcggagaccgaggagcgacuucaggaauacagauaagugucugguggcuugacguggauuuuaaugaauuuggacuccauguggauuuggucgucucccugauuccgagcugcgggcagggagaggggccucgcgccgcccucagcagccggcggcggccgagguagaccgagcggggacggaaggacagaccgacgucgccgagcuggguaagcggcggcugggccgggcgcucggagucggcagcgcccuccgcccucuccccacaggcgcgcacacccguggcggcuucucccgcgcccgccucuuuggggucccggccccagaagacccggcuuggccgcggcgggcgaguccccgcgugggcucggccacuuucgcgggcuggagcgcggcgugcgcgcgaucgcaggcucacuggagccgcugccucccgccgagggcuucccggccggcagcccgccggcuucccgaaugcgggcugagggcggcagcagcgcuccgcggcgcgccuccaccgcgcaccugccggcgcucugcggcuuuggggagcucggggcggcaaggcuguccugagagcuggagcccaaagagggccucgguggcaccagcgagacagcccaaagccacacuggccagcgaucgauuugggggcguucacuccagugccggggucccugguggccgccggcucucccuuccgaucggggacuggagaucaggggaaugggaaaacaucauuugcgcggguuccauaaggcucagggagagauuccuaggcacugaaugggucuaaguguuucaucucccggggcucccuuugcgguguaucgcccagcagggguccagccccuuaguuugagcaccacaggagugcuggggguugaaaugggaguuugcuuagggucccagaggcuccuuaugaaccauuugagaauguuuccuuccaugugcucuuucuugccccaccccacaagugagguagggauccuagaaaauucuagcccuuuuuauccaucccacagguagucucuauaaugccaaucauggucuagaugcccagagagucaccagaaacuaccauuuuagauccccgaaaaaaguccaccuguuuggaaugacccuugcccuagugggagcuaccuacucaaacucagcucugcucaggagggauagaaauaaugguggggaggaaguuggauaaaagauuuggggcucuaggucaguaagggucuagaaaugagagccccaugaagugggcaauggaaaucugaacagguccccuguaggaaucuuagagugacaguggcacaccaguagaaagugcacaagggacaugaaggcagcaucaguuugaggggacugggacugccagucauagcuugaggcagucacuugggggcccaucaguuuggaagaacccacagaaauuugggggcacauucauuuccuuccauucacgcgcacaguggacaaggcuuaugagcggcaggccaagaugaguaucuuggcuggccugggcuggaggcuuugagagcaggagucagguuuagcucuccccucuccccacacaauagcagucucccuccuuugcugggcuucuuucccagaucuugaaacuucacucuucccucuggguuggcuuuggauucuggggccuucuacugauugacagagccccaggaagagauaaccuuggcuggaggaauucagcuauuccuaacugaaaugcacaacuuuuaugcaauaaccccagaaagcucccagaguugcuugcagcccucuccccucugaccuccagg

SEQ ID NO: 19284 - RNA, 2935 nt, Homo sapiens
ccuggaggucagaggggagagggcugcaagcaacucugggagcuuucugggguuauugcauaaaaguugugcauuucaguuaggaauagcugaauuccuccagccaagguuaucucuuccuggggcucugucaaucaguagaaggccccagaauccaaagccaacccagagggaagagugaaguuucaagaucugggaaagaagcccagcaaaggagggagacugcuauuguguggggagaggggagagcuaaaccugacuccugcucucaaagccuccagcccaggccagccaagauacucaucuuggccugccgcucauaagccuuguccacugugcgcgugaauggaaggaaaugaaugugcccccaaauuucuguggguucuuccaaacugaugggcccccaagugacugccucaagcuaugacuggcagucccaguccccucaaacugaugcugccuucaugucccuugugcacuuucuacuggugugccacugucacucuaagauuccuacaggggaccuguucagauuuccauugcccacuucauggggcucucauuucuagacccuuacugaccuagagccccaaaucuuuuauccaacuuccuccccaccauuauuucuaucccuccugagcagagcugaguuugaguagguagcucccacuagggcaagggucauuccaaacagguggacuuuuuucggggaucuaaaaugguaguuucuggugacucucugggcaucuagaccaugauuggcauuauagagacuaccugugggauggauaaaaagggcuagaauuuucuaggaucccuaccucacuugugggguggggcaagaaagagcacauggaaggaaacauucucaaaugguucauaaggagccucugggacccuaagcaaacucccauuucaacccccagcacuccuguggugcucaaacuaaggggcuggaccccugcugggcgauacaccgcaaagggagccccgggagaugaaacacuuagacccauucagugccuaggaaucucucccugagccuuauggaacccgcgcaaaugauguuuucccauuccccugaucuccaguccccgaucggaagggagagccggcggccaccagggaccccggcacuggagugaacgcccccaaaucgaucgcuggccaguguggcuuugggcugucucgcuggugccaccgaggcccucuuugggcuccagcucucaggacagccuugccgccccgagcuccccaaagccgcagagcgccggcaggugcgcgguggaggcgcgccgcggagcgcugcugccgcccucagcccgcauucgggaagccggcgggcugccggccgggaagcccucggcgggaggcagcggcuccagugagccugcgaucgcgcgcacgccgcgcuccagcccgcgaaaguggccgagcccacgcggggacucgcccgccgcggccaagccgggucuucuggggccgggaccccaaagaggcgggcgcgggagaagccgccacgggugugcgcgccuguggggagagggcggagggcgcugccgacuccgagcgcccggcccagccgccgcuuacccagcucggcgacgucggucuguccuuccguccccgcucggucuaccucggccgccgccggcugcugagggcggcgcgaggccccucucccugcccgcagcucggaaucagggagacgaccaaauccacauggaguccaaauucauuaaaauccacgucaagccaccagacacuuaucuguauuccugaagucgcuccucggucuccgcuccgcgcgccccucaguccuccgucgccccgcagcagcccggcugggcgcugucgccggcucucagggggcacccggaggcgccgagggggcgugugggggcggccggcggugucucuccugaggaagaagcagagccccggcugucuucagauuuuuccagcgcgacuuuccgggcuccucugacaucagcaaucccggcgcuuccuucccuucuugcucuccgguucguucacagucccauuuccuccgggagccuggcuuuccagaucuauuucgagguuugcuccgcuggcugcggcgcucgcacgcccuaccgcucccaagcucucggggucucucuccggaucgcucgcccucucggcugaaaaauucccagcaacugcccuccgccgcccucccgcuccagucuggcgcggaugccgcuccucccggcagcucuggcucccgcgguggcggcggcggcggcggcggcggcggcggcggaggagcccugagcgccggccucccuauuucaccaugcagcucauuaucauagaggccgcgcgcguuaacccccuccccgccggccgcguccgcccgggcuggggccgcgcccgcugcuggcaccgcccgccaccgccagcacccugcccccucccccgcccgcgcggacuuccuccuccgcaagcugucaacaaaggagaagcagguuuggcauccggaggccgcucggcugccuguccugcgcccagcucagcccggacccaucggccaccuuaaguagccaagggggcaaggaaaaugcugccagggcccgggaauucgagucgggccuugcgagcccagcuggcuuggcccccgggggaauagaaggucuagcguugggguuaggggggagcucagaacacaggaagagugggugagggcaguagggacagggaaucccccccauucgcaucaccugucaccgcacacauccugcacaccucccucuucaucuguaauuugagugaggggugaguggggaggaacggggcuugucugguaggguugagacuagagucuuggaauuugugggagcaaauuuccucuucuuguaaauuaaaaaaagaaaaaggccaacaagcugucaaauaaggcuugaaguuguug

SEQ ID NO: 19285 - RNA, 2447 nt, Homo sapiens
uuuuaaaugaaagaugacucagacacagagucugauuagccuucauuuaaaacgcacaaucuuaagguagcuguaacucauacacucugagggguacauuuaaaaagcaagugcaaauccacacacuucuugaucuuuaaagccaguaccugccucagcauuugacauucgauucaaccauuaagaacaauacugaaacuaaaaucuuaagggagaggaaggggaggggaguggagagggaaagagaguucucugaacaccaagggucaagauucauauuaugcaggaaguaguauaguaaauaauauuaagucugccucuaccgcauuuccaccuaacugcugauccgcacagaacgugggcaaagagcgccccauccgcagaaacgauuguuuaaaaccuggcgacagcaggguagaggacgccugcugccggaggggcuaugucauccgugucaaggcaggcucugaguaggggaaucagggcagaauucggucuggcuggacucagaaagccccacacuuuuucugcccgauguuuuaccccuguuucuucuuuaggaacaaacuuagagcuggaaaguguucgaucuuuuuuccucaaacuacacaggccuggucuucuuuuuuuacauuucagaacucuccugaacuucuccaggugaaagggagaaagaggugguacuggaauugccuuuauuuaaacggggguguauccuacaucuuaggugggaggcuaauggagggcaguacccagagacagaguaaggcaagaguugcaggcaaggaggcgacuugaaagcaaagacgcaagaaaauucugugcagccgggaaucugggaaaucucagaucccucaaacuuaagacaggggucuucccccccaaaccccuucagcaucagaauuccauuccugaagccaggagguaagagaccugucuaaaaaccaaaggcacuagcucugggaaaaggucaaggagaagggugugaauaaauaggucucuggggccuuucugaaaaugugcgaauugagggacgcuggcagagggcccccuccaccccgcccacccgccuagaaagagcuagcggguaacagggaacgccagguuuuuuggaagagccggguuccagccgugcuuguccggcgccggcuaccgggcccagagagcccggacccgcggaggcagagccagggcaccccgcgcuuggggacaucccgagaccccccaccccaaaaccugcagccgcgcagagacggagggcugcggccuggcgcccgccaggugagcgccaggccccagggccaccagccgggagaggcgccugcugcgacucuuucaaaacacacucucgcgacgagccagaggccuuccucgcccauuuccgggccccaauuuuuuuguaaaugaaccaggaacggcagaugggggcuuucgcuugaccucuccccgcccucaggucccucccgaccuccccgagccgggacggcugaagcggccggcgggagccccggcaccccgggcgcacucaccguggugggucggaggguaccucugcaccguggcccugaccgaguuuccguaguagggcgggacgugguugccuugaccgucgauguuaaaaagcacauccaccuccuccggcagcggguacugcgccgcguccauguaggaguggcugaggcccggguggugcguguccgggugcugcccguugagcacggcgggguggugguggcucacccagcgcggcugguccgccgucaccuccauggccucggcugugcucgcgcccucucgccgggcccggaacccgcgcgcggggagggagggcgguccgccugggaggucggggggcuccugccgucggagggucgggggucguugaaugauuugcuuucgguggggggaugggaaggcugggaagcaaaggugagcaaaggagaagguuuuuuaaaaauuaucuuggaggggucguuuagcaaagagaagaaggggaagacaaaaauccaaaaacuggguacggcagaauaaaacgggaccagguuguaaaaaggggcgacgacucugcaauucugcgagccaggcuccucugcaccgggguccucagccgcucggaggcggagucccuccucgggucaccugcaagggagagaaugggagaccuggaugagccccugaguugcuggaguggcacaaccuccccucgcgccgcccgcccgcccagcgcacccgagacccgcacgggagcgcggggacacggccgcggagcccgcagggcucucggggacgucccugcagcccggcucgcgggagccggggcuggcugagcaacuuggagggcaagucccagggcugacuguuacgacuuggagggcaagucccucccucggggacaccggucccgggaccguccucucagccccuagaaaaccuccaaaagaggagag

SEQ ID NO: 19286 - RNA, 2447 nt, Homo sapiens
cucuccucuuuuggagguuuucuaggggcugagaggacggucccgggaccgguguccccgagggagggacuugcccuccaagucguaacagucagcccugggacuugcccuccaaguugcucagccagccccggcucccgcgagccgggcugcagggacguccccgagagcccugcgggcuccgcggccguguccccgcgcucccgugcgggucucgggugcgcugggcgggcgggcggcgcgaggggagguugugccacuccagcaacucaggggcucauccaggucucccauucucucccuugcaggugacccgaggagggacuccgccuccgagcggcugaggaccccggugcagaggagccuggcucgcagaauugcagagucgucgccccuuuuuacaaccuggucccguuuuauucugccguacccaguuuuuggauuuuugucuuccccuucuucucuuugcuaaacgaccccuccaagauaauuuuuaaaaaaccuucuccuuugcucaccuuugcuucccagccuucccauccccccaccgaaagcaaaucauucaacgacccccgacccuccgacggcaggagccccccgaccucccaggcggaccgcccucccuccccgcgcgcggguuccgggcccggcgagagggcgcgagcacagccgaggccauggaggugacggcggaccagccgcgcugggugagccaccaccaccccgccgugcucaacgggcagcacccggacacgcaccacccgggccucagccacuccuacauggacgcggcgcaguacccgcugccggaggagguggaugugcuuuuuaacaucgacggucaaggcaaccacgucccgcccuacuacggaaacucggucagggccacggugcagagguacccuccgacccaccacggugagugcgcccggggugccggggcucccgccggccgcuucagccgucccggcucggggaggucgggagggaccugagggcggggagaggucaagcgaaagcccccaucugccguuccugguucauuuacaaaaaaauuggggcccggaaaugggcgaggaaggccucuggcucgucgcgagaguguguuuugaaagagucgcagcaggcgccucucccggcugguggcccuggggccuggcgcucaccuggcgggcgccaggccgcagcccuccgucucugcgcggcugcagguuuugggguggggggucucgggauguccccaagcgcggggugcccuggcucugccuccgcggguccgggcucucugggcccgguagccggcgccggacaagcacggcuggaacccggcucuuccaaaaaaccuggcguucccuguuacccgcuagcucuuucuaggcgggugggcgggguggagggggcccucugccagcgucccucaauucgcacauuuucagaaaggccccagagaccuauuuauucacacccuucuccuugaccuuuucccagagcuagugccuuugguuuuuagacaggucucuuaccuccuggcuucaggaauggaauucugaugcugaagggguuugggggggaagaccccugucuuaaguuugagggaucugagauuucccagauucccggcugcacagaauuuucuugcgucuuugcuuucaagucgccuccuugccugcaacucuugccuuacucugucucuggguacugcccuccauuagccucccaccuaagauguaggauacacccccguuuaaauaaaggcaauuccaguaccaccucuuucucccuuucaccuggagaaguucaggagaguucugaaauguaaaaaaagaagaccaggccuguguaguuugaggaaaaaagaucgaacacuuuccagcucuaaguuuguuccuaaagaagaaacagggguaaaacaucgggcagaaaaaguguggggcuuucugaguccagccagaccgaauucugcccugauuccccuacucagagccugccuugacacggaugacauagccccuccggcagcaggcguccucuacccugcugucgccagguuuuaaacaaucguuucugcggauggggcgcucuuugcccacguucugugcggaucagcaguuagguggaaaugcgguagaggcagacuuaauauuauuuacuauacuacuuccugcauaauaugaaucuugacccuugguguucagagaacucucuuucccucuccacuccccuccccuuccucucccuuaagauuuuaguuucaguauuguucuuaaugguugaaucgaaugucaaaugcugaggcagguacuggcuuuaaagaucaagaaguguguggauuugcacuugcuuuuuaaauguaccccucagaguguaugaguuacagcuaccuuaagauugugcguuuuaaaugaaggcuaaucagacucugugucugagucaucuuucauuuaaaa

SEQ ID NO: 19287 - RNA, 2486 nt, Homo sapiens
uugcggaggggugugcggaaacgcccgcgaugggaacuuucugcagaucauguauggagggagcucacaaaaaggaggaaggggagcgcgguggggaggaggccgcgugggcguggaaggucccaggguccugggggugcccgccugcuuaggcgcagggaauggcgcggagcuggcuggggaaggagccgaucacgucccgcaggcuaauuggcuuaagaaauuuugcaagcgcuggaaaaggucguugaaggaguucgcugcacgcgcacgcacacacauacacacacacacaaaaucuuaaaaaaaaaaaaaaaaaaaaaaaaaaaagagcgccgagcaugcgcacagagaggaugccauauuggaaugagcuguagugggagccggaggaccggagcgggcgcgcgagggaggcggcgggcggggagcgagcgggcaagggcgggcgagcgagcaagcgagcgaggccggugcccucccgggcggcgaccggggccuggguccacgccgagggcaggacgaacuucaccagguaggacgccgcgccggcugcuguccccggcgcccaggcuggccggagagcagcccuucggcccgcagguugagugcgcuggucaggggcuuuuuccagccuaggaaaaaaaaggaaaaaaaaaaaaaggaaggaagccugagggagcugggguuggagguggcgggugggggaaggcuggggagggugcaggggagcgaaagagaagggcaggagaagaaagcgacugcacuugagcgaagcuucaaacuccucugugcgcuccagguugucauuuuugcuucccggguccccuucgccugcgucuccgggcucggaaaagccgagccgugcgggaguccguccggaguugcaaaguguccuccuuccccgggcgcagccuguccccucccgccgcccaccuuccucguuucugcacucauuuuagcgacgcagccgccgcugcuaccuaccccgcgcucccgcgucuccuccgcgcuggggucuccccuuucuuuugguuugggugggagaaaaagauggugaggacggggaaucggagaccggcauggggguaaaaaucgugcagacauucggaaucgcucccuuggaaacauuugccugagcaacugaaauaaaauuggcaguaguaguuuuggagcgugcuccagcgaggauggucuuuuuguucauuauuuucucuuuaaaguaauauccugucacuuaggggcuuuccgguugucuccucuuauucgacccccuuucaaaauugcugacuugagcugguucuggaguuuauuuuuuaauaugcgugcguggguauguguauguguguguauguuuugcagaaauccgccaaaaugcaacuguaggaacugcgagauguauuuauugauuuugaccaggggcggugggaaggggcuggagggagcugggggauccuggagggugggaaguggcugauucucgguggccggacacucauccagagccugauccguacucguguuuucuuggaagcgccacaacugcggggaaggagucuuuagaaaccgugccaguuucaauauggcgggcuaagguggcuuuuaaaaacugaaaauaaagguuuugaggugggaaaaaacccagcugaaguuuccaccccuuaguuucgacucucuuuggcuaccccaggaagcgcuuuagcgaauuaaguggggaaaaaaagaaggaaugggcuguccgguuuuuuuuuuccgugguuagagucugugugucaaguccauugcuaggggggaaagggauggagaagugccccuggcccggaccagggcaccgaaacgcaacugucgugugugccuguggauuagugugcaggccugcgugugcgcaguuuuuuugggugugugugucaaagagaaccaccccgaaugugugugugcgucuuggaaccagacccugccaugauuugacgugacaaacugcggacacgugguguaaaguacaugagggcagagggagugauuuauuuugucuuucuaggagacgagcuagcucucgccuugugugugcuggauccugcgcggguagauccccgaguagguggggcgaggaggugcuuauuaaaaggacuaacugucccggguauugggugcaaucgggcugcagacgccagccggauuucgugugugcagggggcgcgcugcacuuaauagugggcuccugcuuuccuccacgccgcucuggggugggaggugggggaccgggaccgaagcuuggagaagaccaaaguggugguggugguggugggguggggcagaagggcgggagcgcgcggcucugggagacaagcacguagggucgaggcgagggguugccuuccuuacuuuuggguuucgcgcucuagggaaggugggggauggggacagcguuuggggaagaaauugucccuugcucggcuuaggaacccucucggcgcaucggagagggg

SEQ ID NO: 19288 - RNA, 2486 nt, Homo sapiens
ccccucuccgaugcgccgagaggguuccuaagccgagcaagggacaauuucuuccccaaacgcuguccccaucccccaccuucccuagagcgcgaaacccaaaaguaaggaaggcaaccccucgccucgacccuacgugcuugucucccagagccgcgcgcucccgcccuucugccccaccccaccaccaccaccaccacuuuggucuucuccaagcuucggucccggucccccaccucccaccccagagcggcguggaggaaagcaggagcccacuauuaagugcagcgcgcccccugcacacacgaaauccggcuggcgucugcagcccgauugcacccaauacccgggacaguuaguccuuuuaauaagcaccuccucgccccaccuacucggggaucuacccgcgcaggauccagcacacacaaggcgagagcuagcucgucuccuagaaagacaaaauaaaucacucccucugcccucauguacuuuacaccacguguccgcaguuugucacgucaaaucauggcagggucugguuccaagacgcacacacacauucggggugguucucuuugacacacacacccaaaaaaacugcgcacacgcaggccugcacacuaauccacaggcacacacgacaguugcguuucggugcccugguccgggccaggggcacuucuccaucccuuuccccccuagcaauggacuugacacacagacucuaaccacggaaaaaaaaaaccggacagcccauuccuucuuuuuuuccccacuuaauucgcuaaagcgcuuccugggguagccaaagagagucgaaacuaagggguggaaacuucagcuggguuuuuucccaccucaaaaccuuuauuuucaguuuuuaaaagccaccuuagcccgccauauugaaacuggcacgguuucuaaagacuccuuccccgcaguuguggcgcuuccaagaaaacacgaguacggaucaggcucuggaugaguguccggccaccgagaaucagccacuucccacccuccaggaucccccagcucccuccagccccuucccaccgccccuggucaaaaucaauaaauacaucucgcaguuccuacaguugcauuuuggcggauuucugcaaaacauacacacacauacacauacccacgcacgcauauuaaaaaauaaacuccagaaccagcucaagucagcaauuuugaaagggggucgaauaagaggagacaaccggaaagccccuaagugacaggauauuacuuuaaagagaaaauaaugaacaaaaagaccauccucgcuggagcacgcuccaaaacuacuacugccaauuuuauuucaguugcucaggcaaauguuuccaagggagcgauuccgaaugucugcacgauuuuuacccccaugccggucuccgauuccccguccucaccaucuuuuucucccacccaaaccaaaagaaaggggagaccccagcgcggaggagacgcgggagcgcgggguagguagcagcggcggcugcgucgcuaaaaugagugcagaaacgaggaaggugggcggcgggaggggacaggcugcgcccggggaaggaggacacuuugcaacuccggacggacucccgcacggcucggcuuuuccgagcccggagacgcaggcgaaggggacccgggaagcaaaaaugacaaccuggagcgcacagaggaguuugaagcuucgcucaagugcagucgcuuucuucuccugcccuucucuuucgcuccccugcacccuccccagccuucccccacccgccaccuccaaccccagcucccucaggcuuccuuccuuuuuuuuuuuuuccuuuuuuuuccuaggcuggaaaaagccccugaccagcgcacucaaccugcgggccgaagggcugcucuccggccagccugggcgccggggacagcagccggcgcggcguccuaccuggugaaguucguccugcccucggcguggacccaggccccggucgccgcccgggagggcaccggccucgcucgcuugcucgcucgcccgcccuugcccgcucgcuccccgcccgccgccucccucgcgcgcccgcuccgguccuccggcucccacuacagcucauuccaauauggcauccucucugugcgcaugcucggcgcucuuuuuuuuuuuuuuuuuuuuuuuuuuuuaagauuuuguguguguguguaugugugugcgugcgcgugcagcgaacuccuucaacgaccuuuuccagcgcuugcaaaauuucuuaagccaauuagccugcgggacgugaucggcuccuuccccagccagcuccgcgccauucccugcgccuaagcaggcgggcacccccaggacccugggaccuuccacgcccacgcggccuccuccccaccgcgcuccccuuccuccuuuuugugagcucccuccauacaugaucugcagaaaguucccaucgcgggcguuuccgcacaccccuccgcaa

SEQ ID NO: 19289 - RNA, 2365 nt, Homo sapiens
aauccugcuugaauggugcuuaacagaaaccuggguuauagcuaagaaucucugaauguccaggggucgaguuaccuaaagcccaauagaccucguuaagucaaaguugcugcaggagaggaggucucuugauggcgaugccagggucgcgggccauccccuaugccacucaauaagcaaaguuaaaaccgagaaacucagcccacaccgcaggcugcaggcugcaaggccucgccucaguggcuacugauucagcgugcacagaaggucccauuacacuuuuagguaguuacaaauauuauuuuccuccuuugacuaagagaucaaacaagcuucgguuuugcaaugaccucgaauuucuccacaguaaaguggccccagcagaauacugcagacccaugcguagcccuuguagcggcgccgaccggcucagggaaucaaauccucuuggccggcugguccagaggccgauagacccggggcugggcucgaaccggucgccccccaggccaccugccugagcguccuccgacuccauagagaguuuggguucugagucuggcugcgcgcuguguuucaccgcaugaacccccgaaucucaacuauucuuuuuguuaucagcacuccuugccucuccccuccgcuauuuuuuggcugaagacgaaacuggaguuugcgccuugaaauugacuauaugugaguuucacggccugggacaccgcaaggacucggcgacggcgagccccacggucgcuccuccgcuguggcugagcccugcuuggacucauuccuucggggcccuuguuucucccuccggccuuugucuaccacccccgagucggucacccugccacgcccauuccggacucccccaggccucuccacuccccagaaagcccguaagcuacccucuguugcggaggaucccacggccaggggucgcuucccgcgccgggacuccccagcgcacgagcuguccccgggacccagcucccggcuucccgccccucgagggucgcgcucgcaggggcgcgcaccgaucgagggucccagacuccggaacugcccucuccaggccgcggggcgcccuccugcgcgcacgacccccgccucuccagggugggacggcguccccccuugccgucgcuccagggagcccggccgccgcgcccuuccuccgcgggcucccacccccauuuccggggucuccucccucucgcccgcaccuucccgcgcucccuccccgcccuccccgccgcccgcccgcgcucaccugguuguuuuugcagagaucagcccacaugcuggugccguccccuccgcgcaucaggacgugguaggugaagaaguagaugcccgggauggagcaggugaacuugccggugguggggucguagugguuuccgagguuggugaccacgucgucgaacuugagcaccucguagccuucaugcugccgcuugaggccggcguagaaggcgaucuugggcaccgugcuguagguggcggcgcugauggccccggccgcguucaggccgggcgccccgggcgggcccggcaggccuuggcggcccggcucgcccuucucgcccgggggccccauggggccggguggcccgggcucuccggggggcccgcgcggacccgccuucccgggccugccggccucgccuuuggggcccuggaugaaggugggcagggacugcaugaggccgcggucgggcguggcagcggugcugggcgccuuggugcccccguaggggucgcagaccaugcggcaggugcccagcaucucguagugcgccgacgugccggccgagcucaccagcaccgggaugaggaucaccagcagcagcaccaucaccacccccagcgccccggcggcgaucaggcgccuccugcugcccaccagccggcucagcgcggggcgauccucuugucugcuuuuggacagaauuuugaagguugggcggggaccucuucagagccgaaaacaacccccugcgaaccccaacuccccugggcgugcgugcgccggccgcugcugccgacuccugcuccccccgcggaggcugcggcuggggagggagcgcgggcgcccagugacuugagccgaagucccgagcccggggugggggccgggggaggggugcgcggggcgcccucgccccccgcgagcuccuucgcaccuguggcugcagccggcgccggcgcggccaccgggagggcagagccagccgccgccuccugagcucgcccgggcagcucacacuuuuaugccgccgccgccugcgaucgacuuuuccguuuuugcagacugcgccuguucgcaccaacuuuccgucugaaguugccuuuuucugcc

SEQ ID NO: 19290 - RNA, 2365 nt, Homo sapiens
ggcagaaaaaggcaacuucagacggaaaguuggugcgaacaggcgcagucugcaaaaacggaaaagucgaucgcaggcggcggcggcauaaaagugugagcugcccgggcgagcucaggaggcggcggcuggcucugcccucccgguggccgcgccggcgccggcugcagccacaggugcgaaggagcucgcggggggcgagggcgccccgcgcaccccucccccggcccccaccccgggcucgggacuucggcucaagucacugggcgcccgcgcucccuccccagccgcagccuccgcggggggagcaggagucggcagcagcggccggcgcacgcacgcccaggggaguugggguucgcaggggguuguuuucggcucugaagagguccccgcccaaccuucaaaauucuguccaaaagcagacaagaggaucgccccgcgcugagccggcuggugggcagcaggaggcgccugaucgccgccggggcgcuggggguggugauggugcugcugcuggugauccucaucccggugcuggugagcucggccggcacgucggcgcacuacgagaugcugggcaccugccgcauggucugcgaccccuacgggggcaccaaggcgcccagcaccgcugccacgcccgaccgcggccucaugcagucccugcccaccuucauccagggccccaaaggcgaggccggcaggcccgggaaggcggguccgcgcgggccccccggagagcccgggccacccggccccauggggcccccgggcgagaagggcgagccgggccgccaaggccugccgggcccgcccggggcgcccggccugaacgcggccggggccaucagcgccgccaccuacagcacggugcccaagaucgccuucuacgccggccucaagcggcagcaugaaggcuacgaggugcucaaguucgacgacguggucaccaaccucggaaaccacuacgaccccaccaccggcaaguucaccugcuccaucccgggcaucuacuucuucaccuaccacguccugaugcgcggaggggacggcaccagcaugugggcugaucucugcaaaaacaaccaggugagcgcgggcgggcggcggggagggcggggagggagcgcgggaaggugcgggcgagagggaggagaccccggaaaugggggugggagcccgcggaggaagggcgcggcggccgggcucccuggagcgacggcaaggggggacgccgucccacccuggagaggcgggggucgugcgcgcaggagggcgccccgcggccuggagagggcaguuccggagucugggacccucgaucggugcgcgccccugcgagcgcgacccucgaggggcgggaagccgggagcugggucccggggacagcucgugcgcuggggagucccggcgcgggaagcgaccccuggccgugggauccuccgcaacagaggguagcuuacgggcuuucuggggaguggagaggccugggggaguccggaaugggcguggcagggugaccgacucgggggugguagacaaaggccggagggagaaacaagggccccgaaggaaugaguccaagcagggcucagccacagcggaggagcgaccguggggcucgccgucgccgaguccuugcggugucccaggccgugaaacucacauauagucaauuucaaggcgcaaacuccaguuucgucuucagccaaaaaauagcggaggggagaggcaaggagugcugauaacaaaaagaauaguugagauucggggguucaugcggugaaacacagcgcgcagccagacucagaacccaaacucucuauggagucggaggacgcucaggcagguggccuggggggcgaccgguucgagcccagccccgggucuaucggccucuggaccagccggccaagaggauuugauucccugagccggucggcgccgcuacaagggcuacgcaugggucugcaguauucugcuggggccacuuuacuguggagaaauucgaggucauugcaaaaccgaagcuuguuugaucucuuagucaaaggaggaaaauaauauuuguaacuaccuaaaaguguaaugggaccuucugugcacgcugaaucaguagccacugaggcgaggccuugcagccugcagccugcggugugggcugaguuucucgguuuuaacuuugcuuauugaguggcauaggggauggcccgcgacccuggcaucgccaucaagagaccuccucuccugcagcaacuuugacuuaacgaggucuauugggcuuuagguaacucgaccccuggacauucagagauucuuagcuauaacccagguuucuguuaagcaccauucaagcaggauu

SEQ ID NO: 19291 - RNA, 2887 nt, Homo sapiens
aaaaguccgcacauucgagcaaagacaggcuuuagcgaguuauuaaaaacuuaggggcgcucuugucccccacagggcccgaccgcacacagcaaggcgauggcccagcuguaaguugguagcacugagaacuagcagcgcgcgcggagcccgcugagacuugaaucaaucuggucuaacgguuuccccuaaaccgcuaggagcccucaaucggcgggacagcagggcgcggugagucaccgccggugacuaagcgaccccaccccucucccucgggcuuuccucugccaccgccgucucgcaacucccgccguccgaagcuggacugagcccguuaggucccucgacagaaccuccccuccccccaacaucucuccgccaaggcaagucgauggacagaggcgcgggccggagcagccccccuuuccaagcgggcggcgcgcgaggcugcggcgaggccugagcccugcguuccugcgcugugcgcgcccccaccccgcguuccaaucucaggcgcucuuuguuucuuucuccgcgacuucagaucugagggauuccuuacucuuuccucuucccgcuccuuugcccgcgggucuccccgccugaccgcagccccgagaccgccgcgcaccuccucccacgccccuuuggcguggugccaccggaccccucugguucagucccaggcggaccccccccucaccgcgcgaccccgccuuuuucagcaccccagggugagcccagcucagacuaucauccggaaagcccccaaaagucccagcccagcgcugaaguaacgggaccaugcccagucccaggccccggagcaggaaggcucgagggcgcccccaccccacccgcccacccuccccgcuucucgcuaggucccuauuggcuggcgcgcuccgcggcugggauggcagugggaggggacccucuuuccuaacgggguuauaaaaacagcgcccucggcgggguccaguccucugccacucucgcuccgagguccccgcgccagagacgcagccgcgcucccaccacccacacccaccgcgcccucguucgccucuucuccgggagccaguccgcgccaccgccgccgcccaggccaucgccacccuccgcagccauguccaccagguccguguccucguccuccuaccgcaggauguucggcggcccgggcaccgcgagccggccgagcuccagccggagcuacgugacuacguccacccgcaccuacagccugggcagcgcgcugcgccccagcaccagccgcagccucuacgccucguccccgggcggcguguaugccacgcgcuccucugccgugcgccugcggagcagcgugcccggggugcggcuccugcaggacucgguggacuucucgcuggccgacgccaucaacaccgaguucaagaacacccgcaccaacgagaagguggagcugcaggagcugaaugaccgcuucgccaacuacaucgacaaggugcgcuuccuggagcagcagaauaagauccugcuggccgagcucgagcagcucaagggccaaggcaagucgcgccugggggaccucuacgaggaggagaugcgggagcugcgccggcagguggaccagcuaaccaacgacaaagcccgcgucgagguggagcgcgacaaccuggccgaggacaucaugcgccuccgggagaaguaaggcugcgcccaugcaaguagcugggccucgggagggggcuggagggagaggggaacgcccccccggcccccgcgagagcugccacgcccuuggggauguggccggggggaggccugccagggagacagcggagagcggggcuguggcugugguggcgcagccccgcccagaacccagaccuugcaguucgcauuuccuccucuguccccacacauugcccaaggacgcuccguuucaaguuacagauuucuuaaaacuaccacuuugugugcaguugaaggcccuugggcacaaugagagccaguccuccaaacuuucagaaaguuuccugccccuucuggcaggcugccaaucaccgggcgggagaaggaaggaggggaaggcgguggagggagcgagacaaagggauggucccucgggggcggggauggcggggcuguccuguaggucugugcggccaccgugauugccccucugcgcggugcccgaagucccgcugaaaccugccgagggcagcaggucugaaagcugcaggcgcuaguugcgcggagguggcgcagcugcucuggaggcgcagagcgaauacgugguguuuggguguggccgccccgccccuggcgguuuccucguuccccuuugguuaaugcgcaacuguuucagauugcaggaggagaugcuucagagagaggaagccgaaaacacccugcaaucuuucagacagguuuguagacucucuucccacucgcagccgccugaccccacccaacacaacccacgagcaauucuaaaaguugcuuaacucacgucuaaaaagugcaaaacuucagggcugcgcguaaagcccucuaguggcgggaagaccacagguuggagcuucucaugauuagaaaaauauuaauaaaaccccuugagcgauuuuuuuuuuuuuuuugagacggagucuuacucugucgcccaggcuggagugcaguggcgagaucuuggcucacugcauccuccgccucccggguucaagcgauccuugaaugauuucuaagcaguuccuugggacauaaagaaaaaucuuuuaacuuuuuacuuuguuucccaaauguugcacaguuuugcaacacauugaccuucugguuucgaacgguuacaauuuuagauugugguuugccaaagucaaguugcuuaauuuuuacaaggcca

SEQ ID NO: 19292 - RNA, 2887 nt, Homo sapiens
uggccuuguaaaaauuaagcaacuugacuuuggcaaaccacaaucuaaaauuguaaccguucgaaaccagaaggucaauguguugcaaaacugugcaacauuugggaaacaaaguaaaaaguuaaaagauuuuucuuuaugucccaaggaacugcuuagaaaucauucaaggaucgcuugaacccgggaggcggaggaugcagugagccaagaucucgccacugcacuccagccugggcgacagaguaagacuccgucucaaaaaaaaaaaaaaaaucgcucaagggguuuuauuaauauuuuucuaaucaugagaagcuccaaccuguggucuucccgccacuagagggcuuuacgcgcagcccugaaguuuugcacuuuuuagacgugaguuaagcaacuuuuagaauugcucguggguuguguuggguggggucaggcggcugcgagugggaagagagucuacaaaccugucugaaagauugcaggguguuuucggcuuccucucucugaagcaucuccuccugcaaucugaaacaguugcgcauuaaccaaaggggaacgaggaaaccgccaggggcggggcggccacacccaaacaccacguauucgcucugcgccuccagagcagcugcgccaccuccgcgcaacuagcgccugcagcuuucagaccugcugcccucggcagguuucagcgggacuucgggcaccgcgcagaggggcaaucacgguggccgcacagaccuacaggacagccccgccauccccgcccccgagggaccaucccuuugucucgcucccuccaccgccuuccccuccuuccuucucccgcccggugauuggcagccugccagaaggggcaggaaacuuucugaaaguuuggaggacuggcucucauugugcccaagggccuucaacugcacacaaagugguaguuuuaagaaaucuguaacuugaaacggagcguccuugggcaauguguggggacagaggaggaaaugcgaacugcaaggucuggguucugggcggggcugcgccaccacagccacagccccgcucuccgcugucucccuggcaggccuccccccggccacauccccaagggcguggcagcucucgcgggggccgggggggcguuccccucucccuccagcccccucccgaggcccagcuacuugcaugggcgcagccuuacuucucccggaggcgcaugauguccucggccagguugucgcgcuccaccucgacgcgggcuuugucguugguuagcugguccaccugccggcgcagcucccgcaucuccuccucguagaggucccccaggcgcgacuugccuuggcccuugagcugcucgagcucggccagcaggaucuuauucugcugcuccaggaagcgcaccuugucgauguaguuggcgaagcggucauucagcuccugcagcuccaccuucucguuggugcggguguucuugaacucgguguugauggcgucggccagcgagaaguccaccgaguccugcaggagccgcaccccgggcacgcugcuccgcaggcgcacggcagaggagcgcguggcauacacgccgcccggggacgaggcguagaggcugcggcuggugcuggggcgcagcgcgcugcccaggcuguaggugcggguggacguagucacguagcuccggcuggagcucggccggcucgcggugcccgggccgccgaacauccugcgguaggaggacgaggacacggaccugguggacauggcugcggaggguggcgauggccugggcggcggcgguggcgcggacuggcucccggagaagaggcgaacgagggcgcgguggguguggguggugggagcgcggcugcgucucuggcgcggggaccucggagcgagaguggcagaggacuggaccccgccgagggcgcuguuuuuauaaccccguuaggaaagaggguccccucccacugccaucccagccgcggagcgcgccagccaauagggaccuagcgagaagcggggagggugggcggguggggugggggcgcccucgagccuuccugcuccggggccugggacugggcauggucccguuacuucagcgcugggcugggacuuuugggggcuuuccggaugauagucugagcugggcucacccuggggugcugaaaaaggcggggucgcgcggugagggggggguccgccugggacugaaccagagggguccgguggcaccacgccaaaggggcgugggaggaggugcgcggcggucucggggcugcggucaggcggggagacccgcgggcaaaggagcgggaagaggaaagaguaaggaaucccucagaucugaagucgcggagaaagaaacaaagagcgccugagauuggaacgcggggugggggcgcgcacagcgcaggaacgcagggcucaggccucgccgcagccucgcgcgccgcccgcuuggaaaggggggcugcuccggcccgcgccucuguccaucgacuugccuuggcggagagauguuggggggaggggagguucugucgagggaccuaacgggcucaguccagcuucggacggcgggaguugcgagacggcgguggcagaggaaagcccgagggagagggguggggucgcuuagucaccggcggugacucaccgcgcccugcugucccgccgauugagggcuccuagcgguuuaggggaaaccguuagaccagauugauucaagucucagcgggcuccgcgcgcgcugcuaguucucagugcuaccaacuuacagcugggccaucgccuugcugugugcggucgggcccugugggggacaagagcgccccuaaguuuuuaauaacucgcuaaagccugucuuugcucgaaugugcggacuuuu

SEQ ID NO: 19293 - RNA, 2257 nt, Homo sapiens
uccuuucagaaggaaagguccugcuguuaaauuaagcacugagccccacauuucaaccugacccuucugucugaaugugacacguuucccuccccagcccacuuacuuuaguucaggccauucauauucauaaacagauuaucugugaaugacaagcugaucccuggaaagagauggcaaguuagccccacccaccauccucaccaccauugaguuucacacugaaccugacacaaguuauaaccaccaccuucuaggaaaaccacuucucagggagcagggaggacguggccacaaggucaagaacggguuggauccuagcacacugagagauggguacccucuggcugacaccgucaggauucucaggguuaaugaggcucaguucugggaaaccagcaccccacacccucccauccggacacacugcuagauauuuuacaugcauccucccaauuggcuccagagcccagcuugcuguugcucccuuuuacagacaagccauaggucacucaggagccgccagcguguccuagagcuccugcagaggccuccacugccagagagcccccaaccuggguaccaaaggcuucaaaucucaagcucuguccacuugagcuacuuuauuuccuagcugccuucaaaaccccucagugugcuuuuuaaaaacaaaacuugaagcccgcccuggaggagucaagaggagacccaggaagaaggaggccuccagagcagcacgcgggggucucuggggcccugccgggcucgcagaagcgacuccccguggcucgcggggauggggacggcugggcgccggcgggacgcugcaggagcgagcuaccggccggaggacacggggggacgcugggaacucggggugaagggacgggacucagaguuucgucagauugggggcggggagaggaggcccggguccgaggauggaagcgauccccgccgggagggagaacaaagcgguggcccucucucucccccgacgcacggcaagcauuuaaucuacaagcagggugccagggagggaggggagcgggccgagccccaaaauagggaguuugcauuuaccacgacgccucgcccguagucuggcgccuccucgcugcucccggccauguuucucccggggaacgcgggaagggaagacggcgcgggaaggagcagggagggcgaaggcugcgugggggaugggacguggggauggggacggggacggggacggggacggggacggggacggguccgccccgccccgggcccgccggcgggaagcagcggccugacgcggauccauggccccggcgcugcgcccccuccccuggcuaggccgcgggggcgcggggagcagcugccaagccgcuaccgcucccccugagcgcgggccccggacgcgucccuugcggccgccgcugucgccgccgcccccugccggauggucgcgugcagcccccggccccgccgccaagccccgcggggacucuggagcaggaagcccgcggcaggaagagaacgugucccccaggccccugauucccagauccaccgucccagcccucgggcuaacaaucuccuugacuccucccugccagauuucaugcacgcgauugucccaagcagaagcgugaaagagccugugagccagcgugcucuuggaggaugggaaguguccuggauguguuuucaaaccuuggagccgccacccaccucucuccaccuccgcucaucucccuccaccuccccucaccucccuccaccuccccucaccucccuccaucuuccuccaccuuucuccaccuucccccaccucccucaucccagggccuggagcuggaaagauuacacccgauugcuuuuaggguggcccggaucugcagugaucagaucugggcuuugaggauccagccuuucggccuuucgucaacugcauucaggggaggagggggagagauuuuuacacauucucugcuuuaccaguuuugcaagaacaucuggucagauuguaauuguuccagguugcagcuuuacuaaagcaaucgcucuuuucugauuagaaauccuucuuguaugagucuguuguucauuucaaccccucucacaugccuaugcuccgguucuuuguccacuccuguagguuccugcuuuuucugggugugucuucauuccccaggucccugacaucucaccagcgucuucauucacucagcccaauucgggucgaagcccugaauccaagagaacuuaa

SEQ ID NO: 19294 - RNA, 2257 nt, Homo sapiens
uuaaguucucuuggauucagggcuucgacccgaauugggcugagugaaugaagacgcuggugagaugucagggaccuggggaaugaagacacacccagaaaaagcaggaaccuacaggaguggacaaagaaccggagcauaggcaugugagagggguugaaaugaacaacagacucauacaagaaggauuucuaaucagaaaagagcgauugcuuuaguaaagcugcaaccuggaacaauuacaaucugaccagauguucuugcaaaacugguaaagcagagaauguguaaaaaucucucccccuccuccccugaaugcaguugacgaaaggccgaaaggcuggauccucaaagcccagaucugaucacugcagauccgggccacccuaaaagcaaucggguguaaucuuuccagcuccaggcccugggaugagggaggugggggaagguggagaaagguggaggaagauggagggaggugaggggagguggagggaggugaggggagguggagggagaugagcggagguggagagagguggguggcggcuccaagguuugaaaacacauccaggacacuucccauccuccaagagcacgcuggcucacaggcucuuucacgcuucugcuugggacaaucgcgugcaugaaaucuggcagggaggagucaaggagauuguuagcccgagggcugggacgguggaucugggaaucaggggccugggggacacguucucuuccugccgcgggcuuccugcuccagaguccccgcggggcuuggcggcggggccgggggcugcacgcgaccauccggcagggggcggcggcgacagcggcggccgcaagggacgcguccggggcccgcgcucagggggagcgguagcggcuuggcagcugcuccccgcgcccccgcggccuagccaggggagggggcgcagcgccggggccauggauccgcgucaggccgcugcuucccgccggcgggcccggggcggggcggacccguccccguccccguccccguccccguccccguccccauccccacgucccaucccccacgcagccuucgcccucccugcuccuucccgcgccgucuucccuucccgcguuccccgggagaaacauggccgggagcagcgaggaggcgccagacuacgggcgaggcgucgugguaaaugcaaacucccuauuuuggggcucggcccgcuccccucccucccuggcacccugcuuguagauuaaaugcuugccgugcgucgggggagagagagggccaccgcuuuguucucccucccggcggggaucgcuuccauccucggacccgggccuccucuccccgcccccaaucugacgaaacucugagucccgucccuucaccccgaguucccagcguccccccguguccuccggccgguagcucgcuccugcagcgucccgccggcgcccagccguccccauccccgcgagccacggggagucgcuucugcgagcccggcagggccccagagacccccgcgugcugcucuggaggccuccuucuuccugggucuccucuugacuccuccagggcgggcuucaaguuuuguuuuuaaaaagcacacugagggguuuugaaggcagcuaggaaauaaaguagcucaaguggacagagcuugagauuugaagccuuugguacccagguugggggcucucuggcaguggaggccucugcaggagcucuaggacacgcuggcggcuccugagugaccuauggcuugucuguaaaagggagcaacagcaagcugggcucuggagccaauugggaggaugcauguaaaauaucuagcaguguguccggaugggaggguguggggugcugguuucccagaacugagccucauuaacccugagaauccugacggugucagccagaggguacccaucucucagugugcuaggauccaacccguucuugaccuuguggccacguccucccugcucccugagaagugguuuuccuagaagguggugguuauaacuugugucagguucagugugaaacucaaugguggugaggaugguggguggggcuaacuugccaucucuuuccagggaucagcuugucauucacagauaaucuguuuaugaauaugaauggccugaacuaaaguaagugggcuggggagggaaacgugucacauucagacagaagggucagguugaaauguggggcucagugcuuaauuuaacagcaggaccuuuccuucugaaagga

SEQ ID NO: 19295 - RNA, 2487 nt, Homo sapiens
gccuagacaaguauguuuuaaucauuucuuuaacugacaacaagaaagaugauuugauaauuugccuaaaaugagcagaugcucaggaggacacgucuccauccuaugucccuucugucuaauuucaccuagaaaugaaaacuacucccuucucccucuuuuccaggcaaaaggcugauuuaacuaagcaugcaagacgccaacacccucccccucaguacguccaaguuuccuucgcucugagccaccgaaucucugcuucuccccccucugccgcccacccuacgccacccacgcagguuuccgagucauccggaacgcgagugggugcgaggacucggcaggcugccucccgcgcccccgccgcccgcgggccgccucggguucagcacuggacagcucccuccccggccccacaaauggcagucggcugauugacagaggagccgaccaaacagggaacaagacgacuugcagccgcccuacaaggguuugguugcggccaagcugccucuuuaaacuggcuuuccucccccgaggagggagcagggagagaggguggagugugguuugcggccaaaccuaaaggcugcaauuaaccagccgcccggccuucgcuacuccggacagacgaacgucuuaaaggacgucuucgcuccucgggagucgcggcugcgcucgcggugcgggucugggcgcgcgccccgcgccuccgggcgaagcggucgaggaggagccagugccgggaggcgggaacgaccugcggcgggugagacuauggagcagcgucuucggcggccgcggcggcagcagcagcagcagcuucugaacgcgccucaaugagagcggcgguggcggcagccgggccgagagacggacucgggcugacuccagccgcugggagcgcgaggccauguaacccgcucggcuccaggcugcgaggugcguaauccccagccggccccucgcgcagcgggcacggccagcgcugccacaggugacuugauuucugcgacgguagcuuagccacccggggccaaucucgaaacauucuuauuuucaaguccuuuggacugggugccaucuggagaagggggaagacuccucgaaaaagucugacuguugagaaacugacgauccaaauuuaaaaagugauuccccccccucccguucccuccucuucucucugggaggcagaugggagccauggcuuaccccuuacuccucugccuccugcuugcucagcugggauugggagcuguuggcgccagccgcgacccccaaggacggccggauuccccucgagagaggaccccgaaggggaagccgcacgcccagcagccgggucgagccucugccucggacuccucggcucccuggagccgcuccaccgauggcaccaucuuggcgcagaaacucgccgaggaggugcccauggacguggccucuuaccucuacaccggggacucccaccagcugaagcgagccaacugcuccggccgcuacgaguuggcgggccugccggggaaguggccagcccuggccagcgcgcaccccuccuugcaccgggcgcuggacacacugacacacgccaccaacuuccucaacgugaugcugcagagcaauaagucgcgggagcagaacuugcaggacgaccuggauugguaccaggcgcugguguggagccuucuggagggcgagcccagcaucucccgggcggccaucaccuucagcaccgauucgcuguccgcaccggccccacaggucuuccuccaggccacgcgcgaggagagccgcauccugcuccaagaccuguccuccuccgcaccccaccuggccaacgccacucuggagaccgagugguuccacggccuccggcgcaaguggaggccccacuuacaccgccgcggccccaaucaggggccccggggccugggccacagcuggcggcgcaaggacgggcucggcggggacaagagccacuucaaguggucuccgccuuaucuggagugcgagaacgggaguuacaagcccggguggcugguuacucuuuccucugccaucuacggguugcagccuaaccuggucccggaauucagguagggagggccggggggcaggggggaaggcaaaagcgaagcuuuccuuccggucuugugggugggugcacgugugaggaaggaacccuuggcugugacgcgaacgcuucucacccucagaguagagacccgggcugagggacaccccacgcgggcgcgggugcuugggggcaagaagcgccccacgcccgucagcuuccggcgcucggcgaaagccauucauucucucggaccaguuuccccgcacugggcgagggacaggcagcccuuggcaggacggagacacccccgcugcucugugcuucccuccaauuguccggagagcagggaggggcguuccccaccggggggcgaugcgacaacuuggcgagcgccggguguguccgcg

SEQ ID NO: 19296 - RNA, 2487 nt, Homo sapiens
cgcggacacacccggcgcucgccaaguugucgcaucgccccccgguggggaacgccccucccugcucuccggacaauuggagggaagcacagagcagcgggggugucuccguccugccaagggcugccugucccucgcccagugcggggaaacugguccgagagaaugaauggcuuucgccgagcgccggaagcugacgggcguggggcgcuucuugcccccaagcacccgcgcccgcguggggugucccucagcccgggucucuacucugagggugagaagcguucgcgucacagccaaggguuccuuccucacacgugcacccacccacaagaccggaaggaaagcuucgcuuuugccuuccccccugccccccggcccucccuaccugaauuccgggaccagguuaggcugcaacccguagauggcagaggaaagaguaaccagccacccgggcuuguaacucccguucucgcacuccagauaaggcggagaccacuugaaguggcucuuguccccgccgagcccguccuugcgccgccagcuguggcccaggccccggggccccugauuggggccgcggcgguguaaguggggccuccacuugcgccggaggccguggaaccacucggucuccagaguggcguuggccagguggggugcggaggaggacaggucuuggagcaggaugcggcucuccucgcgcguggccuggaggaagaccuguggggccggugcggacagcgaaucggugcugaaggugauggccgcccgggagaugcugggcucgcccuccagaaggcuccacaccagcgccugguaccaauccaggucguccugcaaguucugcucccgcgacuuauugcucugcagcaucacguugaggaaguugguggcgugugucaguguguccagcgcccggugcaaggaggggugcgcgcuggccagggcuggccacuuccccggcaggcccgccaacucguagcggccggagcaguuggcucgcuucagcuggugggaguccccgguguagagguaagaggccacguccaugggcaccuccucggcgaguuucugcgccaagauggugccaucgguggagcggcuccagggagccgaggaguccgaggcagaggcucgacccggcugcugggcgugcggcuuccccuucgggguccucucucgaggggaauccggccguccuugggggucgcggcuggcgccaacagcucccaaucccagcugagcaagcaggaggcagaggaguaagggguaagccauggcucccaucugccucccagagagaagaggagggaacgggaggggggggaaucacuuuuuaaauuuggaucgucaguuucucaacagucagacuuuuucgaggagucuucccccuucuccagauggcacccaguccaaaggacuugaaaauaagaauguuucgagauuggccccggguggcuaagcuaccgucgcagaaaucaagucaccuguggcagcgcuggccgugcccgcugcgcgaggggccggcuggggauuacgcaccucgcagccuggagccgagcggguuacauggccucgcgcucccagcggcuggagucagcccgaguccgucucucggcccggcugccgccaccgccgcucucauugaggcgcguucagaagcugcugcugcugcugccgccgcggccgccgaagacgcugcuccauagucucacccgccgcaggucguucccgccucccggcacuggcuccuccucgaccgcuucgcccggaggcgcggggcgcgcgcccagacccgcaccgcgagcgcagccgcgacucccgaggagcgaagacguccuuuaagacguucgucuguccggaguagcgaaggccgggcggcugguuaauugcagccuuuagguuuggccgcaaaccacacuccacccucucucccugcucccuccucgggggaggaaagccaguuuaaagaggcagcuuggccgcaaccaaacccuuguagggcggcugcaagucgucuuguucccuguuuggucggcuccucugucaaucagccgacugccauuuguggggccggggagggagcuguccagugcugaacccgaggcggcccgcgggcggcgggggcgcgggaggcagccugccgaguccucgcacccacucgcguuccggaugacucggaaaccugcguggguggcguagggugggcggcagaggggggagaagcagagauucgguggcucagagcgaaggaaacuuggacguacugagggggaggguguuggcgucuugcaugcuuaguuaaaucagccuuuugccuggaaaagagggagaagggaguaguuuucauuucuaggugaaauuagacagaagggacauaggauggagacguguccuccugagcaucugcucauuuuaggcaaauuaucaaaucaucuuucuuguugucaguuaaagaaaugauuaaaacauacuugucuaggc

SEQ ID NO: 19297 - RNA, 2630 nt, Homo sapiens
cuugggcugauaccccugccccacugcacuggucuguaccucuaucccaggagaguccugggggggagggguggggcaggcacgccucuccugccucgggugugcugucucccuccaccccaaggccugucuccaacccaggcccuauccagcaugggaaugggaccaucccugcgugggggccacuccgcaugugcacguugggaucacuuugcggagccuggguggggucgagacgggugaggagcaggaccucuggguugcauugcgugugggcgccuguugcagccgugagcugggcgggugcaggugggcgguguccugcugcucaggucagggcucggcgggcgcccggugguggacaaggcggggugagguggucuugauagcgcuguggccggcgcugagccaagaguaguuuggagcucccggacagguggcuggcggugccgggcguuggcuguuugcccugcccccgccccaagcguggauccagccgugggacaggaacugccugagcucgggccagagaguuaauauuugugcaggcgccgcaggaacgggcuccgcggacgacgggcuccagggacgcacaggcagcgggccucccaccgcgggugccgggggcgggggggcugcccccaugcggggcccuuccuggucgcggccucggccgcugcugcugcuguugcugcugcugucgccuuggccugucugggcccaggugucggccacggccucgcccucggggucccugggcgccccggacugccccgaggugugcacgugcgugccgggaggccuggccagcugcucggcacucucgcugcccgccgugcccccgggccugagccugcgccugcgcgcgcugcugcuggaccacaaccgcguccgugcgcugccgccaggugccuucgcgggagcgggcgcgcuacagcgccuggaccugcgcgagaacgggcugcacucggugcaugugcgagccuucuggggccugggcgcgcugcagcugcuggaccugagcgccaaccagcuggaagcacuggcaccagggacuuucgcgccgcugcgcgcgcugcgcaaccucucauuggccggcaaccggcuggcgcgccuggagcccgcggcgcuaggcgcgcucccgcugcugcgcucacucagccugcaggacaacgagcuggcggcacucgcgccggggcugcugggccgccugcccgcucuagacgcgcugcaccugcgcggcaacccuuggggcugcgggugcgcgcugcgcccgcucugcgccuggcugcgccggcacccgcugcccgcgucaggugagcugcuggggacgcgggucggggucugcagggcggugcggcagccgccaccugacgccgcgccuuugucugugucccacagaggccgagacggugcucugcguguggccgggacgccugacgcucagcccccugacugccuuuuccgacgccgccuuuagccauugcgcgcagccgcucgcccugcgggaccuggccgugguuuacacgcucgggccggccuccuuccucgucagccuggcuuccugccuggcgcugggcucugggcucaccgccugccgugcgcgccgccgccgccuccgcaccgccgcccuccgcccgccgagaccgccagacccgaaccccgaucccgacccccacggcugugccucgcccgcggacccggggagccccgccgcugccgcccaagccugagcggccgcggccgccuggagcgcucgaagcuucccccaugccuuugcccucccuuuacacugucugccggcgucaacaagcgacacagaccgaaaacugcgugacauuccuuuaggcaucaccacugcauacaccgggagguggggguugggcggugcgcgccugcacccuggggacggaggggcagagcgcggcugcgcacgggccgcacggggaaggcacgcgcucgggcccugggagugcugguucuguacaagguggcgggccggucacgcacccggagcgagggcgggggcgggcggguggcgcucucccgugcccaaggugcagggcaggguugaagacagucccgagccagcguccggggacccccggggaggcccguucugggcugcaggccggacgaggagaggaggggcucagcccucucgagucuggaggaggcggcccgaggcggcgggaggcgcugccagcugggaagucagggacggccgugggggagggcagggccagccccggcguguggggucaaggggcagacggggugugggugggcggugccgcaagaagaggggaggguggagcucaggcugcagaggagcgcaggcgcccgaggaggggcgacccagccagcuggggccaugggccccacuguggcucaggcuggugcugcgggaaggauggggcugccgucucugcuccaagccccuccgccuggggccaguuagcccccgcuccccacugcucagagaccccagggcccugccucugccggagcgcccugcggcccugcccagccgacucagcucugccccguccucagccgcuccgguccgcaccuugguccagcaggggcugcccgccaggcagcggggugggcgggcggacggacgggag

SEQ ID NO: 19298 - RNA, 2630 nt, Homo sapiens
cucccguccguccgcccgcccaccccgcugccuggcgggcagccccugcuggaccaaggugcggaccggagcggcugaggacggggcagagcugagucggcugggcagggccgcagggcgcuccggcagaggcagggcccuggggucucugagcaguggggagcgggggcuaacuggccccaggcggaggggcuuggagcagagacggcagccccauccuucccgcagcaccagccugagccacaguggggcccauggccccagcuggcugggucgccccuccucgggcgccugcgcuccucugcagccugagcuccacccuccccucuucuugcggcaccgcccacccacaccccgucugccccuugaccccacacgccggggcuggcccugcccucccccacggccgucccugacuucccagcuggcagcgccucccgccgccucgggccgccuccuccagacucgagagggcugagccccuccucuccucguccggccugcagcccagaacgggccuccccggggguccccggacgcuggcucgggacugucuucaacccugcccugcaccuugggcacgggagagcgccacccgcccgcccccgcccucgcuccgggugcgugaccggcccgccaccuuguacagaaccagcacucccagggcccgagcgcgugccuuccccgugcggcccgugcgcagccgcgcucugccccuccguccccagggugcaggcgcgcaccgcccaacccccaccucccgguguaugcaguggugaugccuaaaggaaugucacgcaguuuucggucugugucgcuuguugacgccggcagacaguguaaagggagggcaaaggcaugggggaagcuucgagcgcuccaggcggccgcggccgcucaggcuugggcggcagcggcggggcuccccggguccgcgggcgaggcacagccgugggggucgggaucgggguucgggucuggcggucucggcgggcggagggcggcggugcggaggcggcggcggcgcgcacggcaggcggugagcccagagcccagcgccaggcaggaagccaggcugacgaggaaggaggccggcccgagcguguaaaccacggccaggucccgcagggcgagcggcugcgcgcaauggcuaaaggcggcgucggaaaaggcagucagggggcugagcgucaggcgucccggccacacgcagagcaccgucucggccucugugggacacagacaaaggcgcggcgucagguggcggcugccgcaccgcccugcagaccccgacccgcguccccagcagcucaccugacgcgggcagcgggugccggcgcagccaggcgcagagcgggcgcagcgcgcacccgcagccccaaggguugccgcgcaggugcagcgcgucuagagcgggcaggcggcccagcagccccggcgcgagugccgccagcucguuguccugcaggcugagugagcgcagcagcgggagcgcgccuagcgccgcgggcuccaggcgcgccagccgguugccggccaaugagagguugcgcagcgcgcgcagcggcgcgaaagucccuggugccagugcuuccagcugguuggcgcucagguccagcagcugcagcgcgcccaggccccagaaggcucgcacaugcaccgagugcagcccguucucgcgcagguccaggcgcuguagcgcgcccgcucccgcgaaggcaccuggcggcagcgcacggacgcgguugugguccagcagcagcgcgcgcaggcgcaggcucaggcccgggggcacggcgggcagcgagagugccgagcagcuggccaggccucccggcacgcacgugcacaccucggggcaguccggggcgcccagggaccccgagggcgaggccguggccgacaccugggcccagacaggccaaggcgacagcagcagcaacagcagcagcagcggccgaggccgcgaccaggaagggccccgcaugggggcagcccccccgcccccggcacccgcggugggaggcccgcugccugugcgucccuggagcccgucguccgcggagcccguuccugcggcgccugcacaaauauuaacucucuggcccgagcucaggcaguuccugucccacggcuggauccacgcuuggggcgggggcagggcaaacagccaacgcccggcaccgccagccaccuguccgggagcuccaaacuacucuuggcucagcgccggccacagcgcuaucaagaccaccucaccccgccuuguccaccaccgggcgcccgccgagcccugaccugagcagcaggacaccgcccaccugcacccgcccagcucacggcugcaacaggcgcccacacgcaaugcaacccagagguccugcuccucacccgucucgaccccacccaggcuccgcaaagugaucccaacgugcacaugcggaguggcccccacgcagggauggucccauucccaugcuggauagggccuggguuggagacaggccuugggguggagggagacagcacacccgaggcaggagaggcgugccugccccaccccucccccccaggacucuccugggauagagguacagaccagugcaguggggcagggguaucagcccaag

SEQ ID NO: 19299 - RNA, 3456 nt, Homo sapiens
gcugaggucgguggcaagggacccugccagccuggcagcacaaacaggaaggauggcaggcucuggcaccagaggccgggucacccgcaggcguggcaggacagccuccuuccugcaggaacugccgccgggugucuguuucaaggagaagagaugggguggugugaggcugaagccaagguguggcuccccgggggcccccugccagaggaggaacgcuggggugggauuaaaggcccaggugccacuguggucaucaccgaaaacaugggaggcuggaaaggcggggcuggaggcagcugcccacucuggugccagccccuaagccaagcagcucaggcacugacaguuucccguggcgcccacaggcaccccucccuccaaaccccccucccuccaagcuccccuccaagcuccccucccuccagcccccucccuccaaaccccccucucuccagccccccucccaagcccccucccuccaagucccccucccuccagccccccucccuccagccguugcacaaguuccgcagcaaagcucagcucagaggcuacacugcgccacaggggugggggccucugacuaccacccugucccagucuugccucuguccccacagugggauccucccacuucagucuccagcugccugguuccccucccaaggcagccuuguccucacuguggggccggggagaggccagcagccccuggggcccaaaaguagaacaggacagggacagggguggugggaggcaggcccccucugagggugcuggggcaaaggucuggacaacaguucaugguugccauuccucccaggacacacgaucugagcccccaaaagaccugacaggacagacgcguccucauucccagcaucccagcauuuugggaggccgaggugggaggacugcuugagccaggaguuugaaacuagccuggacaacauaacaagacucugccucuacaaaaaauuuuaaaaaauuaaccaggcaugguagugcacacccauagacccagcuccuugggaggcugaggugggagcauugcuugagcccaggagguugaggcugcagcaaaccgugacugcgccacugcacuccagccugggcaacagagcaagacccugucucaaaaaacaaaaaacaaaaacccacacacaaaaaagcaaacuuggcugggcgcgguggcucaugccuguaaucccaacacuuugggaggcugaaacuuguggaucaccugaagucaggaguuugagaccagccuggccaacaugggaaaaccccaucucuacuaaaaauacaaaaauuagcugggcgugguggcaggcacccauaaucccagcuacuugggaggcugagacaggagaaucacuugaacccggaagguggagguugcagugagccaagaucgcaccacuugauccugacuucaggugauccacaagccuuggccucccaaaaugcugggauuacagccugggcgauagugcaagacucccucucaaaaaacaaacaaacaaacaaacaaacaaaccaagccugaccugcauugagaucuccaggacgucugggucuggccacgccugggaccacacaaggucccgugcagcagaguggcaacgugguugggugaagaggcugauggggccucccacuguggcugagagugggguguugguuggcuggggcucagggugaccccgcagggccaucccagccuggcuggcacccaacgugggcugguguagaagaaggaaccuggccuccaggcuccaggcccuggcuuagagggagcggggagucuggacuucaggcuggaucccuuccucuuccuggagcgggugcuggcccccaacccgcuugcgucagggacaaaaggacuccuucccuuuccagccuggaaagccccucugcugcaggcuggaggaagggacccugggcccagccuauagucagcggugucuaugggcauggaucuggacggggaaaaggacaaagcagccuccauccacaguucauuccgggaccaggcccuugcaggcacgcgcugggcuccugugggaagacacuaagggccccaggacagaccuccucuccgggcaucuggguuccuagauggcagagguggcagaguggggugggauggcccaauugggagcuuuagcuuccggcaaagagcugagcacaguacaucuucaauguguaagauucuccugggagaccagggcccagcugguggugagcugggggaagugggugauacugccgugggaggagccaccuggcccucuggggaagugcacucgcugucugcagcgcccaggccuggguagcugggugggggcuggggggccaucugugcucagggugccugcaccugggccuucucugcccugggccaagccugcccgagccucucuguccucugccugcccagcuggacaucucugggccucucuggagaccaguggggugggcugugggggcgucauauugcccuggcuuggcaucccucuuguggcuguaccccucccagcagccccaggacuagcaaguccccgagauggggguggggacagugguugaugccaaagguugugggggcaggggcggggcaggagcaggaagguccccugaguucccucaccuugggcagagauaaaaggagcacaguuccaggcggggcugagcuagggcguagcugugauuucaggggcaccucuggcggcugccgugauuugagaaucucgggucucuuggcugacugauccugggagacuguggaugaauaaugcuggugagugucuggcccucggggaggcccaagcuggggacagcuaggcaaccugggaggggaggacggggguggcgcugaguggggcaugucggugucccugagcccaugggaggggaggacggggguggcgcugaguggggcaugugggugucccugagcccaugggaggggaggacgggguuggcgcugaguggggcguguggaugucccugagcccaagugacagagccuccccucccucgugcugcugcagggcacggccccacccggaggcugcgaggcuuggggguccuggccgggguggcucugcucgcugcccucuggcuccuguggcugcuggggucagccccucgggguaccccggcaccccagcccacgaucaccauccuugucuggcacuggcccuucacugaccagcccccagagcugcccagcgacaccugcacccgcuacggcaucgcccgcugccaccugagugccaaccgaagccugcuggccagcgccgacgccguggucuuccaccaccgcgagcugcagacccggcggucccaccugccccuggcccagcggccgcgagggcagcccugggugugggccuccauggagucuccuagccacacccacggccucagccaccuccgaggcaucuu

SEQ ID NO: 19300 - RNA, 3456 nt, Homo sapiens
aagaugccucggagguggcugaggccguggguguggcuaggagacuccauggaggcccacacccagggcugcccucgcggccgcugggccaggggcaggugggaccgccgggucugcagcucgcggugguggaagaccacggcgucggcgcuggccagcaggcuucgguuggcacucagguggcagcgggcgaugccguagcgggugcaggugucgcugggcagcucugggggcuggucagugaagggccagugccagacaaggauggugaucgugggcuggggugccgggguaccccgaggggcugaccccagcagccacaggagccagagggcagcgagcagagccaccccggccaggacccccaagccucgcagccuccggguggggccgugcccugcagcagcacgagggaggggaggcucugucacuugggcucagggacauccacacgccccacucagcgccaaccccguccuccccucccaugggcucagggacacccacaugccccacucagcgccacccccguccuccccucccaugggcucagggacaccgacaugccccacucagcgccacccccguccuccccucccagguugccuagcuguccccagcuugggccuccccgagggccagacacucaccagcauuauucauccacagucucccaggaucagucagccaagagacccgagauucucaaaucacggcagccgccagaggugccccugaaaucacagcuacgcccuagcucagccccgccuggaacugugcuccuuuuaucucugcccaaggugagggaacucaggggaccuuccugcuccugccccgccccugcccccacaaccuuuggcaucaaccacuguccccacccccaucucggggacuugcuaguccuggggcugcugggagggguacagccacaagagggaugccaagccagggcaauaugacgcccccacagcccaccccacuggucuccagagaggcccagagauguccagcugggcaggcagaggacagagaggcucgggcaggcuuggcccagggcagagaaggcccaggugcaggcacccugagcacagauggccccccagcccccacccagcuacccaggccugggcgcugcagacagcgagugcacuuccccagagggccagguggcuccucccacggcaguaucacccacuucccccagcucaccaccagcugggcccuggucucccaggagaaucuuacacauugaagauguacugugcucagcucuuugccggaagcuaaagcucccaauugggccaucccaccccacucugccaccucugccaucuaggaacccagaugcccggagaggaggucuguccuggggcccuuagugucuucccacaggagcccagcgcgugccugcaagggccuggucccggaaugaacuguggauggaggcugcuuuguccuuuuccccguccagauccaugcccauagacaccgcugacuauaggcugggcccagggucccuuccuccagccugcagcagaggggcuuuccaggcuggaaagggaaggaguccuuuugucccugacgcaagcggguugggggccagcacccgcuccaggaagaggaagggauccagccugaaguccagacuccccgcucccucuaagccagggccuggagccuggaggccagguuccuucuucuacaccagcccacguugggugccagccaggcugggauggcccugcggggucacccugagccccagccaaccaacaccccacucucagccacagugggaggccccaucagccucuucacccaaccacguugccacucugcugcacgggaccuuguguggucccaggcguggccagacccagacguccuggagaucucaaugcaggucaggcuugguuuguuuguuuguuuguuuguuuguuuuuugagagggagucuugcacuaucgcccaggcuguaaucccagcauuuugggaggccaaggcuuguggaucaccugaagucaggaucaaguggugcgaucuuggcucacugcaaccuccaccuuccggguucaagugauucuccugucucagccucccaaguagcugggauuaugggugccugccaccacgcccagcuaauuuuuguauuuuuaguagagaugggguuuucccauguuggccaggcuggucucaaacuccugacuucaggugauccacaaguuucagccucccaaaguguugggauuacaggcaugagccaccgcgcccagccaaguuugcuuuuuuguguguggguuuuuguuuuuuguuuuuugagacagggucuugcucuguugcccaggcuggagugcaguggcgcagucacgguuugcugcagccucaaccuccugggcucaagcaaugcucccaccucagccucccaaggagcugggucuaugggugugcacuaccaugccugguuaauuuuuuaaaauuuuuuguagaggcagagucuuguuauguuguccaggcuaguuucaaacuccuggcucaagcaguccucccaccucggccucccaaaaugcugggaugcugggaaugaggacgcgucuguccugucaggucuuuugggggcucagaucguguguccugggaggaauggcaaccaugaacuguuguccagaccuuugccccagcacccucagagggggccugccucccaccaccccugucccuguccuguucuacuuuugggccccaggggcugcuggccucuccccggccccacagugaggacaaggcugccuugggaggggaaccaggcagcuggagacugaagugggaggaucccacuguggggacagaggcaagacugggacagggugguagucagaggcccccaccccuguggcgcaguguagccucugagcugagcuuugcugcggaacuugugcaacggcuggagggaggggggcuggagggagggggacuuggagggagggggcuugggaggggggcuggagagagggggguuuggagggagggggcuggagggaggggagcuuggaggggagcuuggagggagggggguuuggagggaggggugccugugggcgccacgggaaacugucagugccugagcugcuuggcuuaggggcuggcaccagagugggcagcugccuccagccccgccuuuccagccucccauguuuucggugaugaccacaguggcaccugggccuuuaaucccaccccagcguuccuccucuggcagggggcccccggggagccacaccuuggcuucagccucacaccaccccaucucuucuccuugaaacagacacccggcggcaguuccugcaggaaggaggcuguccugccacgccugcgggugacccggccucuggugccagagccugccauccuuccuguuugugcugccaggcuggcagggucccuugccaccgaccucagc

SEQ ID NO: 19301 - RNA, 2630 nt, Homo sapiens
gggcucugaggccuggccggcggugggucgcgagucgaugaccagguccgugaugagcucguccagcugcucuaggcuccgcuggcggccagagguggggccgucgggggccgcguggggagguggccgcgugcggcccccgggcaacucccaggcccuggcgcucgggcgcucgguggcgcgcaggucauugucagugauggugaucucgggcgucacguaccaguugcggcccaggcccucgcccgcgcggcccuucuccgucagcgacgucucggacagggacagugcggcguagcgucugggagagguggacagguucacgacgacgggcgggcgccggccuucgggggacacgccucgcggcucccgcaccucgcgccccagcagguucucguagcugcggccgcggcccaacgggucuucucggcgcggccccggggccagaauguugucccaggagcgcgaguaguggcggcugucgguggccagccggggcggacuggugccggugccgccgugccaggaggcgagcaacgggucggggucagagggcggcaccacuugcagggugcgguacggucgcgggccccaguccgcccaggccgggcugcugcgcgggugcggguacguccgagccaggacgucacgcucgcgguaccuuccgaaguccuccguguaaaaggggcgggcgguggagugggcccggggcuccucggggacauagcggggcccguagggcaggccguaggcucguggagccuccccauaguaggagcgggagggcgguuccuggauugggaaggugcgcaccucuccugcguaguagccgcccaugcgccuuggacugggccccgagagcuccucggacggauagggccugggguaguaggcgucgaagguugggccgggacuggcugcaaagcugccccggaagccuuggggcuccucuguauagaagaacuggguggggcccggcgggguggugaagggcagacugcggcgcucggcguagucccggggcccaggcaggggcccgucgcaguagaacgcccggggauccgcacaguaugagucgcugggcgucggggugcgcgacagcgccauguggcggggcccgggcaccgugaggccguggaacugcggggcggggcgggcccagugcgcggccucggugggcccgcaggaccgcgagccccggguggcgugcuggagcacugcgucgucuggcuugauguccaggcggcagcgcacguggggggcgggacccgcggguggcucgggcggugcgcagcggcccgcggcggcgcacaggggcgcgacgcggccggggccgccccgcugcggcugcaacuugaugggaugcagcucguuggcaagggcgcggagcgccggguacgcgggcucccggcgcggcgaugccucggcccgcgccgcacgcugggccucccgcccucggcggggcaacaccggcggcgaggcgggcgcgggcgucaggcccgggggcgcgcggggcgcacucuuggagcgggcgcggcggcguggcucggcuucgcggguccgggcgcgcggcacagcggacuccggcggcgguggcuccggcagggucuccauggccggcccguccagcgccuccaggaagucgaagcugcggcaguggcgcuuguugaaaggcgcgggcucagcaggccgggccacggaucgcucacauggcgagcacuuggacgcgggucccggggucgccaccuugauguccugguacacggucgacaccagcagguccggaggguccguacgggucaucuuaaaagagguccccaggcuggcggcuccagcucacacugccuugcggggcuuuugcccuggggggagacgcgggucagggcggcccccuccgcagcccaggccccgcuacucccccacgcuggcccggcuuaccuggggcgcagcgggcggagcagcccuggcugcgggccugggccgagaacgcgggcgcuuccuccaugccggggucagaagcaccugcgggaggaacccagcuguccaggcgcccguccugcccguccccccguccucucccugcgauggggcgggcgggccagaaaggcuuagccgugguugugguucccgcggcgggagcucccgcgugaagcuccagggccuccccucccccgacuagugacggcggggucggcucggguggaccccuuuccgggugggguaggggagugggggcgugguccuggggcugcgcccucugguguccgcaguuggaaggacgggccgcauuugggccuuauuuauagguguugccccaggagacgucagugacugcgcccccgucacagcgcccacugcagagcgaccccuccgaucgcgcacaguggaaggcgagucccugggccucagccuuagccggcucugcaccaagugggugacaccaaccaccccaccugcuggccgggccgagcacagagccccgcccccagcacugcaaggacccacgccuaggugcccucaacuucccgcgagccccaggccagaaaaaugcccccagagagcauacccgggcccuaaaucucccuuuccucugccgacaccuuuucugaccccaaguaucuuuggguggu

SEQ ID NO: 19302 - RNA, 2630 nt, Homo sapiens
accacccaaagauacuuggggucagaaaaggugucggcagaggaaagggagauuuagggcccggguaugcucucugggggcauuuuucuggccuggggcucgcgggaaguugagggcaccuaggcguggguccuugcagugcugggggcggggcucugugcucggcccggccagcagguggggugguuggugucacccacuuggugcagagccggcuaaggcugaggcccagggacucgccuuccacugugcgcgaucggaggggucgcucugcagugggcgcugugacgggggcgcagucacugacgucuccuggggcaacaccuauaaauaaggcccaaaugcggcccguccuuccaacugcggacaccagagggcgcagccccaggaccacgcccccacuccccuaccccacccggaaagggguccacccgagccgaccccgccgucacuagucgggggaggggaggcccuggagcuucacgcgggagcucccgccgcgggaaccacaaccacggcuaagccuuucuggcccgcccgccccaucgcagggagaggacggggggacgggcaggacgggcgccuggacagcuggguuccucccgcaggugcuucugaccccggcauggaggaagcgcccgcguucucggcccaggcccgcagccagggcugcuccgcccgcugcgccccagguaagccgggccagcgugggggaguagcggggccugggcugcggagggggccgcccugacccgcgucuccccccagggcaaaagccccgcaaggcagugugagcuggagccgccagccuggggaccucuuuuaagaugacccguacggacccuccggaccugcuggugucgaccguguaccaggacaucaagguggcgaccccgggacccgcguccaagugcucgccaugugagcgauccguggcccggccugcugagcccgcgccuuucaacaagcgccacugccgcagcuucgacuuccuggaggcgcuggacgggccggccauggagacccugccggagccaccgccgccggaguccgcugugccgcgcgcccggacccgcgaagccgagccacgccgccgcgcccgcuccaagagugcgccccgcgcgcccccgggccugacgcccgcgcccgccucgccgccgguguugccccgccgagggcgggaggcccagcgugcggcgcgggccgaggcaucgccgcgccgggagcccgcguacccggcgcuccgcgcccuugccaacgagcugcaucccaucaaguugcagccgcagcggggcggccccggccgcgucgcgccccugugcgccgccgcgggccgcugcgcaccgcccgagccacccgcgggucccgccccccacgugcgcugccgccuggacaucaagccagacgacgcagugcuccagcacgccacccggggcucgcgguccugcgggcccaccgaggccgcgcacugggcccgccccgccccgcaguuccacggccucacggugcccgggccccgccacauggcgcugucgcgcaccccgacgcccagcgacucauacugugcggauccccgggcguucuacugcgacgggccccugccugggccccgggacuacgccgagcgccgcagucugcccuucaccaccccgccgggccccacccaguucuucuauacagaggagccccaaggcuuccggggcagcuuugcagccagucccggcccaaccuucgacgccuacuaccccaggcccuauccguccgaggagcucucggggcccaguccaaggcgcaugggcggcuacuacgcaggagaggugcgcaccuucccaauccaggaaccgcccucccgcuccuacuauggggaggcuccacgagccuacggccugcccuacgggccccgcuauguccccgaggagccccgggcccacuccaccgcccgccccuuuuacacggaggacuucggaagguaccgcgagcgugacguccuggcucggacguacccgcacccgcgcagcagcccggccugggcggacuggggcccgcgaccguaccgcacccugcaaguggugccgcccucugaccccgacccguugcucgccuccuggcacggcggcaccggcaccaguccgccccggcuggccaccgacagccgccacuacucgcgcuccugggacaacauucuggccccggggccgcgccgagaagacccguugggccgcggccgcagcuacgagaaccugcuggggcgcgaggugcgggagccgcgaggcgugucccccgaaggccggcgcccgcccgucgucgugaaccuguccaccucucccagacgcuacgccgcacugucccuguccgagacgucgcugacggagaagggccgcgcgggcgagggccugggccgcaacugguacgugacgcccgagaucaccaucacugacaaugaccugcgcgccaccgagcgcccgagcgccagggccugggaguugcccgggggccgcacgcggccaccuccccacgcggcccccgacggccccaccucuggccgccagcggagccuagagcagcuggacgagcucaucacggaccuggucaucgacucgcgacccaccgccggccaggccucagagccc

SEQ ID NO: 19303 - RNA, 2604 nt, Homo sapiens
aaagaacagggggccgcgcccgccccacguccgcuccgccccgggccagccccuuccucgcugcgacucgcccgcuguccccacccccucgcccgcggcgcccagugggaggcgggggcuggccucgccgagcccagcgccgggcucugauuugcugcgggcguuggggaucgacagccuccgcggcugccuuccaggagagagggagggaggaaaagggggaaaaaagugcuccgcgccgaaggcgagguccgcacucuccguccccgcggcuggcgcaggaccucacucgagcggagcgcccacggggagcgggucgcggggcggcggcggcgaggaggaggcgagaaggaguuggaggaggaggaggaggaggcgagggcgagcuagcccagcggggucccggccgccccgcgggccaaagucgagcccucccgcccgugggcgagcgcgccagccgccccuuccagaacagccgccgccacaaagaagaacggggggugccgagguccccaugaccuccuaaaguggugcggucccugcugagugcgcugcccgggccgugacccgcgccccugugcguccccgcgcgccuccgagcgccccugugcgccccggcccgcgccccgccggcauggacguccauacccgcuggaaagcgcgcagcgcgcuccgcccgggcgccccgcugcugcccccgcugcugcugcugcugcugugggcgccgccuccgagccgcgcagguaagggcgccccggggcgcggggcugcgggauggggcgcgcgcagcccgggcgccgcugucauccccgggcgccuucgcccgcagaacuuuucuuccuuggccuguggaaugcacgggccaagaccacgaaugccauuugcugggggcccccccgagaugacgacacgcagacacaaugcccgcgggcgcgccgccgcccccuccccagacgggcgggucggguggggcugucgcgcgagccgaggaaggaccgagggcuggaucagcaggagggguuguccacgaggcgggcaaacuuuugucccaaaaaccuuccuucucugucccacaucacaggcgcccagcuugggcccucacagcccuacagcagaacuuccucugcuccaaaccgggcagggccgcccccuagaguuacagcccuucaaaucccgggacuccuggggauggggggaaucccagaagccugggcccccagcacugaacuucccccaggcacugucacucuaggcugagcuggcgcccugcuuuccccagggacagcguuuccugcagccuuggucaccuaaguguucgggggcacuggggaccccugcagggugguagacagcccugcuccuaaucccacccccaaacuucuugaucccuggaaggcagcuuuuccuggauucgcugcugagagaugggaugcguggagcaaagccagagaugggcuugcaggcggggcugugagugguugggaugauaugcagaugugggauuccuucugccaagggucagcccuuagaaggaggcuugcuucccggggagggcgcuucaaggcggggacugucugcgucccugccuggguucucgaggguucaacucucccuggcgcagcuuccugacgggggaguuuuucuaggcaucgcucuugguaguuaguggcgggguggguuuucacagacucucgaacaucagagcccccagcccuggaaggucccccgaauccuuauugacaggcggggagauggaggcucagagcugugugcugccaggucaggagaaguggcgggcagagcgaugggacggugggcucagcgaacgucuggaccagcccgccgccugccagcaagaaugcuucucucugcuucacgauuggaagacaagugggaagaaucauuguccguguuccgcuugucaauuaaaacacucuuuuccuuuuucccuggcacgaucagugcuuguugggcuaacuggaugagcuggagucugggugugggggcugcccuggggcucugggggaggagccaggagccuggccuggcucccaggaccugggaucucaucccugggccgccaccaacucucuccugacccugggcuaacugggcuuguguuucuccagggguuagcugaaggugggggacaacagagguccccagaaaaguggagaggagaaggaagguguggucagggacugugccauugccgggggacuaggcccugucucagcgccucuggggacuuuuccccagaaacucaggagggaguccuucaggggaaucgucacccuagacagcuggggcagggcacugccuggggaccaugcaccggacugggcuugggguuccauuucccucccugcccaucuccccaccuccacacugucuuuuucccucucugguugcccucgcuaaucgaagugcggcucguuggaagugggagugaggauggcccagagcagcaggcuauggaguuggacauuuugcuuuugucagaacagacuuuuagaagcauguggagagaccacuuuucuuagugaguuuugccaacgucucuccaccucccagggugggaccuauuuggaagucauccuucga

SEQ ID NO: 19304 - RNA, 2604 nt, Homo sapiens
ucgaaggaugacuuccaaauaggucccacccugggagguggagagacguuggcaaaacucacuaagaaaaguggucucuccacaugcuucuaaaagucuguucugacaaaagcaaaauguccaacuccauagccugcugcucugggccauccucacucccacuuccaacgagccgcacuucgauuagcgagggcaaccagagagggaaaaagacaguguggagguggggagaugggcagggagggaaauggaaccccaagcccaguccggugcaugguccccaggcagugcccugccccagcugucuagggugacgauuccccugaaggacucccuccugaguuucuggggaaaaguccccagaggcgcugagacagggccuagucccccggcaauggcacagucccugaccacaccuuccuucuccucuccacuuuucuggggaccucuguugucccccaccuucagcuaaccccuggagaaacacaagcccaguuagcccagggucaggagagaguugguggcggcccagggaugagaucccagguccugggagccaggccaggcuccuggcuccucccccagagccccagggcagcccccacacccagacuccagcucauccaguuagcccaacaagcacugaucgugccagggaaaaaggaaaagaguguuuuaauugacaagcggaacacggacaaugauucuucccacuugucuuccaaucgugaagcagagagaagcauucuugcuggcaggcggcgggcugguccagacguucgcugagcccaccgucccaucgcucugcccgccacuucuccugaccuggcagcacacagcucugagccuccaucuccccgccugucaauaaggauucgggggaccuuccagggcugggggcucugauguucgagagucugugaaaacccaccccgccacuaacuaccaagagcgaugccuagaaaaacucccccgucaggaagcugcgccagggagaguugaacccucgagaacccaggcagggacgcagacaguccccgccuugaagcgcccuccccgggaagcaagccuccuucuaagggcugacccuuggcagaaggaaucccacaucugcauaucaucccaaccacucacagccccgccugcaagcccaucucuggcuuugcuccacgcaucccaucucucagcagcgaauccaggaaaagcugccuuccagggaucaagaaguuugggggugggauuaggagcagggcugucuaccacccugcagggguccccagugcccccgaacacuuaggugaccaaggcugcaggaaacgcugucccuggggaaagcagggcgccagcucagccuagagugacagugccugggggaaguucagugcugggggcccaggcuucugggauuccccccauccccaggagucccgggauuugaagggcuguaacucuagggggcggcccugcccgguuuggagcagaggaaguucugcuguagggcugugagggcccaagcugggcgccugugaugugggacagagaaggaagguuuuugggacaaaaguuugcccgccucguggacaaccccuccugcugauccagcccucgguccuuccucggcucgcgcgacagccccacccgacccgcccgucuggggagggggcggcggcgcgcccgcgggcauugugucugcgugucgucaucucgggggggcccccagcaaauggcauucguggucuuggcccgugcauuccacaggccaaggaagaaaaguucugcgggcgaaggcgcccggggaugacagcggcgcccgggcugcgcgcgccccaucccgcagccccgcgccccggggcgcccuuaccugcgcggcucggaggcggcgcccacagcagcagcagcagcagcgggggcagcagcggggcgcccgggcggagcgcgcugcgcgcuuuccagcggguauggacguccaugccggcggggcgcgggccggggcgcacaggggcgcucggaggcgcgcggggacgcacaggggcgcgggucacggcccgggcagcgcacucagcagggaccgcaccacuuuaggaggucauggggaccucggcaccccccguucuucuuuguggcggcggcuguucuggaaggggcggcuggcgcgcucgcccacgggcgggagggcucgacuuuggcccgcggggcggccgggaccccgcugggcuagcucgcccucgccuccuccuccuccuccuccaacuccuucucgccuccuccucgccgccgccgccccgcgacccgcuccccgugggcgcuccgcucgagugagguccugcgccagccgcggggacggagagugcggaccucgccuucggcgcggagcacuuuuuucccccuuuuccucccucccucucuccuggaaggcagccgcggaggcugucgauccccaacgcccgcagcaaaucagagcccggcgcugggcucggcgaggccagcccccgccucccacugggcgccgcgggcgaggggguggggacagcgggcgagucgcagcgaggaaggggcuggcccggggcggagcggacguggggcgggcgcggcccccuguucuuu

SEQ ID NO: 19305 - RNA, 2510 nt, Homo sapiens
ccggaagugcacucgggacgccgggguucuggaggagagaccacacgccgcaaaaguggccuccgaaugcgcccggggccugcccucggcgacacugcuggcucggcggccgcagccuaccugaaguaguccaucuugcagaagaucuccuuguucuugauguagcagcuguucugcugccucagcgacgugcgacacacggagcacucgaggcaccgcacgugccagaugagguuguugaccuggggacggggcggggacggaggucggcucagcgcgggccucuuucacuccgggccccagccuucccggucucauuuacagucagaggcgcugaagcucagaaggugcaugcgauuccccuauuuuucucccguaauacugagacucagggaaauggaaauaaacucuucuuauuuuucagacggaacccgggggcucaggcagacccuaagucuugcccaaagcuucgcagucgggcagcaguggagccaggauuuggaaguaagaggaccugcggugcuucccugcagucuccugcgcugcgucccacgccccgacaacacgcacgcaacaccuaccccugucucaccuugagcagauaucgguccaggaucucgaggccgcagcuggagcagauguucuugccugcagacggcacggaggaggcggcagagggcggugagcagacagauggcgugcugggcguacauggggaggccugacccucguccuuguccagagcuccugccagggccucggcgucagacugagccugcggcgggggagagaaggagaggagcgcugauccgggcacccagaguuggggcugccuuggagacaaaucuggggcccccgagcaccaauugacaacgaaaucuccccaggacaaugcgccguagacugaaggacagggauggaagggccuauuggagaggaagggacggccccaacuuuuaacacgcgcauucugggugcugggagcgguuaaagccaacauucccugccggaaaaccgaggcucagagaggggcggcgcccgccgggagucccccagagcgugagcagcaguucguggccggaaaaccuggccagguccccagggccgggccgcuggaggacugggcaccgcaggcagggccaaacggacucaccauggcgggcggcgcggucccuucaagacagcggguggucgcuuugcagccggacccuggcugggccaucaccugggggagggggggagggaacgcaggcggcggcggcugcugaacuggcuccgcacagccugagcccagcgccuccccgcgccuguuauauaaaccggcgccgaacaaugaguccuaacuuuguagugggcauuuaaagcccuuccccacaaaagcggugucucucuaaugaagcaauuugaauuuggauuggauuuuuucccucucucucccccucucccugcacuuaacccguggcucuugaaguaaucgcuuaguucccuugcaauccaagccucugaggggggaagaaaaacacgcgcacacacacacaaacuaccugcaauuagaaauugucgugaaugcccaagauaagagguagccagagugucaauuccaacugucaaucagugagauccaucaggccgcccaaagaauugcaaauuugauuuuuuaaugguaguaauuaaaaaucgaauuuuuucucucuccacccgcccccccaccccacuccccuuccucgcucccuucuccucucggcacaaaaugcaaaaaggagaaaagagagaaagaaagaaaauaaaaaagagaugggugaggggcggagggugguugaagaaaagaaaaccccgagcgcggugagcacccgcccgcccgcccgccugacacgcgcggcgaaauugaagcagcuauauugacacggauucaggcgccuuucgagggccagucggagggaaacccggagcaaaaagagagcgagaucggggcgaaacgggaccaaaaagagaaaagagaggcgcucaaggggaggaaaaagcacccuccagccccucggcgcgccggguaccggccccgcgucgggauucucagcgcugcgccggcacaacccccggcgcaucggcgcuaucagcgccuauucagacggacaauaccggccucgccuccucuugauucgccugugucuuuacuaaaucgcuuuuugagaaauuccuccaacauuugcauaauguguucccgcuuuccgcgaccccccccccccgcucgcgcgcgcgcucccacacucacaagcacacacucacaggcgcacccucguaccccuccuuccugcaaccgcccgccacccugcucggcccggcugggucccggacccugcccgaccccggcccgggccgcucacccagucguucgccggcucaccuggucgguggcggggccgcccucggccggcagccggcagcccucgggcaacgccggggcggcguucucaugcuuccaguacaugggccggggaaccucgggcucagcg

SEQ ID NO: 19306 - RNA, 2510 nt, Homo sapiens
cgcugagcccgagguuccccggcccauguacuggaagcaugagaacgccgccccggcguugcccgagggcugccggcugccggccgagggcggccccgccaccgaccaggugagccggcgaacgacugggugagcggcccgggccggggucgggcaggguccgggacccagccgggccgagcaggguggcgggcgguugcaggaaggagggguacgagggugcgccugugagugugugcuugugagugugggagcgcgcgcgcgagcggggggggggggucgcggaaagcgggaacacauuaugcaaauguuggaggaauuucucaaaaagcgauuuaguaaagacacaggcgaaucaagaggaggcgaggccgguauuguccgucugaauaggcgcugauagcgccgaugcgccggggguugugccggcgcagcgcugagaaucccgacgcggggccgguacccggcgcgccgaggggcuggagggugcuuuuuccuccccuugagcgccucucuuuucucuuuuuggucccguuucgccccgaucucgcucucuuuuugcuccggguuucccuccgacuggcccucgaaaggcgccugaauccgugucaauauagcugcuucaauuucgccgcgcgugucaggcgggcgggcgggcgggugcucaccgcgcucgggguuuucuuuucuucaaccacccuccgccccucacccaucucuuuuuuauuuucuuucuuucucucuuuucuccuuuuugcauuuugugccgagaggagaagggagcgaggaaggggaguggggugggggggcggguggagagagaaaaaauucgauuuuuaauuacuaccauuaaaaaaucaaauuugcaauucuuugggcggccugauggaucucacugauugacaguuggaauugacacucuggcuaccucuuaucuugggcauucacgacaauuucuaauugcagguaguuugugugugugugcgcguguuuuucuuccccccucagaggcuuggauugcaagggaacuaagcgauuacuucaagagccacggguuaagugcagggagagggggagagagagggaaaaaauccaauccaaauucaaauugcuucauuagagagacaccgcuuuuguggggaagggcuuuaaaugcccacuacaaaguuaggacucauuguucggcgccgguuuauauaacaggcgcggggaggcgcugggcucaggcugugcggagccaguucagcagccgccgccgccugcguucccucccccccucccccaggugauggcccagccaggguccggcugcaaagcgaccacccgcugucuugaagggaccgcgccgcccgccauggugaguccguuuggcccugccugcggugcccaguccuccagcggcccggcccuggggaccuggccagguuuuccggccacgaacugcugcucacgcucugggggacucccggcgggcgccgccccucucugagccucgguuuuccggcagggaauguuggcuuuaaccgcucccagcacccagaaugcgcguguuaaaaguuggggccgucccuuccucuccaauaggcccuuccaucccuguccuucagucuacggcgcauuguccuggggagauuucguugucaauuggugcucgggggccccagauuugucuccaaggcagccccaacucugggugcccggaucagcgcuccucuccuucucucccccgccgcaggcucagucugacgccgaggcccuggcaggagcucuggacaaggacgagggucaggccuccccauguacgcccagcacgccaucugucugcucaccgcccucugccgccuccuccgugccgucugcaggcaagaacaucugcuccagcugcggccucgagauccuggaccgauaucugcucaaggugagacagggguagguguugcgugcguguugucggggcgugggacgcagcgcaggagacugcagggaagcaccgcagguccucuuacuuccaaauccuggcuccacugcugcccgacugcgaagcuuugggcaagacuuagggucugccugagcccccggguuccgucugaaaaauaagaagaguuuauuuccauuucccugagucucaguauuacgggagaaaaauaggggaaucgcaugcaccuucugagcuucagcgccucugacuguaaaugagaccgggaaggcuggggcccggagugaaagaggcccgcgcugagccgaccuccguccccgccccguccccaggucaacaaccucaucuggcacgugcggugccucgagugcuccgugugucgcacgucgcugaggcagcagaacagcugcuacaucaagaacaaggagaucuucugcaagauggacuacuucagguaggcugcggccgccgagccagcagugucgccgagggcaggccccgggcgcauucggaggccacuuuugcggcguguggucucuccuccagaaccccggcgucccgagugcacuuccgg

SEQ ID NO: 19307 - RNA, 3318 nt, Homo sapiens
ugggaugguuuuugcuauuaagccgauuuuauagaugagaauacugagggcuagaaaagauaaguaccuuguccaaggugacacggccaguaagcuguggagucuggauuugaacuaggcucucuuggaguuuggagcccggucuuuucauuucuggcagagaccuguggcuucagggggcggagcccagcccaugggggaaguaaguccuuccuguuagaucugucugaggaguagugaguuucucaucuaggaaaccaucagcaggccaggcuggacugccccauuucuagcccccuuucuucucugcagacugcccuguuucuagccccuuuucuucucuacccuuuucuguagagugcguuagacccauuuuacagaaggggacucugagacccuuucuucucugcggggcaggguaugugguucagacgagccgcuuccauccccaguucugucccuaagcccugggugaccucagcauugagcaucgucucugagccucaguuuccugucuauaucuagugccaccaggcaucagaaacguaagugcuucaaggaucuugggugaaaagccgcuuuagcggcgagcauacacuaauuaauaaaaugccuuggccggggcugggcagaggaaguaagcgggcagccgaggugacagcuggagggaggagcggggguggagccgggggaaggguggggaggggaugggcuggagcuccgggcagugugcgaggcgcacgcacaggagccugcacucugcgucccgcaccccagcagccgcgccaugagccgugagugcgaccccggugcccgguggggaauuuucuuggccuccugguggagccuugaaugccaggcucagccccucaucucucuccucugcagggagucucuugcucugguucuugcuguuccugcuccugcucccgccgcuccccguccugcucgcggacccaggggcgcccacgccagguaggcggccccaucccuccccaagggaauccccggucuugcgccccuggccugguuucaacccccuccuuuccccuccagcgggcccagcuuccccuuucugcucgcggugcugagaaagacugaggcugagucuuuuggugggaugggggcucccugaagcccccccggcgguguggccuuggcuaaugggcuaucuaguucuuucaggggaaacagcagacugggaucuggugccaacuuggggagaagggacagucccuauccaucccccucaccuguucugggccccagaugucuaagcagccucugcacccaacaaccccgcuguuuccuauaggggccucuuugggaggaagccgcaggcaccaagggaaaugaguucccuuucuccagccucuaaccgucugggaacccauccugauucccauugccaguggagaaggucuccccuggugaagacuucgggagaacaugggagauggaaauacauuuaggagccgggaugcuucaucugggguuuaagagauccccauugagcaaaugaggaaaccgaggcucaguaggugccaugauuccccaagcucacaaaauacauggugggcccaggaucugaacucaggucugucugcguccacacacuucgcaaggucuuuccacagaaagcugcuucuacccacaauggacccggagccacucuggguuucaugggggagguugauggggaaauuccgcccuucccucccccaugcaugugccagguuccaggugaaggaauucagcuccucgcucagccaaccuuccucccccagcucgcugcuugugugugugcgugugugugagcaugugucccaguuggauauaguuuccuccaccaccuagcuguguaaaaucucuaaaaugaggcccagagagggcaggagggagcagagggaguccgcacuuucugcugugaugcucuaaggaucuggugcgugggggaaagaggaaagauauguacauggauuuuggaucagaccaaguuuccugaaacgggcuuuggguggguggcauuuaggggacccaaagagaggacggagggugcucuaggaaagggauugcguugaauaaaagucugguuuaugggaagaggaggaggaagacucauguggccagcacuuuaaaguuuacaaagguugguuguggacauccaccucuuuggugcucucaacagcccugccagagagaugcguuagacccagucuacagaaggggacucugaggcccagagggagugaagccacuugucugaauccucacagugagcuggugguggggaguagaaggggcucuucagguugccucgcugacccaucuugucagucccuggaucagcccagcacuuccucugaggccccaucuggccucauccaggcacucuugguauacaggucccacccgucuguauucuuuuuuaguccauucacuaaugcacaaugagccauggucugugcuauuuuguuuuuugccuuuucuguuuccuuuuguauaauaaauguuuacacggaauuguuuuuuuuuauccccaaggguuauuuaugccagucuuuggcuggggccuggagacacggagcugggaggagcugacaggcugaugguggagccagaaaugccaacagacugucauccaaggggaccagggcugugcggagcucaugggaggaagcagggguauagggagcccagggaagggagcaggggugugcggagcucaggggagggagcagcugccucucagugcgaagaauugagggaggcuucuuggaucugaugacuuuuggacuggaccucgaaggagguggcgggugggggaaacacuaagagacucgaccaggaaacaccguaaggguaauguggagcaggaggcugagguuggaugcguaauguggggaugagacuggaggccagaaaacugguaccgaggcuccugcaaggaucuaggaaagaacgaaugacugguggagugcaggggcagaaggucuggguugcccucauauuuccaagucugcgaguaaacugagggccaagcuacuugggcaucugccccaggaagccaaagccugucuuuuaccucuagaggcaaaggagaugaagagaugagggcugcacucaccuaagagggcaggcggagggagagaaugcugcuuuugccucucuggugggugaggagauggaggccagccuggaggcaaggcugugccgggggcgcccugaaugcucaaguacuuccccucuagucucuggacuugacucagugcccaucuucuagauggggauagggcaugaccuggcaaccagagcugc

SEQ ID NO: 19308 - RNA, 3318 nt, Homo sapiens
gcagcucugguugccaggucaugcccuauccccaucuagaagaugggcacugagucaaguccagagacuagaggggaaguacuugagcauucagggcgcccccggcacagccuugccuccaggcuggccuccaucuccucacccaccagagaggcaaaagcagcauucucucccuccgccugcccucuuaggugagugcagcccucaucucuucaucuccuuugccucuagagguaaaagacaggcuuuggcuuccuggggcagaugcccaaguagcuuggcccucaguuuacucgcagacuuggaaauaugagggcaacccagaccuucugccccugcacuccaccagucauucguucuuuccuagauccuugcaggagccucgguaccaguuuucuggccuccagucucauccccacauuacgcauccaaccucagccuccugcuccacauuacccuuacgguguuuccuggucgagucucuuaguguuucccccacccgccaccuccuucgagguccaguccaaaagucaucagauccaagaagccucccucaauucuucgcacugagaggcagcugcucccuccccugagcuccgcacaccccugcucccuucccugggcucccuauaccccugcuuccucccaugagcuccgcacagcccugguccccuuggaugacagucuguuggcauuucuggcuccaccaucagccugucagcuccucccagcuccgugucuccaggccccagccaaagacuggcauaaauaacccuuggggauaaaaaaaaacaauuccguguaaacauuuauuauacaaaaggaaacagaaaaggcaaaaaacaaaauagcacagaccauggcucauugugcauuagugaauggacuaaaaaagaauacagacgggugggaccuguauaccaagagugccuggaugaggccagauggggccucagaggaagugcugggcugauccagggacugacaagaugggucagcgaggcaaccugaagagccccuucuacuccccaccaccagcucacugugaggauucagacaaguggcuucacucccucugggccucagaguccccuucuguagacugggucuaacgcaucucucuggcagggcuguugagagcaccaaagagguggauguccacaaccaaccuuuguaaacuuuaaagugcuggccacaugagucuuccuccuccucuucccauaaaccagacuuuuauucaacgcaaucccuuuccuagagcacccuccguccucucuuuggguccccuaaaugccacccacccaaagcccguuucaggaaacuuggucugauccaaaauccauguacauaucuuuccucuuucccccacgcaccagauccuuagagcaucacagcagaaagugcggacucccucugcucccuccugcccucucugggccucauuuuagagauuuuacacagcuaggugguggaggaaacuauauccaacugggacacaugcucacacacacgcacacacacaagcagcgagcugggggaggaagguuggcugagcgaggagcugaauuccuucaccuggaaccuggcacaugcaugggggagggaagggcggaauuuccccaucaaccucccccaugaaacccagaguggcuccggguccauuguggguagaagcagcuuucuguggaaagaccuugcgaaguguguggacgcagacagaccugaguucagauccugggcccaccauguauuuugugagcuuggggaaucauggcaccuacugagccucgguuuccucauuugcucaauggggaucucuuaaaccccagaugaagcaucccggcuccuaaauguauuuccaucucccauguucucccgaagucuucaccaggggagaccuucuccacuggcaaugggaaucaggauggguucccagacgguuagaggcuggagaaagggaacucauuucccuuggugccugcggcuuccucccaaagaggccccuauaggaaacagcgggguuguugggugcagaggcugcuuagacaucuggggcccagaacaggugagggggauggauagggacugucccuucuccccaaguuggcaccagaucccagucugcuguuuccccugaaagaacuagauagcccauuagccaaggccacaccgccgggggggcuucagggagcccccaucccaccaaaagacucagccucagucuuucucagcaccgcgagcagaaaggggaagcugggcccgcuggaggggaaaggaggggguugaaaccaggccaggggcgcaagaccggggauucccuuggggagggauggggccgccuaccuggcgugggcgccccuggguccgcgagcaggacggggagcggcgggagcaggagcaggaacagcaagaaccagagcaagagacucccugcagaggagagagaugaggggcugagccuggcauucaaggcuccaccaggaggccaagaaaauuccccaccgggcaccggggucgcacucacggcucauggcgcggcugcuggggugcgggacgcagagugcaggcuccugugcgugcgccucgcacacugcccggagcuccagcccauccccuccccacccuucccccggcuccacccccgcuccucccuccagcugucaccucggcugcccgcuuacuuccucugcccagccccggccaaggcauuuuauuaauuaguguaugcucgccgcuaaagcggcuuuucacccaagauccuugaagcacuuacguuucugaugccugguggcacuagauauagacaggaaacugaggcucagagacgaugcucaaugcugaggucacccagggcuuagggacagaacuggggauggaagcggcucgucugaaccacauacccugccccgcagagaagaaagggucucagaguccccuucuguaaaaugggucuaacgcacucuacagaaaaggguagagaagaaaaggggcuagaaacagggcagucugcagagaagaaagggggcuagaaauggggcaguccagccuggccugcugaugguuuccuagaugagaaacucacuacuccucagacagaucuaacaggaaggacuuacuucccccaugggcugggcuccgcccccugaagccacaggucucugccagaaaugaaaagaccgggcuccaaacuccaagagagccuaguucaaauccagacuccacagcuuacuggccgugucaccuuggacaagguacuuaucuuuucuagcccucaguauucucaucuauaaaaucggcuuaauagcaaaaaccauccca

SEQ ID NO: 19309 - RNA, 2870 nt, Homo sapiens
caaaugcuugacaaauuagauaaggcucuuuuguacuuucuuuuuaagcaaagaacuuaucaguuuaaccuuuaaauucucaaaaguggcugggcgcacuggcucauacugguaaacccaacacuuugggaagccaaggugagaggauugcuugaagccugggguuucggaucaacuaggcaacauagcaagaccuugucucuacauuaaaauaaaauaucaagaguaaagucugaagguucuuacuacaguuaugcuugccagcaaaaaguguucuucuguuucuucaacacagagccaucugaccucaccuauuuuacuuaaaaguccccagugacuucugaacacccauggguguauuuugugaaagcagguauguuuuucuuucuuuuuuguuuuuuaaaguaccuuaaccuaauccauuuccaaauccaauuuaauucuaucucauuuugcaaucccugaauacauuucgguauccugacagcugucucaucgucaauucacauaauuuugcagcuccacuuaggaaccuugcuuguaugcucaauaucuuucuaccgauauauuucuuuacucauccuaaugugagaauauaugucaggauauaugaaaauauuuaagcaaugaaaaaccuggggaaagaaaagaaaugaaagucaacagugggaguaauauuugcagaaaggagaaaguuaauuugagcaaaaugaaauaauuaauacacuacauguuuccucuauguaaaaauuauacuaaauaucuuuuagauuagucauguugcuuugagacuuuuccauguuuccucuagacagcugccaauguucgcauggucucugaugaauaaacaugcugugacuugcuucuaaggaaacgccugucauguuccagggaaaaaugacuucuacacucuuaaaucaggaaaacuguacaagucucauucauuagugacaacgucgauuuuuccuuaacguuucuauuucuggaaugcucguauucucauuagggcauuucugcauucagauuaacuaagaaaauaaacuauguuggaggaacacuuaugcuggggggaaaaaucuuguacuacaucaaacgaguuuccuacuugagaaacucaacuagcauccagguuacuccugaacuauuuacuaagaccaagguuauuuucagguuuucuucaucucuugcagaacuaccuguucucauuacuguuuacucaaacgcuuaacaagguaacuauuagcauaucuggcaggaagacaugccucauuuaauauuaacucaccaugugacagcccccuuccucucuucucaaacaugugaggauaaaaagaaaaguagaguuguuugcaaucugauuugcgcuggguuuuggaaccagcaauuggccacaggcacacacacccccaaucagaggcgcgcaccccgcucgcucccggaacugucaugcgggcugacagcuggcacacccuccugucgcccuccacccgccugcagaaagcccacucccuacagucaccuugacauugcucaccugccugggccucagcccaugaccaaggaaacuuuugcccucccuccccaggagcucacuuacagguaucguccaccgcucccccagagcccaaacaagggucccuuuguuacaauuuuugcucccggacuccucacccaauuccuggcauucagcuggccuguagcaacccagggcagccccgguaggaaggcaaccaaaaacgacccgagcccuccgcccgggcggccuccgagaaggccgggaggaagcagccuccccggccgcguggaggacagucagugagucaggccgccggcagggcagcgaguugccagccaggugaaacggccgaggccucgcuguccucgccggccucgcccuccccggugagaggcggcgcggcgcucugggcuuaccuggcuggggcguccugcgggcgcgggguucggccguccaucgcccugcggggcgcugcgcgggcuccagcucccaggcggcgcgucacugcuggggugggagaggccggcgggucagggcgggacgcgcgccuucccgaggccggagcgaagcuggcugagcgucaagagcccgcccgagccgcuccagccccggccggcccgccucccgggugcgcuuccaccugcgggccccggcucccagcccgcgggcgccgccgccgucucuacaaggucuagcgggcgcccagagcacggcggaggaggcgguggcgcugcagcccccgccccgugggguuuacuggguagccauuuggcgccucucggagggagaggagccgccggggcuggaaaaggaggaggagcggggccgggcgcacgggcaccgcugccacgccggcagcgcacucccaggcuccuccggccgaguuugcacaaacaaaacgcccuaggaaaacuuuucccgaagagaaguugggagggcugaucucucuuuucccacccaaggcuccuacguucuuuuccaaaggagacaguagcucgccuguucucccucgcggcuuccucuccuacucuucccuuccccggcccgcgcucuugccgcucggcucucaagccaggacuugaauggagaagcggcaaccccugcgaggcucagcccagcgcgggcagggccgacucagcaccuccccugucccgcgggcggggugcgggcgcuggcugggcgcugggggccucgcuggagcccgcucucucacucacccugccccauuucccugcccggaguccgggagcucgccgccgccucugcagcacggccgcacauaaguggggaccagcucggcggcauuggagcgagggaagcagcgagccggagagaggaacggggcggggguggg

SEQ ID NO: 19310 - RNA, 2870 nt, Homo sapiens
cccacccccgccccguuccucucuccggcucgcugcuucccucgcuccaaugccgccgagcugguccccacuuaugugcggccgugcugcagaggcggcggcgagcucccggacuccgggcagggaaauggggcagggugagugagagagcgggcuccagcgaggcccccagcgcccagccagcgcccgcaccccgcccgcgggacaggggaggugcugagucggcccugcccgcgcugggcugagccucgcagggguugccgcuucuccauucaaguccuggcuugagagccgagcggcaagagcgcgggccggggaagggaagaguaggagaggaagccgcgagggagaacaggcgagcuacugucuccuuuggaaaagaacguaggagccuugggugggaaaagagagaucagcccucccaacuucucuucgggaaaaguuuuccuagggcguuuuguuugugcaaacucggccggaggagccugggagugcgcugccggcguggcagcggugcccgugcgcccggccccgcuccuccuccuuuuccagccccggcggcuccucucccuccgagaggcgccaaauggcuacccaguaaaccccacggggcgggggcugcagcgccaccgccuccuccgccgugcucugggcgcccgcuagaccuuguagagacggcggcggcgcccgcgggcugggagccggggcccgcagguggaagcgcacccgggaggcgggccggccggggcuggagcggcucgggcgggcucuugacgcucagccagcuucgcuccggccucgggaaggcgcgcgucccgcccugacccgccggccucucccaccccagcagugacgcgccgccugggagcuggagcccgcgcagcgccccgcagggcgauggacggccgaaccccgcgcccgcaggacgccccagccagguaagcccagagcgccgcgccgccucucaccggggagggcgaggccggcgaggacagcgaggccucggccguuucaccuggcuggcaacucgcugcccugccggcggccugacucacugacuguccuccacgcggccggggaggcugcuuccucccggccuucucggaggccgcccgggcggagggcucgggucguuuuugguugccuuccuaccggggcugcccuggguugcuacaggccagcugaaugccaggaauugggugaggaguccgggagcaaaaauuguaacaaagggacccuuguuugggcucugggggagcgguggacgauaccuguaagugagcuccuggggagggagggcaaaaguuuccuuggucaugggcugaggcccaggcaggugagcaaugucaaggugacuguagggagugggcuuucugcaggcggguggagggcgacaggagggugugccagcugucagcccgcaugacaguuccgggagcgagcggggugcgcgccucugauugggggugugugugccuguggccaauugcugguuccaaaacccagcgcaaaucagauugcaaacaacucuacuuuucuuuuuauccucacauguuugagaagagaggaagggggcugucacauggugaguuaauauuaaaugaggcaugucuuccugccagauaugcuaauaguuaccuuguuaagcguuugaguaaacaguaaugagaacagguaguucugcaagagaugaagaaaaccugaaaauaaccuuggucuuaguaaauaguucaggaguaaccuggaugcuaguugaguuucucaaguaggaaacucguuugauguaguacaagauuuuuccccccagcauaaguguuccuccaacauaguuuauuuucuuaguuaaucugaaugcagaaaugcccuaaugagaauacgagcauuccagaaauagaaacguuaaggaaaaaucgacguugucacuaaugaaugagacuuguacaguuuuccugauuuaagaguguagaagucauuuuucccuggaacaugacaggcguuuccuuagaagcaagucacagcauguuuauucaucagagaccaugcgaacauuggcagcugucuagaggaaacauggaaaagucucaaagcaacaugacuaaucuaaaagauauuuaguauaauuuuuacauagaggaaacauguaguguauuaauuauuucauuuugcucaaauuaacuuucuccuuucugcaaauauuacucccacuguugacuuucauuucuuuucuuuccccagguuuuucauugcuuaaauauuuucauauauccugacauauauucucacauuaggaugaguaaagaaauauaucgguagaaagauauugagcauacaagcaagguuccuaaguggagcugcaaaauuaugugaauugacgaugagacagcugucaggauaccgaaauguauucagggauugcaaaaugagauagaauuaaauuggauuuggaaauggauuagguuaagguacuuuaaaaaacaaaaaagaaagaaaaacauaccugcuuucacaaaauacacccauggguguucagaagucacuggggacuuuuaaguaaaauaggugaggucagauggcucuguguugaagaaacagaagaacacuuuuugcuggcaagcauaacuguaguaagaaccuucagacuuuacucuugauauuuuauuuuaauguagagacaaggucuugcuauguugccuaguugauccgaaaccccaggcuucaagcaauccucucaccuuggcuucccaaaguguuggguuuaccaguaugagccagugcgcccagccacuuuugagaauuuaaagguuaaacugauaaguucuuugcuuaaaaagaaaguacaaaagagccuuaucuaauuugucaagcauuug

SEQ ID NO: 19311 - RNA, 2667 nt, Homo sapiens
ccacugcccggaccaccgccgcccgccauccgcugcggcacaccaaagucccaggaggccggcgcugagacuggcggcgaagcacaagguggagaagcgcuggccccagggugcugcuccgaggggaucucaccacuuuuccacaucuucuugaacuuggaccggcgguucuggaaccagauuuugaccuuugaggaaaaagaccugagcauuaguggaggaaccuagucuuggggcaguagggguucgaagaggagaaaaaagaaggcagagaaaaaccgcuggcuagcggugggcagcgagcgcccuggggagauaagaggaucacgggcggcggccuucgaggcucugccgguuccugcucccuggggagguaauugccaaaaggccaggacugcugguguacgugcacugugaugauggugacagcgggagggugaggagggccaguuauuucacccgcuuaaucaguagcgagagguacgggauuucuguccacccggucccuuuccuucccucccacggcggccccuuggggguuuccagcuuugggccuagaagcuuacuuagggccgcucgaggcgcaggccuggaaauccuuaaaaguacuuaaaaugaacuuuaaaaagcauuguccuaaacccgccugcuucccagccaucucaggcccgcgcucuccucgccccugcagggcgcgagccccaccugagucugggugaggcccagagaggccgccagcucggcucgcuccggcaaggccaaguauugagucuuuuggaaacgccgcugaagagccgccagcuggaaacuggaguagauggugcgggguuuccggacuuucuuuggcuucccguucacuauccgaauuucaggcucaagguccuccuucucugcaacgauaaagaaucguaagaacagcgcaacccagggguccuggaguucccgcccuccuagagggcccggcgggggggacuuggcuugagcaaagaggugggugcacugaacuguggcgccacgggcaggcgcaacuucgcagcgugcgaucggagccgccaccgaccccgggagcuguacccuccagggaagggggagacaagugcacacccaagagaaagaagcugguggcaaggagaugcccuuaugaggcaggcagagcacgcccacuuggcucuugaggccaccagguccuaccaaaggagagagggacguaaccggcgaccugcggcagauuggaggcuggggaggguaaagggcacaagcgggcggugagcaggcagcgugaaaauccagagcuuucgaaggccccccgccccaaacacguuuacccauccaucccauuaacuagaccgacucggcacucuugacuucagcguuaugcauaccaggcucguuguuggcuggggacgaacugguuccauagggagcguaggagguguaggcggcgguguagcccaggucauagcugcucuuggcggaguaagggacguuguugaggccgcuggcuugguacugguaggaacccaugugcgcguagggcgagcccccgccgccgccgccgcccgccgggugcugcugguugguguaguagcugcugucgguggcgguggacaccggaagggugggcgacuccuggggcuuguggaggcugcugcugcugcugcuguugccacccgggccggcgccgccgccgcucgggggcugcuggugcuggugguacgugcuggaggcggcgaucugggucgagugcauaucagccacuagacugucaaagacuccagucauccuggcccgagacgggaaagagcagagguggcgggcgugcgggggaagccaggcgccuccucugucucucccgguccccuccagcagccaauguaauuacggggguggugguggggaaacaagaaaggaggcaaccgucuaggcgccuccuccuccgggggaggcgaucaccgugcgcugcucgggacagcugccucuggucgcauccucuuucggccucugggcccgcucggcuccuugcccagcgcgagcgcgggcucuggcggggggcgggcaguggagggggcagggguggcugggccgggucggggcucugggaggcgggagcaggugagcggccccgagcggcuuuacgauugucugccaggcgggcuccugaagugugggcauuuaacacucgucacgugagcgcuggcgacgucaccuagcaacagccaaucagaagcaaacggccgcggagcuccgggaacgcccggccaaggggcgggcgucacauggugggcgcuguggcugcggcugcggcugcagcggccccaggugcaaacagacugccgccgaaugugagcagcgaggcgaggggucgagguagcgaggagucaggguggcccgcagcaggaagacagaaggcguggagacagacuggcguuuugccucagaggaagaagugggguccccucucccauucugugagcaagugccaguuccagugauucguacuuucauguccgaggucaguuuucaaacacauuaaaguacaucggugcccagaguccagccagcucuaucuucacuuuuccucgaagugucuggcauuuauucuuguuagccacucggcacuugacauaaucaauugauuuaauuauccacaaaccacguguaaugcuc

SEQ ID NO: 19312 - RNA, 2667 nt, Homo sapiens
gagcauuacacgugguuuguggauaauuaaaucaauugauuaugucaagugccgaguggcuaacaagaauaaaugccagacacuucgaggaaaagugaagauagagcuggcuggacucugggcaccgauguacuuuaauguguuugaaaacugaccucggacaugaaaguacgaaucacuggaacuggcacuugcucacagaaugggagaggggaccccacuucuuccucugaggcaaaacgccagucugucuccacgccuucugucuuccugcugcgggccacccugacuccucgcuaccucgaccccucgccucgcugcucacauucggcggcagucuguuugcaccuggggccgcugcagccgcagccgcagccacagcgcccaccaugugacgcccgccccuuggccgggcguucccggagcuccgcggccguuugcuucugauuggcuguugcuaggugacgucgccagcgcucacgugacgaguguuaaaugcccacacuucaggagcccgccuggcagacaaucguaaagccgcucggggccgcucaccugcucccgccucccagagccccgacccggcccagccaccccugcccccuccacugcccgccccccgccagagcccgcgcucgcgcugggcaaggagccgagcgggcccagaggccgaaagaggaugcgaccagaggcagcugucccgagcagcgcacggugaucgccucccccggaggaggaggcgccuagacgguugccuccuuucuuguuuccccaccaccacccccguaauuacauuggcugcuggaggggaccgggagagacagaggaggcgccuggcuucccccgcacgcccgccaccucugcucuuucccgucucgggccaggaugacuggagucuuugacagucuaguggcugauaugcacucgacccagaucgccgccuccagcacguaccaccagcaccagcagcccccgagcggcggcggcgccggcccggguggcaacagcagcagcagcagcagccuccacaagccccaggagucgcccacccuuccgguguccaccgccaccgacagcagcuacuacaccaaccagcagcacccggcgggcggcggcggcggcgggggcucgcccuacgcgcacauggguuccuaccaguaccaagccagcggccucaacaacgucccuuacuccgccaagagcagcuaugaccugggcuacaccgccgccuacaccuccuacgcucccuauggaaccaguucguccccagccaacaacgagccugguaugcauaacgcugaagucaagagugccgagucggucuaguuaaugggauggauggguaaacguguuuggggcggggggccuucgaaagcucuggauuuucacgcugccugcucaccgcccgcuugugcccuuuacccuccccagccuccaaucugccgcaggucgccgguuacgucccucucuccuuugguaggaccugguggccucaagagccaagugggcgugcucugccugccucauaagggcaucuccuugccaccagcuucuuucucuugggugugcacuugucucccccuucccuggaggguacagcucccggggucgguggcggcuccgaucgcacgcugcgaaguugcgccugcccguggcgccacaguucagugcacccaccucuuugcucaagccaagucccccccgccgggcccucuaggagggcgggaacuccaggaccccuggguugcgcuguucuuacgauucuuuaucguugcagagaaggaggaccuugagccugaaauucggauagugaacgggaagccaaagaaaguccggaaaccccgcaccaucuacuccaguuuccagcuggcggcucuucagcggcguuuccaaaagacucaauacuuggccuugccggagcgagccgagcuggcggccucucugggccucacccagacucagguggggcucgcgcccugcaggggcgaggagagcgcgggccugagauggcugggaagcaggcggguuuaggacaaugcuuuuuaaaguucauuuuaaguacuuuuaaggauuuccaggccugcgccucgagcggcccuaaguaagcuucuaggcccaaagcuggaaacccccaaggggccgccgugggagggaaggaaagggaccggguggacagaaaucccguaccucucgcuacugauuaagcgggugaaauaacuggcccuccucacccucccgcugucaccaucaucacagugcacguacaccagcaguccuggccuuuuggcaauuaccuccccagggagcaggaaccggcagagccucgaaggccgccgcccgugauccucuuaucuccccagggcgcucgcugcccaccgcuagccagcgguuuuucucugccuucuuuuuucuccucuucgaaccccuacugccccaagacuagguuccuccacuaaugcucaggucuuuuuccucaaaggucaaaaucugguuccagaaccgccgguccaaguucaagaagauguggaaaaguggugagauccccucggagcagcacccuggggccagcgcuucuccaccuugugcuucgccgccagucucagcgccggccuccugggacuuuggugugccgcagcggauggcgggcggcggugguccgggcagugg

SEQ ID NO: 19313 - RNA, 2539 nt, Homo sapiens
cucugcucgcugcuucucucccuucccccuuccucccccucuucccccuccuuccuccuccccgccggccucgguccgcguacuuaaagcggcgcgggagggcggacgcgggcgggcggcccguucgggcgguggcagaugcgcccagcggugacagcggccagcggcgcgcaggugaccggccugaggcgcagccuggucagggagcgcccggggagagcuggcggcagagggcagccgauccgcccccagcgcgcgcgucucggcgccaggagccgucccggggcguguuggcgagcguugauauagauauaaggacauuucucuucauggcgucacgugacauaauuaccaccagaaucaaucaagaugaauugcacgucagcgcccgguggggauuuuugcuuaguugauccuggcccaagccucuugugcaaucgauggcucagguuggcugcgcggggagcggccagaggcucgcuggcgcgcacgccgcggagucaugaacgacuuugacgagugcggccagagcgcagccagcauguaccugccgggcugcgccuacuauguggccccgucugacuucgcuagcaagccuucguuccuuucccaaccgucguccugccagaugacuuuccccuacucuuccaaccuggcuccgcacguccagcccgugcgcgaaguggccuuccgcgacuacggccuggagcgcgccaaguggccguaccgcggcggcggcggcggcggcagcgcggggggcggcagcagcgggggcggccccggcgggggcggcggcggcgcggggggcuacgcucccuacuacgcggcggcggcggcggcggcugcggcggccgcggcggccgaggaggcggccaugcaacgcgagcuucucccgcccgcgggccgccggccggacgugcucuucaaggcgccugagccggugugcgcugcgccggggccgccgcacggccccgcgggcgccgccuccaacuucuacagcgcggugggccgcaauggcaucuugccacagggcuucgaccaguucuacgaggcagcgcccgggcccccguucgccgggccgcagcccccgccgccacccgcgccgccacagcccgagggcgcagccgacaagggcgaccccaggaccggggcugguggcggcgggggcagucccugcaccaaggcgaccccuggcucggagcccaagggggcagcagaaggcagcgguggcgacggcgagggccccccgggagaggcgggggccgagaagagcagcagcgcagguaggcaccggguacugggcaagcggugggcccgggggccgcgggggagggggggggggcggaggccucccucugcuugcgccuuuuuaugugcuacuuuauaagcauucgaagagguuuauacauccuauaagauuuccugggccguuguaaaguguguuuaugguaggaaaccaauuuaggugggcuuaagguagacuucgaggaggacauuaauagcugucgagagccuuuucccaguuuugggcaggggguugcuagauaccauggagggagggagggagggagauuucaagccagugugagugcauacaccggagccuccugcuuuuaagggagagaggcgggggguggggaaguggggggaguuugauccuugcacuggacuuuauccaagccgcuagcugacgcgcgccgcuggagucaagcagaugccccggcgggccugcucuugucucuguucccucagguuccaguuuagagccugccuugcccucugcuuccccaccuccgugccaggcucuguguguguguguguguguguguguguguguguguguguccgggcgugaacacauguccacgcccgcacucucuccugugcccgcccauauaucaucccccacgacgcaggcagggccuuucggccgcggcagagaacguccccaacggggccagggccuggcccucgcucaguggcccgggcgggcgggcgggugggggcugucaggcagcggccucucucacccccuggucucuuugccuugcaguugccccccagcggucccggaaaaagcgcugucccuauaccaaguaccagauccgcgaacuggaacgcgaguuuuucuuuaacguguacauaaacaaagagaaaagacuucaacucucucggaugcucaaccucacugaccggcaagucaaaaucugguuccagaaucgcaggaugaaagaaaagaaacugaacagagaccgucugcaguauuucacuggaaaccccuuauuuugagagcuccaggaagcgcccucaccccagccccacucacccacccuccuucccaccagccugcucuccgcaggcccacuguccuuggguuuaaugacgucucuucucuguggaacuucacgauuccuucccacggucaacucgggaccucccagcgaccacugcagccugcggacgaggccgggacuuggccgagcggauccuaauaaggggaaaaugguaaaugcaaacgucccguuacaauuuuaccgcc

SEQ ID NO: 19314 - RNA, 2539 nt, Homo sapiens
ggcgguaaaauuguaacgggacguuugcauuuaccauuuuccccuuauuaggauccgcucggccaagucccggccucguccgcaggcugcaguggucgcugggaggucccgaguugaccgugggaaggaaucgugaaguuccacagagaagagacgucauuaaacccaaggacagugggccugcggagagcaggcuggugggaaggagggugggugaguggggcuggggugagggcgcuuccuggagcucucaaaauaagggguuuccagugaaauacugcagacggucucuguucaguuucuuuucuuucauccugcgauucuggaaccagauuuugacuugccggucagugagguugagcauccgagagaguugaagucuuuucucuuuguuuauguacacguuaaagaaaaacucgcguuccaguucgcggaucugguacuugguauagggacagcgcuuuuuccgggaccgcuggggggcaacugcaaggcaaagagaccagggggugagagaggccgcugccugacagcccccacccgcccgcccgcccgggccacugagcgagggccaggcccuggccccguuggggacguucucugccgcggccgaaaggcccugccugcgucgugggggaugauauaugggcgggcacaggagagagugcgggcguggacauguguucacgcccggacacacacacacacacacacacacacacacacacacacagagccuggcacggagguggggaagcagagggcaaggcaggcucuaaacuggaaccugagggaacagagacaagagcaggcccgccggggcaucugcuugacuccagcggcgcgcgucagcuagcggcuuggauaaaguccagugcaaggaucaaacuccccccacuuccccaccccccgccucucucccuuaaaagcaggaggcuccgguguaugcacucacacuggcuugaaaucucccucccucccucccuccaugguaucuagcaacccccugcccaaaacugggaaaaggcucucgacagcuauuaauguccuccucgaagucuaccuuaagcccaccuaaauugguuuccuaccauaaacacacuuuacaacggcccaggaaaucuuauaggauguauaaaccucuucgaaugcuuauaaaguagcacauaaaaaggcgcaagcagagggaggccuccgcccccccccccucccccgcggcccccgggcccaccgcuugcccaguacccggugccuaccugcgcugcugcucuucucggcccccgccucucccggggggcccucgccgucgccaccgcugccuucugcugcccccuugggcuccgagccaggggucgccuuggugcagggacugcccccgccgccaccagccccgguccuggggucgcccuugucggcugcgcccucgggcuguggcggcgcggguggcggcgggggcugcggcccggcgaacgggggcccgggcgcugccucguagaacuggucgaagcccuguggcaagaugccauugcggcccaccgcgcuguagaaguuggaggcggcgcccgcggggccgugcggcggccccggcgcagcgcacaccggcucaggcgccuugaagagcacguccggccggcggcccgcgggcgggagaagcucgcguugcauggccgccuccucggccgccgcggccgccgcagccgccgccgccgccgccgcguaguagggagcguagccccccgcgccgccgccgcccccgccggggccgcccccgcugcugccgccccccgcgcugccgccgccgccgccgccgcgguacggccacuuggcgcgcuccaggccguagucgcggaaggccacuucgcgcacgggcuggacgugcggagccagguuggaagaguaggggaaagucaucuggcaggacgacgguugggaaaggaacgaaggcuugcuagcgaagucagacggggccacauaguaggcgcagcccggcagguacaugcuggcugcgcucuggccgcacucgucaaagucguucaugacuccgcggcgugcgcgccagcgagccucuggccgcuccccgcgcagccaaccugagccaucgauugcacaagaggcuugggccaggaucaacuaagcaaaaauccccaccgggcgcugacgugcaauucaucuugauugauucuggugguaauuaugucacgugacgccaugaagagaaauguccuuauaucuauaucaacgcucgccaacacgccccgggacggcuccuggcgccgagacgcgcgcgcugggggcggaucggcugcccucugccgccagcucuccccgggcgcucccugaccaggcugcgccucaggccggucaccugcgcgccgcuggccgcugucaccgcugggcgcaucugccaccgcccgaacgggccgcccgcccgcguccgcccucccgcgccgcuuuaaguacgcggaccgaggccggcggggaggaggaaggagggggaagagggggaggaagggggaagggagagaagcagcgagcagag

SEQ ID NO: 19315 - RNA, 2454 nt, Homo sapiens
aaccagccugcgcccccacccgcuuguccuggacccggcccucuuaagcgcguucugccugguuguguguggggggaaugcuucugugcgcuggcgccagggcacucuggcuucccuccccguccgugcguguccacuuggaggccccuagagcugagacuuuccuuccgccgguugggcccaggggccgaagcgggggacgcgaguggggcgggcuggccgagcgagcccuggagaggcggacaggagggcggcggagagcgcugggccgguugucuccagcgcgcacuaucgcgggcgcguaguagaugucgcuguuguccgugcuuacccggccggccggccaggcucuggagcacgugacccgagaggaggcugcggcucaaggccauuuucaaaucucauuggcuugguugucauguggucggcagaggcauccacaauuacacggggaauguuuuccuagagaugucagccuacaaaggacacaaucucucuucuucaaauucuuccccaaaauguccuuucccaacagcucuccugcugcuaauacuuuuuuaguagauuccuugaucagugccugcaggagugacaguuuuuauuccagcagcgccagcauguacaugccaccaccuagcgcagacauggggaccuauggaaugcaaaccuguggacugcucccgucucuggccaaaagagaagugaaccaccaaaauauggguaugaaugugcauccuuauauaccucaaguagacaguuggacagauccgaacagaucuugucgaauagagcaaccuguuacacagcaaguccccacuugcuccuucaccaccaacauuaaggaagaauccaauugcugcauguauucugauaagcgcaacaaacucauuucggccgaggucccuucguaccagaggcuggucccugagucuugucccguugagaacccugagguucccgucccuggauauuuuagacugagucagaccuacgccaccgggaaaacccaagaguacaauaauagccccgaaggcagcuccacugucaugcuccagcucaacccucguggcgcggccaagccgcagcucuccgcugcccagcugcagauggaaaagaagaugaacgagcccgugagcggccaggagcccaccaaagucucccagguggagagccccgaggccaaaggcggccuucccgaagagaggagcugccuggcugaggucuccguguccagucccgaagugcaggagaaggaaagcaaaggucgguaugagcagaguugccaccccagcggggcgcgcagcccgggaacccggcagagagggagugccggggugcccagcgccgagccggagcccgacuuggcaggugcugcuccgccugguuuuagaggggugaucucagcccugagauaguccccgcuucuccccugcugcccuggcccucuccgccaguccuggccccacgcugauggcgcccgggcagaggaaaagcuugccgguuuuauuuuuccugagcuagaccugaacacaacaaaagagcgcaaaggagaccugcggcucauaaacacgaccacagagccucuuuucuccugcucagauuugcaguuccaguuuugccuugagcccaaugaucauguuaaggugauccagggcaccguguucguguucaaguguaugcaccccgcauccugcgagcuuggggguggugaggggaaagagauggcugggcugguuggugcuugaguugggaaacagggcuuacugccuuugcugggcuagguaaccuuggcuuuguuuaggaaaagugcugcagucuuugcaauccgucggcaaagagggcaaaggcggagggggagaguggaacccgcauugcccucccugcaaggccagccuuagggcugggcuaaggcaaagagccagggaucuggcuuuuugagaaggaacccuccuccucucccccagugcuuagaggugggccacaguagggggcucccuuucugggggaaugcuuuagugugggggcaagaagacaugaaaauuaaggaaauucuggggaaugcaacaauacccaggcaaggugggggaaggugucucgcuuccccauuuaucuuuugaaagagaaugggcaccuauaaaccugacugucaggauuccugacugccuaggagagguggggaagaaguggcagauuuggggaccugaggcagcagugggguugguaggcuuguccaggucguggcguauuccccuccgucccuguuaggagcugaacccuuagaauguugcuggggagaucuggaaaguuuacuauucuacuaauguuuuguacaagugagaaaguugaaagagagagcgagaacccaaaugcagacuguccugccaucaugucauuuaaguaauguggcaucaauguaagauucccuuccaaggcccacuucaugugaguaauguu

SEQ ID NO: 19316 - RNA, 2454 nt, Homo sapiens
aacauuacucacaugaagugggccuuggaagggaaucuuacauugaugccacauuacuuaaaugacaugauggcaggacagucugcauuuggguucucgcucucucuuucaacuuucucacuuguacaaaacauuaguagaauaguaaacuuuccagaucuccccagcaacauucuaaggguucagcuccuaacagggacggaggggaauacgccacgaccuggacaagccuaccaaccccacugcugccucagguccccaaaucugccacuucuuccccaccucuccuaggcagucaggaauccugacagucagguuuauaggugcccauucucuuucaaaagauaaauggggaagcgagacaccuucccccaccuugccuggguauuguugcauuccccagaauuuccuuaauuuucaugucuucuugcccccacacuaaagcauucccccagaaagggagcccccuacuguggcccaccucuaagcacugggggagaggaggaggguuccuucucaaaaagccagaucccuggcucuuugccuuagcccagcccuaaggcuggccuugcagggagggcaaugcggguuccacucucccccuccgccuuugcccucuuugccgacggauugcaaagacugcagcacuuuuccuaaacaaagccaagguuaccuagcccagcaaaggcaguaagcccuguuucccaacucaagcaccaaccagcccagccaucucuuuccccucaccacccccaagcucgcaggaugcggggugcauacacuugaacacgaacacggugcccuggaucaccuuaacaugaucauugggcucaaggcaaaacuggaacugcaaaucugagcaggagaaaagaggcucuguggucguguuuaugagccgcaggucuccuuugcgcucuuuuguuguguucaggucuagcucaggaaaaauaaaaccggcaagcuuuuccucugcccgggcgccaucagcguggggccaggacuggcggagagggccagggcagcaggggagaagcggggacuaucucagggcugagaucaccccucuaaaaccaggcggagcagcaccugccaagucgggcuccggcucggcgcugggcaccccggcacucccucucugccggguucccgggcugcgcgccccgcugggguggcaacucugcucauaccgaccuuugcuuuccuucuccugcacuucgggacuggacacggagaccucagccaggcagcuccucucuucgggaaggccgccuuuggccucggggcucuccaccugggagacuuuggugggcuccuggccgcucacgggcucguucaucuucuuuuccaucugcagcugggcagcggagagcugcggcuuggccgcgccacgaggguugagcuggagcaugacaguggagcugccuucggggcuauuauuguacucuuggguuuucccgguggcguaggucugacucagucuaaaauauccagggacgggaaccucaggguucucaacgggacaagacucagggaccagccucugguacgaagggaccucggccgaaaugaguuuguugcgcuuaucagaauacaugcagcaauuggauucuuccuuaauguugguggugaaggagcaaguggggacuugcuguguaacagguugcucuauucgacaagaucuguucggaucuguccaacugucuacuugagguauauaaggaugcacauucauacccauauuuuggugguucacuucucuuuuggccagagacgggagcaguccacagguuugcauuccauagguccccaugucugcgcuaggugguggcauguacaugcuggcgcugcuggaauaaaaacugucacuccugcaggcacugaucaaggaaucuacuaaaaaaguauuagcagcaggagagcuguugggaaaggacauuuuggggaagaauuugaagaagagagauuguguccuuuguaggcugacaucucuaggaaaacauuccccguguaauuguggaugccucugccgaccacaugacaaccaagccaaugagauuugaaaauggccuugagccgcagccuccucucgggucacgugcuccagagccuggccggccggccggguaagcacggacaacagcgacaucuacuacgcgcccgcgauagugcgcgcuggagacaaccggcccagcgcucuccgccgcccuccuguccgccucuccagggcucgcucggccagcccgccccacucgcgucccccgcuucggccccugggcccaaccggcggaaggaaagucucagcucuaggggccuccaaguggacacgcacggacggggagggaagccagagugcccuggcgccagcgcacagaagcauuccccccacacacaaccaggcagaacgcgcuuaagagggccggguccaggacaagcgggugggggcgcaggcugguu

SEQ ID NO: 19317 - RNA, 2443 nt, Homo sapiens
ggcgugugugaguguggcagggggagggggcccuccgaucugcuccauccguccguuuuauuagggacacauuaaucuauaaucaaauacaccucauaaaauuuuuauugaaaggcauaauaucauuacagaggucuuccaccuguuuuaaacaacacgacaagcugugagcaagcguguguguggggauguguggggaggggugggugugaguagggagagaggcgaggggagaacagcuccccucgggcgcuaggggccgccccgagggcccgccugccucgggcgacaccggccuggcgcccccgcggccgcuccgugugcccuggacucgccgcccgcggcucggaagcuggagagucagcgacggggcccgacugcgggaccgagggcugcaagaagaagcgaacaaauaguccccagcgccuccucuggaugcggucgcgucugugguccuggcagccgcugggcgggccaggccaggucgggccgggccgagccgggcacauggaccugggccugcgggcucuaauugcggcgcuuauguugaugauuuuuuuuuuaaucacagcagcccccaguuuagcggacugauuuacucccgguauugguaaauaugaucacgugggccgcgcgaccaaugguggaggcugcagccugcgaacuagucgguggcucgggcgccggcggggagcugcucggcggcggacaguguaauguugggugggagugcgggacgccucaaaaugucuuccaguggcacccucagcaacuacuacguggacucgcuuauaggccaugagggcgacgagguguucgcggcgcgcuucgggccgccggggccaggcgcgcagggccggccugcagguguggcugauggcccggccgccaccgccgccgaguucgccucguguaguuuugcccccagaucggccguguucucugccucgugguccgcggugcccucccagcccccggcagcggcggcgaugagcggccucuaccacccguacguucccccgccgccccuggccgccucugccuccgagcccggccgcuacgugcgcuccuggauggagccgcugcccggcuucccgggcggugcgggcgguggcgguggugguggaggcggcgguccgggccgcggucccagcccuggccccagcggcccagccaacgggcgccacuacgggauuaagccugaaacccgagcggccccggcccccgccacggccgccuccaccaccuccuccuccuccacuuccuuauccuccuccuccaaacggacugagugcuccguggcccgggagucccaggggagcagcggccccgaguucucgugcaacucguuccugcaggagaaggcggcagcggcgacggggggaaccgggccuggggcagggaucggggccgcgacugggacgggcggcucgucggagcccucagcuugcagcgaccacccgaucccaggcuguucgcugaaggaggaggagaagcagcauucgcagccgcagcagcagcaacuugacccaaguaagugcaaaagaaauugcccccugauuuauugcugaaaccuguaaggcucgaaugugcaaaacugauaguuuuacuaaccuauaaaaacgucuagacgccuacccaagccuaggcgaacaacaugcauccauaaaaagagcuucccauaaccaccuacccugggcgcucaguuaguacgguaaacagagcgcgagcauuaaggcuuuuuaugauaauuccccacaaguugugaaaagcgaccauccuuggugaaauuaauuuaacgaccucucuuccccacccuguggucucucccugccuccccuccucuccucucuccccgucuccaaaccucccucuuuguagacaaccccgccgcgaacuggauccacgcucgcuccacccggaaaaagcgcugucccuacaccaaauaccagacgcuugagcuggagaaagaauuccucuucaacauguaccucacccgggaccggcgcuacgagguggccaggauucucaaccuaacagagagacaggucaaaaucugguuucagaaccguaggaugaaaaugaaaaagaugagcaaggagaaaugccccaaaggagacugacccggcgcggugcuggcgggagcgcucaagggcagcggauuuguuguuguugcuguuuuccuuuguggguguuuggugcuugauuuccagaaacucuccagcgacuuggacuucuucuucuuuuuuuuuuucuuuuuagauagaagugacugugugguuggucucugagguauuugggggacucuguauuugcucguuuacguguuggaaaaaccaaguggcuuugggguuucgcccuaucccacucccucucuuuccugcuccauugguuccuuaagaaaugcuauauuuugugagugcaagcuggcuuggggagcccu

SEQ ID NO: 19318 - RNA, 2443 nt, Homo sapiens
agggcuccccaagccagcuugcacucacaaaauauagcauuucuuaaggaaccaauggagcaggaaagagagggagugggauagggcgaaaccccaaagccacuugguuuuuccaacacguaaacgagcaaauacagagucccccaaauaccucagagaccaaccacacagucacuucuaucuaaaaagaaaaaaaaaaagaagaagaaguccaagucgcuggagaguuucuggaaaucaagcaccaaacacccacaaaggaaaacagcaacaacaacaaauccgcugcccuugagcgcucccgccagcaccgcgccgggucagucuccuuuggggcauuucuccuugcucaucuuuuucauuuucauccuacgguucugaaaccagauuuugaccugucucucuguuagguugagaauccuggccaccucguagcgccggucccgggugagguacauguugaagaggaauucuuucuccagcucaagcgucugguauuugguguagggacagcgcuuuuuccggguggagcgagcguggauccaguucgcggcgggguugucuacaaagagggagguuuggagacggggagagaggagaggaggggaggcagggagagaccacaggguggggaagagaggucguuaaauuaauuucaccaaggauggucgcuuuucacaacuuguggggaauuaucauaaaaagccuuaaugcucgcgcucuguuuaccguacuaacugagcgcccaggguaggugguuaugggaagcucuuuuuauggaugcauguuguucgccuaggcuuggguaggcgucuagacguuuuuauagguuaguaaaacuaucaguuuugcacauucgagccuuacagguuucagcaauaaaucagggggcaauuucuuuugcacuuacuugggucaaguugcugcugcugcggcugcgaaugcugcuucuccuccuccuucagcgaacagccugggaucggguggucgcugcaagcugagggcuccgacgagccgcccgucccagucgcggccccgaucccugccccaggcccgguuccccccgucgccgcugccgccuucuccugcaggaacgaguugcacgagaacucggggccgcugcuccccugggacucccgggccacggagcacucaguccguuuggaggaggaggauaaggaaguggaggaggaggaggugguggaggcggccguggcgggggccggggccgcucggguuucaggcuuaaucccguaguggcgcccguuggcugggccgcuggggccagggcugggaccgcggcccggaccgccgccuccaccaccaccgccaccgcccgcaccgcccgggaagccgggcagcggcuccauccaggagcgcacguagcggccgggcucggaggcagaggcggccaggggcggcgggggaacguacgggugguagaggccgcucaucgccgccgcugccgggggcugggagggcaccgcggaccacgaggcagagaacacggccgaucugggggcaaaacuacacgaggcgaacucggcggcgguggcggccgggccaucagccacaccugcaggccggcccugcgcgccuggccccggcggcccgaagcgcgccgcgaacaccucgucgcccucauggccuauaagcgaguccacguaguaguugcugagggugccacuggaagacauuuugaggcgucccgcacucccacccaacauuacacuguccgccgccgagcagcuccccgccggcgcccgagccaccgacuaguucgcaggcugcagccuccaccauuggucgcgcggcccacgugaucauauuuaccaauaccgggaguaaaucaguccgcuaaacugggggcugcugugauuaaaaaaaaaaucaucaacauaagcgccgcaauuagagcccgcaggcccagguccaugugcccggcucggcccggcccgaccuggccuggcccgcccagcggcugccaggaccacagacgcgaccgcauccagaggaggcgcuggggacuauuuguucgcuucuucuugcagcccucggucccgcagucgggccccgucgcugacucuccagcuuccgagccgcgggcggcgaguccagggcacacggagcggccgcgggggcgccaggccggugucgcccgaggcaggcgggcccucggggcggccccuagcgcccgaggggagcuguucuccccucgccucucucccuacucacacccaccccuccccacacauccccacacacacgcuugcucacagcuugucguguuguuuaaaacagguggaagaccucuguaaugauauuaugccuuucaauaaaaauuuuaugagguguauuugauuauagauuaaugugucccuaauaaaacggacggauggagcagaucggagggcccccucccccugccacacucacacacgcc

SEQ ID NO: 19319 - RNA, 2376 nt, Homo sapiens
guauaaacaccuuguuuacuccuguuucuuauacaaaaugggcaaaaaugucuucaaggauuuauaaccauuuuguaaauauuaauguggcuucugcuagggguggacaacuucccggcuucuaugggaggggccacuuagaaaacgccuucagauaagguucaauucuuuuguauuucagcaaagucagcccacgcaucucuauuugguuugacaaauaaugcaacuccuacuacauccccgaugacacgaagugaaauuccuauuguguggaaauaauuuaacuucuaaucuucugguggaacaacaaucguuucuauuuggauguuuguauuucacuaaguaaugauggcucaaaauaauauuuaguuuccuuguuccuuugugcuguuuuuaaaauggcauguuagauuugggggugggaggggauauccuuuugcuaaauuucacuuuaucugagcagguuuaaaauauauauguuguagaaguguaucaacagaauaaaugacuucaaucgaaggcacauuuuacccacuuucaaggcuuaacauuguuuucuaugaaauuugcauccauaggcagaauuucuaauugucuuguaagaaauuauuuuuuaagcuauuagagaaaucaaaggagagcucacugccuugcagggauuacaaccaccuuucuuaacuggcuaaauauuaacuagcugaauugucaggcugcuuagauucagcccgauuuucccucaucuccucuuccuaccauaaauaauaauaaaaauacguaaugugucauggcuccaggcguuuuccagcacaguguguuaccgcaggaguaucugcugagucugcgggugucugcaaagccccaagugucauuugcggcuuaggguuucauggauuagacuuuaaacggugucuagcccggcugacauuagcuuccucucacacucaggcuccaaggaagugugggaucaggggcucccucuccaggcagccacagcuuuccccgacgcccuccucucgaguggggugagggcuuggaccaaaucugccaccuucugucaucucuggagguucccgagacuucuaauagcucggaucuguuccugccauuggcgugagacucaucugaggggcgugggugggggugggcggcgagccgggggagggcgcguuuccgcgcggcugccagcccaggagaaaguuggggcccgcggcacagccauuuaaaacuucauaaauuauaaacaagccgccuuggccuucgcaauaaauuccgcuccuuuugagccugcaauuaguguuagaaagcaaccgagucuaaacacaaccaaacgcccucugaagggcccaacugccugagguugcaaaccuuuauuucccagcgccacccccucuccgacugagguuugcacacacagucgccuccucccccgccaccgccggcgguacacacucggcuggguucccgcucugcaagggaaggucacaauagcugcucuaucggcugcggaggcgccugccgccucccucccgagucucagaagcagaaaaacaagagaaugggggaggggaggccccagcaacagcgcccuuugcgggaggcaaccuccacccuagccagggucucucuccugggacgagugcucgcagaggguugcggggagggcaaagggagcgcaccaagaccaccaggcugcuccaggccuugccgcagggcgcuggguugagggugcccggagcagccgcgccauugugugucagguuuucccacgggauccgugaugggggaggccauauaaagggagcucggauccgggccucuccggcauuggucucugggagggucuaccucguuugcccaaggggaagaaauggcucugucucaggccuuagccagcucugcuuuuuuccuagagacuacuuuggggaagguggggaucagggagauuguggguccuccuggggucugaagaaaggggucagggcaggaucucaggcccauggcugagggguggcagucgucuggacauucuaggugguucuguccaggcaaucaaauaugaauuaaggcaggauagcugugaggcagccagaauggccagcugcaaaacgggagguggggguggggaaggagaugcagacagugagagcuuucccugcaaccaagaaaaacucaggauccagccaggaguugaagugcugagacccaacugaacuagccaggaagaauggggaaguggcagaagaaaggccuggagaguaguccuggucacugguaagcaggucagaaagggcgauuaaguacauauucugucuccuggcuuucagaccuccaccuuauccagggaccugacagagaaaaaucugccucugauggaau

SEQ ID NO: 19320 - RNA, 2376 nt, Homo sapiens
auuccaucagaggcagauuuuucucugucaggucccuggauaagguggaggucugaaagccaggagacagaauauguacuuaaucgcccuuucugaccugcuuaccagugaccaggacuacucuccaggccuuucuucugccacuuccccauucuuccuggcuaguucaguugggucucagcacuucaacuccuggcuggauccugaguuuuucuugguugcagggaaagcucucacugucugcaucuccuuccccacccccaccucccguuuugcagcuggccauucuggcugccucacagcuauccugccuuaauucauauuugauugccuggacagaaccaccuagaauguccagacgacugccaccccucagccaugggccugagauccugcccugaccccuuucuucagaccccaggaggacccacaaucucccugauccccaccuuccccaaaguagucucuaggaaaaaagcagagcuggcuaaggccugagacagagccauuucuuccccuugggcaaacgagguagacccucccagagaccaaugccggagaggcccggauccgagcucccuuuauauggccucccccaucacggaucccgugggaaaaccugacacacaauggcgcggcugcuccgggcacccucaacccagcgcccugcggcaaggccuggagcagccugguggucuuggugcgcucccuuugcccuccccgcaacccucugcgagcacucgucccaggagagagacccuggcuaggguggagguugccucccgcaaagggcgcuguugcuggggccuccccucccccauucucuuguuuuucugcuucugagacucgggagggaggcggcaggcgccuccgcagccgauagagcagcuauugugaccuucccuugcagagcgggaacccagccgaguguguaccgccggcgguggcgggggaggaggcgacugugugugcaaaccucagucggagaggggguggcgcugggaaauaaagguuugcaaccucaggcaguugggcccuucagagggcguuugguuguguuuagacucgguugcuuucuaacacuaauugcaggcucaaaaggagcggaauuuauugcgaaggccaaggcggcuuguuuauaauuuaugaaguuuuaaauggcugugccgcgggccccaacuuucuccugggcuggcagccgcgcggaaacgcgcccucccccggcucgccgcccacccccacccacgccccucagaugagucucacgccaauggcaggaacagauccgagcuauuagaagucucgggaaccuccagagaugacagaagguggcagauuugguccaagcccucaccccacucgagaggagggcgucggggaaagcuguggcugccuggagagggagccccugaucccacacuuccuuggagccugagugugagaggaagcuaaugucagccgggcuagacaccguuuaaagucuaauccaugaaacccuaagccgcaaaugacacuuggggcuuugcagacacccgcagacucagcagauacuccugcgguaacacacugugcuggaaaacgccuggagccaugacacauuacguauuuuuauuauuauuuaugguaggaagaggagaugagggaaaaucgggcugaaucuaagcagccugacaauucagcuaguuaauauuuagccaguuaagaaaggugguuguaaucccugcaaggcagugagcucuccuuugauuucucuaauagcuuaaaaaauaauuucuuacaagacaauuagaaauucugccuauggaugcaaauuucauagaaaacaauguuaagccuugaaaguggguaaaaugugccuucgauugaagucauuuauucuguugauacacuucuacaacauauauauuuuaaaccugcucagauaaagugaaauuuagcaaaaggauauccccucccacccccaaaucuaacaugccauuuuaaaaacagcacaaaggaacaaggaaacuaaauauuauuuugagccaucauuacuuagugaaauacaaacauccaaauagaaacgauuguuguuccaccagaagauuagaaguuaaauuauuuccacacaauaggaauuucacuucgugucaucggggauguaguaggaguugcauuauuugucaaaccaaauagagaugcgugggcugacuuugcugaaauacaaaagaauugaaccuuaucugaaggcguuuucuaaguggccccucccauagaagccgggaaguuguccaccccuagcagaagccacauuaauauuuacaaaaugguuauaaauccuugaagacauuuuugcccauuuuguauaagaaacaggaguaaacaagguguuuauac

SEQ ID NO: 19321 - RNA, 2677 nt, Homo sapiens
aguccuaggaaagggggaagaaaggaaaaaaccaaacaucugcucuagguuuagaagagggauaacaucagcgccaagcaaaccgaaagcgcagaggacucagaagaggggaagaggaauaacuuuaucuguccuggaggugggcgaagagcagucuccaccggccgcgcgucacgcucccauuuaaccuuuuccaugccgcgacgcccacacuccgcccucgagggacuagccccccccacgauccagagcagaagcggcucgccccgcugcauccacgggcccucacccaagcguccaguccugccuuucuccccccaccucgcccaauaccuguccgagagcaggcguucugcccucucgccccgcccuugcccaggcagcccccggucgcgacggcucuccucggggcucgggggcgcugggcggcggcccugggcugcuuuggcuaacuuggcugcggggcaggcgcgaggagcggcgcgccgaccgggccgagcggagaggccgcccauuggccggccagcgccacguggccgcccccgccgguauauuaggccacuauuuaccuccggcucacucgccauggguuggagagggcagcucggguagagagggcuggcggagcggcgcagacggcggcaguccugcucagccucugcccggcuccguacuccggccccggccugcgcccucagaaagguggggcccgaaccaugagcuccuaccuggaguacgugucaugcagcagcagcggcggggucggcggcgacgugcucagcuuggcacccaaguucugccgcuccgacgcccggcccguggcucugcagcccgccuucccucugggcaacggcgacggcgccuucgucagcugucugccccuggccgccgcccgacccucgccuucgcccccggccgcccccgcgcggccguccguaccgccuccggccgcgccccaguacgcgcagugcacccuggagggggccuacgaaccuggugccgcaccugccgcggcagcugggggcgcggacuacggcuuccugggguccgggccggcguacgacuucccgggcgugcuggggcgggcggccgacgacggcgggucucacguccacuacgccaccucggccgucuucucgggcggcggcucuuuccuccucagcggccagguggauuacgcggccuucggcgaacccggcccuuuuccggcuugucucaaagcgucagccgacggccacccuggugcuuuccagaccgcauccccggccccaggcaccuaccccaaguccgucucucccgccuccggccucccugccgccuucagcacguucgaguggaugaaagugaagaggaaugccucuaagaaagguaaguccgcgggccuuggauggggccaccugggguuggggacggagccucccccgcggaaaugcgcugggagcguggugucgcugccuuuccagacagcgguuuggguuuuguggaggagacgcguucccgggcgaauuccauggagucugccucgaguacagauucggaaaaugugccaggcauugagaaaauuucaggaaggagcucuccguggaacuucuccugguacaaauucuguuccuagggacccaggagggcugcgcugggacuuugauucuaacuagcuccacugcucacccacauucuguccccggccucaggccuggcugacgcccugucuuuacguugcaggcaaacucgccgaguauggggccgcuagccccuccagcgcgauccgcacgaauuucagcaccaagcaacugacagaacuggaaaaagaguuucauuucaauaaguacuuaacucgagcccggcgcaucgagauagccaacugcuugcaccugaaugacacgcaagucaaaaucugguuccagaaccgcaggaugaaacagaagaaaagggaacgagaagggcuucuggccacggccauuccuguggcuccccuccaacuuccccucucuggaacaacccccacuaaguuuaucaagaaccccggcagcccuucucagucccaagagccuucgugaggccgguacuuggggccgaaaaacuguggccugcagaagucccaggcgacccccaucccuaucuagacuuaggagcucaguuugggauggaggugggagaacaaaaaugaauagggauuucacuugggaaaugaaguacuuuaguuggcuuccgaguuccagacuauauguccagauauuaauugacugucuuguaagccacuuguuugguuaugauuugugucuuaucagggaaaaggugcccagcugccagcccagcuccgcugcuaucuuugccucacuuagucaugugcaauucgcguugcagaguggcagaccauuaguugcugaguucugucagcacucugaugugcucagaagagcaccugcccaaaguuuuucugguuuuaauuuaaaggacaaggcuacauauauucagcuuuuugagaugaccaaagcuaguuagggucuccuugauguagcuaagcugcuucagugaucuucacauuugcacuccaguuuuuuuuucuuuaaaaaagcgguuucuaccucucuaugugccugagugaugauacaaucgcuguuuaguuacuagaugaacaaauccacagaauggguaaagaguagaaucugaacuauau

SEQ ID NO: 19322 - RNA, 2677 nt, Homo sapiens
auauaguucagauucuacucuuuacccauucuguggauuuguucaucuaguaacuaaacagcgauuguaucaucacucaggcacauagagagguagaaaccgcuuuuuuaaagaaaaaaaaacuggagugcaaaugugaagaucacugaagcagcuuagcuacaucaaggagacccuaacuagcuuuggucaucucaaaaagcugaauauauguagccuuguccuuuaaauuaaaaccagaaaaacuuugggcaggugcucuucugagcacaucagagugcugacagaacucagcaacuaauggucugccacucugcaacgcgaauugcacaugacuaagugaggcaaagauagcagcggagcugggcuggcagcugggcaccuuuucccugauaagacacaaaucauaaccaaacaaguggcuuacaagacagucaauuaauaucuggacauauagucuggaacucggaagccaacuaaaguacuucauuucccaagugaaaucccuauucauuuuuguucucccaccuccaucccaaacugagcuccuaagucuagauagggaugggggucgccugggacuucugcaggccacaguuuuucggccccaaguaccggccucacgaaggcucuugggacugagaagggcugccgggguucuugauaaacuuaguggggguuguuccagagaggggaaguuggaggggagccacaggaauggccguggccagaagcccuucucguucccuuuucuucuguuucauccugcgguucuggaaccagauuuugacuugcgugucauucaggugcaagcaguuggcuaucucgaugcgccgggcucgaguuaaguacuuauugaaaugaaacucuuuuuccaguucugucaguugcuuggugcugaaauucgugcggaucgcgcuggaggggcuagcggccccauacucggcgaguuugccugcaacguaaagacagggcgucagccaggccugaggccggggacagaaugugggugagcaguggagcuaguuagaaucaaagucccagcgcagcccuccugggucccuaggaacagaauuuguaccaggagaaguuccacggagagcuccuuccugaaauuuucucaaugccuggcacauuuuccgaaucuguacucgaggcagacuccauggaauucgcccgggaacgcgucuccuccacaaaacccaaaccgcugucuggaaaggcagcgacaccacgcucccagcgcauuuccgcgggggaggcuccguccccaaccccagguggccccauccaaggcccgcggacuuaccuuucuuagaggcauuccucuucacuuucauccacucgaacgugcugaaggcggcagggaggccggaggcgggagagacggacuugggguaggugccuggggccggggaugcggucuggaaagcaccaggguggccgucggcugacgcuuugagacaagccggaaaagggccggguucgccgaaggccgcguaauccaccuggccgcugaggaggaaagagccgccgcccgagaagacggccgagguggcguaguggacgugagacccgccgucgucggccgcccgccccagcacgcccgggaagucguacgccggcccggaccccaggaagccguaguccgcgcccccagcugccgcggcaggugcggcaccagguucguaggcccccuccagggugcacugcgcguacuggggcgcggccggaggcgguacggacggccgcgcgggggcggccgggggcgaaggcgagggucgggcggcggccaggggcagacagcugacgaaggcgccgucgccguugcccagagggaaggcgggcugcagagccacgggccgggcgucggagcggcagaacuugggugccaagcugagcacgucgccgccgaccccgccgcugcugcugcaugacacguacuccagguaggagcucaugguucgggccccaccuuucugagggcgcaggccggggccggaguacggagccgggcagaggcugagcaggacugccgccgucugcgccgcuccgccagcccucucuacccgagcugcccucuccaacccauggcgagugagccggagguaaauaguggccuaauauaccggcgggggcggccacguggcgcuggccggccaaugggcggccucuccgcucggcccggucggcgcgccgcuccucgcgccugccccgcagccaaguuagccaaagcagcccagggccgccgcccagcgcccccgagccccgaggagagccgucgcgaccgggggcugccugggcaagggcggggcgagagggcagaacgccugcucucggacagguauugggcgagguggggggagaaaggcaggacuggacgcuugggugagggcccguggaugcagcggggcgagccgcuucugcucuggaucguggggggggcuagucccucgagggcggagugugggcgucgcggcauggaaaagguuaaaugggagcgugacgcgcggccgguggagacugcucuucgcccaccuccaggacagauaaaguuauuccucuuccccucuucugaguccucugcgcuuucgguuugcuuggcgcugauguuaucccucuucuaaaccuagagcagauguuugguuuuuuccuuucuucccccuuuccuaggacu

SEQ ID NO: 19323 - RNA, 2310 nt, Homo sapiens
gccccucaaacaauuccauugggcagagggugcuauacucauucuacagaugcgguuaacugaggguagagaagccugaagagcaaguccagcccuguggcccggcccuggagccagucuccugacaucuacucccagguucucugcaggaggucacauugccuucuggcccccaggagagccugugcagaaccugcuggggaaacugcgaggagagacccuugggugccgagggucacgcagcccccaggccccagcccccuucuccuacagccugcuaggcggcauugcugccccagggugaugcuucugcucucuccuguauucgcgcuggagaaguuuucccugaaaccagguuccauccccagccaauaacucauuuccucagagauggugucuguauaaaacaagcaagauggucauuugcagaaacgcacagcaaggcagcccuagaccgcuuccccugcggguucaaaccccaacaggcuccagaggcuaagaggacgugcccgcuggcucagcucccauggcacgggcugggugcuccgcuauuucacuucucucccucaguuccccaucugugaaaugggaaugccccuucagcugcucugccucagccccuauggaaaugccaggaaggggaaaggucggucaccaaaacgccagggacagcauuaucugaaaagugaagccagaaaagagggugagggugggguggggagggggagccagcgcccacaaagcacgaauuaaacacccaugaaaucaagcacgacgccaagagggccggcugccuugagaaaagccagcgugcggccaccuuuuccccggccugggaacuuuccccaggaacagggcccucggcccggagucccgcgccucgcccagggccccacugcccagcgccuggcccugcccugucgcccccgccgccccucgggccccugcaggccgggucggaggucugucggcaaaggcucagccaggccgcccggcucugcguccccagaccuccgcaaacacgcccccuccggccgccuccggcuaggaagccgggcccgugcccgccagaugugcccagcgccgggaagagccgggccagggacggccuggagcccgcgcggaggcuuuccccgggaggcucgggcaccgcggcacccggaucccgccucucucccccgauccugggcagccggaaaagggaucgaucgccggcgugcgaggccggccgggguccccgcaagucgccuuccggggauccggggauccggacccccgcccccuuccccggaaccccccggggggguacgcucgggcaggugcagucaaugccagucccgccccagccuccugccccccgcccgagcccacccggcgcuuaccuggcccaggcgcagcagcagcagcagcagcggcagcgcccagcgcagcccgggcgagcgcggaggcagccgcgccucccgcgccgccggcuucaugccccgcgcgcccuggaacgugccccggacgcgcgaaucgggccccgccgugcgcccgagcccgggcaccgucgucgccgccuccugccgucuccuucgccuccuccuccgccagccgguccgccucguccccgcuccgcccgccccgggcuuccccggagacauggcagcggcggcggcggccgcggccacacgccggagccuagcgcggcugccgcgggggggccgcgucccugagcgcgcaggggcuucgcggggcggagcgagcggcgcccacccccagcgcgcggcuacccggucccggcucccgcggcugcucccgcugccuccuccgcgcgucaugcggcuggggcugcugcagggagccgcggcgagcgcucggcccccucccuuccccucccccucugaauauucaucgcuuccucccgccccggccggcccggcggcugcggagcuccgcagccccucgccgccgcccgccgcugcccccgcccccuccgagccggccgcggauccccucccgcgggcagaggaagcgcucccgccucgcccgccccuccgcccagcccucccacauuccugggacuuggagcccgggaccaggcuccguggcucuagcgccucgagccggcaccccucaggacgggcuccccagccucacaccagguccacggcgccggguucgggugggcagagguugaccgagaccccuacugagagcgcagccaagccugauuguagacagcaacccggcgaaggcgcguuugaccuggcccugggugggcuugggggugcgugaaccccgaaauuguagaaggcacgcuguacauug

SEQ ID NO: 19324 - RNA, 2310 nt, Homo sapiens
caauguacagcgugccuucuacaauuucgggguucacgcacccccaagcccacccagggccaggucaaacgcgccuucgccggguugcugucuacaaucaggcuuggcugcgcucucaguaggggucucggucaaccucugcccacccgaacccggcgccguggaccuggugugaggcuggggagcccguccugaggggugccggcucgaggcgcuagagccacggagccuggucccgggcuccaagucccaggaaugugggagggcugggcggaggggcgggcgaggcgggagcgcuuccucugcccgcgggaggggauccgcggccggcucggagggggcgggggcagcggcgggcggcggcgaggggcugcggagcuccgcagccgccgggccggccggggcgggaggaagcgaugaauauucagagggggaggggaagggagggggccgagcgcucgccgcggcucccugcagcagccccagccgcaugacgcgcggaggaggcagcgggagcagccgcgggagccgggaccggguagccgcgcgcugggggugggcgccgcucgcuccgccccgcgaagccccugcgcgcucagggacgcggcccccccgcggcagccgcgcuaggcuccggcguguggccgcggccgccgccgccgcugccaugucuccggggaagcccggggcgggcggagcggggacgaggcggaccggcuggcggaggaggaggcgaaggagacggcaggaggcggcgacgacggugcccgggcucgggcgcacggcggggcccgauucgcgcguccggggcacguuccagggcgcgcggggcaugaagccggcggcgcgggaggcgcggcugccuccgcgcucgcccgggcugcgcugggcgcugccgcugcugcugcugcugcugcgccugggccagguaagcgccgggugggcucgggcggggggcaggaggcuggggcgggacuggcauugacugcaccugcccgagcguacccccccgggggguuccggggaagggggcggggguccggauccccggauccccggaaggcgacuugcggggaccccggccggccucgcacgccggcgaucgaucccuuuuccggcugcccaggaucgggggagagaggcgggauccgggugccgcggugcccgagccucccggggaaagccuccgcgcgggcuccaggccgucccuggcccggcucuucccggcgcugggcacaucuggcgggcacgggcccggcuuccuagccggaggcggccggagggggcguguuugcggaggucuggggacgcagagccgggcggccuggcugagccuuugccgacagaccuccgacccggccugcaggggcccgaggggcggcgggggcgacagggcagggccaggcgcugggcaguggggcccugggcgaggcgcgggacuccgggccgagggcccuguuccuggggaaaguucccaggccggggaaaagguggccgcacgcuggcuuuucucaaggcagccggcccucuuggcgucgugcuugauuucauggguguuuaauucgugcuuugugggcgcuggcucccccuccccaccccacccucacccucuuuucuggcuucacuuuucagauaaugcugucccuggcguuuuggugaccgaccuuuccccuuccuggcauuuccauaggggcugaggcagagcagcugaaggggcauucccauuucacagauggggaacugagggagagaagugaaauagcggagcacccagcccgugccaugggagcugagccagcgggcacguccucuuagccucuggagccuguugggguuugaacccgcaggggaagcggucuagggcugccuugcugugcguuucugcaaaugaccaucuugcuuguuuuauacagacaccaucucugaggaaaugaguuauuggcuggggauggaaccugguuucagggaaaacuucuccagcgcgaauacaggagagagcagaagcaucacccuggggcagcaaugccgccuagcaggcuguaggagaagggggcuggggccugggggcugcgugacccucggcacccaagggucucuccucgcaguuuccccagcagguucugcacaggcucuccugggggccagaaggcaaugugaccuccugcagagaaccugggaguagaugucaggagacuggcuccagggccgggccacagggcuggacuugcucuucaggcuucucuacccucaguuaaccgcaucuguagaaugaguauagcacccucugcccaauggaauuguuugaggggc

SEQ ID NO: 19325 - RNA, 2638 nt, Homo sapiens
aggugaggaggaaaaacuagguuauuuucagcucuuccuuuacuggcaacauugacccauuuauccuucucuuccuucagaccucucccccaaggccacuuagcuuggacaucugucccagccaaaaucucaccuuccacuguccuugcagcccaaaggcuaguccagccucugaguccagcucuagcccucucuccccacacuaggaaggaagcuggacuguagagcgcucugggccaccccgcguuagcugcugccucuggccucaguuuccccaacugcucagauuaaugaugccugcucucuagacccagaggacgaagcucuaaggaggucacagaugaggaaggguccagugcucggcgcagacuccgugcggagccccuaggccccgcagcucgccccucccucuccccuacuccccuccucucccccucccgucucucccccgccucuucgcucucgcucggcucccucucuagcugaccuucccuuucccucacgccuccccacgcccggccccuggccccagcacccuguccgcugccgccucagagccgggaaaagcagccggagcccccgccgccccugccgcagcgcgggcggucagcgcgcagcccggcacccgcagccugcagccugcagcccgcagcccgcagcccggagccagaucgcgggcucagaccgaacccgacucgaccgccgcccccagccaggugagggcagcugaggggaggcagggagccgagguucccccuuuacuggaagcgagggcuggggaggcgcggggaaauuggguccuuuuuccuugaaaggaggaccugggagccuuuucgugaaacaggcacaagggcuuucauuccaaagggauggauggauggagggaaggucucgggggagagggauugguuuuuguuuuuuaaaaauaaggauuaauuggcuucugugaaagugggacuucuuggaaggaugaggggcuuucaagguagguuggggagggggcucuggcagggcuugagggaaggguuaacuggugaguggcagggcaagggggaacucugcgauccccucagccugacaucgcugcaccucccgccuuggcuccggggcucugggucucuccagcucugugucccaguuuuucucuuugaagaugacuauuuugaaccccaccuggacagagccaggaacagccauuuccuucccuggagcuaugacacccaccugacacacccucccacaccucugaccugcucagggaaggggguucagggaaggacgaggauccagggaucugggaauugggcagugugggugaaacggaggcuggguacugggugcacaggaagacccuuggcacugguggggugcaccagccuuggucaggagguugcugggcagcugcuucuggggcaggacccacuaggaaagcagcgguauggaaaagcugagcuguuuuccguguucccagaagacaaaacacuagagaauguguuugcuugcuuuuguuugguuuugcuuucugucuuccucacccuggaucccaagacucauuccucugaucuccucuccuaguuuugcaaaaagguaaacugaggcacagaacaaauuggcuggacauaccugugucuaggagggaagagugacaggaaggcauacggaauuugagucaaaaaaccucagugcuccaugggugaccuugggccaaaaugcuuucccuuguugggccucagcuuucucaucuauaaaaugggagacggcccaccugucuuguagguuugccaagaccaugugucuaaaagaacuuuguaaaagggaaugcacuggacacuugugaggugccaucuucaccacuguggauggccccuucccuccucccuguccuaaccaagggacaccuaacuaauccauaggacaccuuugugagaauuacaaaaagcaccuccucuggaaggagacagcauucaguuggcuagcaacuuggggucuuuaguaugagaaugagaagguggcauacuuuacgccaggugcugcucuaacauguggagugugagcuagauucuagcugggacguucugcacaucuacaccugacaacccuucucagcaggucccugcugucucuaagagacacagagcuacacauacagggcauuuucuaaagcagcccacaucccaggcugucuccagcucauuucuuuccuguuuuguuuccacaucagggcuuuuggguauucaagccccaaagcacgugcccuacuaggaagcaggauggaaucccuacaucagagagugacuccuuugaguuaagcagugccuucaccaagcucucagggguaggagugacugagucccuaaacccuuacgucaagaacuggaccagaucacuuuugucagggcaaccgacagaagcaucugcacaccucagcacugccguugacaaaccauguucacaccuaucucagcacacccccacagcaagccugugugugaggucucuuccccauuuacauggaggaagccaugcccagagaaguuagggaaccugcccaagguuucacagugugagugguagagccaggaccugaacccagaucuggcuaucuguccucuccaauccaucacucccaaggaacaaa

SEQ ID NO: 19326 - RNA, 2638 nt, Homo sapiens
uuuguuccuugggagugauggauuggagaggacagauagccagaucuggguucagguccuggcucuaccacucacacugugaaaccuugggcagguucccuaacuucucugggcauggcuuccuccauguaaauggggaagagaccucacacacaggcuugcugugggggugugcugagauaggugugaacaugguuugucaacggcagugcugaggugugcagaugcuucugucgguugcccugacaaaagugaucugguccaguucuugacguaaggguuuagggacucagucacuccuaccccugagagcuuggugaaggcacugcuuaacucaaaggagucacucucugauguagggauuccauccugcuuccuaguagggcacgugcuuuggggcuugaauacccaaaagcccugauguggaaacaaaacaggaaagaaaugagcuggagacagccugggaugugggcugcuuuagaaaaugcccuguauguguagcucugugucucuuagagacagcagggaccugcugagaaggguugucagguguagaugugcagaacgucccagcuagaaucuagcucacacuccacauguuagagcagcaccuggcguaaaguaugccaccuucucauucucauacuaaagaccccaaguugcuagccaacugaaugcugucuccuuccagaggaggugcuuuuuguaauucucacaaagguguccuauggauuaguuaggugucccuugguuaggacagggaggagggaaggggccauccacaguggugaagauggcaccucacaaguguccagugcauucccuuuuacaaaguucuuuuagacacauggucuuggcaaaccuacaagacaggugggccgucucccauuuuauagaugagaaagcugaggcccaacaagggaaagcauuuuggcccaaggucacccauggagcacugagguuuuuugacucaaauuccguaugccuuccugucacucuucccuccuagacacagguauguccagccaauuuguucugugccucaguuuaccuuuuugcaaaacuaggagaggagaucagaggaaugagucuugggauccagggugaggaagacagaaagcaaaaccaaacaaaagcaagcaaacacauucucuaguguuuugucuucugggaacacggaaaacagcucagcuuuuccauaccgcugcuuuccuaguggguccugccccagaagcagcugcccagcaaccuccugaccaaggcuggugcaccccaccagugccaagggucuuccugugcacccaguacccagccuccguuucacccacacugcccaauucccagaucccuggauccucguccuucccugaacccccuucccugagcaggucagaggugugggagggugugucaggugggugucauagcuccagggaaggaaauggcuguuccuggcucuguccaggugggguucaaaauagucaucuucaaagagaaaaacugggacacagagcuggagagacccagagccccggagccaaggcgggaggugcagcgaugucaggcugaggggaucgcagaguucccccuugcccugccacucaccaguuaacccuucccucaagcccugccagagcccccuccccaaccuaccuugaaagccccucauccuuccaagaagucccacuuucacagaagccaauuaauccuuauuuuuaaaaaacaaaaaccaaucccucucccccgagaccuucccuccauccauccaucccuuuggaaugaaagcccuugugccuguuucacgaaaaggcucccagguccuccuuucaaggaaaaaggacccaauuuccccgcgccuccccagcccucgcuuccaguaaagggggaaccucggcucccugccuccccucagcugcccucaccuggcugggggcggcggucgagucggguucggucugagcccgcgaucuggcuccgggcugcgggcugcgggcugcaggcugcaggcugcgggugccgggcugcgcgcugaccgcccgcgcugcggcaggggcggcgggggcuccggcugcuuuucccggcucugaggcggcagcggacagggugcuggggccaggggccgggcguggggaggcgugagggaaagggaaggucagcuagagagggagccgagcgagagcgaagaggcgggggagagacgggagggggagaggaggggaguaggggagagggaggggcgagcugcggggccuaggggcuccgcacggagucugcgccgagcacuggacccuuccucaucugugaccuccuuagagcuucguccucugggucuagagagcaggcaucauuaaucugagcaguuggggaaacugaggccagaggcagcagcuaacgcgggguggcccagagcgcucuacaguccagcuuccuuccuaguguggggagagagggcuagagcuggacucagaggcuggacuagccuuugggcugcaaggacaguggaaggugagauuuuggcugggacagauguccaagcuaaguggccuugggggagaggucugaaggaagagaaggauaaaugggucaauguugccaguaaaggaagagcugaaaauaaccuaguuuuuccuccucaccu

SEQ ID NO: 19327 - RNA, 2738 nt, Homo sapiens
gagcgggggcgagacuugcugcuaggauaauuuuuuuuuuuuaaguuagggaaauuuaagcaguaguaauagcgacagggagggggcucucucucgggccaggaaugugggggcggccugaggaggagcggggccccgcgcaggaggcgccggcggguggggucgggggaccagggagccggggccgagggcgggaaggggccgggccggcgcugggggcgggcccaggcgcgguggcgguggccggggcugcggcgcggggggcggggcggucgggcccgggacacccccucccgguccccuggcggggcagcgucggcucuggcagcacuggaggcggcggcggcccgagggcgacuugcggggcgcgcaggccgccgugcacccgggacgcuucccccucggggacccuccgcgggcuucuccgccgcgccguccggcgggagccggcgggaccccgggcgagcggcgcgggcggcaccaugaggcggcaguggggcgcgcugcugcuuggcgcccugcucugcgcacacgguaagcggcgcccgccgggaaaguuugucccuggguccggccgcugcaggacucgccucccgggaccuggacggcgcgggccggggccugagaccccucgcccucgcuccuagccguggcccuggggcugcgugcaggggagaggacccggagcggccccggcuccagcaguccgagcgggggcaucagcggaggcgcuuccgcggguucgggucugggccggggcgcgggucugggccggggcgcggguaagguccggggcguucguucgcucgcccucccucgcugcucuuucaagagcgggggcugcuucccuuucagguuaggucgggggcucuguguccuuggugcgaaugaaugcgugcgaagaaagggaggcgggugaggagggucgcuaaacccauaaauuguaaauagcccuccuuccuggggcugggggcucgggcggguugcggagagaggccccgguagaaucugguacuugggcaccgggauuccucuacucggagaacgauucccggacuccaggucuugcucccaccaaggggcucuggggcacuguuugcgggcagcaucuccccucggcgguguuucggggucccucucuuggcugcggccagucagcuuccagcccuggaucguccuaaagggaggugguuggaaagggggcugaggaggaauauagggaagaaacugcuggaaggcucccgcagaucugcccuggcugggguaggggggcagggggccgguaacccugaaccccagaaggcagccgccgggcccucgcggcagggucccagcccucgggggagcuggacggcugcagcaggacuccuuggugcccguacccccuguugugugggacuagggcuccgauggaaucugcuucuccgcgggcucuuaacgacccugggugcaccccgugauugagcagcuuucccuaguuugugcccagagaucaaagaacuuugaucuuugaaccccagcccuauucacccaucgcuauucaucguggcgggaguuccgagucuccccauuugccucgcagccccgaugaagggagcuggggcucagaauggaggggucuggagacccugccuggucuuuuaccgguucuuucuuucacguaggacagcucguguggaaaaagucagugcagauuuccgaacuugccuggcagggcguggagaugucuaggcacucguuuuaaagauugguuuaccucccaaauccaaaacagaguuuucaugucucuuauuuaaacuaccuguggguuuucaggggcuuuuuuccgcguccucucuagcgcggacugagcucuuucucuccgaagagcgguagcuuggccggcccacguuccgcuccgcucugcgcucuccccuccccggcucucuccuggaagguuauuuguagccucuuuggcguguugggacagcggcccuacugggguaggaauguagcuguucuucccaccacaugggccccuuaaagggacagcuuugcuuuuugggggguuucccccuucggguugcaaggaaaggggauggaacuuuccucucagcccccuggaggaaguuuugaaaaagaucaagggaaauggcaaggcacugggaaaaaaaaaaaaaauuaggguuaaaacggauaccaacaaagccagagaggagauugucgccuucugcccuagggaagggggagcuggaagguuccgggcugagacuggccaagaagauuuuacugcuccagagcugucaacgcugcaaauauuacaugugcauagaggaugggggugagaauggggggagagaauugcguaugucuaauguuucacagaaaaagaaugggaggauucgcgguaacgcuuuuagguuucuuucucuuuuuuuucuuggagagggugucucacucuguugcccaggcuggaaugcaguggggcaaucauagcucacuacagccucgaccucccaagcucaagugaucuugucaucucagccuccugaguaacugggacuacaggcaugcaccaccauacccuacaaauuuuuguuuuuuuuucuagagaugggguuucaccauguugccaaggcuagucuccaacuccugggcucaagugauccaccugccucggccucccaaagugcugguauuacaggugugagccacuguguccggcccagguuucuuuuuaaggaaaaaaguuuaauaga

SEQ ID NO: 19328 - RNA, 2738 nt, Homo sapiens
ucuauuaaacuuuuuuccuuaaaaagaaaccugggccggacacaguggcucacaccuguaauaccagcacuuugggaggccgaggcagguggaucacuugagcccaggaguuggagacuagccuuggcaacauggugaaaccccaucucuagaaaaaaaaacaaaaauuuguaggguaugguggugcaugccuguagucccaguuacucaggaggcugagaugacaagaucacuugagcuugggaggucgaggcuguagugagcuaugauugccccacugcauuccagccugggcaacagagugagacacccucuccaagaaaaaaaagagaaagaaaccuaaaagcguuaccgcgaauccucccauucuuuuucugugaaacauuagacauacgcaauucucuccccccauucucacccccauccucuaugcacauguaauauuugcagcguugacagcucuggagcaguaaaaucuucuuggccagucucagcccggaaccuuccagcucccccuucccuagggcagaaggcgacaaucuccucucuggcuuuguugguauccguuuuaacccuaauuuuuuuuuuuuuucccagugccuugccauuucccuugaucuuuuucaaaacuuccuccagggggcugagaggaaaguuccauccccuuuccuugcaacccgaagggggaaaccccccaaaaagcaaagcugucccuuuaaggggcccauguggugggaagaacagcuacauuccuaccccaguagggccgcugucccaacacgccaaagaggcuacaaauaaccuuccaggagagagccggggaggggagagcgcagagcggagcggaacgugggccggccaagcuaccgcucuucggagagaaagagcucaguccgcgcuagagaggacgcggaaaaaagccccugaaaacccacagguaguuuaaauaagagacaugaaaacucuguuuuggauuugggagguaaaccaaucuuuaaaacgagugccuagacaucuccacgcccugccaggcaaguucggaaaucugcacugacuuuuuccacacgagcuguccuacgugaaagaaagaaccgguaaaagaccaggcagggucuccagaccccuccauucugagccccagcucccuucaucggggcugcgaggcaaauggggagacucggaacucccgccacgaugaauagcgaugggugaauagggcugggguucaaagaucaaaguucuuugaucucugggcacaaacuagggaaagcugcucaaucacggggugcacccagggucguuaagagcccgcggagaagcagauuccaucggagcccuagucccacacaacaggggguacgggcaccaaggaguccugcugcagccguccagcucccccgagggcugggacccugccgcgagggcccggcggcugccuucugggguucaggguuaccggcccccugccccccuaccccagccagggcagaucugcgggagccuuccagcaguuucuucccuauauuccuccucagcccccuuuccaaccaccucccuuuaggacgauccagggcuggaagcugacuggccgcagccaagagagggaccccgaaacaccgccgaggggagaugcugcccgcaaacagugccccagagccccuuggugggagcaagaccuggaguccgggaaucguucuccgaguagaggaaucccggugcccaaguaccagauucuaccggggccucucuccgcaacccgcccgagcccccagccccaggaaggagggcuauuuacaauuuauggguuuagcgacccuccucacccgccucccuuucuucgcacgcauucauucgcaccaaggacacagagcccccgaccuaaccugaaagggaagcagcccccgcucuugaaagagcagcgagggagggcgagcgaacgaacgccccggaccuuacccgcgccccggcccagacccgcgccccggcccagacccgaacccgcggaagcgccuccgcugaugcccccgcucggacugcuggagccggggccgcuccggguccucuccccugcacgcagccccagggccacggcuaggagcgagggcgaggggucucaggccccggcccgcgccguccaggucccgggaggcgaguccugcagcggccggacccagggacaaacuuucccggcgggcgccgcuuaccgugugcgcagagcagggcgccaagcagcagcgcgccccacugccgccucauggugccgcccgcgccgcucgcccggggucccgccggcucccgccggacggcgcggcggagaagcccgcggaggguccccgagggggaagcgucccgggugcacggcggccugcgcgccccgcaagucgcccucgggccgccgccgccuccagugcugccagagccgacgcugccccgccaggggaccgggagggggugucccgggcccgaccgccccgccccccgcgccgcagccccggccaccgccaccgcgccugggcccgcccccagcgccggcccggccccuucccgcccucggccccggcucccuggucccccgaccccacccgccggcgccuccugcgcggggccccgcuccuccucaggccgcccccacauuccuggcccgagagagagcccccucccugucgcuauuacuacugcuuaaauuucccuaacuuaaaaaaaaaaaauuauccuagcagcaagucucgcccccgcuc

SEQ ID NO: 19329 - RNA, 2586 nt, Homo sapiens
gauucccagcccaagaguccuuucucucuuuccuuaggcaccccaucuucucccgcugccucuccuggcgcugccccaggugcgagaucaggagccuccccagcagggcuuuuccuccccaguguccuagugcuggaucccacugucuggucgugccucuuuuccugugcuggaccaaggcccagauaagcagcuggggaugcagggcugaauggagcagcaggaagaggcuucgggcggccgaguucauucagaagaaagcccaacucagagcugccaagggccgagagaagcuuacugcagggcucuacugcccugcuugacuucaaggguccgagcucugacaaaccucuuucccucugacuagugucuuuuaccagcuucaagaggagguguggaucccccgaucccugcugcuuuauuccugggaucugugccagaaccaucuauaggaagaccugauccaaccucucccccauuuuacagacaaagaaacugaggcucagggaggagagccagugguaggggccaagcucacaggggaagcagagccaggacuagaaaccaagucucgcugcagucaaugcaagcccucugcccuuauacccuugucuugucugcugaauuaugcucucucugccugggacaggggccuuccucagagcgcagggugaccaggaugugcugcuuaauggagaacagggagaccucagcccccaugccuccuugacuccggcuccugucccuuggccugguuccucaccaucaaucuaguggccugggacaguuuagguggaaguccaagaugcucaaguccucuaaggacuugacucuugccuggccaaguuuaucuugguccugggagguagaggucagcagguaaagagucucaagugcuugaucacaggguguguguguguguguggcgugugaacaggcaugcacacgcaacuggugguucacugaagagggggcucccacuagacuccccaaacaauccacauuucaucugggcaggcccuucugaacccaaauauuuucucccauucuaaguccgugccccucccccaucaaggccuuagggcugagccugagagagggagggagggaagaagagagagaagccacguuuccuuagggagggaggggaagagugagaaagaggagaaagacaagcucacagucggaccuagucaagaagacauagggagagggagaaagucagccagacuccaggaacagagggacagagcagagaucuagaggcagauggagagaaauggcucccuccuccugagccaucacccuauguugcccugaccgccucuucccagcccccagccucaggucccucccugggguggggggucucugggccugauucccuggggcugccaggguagcacccugaaauuucugggccuggcuuccccgaggggucgggucucaggcccucugaacguuccccggugcgccccccagcggagauccagccuaugagccaccgaagccccaagggaggcgcaggaaagggcgcugccacuuugcgcccagucugguccuggaaccugggguggguuggggacggcuagaagacguggguggagggcgggauuggugucucuugagcucagauccgaggaucggacggacccgauaccucgauggccccuucccccuagaagguggaggccaguguauucaaagauugagcccccaggaggggcgcuuagcuccaaacacaugucgcuccuggagacccugcgcugaacccucuccccggcuccugcccagugauguguagucggguccuucuaggggcccaggcgcgccgcgaggacgggugccgagggguggaacgggaacggagacccuucaucuuaccgcauuguugaggaaguccgacucguucagaucccccaaguccaggaagcuggauccggggaacagccugucggccgggaaggguuccaagacggcguccaucgcagccggcucccgggacccccuuccacugggcuucccucacuccagggcggcggcgcgcccaguccagagcuccugccugagcgcuggcaaacgggcggggggcagguccggggcgaagccccgggggaggggcggacggaggcggcgcggccccggguggggggcgcggggcgcgcgggggccuuagggcagcggcuaggagcgggaugggcucaggggccccgggcgcaccgugggcauucagccgacuccaccuccuccugcuccuccuggggcacagcuggcuuccauggggagcccgggguuggggcugagggcuucaggagccccccggacagggugggagccggggcgggggagcuaagugcucccccgagacuggguggcugccggccucuccucugucucugcgucucccuccgcacgucuucugucacuuuccucucugugaaaccgggaaccccuggcuggcuagcccagcuggccaaggcgccacgcccccacaucaauauucacaauaauuuaauauuaaugagaagagggcguggcucgaggaauccucucuccuuuuuuaaagagacaucugcaacuucgucu

SEQ ID NO: 19330 - RNA, 2586 nt, Homo sapiens
agacgaaguugcagaugucucuuuaaaaaaggagagaggauuccucgagccacgcccucuucucauuaauauuaaauuauugugaauauugaugugggggcguggcgccuuggccagcugggcuagccagccagggguucccgguuucacagagaggaaagugacagaagacgugcggagggagacgcagagacagaggagaggccggcagccacccagucucgggggagcacuuagcucccccgccccggcucccacccuguccggggggcuccugaagcccucagccccaaccccgggcuccccauggaagccagcugugccccaggaggagcaggaggagguggagucggcugaaugcccacggugcgcccggggccccugagcccaucccgcuccuagccgcugcccuaaggcccccgcgcgccccgcgccccccacccggggccgcgccgccuccguccgccccucccccggggcuucgccccggaccugccccccgcccguuugccagcgcucaggcaggagcucuggacugggcgcgccgccgcccuggagugagggaagcccaguggaagggggucccgggagccggcugcgauggacgccgucuuggaacccuucccggccgacaggcuguuccccggauccagcuuccuggacuugggggaucugaacgagucggacuuccucaacaaugcgguaagaugaagggucuccguucccguuccaccccucggcacccguccucgcggcgcgccugggccccuagaaggacccgacuacacaucacugggcaggagccggggagaggguucagcgcagggucuccaggagcgacauguguuuggagcuaagcgccccuccugggggcucaaucuuugaauacacuggccuccaccuucuagggggaaggggccaucgagguaucggguccguccgauccucggaucugagcucaagagacaccaaucccgcccuccacccacgucuucuagccguccccaacccaccccagguuccaggaccagacugggcgcaaaguggcagcgcccuuuccugcgccucccuuggggcuucgguggcucauaggcuggaucuccgcuggggggcgcaccggggaacguucagagggccugagacccgaccccucggggaagccaggcccagaaauuucagggugcuacccuggcagccccagggaaucaggcccagagaccccccaccccagggagggaccugaggcugggggcugggaagaggcggucagggcaacauagggugauggcucaggaggagggagccauuucucuccaucugccucuagaucucugcucugucccucuguuccuggagucuggcugacuuucucccucucccuaugucuucuugacuagguccgacugugagcuugucuuucuccucuuucucacucuuccccucccucccuaaggaaacguggcuucucucucuucuucccucccucccucucucaggcucagcccuaaggccuugaugggggaggggcacggacuuagaaugggagaaaauauuuggguucagaagggccugcccagaugaaauguggauuguuuggggagucuagugggagcccccucuucagugaaccaccaguugcgugugcaugccuguucacacgccacacacacacacacacccugugaucaagcacuugagacucuuuaccugcugaccucuaccucccaggaccaagauaaacuuggccaggcaagagucaaguccuuagaggacuugagcaucuuggacuuccaccuaaacugucccaggccacuagauugauggugaggaaccaggccaagggacaggagccggagucaaggaggcaugggggcugaggucucccuguucuccauuaagcagcacauccuggucacccugcgcucugaggaaggccccugucccaggcagagagagcauaauucagcagacaagacaaggguauaagggcagagggcuugcauugacugcagcgagacuugguuucuaguccuggcucugcuuccccugugagcuuggccccuaccacuggcucuccucccugagccucaguuucuuugucuguaaaaugggggagagguuggaucaggucuuccuauagaugguucuggcacagaucccaggaauaaagcagcagggaucgggggauccacaccuccucuugaagcugguaaaagacacuagucagagggaaagagguuugucagagcucggacccuugaagucaagcagggcaguagagcccugcaguaagcuucucucggcccuuggcagcucugaguugggcuuucuucugaaugaacucggccgcccgaagccucuuccugcugcuccauucagcccugcauccccagcugcuuaucugggccuugguccagcacaggaaaagaggcacgaccagacagugggauccagcacuaggacacuggggaggaaaagcccugcuggggaggcuccugaucucgcaccuggggcagcgccaggagaggcagcgggagaagauggggugccuaaggaaagagagaaaggacucuugggcugggaauc

SEQ ID NO: 19331 - RNA, 2772 nt, Homo sapiens
ucucaaagcauauugcuugcuacugucucaggcgcuauccugagcuggcagagagugaugguauauuuauuaaaagacguauuguccucuacuaagagcacuggcugggaaaucaggacaccugagcucuugagaaacaauaaaguacaguggucgggcaugugaacugugaagccagauugcuugaguucagaucccagcucugccacuuauuagcugggugaucuuggacaaguuaguuaacuucucugugccuugguuuuucccucuguaaaauguggauuauaaucccaucuuguuaugaagauuagcugaguuaauauggcuaagauccaugugccuggcacauuuuaaucacucaacaaaugucaguugcuuuugcugcuguuguuacuauuauuauuacuauuguucuugccccggcugggcuccuaacuugcugggugaccuuuaguaaguuacuugcucucucugugcccccaggcucuuucuccuaugacugcugcaccaaaggagcugggacagaugaaguccuaggaugccuagaagaguuguucuucacugcuucaguccccaugaccacucuaucccccguggccccagcugccacucaccgaugaugauaccgcaggugagcagggcauagaaggagguggucugcuugagcagcagguaggagagcagcacguugaagacgguggugagugagcggcccacauuguagaaggccacaccgacguacuugaggcagagguuauugaaggugaucaugccgaugaagaccaccgacaggggcaggacgcugcgggccacccugagguccaggcgcaagcuggggaaguccacggcaccagggcagcaggcggccagagcgcugaggccuuugcacagcagcguggucaccaggcacugguagaaggugacgaagauggggguguccagccgcagggaggggcuguccagcagguacuuauuaaggaacaccauggagauggaggugacccaguagagggagaccaccagcgcgaucugcaaugcccgcagcagaaagggcuucuccccguuggccucugccucugcagaggggucugaggccccggucagcgccaugugcaggauccuggaccgcuucagaggggcccuauucaugguagcagaggagcugggucaccccgcggccagaacucugauucccuggaguccagggcagugagcucacuugugcucuccgcaaggaagccgcagcccuccauugucacaugugggcuggccuaaaggccuccccauuguccucauggauugagaaguucugcuuuggggugagcccaguugugcugcuccacaaccuacucccaccccgagggggcucugagacaagacacagggcaagggagaggaauaggauaaggcggugaggccaggacagagaagaccugugaggggagaagaggcuggggccuaacagggaggggucgcagagagaagggaggggagaggaauggcagggcggggcaggaguagguacgcggggcgaaggugcaggaaaaggacgcguggcagagugggaagaggugccgagagggcgucaugggcggcugugggagggaggggcgggcagggggagggaggcguacagggagcugccggaggccgggcgcggcuggagggagggcugcggaagggucagaggggcucggggcuuggggcugaaggacgcgggagggggcugggccggcgcccacgucucgcugccuucccgggcucugucgccggcucagcccaggagccuccggacauccgaggccgacuccccgggaggcgggcccuggacucacuuccugacacgcccccacguggccuuaaagggcccgcacgccccgccuugcccuuaaagcgacagccccagagaggcggaguucgccaguccccagccccgccccugcgcuccgcugcccgcugcuggcgggggaccucggcagccacagguuuuucugggugcuugagccucgcccugcuuccuggaagggcuccaucaaccucgccugcccacccucagcuccguccgccccggagccuccgucccccgacuuggcuaggcuuggcucgcagguccacuucccggaaccccgacccaggacccgggcggcgcuacaucagccuggaccccuccaccuccggagacucgcguugcagccccgcgucccucugccaauccgagcucacucuuccauaacaauguugugguccccuccuuuccccccauuuucaccgcccccaggcccucucccaagcccgagacccccggcagcgcuccccgaggccggaggccacgccgccucucucggacuucaguuuguccucccugugcuccugucgagguccucugggcggcccggauccgagauuccaaaggcucaagacagcaucucuuaccccuuccagaaaauacuguuuccccggccgguccagccgcaucagcucccgcgucccugccuguguccccgggccgcgaaggcgaccuggcgcucaccuccuccggugcacugggcgcccgccccgcgaccccgugcugcaucugcagcgccgcacccugggccgcgcccgcgggaucgacuuccugcuuuccgccccgggcccgggcaccuugccagccucgccggccuguucgcggcaugggccccgggggugccggcggagaggcggugauccggacggucgugggaggaggcccucuccucuuuccaaggcuacuccugucccugguacccccgc

SEQ ID NO: 19332 - RNA, 2772 nt, Homo sapiens
gcggggguaccagggacaggaguagccuuggaaagaggagagggccuccucccacgaccguccggaucaccgccucuccgccggcacccccggggcccaugccgcgaacaggccggcgaggcuggcaaggugcccgggcccggggcggaaagcaggaagucgaucccgcgggcgcggcccagggugcggcgcugcagaugcagcacggggucgcggggcgggcgcccagugcaccggaggaggugagcgccaggucgccuucgcggcccggggacacaggcagggacgcgggagcugaugcggcuggaccggccggggaaacaguauuuucuggaagggguaagagaugcugucuugagccuuuggaaucucggauccgggccgcccagaggaccucgacaggagcacagggaggacaaacugaaguccgagagaggcggcguggccuccggccucggggagcgcugccgggggucucgggcuugggagagggccugggggcggugaaaauggggggaaaggaggggaccacaacauuguuauggaagagugagcucggauuggcagagggacgcggggcugcaacgcgagucuccggagguggagggguccaggcugauguagcgccgcccggguccugggucgggguuccgggaaguggaccugcgagccaagccuagccaagucgggggacggaggcuccggggcggacggagcugagggugggcaggcgagguugauggagcccuuccaggaagcagggcgaggcucaagcacccagaaaaaccuguggcugccgaggucccccgccagcagcgggcagcggagcgcaggggcggggcuggggacuggcgaacuccgccucucuggggcugucgcuuuaagggcaaggcggggcgugcgggcccuuuaaggccacgugggggcgugucaggaagugaguccagggcccgccucccggggagucggccucggauguccggaggcuccugggcugagccggcgacagagcccgggaaggcagcgagacgugggcgccggcccagcccccucccgcguccuucagccccaagccccgagccccucugacccuuccgcagcccucccuccagccgcgcccggccuccggcagcucccuguacgccucccucccccugcccgccccucccucccacagccgcccaugacgcccucucggcaccucuucccacucugccacgcguccuuuuccugcaccuucgccccgcguaccuacuccugccccgcccugccauuccucuccccucccuucucucugcgaccccucccuguuaggccccagccucuucuccccucacaggucuucucuguccuggccucaccgccuuauccuauuccucucccuugcccugugucuugucucagagcccccucggggugggaguagguuguggagcagcacaacugggcucaccccaaagcagaacuucucaauccaugaggacaauggggaggccuuuaggccagcccacaugugacaauggagggcugcggcuuccuugcggagagcacaagugagcucacugcccuggacuccagggaaucagaguucuggccgcggggugacccagcuccucugcuaccaugaauagggccccucugaagcgguccaggauccugcacauggcgcugaccggggccucagaccccucugcagaggcagaggccaacggggagaagcccuuucugcugcgggcauugcagaucgcgcugguggucucccucuacugggucaccuccaucuccaugguguuccuuaauaaguaccugcuggacagccccucccugcggcuggacacccccaucuucgucaccuucuaccagugccuggugaccacgcugcugugcaaaggccucagcgcucuggccgccugcugcccuggugccguggacuuccccagcuugcgccuggaccucaggguggcccgcagcguccugccccugucgguggucuucaucggcaugaucaccuucaauaaccucugccucaaguacgucgguguggccuucuacaaugugggccgcucacucaccaccgucuucaacgugcugcucuccuaccugcugcucaagcagaccaccuccuucuaugcccugcucaccugcgguaucaucaucggugaguggcagcuggggccacgggggauagaguggucauggggacugaagcagugaagaacaacucuucuaggcauccuaggacuucaucugucccagcuccuuuggugcagcagucauaggagaaagagccugggggcacagagagagcaaguaacuuacuaaaggucacccagcaaguuaggagcccagccggggcaagaacaauaguaauaauaauaguaacaacagcagcaaaagcaacugacauuuguugagugauuaaaaugugccaggcacauggaucuuagccauauuaacucagcuaaucuucauaacaagaugggauuauaauccacauuuuacagagggaaaaaccaaggcacagagaaguuaacuaacuuguccaagaucacccagcuaauaaguggcagagcugggaucugaacucaagcaaucuggcuucacaguucacaugcccgaccacuguacuuuauuguuucucaagagcucagguguccugauuucccagccagugcucuuaguagaggacaauacgucuuuuaauaaauauaccaucacucucugccagcucaggauagcgccugagacaguagcaagcaauaugcuuugaga

SEQ ID NO: 19333 - RNA, 2523 nt, Homo sapiens
aagggagaacacaggaagggggcuccaccagccaaugucacagcccugcuccggggccaccagcgcucuguuugguagaaaauugcagaauuagcucaacggcucaaacgcaaguuuuccuuuuucggaaagggaaugagggggggcccaagaauggggugcaucucccacagggacggccacucgggggccaaaccccaguagccaguuucuucggauccaauccccgugcuggcacaguaaagaauccuuuuauaagcuggguggagagaauguuacacuucucgccucggugaguucguccucccagaacuuugaaaggaaacagcgugggauugaaagaaaggggcaggugggugaaaagcugaaguuuuuagacaccuuugcgggugggcguuggccggcuggucccugacaguggcagaggcgaccgcccuuccccccaucauccauaccccagccccagaucucucucuuuuccucccggugacacuaagucccagaccggcggccguacuuggccuuacagugcaaaaugugcuuggcgaggaagucgaggcggcgcuguagcagcugagcgugggggucugcaagggcggccagcucggggaagcgaggcucguggcgccgguagaggcgcagcagccgggccgcggcguccuguccgcggugcagcuccaggacgcgccgcgcgguccgcucgcggaacacgcacacugacugcaacagcggcucguuauacuugucccacaugccugcuacccgguagccgugcaccaagcccgccucauuguccagaaagaccagcgccccgcccggaccgcggugcagguugcugguggcacgcugcaugacgcgcgggucccacugcaggcugaagagguugcuuacgagccggucgaaguuggccgucagguagucgaaaaggauuaagucgguccauuguacuagguccaccagcuccgccuggcugagguuggccagcucacccccggcaucccggagggggcgcagacggccguccuccgagcgccagggcgcgggcaccaccacguccgugagguugggcagccagcgugucaggcucaccacgcugcccucgguccagugcgcagcgcgcagcuccuccugcaccugcgcccacugcgcgccccgagccuccacccgagccagugccagcggcggcacguggcgcuggaggcccagcaggcgcgccagauaguaagacagggccucgcccugaaucugcuccggguugaugccguagcgcacgcaggcgcgggugccgucggcaaaacgggccagucgguuggagcugcgcccgcaacccccgcgcuccagggccaccauccgggcgccgcgagccgccuccagccacgccgccgccugggccuccgaaaagcccgggggcaccugcuccuccaggccgcggcuccagaagacgcccccgugcaccgcggcgcucuccuccggccggggcugccuggcugacacgugccaccugggcucgcuccgggacugccggggcgggccguccgcgccggccgccagggugagcagcgcccggaaaguuuucagggagccgccgcgggcgucccacgccaggggcgggggcagagggaagcgaggcgcgggcgcggggccgccgcuccgggccgggcgccgugggagucggucuucgggcggccgggaggcgggcagcucgguccgcggcggcaggagcccuccccacagcgccagcagcgagcccagcgccagcagccagagccccgcgguggcggcggcgccccgcauccuccugcccaugcucccgcggcugugccggugcgccgccgccgcuucaagccgagcccaggcacccgggucccggcggcgaggcgggcccggcaguuugugggcuccggggcuucgggcgcuucggccccaucgcggccgcggggcgcugcggggcucuguccggcgcuccgcccggcgcugggaacucgaguccccgccgcuucccagcugcuuuuguauuucgcugugagacccuccggugggcgcgauucacaggcgcccggaccacgugggagccagggggaucccccucccccuccuccgccuccgcuccccgccccccgcucccccgcccccuuccucuccucuuccacuuaaagcggcgauggcuccuuccgagagggagaggcggccccacacucgguccgggacuugggggccuggaggaagccggacuggcugcgcccgcgccggggcguaggaggggguggcgcagagccggagucuggggccuggcgggagggacgcgcccugggcccucgcgggggugucuuggucgccgggucccuuugccuaggcagcgcgggucuccugcaaacuucagacagauuuccaccucuuuccgagcuccgccaggcuaggaucaggcagggucccuuugcuuucucaguuucugucugggugauucacgcugcuuuauguaaaucucugggaaugucuccgagccacagaggaugugauuccagc

SEQ ID NO: 19334 - RNA, 2523 nt, Homo sapiens
gcuggaaucacauccucuguggcucggagacauucccagagauuuacauaaagcagcgugaaucacccagacagaaacugagaaagcaaagggacccugccugauccuagccuggcggagcucggaaagagguggaaaucugucugaaguuugcaggagacccgcgcugccuaggcaaagggacccggcgaccaagacacccccgcgagggcccagggcgcgucccucccgccaggccccagacuccggcucugcgccacccccuccuacgccccggcgcgggcgcagccaguccggcuuccuccaggcccccaagucccggaccgaguguggggccgccucucccucucggaaggagccaucgccgcuuuaaguggaagaggagaggaagggggcgggggagcggggggcggggagcggaggcggaggagggggagggggaucccccuggcucccacgugguccgggcgccugugaaucgcgcccaccggagggucucacagcgaaauacaaaagcagcugggaagcggcggggacucgaguucccagcgccgggcggagcgccggacagagccccgcagcgccccgcggccgcgauggggccgaagcgcccgaagccccggagcccacaaacugccgggcccgccucgccgccgggacccgggugccugggcucggcuugaagcggcggcggcgcaccggcacagccgcgggagcaugggcaggaggaugcggggcgccgccgccaccgcggggcucuggcugcuggcgcugggcucgcugcuggcgcuguggggagggcuccugccgccgcggaccgagcugcccgccucccggccgcccgaagaccgacucccacggcgcccggcccggagcggcggccccgcgcccgcgccucgcuucccucugcccccgccccuggcgugggacgcccgcggcggcucccugaaaacuuuccgggcgcugcucacccuggcggccggcgcggacggcccgccccggcagucccggagcgagcccagguggcacgugucagccaggcagccccggccggaggagagcgccgcggugcacgggggcgucuucuggagccgcggccuggaggagcaggugcccccgggcuuuucggaggcccaggcggcggcguggcuggaggcggcucgcggcgcccggaugguggcccuggagcgcggggguugcgggcgcagcuccaaccgacuggcccguuuugccgacggcacccgcgccugcgugcgcuacggcaucaacccggagcagauucagggcgaggcccugucuuacuaucuggcgcgccugcugggccuccagcgccacgugccgccgcuggcacuggcucggguggaggcucggggcgcgcagugggcgcaggugcaggaggagcugcgcgcugcgcacuggaccgagggcagcguggugagccugacacgcuggcugcccaaccucacggacgugguggugcccgcgcccuggcgcucggaggacggccgucugcgcccccuccgggaugccgggggugagcuggccaaccucagccaggcggagcugguggaccuaguacaauggaccgacuuaauccuuuucgacuaccugacggccaacuucgaccggcucguaagcaaccucuucagccugcagugggacccgcgcgucaugcagcgugccaccagcaaccugcaccgcgguccgggcggggcgcuggucuuucuggacaaugaggcgggcuuggugcacggcuaccggguagcaggcaugugggacaaguauaacgagccgcuguugcagucagugugcguguuccgcgagcggaccgcgcggcgcguccuggagcugcaccgcggacaggacgccgcggcccggcugcugcgccucuaccggcgccacgagccucgcuuccccgagcuggccgcccuugcagacccccacgcucagcugcuacagcgccgccucgacuuccucgccaagcacauuuugcacuguaaggccaaguacggccgccggucugggacuuagugucaccgggaggaaaagagagagaucuggggcugggguauggaugauggggggaagggcggucgccucugccacugucagggaccagccggccaacgcccacccgcaaaggugucuaaaaacuucagcuuuucacccaccugccccuuucuuucaaucccacgcuguuuccuuucaaaguucugggaggacgaacucaccgaggcgagaaguguaacauucucuccacccagcuuauaaaaggauucuuuacugugccagcacggggauuggauccgaagaaacuggcuacugggguuuggcccccgaguggccgucccugugggagaugcaccccauucuugggcccccccucauucccuuuccgaaaaaggaaaacuugcguuugagccguugagcuaauucugcaauuuucuaccaaacagagcgcugguggccccggagcagggcugugacauuggcugguggagcccccuuccuguguucucccuu

SEQ ID NO: 19335 - RNA, 3190 nt, Homo sapiens
gucagaaugcccaaagacaaagcagaagauggcacugguagguaacauacaaauaaacuucccuagagacuauagggaaaccaccagggcccucuucuuucaggccaggcccagggcucucccugaucuccagcuugacucuucucucccauccugaauguuuccacuuuucaagggcuuauuugagcuccagucccuuuuggaacuuucccuaaggccuagaguccaccaaaauccuucccucccugaaauccuuccaaguucguccaucuuauacagucuaacauauucuaagccuaggcuuuggagcucaguggagcuggguuuccauccagcacugcuccuggcuaugugaaugccagcaagucacuuaacgucucuaagcaucaguuuuccuccugucaaacaggccugauaacaggaagcuucuuacuaggccauugugaggguagaaugagauaacacauggaaaauauuuaacauaaugccuggcacagugaaaauauacaguaaaugguagcuagcacuguauucauuuuuuuuuuuuuaacagagucacgcuuugucacccaggcuggagugcaauggcauaaucuugguucacugcaaccuucaccuccuagguucaagcaauucuccugccucagcgucccaagcagcugggacuacaggugugcaccaccacacccugcuaauuuuuguauuuuuuguaaagaugggguuucaccauguuggccaaggcuggucucaaacuccugaccuuggguaauuugcugccucagccucccaaaguccuaggauuacaggcaugggccaccaugacaggcuguguuguugcuaucauuauuauuauuauuucagcuucaguaguauaaauccuagauccccaaauccccaccuagcaaagaccucucacucacacagaaagggagaugcauaugcacagagaacucauccugccuagccuccaccuagggucacuuucuuccuacugcagaaaguaggaagauagagaaagcagaaaguaauucaagauacuuuauacuggguacucaaucuaaacuaccugggugagacuguguguuucaauuucucaguacucccguggaacuggguuaauaaauauuugcugaguagaauuuacugcaugcaggcugagcugucuuaaugacccagcuggcacuucuuaaaagaaagauuaauuuuggccagcgauaagcaaaucggccauguaauuaucuguacauacauagacaaagaaagagaaugcuuggaguugagccgugcuagaauauaccuuacacgcagccccuccccuccauagccaccacaaagcacugacccuguuuggaugagauauuggagcccuagcuccagggucccugauguugcccugguaucaaggcucuucucucugcucugaggcugccaggcagggaauauaagccaccuuacuguugagauuuccccacacugauuggcagaagcaggagguggugaggaccaagcagcugguccagugguugccucucauauucaugcucccuaucccaggcuggaaucucauggagacccaagaccucaccgcagagcugguucaagcuuccacagcgcuaagguggcagugacacugcggacuguaagcuuuggaacaaggcucaguggggagcugggagaacccaggaccccuuucuggaaaacccauugccagcuagucucacacuuggaauugugaucccuucugugaccaccuugauaacagccacucgcccuguuccagccccagucucugccccgcccagcucugcccugccuagacacagcccgguggggcuuggcgagcccuugggcacaggagccuguuaguccagacaacgacugugcgcauccgggagaacgguuacuuucugccaugugcugcagcucuagcgaccucgcccaaaacugcgcgccggcagccugcccaacaaacuuucuucucuuucucuuuuucuuucaaccaaauggugcuuccacagacacauucuccaacgguuuagcgcaaaucccagcccugcuuuccggagcccaaugcacuucgcagacagcucacuugacuccagucccccagggccgacucagccggaggggcugccgccggguccgcgcugagcaccccgcacccaucuugcugcccaggcugcggcgggcacucaccgaucugcgccaggcucagcggcacgaggcagaguccccaggcugcgugccaccaaaacuuguccaugguguccggagcgaacggagggcgcgggcgaaaggagcuggaggaucccugggcgcggggcaggggccggcggaggacgggacgaggauggcggaccgaaccuggcagaggcugggguccgcugggcaaugaggcugccucggaaguuggcugcaguuuuuauucgagguugaaaacagugaccuaagacggagggagggagcgagcgaaggacacacccaagcaaggggggcugugacuaagcagcccgcagagguuuuaagaaguagcagcccucccgggcgggccccucugcccccgccccgugcucugcugaggcuguaaauaaucggggcugccagggacgugggucggggaaccuggagugucgcggggugccugugccuccgagccccacuggccccugcgcccagagacgcacuggcuuucuucucccgcuggccccgcggcgucaggacagaggaugaccgaaccguaaaaccuugcaccauuggguucagccuuuggccucuccuuucccgcuaaauuucucugaauccggcuggagcaagaucucuggguuucacaggauguuggauauccugggagaggagcuggagagagggcgaggucuugcccuggguggcgcagugccuccgugcccacaguggggagugagggguggggaguuggugaaucuuccaaguggaaagagggagagcucauucuuuuuccccucaauaacaaguccacauggcuugaaugaauuuuagcuucuuggcagaacagcucagggaaagcuacugauggccugucauagggcuggcauuuggcucagcuaacccauguguucaagccagugugaaugggcaccucucuccacacacaugcucauucauccuccuaaauauccuuccauccgcccauccaucuauccacccaucuuuc

SEQ ID NO: 19336 - RNA, 3190 nt, Homo sapiens
gaaagauggguggauagauggaugggcggauggaaggauauuuaggaggaugaaugagcauguguguggagagaggugcccauucacacuggcuugaacacauggguuagcugagccaaaugccagcccuaugacaggccaucaguagcuuucccugagcuguucugccaagaagcuaaaauucauucaagccauguggacuuguuauugaggggaaaaagaaugagcucucccucuuuccacuuggaagauucaccaacuccccaccccucacuccccacugugggcacggaggcacugcgccacccagggcaagaccucgcccucucuccagcuccucucccaggauauccaacauccugugaaacccagagaucuugcuccagccggauucagagaaauuuagcgggaaaggagaggccaaaggcugaacccaauggugcaagguuuuacgguucggucauccucuguccugacgccgcggggccagcgggagaagaaagccagugcgucucugggcgcaggggccaguggggcucggaggcacaggcaccccgcgacacuccagguuccccgacccacgucccuggcagccccgauuauuuacagccucagcagagcacggggcgggggcagaggggcccgcccgggagggcugcuacuucuuaaaaccucugcgggcugcuuagucacagccccccuugcuuggguguguccuucgcucgcucccucccuccgucuuaggucacuguuuucaaccucgaauaaaaacugcagccaacuuccgaggcagccucauugcccagcggaccccagccucugccagguucgguccgccauccucgucccguccuccgccggccccugccccgcgcccagggauccuccagcuccuuucgcccgcgcccuccguucgcuccggacaccauggacaaguuuugguggcacgcagccuggggacucugccucgugccgcugagccuggcgcagaucggugagugcccgccgcagccugggcagcaagaugggugcggggugcucagcgcggacccggcggcagccccuccggcugagucggcccugggggacuggagucaagugagcugucugcgaagugcauugggcuccggaaagcagggcugggauuugcgcuaaaccguuggagaaugugucuguggaagcaccauuugguugaaagaaaaagagaaagagaagaaaguuuguugggcaggcugccggcgcgcaguuuugggcgaggucgcuagagcugcagcacauggcagaaaguaaccguucucccggaugcgcacagucguugucuggacuaacaggcuccugugcccaagggcucgccaagccccaccgggcugugucuaggcagggcagagcugggcggggcagagacuggggcuggaacagggcgaguggcuguuaucaagguggucacagaagggaucacaauuccaagugugagacuagcuggcaauggguuuuccagaaagggguccuggguucucccagcuccccacugagccuuguuccaaagcuuacaguccgcagugucacugccaccuuagcgcuguggaagcuugaaccagcucugcggugaggucuugggucuccaugagauuccagccugggauagggagcaugaauaugagaggcaaccacuggaccagcugcuugguccucaccaccuccugcuucugccaaucaguguggggaaaucucaacaguaagguggcuuauauucccugccuggcagccucagagcagagagaagagccuugauaccagggcaacaucagggacccuggagcuagggcuccaauaucucauccaaacagggucagugcuuugugguggcuauggaggggaggggcugcguguaagguauauucuagcacggcucaacuccaagcauucucuuucuuugucuauguauguacagauaauuacauggccgauuugcuuaucgcuggccaaaauuaaucuuucuuuuaagaagugccagcugggucauuaagacagcucagccugcaugcaguaaauucuacucagcaaauauuuauuaacccaguuccacgggaguacugagaaauugaaacacacagucucacccagguaguuuagauugaguacccaguauaaaguaucuugaauuacuuucugcuuucucuaucuuccuacuuucugcaguaggaagaaagugacccuagguggaggcuaggcaggaugaguucucugugcauaugcaucucccuuucugugugagugagaggucuuugcuagguggggauuuggggaucuaggauuuauacuacugaagcugaaauaauaauaauaaugauagcaacaacacagccugucaugguggcccaugccuguaauccuaggacuuugggaggcugaggcagcaaauuacccaaggucaggaguuugagaccagccuuggccaacauggugaaaccccaucuuuacaaaaaauacaaaaauuagcagggugugguggugcacaccuguagucccagcugcuugggacgcugaggcaggagaauugcuugaaccuaggaggugaagguugcagugaaccaagauuaugccauugcacuccagccugggugacaaagcgugacucuguuaaaaaaaaaaaaaugaauacagugcuagcuaccauuuacuguauauuuucacugugccaggcauuauguuaaauauuuuccauguguuaucucauucuacccucacaauggccuaguaagaagcuuccuguuaucaggccuguuugacaggaggaaaacugaugcuuagagacguuaagugacuugcuggcauucacauagccaggagcagugcuggauggaaacccagcuccacugagcuccaaagccuaggcuuagaauauguuagacuguauaagauggacgaacuuggaaggauuucagggagggaaggauuuugguggacucuaggccuuagggaaaguuccaaaagggacuggagcucaaauaagcccuugaaaaguggaaacauucaggaugggagagaagagucaagcuggagaucagggagagcccugggccuggccugaaagaagagggcccuggugguuucccuauagucucuagggaaguuuauuuguauguuaccuaccagugccaucuucugcuuugucuuugggcauucugac

SEQ ID NO: 19337 - RNA, 2684 nt, Homo sapiens
ggauggaaugcuugcucugcauaaggguacaggguaugagccuugucagaaacuuuugcaauugaauuuaugagagaaacuggagaaaauuugagucuuuaagcagaccuauagagaucaaauuuaaaguuugggcaauggcuagauuuguuuucuugugaggaugucagggugacuacagagaggagaauugccaaauauguagcuauuccucugccuucuuuaucauauacucuaaguaaacuggcuuaaauccaguccuucucucuccuuuugcauuggccccuuuuagaaauaugaaaguuacagauguaaauuacaaaguaagccaguauuacaugaaaacauguuuauugccugaauaauaaaacuuagcuaaggaguuauuagaauuaggauucccccuacuugaaguacaaguuuccaauaaacagacagacagaagcaaaaccccaaaugagaaagaauacauugguaaccuaaaucauaggcauuuguggguauguucauacaaucuaccuauuucuuuguaauuuacuauagcacugaugacaaagcauagacauacaaugagaaagagcaaaucagcauaucagugugacugugcaaccacuacaaagcuuggccuucuuaaauguggccacuuuaacuuacacacacccacagaggcaucagaaaucucccugcaaacacgauuugccuauaguuuuguggcaauacuguuacauagaacaaaaacaacucucagaccaugguuaauaaauaagagagaaaagaaguaagaaacaacuuccauggguuggcaggcaugcaaagcagcaccuugaaccucauuugaaaaacaggcaacugggauagcuuuuggagcccaggagugaaggcuagaggcugaaaggagcuaugcacuauuaucuuuggguauuuccacauaaucugcaggauggggaaguuuaauuccgcaccacauaaacugugcucuuuuagauguggcugaaacgggugucucugcagaauuagaaacccaucuagaaaugacauugcuuaaaauuguucuuuccaggugacaauuccauaacaaucacauaaauaauguacaaaaacaaaacuaaaaacaaagucacucaaguguccaauuuuucucuuuugaaagaugaccuuagauguauucucaaagugcaaaucgggauauaaaaaaauaguagguaugggggaaauguagccccaucuucugucccccacccuccaaaacggggcugauuugauucccucuuucuagcauuuguauccuuccaccuauacuuuaagauaaucauuuuucagccgaccuagucgggucccauggcuccuaauggugagggccagcagcucguauuugucccugagccccacagagauguccagugucuccuucagcagggaccugguguggaccagcauucccagaaaguccucguugagccugcucuccugccggcuguccuguuccuggcccugcuugaacuugcucuccagcucagugagggauuuguccgaguuggaguaggcauccccgaucuggugggacucccgccgcagguacuugccauagcucucuuccccgucuaggucguaggagaugcuuuugcugaugcccuccagcacgcgcccagcauccuccaccuggcggcccagcacggugaacuccucccgcagggugaggcucagcaggcugccaaccuggcuccccucccccugggagcagcgccuguggucacucacccugaagagcagcuggcacuucucggggucaucguucuccucauaguccccaucgggcacgaaguaguggugcagagucccauuggacaucucuggguagagggggccaucgaaguagccuugacacagguggcagaagaaacucaugcagaagaacuucagaaacaccauucuggauauucaggauggccagggaccccaggaggagacuuuuuacccaggcacaaggaagggagugucuuugcgagucagcgucucccugagacagcguccgccucagucccagcuggcuugcugcucccuggcccccaguccccagcaggcuucauguggcucugcacaccagcgucuggguagcgcgcccgccgcagcgcaggaugcacccacccuugcgccccucgcucggugacuggaacuccuccggcacaggcguagcggggaaccccuccuccggggcccuggcaagaugcuggcucuguugcccuccucucggaguuuccccuugcucccgggagauggaguguguagcuggagagaaaggcucuugcccccugauaguauuucaauuucuggacugggugggaaugcggagcuuuuccuuuggcuaaagauauccugaggaucucucugcucucaaauuacagcugguuucgucacuuggaagccagggaacaaguuuggaaaagaaccucucaccaggucuccacuauuaaagguacagggucgcuuuuuaaagguuggaagggaagacucuacaauagaauuuagcucgaaagagaaaaugagaagagaauaaauggaauuuccaccacaaaaacccugguuuguuauugacauauugggagggggaaggaaugauuacccuggaaaaaugccauuucacgugucucaauaaauaucagguuggauuuucugaguauaucuau

SEQ ID NO: 19338 - RNA, 2684 nt, Homo sapiens
auagauauacucagaaaauccaaccugauauuuauugagacacgugaaauggcauuuuuccaggguaaucauuccuucccccucccaauaugucaauaacaaaccaggguuuuugugguggaaauuccauuuauucucuucucauuuucucuuucgagcuaaauucuauuguagagucuucccuuccaaccuuuaaaaagcgacccuguaccuuuaauaguggagaccuggugagagguucuuuuccaaacuuguucccuggcuuccaagugacgaaaccagcuguaauuugagagcagagagauccucaggauaucuuuagccaaaggaaaagcuccgcauucccacccaguccagaaauugaaauacuaucagggggcaagagccuuucucuccagcuacacacuccaucucccgggagcaaggggaaacuccgagaggagggcaacagagccagcaucuugccagggccccggaggagggguuccccgcuacgccugugccggaggaguuccagucaccgagcgaggggcgcaagggugggugcauccugcgcugcggcgggcgcgcuacccagacgcuggugugcagagccacaugaagccugcuggggacugggggccagggagcagcaagccagcugggacugaggcggacgcugucucagggagacgcugacucgcaaagacacucccuuccuugugccuggguaaaaagucuccuccuggggucccuggccauccugaauauccagaaugguguuucugaaguucuucugcaugaguuucuucugccaccugugucaaggcuacuucgauggcccccucuacccagagauguccaaugggacucugcaccacuacuucgugcccgauggggacuaugaggagaacgaugaccccgagaagugccagcugcucuucagggugagugaccacaggcgcugcucccagggggaggggagccagguuggcagccugcugagccucacccugcgggaggaguucaccgugcugggccgccagguggaggaugcugggcgcgugcuggagggcaucagcaaaagcaucuccuacgaccuagacggggaagagagcuauggcaaguaccugcggcgggagucccaccagaucggggaugccuacuccaacucggacaaaucccucacugagcuggagagcaaguucaagcagggccaggaacaggacagccggcaggagagcaggcucaacgaggacuuucugggaaugcugguccacaccaggucccugcugaaggagacacuggacaucucuguggggcucagggacaaauacgagcugcuggcccucaccauuaggagccaugggacccgacuaggucggcugaaaaaugauuaucuuaaaguauagguggaaggauacaaaugcuagaaagagggaaucaaaucagccccguuuuggagggugggggacagaagauggggcuacauuucccccauaccuacuauuuuuuuauaucccgauuugcacuuugagaauacaucuaaggucaucuuucaaaagagaaaaauuggacacuugagugacuuuguuuuuaguuuuguuuuuguacauuauuuaugugauuguuauggaauugucaccuggaaagaacaauuuuaagcaaugucauuucuagauggguuucuaauucugcagagacacccguuucagccacaucuaaaagagcacaguuuauguggugcggaauuaaacuuccccauccugcagauuauguggaaauacccaaagauaauagugcauagcuccuuucagccucuagccuucacuccugggcuccaaaagcuaucccaguugccuguuuuucaaaugagguucaaggugcugcuuugcaugccugccaacccauggaaguuguuucuuacuucuuuucucucuuauuuauuaaccauggucugagaguuguuuuuguucuauguaacaguauugccacaaaacuauaggcaaaucguguuugcagggagauuucugaugccucuguggguguguguaaguuaaaguggccacauuuaagaaggccaagcuuuguagugguugcacagucacacugauaugcugauuugcucuuucucauuguaugucuaugcuuugucaucagugcuauaguaaauuacaaagaaauagguagauuguaugaacauacccacaaaugccuaugauuuagguuaccaauguauucuuucucauuugggguuuugcuucugucugucuguuuauuggaaacuuguacuucaaguagggggaauccuaauucuaauaacuccuuagcuaaguuuuauuauucaggcaauaaacauguuuucauguaauacuggcuuacuuuguaauuuacaucuguaacuuucauauuucuaaaaggggccaaugcaaaaggagagagaaggacuggauuuaagccaguuuacuuagaguauaugauaaagaaggcagaggaauagcuacauauuuggcaauucuccucucuguagucacccugacauccucacaagaaaacaaaucuagccauugcccaaacuuuaaauuugaucucuauaggucugcuuaaagacucaaauuuucuccaguuucucucauaaauucaauugcaaaaguuucugacaaggcucauacccuguacccuuaugcagagcaagcauuccaucc

SEQ ID NO: 19339 - RNA, 2591 nt, Homo sapiens
cacacagacacacacacacacacgcacacauacugccacuacccugcuaaaaaucccugaaauaguuaauauuaacaauuugacagugccauuuauccagagauaguaaucaaaucaccuacuguuauagacuuggcuuggggggcagugagaauauauaguuuucuuaagaucuuucccuccuugcuuugaaaaguacaucccccccucaagacucucaugcucccccuccuuccaaaaaaagagaaaaggggagggggaagcccuagggaugaaagaggacuccucacccuagaaugggguuaucuuaaccucuucuacgcuauuuauuuaacuuguguguacagccagaaggaagccacuacucuggggucccugggacagcuuaaaacccuagugacccacuuaacacaauagauuguuuuaaucaguucguguccuggcaccaucucgaaggggaacauaaacagacgcgcacaccgcucagauuugcucuuuccagcaggagauccaauuaccuaucgguggucaccucucugcccucggaccguuuaagagggggauuuuaaccccuaacgcugaggcuguauuucugucuauaagagccgagauucggagucggucgaggaggggaaggcaguagacggauucgacccgggaaugcauuagggacagcuccgggcgcgcaggaauuucuucacagcagaggcuggucaccugccguccgucccuccccgccuggcccggugaccgucgccagagccuggcgcaggcaaauaaacgccaagcuggggcacccccaaggaggagcugcgauccgaaggcaaugccaagcgagagcgguggcgcgucuguucuuccggagucuguagucuacaaauaacuccggccagcaaggaggugacagccccaauauaccucccacuccccugcuauggccuugcuccgcaagcuguggaggggccagcggagccagccaggcagcgagagagaacgaaagacgcccagcucguugcagccgccaacccgccucagccgccagucccuaguccucaggagcuagugaggcgcugcaaggcgaggcuggggccucuagaacacaguuuaaggggugcgcgcggaagugggaaccagccgguggccgcugcccggcgccagaacgucuaccauucagcccgggcgugcgcggggcggggaagaggcuggaguagagaagcgagcgcccgcgagugcguggccgguccgcgagcgcguguggugucugccuugugagcacugcggguucgcuggaccccgcggccagggccgcgccccgcaccgcagcugucggauuacccaccguucgguuuuccgcuguggcugaacacagcggcucugcccuugccagucuccaucucaccucggggaucggcaaaugcacacaucauggauucuccggaugcuccaacccgcggacuccaaugggcgccccaagacgcccccagacccagcgcggcgccccaagcacaugggacccucucaaggcaacucgccgcgcagucagcggccgacuagcagguccggaugcuccugcgcucuggcggccuggacuucgcgcccucgcuaagcgggcgcgucugccaggcgcugcugccaccagcaccaggagcguguucgggggccuccgggagguggaaacgggaugugggggucauccugcccgcuccugacaacuuuuuuuccuacguuucccugcagacccagagcagcgaggucacgguguccgcggccucagcaggaaggaccccgcgaugguucuucacaauucacccccgcgaacaacgcacccgagccugcgcgcacggagggcugccgcgcguggaacugagcggguccuggguugguuugcggcccucuucccuccgcccacucacaucccugccgggugcguccgcgcucaccugucagugcggcggguccucggggccugcgcuuucgacgcguggcgcugagugcggccgcggccagagccgccggggcucggcgcggggucagcgggaccgagagugacgcggcggccgugcacugggucgcccgguccgcggaaggcgcaccgagugccaggcaucgcgccgucucccguuuaaaugccggcggcagagcgcggcgcccggggccgcgccucuccauuggccaggcgccgccgccgccgccagacccgcuauccgcccccuuucccgguacugcccccgccccccgcaccccuccugcuuccccgcgggguccccucuccgcccgccucgccucuuugucugcuccccccgcccgggccggcugggagaggucaccccagggaaccgcgccuggaaugcacagcaaaucacauuuuccgcucccguuggagagggaagagcgggaggaaauccccccggcuggcggccccucauuccuucucugccccaggucugggcuuucccugucggccgcccggcaucgccugcguuggucccgcgcucaguagcggagacugcgcugggaagagcgagaucuccgugggaucgugccagauucggccauucuuccccucuggagggaacgggacugcgggaugc

SEQ ID NO: 19340 - RNA, 2591 nt, Homo sapiens
gcaucccgcagucccguucccuccagaggggaagaauggccgaaucuggcacgaucccacggagaucucgcucuucccagcgcagucuccgcuacugagcgcgggaccaacgcaggcgaugccgggcggccgacagggaaagcccagaccuggggcagagaaggaaugaggggccgccagccggggggauuuccucccgcucuucccucuccaacgggagcggaaaaugugauuugcugugcauuccaggcgcgguucccuggggugaccucucccagccggcccgggcggggggagcagacaaagaggcgaggcgggcggagaggggaccccgcggggaagcaggaggggugcggggggcgggggcaguaccgggaaagggggcggauagcgggucuggcggcggcggcggcgccuggccaauggagaggcgcggccccgggcgccgcgcucugccgccggcauuuaaacgggagacggcgcgaugccuggcacucggugcgccuuccgcggaccgggcgacccagugcacggccgccgcgucacucucggucccgcugaccccgcgccgagccccggcggcucuggccgcggccgcacucagcgccacgcgucgaaagcgcaggccccgaggacccgccgcacugacaggugagcgcggacgcacccggcagggaugugagugggcggagggaagagggccgcaaaccaacccaggacccgcucaguuccacgcgcggcagcccuccgugcgcgcaggcucgggugcguuguucgcgggggugaauugugaagaaccaucgcgggguccuuccugcugaggccgcggacaccgugaccucgcugcucugggucugcagggaaacguaggaaaaaaaguugucaggagcgggcaggaugacccccacaucccguuuccaccucccggaggcccccgaacacgcuccuggugcugguggcagcagcgccuggcagacgcgcccgcuuagcgagggcgcgaaguccaggccgccagagcgcaggagcauccggaccugcuagucggccgcugacugcgcggcgaguugccuugagagggucccaugugcuuggggcgccgcgcugggucugggggcgucuuggggcgcccauuggaguccgcggguuggagcauccggagaauccaugaugugugcauuugccgauccccgaggugagauggagacuggcaagggcagagccgcuguguucagccacagcggaaaaccgaacgguggguaauccgacagcugcggugcggggcgcggcccuggccgcgggguccagcgaacccgcagugcucacaaggcagacaccacacgcgcucgcggaccggccacgcacucgcgggcgcucgcuucucuacuccagccucuuccccgccccgcgcacgcccgggcugaaugguagacguucuggcgccgggcagcggccaccggcugguucccacuuccgcgcgcaccccuuaaacuguguucuagaggccccagccucgccuugcagcgccucacuagcuccugaggacuagggacuggcggcugaggcggguuggcggcugcaacgagcugggcgucuuucguucucucucgcugccuggcuggcuccgcuggccccuccacagcuugcggagcaaggccauagcaggggagugggagguauauuggggcugucaccuccuugcuggccggaguuauuuguagacuacagacuccggaagaacagacgcgccaccgcucucgcuuggcauugccuucggaucgcagcuccuccuugggggugccccagcuuggcguuuauuugccugcgccaggcucuggcgacggucaccgggccaggcggggagggacggacggcaggugaccagccucugcugugaagaaauuccugcgcgcccggagcugucccuaaugcauucccgggucgaauccgucuacugccuuccccuccucgaccgacuccgaaucucggcucuuauagacagaaauacagccucagcguuagggguuaaaaucccccucuuaaacgguccgagggcagagaggugaccaccgauagguaauuggaucuccugcuggaaagagcaaaucugagcggugugcgcgucuguuuauguuccccuucgagauggugccaggacacgaacugauuaaaacaaucuauuguguuaagugggucacuaggguuuuaagcugucccagggaccccagaguaguggcuuccuucuggcuguacacacaaguuaaauaaauagcguagaagagguuaagauaaccccauucuagggugaggaguccucuuucaucccuagggcuucccccuccccuuuucucuuuuuuuggaaggagggggagcaugagagucuugagggggggauguacuuuucaaagcaaggagggaaagaucuuaagaaaacuauauauucucacugccccccaagccaagucuauaacaguaggugauuugauuacuaucucuggauaaauggcacugucaaauuguuaauauuaacuauuucagggauuuuuagcaggguaguggcaguaugugugcgugugugugugugugucugugug

SEQ ID NO: 19341 - RNA, 2653 nt, Homo sapiens
accccacggggacgguggaggagagucagcgagggcccgaggggcagguacuuuaacgaauggcucucuugguguccccugcgccccgucggcccauuuuucuuuuuacaaaacgggcccagucucuaguauccaccucucgccaucaaccaggcauuccgggagaucagcucgcccgaaagccccugcgccaccccgcgggcccuccuagguggucuccccagccccgucccuuuucgggaugcuugcugaucaccccgagcccgcguggcgcaagaguacgagcgccgagcccgugcgcgccaaggcugcgugggcgggcaccgacuuuucugagaaguucuagugcucccaagccccgacccccgcccccuucacuuucuagcuggaaaguugcgcgccaggcagcggggggcggagagaggagcccagacuggcccccaccucccgcuuccugcccggccgccgcccauuggccggaggaauccccaggaaugcgagcgccccuuuaaaagcgcgcggcuccuccgccuugccagccgcugcgcccgagcuggccugcgaguucagggcuccugucgcucuccaggagcaaccucuacuccggacgcacaggcauuccccgcgccccuccagcccucgccgcccucgccaccgcucccggccgccgcgcuccgguacacacagguaagucgcccccggcggccgccgaggaccaaagcugcccgggacauccaccuggagcgcugaggcuucagucccucugguggaccccggaaccuacacucuccccgcucgccuaccccagcccgcuccucucagccgcuggaggacucuucagggcaaggcuccagagccauccucuccagccuugagguucacaaaccaacucaucaggacaccccaagauuuccuuacucucugaaguccuccuuaagccuuuguaucagcacuccagggaagagucuguacuuccccugcccucccugcaaccccaaacuacaguuccugaucuugcucaccuucgacuucccaaaagcccccaaauuguuggucuugcgccccccacacuuuaaaaccagcaucucuuuccuccaccucucucucucucucucucucucucucucaugcucucuggaaaguaauccuguuguccuucauuucagcaaacgcggggucaaagagggauggucccggcccuguccccaugcccagccccguuucugcgcaccgucccucccugccuagcugaucucugacccucggcucuugugcuuccugcuacaggaucccugcugggcaccaacagcuccaccauggggcuggccuggggacuaggcguccuguuccugaugcauguguguggcaccaaccgcauuccaggugaguuuguguggcaccuuuaggggaaggagggacaaggaagaggugcuggcuaucccaggugugcccccucacgugcuguccucucccucuugagccugacuggacaucaggacgcagcuucacucugauccugguauuuauucaccucuuucagugguugccaggaguuuucaccccaacccuuugucuccaccccuaaggacucagcccccuacugcuggucccagccuagaaagcucacuuuguguucucuccugucuaacagagucuggcggagacaacagcguguuugacaucuuugaacucaccggggccgcccgcaaggggucugggcgccgacuggugaagggccccgacccuuccagcccagcuuuccgcaucgaggaugccaaccugauccccccugugccugaugacaaguuccaagaccugguggaugcugugcgggcagaaaaggguuuccuccuucuggcaucccugaggcagaugaagaagacccggggcacgcugcuggcccuggagcggaaagaccacucuggccaggucuucagcgugguguccaauggcaaggcgggcacccuggaccucagccugaccguccaaggaaagcagcacguggugucuguggaagaagcucuccuggcaaccggccaguggaagagcaucacccuguuugugcaggaagacagggcccagcuguacaucgacugugaaaagauggagaaugcugaguuggacguccccauccaaagcgucuucaccagagaccuggccagcaucgccagacuccgcaucgcaaaggggggcgucaaugacaauuuccaggugaggcuucuucucugagcccugcuccgugggaucaucugcuagacaggugaccugccaggagggcuacaggaaauccugucuguaaacuaacgcagcaguucucagauuuuaggcagcaugagcaucaccuggagggcuugugaaagcucacccugcugcaccccagccccagagucugggauucuguaaaacugcaacucuaacaaguaccaggugaugcugaugccgguggucugggaagcacacuuugaaaacuacucaaggaaacaagaaaugguuuuccuuuagcagucagccuguucaagccuuagauacuccuuaggcucuuaagaaaagagcuuauuucaaaugcauucccccaauuuuaaucuuguuugaaauggauacuuucuaugggcagaaucaguaccacuuugcuauuggauuccucauggggaug

SEQ ID NO: 19342 - RNA, 2653 nt, Homo sapiens
cauccccaugaggaauccaauagcaaagugguacugauucugcccauagaaaguauccauuucaaacaagauuaaaauugggggaaugcauuugaaauaagcucuuuucuuaagagccuaaggaguaucuaaggcuugaacaggcugacugcuaaaggaaaaccauuucuuguuuccuugaguaguuuucaaagugugcuucccagaccaccggcaucagcaucaccugguacuuguuagaguugcaguuuuacagaaucccagacucuggggcuggggugcagcagggugagcuuucacaagcccuccaggugaugcucaugcugccuaaaaucugagaacugcugcguuaguuuacagacaggauuuccuguagcccuccuggcaggucaccugucuagcagaugaucccacggagcagggcucagagaagaagccucaccuggaaauugucauugacgccccccuuugcgaugcggagucuggcgaugcuggccaggucucuggugaagacgcuuuggauggggacguccaacucagcauucuccaucuuuucacagucgauguacagcugggcccugucuuccugcacaaacagggugaugcucuuccacuggccgguugccaggagagcuucuuccacagacaccacgugcugcuuuccuuggacggucaggcugagguccagggugcccgccuugccauuggacaccacgcugaagaccuggccagaguggucuuuccgcuccagggccagcagcgugccccgggucuucuucaucugccucagggaugccagaaggaggaaacccuuuucugcccgcacagcauccaccaggucuuggaacuugucaucaggcacaggggggaucagguuggcauccucgaugcggaaagcugggcuggaagggucggggcccuucaccagucggcgcccagaccccuugcgggcggccccggugaguucaaagaugucaaacacgcuguugucuccgccagacucuguuagacaggagagaacacaaagugagcuuucuaggcugggaccagcaguagggggcugaguccuuagggguggagacaaaggguuggggugaaaacuccuggcaaccacugaaagaggugaauaaauaccaggaucagagugaagcugcguccugauguccagucaggcucaagagggagaggacagcacgugagggggcacaccugggauagccagcaccucuuccuugucccuccuuccccuaaaggugccacacaaacucaccuggaaugcgguuggugccacacacaugcaucaggaacaggacgccuaguccccaggccagccccaugguggagcuguuggugcccagcagggauccuguagcaggaagcacaagagccgagggucagagaucagcuaggcagggagggacggugcgcagaaacggggcugggcauggggacagggccgggaccaucccucuuugaccccgcguuugcugaaaugaaggacaacaggauuacuuuccagagagcaugagagagagagagagagagagagagagagguggaggaaagagaugcugguuuuaaaguguggggggcgcaagaccaacaauuugggggcuuuugggaagucgaaggugagcaagaucaggaacuguaguuugggguugcagggagggcaggggaaguacagacucuucccuggagugcugauacaaaggcuuaaggaggacuucagagaguaaggaaaucuugggguguccugaugaguugguuugugaaccucaaggcuggagaggauggcucuggagccuugcccugaagaguccuccagcggcugagaggagcgggcugggguaggcgagcggggagaguguagguuccgggguccaccagagggacugaagccucagcgcuccagguggaugucccgggcagcuuugguccucggcggccgccgggggcgacuuaccuguguguaccggagcgcggcggccgggagcgguggcgagggcggcgagggcuggaggggcgcggggaaugccugugcguccggaguagagguugcuccuggagagcgacaggagcccugaacucgcaggccagcucgggcgcagcggcuggcaaggcggaggagccgcgcgcuuuuaaaggggcgcucgcauuccuggggauuccuccggccaaugggcggcggccgggcaggaagcgggaggugggggccagucugggcuccucucuccgccccccgcugccuggcgcgcaacuuuccagcuagaaagugaagggggcgggggucggggcuugggagcacuagaacuucucagaaaagucggugcccgcccacgcagccuuggcgcgcacgggcucggcgcucguacucuugcgccacgcgggcucggggugaucagcaagcaucccgaaaagggacggggcuggggagaccaccuaggagggcccgcgggguggcgcaggggcuuucgggcgagcugaucucccggaaugccugguugauggcgagagguggauacuagagacugggcccguuuuguaaaaagaaaaaugggccgacggggcgcaggggacaccaagagagccauucguuaaaguaccugccccucgggcccucgcugacucuccuccaccguccccguggggu

SEQ ID NO: 19343 - RNA, 2568 nt, Homo sapiens
gcuccaggaaggaaaaggagaucggauuucccuagcgcugguuuuugcauuccgggcuuaaguucuuuuuaccugcuuuggaacacuagguaacuagcgccugcugcggaugcacagccuacagggacugccuagugucuccgcccccaagaccauccccgaaccacccacucaccuccugccccauuaccgggcaaccccucuauccuccggcggccagggucucagcccuuaaccccgccaucacggaggacuggucaccucggcacgcgcagagcugggggaccuagagguugggagcggcacggaggggcggggaccugcgcccgacuggcugacggggaggggggagcggcgggggcggaggcccccuccgggcggcgcugggacuguagcagcuagaggccgggaggggaggggagaaugaccaugagucugagugacaggcggcgaggagaggagccaauauauauaaggaaggcccccagcgcgcagguuucaguagcggcgcugcgcgcaggccgggaacacgaggccaagagccgcagccccagccgccuuggugcagcguacaccggcacuagcccgcuugcagccccaggauuagacagaagacgcguccucggcgcggucgccgcccagccguagucaccuggauuaccuacagcggcagcugcagcggagccagcgagaaggccaaaggggagcagcgucccgagaggagcgccucuuuucagggaccccgccggcuggcggacgcgcgggaaagcggcgucgcgaacagagccagauugagggcccgcggguggagagagcgacgcccgaggggauggcggcagcgucccggagcgccucuggcugggcgcuacugcugcugguggcacuuuggcagcagguaacacgucccgcgcccucuccguccccucugccgcgcucugggccucagccccgggcaccagcugagcugaccgguccccucccuccuucccucggucccugugcaauagcgcgcggccggcuccggcgucuuccagcugcagcugcaggaguucaucaacgagcgcggcguacuggccagugggcggccuugcgagcccggcugccggacuuucuuccgcgucugccuuaagcacuuccaggcggucgucucgcccggacccugcaccuucgggaccgucuccacgccgguauugggcaccaacuccuucgcuguccgggacgacaguagcggcggggggcgcaacccucuccaacugcccuucaauuucaccuggccggugagcacagccugggcgcacugggaggucgcagaagccgagagaggaggcgcccugggaccaaagcccccuccccagauuuccuuguacacacacccccacccccaaaaagcccaggaugcauucuuuccuggcucuucccgacucucuccugagacugaucccagaaaaggcucucaccagucuccgucuucccaguuuauguccucccguccccagcucuugggacacgauuuucauuaccuaccacucuggggcgguacccuaccacccccuccuccaguggcucucccuuacacucucccgucucucaacccucccucuaccggggguucuccucucgccuucccugcucaagcgcuacacugugcacagccccguuauguugacccgggcgcaguaacugaauccugcaauuagauuaauuaaacaggcugccgcaaggcacccccaccucuccccgcuugcucaucucgccaucucuccguccccccacccccuuucccaggguaccuucucgcucaucaucgaagcuuggcacgcgccaggagacgaccugcggccaggugaguagcucgcuccgccaccacaggggggcgacacggcgcagcgccgaaagaguuaaucuguucuaggcgggggaagugcgggcuugggggugggaggcaggacgcuuagcuuggccuggagcugcgccccgcgcuggacgcucggauuccgcucgcugccuggacucagagcacaauugcguuuccugcggguuauuuuuggcgugggaacgcggggaguacggcggugagaaaggcugaagcugccagcgccgcugacgggccccuuccuguauuuuacaccuuucgcgaauuccgcuccuuuggaaagggaauaauggcuuugggauguuguucugacacagaggaaaaggauauuucagcagcacaacaauucucacuuugaaaaggaaaaaagaaaaccauuacccaccucuggaggcagaaccccugaaugggcaccaaaggacccccugcucccaggguccucucuagccuggggagcuuuucuuucuuuuucucuuuuuuccauuuugaccucuuuuccucuuuccccucccuaucugccuccaagacccugggauaucuuaacauccuucuauuguccccuuuuugaauacuaucaggcccccugcacaugcacacacguagggcagcuacguagcggggcuuugggucccucuggccuguucuugcuggcaggcgggggucaucuggauaacugggcugauugguuggcugau

SEQ ID NO: 19344 - RNA, 2568 nt, Homo sapiens
aucagccaaccaaucagcccaguuauccagaugacccccgccugccagcaagaacaggccagagggacccaaagccccgcuacguagcugcccuacgugugugcaugugcagggggccugauaguauucaaaaaggggacaauagaaggauguuaagauaucccagggucuuggaggcagauagggaggggaaagaggaaaagaggucaaaauggaaaaaagagaaaaagaaagaaaagcuccccaggcuagagaggacccugggagcaggggguccuuuggugcccauucagggguucugccuccagagguggguaaugguuuucuuuuuuccuuuucaaagugagaauuguugugcugcugaaauauccuuuuccucugugucagaacaacaucccaaagccauuauucccuuuccaaaggagcggaauucgcgaaagguguaaaauacaggaaggggcccgucagcggcgcuggcagcuucagccuuucucaccgccguacuccccgcguucccacgccaaaaauaacccgcaggaaacgcaauugugcucugaguccaggcagcgagcggaauccgagcguccagcgcggggcgcagcuccaggccaagcuaagcguccugccucccacccccaagcccgcacuucccccgccuagaacagauuaacucuuucggcgcugcgccgugucgccccccugugguggcggagcgagcuacucaccuggccgcaggucgucuccuggcgcgugccaagcuucgaugaugagcgagaagguacccugggaaaggggguggggggacggagagauggcgagaugagcaagcggggagaggugggggugccuugcggcagccuguuuaauuaaucuaauugcaggauucaguuacugcgcccgggucaacauaacggggcugugcacaguguagcgcuugagcagggaaggcgagaggagaacccccgguagagggaggguugagagacgggagaguguaagggagagccacuggaggagggggugguaggguaccgccccagagugguagguaaugaaaaucgugucccaagagcuggggacgggaggacauaaacugggaagacggagacuggugagagccuuuucugggaucagucucaggagagagucgggaagagccaggaaagaaugcauccugggcuuuuuggggguggggguguguguacaaggaaaucuggggagggggcuuuggucccagggcgccuccucucucggcuucugcgaccucccagugcgcccaggcugugcucaccggccaggugaaauugaagggcaguuggagaggguugcgccccccgccgcuacugucgucccggacagcgaaggaguuggugcccaauaccggcguggagacggucccgaaggugcaggguccgggcgagacgaccgccuggaagugcuuaaggcagacgcggaagaaaguccggcagccgggcucgcaaggccgcccacuggccaguacgccgcgcucguugaugaacuccugcagcugcagcuggaagacgccggagccggccgcgcgcuauugcacagggaccgagggaaggagggaggggaccggucagcucagcuggugcccggggcugaggcccagagcgcggcagaggggacggagagggcgcgggacguguuaccugcugccaaagugccaccagcagcaguagcgcccagccagaggcgcuccgggacgcugccgccauccccucgggcgucgcucucuccacccgcgggcccucaaucuggcucuguucgcgacgccgcuuucccgcgcguccgccagccggcggggucccugaaaagaggcgcuccucucgggacgcugcuccccuuuggccuucucgcuggcuccgcugcagcugccgcuguagguaauccaggugacuacggcugggcggcgaccgcgccgaggacgcgucuucugucuaauccuggggcugcaagcgggcuagugccgguguacgcugcaccaaggcggcuggggcugcggcucuuggccucguguucccggccugcgcgcagcgccgcuacugaaaccugcgcgcugggggccuuccuuauauauauuggcuccucuccucgccgccugucacucagacucauggucauucuccccuccccucccggccucuagcugcuacagucccagcgccgcccggagggggccuccgcccccgccgcuccccccuccccgucagccagucgggcgcagguccccgccccuccgugccgcucccaaccucuaggucccccagcucugcgcgugccgaggugaccaguccuccgugauggcgggguuaagggcugagacccuggccgccggaggauagagggguugcccgguaauggggcaggaggugagugggugguucggggauggucuugggggcggagacacuaggcagucccuguaggcugugcauccgcagcaggcgcuaguuaccuaguguuccaaagcagguaaaaagaacuuaagcccggaaugcaaaaaccagcgcuagggaaauccgaucuccuuuuccuuccuggagc

SEQ ID NO: 19345 - RNA, 3097 nt, Homo sapiens
gaaauguauuuuugaaggaaaaauacuggacuaaaugagguccucuugagaacauaugaaaaucagagccucagucuacuuauugaacuugccaugugccuugcacacagggcaauaaacaucugcugucugaucaaggucagguuuaccaugauaagcaaacuuccuuccaacauuaucggaauucuggguuuauuuuccacgaaggccaagauggaaccgaauuaaucauaacuauuuucugugcuauuuuaucacagccuaagugcuuggcucauacaaucaucuuguccuuacuccagacuaggagucaaaaacuggucuggugaguuuacuuuuucuucucauaucugggccauacaaacacaaauuuuacuacauauacaugacuauaacaccucauaacaaaaaaagaguaagugaaaugaacagccacauauccaaguggauaccaucacuuggugacccagagcuauauaauaaagcuacagaaccacucaggaaaagagcaucagcgagaaugguaagaauuuaauacaaaaucucccuauauauacugucugaauuuauuuaacaggcuccuccaagaagauaaaaggggucacugacaguccauccuguuguuuccauggaggcuuuaacuuaaacaacugcagacaaauuucucuuaaaggaaauguauucccacuguccuucaauacaggaaaaugacaacccuuagucaagucuaauuaaaauuuuuccggcugaaacaucuguaacagcggcaugggaagccagugaaauggucaguugcauguacacaacacaaacaccacuaguuaaaaauacucccuuaaggccggccacagcagccuuacugcugcagugaaacggagagccccacacaacucaaaaaaccaguucucagaaccacuugcccuguucugcuuccaauguagacaucuaaaggaagcauugcccagaaaacccaauccguaauuuuaauaagcauaauuuacggaagagucaacuacugugugauuucuccucugacugucaugggaaucccuuccuuuccuugcccccuuucaaauacagcaucuaccaagaugaccccaaggaaaguacuuuccucuagaaacaaccagaauugauauugcagggaaaggaacgggcuucuccucuuaucccacucgcaacuccuccccuucuuccccaaggaacucuucucgccucccaaaaucugccucaacaauggcccaagauuccauuuaaccacguccucuccuuuggggcagaaaucucugggaguaggggcaagguaguuuaaccacgaacgggguggggacuaaacaacccuagcaccucuaaggugcccccaggaggucuugccaaggagucuuccacagggagagucauccugcccguuguucuggaucuugaaacuugggagacccacaccaaaggagggaaccgguuccuuuacccuuuaagcgcgucguguccuccaccgccucuucucuuggcccgacuggcucugguuuccuucacguucccagccuccaaauuggcguccgccccauggcucguguaggacgcuaaaagcacgguaaaucccagggcgaucuccagcagacgcccucgacgcaugaugccgagccgccaccggcucccgccgccucuugccgcgcccggggcucggucugcggccgccgcugcgcccugaagcgcaccgcgccgccggggucccgcuaucccgccgcccgucccccgggccgggcuccucccgccuucuccaggcgcugcucccacuucaggcggccccugccagcugcaacacagagacaaauccccgaggcggggagacuuucagggcaucgggaugcugaagccucgcgguccccauucccaagcccaacccgugcgccgccugcgcguggcgcaguuaauuuggguaagggaagaccguuugguccacagcuggcuggaaagcccaggcccccggcggcagcagccccggccgaucccucggccucccgggccccgccagaagagcgcggcgcaaaguacccauauccccagcgguccuaagccccgggcgagcucucuggguuuauuuuuuuuagcggcacgaauugcgcgcgaugcgcgcucugaacgccccacuccucagccugcccucuccgccaggcuggaagccagccgcgccguccccgccgacuccgggcgaugccaccgccccccgaacaucugacgcggagcccggcaccaagagccccgggccaggaagcugucaggcaggggagggccagcgccagcuguggacguuccgggacagccccucaccccagucccugucccugcccucggcgcggcgcaaacgcaaaagccuccguggccgcagcuccagccccgguggccgcccgacccccgucgggaccccggcugcacccacuggagaagcggcggcuccgacucccgaggaggcggcggcggcugcucccagucguggccgcuacagccacugcucggcuccgcucgcagcugucccagcuguggcuccuguccgcuuguggcacccacagucucugccgcggcucccgcagcccccuccuuuccccaccucuucaaguaucguccgcgcagcgguuucucgcgagagaaauacuuuuuuuaaaaaaagaaagaaaaagaaaaugacacccccuccuucgucgcccucaucaccaccccaccccccggccccauccauccucccuuuccacuccccuuugccagccuccgccucggugcggggccucucgcucgcaggauuagcgcagugggaggaggcagaggugaucagguccugcccggccugggacuuuuugucuugagguggggaggggagaaaugggaagagguggaguagcgguuuuagcccgcucugcggcugcgagguuuagauccgagauuaaccucucccgcgauaggugaagcccuaccggagcagaaagcuguuccaccugcaccaagaaugcgcgcuggagacgguugccccggaggcccuggcccgagagaaaaccaguccccgcugcccgcgccucccgguagcgcgcucccugcgccucucccg

SEQ ID NO: 19346 - RNA, 3097 nt, Homo sapiens
cgggagaggcgcagggagcgcgcuaccgggaggcgcgggcagcggggacugguuuucucucgggccagggccuccggggcaaccgucuccagcgcgcauucuuggugcagguggaacagcuuucugcuccgguagggcuucaccuaucgcgggagagguuaaucucggaucuaaaccucgcagccgcagagcgggcuaaaaccgcuacuccaccucuucccauuucuccccuccccaccucaagacaaaaagucccaggccgggcaggaccugaucaccucugccuccucccacugcgcuaauccugcgagcgagaggccccgcaccgaggcggaggcuggcaaaggggaguggaaagggaggauggauggggccggggggugggguggugaugagggcgacgaaggagggggugucauuuucuuuuucuuucuuuuuuuaaaaaaaguauuucucucgcgagaaaccgcugcgcggacgauacuugaagagguggggaaaggagggggcugcgggagccgcggcagagacugugggugccacaagcggacaggagccacagcugggacagcugcgagcggagccgagcaguggcuguagcggccacgacugggagcagccgccgccgccuccucgggagucggagccgccgcuucuccagugggugcagccggggucccgacgggggucgggcggccaccggggcuggagcugcggccacggaggcuuuugcguuugcgccgcgccgagggcagggacagggacuggggugaggggcugucccggaacguccacagcuggcgcuggcccuccccugccugacagcuuccuggcccggggcucuuggugccgggcuccgcgucagauguucggggggcgguggcaucgcccggagucggcggggacggcgcggcuggcuuccagccuggcggagagggcaggcugaggaguggggcguucagagcgcgcaucgcgcgcaauucgugccgcuaaaaaaaauaaacccagagagcucgcccggggcuuaggaccgcuggggauauggguacuuugcgccgcgcucuucuggcggggcccgggaggccgagggaucggccggggcugcugccgccgggggccugggcuuuccagccagcuguggaccaaacggucuucccuuacccaaauuaacugcgccacgcgcaggcggcgcacggguugggcuugggaauggggaccgcgaggcuucagcaucccgaugcccugaaagucuccccgccucggggauuugucucuguguugcagcuggcaggggccgccugaagugggagcagcgccuggagaaggcgggaggagcccggcccgggggacgggcggcgggauagcgggaccccggcggcgcggugcgcuucagggcgcagcggcggccgcagaccgagccccgggcgcggcaagaggcggcgggagccgguggcggcucggcaucaugcgucgagggcgucugcuggagaucgcccugggauuuaccgugcuuuuagcguccuacacgagccauggggcggacgccaauuuggaggcugggaacgugaaggaaaccagagccagucgggccaagagaagaggcgguggaggacacgacgcgcuuaaaggguaaaggaaccgguucccuccuuuggugugggucucccaaguuucaagauccagaacaacgggcaggaugacucucccuguggaagacuccuuggcaagaccuccugggggcaccuuagaggugcuaggguuguuuaguccccaccccguucgugguuaaacuaccuugccccuacucccagagauuucugccccaaaggagaggacgugguuaaauggaaucuugggccauuguugaggcagauuuugggaggcgagaagaguuccuuggggaagaaggggaggaguugcgagugggauaagaggagaagcccguuccuuucccugcaauaucaauucugguuguuucuagaggaaaguacuuuccuuggggucaucuugguagaugcuguauuugaaagggggcaaggaaaggaagggauucccaugacagucagaggagaaaucacacaguaguugacucuuccguaaauuaugcuuauuaaaauuacggauuggguuuucugggcaaugcuuccuuuagaugucuacauuggaagcagaacagggcaagugguucugagaacugguuuuuugaguuguguggggcucuccguuucacugcagcaguaaggcugcuguggccggccuuaagggaguauuuuuaacuagugguguuuguguuguguacaugcaacugaccauuucacuggcuucccaugccgcuguuacagauguuucagccggaaaaauuuuaauuagacuugacuaaggguugucauuuuccuguauugaaggacagugggaauacauuuccuuuaagagaaauuugucugcaguuguuuaaguuaaagccuccauggaaacaacaggauggacugucagugaccccuuuuaucuucuuggaggagccuguuaaauaaauucagacaguauauauagggagauuuuguauuaaauucuuaccauucucgcugaugcucuuuuccugagugguucuguagcuuuauuauauagcucugggucaccaagugaugguauccacuuggauauguggcuguucauuucacuuacucuuuuuuuguuaugagguguuauagucauguauauguaguaaaauuuguguuuguauggcccagauaugagaagaaaaaguaaacucaccagaccaguuuuugacuccuagucuggaguaaggacaagaugauuguaugagccaagcacuuaggcugugauaaaauagcacagaaaauaguuaugauuaauucgguuccaucuuggccuucguggaaaauaaacccagaauuccgauaauguuggaaggaaguuugcuuaucaugguaaaccugaccuugaucagacagcagauguuuauugcccugugugcaaggcacauggcaaguucaauaaguagacugaggcucugauuuucauauguucucaagaggaccucauuuaguccaguauuuuuccuucaaaaauacauuuc

SEQ ID NO: 19347 - RNA, 2644 nt, Homo sapiens
gagagaaagucccucuggcucaaggucuccaaauagaugagaaauaggacaucucagcagggaccccccccaucauccaguguagaaaucacccguggcagcaggcauuugucaauguuuguggugacaaauuucuaagaggaaaauucugggagggaaagggaaaaggcagaggaagcgugggguuagggggugggguacuccaagggucaucguuggcccuaaagggggaccugcaucugagaagcuggguuccccaggacugaguggcuugggacaggucaaagggugggcgcaaaaacggaggggugcuagucccuccgacuccggguaacaccuucccuucccuuagucgcugguccccgccuccucccgguguguugguccccgcgcccugccuucccccucaaccucccccccgccccgaagucuccaggucagcccagacugcgccccacgugaggggcgggggcgggcgcgggcgccagcgccuuccugcucugcccuuguauggugccccggaggccggcccacggguacuuaacccgggccgccgcggagggcgcccggagucgaccgcucgggcagcgccaccgccacgagagcccgggacgcgggaaagaccgaaaggaagaggaagaggcaccgguggccauggggcuggaggcggcgcgcgagcuggagugcgcggcgcugggcacgcugcugcgggauccgcgggaggcggaacgcacgcugcugcuggacugccgccccuuccuggccuucugccggcgccacgugcgcgccgcgcggccagugccuuggaacgcgcugcugcggcgccgcgcgcgcggcccuccugccgccguucucgccugccugcugcccgaccgcgcgcugcggacgcgccugguccgcggggagcuggcgcgggccguggugcuggacgagggcagugccucgguggcggagcuccggcccgacagcccggcucaugugcugcuggccgcgcugcugcacgagacccgcgcggggcccacugccguguacuuccugcgaggugagcaagccggccgcccuuggcccgccccacccgacuccagcccggcuuucccugcugaucgugcucuuccccuccuugcaggaggcuucgacggcuuccagggcugcugucccgaucugugcucugaggcccccgccccugcgcugccgccaacaggggacaaaaccagccgcuccgacuccagggcuccugucuacgaccaggugaguauugaccccccucccccgaaccucccucucuccccgccgcggacugggcgccucuagggaaagagccugccauuuggggaugcgagcaguuugcccauauacacacacuuuuauacguguguguguugggggaggggguggggcauggcugcucgcgcgugccuguaugggucuguguauguuugcauguguauguugggagcaugaagggaaauguaugucccgguguguccuccgcacauuccugagaccugucucaggucaggaggacuggcugaggaguccucuugucucggccagcccauggggucuccacccgcugcugcuccagcucuccggggcugggcuggaaaggccucaccgccccucuguucccuccaggguggcccuguggagaucuugcccuaccuguuccugggcagcugcagucacucgucagaccugcaggggcugcaggccuguggcaucacagccguccucaacguguccgccagcugccccaaccacuuugagggccuuuuccgcuacaagaguaucccuguggaggacaaccagaugguggagaucagugccugguuccaggaggccauaggcuucauugguaagggggcaccucugcccagaaaucccgaggggcuccagaggagaggacugggggcaccugucuccugggcugugcacauuccgucugacaccacucccccaucucccuugcagacugggugaagaacagcggaggccgggugcuggugcacugccaggcggguaucucgcgcucugccaccaucugucuggcauaccucaugcagagucgccgugugcggcuggacgaggccuuugacuucguuaagcagcgccggggggucaucucccccaacuucaguuucauggggcagcugcugcaguuugagacccaggugcugugucacugagguggugccccucugccugccugccccacugugcuggcaggagcugacuguggacuggugggcuccccucugggccagcacaguccccucaccucuggcagggcugcuaccuccucagaguuucagaagcccccacaugggggcucuaggaaugccggcaugcuggucuuuccgaccuggugcucuucugcugggggacugaggcuggcccucauucggggucgggaaccaagggugugucugcucuuucccuccccauccucuggcagaaaucagcuagacgcuauaccguggacucucccugguccaccaccauguugaagcccuuggcagccugagagcuccaaggaacaagcugugacaaccaggagcccugucuguggguucgucugcccagggccuggagcccaagcccuguguuccuggggaagcuggggacuugggaagugaugggugug

SEQ ID NO: 19348 - RNA, 2644 nt, Homo sapiens
cacacccaucacuucccaaguccccagcuuccccaggaacacagggcuugggcuccaggcccugggcagacgaacccacagacagggcuccugguugucacagcuuguuccuuggagcucucaggcugccaagggcuucaacauggugguggaccagggagaguccacgguauagcgucuagcugauuucugccagaggauggggagggaaagagcagacacacccuugguucccgaccccgaaugagggccagccucagucccccagcagaagagcaccaggucggaaagaccagcaugccggcauuccuagagcccccaugugggggcuucugaaacucugaggagguagcagcccugccagaggugaggggacugugcuggcccagaggggagcccaccaguccacagucagcuccugccagcacaguggggcaggcaggcagaggggcaccaccucagugacacagcaccugggucucaaacugcagcagcugccccaugaaacugaaguugggggagaugaccccccggcgcugcuuaacgaagucaaaggccucguccagccgcacacggcgacucugcaugagguaugccagacagaugguggcagagcgcgagauacccgccuggcagugcaccagcacccggccuccgcuguucuucacccagucugcaagggagaugggggaguggugucagacggaaugugcacagcccaggagacaggugcccccaguccucuccucuggagccccucgggauuucugggcagaggugcccccuuaccaaugaagccuauggccuccuggaaccaggcacugaucuccaccaucugguuguccuccacagggauacucuuguagcggaaaaggcccucaaagugguuggggcagcuggcggacacguugaggacggcugugaugccacaggccugcagccccugcaggucugacgagugacugcagcugcccaggaacagguagggcaagaucuccacagggccacccuggagggaacagaggggcggugaggccuuuccagcccagccccggagagcuggagcagcagcggguggagaccccaugggcuggccgagacaagaggacuccucagccaguccuccugaccugagacaggucucaggaaugugcggaggacacaccgggacauacauuucccuucaugcucccaacauacacaugcaaacauacacagacccauacaggcacgcgcgagcagccaugccccacccccucccccaacacacacacguauaaaaguguguguauaugggcaaacugcucgcauccccaaauggcaggcucuuucccuagaggcgcccaguccgcggcggggagagagggagguucgggggaggggggucaauacucaccuggucguagacaggagcccuggagucggagcggcugguuuuguccccuguuggcggcagcgcaggggcgggggccucagagcacagaucgggacagcagcccuggaagccgucgaagccuccugcaaggaggggaagagcacgaucagcagggaaagccgggcuggagucggguggggcgggccaagggcggccggcuugcucaccucgcaggaaguacacggcagugggccccgcgcgggucucgugcagcagcgcggccagcagcacaugagccgggcugucgggccggagcuccgccaccgaggcacugcccucguccagcaccacggcccgcgccagcuccccgcggaccaggcgcguccgcagcgcgcggucgggcagcaggcaggcgagaacggcggcaggagggccgcgcgcgcggcgccgcagcagcgcguuccaaggcacuggccgcgcggcgcgcacguggcgccggcagaaggccaggaaggggcggcaguccagcagcagcgugcguuccgccucccgcggaucccgcagcagcgugcccagcgccgcgcacuccagcucgcgcgccgccuccagccccauggccaccggugccucuuccucuuccuuucggucuuucccgcgucccgggcucucguggcgguggcgcugcccgagcggucgacuccgggcgcccuccgcggcggcccggguuaaguacccgugggccggccuccggggcaccauacaagggcagagcaggaaggcgcuggcgcccgcgcccgcccccgccccucacguggggcgcagucugggcugaccuggagacuucggggcgggggggagguugagggggaaggcagggcgcggggaccaacacaccgggaggaggcggggaccagcgacuaagggaagggaagguguuacccggagucggagggacuagcaccccuccguuuuugcgcccacccuuugaccugucccaagccacucaguccuggggaacccagcuucucagaugcaggucccccuuuagggccaacgaugacccuuggaguaccccacccccuaaccccacgcuuccucugccuuuucccuuucccucccagaauuuuccucuuagaaauuugucaccacaaacauugacaaaugccugcugccacgggugauuucuacacuggaugauggggggggucccugcugagauguccuauuucucaucuauuuggagaccuugagccagagggacuuucucuc

SEQ ID NO: 19349 - RNA, 2576 nt, Homo sapiens
agagcacgggucccguggccacguugagugucgcagaguacgggacgcagggcggggcuucuggaccagcgcgcaucccaauuggcucucggggcugccuuuuagccggacgcgcggaggugggcaauccgcuccuucccuugagcaguccacgccuuguggcggcuuugcggagcugcugcuuuggcgggaguuggaagcuggugugaggugagaggcgcgguggucgcuccccggcgaggccaggucagaaggggaccgggaucauccaggggcuuuccugcuucaagagccuggucugagcggccuguuggggacugggcggaagucgaaagggagggagugccggccaugcgggucuuguggcgggaaugaguccuuguggggcgugguguuguggagagccccgcuuugccucuuccucggcaucccguuccccuacauccagagagggcauccaggaccugaugucgggcaggugcccuucgcacaucuugggguagcucggggagcgccugucacgggucugacgaggaagcugaggccugaggggcccugggcgggggcuguggggcgccgaggccauguuugagcagagccgggaaggugaaguucucuugcggcucucuguagggcacaagcauuccaaacgugggggcagguuuagaguuuuacccuugaucaagggcugaacgcucagaugugcacaggcucaggcgucagugauaaucaagguggaggcaaacgggagggcuccugcugucgggcuaaagggacaguggcggccagcugagcccuguggggugugugcucagagaugccagagcucagcuuuuuccauuacagccgcgacuggaaaccuugauuuucaaaaaauguauauguaacaagcccucugcuguucaacguugguuuuacaucauaagguuuuagcacguuguguagucaaagaaguguguguguguguauauauauguauauauguauuauauguauauauguguguguauauauguauauauguauuauauauguauauauguguguguauauauauguauauauguauuauauauguauauauguguguguauauauaugugucuaugaguugaauuugcccucggggugccaguuugcauccucugcuguaggaguccugagcuguguuguuaacuggcagaugggaauaaccccuugccauggcuuugacucugcuuccguagagcuagcacagaccuaaugggguuagauuuggggguuggggguggucugcagcuaggggacagacacccuccuugcaaagcgggcguggguuuguagccuuccuguaccaugugucugugaacagggcuaugcaacauuuucaagauaacagagugccuuugggaugagccucccguggcccccgagacccugggcacugcagggauccugaucccauuacugcuuggcuuccuggcuggaaaccgagcugacuggggaaaggaggaacgcgccuggagaauucuugggaggaaguuauugugggucagcuggcucuuccugguucccucuugcacaccgggcagacugcuggacauacagagaugagucccugcccucaggacacucugaccacguagggagaugaaaccauagcccuggaggagggcuucgaauggcucuuugccgggcaggcuugggcuggggaacccaaggaggagagggagggcuuagaggguguuccagaagcaucguggacuuagaacccugggcagaauuggguggguggcugggaagggagaggcuccuagaugggccugaucgaagugugguagggauggggaaacaugauuagaccagcccacucaucagggucgugcugacaaauagggaagaggggcuuuuaggcccaaauuuuugagccaggagucguucagugcuguuugaaggaacauagguauuuauuaguucagggaaauauuguggugggaaggaggggcugaggagauacaaguggcgucuucuguggagaacguuaaugugagaggggagugauuguggaaaagucugucuuuguccccaacuagaugcucauuccuggugaguaggccucuguguucugacccugaguugucccucuucuauuagccagcccacauucccguaauguuugggugguuacagggcugucuccuggugaggaggggagggcagcugaguaggaccugguggccucauggcgauagucuucuuccuccuuggcagucuugugccuccuuccuuccaauccagcccucauucuuucccucugcacagaaaggaucagcaucuccgguacagcccccaucugugcuaggagauggccggguggguguggaugcuaagacaaccgaucccccucauguuggcccgaggagggcccugaccuggauacugugagaccuuuugaggacagcuggcuccuuugugggaucaguuggguguggggcagggccuugaccugagccagccccuaguuuccagccuagguucuccucaccacuaauggccuaagugaugucugucuguccugugaugggggguugcaguua

SEQ ID NO: 19350 - RNA, 2576 nt, Homo sapiens
uaacugcaaccccccaucacaggacagacagacaucacuuaggccauuaguggugaggagaaccuaggcuggaaacuaggggcuggcucaggucaaggcccugccccacacccaacugaucccacaaaggagccagcuguccucaaaaggucucacaguauccaggucagggcccuccucgggccaacaugagggggaucgguugucuuagcauccacacccacccggccaucuccuagcacagaugggggcuguaccggagaugcugauccuuucugugcagagggaaagaaugagggcuggauuggaaggaaggaggcacaagacugccaaggaggaagaagacuaucgccaugaggccaccagguccuacucagcugcccuccccuccucaccaggagacagcccuguaaccacccaaacauuacgggaaugugggcuggcuaauagaagagggacaacucagggucagaacacagaggccuacucaccaggaaugagcaucuaguuggggacaaagacagacuuuuccacaaucacuccccucucacauuaacguucuccacagaagacgccacuuguaucuccucagccccuccuucccaccacaauauuucccugaacuaauaaauaccuauguuccuucaaacagcacugaacgacuccuggcucaaaaauuugggccuaaaagccccucuucccuauuugucagcacgacccugaugagugggcuggucuaaucauguuuccccaucccuaccacacuucgaucaggcccaucuaggagccucucccuucccagccacccacccaauucugcccaggguucuaaguccacgaugcuucuggaacacccucuaagcccucccucuccuccuuggguuccccagcccaagccugcccggcaaagagccauucgaagcccuccuccagggcuaugguuucaucucccuacguggucagaguguccugagggcagggacucaucucuguauguccagcagucugcccggugugcaagagggaaccaggaagagccagcugacccacaauaacuuccucccaagaauucuccaggcgcguuccuccuuuccccagucagcucgguuuccagccaggaagccaagcaguaaugggaucaggaucccugcagugcccagggucucgggggccacgggaggcucaucccaaaggcacucuguuaucuugaaaauguugcauagcccuguucacagacacaugguacaggaaggcuacaaacccacgcccgcuuugcaaggagggugucuguccccuagcugcagaccacccccaacccccaaaucuaaccccauuaggucugugcuagcucuacggaagcagagucaaagccauggcaagggguuauucccaucugccaguuaacaacacagcucaggacuccuacagcagaggaugcaaacuggcaccccgagggcaaauucaacucauagacacauauauauacacacacauauauacauauauaauacauauauacauauauauacacacacauauauacauauauaauacauauauacauauauacacacacauauauacauauaauacauauauacauauauauacacacacacacacuucuuugacuacacaacgugcuaaaaccuuaugauguaaaaccaacguugaacagcagagggcuuguuacauauacauuuuuugaaaaucaagguuuccagucgcggcuguaauggaaaaagcugagcucuggcaucucugagcacacaccccacagggcucagcuggccgccacugucccuuuagcccgacagcaggagcccucccguuugccuccaccuugauuaucacugacgccugagccugugcacaucugagcguucagcccuugaucaaggguaaaacucuaaaccugcccccacguuuggaaugcuugugcccuacagagagccgcaagagaacuucaccuucccggcucugcucaaacauggccucggcgccccacagcccccgcccagggccccucaggccucagcuuccucgucagacccgugacaggcgcuccccgagcuaccccaagaugugcgaagggcaccugcccgacaucagguccuggaugcccucucuggauguaggggaacgggaugccgaggaagaggcaaagcggggcucuccacaacaccacgccccacaaggacucauucccgccacaagacccgcauggccggcacucccucccuuucgacuuccgcccaguccccaacaggccgcucagaccaggcucuugaagcaggaaagccccuggaugaucccgguccccuucugaccuggccucgccggggagcgaccaccgcgccucucaccucacaccagcuuccaacucccgccaaagcagcagcuccgcaaagccgccacaaggcguggacugcucaagggaaggagcggauugcccaccuccgcgcguccggcuaaaaggcagccccgagagccaauugggaugcgcgcugguccagaagccccgcccugcgucccguacucugcgacacucaacguggccacgggacccgugcucu

SEQ ID NO: 19351 - RNA, 2726 nt, Homo sapiens
gaaggguccaggccugggagaggcagagaaggcccggcuugggccugcggagguugcagccauggguggaucugaccccgggcaaauucauccccagagaugcuguucccccacuacuccuugcacugguccagccuccagucccagacccagggcuuccaagacaggccucaagggguaggaggcggccucugaagacagcugccuaccucccaggacugcagcacagcuugugaaagaagcaggaaaguuccucggaagagcucaaggacucaguaagcucaagaaauaacgauuaacaauaugaacuuuccauuugauaauuuauccccaucccugugcuucucauugccacucagccuccuuccuuuccaagaggggaucucagaaaugagaacucggggcacucagaaacaccagcuggggagggucccaaauggggccagcuuccaaacugaaugagugcuggggaaaagcggguggcuucuggcaucugcugauguaccugcugacuggccagggcuugcuacccaugaaugaacacauguaggcccacccacucugugcacccaccucccgggagggggaucuguagggggacacauacacugccgaccacauaugggcagaugcccgcccagauuuucacagacguuuuauuuuuagaggggccagcagcauaagcccaaggcuuggaaaagaagaagggaaggacagaaaaguuagaagccugugaaacgaaccuggcgaggaugaagaaccguuccuuggcacuccacaaaauggugcaugcacaccugccucuuaggagacucaggacuugcuaagucaaccuucuagguucaggugggggucgcccaagucugggugccaggagggcaccgccauaggcucagggagaacaggaggggccggugggagaggggucacucaccgagcggcaggacaaagaagaaagggaaccagcagagcacgaagacacccacgacgauggccagagucuuggccgcuuucuucucacgggagaacuugagcaggcgcacggagagcgagcugcggaagguguggcccuuggcgcugcgcaugccgugcgccccgucggcgcccguggccgcgccgcgacaguggaugcgcagcaccaccucggaggccuugccucgcucgcgcuugacgcccgccucgaggcugcgcguggugcugcgcgcgaccacguacacgcggcaguacaugaccacgaugaccgccaugggcagguagaaggagcacacggaggagaagacagcguagcccgccuccucggugauaccgcagaagcgcucgucagggggcacgggcuccuuccagcccagcaggggcccuacggacaccaccagggcuacgacccagagcagggccaggauggcggccgccuugcgcucggucaugauggcuggguacuugagugaguggcgcacgcccacguaccgguccacggagauggugcagaggcugaggauggaggccgugcagcacagcacguccacggcggcccauacgucgcagaaggcgcggccaaaggcccagaagcccagaaccuccaugguggccgagaagggcaguacgguggcgcucagcagcaggucggccacggccagguucacgaugaaauaguuggugacggucugcagguggcgguugcaggccacugagaggaugacaagcagguuaccugccacggccauaaggaugaaggcugccaggaagacgcccacgcccacgcccugcgcgcucaccaccagucccccgacggccgccgugccauucacgucgccgcccgcgcccgcgcuccccggcucccccgcggagcuccgguuguccucgccgcugccugcgcccaccacgccgccgccgccgcccgcgccccccggcacgccgcccaccgccgggcccuccgagggggccgcgccgcccgcgcugcccccgccgccgcccgcgcuggagcccccugcgcugcuguccgggcggggucccucgaaacugacgcucaggagaucgcggaaagucaucucaacgcgcggccgucgguggccgggccggggcacagaacgagcggccggcagggaggggagcacagggcauagccgcggggcuccagaugcagcuccgcgcacgggucccgucgggguccugcccaaguuccugugacgcggagcgcggcuguccgagagcggagcugccuggcccgggcggcggccgggcuccccgaggccggccguggaguagcaccgaagagccggggcccgcuacgcgcgcggcgcucugagcgugcccggcaagcgggcaaagcggcggcuccggggccgggcggugcaggcagcggccacugcggcgcucccaacucggcgcggggggcgggaccgaggaggggcagcgccaggaaggaggagggggcgacccgggccgagagacgggcgccacacuccaggguagaagggacccuucgcucaggacaagcgauugugucgggguccggggggcugcggcgcuggcgcgcgcucgggucccgcagcagccacccacgccucuccgcaggugcccaagcccgcgcucuccccuagcggugcccuuugcguuccuucccgcuccucucccggacccccucccccuuggcccucagcggcgucccucuuccucccgcccucucccccgagucucucggucacucgcuggugcccuugggcgcgcgg

SEQ ID NO: 19352 - RNA, 2726 nt, Homo sapiens
ccgcgcgcccaagggcaccagcgagugaccgagagacucgggggagagggcgggaggaagagggacgccgcugagggccaagggggaggggguccgggagaggagcgggaaggaacgcaaagggcaccgcuaggggagagcgcgggcuugggcaccugcggagaggcguggguggcugcugcgggacccgagcgcgcgccagcgccgcagccccccggaccccgacacaaucgcuuguccugagcgaagggucccuucuacccuggaguguggcgcccgucucucggcccgggucgcccccuccuccuuccuggcgcugccccuccucggucccgccccccgcgccgaguugggagcgccgcaguggccgcugccugcaccgcccggccccggagccgccgcuuugcccgcuugccgggcacgcucagagcgccgcgcgcguagcgggccccggcucuucggugcuacuccacggccggccucggggagcccggccgccgcccgggccaggcagcuccgcucucggacagccgcgcuccgcgucacaggaacuugggcaggaccccgacgggacccgugcgcggagcugcaucuggagccccgcggcuaugcccugugcuccccucccugccggccgcucguucugugccccggcccggccaccgacggccgcgcguugagaugacuuuccgcgaucuccugagcgucaguuucgagggaccccgcccggacagcagcgcagggggcuccagcgcgggcggcggcgggggcagcgcgggcggcgcggcccccucggagggcccggcggugggcggcgugccggggggcgcgggcggcggcggcggcguggugggcgcaggcagcggcgaggacaaccggagcuccgcgggggagccggggagcgcgggcgcgggcggcgacgugaauggcacggcggccgucgggggacugguggugagcgcgcagggcgugggcgugggcgucuuccuggcagccuucauccuuauggccguggcagguaaccugcuugucauccucucaguggccugcaaccgccaccugcagaccgucaccaacuauuucaucgugaaccuggccguggccgaccugcugcugagcgccaccguacugcccuucucggccaccauggagguucugggcuucugggccuuuggccgcgccuucugcgacguaugggccgccguggacgugcugugcugcacggccuccauccucagccucugcaccaucuccguggaccgguacgugggcgugcgccacucacucaaguacccagccaucaugaccgagcgcaaggcggccgccauccuggcccugcucugggucguagcccuggugguguccguagggccccugcugggcuggaaggagcccgugcccccugacgagcgcuucugcgguaucaccgaggaggcgggcuacgcugucuucuccuccgugugcuccuucuaccugcccauggcggucaucguggucauguacugccgcguguacguggucgcgcgcagcaccacgcgcagccucgaggcgggcgucaagcgcgagcgaggcaaggccuccgagguggugcugcgcauccacugucgcggcgcggccacgggcgccgacggggcgcacggcaugcgcagcgccaagggccacaccuuccgcagcucgcucuccgugcgccugcucaaguucucccgugagaagaaagcggccaagacucuggccaucgucgugggugucuucgugcucugcugguucccuuucuucuuuguccugccgcucggugagugaccccucucccaccggccccuccuguucucccugagccuauggcggugcccuccuggcacccagacuugggcgacccccaccugaaccuagaagguugacuuagcaaguccugagucuccuaagaggcaggugugcaugcaccauuuuguggagugccaaggaacgguucuucauccucgccagguucguuucacaggcuucuaacuuuucuguccuucccuucuucuuuuccaagccuugggcuuaugcugcuggccccucuaaaaauaaaacgucugugaaaaucugggcgggcaucugcccauauguggucggcaguguaugugucccccuacagaucccccucccgggaggugggugcacagagugggugggccuacauguguucauucauggguagcaagcccuggccagucagcagguacaucagcagaugccagaagccacccgcuuuuccccagcacucauucaguuuggaagcuggccccauuugggacccuccccagcugguguuucugagugccccgaguucucauuucugagauccccucuuggaaaggaaggaggcugaguggcaaugagaagcacagggauggggauaaauuaucaaauggaaaguucauauuguuaaucguuauuucuugagcuuacugaguccuugagcucuuccgaggaacuuuccugcuucuuucacaagcugugcugcaguccugggagguaggcagcugucuucagaggccgccuccuaccccuugaggccugucuuggaagcccugggucugggacuggaggcuggaccagugcaaggaguagugggggaacagcaucucuggggaugaauuugcccggggucagauccacccauggcugcaaccuccgcaggcccaagccgggccuucucugccucucccaggccuggacccuuc

SEQ ID NO: 19353 - RNA, 2787 nt, Homo sapiens
ugcgcccgaggacgacggggcgccagagccgcggugcuuucaacuggcgagcgcgaaugggggugcacuggaguaaggcagagugaugcgggggggcaacucgccuggcaccgagaucgccgccgugcccuucccuggacccggcgucgcccaggauggcugccccgagccaugggccgcggcggagcuagcgcggagcgcccgacccucgacccccgagucccggagccggccccgcgcggggccacgcgucccucgggcgcugguuccuaaggaggacgacagcaccagcuucuccuuucucccuucccuucccugccccgcacuccucccccugcucgcuguuguugugugucagcacuuggcuggggacuucuugaacuugcagggagaauaacuugcgcaccccacuuugcgccggugccuuugccccagcggagccugcuucgccaucuccgagccccaccgccccuccacuccucggccuugcccgacacugagacgcuguucccagcgugaaaagagagacugcgcggccggcacccgggagaaggaggaggcaaagaaaaggaacggacauucgguccuugcgccagguccuuugaccagaguuuuuccauguggacgcucuuucaauggacguguccccgcgugcuucuuagacggacugcggucuccuaaagguagaggacgcgggccagggcccgggguggguggugggugggagggggauuugggcagccacugcgguagagcccuuccuuacguccaggccagaaguaaacagaccccucuccaguccacgugcaacggagcccugcaggggcucccacuuccagcugccccgggcgaccguaagccucacccucccggcccgcacucuuccaccccucuuucuuccccucucccuggaauacuuuuggagcuguuaacacuuagaugagguguuuuauuuauuuauuuauuuauuuuuaauuuuuuuaaaaacuuuuuugggucaaagaaaucccuuugagaggguagccccuggguuucacccguuagcugagaaccuguccgcucugccauggugaucuccauucuucaaguguuuccgggagacuugguuucuuugcucagagccgugucccauuuaggaaaguacuaggaguuugggguucucccuacuuguuuccagaaaugcgaggggucaguacugaaggaucacuugguacuguguuuuuaacagcugacacgugcauuaauagauauucaccauuuacguaaucccgggaagauacauguguaucuugacugcacuguggggaugcgggauggagcugccuuucgagacaccccugaggguaggggccugggacacaagucauaaguggcuucagaaguuguggccuugagcuuacagggucuggaagcuauaagggugugugugugugugugugugugugugugugugugucaggaaguucuauacagugccucuaaggaagucacaugcaccauuuauguguguuuauaugccagacagcgcucagcacuccgcauuuggguuuguauaggggacgcagggugucagaucaagcggugguuuucccagguucccggcauuggcugucagcgcugugucacacacaaaaaagugacagucauuggcgcugguuugguugggggggagggcaaaucccaaaucugaugucagacgagcuaagcguuggaugggagcgauaaaucaucugguucaggaacuugggacccuucauuaucccaaacguuugagcuucggucggucuuaccuagacucgugagugugccaagccaggagggcauccuggaggaggcacgccagccaaaugggagaccgggccgcgggggcgcgaggggggaggacugggcggggaacucgggugacucacgucgguccuguccgcaggucgaccaugguggccgggacccgcugucuucuagcguugcugcuuccccagguccuccugggcggcgcggcuggccucguuccggagcugggccgcaggaaguucgcggcggcgucgucgggccgccccucaucccagcccucugacgagguccugagcgaguucgaguugcggcugcucagcauguucggccugaaacagagacccacccccagcagggacgccguggugccccccuacaugcuagaccuguaucgcaggcacucaggucagccgggcucacccgccccagaccaccgguuggagagggcagccagccgagccaacacugugcgcagcuuccaccaugaaggugaggcauggagcagggcgugggggcggggagucacccugcaaagcccuccaccgugggcagacugcagccgucccuguagaggcagcuuggccggggcaccagcggacguuuccacucuugcuucuguacuaucguuucugaaucugauuuuaacucacugcuuguguggugggggagccagggauuccccuuuaguaacuccgcacccucuuccuggcuugcagccagaagagcuacuccuccuggaagaauuggagagaaaucaagugauggggaagaugagggcaaaaggcaugccucuagucagcuaaacgugcaagaauuccacagagggaaaaggagaaaaagggaggcagauugagauuucuuuaagucuguuuggaagcuuuugcucuauaaaucugccgcuuaagccaggguuuuaggguagacagagccaagggcagaguuuucagagauaguauugaaaaaucaaagcccagggccccaaagucuuucuaauuu

SEQ ID NO: 19354 - RNA, 2787 nt, Homo sapiens
aaauuagaaagacuuuggggcccugggcuuugauuuuucaauacuaucucugaaaacucugcccuuggcucugucuacccuaaaacccuggcuuaagcggcagauuuauagagcaaaagcuuccaaacagacuuaaagaaaucucaaucugccucccuuuuucuccuuuucccucuguggaauucuugcacguuuagcugacuagaggcaugccuuuugcccucaucuuccccaucacuugauuucucuccaauucuuccaggaggaguagcucuucuggcugcaagccaggaagagggugcggaguuacuaaaggggaaucccuggcucccccaccacacaagcagugaguuaaaaucagauucagaaacgauaguacagaagcaagaguggaaacguccgcuggugccccggccaagcugccucuacagggacggcugcagucugcccacgguggagggcuuugcagggugacuccccgcccccacgcccugcuccaugccucaccuucaugguggaagcugcgcacaguguuggcucggcuggcugcccucuccaaccgguggucuggggcgggugagcccggcugaccugagugccugcgauacaggucuagcauguaggggggcaccacggcgucccugcugggggugggucucuguuucaggccgaacaugcugagcagccgcaacucgaacucgcucaggaccucgucagagggcugggaugaggggcggcccgacgacgccgccgcgaacuuccugcggcccagcuccggaacgaggccagccgcgccgcccaggaggaccuggggaagcagcaacgcuagaagacagcgggucccggccaccauggucgaccugcggacaggaccgacgugagucacccgaguuccccgcccaguccuccccccucgcgcccccgcggcccggucucccauuuggcuggcgugccuccuccaggaugcccuccuggcuuggcacacucacgagucuagguaagaccgaccgaagcucaaacguuugggauaaugaagggucccaaguuccugaaccagaugauuuaucgcucccauccaacgcuuagcucgucugacaucagauuugggauuugcccucccccccaaccaaaccagcgccaaugacugucacuuuuuugugugugacacagcgcugacagccaaugccgggaaccugggaaaaccaccgcuugaucugacacccugcguccccuauacaaacccaaaugcggagugcugagcgcugucuggcauauaaacacacauaaauggugcaugugacuuccuuagaggcacuguauagaacuuccugacacacacacacacacacacacacacacacacacacccuuauagcuuccagacccuguaagcucaaggccacaacuucugaagccacuuaugacuugugucccaggccccuacccucaggggugucucgaaaggcagcuccaucccgcauccccacagugcagucaagauacacauguaucuucccgggauuacguaaauggugaauaucuauuaaugcacgugucagcuguuaaaaacacaguaccaagugauccuucaguacugaccccucgcauuucuggaaacaaguagggagaaccccaaacuccuaguacuuuccuaaaugggacacggcucugagcaaagaaaccaagucucccggaaacacuugaagaauggagaucaccauggcagagcggacagguucucagcuaacgggugaaacccaggggcuacccucucaaagggauuucuuugacccaaaaaaguuuuuaaaaaaauuaaaaauaaauaaauaaauaaauaaaacaccucaucuaaguguuaacagcuccaaaaguauuccagggagaggggaagaaagagggguggaagagugcgggccgggagggugaggcuuacggucgcccggggcagcuggaagugggagccccugcagggcuccguugcacguggacuggagaggggucuguuuacuucuggccuggacguaaggaagggcucuaccgcaguggcugcccaaaucccccucccacccaccacccaccccgggcccuggcccgcguccucuaccuuuaggagaccgcaguccgucuaagaagcacgcggggacacguccauugaaagagcguccacauggaaaaacucuggucaaaggaccuggcgcaaggaccgaauguccguuccuuuucuuugccuccuccuucucccgggugccggccgcgcagucucucuuuucacgcugggaacagcgucucagugucgggcaaggccgaggaguggaggggcgguggggcucggagauggcgaagcaggcuccgcuggggcaaaggcaccggcgcaaaguggggugcgcaaguuauucucccugcaaguucaagaaguccccagccaagugcugacacacaacaacagcgagcagggggaggagugcggggcagggaagggaagggagaaaggagaagcuggugcugucguccuccuuaggaaccagcgcccgagggacgcguggccccgcgcggggccggcuccgggacucgggggucgagggucgggcgcuccgcgcuagcuccgccgcggcccauggcucggggcagccauccugggcgacgccggguccagggaagggcacggcggcgaucucggugccaggcgaguugcccccccgcaucacucugccuuacuccagugcacccccauucgcgcucgccaguugaaagcaccgcggcucuggcgccccgucguccucgggcgca

SEQ ID NO: 19355 - RNA, 2455 nt, Homo sapiens
ugaacccuccugacauauuuggggccauucuucuccuuuguugcuauuuugcuagcgacccgcggguaauccccgcgcgggaggggggcgugcauugucgcgcugauggacgggcccauuuggcggcuccgcgccccccggaggagagacacaaagcccaggcacgugcgccuccccauagagaagcagcagaccgugaagggaggcggggccgggcgugugccuggaccgggcggggcggcggcgccgggcggggcgaccaggggcgcgcgcgggggccccgcgcccucagguacaucugccgcaccuaccgggcgacccccgagucccggcccccuuuuggccgccccaucgcccucccacccugccaggcugaggagcugcggacgcgcugauuggcuccaggggaagcgggaggcgagaacaauggcccccuccccccguuaaaagggagcggcugccgggcccggggacagggacgcgcgugcagggcgcagagcugggccgagccgucgccggcgccacgcgagucccgcagccgccgcgcccgggcaaugggccgggggcacugagggccgccggggccgagcgcggaggggggaccgagccagugccgugcccucgggccgcgccaacaugccccgcggcuuccuggugaagcgcagcaagaaguccacgcccguuuccuaccggguccgcggcggcgaggacggcgaccgcgcacugcugcucucgcccagcugcgggggcgcccgcgccgagcccccggcgccgagcccgguccccgggccgcugccgccgccgccgcccgcggagcgcgcccaugcagcgcucgccgccgcgcuugccugcgcgccugggccgcagccacccccgcagggcccgcgggccgcgcacuucggcaaccccgaggcugcgcaccccgcgccgcucuacagucccacgcggcccgugagccgcgagcacgagaagcacaaguacuucgaacgcagcuucaaccugggcucgccggucucggccgaguccuuccccacgcccgccgcgcugcucggagggggcggcggcggcggcgcgagcggagcuggcggaggcggcaccugcggcggcgacccgcugcucuucgcgcccgccgagcucaagaugggcacggcguucucggcuggcgccgaggcggcccgcggcccgggccccggccccccacugcccccugccgccgcccugcggcccccgggaaagcggcccccgcccccuaccgccgcggagccgcccgccaaggcagucaaggccccgggcgccaagaagcccaaggccauccgcaagcugcacuucgaggacgaggugaccacgucgcccgugcuggggcucaagaucaaggagggcccgguggaggcgccgcggggccgcgcggggggcgcggcgcggccgcugggcgaguucaucugccagcugugcaaggaggaguacgccgacccguucgcgcuggcgcagcacaaaugcucgcgcaucgugcguguggaguaccgcugucccgagugcgccaaggucuucagcugcccggccaaccuggccucgcaccgccgcuggcacaaaccgcggcccgcgcccgccgccgcccgcgcgccggagccagaagcagcagccagggcugaggcgcgggaggcacccggcggcggcagcgaccgggacacgccgagccccggcggcguguccgagucgggcuccgaggacgggcucuacgagugccaucacugcgccaagaaguuccgccgccaggccuaccuacgcaagcaccugcuggcgcaccaccaggcgcugcaggccaagggcgcgccgcuagcgcccccggccgaggaccuacuggccuuguaccccgggcccgacgagaaggcgccccaggaggcggccggcgacggcgagggggccggcgugcugggccugagugcguccgccgagugccaccugugcccagugugcggagagucguucgccagcaagggcgcucaggagcgccaccugcgccugcugcacgccgcccagguguuccccugcaaguacugcccggccaccuucuacagcucgcccggccuuacgcggcacaucaacaagugccacccauccgaaaacagacaggugauccuccugcaggugcccgugcgcccggccugcuagagcgcgcccuccaccccggcccccgaacugugccuucgcuuggagacccacaaagagagugcgcccugcacuccccgaacccgaguccgcgcugggggagccucgcccccgcccccaccgggugaaagugucgucuccgcuucucucgguguggcgugacgguaaccccauacucuccuuuugacuccuuuuggaacccccacuuuuacguugugucccuccgccucccccauggcgcaacaggagucagucucuuucuguacaagggagaaaagcuguacgcguu

SEQ ID NO: 19356 - RNA, 2455 nt, Homo sapiens
aacgcguacagcuuuucucccuuguacagaaagagacugacuccuguugcgccaugggggaggcggagggacacaacguaaaaguggggguuccaaaaggagucaaaaggagaguaugggguuaccgucacgccacaccgagagaagcggagacgacacuuucacccggugggggcgggggcgaggcucccccagcgcggacucggguucggggagugcagggcgcacucucuuugugggucuccaagcgaaggcacaguucgggggccgggguggagggcgcgcucuagcaggccgggcgcacgggcaccugcaggaggaucaccugucuguuuucggauggguggcacuuguugaugugccgcguaaggccgggcgagcuguagaagguggccgggcaguacuugcaggggaacaccugggcggcgugcagcaggcgcagguggcgcuccugagcgcccuugcuggcgaacgacucuccgcacacugggcacagguggcacucggcggacgcacucaggcccagcacgccggcccccucgccgucgccggccgccuccuggggcgccuucucgucgggcccgggguacaaggccaguagguccucggccgggggcgcuagcggcgcgcccuuggccugcagcgccugguggugcgccagcaggugcuugcguagguaggccuggcggcggaacuucuuggcgcagugauggcacucguagagcccguccucggagcccgacucggacacgccgccggggcucggcgugucccggucgcugccgccgccgggugccucccgcgccucagcccuggcugcugcuucuggcuccggcgcgcgggcggcggcgggcgcgggccgcgguuugugccagcggcggugcgaggccagguuggccgggcagcugaagaccuuggcgcacucgggacagcgguacuccacacgcacgaugcgcgagcauuugugcugcgccagcgcgaacgggucggcguacuccuccuugcacagcuggcagaugaacucgcccagcggccgcgccgcgccccccgcgcggccccgcggcgccuccaccgggcccuccuugaucuugagccccagcacgggcgacguggucaccucguccucgaagugcagcuugcggauggccuugggcuucuuggcgcccggggccuugacugccuuggcgggcggcuccgcggcgguagggggcgggggccgcuuucccgggggccgcagggcggcggcagggggcaguggggggccggggcccgggccgcgggccgccucggcgccagccgagaacgccgugcccaucuugagcucggcgggcgcgaagagcagcgggucgccgccgcaggugccgccuccgccagcuccgcucgcgccgccgccgccgcccccuccgagcagcgcggcgggcguggggaaggacucggccgagaccggcgagcccagguugaagcugcguucgaaguacuugugcuucucgugcucgcggcucacgggccgcgugggacuguagagcggcgcggggugcgcagccucgggguugccgaagugcgcggcccgcgggcccugcggggguggcugcggcccaggcgcgcaggcaagcgcggcggcgagcgcugcaugggcgcgcuccgcgggcggcggcggcggcagcggcccggggaccgggcucggcgccgggggcucggcgcgggcgcccccgcagcugggcgagagcagcagugcgcggucgccguccucgccgccgcggacccgguaggaaacgggcguggacuucuugcugcgcuucaccaggaagccgcggggcauguuggcgcggcccgagggcacggcacuggcucgguccccccuccgcgcucggccccggcggcccucagugcccccggcccauugcccgggcgcggcggcugcgggacucgcguggcgccggcgacggcucggcccagcucugcgcccugcacgcgcgucccuguccccgggcccggcagccgcucccuuuuaacggggggagggggccauuguucucgccucccgcuuccccuggagccaaucagcgcguccgcagcuccucagccuggcagggugggagggcgauggggcggccaaaagggggccgggacucgggggucgcccgguaggugcggcagauguaccugagggcgcggggcccccgcgcgcgccccuggucgccccgcccggcgccgccgccccgcccgguccaggcacacgcccggccccgccucccuucacggucugcugcuucucuauggggaggcgcacgugccugggcuuugugucucuccuccggggggcgcggagccgccaaaugggcccguccaucagcgcgacaaugcacgccccccucccgcgcggggauuacccgcgggucgcuagcaaaauagcaacaaaggagaagaauggccccaaauaugucaggaggguuca

SEQ ID NO: 19357 - RNA, 2474 nt, Homo sapiens
ggacuccgagucuguuucauucagggagagucaugaucgaucgcccuugggaagguggcgagcggauugcugcuugggcauguggcccguuccuagcccuucuccaccucgcccagauucuagaacaggggucccauggaguacucccaagccagcaccccaaauacauuccccuaccccagagucuccccaaacucucccaccagcauacugagcuggcgccgaggcccgaaguccccggacgccaccuccggucgcagcaagcaaccugcgggacaacgcgcggggcgccucgggcugccuccagcgaagacugucccgggcccccucuguccggucucccuccagggacccccucccuugucccagggaaacugcaaggcagugccugugcggagugcgggggcggcuggaggcacugaacggggcaauagggaaagaaccgagaccugaaccacacgcggcugagcuuugcaggcaaaaacuuucuuucucuuuguccacuagucuuugacucugccuccacuucagcccccaacuccuacccaucuucuccuccucagcuccccacccccucgccggccgaccucccaccccuccccagccgcgcgcugccaaacauaacucuguuaggauagugcguggcucggccacgaagaggauuuggaggcgccgcaagucaauauuugaucacaaaguuaauauuaucucaaggcuaacagugugucguauaaaaaagagacccauuugauuccaaggagggcggaaaaggcggcugcccagaaaggcugggguuguggggcggggugggggggugccagcgagggaagcgguccugagguuggggaaggagcgagcgccgccgcuccacuucccccuggaaaagacgagcgcuuaccucgggcucugcauaguagcugcuccagucggacggcucgugcccuuccaucuucaccgcucccagcauacuggaagccgagugcauggcaguuuaaaauuuaacagccacaacaaacgaccagcaaucaccccccacccccacccucuuuuaaaaaaaagucagccaaagcaccguccccuccucccucccucucucgcgcucccucucccugggcuccacucccucucucucccugggcaggccggaggcgguaguuggaagugggcgggaggugggggggggcgaggagcggaggaggcccaggccagcgccccgcgguagggagcacccgccgccgccgcgcucacgggcugccggguggcggcugagguuggcagugccgagcugccccgaggcggcgggaagcgcgcggcgcgggggcuaguggggggguggggaggaggaggaggaaggaggaggaggaggcggugguggugguggaggaggaggaggaggaggaggaggaggaggaggaggaggagguguggaccgcggagcggacaagugccgcagugacgugggaggcuggugauauagcgcggcgcgcuggcgcgggccuccaauccccagacccggggcagcccauuugaauaaucagcucacaccuaggugagagguagccgcagccggcgcuccgcaccugccccucagcgccugccguccgccccaccgccgcggcgccccgcacuccugggcgggccaggggagcgggcugggcgggcgaucgggcacgcgggaucccuggucgagcccccuuuccucccggguccacagcgaguccccugaggaaggagggaccugggaggaaaccacccucuggggcggcuccggccuccagcccccgccccgucucaucgcgccgggcgcccggugcgccugucggagggcgcguccagccucagugcccggcagaucccuaugaaagccggauuuauuuaugccggguuucuucgcucucagugcucauucucugucaaaacagcaaguccaugacagccaauuugcaaagcgcuguccuauuuagaaaaacuacguacacaccuuuaacucgcccgcugcugcuccugcgaggccccucccuguuacaguucagacccggaacggccucgggagaagcgcggggcgcacggucuggccgccucggcucuccgacuccucagacaccggccgccagggacccgcaguggggcggccggcgccuggcgcaagcagccccucuagcagcggccgacgguugggaggcugagauuugucucugauauucaggccggcguguuucaagguuacuuuucagucacaaccgaggugcccacagcauuucguaacuaaaacaaacagggcaggagguggggagggaggggugaggagagaagaauccaggaaucaaugauggggcauauggaguugacuucaagagcgucucuguccucucugucuuccagagggacugcuuaauagaaauuagaaacuccagcaaucguauacuuuuauuuccccagcagcucuuggguucaaaaauugucuucuguucugg

SEQ ID NO: 19358 - RNA, 2474 nt, Homo sapiens
ccagaacagaagacaauuuuugaacccaagagcugcuggggaaauaaaaguauacgauugcuggaguuucuaauuucuauuaagcagucccucuggaagacagagaggacagagacgcucuugaagucaacuccauaugccccaucauugauuccuggauucuucucuccucaccccucccuccccaccuccugcccuguuuguuuuaguuacgaaaugcugugggcaccucgguugugacugaaaaguaaccuugaaacacgccggccugaauaucagagacaaaucucagccucccaaccgucggccgcugcuagaggggcugcuugcgccaggcgccggccgccccacugcgggucccuggcggccggugucugaggagucggagagccgaggcggccagaccgugcgccccgcgcuucucccgaggccguuccgggucugaacuguaacagggaggggccucgcaggagcagcagcgggcgaguuaaagguguguacguaguuuuucuaaauaggacagcgcuuugcaaauuggcugucauggacuugcuguuuugacagagaaugagcacugagagcgaagaaacccggcauaaauaaauccggcuuucauagggaucugccgggcacugaggcuggacgcgcccuccgacaggcgcaccgggcgcccggcgcgaugagacggggcgggggcuggaggccggagccgccccagagggugguuuccucccaggucccuccuuccucaggggacucgcuguggacccgggaggaaagggggcucgaccagggaucccgcgugcccgaucgcccgcccagcccgcuccccuggcccgcccaggagugcggggcgccgcggcgguggggcggacggcaggcgcugaggggcaggugcggagcgccggcugcggcuaccucucaccuaggugugagcugauuauucaaaugggcugccccgggucuggggauuggaggcccgcgccagcgcgccgcgcuauaucaccagccucccacgucacugcggcacuuguccgcuccgcgguccacaccuccuccuccuccuccuccuccuccuccuccuccuccuccuccaccaccaccaccgccuccuccuccuccuuccuccuccuccuccccacccccccacuagcccccgcgccgcgcgcuucccgccgccucggggcagcucggcacugccaaccucagccgccacccggcagcccgugagcgcggcggcggcgggugcucccuaccgcggggcgcuggccugggccuccuccgcuccucgcccccccccaccucccgcccacuuccaacuaccgccuccggccugcccagggagagagagggaguggagcccagggagagggagcgcgagagagggagggaggaggggacggugcuuuggcugacuuuuuuuuaaaagaggguggggguggggggugauugcuggucguuuguuguggcuguuaaauuuuaaacugccaugcacucggcuuccaguaugcugggagcggugaagauggaagggcacgagccguccgacuggagcagcuacuaugcagagcccgagguaagcgcucgucuuuuccagggggaaguggagcggcggcgcucgcuccuuccccaaccucaggaccgcuucccucgcuggcacccccccaccccgccccacaaccccagccuuucugggcagccgccuuuuccgcccuccuuggaaucaaaugggucucuuuuuuauacgacacacuguuagccuugagauaauauuaacuuugugaucaaauauugacuugcggcgccuccaaauccucuucguggccgagccacgcacuauccuaacagaguuauguuuggcagcgcgcggcuggggaggggugggaggucggccggcgaggggguggggagcugaggaggagaagauggguaggaguugggggcugaaguggaggcagagucaaagacuaguggacaaagagaaagaaaguuuuugccugcaaagcucagccgcgugugguucaggucucgguucuuucccuauugccccguucagugccuccagccgcccccgcacuccgcacaggcacugccuugcaguuucccugggacaagggagggggucccuggagggagaccggacagagggggcccgggacagucuucgcuggaggcagcccgaggcgccccgcgcguugucccgcagguugcuugcugcgaccggagguggcguccggggacuucgggccucggcgccagcucaguaugcuggugggagaguuuggggagacucugggguaggggaauguauuuggggugcuggcuugggaguacuccaugggaccccuguucuagaaucugggcgagguggagaagggcuaggaacgggccacaugcccaagcagcaauccgcucgccaccuucccaagggcgaucgaucaugacucucccugaaugaaacagacucggagucc

SEQ ID NO: 19359 - RNA, 2491 nt, Homo sapiens
gugcuuugguagcaaagcugggggugaggaggcacaggcuccuggacggagccaggcuccuggacggaggccgcucagagucucugcggcguccgcucgguccgcacgugcugcagcacuaccuccuuggaaggggccgcgcacuuguacuccaucuuggcccuggcggcgcccugcuucuugcgcagguggcagaggagcgccaaaagcgccaccaccaggcacaggcucgcgauggagaugccuaugagcaagcccgaaugcacgagccccacggccggaggagucaagguggagccgggcgucgggcugggcgggggcucgccagagccgcugucgccaccguccaccuugccggagucacagucggugccaauguggcgggcaagggccgagucgggcccgcagaugcacucgaagguaccggggagguuguggcacaccccggagcagaagccgccguuuucgcacucgucgauguccgugcagaugaaaccgucguccaggauguagccuucagggcacucacagcuagccuggguguuggggucgcagucggcuggacaggcagucugguugcaaaacaucuggcaccugugcggcucguggggaaugggcgcgaagcccucggcgcagacgcagagguagcuaguuugguucaggggcuggcacugguacucgcaguuggcucugaagcacggguccacgggcuccacacacucgccguccaccaggucguaguuaggguagcaguggcacucgaagccacccuguguguugacacagcgcugcggacacggacugggcuccaguaugcagucauccacguccucgcaccgguguuggucggccgccagccgguagccggucucgcacaugcacgaguaggagcccggcuggucgggguugggaacgcagaagugcucgcagaggucguugcaggacugcgucgcggaugcggugcaggagcgcccgucugccugcagggcggcgccggcugggcacuggcagcggggagccccagggaucgcauugcacgcgugcucgcagccgccguucuccacgcugcagucccaagcgcccggcgccucccuggcccagugccccuggaccgcuccgggcggcgcggugcacauuagcuguaagccgaggggagccaccgcggcggagcugcccaccggcagcgccuggaaguccgcuccgcgggccgcgaacggggugccguaggugaucgagacggcggcagccgcggcgccgggcuccacagccaguggccugcagguggcugggaaguggaacucgcagaggaagccaucggccuucacuucgcacugcugcuccucccagaucggcucgcugggcacaguggccucagcagcggagacagcgacgcacaacgggccgcagaggggagccccauugaggucgagccgugcccaccugcuauagcugguguuguugucucccguaacccacuggaagccgcgcaggggcccgaggcgcuuggggucgccgcagccggguggcagcugcaggccgauccagaggcgccggcggccaacgccgccgucgccguucaguagcaaggaaaugacaucggcagccaccgaggagcgcacugucauuagguggccccgcaguccgucgcagaucugacuggcauugaggaaggucgcggggcccggguagagcgcgaagcagucgugcucgacgcacuggcugccacccggcugcggcucugcgggugcggggaaccccaggccggccagggccagcgcgccaaggaccaggaccccaagcauguuacccaggcgcgccgcgugcaggcgccggggaaagcgcgggcacugcgacagggccgugccggagcagaggggcacaggacgccgauggcgacagccucuccuguccgucccagcccagacacuucuugccgcugcgcgcagccccugcgaggcagccucugacaugcggaucggccagggcucgaguuuauaagugcccggcccucccucccuggacguucgggaaaaggaaggaagugccuggugggaagggcugaugccgcauacucggauugcuggguucucuggccgcccuugcgcccgcccucgcgcaugggaucaccucgccgggaugaguaaacccugcccuggcgcagggagguucucgggcggggccgacaggggcaggcgccagggaaggccagcaccccuguaacaagacgacuguccccgcccaccacucgggcccccacgcgugcagcccucuuucaucucuugguccuccuuucuuucuuuucauacauguuacagccacuuccaaggaaagccuggauugcaagagcucugggaaccggagacuucagagaagagggcuuugaauggggagugggggagguggugcacaggaccugcaagacgcugggaggggugaucggcaccaagggcacuuugggaggaccugccuaggacguggacuuccccgaaga

SEQ ID NO: 19360 - RNA, 2491 nt, Homo sapiens
ucuucggggaaguccacguccuaggcagguccucccaaagugcccuuggugccgaucaccccucccagcgucuugcagguccugugcaccaccucccccacuccccauucaaagcccucuucucugaagucuccgguucccagagcucuugcaauccaggcuuuccuuggaaguggcuguaacauguaugaaaagaaagaaaggaggaccaagagaugaaagagggcugcacgcgugggggcccgaguggugggcggggacagucgucuuguuacaggggugcuggccuucccuggcgccugccccugucggccccgcccgagaaccucccugcgccagggcaggguuuacucaucccggcgaggugaucccaugcgcgagggcgggcgcaagggcggccagagaacccagcaauccgaguaugcggcaucagcccuucccaccaggcacuuccuuccuuuucccgaacguccagggagggagggccgggcacuuauaaacucgagcccuggccgauccgcaugucagaggcugccucgcaggggcugcgcgcagcggcaagaagugucugggcugggacggacaggagaggcugucgccaucggcguccugugccccucugcuccggcacggcccugucgcagugcccgcgcuuuccccggcgccugcacgcggcgcgccuggguaacaugcuugggguccugguccuuggcgcgcuggcccuggccggccugggguuccccgcacccgcagagccgcagccggguggcagccagugcgucgagcacgacugcuucgcgcucuacccgggccccgcgaccuuccucaaugccagucagaucugcgacggacugcggggccaccuaaugacagugcgcuccucgguggcugccgaugucauuuccuugcuacugaacggcgacggcggcguuggccgccggcgccucuggaucggccugcagcugccacccggcugcggcgaccccaagcgccucgggccccugcgcggcuuccaguggguuacgggagacaacaacaccagcuauagcaggugggcacggcucgaccucaauggggcuccccucugcggcccguugugcgucgcugucuccgcugcugaggccacugugcccagcgagccgaucugggaggagcagcagugcgaagugaaggccgauggcuuccucugcgaguuccacuucccagccaccugcaggccacuggcuguggagcccggcgccgcggcugccgccgucucgaucaccuacggcaccccguucgcggcccgcggagcggacuuccaggcgcugccggugggcagcuccgccgcgguggcuccccucggcuuacagcuaaugugcaccgcgccgcccggagcgguccaggggcacugggccagggaggcgccgggcgcuugggacugcagcguggagaacggcggcugcgagcacgcgugcaaugcgaucccuggggcuccccgcugccagugcccagccggcgccgcccugcaggcagacgggcgcuccugcaccgcauccgcgacgcaguccugcaacgaccucugcgagcacuucugcguucccaaccccgaccagccgggcuccuacucgugcaugugcgagaccggcuaccggcuggcggccgaccaacaccggugcgaggacguggaugacugcauacuggagcccaguccguguccgcagcgcugugucaacacacaggguggcuucgagugccacugcuacccuaacuacgaccugguggacggcgaguguguggagcccguggacccgugcuucagagccaacugcgaguaccagugccagccccugaaccaaacuagcuaccucugcgucugcgccgagggcuucgcgcccauuccccacgagccgcacaggugccagauguuuugcaaccagacugccuguccagccgacugcgaccccaacacccaggcuagcugugagugcccugaaggcuacauccuggacgacgguuucaucugcacggacaucgacgagugcgaaaacggcggcuucugcuccggggugugccacaaccuccccgguaccuucgagugcaucugcgggcccgacucggcccuugcccgccacauuggcaccgacugugacuccggcaagguggacgguggcgacagcggcucuggcgagcccccgcccagcccgacgcccggcuccaccuugacuccuccggccguggggcucgugcauucgggcuugcucauaggcaucuccaucgcgagccugugccuggugguggcgcuuuuggcgcuccucugccaccugcgcaagaagcagggcgccgccagggccaagauggaguacaagugcgcggccccuuccaaggagguagugcugcagcacgugcggaccgagcggacgccgcagagacucugagcggccuccguccaggagccuggcuccguccaggagccugugccuccucacccccagcuuugcuaccaaagcac

SEQ ID NO: 19361 - RNA, 3221 nt, Homo sapiens
augaaaucuucccaaaaaauuccuuuuuggguauuugagaugauuaguuucuguugcuuucaaccagagaacagacagaagcacccacucagagccaagcacuacugcaagaagaauuucauuuagucuuuuguuuuucugagacagagucucacuguaucacccaggcuggagugaagcggcaugaucuuggcucaccgcaaccucugccucccagcuucaagcaauucuccugccucagccucuugaauagcuagguuuacaggccugugccaccacaccuggcuaauguuuguauuuuuaguagagacgggguuucacuauguugcccaggcuggacucgaacuccugaccucaggugauccacccgccucggccucccaaaguacugagacuacaggcauuagccaccaugccaggccucauuuaaccuuuguaacaauuuacaggaaccauaauugaccccauuuugcagaugagaaaacagguccagagagguugauuaccugggcuaaggucacauagcaaguuaguagcagggccaaaauucauacccaaaccacagaaaucccccucuauucaccacuaagcaccuuacaugcauugccucauuuaugaucauuagcccaguuuuacagcugagaaaccaaggcuagaagugacugaguggagcccagauucaccugugggcccuggaaggcggugcucagagccugcaauuggugaggucagcccgugaggucacaauguugccagggcccagggggcagagcagacggagugugggccaucguccccaguggugaccagcccugccaugggaaacuauaguucccacaaaaggaccaaagcacccaagcaggcccgcaaggagaggccggcugacauggacaaggccugguggaaaucguuccucaaccaccucacucggaagaagccggcugugagggcgggggauggggagcagggcuggggaggcagcuggggggcagagaaagcuggacaagugggugggaagggaugcugggagucuaggccuuguaugcagaaguccuagggggugagggaggaauucgaaaaucucucccaaggaugaggaucccaggagcccauauggguguggauggggguccuuucaagguggcucacgccuguaaucccaacacguugguaggccaagguggguggauaacuucagcccaggaguuugagauuggccugggcaacauagggaggccccaucucuacaaaaauuaaaacuuagcugguugugguggugaaugcccgcagucccagcuacucagaagacugagguggacuacgugagcccaggaggucagggaugcagugagccguugacagcaccacugcuccagccuguaggacacagcaagacccuguuugacucagucuuaaacaaaaaaagcccagaagggagggcagagauuccagaaccagaaaguggaugagacuugagagccccggggggugagcaugagugggauucucucccaacccuggacgaacggguggagaucccaacacggagaaucaguucuaguugguacuacuggagcuagaggcagggggaauucccuaguguccucucuucagcuccuaggcucagaacuucccugucucccucucaaaugagcagaagcccuggaccaggcgggggugggaggugcugaaagccccugacauagggccuggaagggaucucauaaacuuagacggagcuggucucaggaagucagccugggauggaugaggguuuccagaaaggaggcggaguccggggcgccacgcagggaagggcgggcuuccccgcggccugaauuggacagggguccccuccagcccugugcacgagaggaugacaggacccggguggacgacaggacccggguggacgagggucccaggagaagcgcggagcggccccgggucgugggcucggcccuagcgcgcucucccgccucacgccccuguuccacccccagaccaggaucgugcugauucucccccuggacaagcggcagccgcuggccaacgcugggcaacggauugacuacgcguccggcgcugggcugggcuccccggcggcacccagauugcgcggagcgggcgaagguagcgagcgcgagccgaggaugccgguacugcugcugcugcggcggcaagaggcgcggcggccggaagagggcggggccagggcagcucugagcuggccgcggcugcucucgcgcuuccgguccccggggaaggcuccccgcgaagccggccccgccgaggagcagccgcgcaaacggugccgcugcccucgcccgcagcuuuaaacgcuuggcccggaccccgcccaauaaagagugcguggcaacccuggcgccugcgaacccugucggaggcgucugggcgcggagucggggugggcaaagcucagccuaggagccgcagaggggugaacggggcgugaugaaggcagagccaucgccacggucuggagccagggcugucuuuugcuuucuccuuccuugugccaagggucagaacagaaccccaaaccuugcuacaguggcgggaggcaguuuccuucccccaacacuccaaauccaggucacauccugcccagucugcaggcucaagggaggugggcuugggcaaacccaggcuuggccacgcuagugagagggaccugcuuccgguaaagccugacauccccccagcauccagaaaucccucuuaggcaugagggaggguucccggccaacaggcaccauccuggguaagaacagccaggauggcagucagcuggggcaaggccugagacguggauucugccuggggacgcacccaggagaagcuggaagcccugggccucucucuggccccucacuccuacacauugugcuugguaaccccaaagcauucaggccccccagucuuccccaaggcaccugucucccaaccuacccugucccaucuccuuccccacgugacaaagacuaauuccaaaccacuuaccugucuagggcagcucacuccccugcucauaagcuuucaacaggucuccauuaccaacagggaaaaagcccacagcuucagucucacuccccaaaucacuuagaagaagcccugccacacuuucugugggcgggauccugcugcugcuucuccucacucucccgggucccaaauccagcuccacacccaaugccacc

SEQ ID NO: 19362 - RNA, 3221 nt, Homo sapiens
gguggcauuggguguggagcuggauuugggacccgggagagugaggagaagcagcagcaggaucccgcccacagaaaguguggcagggcuucuucuaagugauuuggggagugagacugaagcugugggcuuuuucccuguugguaauggagaccuguugaaagcuuaugagcaggggagugagcugcccuagacagguaagugguuuggaauuagucuuugucacguggggaaggagaugggacaggguagguugggagacaggugccuuggggaagacuggggggccugaaugcuuugggguuaccaagcacaauguguaggagugaggggccagagagaggcccagggcuuccagcuucuccugggugcguccccaggcagaauccacgucucaggccuugccccagcugacugccauccuggcuguucuuacccaggauggugccuguuggccgggaacccucccucaugccuaagagggauuucuggaugcuggggggaugucaggcuuuaccggaagcaggucccucucacuagcguggccaagccuggguuugcccaagcccaccucccuugagccugcagacugggcaggaugugaccuggauuuggaguguugggggaaggaaacugccucccgccacuguagcaagguuugggguucuguucugacccuuggcacaaggaaggagaaagcaaaagacagcccuggcuccagaccguggcgauggcucugccuucaucacgccccguucaccccucugcggcuccuaggcugagcuuugcccaccccgacuccgcgcccagacgccuccgacaggguucgcaggcgccaggguugccacgcacucuuuauugggcgggguccgggccaagcguuuaaagcugcgggcgagggcagcggcaccguuugcgcggcugcuccucggcggggccggcuucgcggggagccuuccccggggaccggaagcgcgagagcagccgcggccagcucagagcugcccuggccccgcccucuuccggccgccgcgccucuugccgccgcagcagcagcaguaccggcauccucggcucgcgcucgcuaccuucgcccgcuccgcgcaaucugggugccgccggggagcccagcccagcgccggacgcguagucaauccguugcccagcguuggccagcggcugccgcuuguccagggggagaaucagcacgauccuggucuggggguggaacaggggcgugaggcgggagagcgcgcuagggccgagcccacgacccggggccgcuccgcgcuucuccugggacccucguccacccggguccugucguccacccggguccugucauccucucgugcacagggcuggaggggaccccuguccaauucaggccgcggggaagcccgcccuucccugcguggcgccccggacuccgccuccuuucuggaaacccucauccaucccaggcugacuuccugagaccagcuccgucuaaguuuaugagaucccuuccaggcccuaugucaggggcuuucagcaccucccacccccgccugguccagggcuucugcucauuugagagggagacagggaaguucugagccuaggagcugaagagaggacacuagggaauucccccugccucuagcuccaguaguaccaacuagaacugauucuccguguugggaucuccacccguucguccaggguugggagagaaucccacucaugcucaccccccggggcucucaagucucauccacuuucugguucuggaaucucugcccucccuucugggcuuuuuuuguuuaagacugagucaaacagggucuugcuguguccuacaggcuggagcaguggugcugucaacggcucacugcaucccugaccuccugggcucacguaguccaccucagucuucugaguagcugggacugcgggcauucaccaccacaaccagcuaaguuuuaauuuuuguagagauggggccucccuauguugcccaggccaaucucaaacuccugggcugaaguuauccacccaccuuggccuaccaacguguugggauuacaggcgugagccaccuugaaaggacccccauccacacccauaugggcuccugggauccucauccuugggagagauuuucgaauuccucccucacccccuaggacuucugcauacaaggccuagacucccagcaucccuucccacccacuuguccagcuuucucugccccccagcugccuccccagcccugcuccccaucccccgcccucacagccggcuucuuccgagugaggugguugaggaacgauuuccaccaggccuuguccaugucagccggccucuccuugcgggccugcuugggugcuuugguccuuuugugggaacuauaguuucccauggcagggcuggucaccacuggggacgauggcccacacuccgucugcucugcccccugggcccuggcaacauugugaccucacgggcugaccucaccaauugcaggcucugagcaccgccuuccagggcccacaggugaaucugggcuccacucagucacuucuagccuugguuucucagcuguaaaacugggcuaaugaucauaaaugaggcaaugcauguaaggugcuuaguggugaauagagggggauuucugugguuuggguaugaauuuuggcccugcuacuaacuugcuaugugaccuuagcccagguaaucaaccucucuggaccuguuuucucaucugcaaaauggggucaauuaugguuccuguaaauuguuacaaagguuaaaugaggccuggcaugguggcuaaugccuguagucucaguacuuugggaggccgaggcggguggaucaccugaggucaggaguucgaguccagccugggcaacauagugaaaccccgucucuacuaaaaauacaaacauuagccaggugugguggcacaggccuguaaaccuagcuauucaagaggcugaggcaggagaauugcuugaagcugggaggcagagguugcggugagccaagaucaugccgcuucacuccagccugggugauacagugagacucugucucagaaaaacaaaagacuaaaugaaauucuucuugcaguagugcuuggcucugagugggugcuucugucuguucucugguugaaagcaacagaaacuaaucaucucaaauacccaaaaaggaauuuuuugggaagauuucau

SEQ ID NO: 19363 - RNA, 3108 nt, Homo sapiens
auaaacucccagaagcucagaugacuaggaucucugcuggauuuccauacaggggugagggcagagccuguauugaacuucccaaaauacucccugagguuuuggaacuugcucucuccuaccauucuuucauccucucuccuaccauucuuucauccugagaucuucucucucaugcauuuauucauucaacaauuauugagugcccaauaaauaaauagagaugaggguuuuuuuuguuguuguuguuuguuuguuuuuuugagacagagucucacucuguugcccaggcuggagugcaauggcgcgaucuucgcucacugcaaccucugccucagccuccugaguagcugggguuacagacaccugccaccaggccuggcuaauuuuuuuuuuuuguauuuuuaguagagaugggguuuugucauguuggccaggcuguuuuugaacuccugaccucaggugauccacccgccucagcaucccaaagugcugggauuacaggugugagccaccacaccggccaguguauuuuguuuuguuuuuuguuuuuuguuucuuuuugagacugagucucacucugucacccaggcuggagugcaguggagugaucucggcucacuguaaccucugccuccccaguucgagugauucuccugccucagccucccgaguagcuaggauuacaggcacccaccaccaugcccagcuaauuuuuguauuuuuaguagagaugggguuucaccauguuggccaggcaggucuugaacuccugaccucaagugauccacccaccucaggcaugagccaccgcgcccggccuauggauaaggucuugaugcuggagaaaggagagugaacaaaacaaucaugaucccugcccucauggggcuuacagacagggaguaaucagauaauugcacaaauaaauaaucauagauuuugguaaaugcuaagacauuuacagagggccagaagaaaacaugucaggcaguuccaaucucuaggucaagagagacaggcauucucuguugagcuggaagaggaaacuaaggcccaggacaggguaggugugccuguugucgcuuggugagucagggcuguauuaggaccagaagucucacuccugacuacugaauaaaaggccuagcuucaggcugauauccaucaugacacaucuucccacuccucucccugcuaccuccugauuccacucccuuuggaaaauaaguuuugauccgcagcccugacauuugacgcccauaaaccucuaaacuccaucuucauuaucuccucacccccaccccauacagagugcaguccagucagguuggcaagggcugcuggucagggccagaugaccagaaaguguagaggaggagagaauuuggggcuuucaggcugggagcagcuagggaagggccaagccggaaaagcagcaucugccaggcugguaagagacaaggcucaagugcaggcacugcgaggaagcgagagugagguagaaggaugcucuaaugccaggaagugacgugcagggacagagggaugggggaugaaggaugaagaauggaggggaggaugaagcugggccacauggcuaggaggaagagcagcagggaaggaaugcacagagagcucuuugcccccaggucucuuccaaucccugucuccuccuucucuuacccccacuucucacaauuccagcagagggcugaggggaacacaguaaaauucuggagacugcuuccuagggagcagaguaccuuacuaauaccccggccagauccauggcucagggaggggugggguaauccacaggagagugaaggcguucuaguccccaaggacuuuugagaggucaugcaguccaugccuccgucucccaacacccaacagaggggaaucauauucucuuuaccccucccuagacaugaagagauucuccgcuucucccagacccucugcuucucacaaucccuggcuguggggaacuucucuuaaggcacagauuggaucccucuugcugcagucucugacuugguuucuccuauccuguccucuguggcuagagaaagcccucuucugggugaucacagcgguuccuuaggaucuccccuucaacauuccuucaucguuaguugguucuucccagaagguaagcccaaucccuucuacugcagucccuagcauccucuccguugucgcauccuacgccuccaaggcagaaaugcacccccuuccucaccaaauaauuaacagagacaagggagaagaagggagagauccaagaagauggggaugaauuaaggagauggagcuggagguggaugcuugacacagaagaaggaagaccggggacuucccaaggcagggcagggacggggucagcgggccucaccggugucggggucucccagaaaggcguccucguccuugcggccccucagcggggccgcgggcgccggcucguccucgggcagccgcgggaagcuggugaugcucauguaguccacuggcgaguaggcgcccagggcgcucuccuggcuggccucguucuccgccgccauccucgcccgcgccccccagcagcgcagcgccugccggaaguggcugcggcgggggagugggagggcggagggcggggccugaucuucgcgacagccgggagggggcgccucucccagcccucggccgugucccggucugacucgcccccgucugcucagcgcuaucagccugcagcuggcacacaggugcguguagauggacagccaggaaggcagcgcagggucgaggggagagcgcggggcaagcgagacuucaguggcucugcacuuuacgcagcucagggaccaaaccccuuccuccuuccagccugaauacagcuaguguccuccucaaaucccaggcuuccuuuucgggccccagacccuuucacugaccgcaaaucccucucgaccccagauccugucucugaccccaaacuccucggaccccagaccccuccuugaauuccgagauccuccuccuccgauuuuagacuccuccuccgaccuuagaccucuuuuucgacuucagacucugucuucacccccaaacccuuuu

SEQ ID NO: 19364 - RNA, 3108 nt, Homo sapiens
aaaaggguuugggggugaagacagagucugaagucgaaaaagaggucuaaggucggaggaggagucuaaaaucggaggaggaggaucucggaauucaaggaggggucugggguccgaggaguuuggggucagagacaggaucuggggucgagagggauuugcggucagugaaagggucuggggcccgaaaaggaagccugggauuugaggaggacacuagcuguauucaggcuggaaggaggaagggguuuggucccugagcugcguaaagugcagagccacugaagucucgcuugccccgcgcucuccccucgacccugcgcugccuuccuggcuguccaucuacacgcaccugugugccagcugcaggcugauagcgcugagcagacgggggcgagucagaccgggacacggccgagggcugggagaggcgcccccucccggcugucgcgaagaucaggccccgcccuccgcccucccacucccccgccgcagccacuuccggcaggcgcugcgcugcuggggggcgcgggcgaggauggcggcggagaacgaggccagccaggagagcgcccugggcgccuacucgccaguggacuacaugagcaucaccagcuucccgcggcugcccgaggacgagccggcgcccgcggccccgcugaggggccgcaaggacgaggacgccuuucugggagaccccgacaccggugaggcccgcugaccccgucccugcccugccuugggaaguccccggucuuccuucuucugugucaagcauccaccuccagcuccaucuccuuaauucauccccaucuucuuggaucucucccuucuucucccuugucucuguuaauuauuuggugaggaagggggugcauuucugccuuggaggcguaggaugcgacaacggagaggaugcuagggacugcaguagaagggauugggcuuaccuucugggaagaaccaacuaacgaugaaggaauguugaaggggagauccuaaggaaccgcugugaucacccagaagagggcuuucucuagccacagaggacaggauaggagaaaccaagucagagacugcagcaagagggauccaaucugugccuuaagagaaguuccccacagccagggauugugagaagcagagggucugggagaagcggagaaucucuucaugucuagggagggguaaagagaauaugauuccccucuguuggguguugggagacggaggcauggacugcaugaccucucaaaaguccuuggggacuagaacgccuucacucuccuguggauuaccccaccccucccugagccauggaucuggccgggguauuaguaagguacucugcucccuaggaagcagucuccagaauuuuacuguguuccccucagcccucugcuggaauugugagaaguggggguaagagaaggaggagacagggauuggaagagaccugggggcaaagagcucucugugcauuccuucccugcugcucuuccuccuagccauguggcccagcuucauccuccccuccauucuucauccuucaucccccaucccucugucccugcacgucacuuccuggcauuagagcauccuucuaccucacucucgcuuccucgcagugccugcacuugagccuugucucuuaccagccuggcagaugcugcuuuuccggcuuggcccuucccuagcugcucccagccugaaagccccaaauucucuccuccucuacacuuucuggucaucuggcccugaccagcagcccuugccaaccugacuggacugcacucuguauggggugggggugaggagauaaugaagauggaguuuagagguuuaugggcgucaaaugucagggcugcggaucaaaacuuauuuuccaaagggaguggaaucaggagguagcagggagaggagugggaagaugugucaugauggauaucagccugaagcuaggccuuuuauucaguagucaggagugagacuucugguccuaauacagcccugacucaccaagcgacaacaggcacaccuacccuguccugggccuuaguuuccucuuccagcucaacagagaaugccugucucucuugaccuagagauuggaacugccugacauguuuucuucuggcccucuguaaaugucuuagcauuuaccaaaaucuaugauuauuuauuugugcaauuaucugauuacucccugucuguaagccccaugagggcagggaucaugauuguuuuguucacucuccuuucuccagcaucaagaccuuauccauaggccgggcgcgguggcucaugccugagguggguggaucacuugaggucaggaguucaagaccugccuggccaacauggugaaaccccaucucuacuaaaaauacaaaaauuagcugggcaugguggugggugccuguaauccuagcuacucgggaggcugaggcaggagaaucacucgaacuggggaggcagagguuacagugagccgagaucacuccacugcacuccagccugggugacagagugagacucagucucaaaaagaaacaaaaaacaaaaaacaaaacaaaauacacuggccggugugguggcucacaccuguaaucccagcacuuugggaugcugaggcggguggaucaccugaggucaggaguucaaaaacagccuggccaacaugacaaaaccccaucucuacuaaaaauacaaaaaaaaaaaauuagccaggccugguggcaggugucuguaaccccagcuacucaggaggcugaggcagagguugcagugagcgaagaucgcgccauugcacuccagccugggcaacagagugagacucugucucaaaaaaacaaacaaacaacaacaacaaaaaaaacccucaucucuauuuauuuauugggcacucaauaauuguugaaugaauaaaugcaugagagagaagaucucaggaugaaagaaugguaggagagaggaugaaagaaugguaggagagagcaaguuccaaaaccucagggaguauuuugggaaguucaauacaggcucugcccucaccccuguauggaaauccagcagagauccuagucaucugagcuucugggaguuuau

SEQ ID NO: 19365 - RNA, 2862 nt, Homo sapiens
acacacacgugaaccucuccagguacagagcugugcaucccaugugcgugcagcccugcugcuccggcuuccucucccugccccauggccugccuccuuguggucaccacaguccucccugggccugccaggccccccuguggcaucacccguugccuaaggggcccucugcucccuccucuccccucaccuucugccucugucacuuccuccuagccuugugcugccucugcccccagaaccuuccccuugucccucugugguuccugggcuccaacccaagccugccccugucugugcgggugaugcucugcugcaagcccaaaucccugggguccuccuuggcacccucuuuucuggggccgccuucuacucuggccuguaugggggcucaggugggcucucuggaguccaagaagccccuuguggaguuggcagcugcucucagcugaaggcaggacuggcgcuugugccaggggauuccaaguguguaggugaggagugcacuuacgugacugucccggggcacuugggcccccaucuacacugccgguauucagccuuuacguagcucuccgcucccuccuguaggaugcaggucacauuccugugcaccacauaggcacagagggcccuacaggagaaaauggcaccccuggaauaucuggcugagcgaggcccacagaggcgccuacccucccaccuccaucugugggccucagcaggacuccaaacucccaugucucuucugucuguucucugugucccugggagccaacgcccuuggucugggguccagccccgcugcuggucucugauuccagccuccgugauggguggccccugggcuaagcacuauuuggaaccaggagccugauguggcugccccucccugcguggggaagaggccagcccggauucucccucaagugcccugccacacccccccauccuucgcugauuccaaacuccuuaucuuggcauuuaaggcuuccgaguccccacucagugacuccuuugagagcaccaugucuuguccuuccucccugccuggcucccggggaaauccaccucuccucguaguuuugcagccccugccuuugguccuguucccuuacucucagagcaguucuuguaccaccuccuccaggaggcucgcugugauguacccaggcccacugagugucgguacucuuccuccuacaacagcucucaaauucagcuagaauucaaguucagccagcaccccaggcagagccuccagcccacuuaacugaggccaguucgcaagccacugcccacgaaacaccagaagcugaggcggggaaagcaggcuccuugaugagccacaagggcugaggagguggcugccuggcauaagccgaccgcuguggacggcugugccacagcacaggcccggagccaggagcccgcucuggcucugcagcccggccacgcuggggcucccaugggguugcuggggccaggcugacugcgagagggcagcggccgcccggaugcgcagcucuaucuccuaccuggccgggccaggggagagaagggaggcccggggcgggggagccccgcgugcucagcgcgcggaccgccuuuccuccucucccuccaccugguccgcucgcccggagucugcacacagcgcagcuggaaaauguuacuucgcuggaaagguuuccgcuggcacugccaggaucccaagccgccgcgccaggcccccucgguuccuuuuuccucgccagccccgcaaccucccggagcguagggcgcucgccugggcaggggcucggccccgggcgccgcccccucugugcagcggccucggggugcccggggccucgacgccccccgcgggugcgggcaggugggagcggcgacgcgcgcgggcccaucccucccucuucccgcccgccgcccgcccgcgcuuacuugugcggccccgggcgcagccgcgggcgccaucccgucguguagagacuguagcgggaggcaccgggcggcgcaggccgcgccaggagcggggugccccuggccugcgcccccgagagcagcgccgcgacggcgcacagccagacgagcaggcggcggcggcccauagcggcccccgcgccucugcccggccccgcgcggugccccccgccggguguccgccugcagcgccgcgccgcccccgccgcuggucggcccgggucccgccccgagggucccgggguccccuucggcccccgagcucgcuggcccggccgccuggcgcuucgcggcggcugcgucccgcggaguggccggcgcugcuagcggcuggggccgcggaggggaggcgggaggcgggcucuuugcggauuagcauaaacuuggggccgcgccgcucgccgccgccagccccucgccccagcuccgagcggacggccgaggagccgccugcgaacaggagguuccaaagggagcagccccagguggcaggggcgcaggccgccgcgcccugggaggccccccgagcacaccagccacucugucgccugcgggcacggggcgagacgcagagaagcggaccccugaggccagccugggcguggacuuuccaggagucguccacccucaggauacgcuugucuucagaguccgugugaacccgggaacugcucuccagggcucuggagccgagauggccgugacugggggcacagcagcaccaccucccccgccaccucuuuggaauagaccccagaucauccccguuugcucgcucugccuccuggccccaucauugcccgggaaccuuaguuugauaacuccgcugaccucuccccaggcaucccaccucccccuuaccccgcaaccucugccacg

SEQ ID NO: 19366 - RNA, 2862 nt, Homo sapiens
cguggcagagguugcgggguaagggggaggugggaugccuggggagaggucagcggaguuaucaaacuaagguucccgggcaaugauggggccaggaggcagagcgagcaaacggggaugaucuggggucuauuccaaagagguggcgggggagguggugcugcugugcccccagucacggccaucucggcuccagagcccuggagagcaguucccggguucacacggacucugaagacaagcguauccugaggguggacgacuccuggaaaguccacgcccaggcuggccucagggguccgcuucucugcgucucgccccgugcccgcaggcgacagaguggcuggugugcucggggggccucccagggcgcggcggccugcgccccugccaccuggggcugcucccuuuggaaccuccuguucgcaggcggcuccucggccguccgcucggagcuggggcgaggggcuggcggcggcgagcggcgcggccccaaguuuaugcuaauccgcaaagagcccgccucccgccuccccuccgcggccccagccgcuagcagcgccggccacuccgcgggacgcagccgccgcgaagcgccaggcggccgggccagcgagcucgggggccgaaggggaccccgggacccucggggcgggacccgggccgaccagcggcgggggcggcgcggcgcugcaggcggacacccggcggggggcaccgcgcggggccgggcagaggcgcgggggccgcuaugggccgccgccgccugcucgucuggcugugcgccgucgcggcgcugcucucgggggcgcaggccaggggcaccccgcuccuggcgcggccugcgccgcccggugccucccgcuacagucucuacacgacgggauggcgcccgcggcugcgcccggggccgcacaaguaagcgcgggcgggcggcgggcgggaagagggagggaugggcccgcgcgcgucgccgcucccaccugcccgcacccgcggggggcgucgaggccccgggcaccccgaggccgcugcacagagggggcggcgcccggggccgagccccugcccaggcgagcgcccuacgcuccgggagguugcggggcuggcgaggaaaaaggaaccgagggggccuggcgcggcggcuugggauccuggcagugccagcggaaaccuuuccagcgaaguaacauuuuccagcugcgcugugugcagacuccgggcgagcggaccagguggagggagaggaggaaaggcgguccgcgcgcugagcacgcggggcucccccgccccgggccucccuucucuccccuggcccggccagguaggagauagagcugcgcauccgggcggccgcugcccucucgcagucagccuggccccagcaaccccaugggagccccagcguggccgggcugcagagccagagcgggcuccuggcuccgggccugugcuguggcacagccguccacagcggucggcuuaugccaggcagccaccuccucagcccuuguggcucaucaaggagccugcuuuccccgccucagcuucugguguuucgugggcaguggcuugcgaacuggccucaguuaagugggcuggaggcucugccuggggugcuggcugaacuugaauucuagcugaauuugagagcuguuguaggaggaagaguaccgacacucagugggccuggguacaucacagcgagccuccuggaggaggugguacaagaacugcucugagaguaagggaacaggaccaaaggcaggggcugcaaaacuacgaggagagguggauuuccccgggagccaggcagggaggaaggacaagacauggugcucucaaaggagucacugaguggggacucggaagccuuaaaugccaagauaaggaguuuggaaucagcgaaggauggggggguguggcagggcacuugagggagaauccgggcuggccucuuccccacgcagggaggggcagccacaucaggcuccugguuccaaauagugcuuagcccaggggccacccaucacggaggcuggaaucagagaccagcagcggggcuggaccccagaccaagggcguuggcucccagggacacagagaacagacagaagagacaugggaguuuggaguccugcugaggcccacagauggaggugggaggguaggcgccucugugggccucgcucagccagauauuccaggggugccauuuucuccuguagggcccucugugccuauguggugcacaggaaugugaccugcauccuacaggagggagcggagagcuacguaaaggcugaauaccggcaguguagaugggggcccaagugccccgggacagucacguaagugcacuccucaccuacacacuuggaauccccuggcacaagcgccaguccugccuucagcugagagcagcugccaacuccacaaggggcuucuuggacuccagagagcccaccugagcccccauacaggccagaguagaaggcggccccagaaaagagggugccaaggaggaccccagggauuugggcuugcagcagagcaucacccgcacagacaggggcaggcuuggguuggagcccaggaaccacagagggacaaggggaagguucugggggcagaggcagcacaaggcuaggaggaagugacagaggcagaaggugaggggagaggagggagcagagggccccuuaggcaacgggugaugccacaggggggccuggcaggcccagggaggacuguggugaccacaaggaggcaggccauggggcagggagaggaagccggagcagcagggcugcacgcacaugggaugcacagcucuguaccuggagagguucacgugugugu

SEQ ID NO: 19367 - RNA, 2661 nt, Homo sapiens
aaaugcucuucacgcauuguggcauuuaauccucucugcaauuguaagacuaaggcugugauugucccccaucauacagacaaugaaauugaggcucagaaaaguuaagcgcugguacccaaagucauucggccaaaaaguggcugcggcaggauacaaucccacgccugcuaguuucugugagccagccugggcguuuggugccucuccuccugccaggcgaaccucugcagacagaagcccuuccccaccucggcccacuccccuacgcacacaggcuucuguguggcugucuuugcaacucgccaacccccccagaccccuccacacacacaaacacagacaugcacugcccaaccgcaggcggcagggaggggcugcgcccuguugcggggcugagcgugguggcguggcagcgaguggaccaaaacccacugcgcacgagaacgcgcggcuuggcgccuguuucccgccugcucucaggagcgaccgccagggggcgcccgagauggcagggggcgugggaagcccacaucugcccagcaggugcgcccaccccgagcaaacagggggccggggcccggggccuuggagauaaggccuggacaggauauaacccgcgcaagagccgaggagcaggggugugcaggguuccagcgacagcagcacuggacucguccagagggcggcgggugagcggcuggggccccguggagccaccauggaccccgcaggggcagcaggugagcgcuuacccucccgaggccccggagacgccccgugagaacuacgaaggaccacccccccacccccuccccacuauacaaauaggaaaacuaagccccaaggaggcagcccgccgaacugcaaaagcaggauuagaaccuagggcuccugguuccccuucucucucuugaggcccccuggcgccuagaauucacuaaaccucauuuccuuccagcuccuaccccaccgccgcgccccaugcugaagcuguguuagccauuuuucuguugcuguuucuuggcagagagggccagcugccccuaacccaacagcagcuccgcccccgccccccaauuccgugaaugcgccuauucugagcgaggccagugccugcuucucacuccaggcgaccuucucaucccggauucuucucccuuuuccccucccaggccugguagaagaacauaaauccucuggcagggcccgucgugggagggugaccaagcaagauguggcagcgcugguggaagugggagggcggggaacccuugucaagcuugggccacaggcaaagccaacaucccuggacagcaugagggcuaaggcacaaggggccucugccaccucccauacuuuccuacccggagaugccucugggccccuaaaucuugguuaagguuccccucaucccauucuuggucugagccaacuucucaccuggcacccugccuccaccccaggaauccuagaaagucaaaauagcaaaugccucaaaguucaucaccuuuccaaaccccucauucuacaaagaaaggaacuagguccagagaggguagugucuugcugaaggguacauggcgaugucguggcaggacugauacuagaaccugggauuccucugaggaguuaauccuugcauuaaaaaaagaaagauucagagaugcccugaggugagguugagggaguggagcagcaagggaggagaggccuguaaauaaauucucaaaagucccuuagggacauuucaggggguuccuggagggaugagaguagaaaagggaugauccuauuuugauggcuuugagggugggggcucgauuuggaaaggacccugcagaaguggggaagggcacugcaaaucagauagggcacccuaggcagcgucucugcuaaaauacacucgccugaccuggcuugaugccuacuccccugcagaccccucagugccucccaauccuuugacucaccugagccugcaggacagaucagagaugcagcugcagagcgaagccgacaggcggagccucccgggcacuuggaccagguaacggcggcguggcagcgugcccuagguggggacugccaggcagcuggagcacacagaggcaacggccgcauuuaacccagggcuggcggguggggaggggaagugcaggcugcaaccccucccacuggcagggagggauccccccuuccuccugagggggggcaaacccagcacccccugcuccuaccacgcuuggagcugcagacagggcuagcugcgggccaggcuggaauucagcuacagcgggagacuggggagaccggggcagccacacuccacagccggaauucauuggaagcuuagaaggcacuucccugaggagagccccaagggguggagcgguccuggcuguggcugcugccugucuggccuggcuuucgagggugcggucuugcgcuguccccuccaggagugaggagagacucugguccugccaagaggaauaagggcucagaaggacagccucaguuuucauggcucuccuugggccucaaccugcuaaccccccaaaucucucccaccuccccuccucuacuugcucccugcaauugcucgggccuacccacccacaccgcucaagacccccagguuaagaagccaccagaccu

SEQ ID NO: 19368 - RNA, 2661 nt, Homo sapiens
aggucugguggcuucuuaaccugggggucuugagcgguguggguggguaggcccgagcaauugcagggagcaaguagaggaggggaggugggagagauuugggggguuagcagguugaggcccaaggagagccaugaaaacugaggcuguccuucugagcccuuauuccucuuggcaggaccagagucucuccucacuccuggaggggacagcgcaagaccgcacccucgaaagccaggccagacaggcagcagccacagccaggaccgcuccaccccuuggggcucuccucagggaagugccuucuaagcuuccaaugaauuccggcuguggaguguggcugccccggucuccccagucucccgcuguagcugaauuccagccuggcccgcagcuagcccugucugcagcuccaagcgugguaggagcagggggugcuggguuugcccccccucaggaggaaggggggaucccucccugccagugggagggguugcagccugcacuuccccuccccacccgccagcccuggguuaaaugcggccguugccucugugugcuccagcugccuggcaguccccaccuagggcacgcugccacgccgccguuaccugguccaagugcccgggaggcuccgccugucggcuucgcucugcagcugcaucucugaucuguccugcaggcucaggugagucaaaggauugggaggcacugaggggucugcaggggaguaggcaucaagccaggucaggcgaguguauuuuagcagagacgcugccuagggugcccuaucugauuugcagugcccuuccccacuucugcaggguccuuuccaaaucgagcccccacccucaaagccaucaaaauaggaucaucccuuuucuacucucaucccuccaggaacccccugaaaugucccuaagggacuuuugagaauuuauuuacaggccucuccucccuugcugcuccacucccucaaccucaccucagggcaucucugaaucuuucuuuuuuuaaugcaaggauuaacuccucagaggaaucccagguucuaguaucaguccugccacgacaucgccauguacccuucagcaagacacuacccucucuggaccuaguuccuuucuuuguagaaugagggguuuggaaaggugaugaacuuugaggcauuugcuauuuugacuuucuaggauuccugggguggaggcagggugccaggugagaaguuggcucagaccaagaaugggaugaggggaaccuuaaccaagauuuaggggcccagaggcaucuccggguaggaaaguaugggagguggcagaggccccuugugccuuagcccucaugcuguccagggauguuggcuuugccuguggcccaagcuugacaaggguuccccgcccucccacuuccaccagcgcugccacaucuugcuuggucacccucccacgacgggcccugccagaggauuuauguucuucuaccaggccugggaggggaaaagggagaagaauccgggaugagaaggucgccuggagugagaagcaggcacuggccucgcucagaauaggcgcauucacggaauuggggggcgggggcggagcugcuguuggguuaggggcagcuggcccucucugccaagaaacagcaacagaaaaauggcuaacacagcuucagcauggggcgcggcggugggguaggagcuggaaggaaaugagguuuagugaauucuaggcgccagggggccucaagagagagaaggggaaccaggagcccuagguucuaauccugcuuuugcaguucggcgggcugccuccuuggggcuuaguuuuccuauuuguauaguggggagggggugggggggugguccuucguaguucucacggggcgucuccggggccucgggaggguaagcgcucaccugcugccccugcgggguccaugguggcuccacggggccccagccgcucacccgccgcccucuggacgaguccagugcugcugucgcuggaacccugcacaccccugcuccucggcucuugcgcggguuauauccuguccaggccuuaucuccaaggccccgggccccggcccccuguuugcucggggugggcgcaccugcugggcagaugugggcuucccacgcccccugccaucucgggcgcccccuggcggucgcuccugagagcaggcgggaaacaggcgccaagccgcgcguucucgugcgcaguggguuuugguccacucgcugccacgccaccacgcucagccccgcaacagggcgcagccccucccugccgccugcgguugggcagugcaugucuguguuuguguguguggaggggucuggggggguuggcgaguugcaaagacagccacacagaagccugugugcguaggggagugggccgagguggggaagggcuucugucugcagagguucgccuggcaggaggagaggcaccaaacgcccaggcuggcucacagaaacuagcaggcgugggauuguauccugccgcagccacuuuuuggccgaaugacuuuggguaccagcgcuuaacuuuucugagccucaauuucauugucuguaugaugggggacaaucacagccuuagucuuacaauugcagagaggauuaaaugccacaaugcgugaagagcauuu

SEQ ID NO: 19369 - RNA, 2685 nt, Homo sapiens
uuggagauaaggccuggacaggauauaacccgcgcaagagccgaggagcaggggugugcaggguuccagcgacagcagcacuggacucguccagagggcggcgggugagcggcuggggccccguggagccaccauggaccccgcaggggcagcaggugagcgcuuacccucccgaggccccggagacgccccgugagaacuacgaaggaccacccccccacccccuccccacuauacaaauaggaaaacuaagccccaaggaggcagcccgccgaacugcaaaagcaggauuagaaccuagggcuccugguuccccuucucucucuugaggcccccuggcgccuagaauucacuaaaccucauuuccuuccagcuccuaccccaccgccgcgccccaugcugaagcuguguuagccauuuuucuguugcuguuucuuggcagagagggccagcugccccuaacccaacagcagcuccgcccccgccccccaauuccgugaaugcgccuauucugagcgaggccagugccugcuucucacuccaggcgaccuucucaucccggauucuucucccuuuuccccucccaggccugguagaagaacauaaauccucuggcagggcccgucgugggagggugaccaagcaagauguggcagcgcugguggaagugggagggcggggaacccuugucaagcuugggccacaggcaaagccaacaucccuggacagcaugagggcuaaggcacaaggggccucugccaccucccauacuuuccuacccggagaugccucugggccccuaaaucuugguuaagguuccccucaucccauucuuggucugagccaacuucucaccuggcacccugccuccaccccaggaauccuagaaagucaaaauagcaaaugccucaaaguucaucaccuuuccaaaccccucauucuacaaagaaaggaacuagguccagagaggguagugucuugcugaaggguacauggcgaugucguggcaggacugauacuagaaccugggauuccucugaggaguuaauccuugcauuaaaaaaagaaagauucagagaugcccugaggugagguugagggaguggagcagcaagggaggagaggccuguaaauaaauucucaaaagucccuuagggacauuucaggggguuccuggagggaugagaguagaaaagggaugauccuauuuugauggcuuugagggugggggcucgauuuggaaaggacccugcagaaguggggaagggcacugcaaaucagauagggcacccuaggcagcgucucugcuaaaauacacucgccugaccuggcuugaugccuacuccccugcagaccccucagugccucccaauccuuugacucaccugagccugcaggacagaucagagaugcagcugcagagcgaagccgacaggcggagccucccgggcacuuggaccagguaacggcggcguggcagcgugcccuagguggggacugccaggcagcuggagcacacagaggcaacggccgcauuuaacccagggcuggcggguggggaggggaagugcaggcugcaaccccucccacuggcagggagggauccccccuuccuccugagggggggcaaacccagcacccccugcuccuaccacgcuuggagcugcagacagggcuagcugcgggccaggcuggaauucagcuacagcgggagacuggggagaccggggcagccacacuccacagccggaauucauuggaagcuuagaaggcacuucccugaggagagccccaagggguggagcgguccuggcuguggcugcugccugucuggccuggcuuucgagggugcggucuugcgcuguccccuccaggagugaggagagacucugguccugccaagaggaauaagggcucagaaggacagccucaguuuucauggcucuccuugggccucaaccugcuaaccccccaaaucucucccaccuccccuccucuacuugcucccugcaauugcucgggccuacccacccacaccgcucaagacccccagguuaagaagccaccagaccucuaggcucuaaccuggcucacucugcaggaccaaugucaucugccuugacuccuguaaucaaggguaggaaagcccacacagcaacaggccacuucucaugggagaaagggaagaauauggcuuuggccccagaaaggcucagauucccccaggccaucccccauccugaggacaagguuuugggcccuuuucuguuugcaggcaggaggcuagagagcgcuccaggccaggagcccaggaaaggcucucccuuccccucccuccucaccccccacccugccuuccccaggguggggaagcuucaucucuaccaauuccaucagcccuaaaauacucuucuccaucccaaggccaguauaagugcagccuuugugucacagccacgugucccuauggcccugggcuccaaugggcaugaugccagacccacagaguggaaccuggguggucccauggguuccaugcaggcuucguugagcaccuugcagccuaaauauuuagccuacaauuugcagccaagucuccuccuuaccuaaugcuuccucuuccugaccccacaggggcaggauauagagcagccccacccucccacucacucuaacccccugcuc

SEQ ID NO: 19370 - RNA, 2685 nt, Homo sapiens
gagcaggggguuagagugagugggaggguggggcugcucuauauccugccccuguggggucaggaagaggaagcauuagguaaggaggagacuuggcugcaaauuguaggcuaaauauuuaggcugcaaggugcucaacgaagccugcauggaacccaugggaccacccagguuccacucugugggucuggcaucaugcccauuggagcccagggccauagggacacguggcugugacacaaaggcugcacuuauacuggccuugggauggagaagaguauuuuagggcugauggaauugguagagaugaagcuuccccacccuggggaaggcaggguggggggugaggagggaggggaagggagagccuuuccugggcuccuggccuggagcgcucucuagccuccugccugcaaacagaaaagggcccaaaaccuuguccucaggaugggggauggccugggggaaucugagccuuucuggggccaaagccauauucuucccuuucucccaugagaaguggccuguugcugugugggcuuuccuacccuugauuacaggagucaaggcagaugacauugguccugcagagugagccagguuagagccuagaggucugguggcuucuuaaccugggggucuugagcgguguggguggguaggcccgagcaauugcagggagcaaguagaggaggggaggugggagagauuugggggguuagcagguugaggcccaaggagagccaugaaaacugaggcuguccuucugagcccuuauuccucuuggcaggaccagagucucuccucacuccuggaggggacagcgcaagaccgcacccucgaaagccaggccagacaggcagcagccacagccaggaccgcuccaccccuuggggcucuccucagggaagugccuucuaagcuuccaaugaauuccggcuguggaguguggcugccccggucuccccagucucccgcuguagcugaauuccagccuggcccgcagcuagcccugucugcagcuccaagcgugguaggagcagggggugcuggguuugcccccccucaggaggaaggggggaucccucccugccagugggagggguugcagccugcacuuccccuccccacccgccagcccuggguuaaaugcggccguugccucugugugcuccagcugccuggcaguccccaccuagggcacgcugccacgccgccguuaccugguccaagugcccgggaggcuccgccugucggcuucgcucugcagcugcaucucugaucuguccugcaggcucaggugagucaaaggauugggaggcacugaggggucugcaggggaguaggcaucaagccaggucaggcgaguguauuuuagcagagacgcugccuagggugcccuaucugauuugcagugcccuuccccacuucugcaggguccuuuccaaaucgagcccccacccucaaagccaucaaaauaggaucaucccuuuucuacucucaucccuccaggaacccccugaaaugucccuaagggacuuuugagaauuuauuuacaggccucuccucccuugcugcuccacucccucaaccucaccucagggcaucucugaaucuuucuuuuuuuaaugcaaggauuaacuccucagaggaaucccagguucuaguaucaguccugccacgacaucgccauguacccuucagcaagacacuacccucucuggaccuaguuccuuucuuuguagaaugagggguuuggaaaggugaugaacuuugaggcauuugcuauuuugacuuucuaggauuccugggguggaggcagggugccaggugagaaguuggcucagaccaagaaugggaugaggggaaccuuaaccaagauuuaggggcccagaggcaucuccggguaggaaaguaugggagguggcagaggccccuugugccuuagcccucaugcuguccagggauguuggcuuugccuguggcccaagcuugacaaggguuccccgcccucccacuuccaccagcgcugccacaucuugcuuggucacccucccacgacgggcccugccagaggauuuauguucuucuaccaggccugggaggggaaaagggagaagaauccgggaugagaaggucgccuggagugagaagcaggcacuggccucgcucagaauaggcgcauucacggaauuggggggcgggggcggagcugcuguuggguuaggggcagcuggcccucucugccaagaaacagcaacagaaaaauggcuaacacagcuucagcauggggcgcggcggugggguaggagcuggaaggaaaugagguuuagugaauucuaggcgccagggggccucaagagagagaaggggaaccaggagcccuagguucuaauccugcuuuugcaguucggcgggcugccuccuuggggcuuaguuuuccuauuuguauaguggggagggggugggggggugguccuucguaguucucacggggcgucuccggggccucgggaggguaagcgcucaccugcugccccugcgggguccaugguggcuccacggggccccagccgcucacccgccgcccucuggacgaguccagugcugcugucgcuggaacccugcacaccccugcuccucggcucuugcgcggguuauauccuguccaggccuuaucuccaa

SEQ ID NO: 19371 - RNA, 2748 nt, Homo sapiens
gcgagcggagacuagcgcaccggcgucgguggcgaggguggugcagaggaguccggcugggcggagggaggaaggaugggugcggguaacuuuuugaccgccuuggaaguaccaguagccgcgcucgcaggggcugccuccgaccgccgggcgagcugcgagcgagugagcccgccaccgccccucccccacuuccgccucccgccucuuccucguucccggcucccagggcccgucggucccccgggagcccuggaggcgcagccccaccccggccggcgcggcucgcucccacgcccccgccgcggccucgcuggagcggacggacugagucagagggggcgccagcgcugcagguaggggcuccggcggcggugggcgcaggugccgcgguggaccgcggaggggaccggagcacgaggggaacggccuugggggagcgcccuccccccguccuccgccgacgccucgugucccuuuuuagggaauuuuuucccucuugcuggcuccagugcggguggggcugagaccgagagggaguucuccauuucgcuggcuccugcccggccccuggcagccuccugcccccaaaucucuucacccccuuuccaguaccuauaggucgcguaaacaacucccuuucuccagcucugggcuccgcggccccccgggggacagcuccuucagucucgugagaucggugggguuagggggaggggaaaagagagggggugucccagagccccuggcccccgucagcucccccaccuuggccucucccucccccuccucgcugcuggagcacaggcuccaggggcccuggguauuuuuagcguugugaccugggcggcagcucuaagagccuuucccgggaaucggcgucagcgccucgcuccuccgccgccagcccgcggccgcacggucuccccagacuuccguggcccugccuuggccagucgggguugggucccucuccaccucuguggcgcccguggagcuggccagggucugggauacgcugggugcagaugagguggggaaggcagucugcggaggaugacgucugauccucaagcuagaaacucccuugccucuggugaugggcucagagcagaacgccgggaaggagaugagcgaaugggaaugaaugcaccgaccugggcuggcccauagccucagugcucuggcagggucucagcuucucagcccuaggggucaggaggccugcucugaacuggacccagaacccgccuuuccaauugcuccucacugacuaauggggagauaagucagugagaugugucccaggagggggacgcauaaagagcuguuggaguucaaaggaaagaugguagucuccuaaauagcucaccuucacaagcagggucuuguauuugaggcagguagguugguuaugccauuuucagauggggagacuaagaccagaaaggugauuuccuuaggggcagagccuagucuggaagucaggccugugacuucagagcaaggguuugggguagauggcacaugcguguguacguguuuguguggguggagagaaaaggaggggcgcgggaggaguugcuuuagccuuugucuggguuuugaaggaugggaaggggugggcugcagcacuggaggaagggaacccuccacccugagaucucugucucuauccuauccugucccuggccuucugaggcaagcggggccaauuaaggggaaaacguaccuccuccauuugugcugaaccaaucccuccaaccccucucaggagggcaugauauggagaguugggcauuggcuguguucccugaauacagaguaucucucuuguggugccuggaacuggcauccccuuuguggagcuuagggcaagccccgccucugcaugagacuugguuugugggacacacuugguuucagggaaggggaaagaggucaccaagggcagagguguccaggccggagccaggggccccacuguugggaugcuggcugcaguggggcgccccaagcccagguccccucugucuucucuuucgacuuugcagcuguacuuguuuugcuccucuacccgcaggagcugacauggacccaaauccucgggccgcccuggagcgccagcagcuccgccuucgggagcggcaaaaauucuucgaggacauuuuacagccagagacagaguuugucuuuccucugucccaucugcaucucgagucgcagagacguaagucccaaguccugagaagagggacugggguaggguagggaggauguccuguggguccugaaucuuguggcacucucuccccucugguuuucuuggcccucuaugcuucuaacuugggaccugacauguaacucucacuguccuggugugcagcuuggguccuccugacuugcccacuucuugauccgcagcccccauagguaguaucucauccauggaagugaauguggacacacuggagcaaguagaacuuauugaccuuggggacccggaugcagcagauguguucuugccuugcgaagauccuccaccaaccccccagucgucugguaugccccucugcuuuggggacuucagugccagucagccagagccggaugucaggcucugaaacgaggcuacaaggcugggcuggggaaguacacaaguaagggcuggaaguggguguuucuaccaaugaaacagcugccuguucugauuuuagggaaguugacccugagggagaacuggguuac

SEQ ID NO: 19372 - RNA, 2748 nt, Homo sapiens
guaacccaguucucccucagggucaacuucccuaaaaucagaacaggcagcuguuucauugguagaaacacccacuuccagcccuuacuuguguacuuccccagcccagccuuguagccucguuucagagccugacauccggcucuggcugacuggcacugaaguccccaaagcagaggggcauaccagacgacugggggguugguggaggaucuucgcaaggcaagaacacaucugcugcauccggguccccaaggucaauaaguucuacuugcuccaguguguccacauucacuuccauggaugagauacuaccuaugggggcugcggaucaagaagugggcaagucaggaggacccaagcugcacaccaggacagugagaguuacaugucaggucccaaguuagaagcauagagggccaagaaaaccagaggggagagagugccacaagauucaggacccacaggacauccucccuacccuaccccagucccucuucucaggacuugggacuuacgucucugcgacucgagaugcagaugggacagaggaaagacaaacucugucucuggcuguaaaauguccucgaagaauuuuugccgcucccgaaggcggagcugcuggcgcuccagggcggcccgaggauuuggguccaugucagcuccugcggguagaggagcaaaacaaguacagcugcaaagucgaaagagaagacagaggggaccugggcuuggggcgccccacugcagccagcaucccaacaguggggccccuggcuccggccuggacaccucugcccuuggugaccucuuuccccuucccugaaaccaagugugucccacaaaccaagucucaugcagaggcggggcuugcccuaagcuccacaaaggggaugccaguuccaggcaccacaagagagauacucuguauucagggaacacagccaaugcccaacucuccauaucaugcccuccugagagggguuggagggauugguucagcacaaauggaggagguacguuuuccccuuaauuggccccgcuugccucagaaggccagggacaggauaggauagagacagagaucucaggguggaggguucccuuccuccagugcugcagcccaccccuucccauccuucaaaacccagacaaaggcuaaagcaacuccucccgcgccccuccuuuucucuccacccacacaaacacguacacacgcaugugccaucuaccccaaacccuugcucugaagucacaggccugacuuccagacuaggcucugccccuaaggaaaucaccuuucuggucuuagucuccccaucugaaaauggcauaaccaaccuaccugccucaaauacaagacccugcuugugaaggugagcuauuuaggagacuaccaucuuuccuuugaacuccaacagcucuuuaugcgucccccuccugggacacaucucacugacuuaucuccccauuagucagugaggagcaauuggaaaggcggguucuggguccaguucagagcaggccuccugaccccuagggcugagaagcugagacccugccagagcacugaggcuaugggccagcccaggucggugcauucauucccauucgcucaucuccuucccggcguucugcucugagcccaucaccagaggcaagggaguuucuagcuugaggaucagacgucauccuccgcagacugccuuccccaccucaucugcacccagcguaucccagacccuggccagcuccacgggcgccacagagguggagagggacccaaccccgacuggccaaggcagggccacggaagucuggggagaccgugcggccgcgggcuggcggcggaggagcgaggcgcugacgccgauucccgggaaaggcucuuagagcugccgcccaggucacaacgcuaaaaauacccagggccccuggagccugugcuccagcagcgaggagggggagggagaggccaaggugggggagcugacgggggccaggggcucugggacacccccucucuuuuccccucccccuaaccccaccgaucucacgagacugaaggagcugucccccggggggccgcggagcccagagcuggagaaagggaguuguuuacgcgaccuauagguacuggaaagggggugaagagauuugggggcaggaggcugccaggggccgggcaggagccagcgaaauggagaacucccucucggucucagccccacccgcacuggagccagcaagagggaaaaaauucccuaaaaagggacacgaggcgucggcggaggacggggggagggcgcucccccaaggccguuccccucgugcuccgguccccuccgcgguccaccgcggcaccugcgcccaccgccgccggagccccuaccugcagcgcuggcgcccccucugacucaguccguccgcuccagcgaggccgcggcgggggcgugggagcgagccgcgccggccgggguggggcugcgccuccagggcucccgggggaccgacgggcccugggagccgggaacgaggaagaggcgggaggcggaagugggggaggggcgguggcgggcucacucgcucgcagcucgcccggcggucggaggcagccccugcgagcgcggcuacugguacuuccaaggcggucaaaaaguuacccgcacccauccuuccucccuccgcccagccggacuccucugcaccacccucgccaccgacgccggugcgcuagucuccgcucgc

SEQ ID NO: 19373 - RNA, 2836 nt, Homo sapiens
auccuaagcugauuaagggugagugacucugucuuaggaggaggcuuuuuggacacaaaauugggggcgggauuauggagagagacagcccacagccucagaggaggaagccaggcccaggagccucuacauccuuguuagggccaacagggaaacgaaaaaaacacgugggggcucccuccacccucuuaccagccaccccuucuccauccacucucaggggccucuccuuggguggcuagaucuggaggaaggaccccacggagucucccuucagacugggaccugcaggugggccuucagugagaacugagccggagaccccacaaugaaaggcugggcuggacaggagucagcccuagcuaguaagauauggcuggauauuuaggcuuccuccucuccucuuucuuuuaccacaaaucuacuuaccugaccccuuuuuuuaggccccacacucaguuacauucuccccauguuucccaaguuggucuugcuggauuucaacaucaacaucucucuuuucuggguucuccgugaaccucacagaaccucuuuuauagccuugcacacacuguuuugucauuugcucccagcacccagcacuucgggcacaugaagacaggccccaucuuucccaggcaaccccaaaucccagccugacguagagaaguugcugaucaaccagugcccuccugcccugccuuggcucccaccccaagccuuccucaguccccuacagccccugccauuacccagcagcaccaaagacucucuggcccacucuuuguguucaaacucauuccugccuccuccuccuccuccuccuuuauuuuucacauugccucauuuuucgcuccuauuuugaaauuuacaucuuguuccaagagcugaaacaucuuuacaagcugcaccaaaccauucuggaaauaaacucaccaaauaaauaaguaaccagggggugaccccucacccgcaagcauccacaaccaacugcaugugucguguggguccacacccaccccucggggucccuucuuacuuauguuuaaacuaucugacaguaucucaauguccuguaagcaugucuguaagcugcuuuuuucccuugcuggggcagagugagguuauaaauauggagauauuaaaaucacagggugauccaauccagccuaggucugggacuucacagggaagcaaacccuacuccaccccagcaagccacuguugucucucugugcucucucucuuauucgucaguguccaucuucuugcuguggcuuuuuaugggucccugugaaaccucuccaaccaaguagggguauaacgucuuggauaauaaaaagauggagugaccagugccacaugggaaaagucugaggggguugguccucaccucuggggacucaguccuagccccuccccauuacuaaucuucaucguugggaacaaagccagaguccuccagcagugguccucaauauggggaugcaagcagauccccccagaccagcagcccccagaucccagacucaccuuggcagccacagaggaauugggcuucuccaguaggucccagaguuuuuuccucuucucugcgcagcacguguuaucgaacuccucgccuucccgcucccguagggucucggccucacgcuugagcuccucguucaucugcucuuucuucuggugguagcgggccuggcagcaggacuccagguagaucucgucgaugccccaguagucgagcucuuggcugaagcugagcgcgcacaucuccuccaucaugugcagucgcccagugcgguagaaguugaggauggaggugaaggcgcccggguggcggucaaagaaguacucguugucgucgaggcuguagucaucgcacaccucgagcagcgagucgugcguguugcagucgcggagcuugcccagccgcgugcggggcaggcgguccaggguacgccagaguaccucgugcgccagccccccgacguugaggcggacccgccgagagcacgccuugcugcgcacgaucuccaugggcucgggcggcagcgagcugguggagcgggagccaugcuucgucaugcccgccggcaucgcugauccggccgcccccgcccccccugcccccccaggccgcugucacucgacggcaaggcccgcugcugcgggggaggggggcagggagcgcugugggcugcugggggugcagggggccccgcgggcgcgcgucacggccgucuucucaccuccaucccgacggcugcgaggcagaaagcgaaagcggacgcgggucagcaaacggggagcugggcaugcuguccccccgccccccaccucuccaccaggcucccagccggccuugaccuucccccgcgcuuaagcggcucagugggguaggacggauggucgcugucccucccgccggugcugaaguccgccgcaccccauggauggagggaggggccgccccucggggcggggagagggccccaagagaugccccuggagcccgggaggccccacccugggcuucugcggcccaggcgcgacccagccgcccggggcgcuguccgccccuuagagugcugaaacucucuucauuaugggucucccgaucgagucccgaaccuggccccgccauggggagagagggggagcugcaugaaaacuuucuuucuuuaucuuuuucuuucuuucuucuucuucuuuccuucuuuuuuuuuuuuuuaacgaguucucuucuuuuccuuccccuucucgagauaaucaagauuuugggggugggggaauggcagcgggcuuuuuuccaaaucuuaaaagauuuggggga

SEQ ID NO: 19374 - RNA, 2836 nt, Homo sapiens
ucccccaaaucuuuuaagauuuggaaaaaagcccgcugccauucccccacccccaaaaucuugauuaucucgagaaggggaaggaaaagaagagaacucguuaaaaaaaaaaaaaagaaggaaagaagaagaagaaagaaagaaaaagauaaagaaagaaaguuuucaugcagcucccccucucuccccauggcggggccagguucgggacucgaucgggagacccauaaugaagagaguuucagcacucuaaggggcggacagcgccccgggcggcugggucgcgccugggccgcagaagcccaggguggggccucccgggcuccaggggcaucucuuggggcccucuccccgccccgaggggcggccccucccuccauccauggggugcggcggacuucagcaccggcgggagggacagcgaccauccguccuaccccacugagccgcuuaagcgcgggggaaggucaaggccggcugggagccugguggagagguggggggcggggggacagcaugcccagcuccccguuugcugacccgcguccgcuuucgcuuucugccucgcagccgucgggauggaggugagaagacggccgugacgcgcgcccgcggggcccccugcacccccagcagcccacagcgcucccugccccccucccccgcagcagcgggccuugccgucgagugacagcggccugggggggcagggggggcgggggcggccggaucagcgaugccggcgggcaugacgaagcauggcucccgcuccaccagcucgcugccgcccgagcccauggagaucgugcgcagcaaggcgugcucucggcggguccgccucaacgucggggggcuggcgcacgagguacucuggcguacccuggaccgccugccccgcacgcggcugggcaagcuccgcgacugcaacacgcacgacucgcugcucgaggugugcgaugacuacagccucgacgacaacgaguacuucuuugaccgccacccgggcgccuucaccuccauccucaacuucuaccgcacugggcgacugcacaugauggaggagaugugcgcgcucagcuucagccaagagcucgacuacuggggcaucgacgagaucuaccuggaguccugcugccaggcccgcuaccaccagaagaaagagcagaugaacgaggagcucaagcgugaggccgagacccuacgggagcgggaaggcgaggaguucgauaacacgugcugcgcagagaagaggaaaaaacucugggaccuacuggagaagcccaauuccucuguggcugccaaggugagucugggaucugggggcugcuggucuggggggaucugcuugcauccccauauugaggaccacugcuggaggacucuggcuuuguucccaacgaugaagauuaguaauggggaggggcuaggacugaguccccagaggugaggaccaacccccucagacuuuucccauguggcacuggucacuccaucuuuuuauuauccaagacguuauaccccuacuugguuggagagguuucacagggacccauaaaaagccacagcaagaagauggacacugacgaauaagagagagagcacagagagacaacaguggcuugcugggguggaguaggguuugcuucccugugaagucccagaccuaggcuggauuggaucacccugugauuuuaauaucuccauauuuauaaccucacucugccccagcaagggaaaaaagcagcuuacagacaugcuuacaggacauugagauacugucagauaguuuaaacauaaguaagaagggaccccgagggguggguguggacccacacgacacaugcaguugguuguggaugcuugcgggugaggggucacccccugguuacuuauuuauuuggugaguuuauuuccagaaugguuuggugcagcuuguaaagauguuucagcucuuggaacaagauguaaauuucaaaauaggagcgaaaaaugaggcaaugugaaaaauaaaggaggaggaggaggaggaggcaggaaugaguuugaacacaaagagugggccagagagucuuuggugcugcuggguaauggcaggggcuguaggggacugaggaaggcuuggggugggagccaaggcagggcaggagggcacugguugaucagcaacuucucuacgucaggcugggauuugggguugccugggaaagauggggccugucuucaugugcccgaagugcugggugcugggagcaaaugacaaaacagugugugcaaggcuauaaaagagguucugugagguucacggagaacccagaaaagagagauguugauguugaaauccagcaagaccaacuugggaaacauggggagaauguaacugaguguggggccuaaaaaaaggggucagguaaguagauuugugguaaaagaaagaggagaggaggaagccuaaauauccagccauaucuuacuagcuagggcugacuccuguccagcccagccuuucauuguggggucuccggcucaguucucacugaaggcccaccugcaggucccagucugaagggagacuccgugggguccuuccuccagaucuagccacccaaggagaggccccugagaguggauggagaagggguggcugguaagaggguggagggagcccccacguguuuuuuucguuucccuguuggcccuaacaaggauguagaggcuccugggccuggcuuccuccucugaggcugugggcugucucucuccauaaucccgcccccaauuuuguguccaaaaagccuccuccuaagacagagucacucacccuuaaucagcuuaggau

SEQ ID NO: 19375 - RNA, 2624 nt, Homo sapiens
cucuggcgcacuggggcuccagcugcaugaucccagcucagaccuuaagccucagugggguguaggugggaugggauguguuuuuaggagaugaggagaccccgguuguugagucgcuccccaaaugcgcaguuucuuaacuccaggugacauccgucuuuuggaggaacgagugaaggccguuuaggcgaaagagggguggguuucaguauuuggaucccuucccccagcucugccaaucucagguguguuuacgguggaggugacagaaggaaggcgcgucgggggacccaggccucgcaggucuucggcugucaacgaggcaccgcccacugacuccgcgcuucgucccucacagcguggggcucggcgcugcgccaggcccgggugcggggcggagcuaggcugggacuggcugggggccgccccgcccggcgccugggccuccgcgccggcccccggggaggaguuaugauaauuuccuucucauuaaggcgcucgggucccccggcuaucgccaggacacacuguucgggcgcggcuuuccccguccgcggagcggucuugacacucgcggcggcagcaucuacgcucgcagagccgccgaugcguguccagugacccggacagcaaggcccgcgcgcggcgggggcggcggcagacgccuggucaccgugaccccgauuuuggauuuaccgcuugggggcuggggggauccuggauuuaacuggcgacuguuuugggggacgccggacgccauguuguggaaaauaaccgauaaugucaaguacgaagaggacugcgaggugagcuggggcuccggggugcagccccgccccgccgaggacaguccgggaggcaggggccacuggaccgaggucggggacgagggcauaggagcccuggccucucggugggacgggauccacuucuccggacaccccuuaguccauuucugcggggccccuuuccuguauagggccuuuuccuaaauagccuccccucgggaacgaggccuggaaagagaauggcaaaucccacccacacagcuuaccgggcgcuuuccuaagcggcaaacagcccugcuucccguuuucucggaaaagugccccgucugcaacccucagacguggcuuuuacgcacgaagucucuguccaaaggggucagaugaggcuaccugcuagcgacaccuuggcggacacuccuccaaggccggcuugucaccugccccgcuaccuccucggggaagcacgaaaacaaccgaaguuuggcuuucaaaagaagugggggcuggggagugguggugggggugcccgaggccagauggggccguaagagcucgcgagugcuccagccugucggacagguugagcuagaguuucggagagugggagggaagaaggaggcggcgagcgggaagaggaagaagacgcaggcagcgcuaggcgagcucaggggcgccgggagcgcggagcucgggcuacggacucgcgggaguucacugcgccuccgggcccuggagggcugccccugcccgcaggcccgggcgcuuccgccaggaggcgacagcgccauguuccuccagguucccggcgccccgagaccccugggcagauggggacgcauccuuuagaaacugagucgggccgcccaggggcgagggaacgugcgcgggcaaggcugcccaauuuccaggguucuucaugcccccucugcgccccgacgugcgagaacacugcccuuggcagugcagggcgcccccacuuauuacuccccucggcugggcccggccagcagggagggccgcccugugcgcgcgcucccucuucacuucccagggcggcgcaggguggcgggcccugcuuuccgagcgccgcccgcucggaggucuuugucccgagggcguggaagggagggucccgggggcgggggaggugcgcauuucccgcgccgcgcacucuauccgcgccugccgcgcugccaccuccagcagucccugcgucaugggcgggcuccacgagauagcucugcaccgggcguccggcuccuucgccccgggcucuggcuccuucgccccgggcuccggccacggacuuuucuggcccaagacccaggguucggacuuggcgccuccaagcgccucgggcuugggagcagcgccuagaccuucgccgccgggcuuugagaacucguucccccaggucuuucaccagacucuccucccuccccgcacucuuugcuuacaacgaaauccucggggcgcauugcccccggguaccuuccgacccugggcaagccccgccgggcggggugcgguuggucccccggggcccucugcguagcccggcgaugccggccaguucgcaguagcgggguuucgcacuaacggggucuccuguuuuuuuuuuucccuccaggaucgccacgacgggagcagcaaugggaauccgcgggucccccaccucuccuccgccgggcagcaccucuacagccccgcgccaccccucucccacacuggagucgccgaauaucagccgccacccuacuuucccccucccuaccagcagcuggccuacucccagucggccgaccccuacucgcaucugggggaagcguacgccgc

SEQ ID NO: 19376 - RNA, 2624 nt, Homo sapiens
gcggcguacgcuucccccagaugcgaguaggggucggccgacugggaguaggccagcugcugguagggagggggaaaguaggguggcggcugauauucggcgacuccagugugggagagggguggcgcggggcuguagaggugcugcccggcggaggagaggugggggacccgcggauucccauugcugcucccgucguggcgauccuggagggaaaaaaaaaaacaggagaccccguuagugcgaaaccccgcuacugcgaacuggccggcaucgccgggcuacgcagagggccccgggggaccaaccgcaccccgcccggcggggcuugcccagggucggaagguacccgggggcaaugcgccccgaggauuucguuguaagcaaagagugcggggagggaggagagucuggugaaagaccugggggaacgaguucucaaagcccggcggcgaaggucuaggcgcugcucccaagcccgaggcgcuuggaggcgccaaguccgaacccugggucuugggccagaaaaguccguggccggagcccggggcgaaggagccagagcccggggcgaaggagccggacgcccggugcagagcuaucucguggagcccgcccaugacgcagggacugcuggagguggcagcgcggcaggcgcggauagagugcgcggcgcgggaaaugcgcaccucccccgcccccgggacccucccuuccacgcccucgggacaaagaccuccgagcgggcggcgcucggaaagcagggcccgccacccugcgccgcccugggaagugaagagggagcgcgcgcacagggcggcccucccugcuggccgggcccagccgaggggaguaauaagugggggcgcccugcacugccaagggcaguguucucgcacgucggggcgcagagggggcaugaagaacccuggaaauugggcagccuugcccgcgcacguucccucgccccugggcggcccgacucaguuucuaaaggaugcguccccaucugcccaggggucucggggcgccgggaaccuggaggaacauggcgcugucgccuccuggcggaagcgcccgggccugcgggcaggggcagcccuccagggcccggaggcgcagugaacucccgcgaguccguagcccgagcuccgcgcucccggcgccccugagcucgccuagcgcugccugcgucuucuuccucuucccgcucgccgccuccuucuucccucccacucuccgaaacucuagcucaaccuguccgacaggcuggagcacucgcgagcucuuacggccccaucuggccucgggcacccccaccaccacuccccagcccccacuucuuuugaaagccaaacuucgguuguuuucgugcuuccccgaggagguagcggggcaggugacaagccggccuuggaggaguguccgccaaggugucgcuagcagguagccucaucugaccccuuuggacagagacuucgugcguaaaagccacgucugaggguugcagacggggcacuuuuccgagaaaacgggaagcagggcuguuugccgcuuaggaaagcgcccgguaagcugugugggugggauuugccauucucuuuccaggccucguucccgaggggaggcuauuuaggaaaaggcccuauacaggaaaggggccccgcagaaauggacuaagggguguccggagaaguggaucccgucccaccgagaggccagggcuccuaugcccucguccccgaccucgguccaguggccccugccucccggacuguccucggcggggcggggcugcaccccggagccccagcucaccucgcaguccucuucguacuugacauuaucgguuauuuuccacaacauggcguccggcgucccccaaaacagucgccaguuaaauccaggauccccccagcccccaagcgguaaauccaaaaucggggucacggugaccaggcgucugccgccgcccccgccgcgcgcgggccuugcuguccgggucacuggacacgcaucggcggcucugcgagcguagaugcugccgccgcgagugucaagaccgcuccgcggacggggaaagccgcgcccgaacaguguguccuggcgauagccgggggacccgagcgccuuaaugagaaggaaauuaucauaacuccuccccgggggccggcgcggaggcccaggcgccgggcggggcggcccccagccagucccagccuagcuccgccccgcacccgggccuggcgcagcgccgagccccacgcugugagggacgaagcgcggagucagugggcggugccucguugacagccgaagaccugcgaggccugggucccccgacgcgccuuccuucugucaccuccaccguaaacacaccugagauuggcagagcugggggaagggauccaaauacugaaacccaccccucuuucgccuaaacggccuucacucguuccuccaaaagacggaugucaccuggaguuaagaaacugcgcauuuggggagcgacucaacaaccggggucuccucaucuccuaaaaacacaucccaucccaccuacaccccacugaggcuuaaggucugagcugggaucaugcagcuggagccccagugcgccagag

SEQ ID NO: 19377 - RNA, 2488 nt, Homo sapiens
cagucacuauaacagaucugcuaaagguaguuucaugauuaauggcugcccgaaguuaccauccucaaacuauuaagccauuggaaaaugcuagaggcuuaauacucguguauagacagacccucauuccccugaauauuugcuauuugggguucuggguuuuuagcugcucccaggcuguguuuauuuccccaauaacuggggaaacuggggaggggcacgaccccacgggagccugcgcccaccugcccaaguacuggaccuggggcuagcuugccgcuugcuccuugccacccgccaggccccccgcccaucgcuucgcccaaauccuuucaaacaagguucccuccugccaccugccggcccacuagggucugcgccacaggcucggcgccaccacgcagcucgcggggagguggcccccaccuccuuacugcacaugcccggcagaaguccgggcgcgcaacuucgcagaaccucacugcccgucccuccucgccucagucuccucuguccucucccaggcaagaggaccggcggaggcaccucucucgagucuuaggcugcggaaucuaagacucagcgagaggagcccgggaggagacagaacuuuccccuuuuuucccaucccuucuucuugcucagagaggcaagcaaggcgcggagcuuuagaaaguucuuaaguggucaggaagguaggugcuucccuuuuucuccucacaaggaggugaggcugggaccuccgggccagcuucucaccucauaggguguaccuuucccggcuccagcagccaaugugcuucggagccacucucugcagagccagagggcaggccggcuucucggugugugccuaagaggauggaucggaggucccgggcucagcaguggcgccgagcucgccauaauuacaacgaccugugcccgcccauaggccgccgggcagccaccgcgcuccucuggcucuccugcuccaucgcgcuccuccgcgcccuugccaccuccaacgcccgugcccagcagcgcgcggcugcccaacagcgccggagcuuccuuaacgcccaccaccgcuccggcgcccagguauucccugagucccccgaaucggaaucugaccacgagcacgaggaggcagaccuugagcugucccuccccgagugccuagaguacgaggaagaguucgacuacgagaccgagagcgagaccgaguccgaaaucgaguccgagaccgacuucgagaccgagccugagaccgcccccaccacugagcccgagaccgagccugaagacgaucgcggcccgguggugcccaagcacuccaccuucggccagucccucacccagcgucugcacgcucucaaguugcgaagccccgacgccuccccaagucgcgcgccgcccagcacucaggagccccagagccccagggaaggggaggagcucaagcccgaggacaaagauccaagggaccccgaagagucgaaggagcccaaggaggagaagcagcggcgucgcugcaagccaaagaagcccacccgccgugacgcguccccggaguccccuuccaaaaagggacccauccccauccggcgucacuaauggaggacgccguccagauucuccuuguuuucauggauucagguuaguugcccaccgcuaaacuggggagccugagggcggugugggagcagcgcagguggaaaggaggugagaaggaaaggcaggucaggggcgagugggaagagaggaggcucagcuggucagccugggaucgggggucagggugaggcggcgagggcucccccaaacuucccaggaugccaggggcgcccugguggccaaaggcuuguuggacggcggggcgcacgccgugcgucccgcuggagacaaccugaggucuccgagcuggugccccggcuacgcgacugaaucccgaacgcaccccagauuuggagcugcacacccaaacggcauugguaagucacuuguuuugcgcgcuuuucuuccuccuagaaagacuagucucaaauaaguuggccuucucagguguccaaaaugugguucggaggugcgcgcgccaacuuucacgaugugagagcagccgcgcuguagagacaccguugaaaugugcggaaaguaaucugaaugggaaugggcgagaacucuagagacugaccacccgggagggaagucacgcgcgcgcggcgccuaagcagcucagagccggagcccaggucccagagcugacaauuaagccgcgggaccuccgcgccagugccuccagcugccgugcgccagccuuggccgccacagcccgccucccgucgcucgcgggacagagaccgccucaaagagcgugcgcaccugcccgcgcgcgccggagcugaccucucccggcggcgggcgguuaggggaaaguaccugggggaaagguagaggagguaaggggacccuuggggaugccccuacgggcuaccaggguugaacg

SEQ ID NO: 19378 - RNA, 2488 nt, Homo sapiens
cguucaacccugguagcccguaggggcauccccaaggguccccuuaccuccucuaccuuucccccagguacuuuccccuaaccgcccgccgccgggagaggucagcuccggcgcgcgcgggcaggugcgcacgcucuuugaggcggucucugucccgcgagcgacgggaggcgggcuguggcggccaaggcuggcgcacggcagcuggaggcacuggcgcggaggucccgcggcuuaauugucagcucugggaccugggcuccggcucugagcugcuuaggcgccgcgcgcgcgugacuucccucccggguggucagucucuagaguucucgcccauucccauucagauuacuuuccgcacauuucaacggugucucuacagcgcggcugcucucacaucgugaaaguuggcgcgcgcaccuccgaaccacauuuuggacaccugagaaggccaacuuauuugagacuagucuuucuaggaggaagaaaagcgcgcaaaacaagugacuuaccaaugccguuugggugugcagcuccaaaucuggggugcguucgggauucagucgcguagccggggcaccagcucggagaccucagguugucuccagcgggacgcacggcgugcgccccgccguccaacaagccuuuggccaccagggcgccccuggcauccugggaaguuugggggagcccucgccgccucacccugacccccgaucccaggcugaccagcugagccuccucucuucccacucgccccugaccugccuuuccuucucaccuccuuuccaccugcgcugcucccacaccgcccucaggcuccccaguuuagcggugggcaacuaaccugaauccaugaaaacaaggagaaucuggacggcguccuccauuagugacgccggauggggaugggucccuuuuuggaaggggacuccggggacgcgucacggcgggugggcuucuuuggcuugcagcgacgccgcugcuucuccuccuugggcuccuucgacucuucggggucccuuggaucuuuguccucgggcuugagcuccuccccuucccuggggcucuggggcuccugagugcugggcggcgcgcgacuuggggaggcgucggggcuucgcaacuugagagcgugcagacgcugggugagggacuggccgaagguggagugcuugggcaccaccgggccgcgaucgucuucaggcucggucucgggcucaguggugggggcggucucaggcucggucucgaagucggucucggacucgauuucggacucggucucgcucucggucucguagucgaacucuuccucguacucuaggcacucggggagggacagcucaaggucugccuccucgugcucguggucagauuccgauucgggggacucagggaauaccugggcgccggagcgguggugggcguuaaggaagcuccggcgcuguugggcagccgcgcgcugcugggcacgggcguuggagguggcaagggcgcggaggagcgcgauggagcaggagagccagaggagcgcgguggcugcccggcggccuaugggcgggcacaggucguuguaauuauggcgagcucggcgccacugcugagcccgggaccuccgauccauccucuuaggcacacaccgagaagccggccugcccucuggcucugcagagaguggcuccgaagcacauuggcugcuggagccgggaaagguacacccuaugaggugagaagcuggcccggaggucccagccucaccuccuugugaggagaaaaagggaagcaccuaccuuccugaccacuuaagaacuuucuaaagcuccgcgccuugcuugccucucugagcaagaagaagggaugggaaaaaaggggaaaguucugucuccucccgggcuccucucgcugagucuuagauuccgcagccuaagacucgagagaggugccuccgccgguccucuugccugggagaggacagaggagacugaggcgaggagggacgggcagugagguucugcgaaguugcgcgcccggacuucugccgggcaugugcaguaaggaggugggggccaccuccccgcgagcugcgugguggcgccgagccuguggcgcagacccuagugggccggcagguggcaggagggaaccuuguuugaaaggauuugggcgaagcgaugggcggggggccuggcggguggcaaggagcaagcggcaagcuagccccagguccaguacuugggcaggugggcgcaggcucccguggggucgugccccuccccaguuuccccaguuauuggggaaauaaacacagccugggagcagcuaaaaacccagaaccccaaauagcaaauauucaggggaaugagggucugucuauacacgaguauuaagccucuagcauuuuccaauggcuuaauaguuugaggaugguaacuucgggcagccauuaaucaugaaacuaccuuuagcagaucuguuauagugacug

SEQ ID NO: 19379 - RNA, 2246 nt, Homo sapiens
gaggaguggaaggagccaaaacgucccugcgaggccugcgcucaccagcccccuuacccaaagucccgggccccuggcgccaggagcaggcuccuggagccggagccagcucggcacuggaaccggcguccucugguggcagagagagagcgcuacuggcgauuuucggaccgaaucggcacgcucgucagauccaagcaggcgggacuggccuggagcaaaaagaaagagagaggagggcguaaggauagaccaaggaagaggggcuggggggcagccugggggcaugaaaaguggccaggaaggagccaagacuccaccagcaacaauugaguugcuucagccucagucuaggguuccuuccaggccuugaaccccccaaccucacaaggguuggaaagugaggccggugaacuuuccagcugguacuuugauuuuaaaauaauaauaauaauuuuuucacccuaguucgguugggugcuccaucuuacggagccccaaacuuauuuugagaggccgccaccguguuaugggcgugcgcaacugccucuacggcaauaauaugucaggacaacgcgauauccccccugaaaucggggaacagcccgagcaaccaccuuuggaggccccaggggcagcugcccccggugcugggccuagcccagccgaagagauggagaccgaaccgccucacaacgagcccauccccgucgagaaugauggcgaggccuguggacccccagaggucuccagacccaacuuucagguccucaacccggcauucagggaagcuggagcccauggaagcuacagcccaccuccugaggaagcaaugcccuucgaggcugaacagcccagcuugggaggcuucuggccuacacuggagcagccuggauuccccagugggguccaugcaggccuugaggccuucggcccagcacucauggagcccggagccuucaguggugccagaccaggccugggaggauacagcccuccaccagaagaagcuaugcccuuugaguuugaccagccugcccagagaggcugcagucaacuucucuuacaggucccagaccuugcuccaggaggcccaggugcugcagggguccccggagcuccucccgaggagccccaagcccucaggccugcaaaggcuggcuccagaggaggcuacagcccucccccugaggagacuaugccauuugagcuugauggagaaggauuuggggacgacagcccacccccggggcuuucccgaguuaucgcacaagucgacggcagcagccaguucgcggcagucgcggccucgagugcgguccgccucacucccgccgcgaacgcgccuccccucugggucccaggcgccaucggcagcccaucccaagaggcugucagaccuccuucuaacuucacgggcagcagccccuggauggagaucuccggacccccguucgagauuggcagcgcccccgcuggggucgacgacacucccgucaacauggacagccccccaaucgcgcuugacggcccgcccaucaaggucuccggagccccagauaagagagagcgagcagagagacccccaguugaggaggaagcagcagagauggaaggagccgcugaugccgcggagggaggaaaaguacccucuccgggguacggauccccugccgccggggcagccucagcggauaccgcugccagggcagccccugcagccccagccgauccugacuccggggcaaccccagaagaucccgacuccgggacagcaccagccgauccugacuccggggcauucgcagccgaucccgacuccggggcagccccugccgccccagccgaucccgacuccggggcggccccugacgccccagccgaucccgacuccggggcggccccugacgccccagccgauccagaugccggggcggccccugaggcucccgccgccccugcggcugcugagacccgggcagcccaugucgccccagcugcgccagacgcaggggcucccacugccccagccgcuucugccacccgggcagcccaaguccgccgggcggccucugcagccccugccuccggggccagacgcaagauccaucucagaccccccagccccgagauccaggcugccgauccgccuacuccgcggccuacucgcgcgucugccuggcggggcaaguccgagagcagccgcggccgccgcguguacuacgaugaagggguggccagcagcg

SEQ ID NO: 19380 - RNA, 2246 nt, Homo sapiens
cgcugcuggccaccccuucaucguaguacacgcggcggccgcggcugcucucggacuugccccgccaggcagacgcgcgaguaggccgcggaguaggcggaucggcagccuggaucucggggcuggggggucugagauggaucuugcgucuggccccggaggcaggggcugcagaggccgcccggcggacuugggcugcccggguggcagaagcggcuggggcagugggagccccugcgucuggcgcagcuggggcgacaugggcugcccgggucucagcagccgcaggggcggcgggagccucaggggccgccccggcaucuggaucggcuggggcgucaggggccgccccggagucgggaucggcuggggcgucaggggccgccccggagucgggaucggcuggggcggcaggggcugccccggagucgggaucggcugcgaaugccccggagucaggaucggcuggugcugucccggagucgggaucuucugggguugccccggagucaggaucggcuggggcugcaggggcugcccuggcagcgguauccgcugaggcugccccggcggcaggggauccguaccccggagaggguacuuuuccucccuccgcggcaucagcggcuccuuccaucucugcugcuuccuccucaacugggggucucucugcucgcucucucuuaucuggggcuccggagaccuugaugggcgggccgucaagcgcgauuggggggcuguccauguugacgggagugucgucgaccccagcgggggcgcugccaaucucgaacggggguccggagaucuccauccaggggcugcugcccgugaaguuagaaggaggucugacagccucuugggaugggcugccgauggcgccugggacccagaggggaggcgcguucgcggcgggagugaggcggaccgcacucgaggccgcgacugccgcgaacuggcugcugccgucgacuugugcgauaacucgggaaagccccgggggugggcugucguccccaaauccuucuccaucaagcucaaauggcauagucuccucagggggagggcuguagccuccucuggagccagccuuugcaggccugagggcuuggggcuccucgggaggagcuccggggaccccugcagcaccugggccuccuggagcaaggucugggaccuguaagagaaguugacugcagccucucugggcaggcuggucaaacucaaagggcauagcuucuucugguggagggcuguauccucccaggccuggucuggcaccacugaaggcuccgggcuccaugagugcugggccgaaggccucaaggccugcauggaccccacuggggaauccaggcugcuccaguguaggccagaagccucccaagcugggcuguucagccucgaagggcauugcuuccucaggaggugggcuguagcuuccaugggcuccagcuucccugaaugccggguugaggaccugaaaguugggucuggagaccucuggggguccacaggccucgccaucauucucgacggggaugggcucguugugaggcgguucggucuccaucucuucggcugggcuaggcccagcaccgggggcagcugccccuggggccuccaaaggugguugcucgggcuguuccccgauuucaggggggauaucgcguuguccugacauauuauugccguagaggcaguugcgcacgcccauaacacgguggcggccucucaaaauaaguuuggggcuccguaagauggagcacccaaccgaacuagggugaaaaaauuauuauuauuauuuuaaaaucaaaguaccagcuggaaaguucaccggccucacuuuccaacccuugugagguugggggguucaaggccuggaaggaacccuagacugaggcugaagcaacucaauuguugcugguggagucuuggcuccuuccuggccacuuuucaugcccccaggcugccccccagccccucuuccuuggucuauccuuacgcccuccucucucuuucuuuuugcuccaggccagucccgccugcuuggaucugacgagcgugccgauucgguccgaaaaucgccaguagcgcucucucucugccaccagaggacgccgguuccagugccgagcuggcuccggcuccaggagccugcuccuggcgccaggggcccgggacuuuggguaagggggcuggugagcgcaggccucgcagggacguuuuggcuccuuccacuccuc

SEQ ID NO: 19381 - RNA, 2381 nt, Homo sapiens
gccuccucugaagcccacaucagggcuugggggucagaggugagccccugugggauccugagaugcagaggaugugucugaggucucucccuggggcguggggccaggugucuggagcuaaugacaccugagugugguuagucuuuuaaucuccagccuaggcaaauagucauuagcuuugccuauggaccgcccugcuccaccacgagcccugcccuccaggaacugcugaaggggucuguccuccacaccuggggugacugugagccccuucccaucacaaaggcugcuugccccccaaccacugcucaggacaagcggggcagguguggggugagggccuggggccccucagaaggccccuuccugugacuccggcuucacccgcccaugcaacccccaggacgaugugugagugccaaagggcccccaggaggcuggaaguggcccugagcaaggcugaccccgaaggucuccagggcucaggccuugcccagcuggaugccagaccaaggcagccgcucagagcagccgcacugggcaucuggacuaggcgccucugcaaccccugcucaccugcccucacccagagcuccuggagcgugggccccugucucagcccccagucccagccccugcucaccugccuucacccagagcuccuggagcgugggcccgucucagcccccagccccugcucaccugcccucacccagaguuccuggagcaugggccccugucucagcccccagcccccagccccugcucaccugccgucacccagagcuccuggagcuccugucaucuggugccucccagcccccagccccugcccuccaagcagugaccgauccaugaacacuggacucccugugugagggcgggagggccuggccagccaggcaggguccuggaggaaccgccugcuggguguccagcuggugcagcugaugcucccccccacaggaccugaccacgccugccggagccuccucucccucucggcagcccacagcggacacugcuguuuuccuaccacaccugccggcccggggcccaucagcugucccugaaugaaugcguggaugaacgaaugaaugaacagauagccacggacaugcgauuuccaacucaaaauccugccguuguucuggacuccccagcugggggcgaggcaggcucugacuccgaggccgagguacucacgguuggucugagagcgucucaggagaagccuuggccacgugggugaugggcacgagcccggcgcugggcuggcccgaaagccugcgugcgaagauguagccgccccccucuucgagggcacagagccuguccccgcggcggacacucagcuccccgccacaccgcgccgugaagucauagagcgcaaggaagagcugagggaaggggcugcaaggcucggcggggagcgugggcacugggucaguguugggguccagggacccgggggugccaugguccggcucgccgcccgccggccagaucuugucccagaagaaggacaggaaggccagccgccuccugaggaacggcuccaucccccggggucaccacgcugggcccgagggccaugggagcccgcgagcccggaagaggaacuggcagggccggugggacccgguguccagcgcucccugcccuggccguggggugacaggggaccccggcccugcggucacucagagguccccuggauccaggaggcacacgguucccaccggcguccgggcuggcguuggggcuggguggggcgcagggcggacccccugccucaggcacaccgacagcaccuccuguccucgaccuccuuggcgucuggagugcaccguccccuccccaacccgacggcagagggcagcuugggcuggggcgggggcgggcuccaggaggggcccgaggagggcggggugggcagggccagccucucucccgcccucugcaaggcccaggcaggcggaauggcucugcccagucaggccuggcccaugcccaagggcaccacaguccaacagccgcccgugcccacggagaaguggggguuccacggagaagcgcugcuguucagcaccugcagugguugccaagccugagcugcacucaggugaaaaauugccugcuuauuuaaguguuggccagauauuuuaacaucauuaacccugcaccaggugccgagccuccggccucugcaguaaauucugaggacaggcgagugagggggcucucagcaccccggcuuucaugcaguaaaacgagaugcugauugcagggagcucggccgcaggccaggcacccagaugccccaugcugcccgaugaccggcuucugagucagucaaugcccaggccauacccaaaggc

SEQ ID NO: 19382 - RNA, 2381 nt, Homo sapiens
gccuuuggguauggccugggcauugacugacucagaagccggucaucgggcagcauggggcaucugggugccuggccugcggccgagcucccugcaaucagcaucucguuuuacugcaugaaagccggggugcugagagcccccucacucgccuguccucagaauuuacugcagaggccggaggcucggcaccuggugcaggguuaaugauguuaaaauaucuggccaacacuuaaauaagcaggcaauuuuucaccugagugcagcucaggcuuggcaaccacugcaggugcugaacagcagcgcuucuccguggaacccccacuucuccgugggcacgggcggcuguuggacuguggugcccuugggcaugggccaggccugacugggcagagccauuccgccugccugggccuugcagagggcgggagagaggcuggcccugcccaccccgcccuccucgggccccuccuggagcccgcccccgccccagcccaagcugcccucugccgucggguuggggaggggacggugcacuccagacgccaaggaggucgaggacaggaggugcugucggugugccugaggcaggggguccgcccugcgccccacccagccccaacgccagcccggacgccggugggaaccgugugccuccuggauccaggggaccucugagugaccgcagggccgggguccccugucaccccacggccagggcagggagcgcuggacaccgggucccaccggcccugccaguuccucuuccgggcucgcgggcucccauggcccucgggcccagcguggugaccccgggggauggagccguuccucaggaggcggcuggccuuccuguccuucuucugggacaagaucuggccggcgggcggcgagccggaccauggcacccccgggucccuggaccccaacacugacccagugcccacgcuccccgccgagccuugcagccccuucccucagcucuuccuugcgcucuaugacuucacggcgcgguguggcggggagcugaguguccgccgcggggacaggcucugugcccucgaagaggggggcggcuacaucuucgcacgcaggcuuucgggccagcccagcgccgggcucgugcccaucacccacguggccaaggcuucuccugagacgcucucagaccaaccgugaguaccucggccucggagucagagccugccucgcccccagcuggggaguccagaacaacggcaggauuuugaguuggaaaucgcauguccguggcuaucuguucauucauucguucauccacgcauucauucagggacagcugaugggccccgggccggcaggugugguaggaaaacagcaguguccgcugugggcugccgagagggagaggaggcuccggcaggcguggucagguccugugggggggagcaucagcugcaccagcuggacacccagcaggcgguuccuccaggacccugccuggcuggccaggcccucccgcccucacacagggaguccaguguucauggaucggucacugcuuggagggcaggggcugggggcugggaggcaccagaugacaggagcuccaggagcucugggugacggcaggugagcaggggcugggggcugggggcugagacaggggcccaugcuccaggaacucugggugagggcaggugagcaggggcugggggcugagacgggcccacgcuccaggagcucugggugaaggcaggugagcaggggcugggacugggggcugagacaggggcccacgcuccaggagcucugggugagggcaggugagcagggguugcagaggcgccuaguccagaugcccagugcggcugcucugagcggcugccuuggucuggcauccagcugggcaaggccugagcccuggagaccuucggggucagccuugcucagggccacuuccagccuccugggggcccuuuggcacucacacaucguccuggggguugcaugggcgggugaagccggagucacaggaaggggccuucugaggggccccaggcccucaccccacaccugccccgcuuguccugagcagugguuggggggcaagcagccuuugugaugggaaggggcucacagucaccccagguguggaggacagaccccuucagcaguuccuggagggcagggcucgugguggagcagggcgguccauaggcaaagcuaaugacuauuugccuaggcuggagauuaaaagacuaaccacacucaggugucauuagcuccagacaccuggccccacgccccagggagagaccucagacacauccucugcaucucaggaucccacaggggcucaccucugacccccaagcccugaugugggcuucagaggaggc

SEQ ID NO: 19383 - RNA, 2958 nt, Homo sapiens
cucccucaggaaagggggccguacugggcaguccuugggcauggaaguuuuaagguggaggcaagggcgaugaaacccuagcgggggugugacaggauugcugguauagucugaccuccgauaggcuugaguuaaccugggggugggacaggaggggaguggagggcugggggggaguguggacccaugccugcuacccacgcucucugggaugugucacggaaggaugaaggagugcuaugagguucaagcuaggagucaggcucccugggggcgauucggagggaaggggcguccagggcuauuuggggaacugcuuuucccucccugcaaacaccacagaugucagugugcagaggaaaggcccgaggauuuauuguggccucuccguccggggacccagcuccaggcuccuccuuuauagaaagcaaacaucuguauuccucacauugcaaaagucuuugccacagugacgcuucugaucacugaaacuucuuggaagaaaaguuuaagaguuuaauuaaaaauuaaauauauuguauuagguauauuuuuuaaaagggcaaaguaaaaaauauuaauacaaucugguuguagaaaauacacugcaagaaaaggagcaggugcuucaaaaauguaacccuggcaacucugccaacagguccugggcucgggcuuccuggaaaagccccgggacacgugggaacuccaggcacccucgcaggggccccccgagggcagguggcccagaagcccaggaaggguggccugggagguggaacgggcgcaaggccgagcaucacuggcuccuagggggcugugacauggaaccaaacauacacgcguaugagagagcagagcggcagcgacgcggucggaucggucgcgggggcugcgggaggaagcgcugcagggacccgggcggcgccggcggccuagccggagaugcacgcgcuguaauagaccgcgcugcuggcguccgacagcgcggagaucaggcugcucuccucugggcaggacauggcgcgcgggcccaguuuggccagugccacgugguacgggagcccgggggcgucgggccgaguccggcugcaguugagguacuggucgaacucggugagguccacgucggcccacagaucggcggcgggccccagcggcucggcgcucuccagcggcggggccucgggcggcggcgacagcgggccgggguacgggccgggcgugcccagggugccguaguacaggccagcgagcggcgccgcggggggcgcgguccugagcgccuccgccaggggagccccguagcaaccgccggggucccgcgacaacucggugggcgcguagggcgcgcggaagggccgcagcgcgcaguccucgggcgccgcgggcggugggaagaaggcagccucgccgggcuccaggccguccagaggcgagcgcucgggcgugggcagccccaggccgucgaacucggcgcccagcgggggcagcucgcggaaggcgcgagccgagccagacgccgcggggaaaggcucgggcgguggcugcgggggcgcuaaucccgggagcaggaggccgggcuccagccgccgggccuugcgcgccugcuucuugcggcgcggccgguacuuguaguugggguggucgcgcaagugcugcacgcgcagccguucggcuuccuccacgaagggccgcuucuccgccgcguucagcuccuuccacgcuuugccugcgggccgugggcgccagugaguggaacgccgucgggcgggugggcgccgagcccuccgugcgcccgggacgccccgcgaggguuuggcgcagcccccgcaccccgcggcccgggaccccugccccccccgccccaccccggcccgagccccccccgcccucucccccuucucugccgcccucccgccgcucacccagcaucuugcugagcaccgcguugugcagguccggguucugcugagccagccgcuugcgcucguccuuugcccacaccaugaaggcguucaugggccgccggaugcgcgacucgucugccgccuggcguuccccgcggccggccgggcugaggccauagcgccccggcucggggcugcgcgggggacugcgcugcgggcugggcggcgaggcgggcgcggcgggcgcggcgagggcggcggggccggcggcgaggccgcgcgugucagcggcggccccgugucccggggcccaugcacagucgcggcgggcgggcgggucguccugugcgccguagccgggcggcgaucucugcauuccagcugggcgcggccugggcggaacggagcgcgggagcgcggcgggcgggcggcgggcacuggggagccgggcgcaagggcaggccaggccgggagggcggauggcgguggggacggcgguggccucgggccgggcgggcgcccagauauagcggcucagggccaaucggcggcggggcgggcgggcgggggcgggucggggccgccuccuccccgggggcucccuuucuucucaggccgggcgggauuccgcugaggccucccccgcgcacagcccccccaccucccccgcgaccucucagaaggagagaccccccgggugggaaagaaagggcugcugaugagggccggugcugccagacuuucggaggcgagcugccacccacccacggagucggacccccgggcaguaacugggggagggcggcagugucccgcugguugccguuccccgccccccgcugggaggcuccauggggaggagagggcccuuuuucacaccaaguucuggggaggcugccuucccaacagccgguaaguccuuccuggagugcagcgccuucagaaaaggccccgucuuuggggaggcgcucugaguccccaggggcgcccaugcuggaaacucuacacccauguguaaccgucagcaccagggacuuugagugccuuu

SEQ ID NO: 19384 - RNA, 2958 nt, Homo sapiens
aaaggcacucaaagucccuggugcugacgguuacacauggguguagaguuuccagcaugggcgccccuggggacucagagcgccuccccaaagacggggccuuuucugaaggcgcugcacuccaggaaggacuuaccggcuguugggaaggcagccuccccagaacuuggugugaaaaagggcccucuccuccccauggagccucccagcggggggcggggaacggcaaccagcgggacacugccgcccucccccaguuacugcccggggguccgacuccguggguggguggcagcucgccuccgaaagucuggcagcaccggcccucaucagcagcccuuucuuucccacccggggggucucuccuucugagaggucgcgggggaggugggggggcugugcgcgggggaggccucagcggaaucccgcccggccugagaagaaagggagcccccggggaggaggcggccccgacccgcccccgcccgcccgccccgccgccgauuggcccugagccgcuauaucugggcgcccgcccggcccgaggccaccgccguccccaccgccauccgcccucccggccuggccugcccuugcgcccggcuccccagugcccgccgcccgcccgccgcgcucccgcgcuccguuccgcccaggccgcgcccagcuggaaugcagagaucgccgcccggcuacggcgcacaggacgacccgcccgcccgccgcgacugugcaugggccccgggacacggggccgccgcugacacgcgcggccucgccgccggccccgccgcccucgccgcgcccgccgcgcccgccucgccgcccagcccgcagcgcagucccccgcgcagccccgagccggggcgcuauggccucagcccggccggccgcggggaacgccaggcggcagacgagucgcgcauccggcggcccaugaacgccuucauggugugggcaaaggacgagcgcaagcggcuggcucagcagaacccggaccugcacaacgcggugcucagcaagaugcugggugagcggcgggagggcggcagagaagggggagagggcggggggggcucgggccgggguggggcggggggggcaggggucccgggccgcggggugcgggggcugcgccaaacccucgcggggcgucccgggcgcacggagggcucggcgcccacccgcccgacggcguuccacucacuggcgcccacggcccgcaggcaaagcguggaaggagcugaacgcggcggagaagcggcccuucguggaggaagccgaacggcugcgcgugcagcacuugcgcgaccaccccaacuacaaguaccggccgcgccgcaagaagcaggcgcgcaaggcccggcggcuggagcccggccuccugcucccgggauuagcgcccccgcagccaccgcccgagccuuuccccgcggcgucuggcucggcucgcgccuuccgcgagcugcccccgcugggcgccgaguucgacggccuggggcugcccacgcccgagcgcucgccucuggacggccuggagcccggcgaggcugccuucuucccaccgcccgcggcgcccgaggacugcgcgcugcggcccuuccgcgcgcccuacgcgcccaccgaguugucgcgggaccccggcgguugcuacggggcuccccuggcggaggcgcucaggaccgcgccccccgcggcgccgcucgcuggccuguacuacggcacccugggcacgcccggcccguaccccggcccgcugucgccgccgcccgaggccccgccgcuggagagcgccgagccgcuggggcccgccgccgaucugugggccgacguggaccucaccgaguucgaccaguaccucaacugcagccggacucggcccgacgcccccgggcucccguaccacguggcacuggccaaacugggcccgcgcgccauguccugcccagaggagagcagccugaucuccgcgcugucggacgccagcagcgcggucuauuacagcgcgugcaucuccggcuaggccgccggcgccgcccgggucccugcagcgcuuccucccgcagcccccgcgaccgauccgaccgcgucgcugccgcucugcucucucauacgcguguauguuugguuccaugucacagcccccuaggagccagugaugcucggccuugcgcccguuccaccucccaggccacccuuccugggcuucugggccaccugcccucggggggccccugcgagggugccuggaguucccacgugucccggggcuuuuccaggaagcccgagcccaggaccuguuggcagaguugccaggguuacauuuuugaagcaccugcuccuuuucuugcaguguauuuucuacaaccagauuguauuaauauuuuuuacuuugcccuuuuaaaaaauauaccuaauacaauauauuuaauuuuuaauuaaacucuuaaacuuuucuuccaagaaguuucagugaucagaagcgucacuguggcaaagacuuuugcaaugugaggaauacagauguuugcuuucuauaaaggaggagccuggagcuggguccccggacggagaggccacaauaaauccucgggccuuuccucugcacacugacaucugugguguuugcagggagggaaaagcaguuccccaaauagcccuggacgccccuucccuccgaaucgcccccagggagccugacuccuagcuugaaccucauagcacuccuucauccuuccgugacacaucccagagagcguggguagcaggcauggguccacacucccccccagcccuccacuccccuccugucccacccccagguuaacucaagccuaucggaggucagacuauaccagcaauccugucacacccccgcuaggguuucaucgcccuugccuccaccuuaaaacuuccaugcccaaggacugcccaguacggcccccuuuccugagggag

SEQ ID NO: 19385 - RNA, 2571 nt, Homo sapiens
ggcgagagcagguucucuuaggaggguguggauugugagcuugugcgcuggcgaggagcagaaggucagggaggcaccguaguuaaugaaucaauaaaccaaacagccgaucaaucacuuccugcaguccgaguccggcgagggcuaaucgauugguccggguauuuugaaaggaaaaacggcgguggauauguugucaaacggaggggugcaggagaggcggggccaggccuccaggugaccccucuggcuuccugggccugcagaggcgccgaaacgugcaggcgccggcguccaugaggcguggggcgcgccgggcgagucccugcuugcaggaggcgcccgagaggccgucgcguacccuggcaagaggagcugguuagcaccucccgaccccgagaaggcccagggggcgcccggcgggcggggcggggaccgggcgaggcccgccucccauuggccgcauagcgccgcccagcgcgggccgccguuauaaagcagccgccggcgccgggugccucacagcacgcugccacgccgacgcagaccccucucugcacgccagcccgcccgcacccaccauggccacaguucagcagcuggaaggaagauggcgccugguggacagcaaaggcuuugaugaauacaugaaggagcuaggugaggcacccggccuggcagcgccugcaacguggcguguugugcggucgucugucccuagguccccgucagcgugccagauucuggggcaggagaugcucggcggccuacccccauccccucccaucuuccccaccacgcggccguugggugcagcgcgcgcagcaccacgcgggcaggcggcgaggagcagggagcgugcgcgccucuugcccgcccgcgggccgcaagauuccggaggugguccaccccgugguccaccuaccucugcuucuuucccuucgcccaaacggcagcccuuccgcauugcuuccuguccuuuagcgcgcgcacccgucaccucacgcugcacuucuuucgacccccuccaggcgacccuguauuucccuuuuuucccccuuuacucauccuuccccuuccugccaccauucugucucucccauuuaccccaucguggcagcacccacuccccuuucccucccugucgcaucuuuuguucccuguggcgcgcaggucacccuccguuuucuucauggggacgcggugcuggcgcgcaguuucccgcagaaauccuguggaggggucugaguggcgcuacagcuucagcuugcauuccucugucagccccgucucccccagguccucugcucgcccuuaccaguugagccgaacccuuuggauugguaccccauggaacaccagggcccccgagaagcguggcgcuggcggugccgaccugcugcuggcacugccgggccggggcgccgcagugggcggguggccugugggaggagcgcaaugaggccuggggguggccguguguugccauccuggccucugccacuugagggugaggaggaaggaggcagugggcuuugcuggaaaaccguaacagaaacugccuggcccuccugcggcuaacugcaugcaagauggguguggcccugcagaaggcagaugacuucuugaagcguuccgagggagaaugaaucucaguaguaagauucauuucucacucaaaacagugcuucauuauaaauuacuguccuuuucuaugccagugacagauugcaugcugauugagacacuggauaaauugcaaacaaaaauggaccuuugucacaggccacuaggaagugagauggaguuagcauagcauggauccucucuggaagggagcuuccagcccuaagggauggcugggauuuaugagggugcuucagaagccgguauccacaaauguuaacccgguugcucgcuggugaaauaacuaccgugacccucuauugauaccuggucgccguggcacuucggaaucacuccuucaguacccuuuauccaagaccaugugguguuaaggcugguuuauggugaaucaugaguguauuuuugauacuaucaguaaagaaggcaguauuuuucuuuuuccuuguaaaccuacaucaagaugacucuggaaaaagcgauuuacugcaccuguccaauaaauaacaguguguguguguguguguguguguguguguguacaaguuuaaggcccaaagaacacuuuucucugccuguagaaagcaaauuguguguagguuuggagggcuuguuuccaggauucuggagucuugaagguugucaagacucaguucauuagggagcagucacaaugugaaaagagcagagcccauuuauuuguccaaagugagaguacauaaugacucaauuaacagcauaaggcaccagcccugagcuggcaaaagagaaggcuccaaggggaacuuuaaagccuggcuggguguucuucaucaagacaaucaugcugcguagguuguagucuccucauuuaugaaacagugauuuggccuggaucuaagauuccuuauacauguuaacuaacucuaaggggaaagagauagauca

SEQ ID NO: 19386 - RNA, 2571 nt, Homo sapiens
ugaucuaucucuuuccccuuagaguuaguuaacauguauaaggaaucuuagauccaggccaaaucacuguuucauaaaugaggagacuacaaccuacgcagcaugauugucuugaugaagaacacccagccaggcuuuaaaguuccccuuggagccuucucuuuugccagcucagggcuggugccuuaugcuguuaauugagucauuauguacucucacuuuggacaaauaaaugggcucugcucuuuucacauugugacugcucccuaaugaacugagucuugacaaccuucaagacuccagaauccuggaaacaagcccuccaaaccuacacacaauuugcuuucuacaggcagagaaaaguguucuuugggccuuaaacuuguacacacacacacacacacacacacacacacacuguuauuuauuggacaggugcaguaaaucgcuuuuuccagagucaucuugauguagguuuacaaggaaaaagaaaaauacugccuucuuuacugauaguaucaaaaauacacucaugauucaccauaaaccagccuuaacaccacauggucuuggauaaaggguacugaaggagugauuccgaagugccacggcgaccagguaucaauagagggucacgguaguuauuucaccagcgagcaaccggguuaacauuuguggauaccggcuucugaagcacccucauaaaucccagccaucccuuagggcuggaagcucccuuccagagaggauccaugcuaugcuaacuccaucucacuuccuaguggccugugacaaagguccauuuuuguuugcaauuuauccagugucucaaucagcaugcaaucugucacuggcauagaaaaggacaguaauuuauaaugaagcacuguuuugagugagaaaugaaucuuacuacugagauucauucucccucggaacgcuucaagaagucaucugccuucugcagggccacacccaucuugcaugcaguuagccgcaggagggccaggcaguuucuguuacgguuuuccagcaaagcccacugccuccuuccuccucacccucaaguggcagaggccaggauggcaacacacggccacccccaggccucauugcgcuccucccacaggccacccgcccacugcggcgccccggcccggcagugccagcagcaggucggcaccgccagcgccacgcuucucgggggcccugguguuccaugggguaccaauccaaaggguucggcucaacugguaagggcgagcagaggaccugggggagacggggcugacagaggaaugcaagcugaagcuguagcgccacucagaccccuccacaggauuucugcgggaaacugcgcgccagcaccgcguccccaugaagaaaacggagggugaccugcgcgccacagggaacaaaagaugcgacagggagggaaaggggagugggugcugccacgaugggguaaaugggagagacagaaugguggcaggaaggggaaggaugaguaaagggggaaaaaagggaaauacagggucgccuggagggggucgaaagaagugcagcgugaggugacgggugcgcgcgcuaaaggacaggaagcaaugcggaagggcugccguuugggcgaagggaaagaagcagagguagguggaccacgggguggaccaccuccggaaucuugcggcccgcgggcgggcaagaggcgcgcacgcucccugcuccucgccgccugcccgcguggugcugcgcgcgcugcacccaacggccgcgugguggggaagaugggaggggauggggguaggccgccgagcaucuccugccccagaaucuggcacgcugacggggaccuagggacagacgaccgcacaacacgccacguugcaggcgcugccaggccgggugccucaccuagcuccuucauguauucaucaaagccuuugcuguccaccaggcgccaucuuccuuccagcugcugaacuguggccauggugggugcgggcgggcuggcgugcagagaggggucugcgucggcguggcagcgugcugugaggcacccggcgccggcggcugcuuuauaacggcggcccgcgcugggcggcgcuaugcggccaaugggaggcgggccucgcccgguccccgccccgcccgccgggcgcccccugggccuucucggggucgggaggugcuaaccagcuccucuugccaggguacgcgacggccucucgggcgccuccugcaagcagggacucgcccggcgcgccccacgccucauggacgccggcgccugcacguuucggcgccucugcaggcccaggaagccagaggggucaccuggaggccuggccccgccucuccugcaccccuccguuugacaacauauccaccgccguuuuuccuuucaaaauacccggaccaaucgauuagcccucgccggacucggacugcaggaagugauugaucggcuguuugguuuauugauucauuaacuacggugccucccugaccuucugcuccucgccagcgcacaagcucacaauccacacccuccuaagagaaccugcucucgcc

SEQ ID NO: 19387 - RNA, 2627 nt, Homo sapiens
gcccggaaggguaauuuagcacaagcugagacagcaguggcgagggaagggcagugggggguggggugcggugggugggggcgucugcuuuccacaggacucccaggcuucgccgccgaucuacaauuugcugaaggagcaaagaacauccucggcucuaaguagggcuuuuagugugcucauugaugagugaaagucgccacacaugucaagcuaaaggcaguuguuggguuacuaacaggacccagcgccuugcaaacauaugcgcuaagcuguguauacagauggcaggcagaauaauggagcaggcgccuuuuauaaagcucuagcugcugccugucuucagaccugggaaaugaaacuauucagacuugcggccagauagcgccugcgauuguuuguuaccguuuuaauccuauuaauuaaaacguuaaccugauuggguagaaagcgcugucccaacaggcgagucuucuucauaauaaccuacucagagauaaugauguaaaagacucccccgucuguggcggcggcuguuugauggguccggaaaucucuugaaggugaauccaagcaagauaaacggugcggagaggaggcgcggggcugggcucagagcggcggcggcggcggcuccacucccuccgcgcccacccucccaccaugcggggccgcggcccauggugagccccagcagccagcaccaucggcuggagacgaagaagaagaagaagaggaggcggcgagcgcgggggaaggcgaaaaagaaaaagaaagaaggggagagggcucccggcagcaccaggaccgacgcgcgcaccagcuccggagcccagcucgcgcgcgucuguggggccgccugacuccggggccgaggcggcggcggcggcagcgggcgcggcggcccgggcugcgcgccggcgcgggaccauggagcgcgggaugcaccucggugcagcggccgccggcgaggacgaccucuuccugcacaagagccugagcgccuccaccuccaagcgcuuggaagcggcuuuccgcuccacgcccccgggcauggaccugucccuggcgccgccgccucgggaacgcccggcguccuccuccucgucgccccugggcugcuucgagccggcugaccccgagggggcagggcugcuguugccgccgccuggaggaggcggcggcggcagcgcgggaaguggcggcggcggcggcggcgggguggguguccccgggcugcuaguagguucagccggcguugggggcgacccuagccuaagcagccugccggccggggccgcccuuugccucaaguacggcgaaagcgcgagccggggcucgguggccgagagcagcggcggcgagcagagccccgacgacgacagcgacggucgcugcgagcucgugcugcgggccggaguagccgacccgcgggccuccccgggagcgggaggugguggcgcgaaggcagccgagggcugcuccaaugcccaccuccacggcggcgccagcguccccccggggggccugggcggcggcggcggcggggguagcagcagcgguagcaguggcggcgguggcgguagcgguagcggcagcggcggcagcagcagcagcagcagcagcagcagcaagaaauccaaagagcaaaaggcgcugcggcuuaacaucaaugcccgagagcgccggcggaugcacgaccugaacgacgcgcuggacgagcugcgcgcggugauccccuacgcgcacagccccucggugcgaaagcucuccaagaucgccacgcugcugcucgccaagaacuacauccucaugcaggcgcaggcccuggaggagaugcggcgccuagucgccuaccucaaccagggccaggccaucucggcugccucccugcccagcucggcggcugcagcggcagcagcugcugcccugcacccggcgcucggcgccuacgagcaggcagccggcuacccguucagcgccggacugcccccggcugccuccugcccggagaagugcgcccuguuuaacagcgucuccuccagccucugcaaacagugcacggagaagccuuaaacacacccccgaaaaacacaagaccgacccaaaaucuagaggaaagcgaaaagcugcuccccacccccuuuauuuugguccucucguaguugugaaacacuugcagagcaaacaaagcagaggcaagaacugaggagaaguaucagagacaaacgggacuuuuagccuugacauccccagaaucucggucuuugggguggggagggagggaggagggagguggaguugggauggaguauggaugucuuuuuuuucucagaaaaguggcaacuuugguggcagccuagaccgcgaggaaguggaaucuuccuuaaaggugaaacauaaguugagaaguagugcuugguuauuaagccuggagaguguuugaauggcaaaauacuaauccuacuaauaauuguggauuuggcuagugcugagggggagaggagggguuagggguuggguagcaugagagauggaauauucauucagacaaaucagaaagggcacuugaaaauaaauuuugauucugagccaggagaaaaacuugaaauguugacuuaagugag

SEQ ID NO: 19388 - RNA, 2627 nt, Homo sapiens
cucacuuaagucaacauuucaaguuuuucuccuggcucagaaucaaaauuuauuuucaagugcccuuucugauuugucugaaugaauauuccaucucucaugcuacccaaccccuaaccccuccucucccccucagcacuagccaaauccacaauuauuaguaggauuaguauuuugccauucaaacacucuccaggcuuaauaaccaagcacuacuucucaacuuauguuucaccuuuaaggaagauuccacuuccucgcggucuaggcugccaccaaaguugccacuuuucugagaaaaaaaagacauccauacuccaucccaacuccaccucccuccucccucccuccccaccccaaagaccgagauucuggggaugucaaggcuaaaagucccguuugucucugauacuucuccucaguucuugccucugcuuuguuugcucugcaaguguuucacaacuacgagaggaccaaaauaaaggggguggggagcagcuuuucgcuuuccucuagauuuugggucggucuuguguuuuucggggguguguuuaaggcuucuccgugcacuguuugcagaggcuggaggagacgcuguuaaacagggcgcacuucuccgggcaggaggcagccgggggcaguccggcgcugaacggguagccggcugccugcucguaggcgccgagcgccgggugcagggcagcagcugcugccgcugcagccgccgagcugggcagggaggcagccgagauggccuggcccugguugagguaggcgacuaggcgccgcaucuccuccagggccugcgccugcaugaggauguaguucuuggcgagcagcagcguggcgaucuuggagagcuuucgcaccgaggggcugugcgcguaggggaucaccgcgcgcagcucguccagcgcgucguucaggucgugcauccgccggcgcucucgggcauugauguuaagccgcagcgccuuuugcucuuuggauuucuugcugcugcugcugcugcugcugcugcugccgccgcugccgcuaccgcuaccgccaccgccgccacugcuaccgcugcugcuacccccgccgccgccgccgcccaggccccccggggggacgcuggcgccgccguggaggugggcauuggagcagcccucggcugccuucgcgccaccaccucccgcucccggggaggcccgcgggucggcuacuccggcccgcagcacgagcucgcagcgaccgucgcugucgucgucggggcucugcucgccgccgcugcucucggccaccgagccccggcucgcgcuuucgccguacuugaggcaaagggcggccccggccggcaggcugcuuaggcuagggucgcccccaacgccggcugaaccuacuagcagcccggggacacccaccccgccgccgccgccgccgccacuucccgcgcugccgccgccgccuccuccaggcggcggcaacagcagcccugcccccucggggucagccggcucgaagcagcccaggggcgacgaggaggaggacgccgggcguucccgaggcggcggcgccagggacagguccaugcccgggggcguggagcggaaagccgcuuccaagcgcuuggagguggaggcgcucaggcucuugugcaggaagaggucguccucgccggcggccgcugcaccgaggugcaucccgcgcuccauggucccgcgccggcgcgcagcccgggccgccgcgcccgcugccgccgccgccgccucggccccggagucaggcggccccacagacgcgcgcgagcugggcuccggagcuggugcgcgcgucgguccuggugcugccgggagcccucuccccuucuuucuuuuucuuuuucgccuucccccgcgcucgccgccuccucuucuucuucuucuucgucuccagccgauggugcuggcugcuggggcucaccaugggccgcggccccgcauggugggagggugggcgcggagggaguggagccgccgccgccgccgcucugagcccagccccgcgccuccucuccgcaccguuuaucuugcuuggauucaccuucaagagauuuccggacccaucaaacagccgccgccacagacgggggagucuuuuacaucauuaucucugaguagguuauuaugaagaagacucgccuguugggacagcgcuuucuacccaaucagguuaacguuuuaauuaauaggauuaaaacgguaacaaacaaucgcaggcgcuaucuggccgcaagucugaauaguuucauuucccaggucugaagacaggcagcagcuagagcuuuauaaaaggcgccugcuccauuauucugccugccaucuguauacacagcuuagcgcauauguuugcaaggcgcuggguccuguuaguaacccaacaacugccuuuagcuugacauguguggcgacuuucacucaucaaugagcacacuaaaagcccuacuuagagccgaggauguucuuugcuccuucagcaaauuguagaucggcggcgaagccugggaguccuguggaaagcagacgcccccacccaccgcaccccaccccccacugcccuucccucgccacugcugucucagcuugugcuaaauuacccuuccgggc

SEQ ID NO: 19389 - RNA, 3424 nt, Homo sapiens
ccugaauucuucuuuaaggaccaggaggagguucgaaccccaagaaaggcugcaagcugaaccagaagcucgaacccaaaguucgcuucacagccagccacacuggcacucgcugaaucugcgcgccucgcgaguucugacgaucgucaugugauaacugccacgcaccugauggcaggggccauugggugcuuugcuugguucccauuaaagucgacugcgacccgaacgcaacaaaccuaagaguuggaaggcgcaaguuccucugccagcgagcucacccucggcaaccagacugcugaaagugcgcuccacgccggaagugcacuaauccgcagcacgugggguugccagggcgcucuucacgugacugggcggagccucgggaaucugguagccaaugguagcccgagagggcggugccugugacgcuccggggccuaucccggaaauagggcugagugggggcggguaagggcggggaggcugggguguggaaaguguggcggccccgccccgucucuuggaacugccgcggccgccaccgccgcugccggcgccgcugcuguaggggaccagcgcgggugcgcagacgaaaggcgcucuuugccagcugaaaggugaagaccuggggaaaagcugguggggaaaagcugguggggauggggccagagugaggcagggccggggaaggcgcccagaacugagcgcugaccgagagaaagaaggagaauggaugggggaacagaggcgagcgcgggacccgccggggcucaggcccuaguggggccgggccgggccgagcugagcccuggaugccggcagaacagggggcgccugugcggccgcggcggcgacguugaaggguggagggcggggugcgcgccagcuagcagagggccgggugcugcuggccagguucuguuaccccgcauccuucgcggggaccugcggccugggcugggucccccgcaguaggguucggggcggcggccgagggcugggcggcgggggaaggucgccggcuucugcgguggggcgaugggggccgcaaccugcuguuuccagcacggaggagcgcccagggcggguguccccacccucagcgagcuccucugcgacuucucaucccaccuccccaagcaguagcuggaaaaguuuguagaggccagaguuagaaaguggccacuagucuaggguggguguuccuuacaugcagaaauaacgggcccaugaugcuuggcacauaacuuguccgaaaugagacguuucccugccuacauacccguuguuaaaaagcaaacacaaacuuuuuguguaguucccacggaaaaacuaccaucuccccugcccaccauggcagacgaaauugauuucacuacuggagaugccggggcuuccagcacuuacccuaugcagugcucggccuugcgcaaaaacggcuucguggugcucaaaggacgaccaugcaaaauaguggagaugucaacuuccaaaacuggaaagcauggucaugccaagguaaguacccuugcagaucaggcuuuggcuucggcguugggacuuugaucauuuguauuccguuacagaucaugagauuucuauacuuaaaauuuuguaauaagcacuauuuuuuccuucccacaauuacuggguaaucaguuauuacguugaauacuuaaagguagcauucccuucuugggcccuuacaauguucauuaacugggaacugaaacuuuccugaauccuagugaccuauaagaucuauuuaguuuacagaugagaaaaccuguucuagcaauucuaagaaaucuacacuuuauuuuucuuguguaaucucauaauugaaucacuggucuauauugggucuugacaugucgugauacuguuuaguuguuuacugccucuuaauuguaagaccacuacauuuuuuuuuaaguaaaauuagaugaccuuggaaggaggagaaaaagaaucuguuguaaucagcauugguauugugcucuuguguguguaaugagugauauacuuggcagagauuaaacagguuuccuguucuccucuguuagguucaccuuguuggaauugauauuuucacgggcaaaaaauaugaagauauuuguccuucuacucacaacauggauguuccaaauauuaagagaaaugauuaucaaguaagcacugauuuucuuuagaauguugcuuguuucuucaaggugcaaauacuuuguacuaucaguaauaauuugacaaaacccaagaguaguuuuguagguuuuucuaaccaauuauuaggcaccagcuaucuuagaaauuggagaaauagugauguuuaacacauguacuuuucuaggauuauugcuaguuugcuauuuuuuucacauucuugcauuuuuuaaaaagucaaauacuuauuaguguucucaggccaagugacugcauauugcaauuaaguccaauguuuaguaaaaguacuauucucucuguuguaaaauauuucuuguucuaauuuaaaacaucccuccuggauguuuuguuucuuuucacugaucagaccugagacauucaagaaacuacugaaauucauguuccuaccaaguuuuugcauuaaugaauguuagucagaacuugacauucuuaaguagagaaauaaguugaaagccauaaauauaaaggauaaaguaccuggucacugaguauggugaagaaaacacaaaaacuauauaauugguuaaauuauacuuagugaccaugcuaugaccuuuugcuaaauuauguauguaaauuucaaguuuuaguuccaguuauacauuuggguaggucauauuuaaugauagcauuuuguuguuugaaguauugaugauaacaaaauaauugaccuuauaggauguggaagcucagauuacuuauaacuaaagcuuuucuugaaagucuucaauuucuguaucaagcauaccauauaucaaacucauuucugcucauuuuacauagugaaaaauacaaaguugacacugguauuuguuuuauccgacuuaaacugauuuuuuucuguacccuuuguuguauuguauaaauuucuuuuaauguugcuaucaacugcacuuacgcaaugauuuccuuuugcuguuuguccacaugcaaacauacuuuuuugugguuuuaaucuaguaaacacuuuuauauuuucacuuuccuacuugucauaaauguuuucuagguugcuuugaagucuuuguagaaauuugaauugucuugcaaguggguuuuuuuaaccagguagaucuggguuuggaucuaguucugucacuuucuaguuggaugauuuuggacaaguuauacaccuuucugagccuguuuucucaucuacaaaauagugauaauaggaggauuaaaugagaaaauguaccccauuaagaacuccaua

SEQ ID NO: 19390 - RNA, 3424 nt, Homo sapiens
uauggaguucuuaaugggguacauuuucucauuuaauccuccuauuaucacuauuuuguagaugagaaaacaggcucagaaagguguauaacuuguccaaaaucauccaacuagaaagugacagaacuagauccaaacccagaucuaccugguuaaaaaaacccacuugcaagacaauucaaauuucuacaaagacuucaaagcaaccuagaaaacauuuaugacaaguaggaaagugaaaauauaaaaguguuuacuagauuaaaaccacaaaaaaguauguuugcauguggacaaacagcaaaaggaaaucauugcguaagugcaguugauagcaacauuaaaagaaauuuauacaauacaacaaaggguacagaaaaaaaucaguuuaagucggauaaaacaaauaccagugucaacuuuguauuuuucacuauguaaaaugagcagaaaugaguuugauauaugguaugcuugauacagaaauugaagacuuucaagaaaagcuuuaguuauaaguaaucugagcuuccacauccuauaaggucaauuauuuuguuaucaucaauacuucaaacaacaaaaugcuaucauuaaauaugaccuacccaaauguauaacuggaacuaaaacuugaaauuuacauacauaauuuagcaaaaggucauagcauggucacuaaguauaauuuaaccaauuauauaguuuuuguguuuucuucaccauacucagugaccagguacuuuauccuuuauauuuauggcuuucaacuuauuucucuacuuaagaaugucaaguucugacuaacauucauuaaugcaaaaacuugguaggaacaugaauuucaguaguuucuugaaugucucaggucugaucagugaaaagaaacaaaacauccaggagggauguuuuaaauuagaacaagaaauauuuuacaacagagagaauaguacuuuuacuaaacauuggacuuaauugcaauaugcagucacuuggccugagaacacuaauaaguauuugacuuuuuaaaaaaugcaagaaugugaaaaaaauagcaaacuagcaauaauccuagaaaaguacauguguuaaacaucacuauuucuccaauuucuaagauagcuggugccuaauaauugguuagaaaaaccuacaaaacuacucuuggguuuugucaaauuauuacugauaguacaaaguauuugcaccuugaagaaacaagcaacauucuaaagaaaaucagugcuuacuugauaaucauuucucuuaauauuuggaacauccauguugugaguagaaggacaaauaucuucauauuuuuugcccgugaaaauaucaauuccaacaaggugaaccuaacagaggagaacaggaaaccuguuuaaucucugccaaguauaucacucauuacacacacaagagcacaauaccaaugcugauuacaacagauucuuuuucuccuccuuccaaggucaucuaauuuuacuuaaaaaaaaauguaguggucuuacaauuaagaggcaguaaacaacuaaacaguaucacgacaugucaagacccaauauagaccagugauucaauuaugagauuacacaagaaaaauaaaguguagauuucuuagaauugcuagaacagguuuucucaucuguaaacuaaauagaucuuauaggucacuaggauucaggaaaguuucaguucccaguuaaugaacauuguaagggcccaagaagggaaugcuaccuuuaaguauucaacguaauaacugauuacccaguaauugugggaaggaaaaaauagugcuuauuacaaaauuuuaaguauagaaaucucaugaucuguaacggaauacaaaugaucaaagucccaacgccgaagccaaagccugaucugcaaggguacuuaccuuggcaugaccaugcuuuccaguuuuggaaguugacaucuccacuauuuugcauggucguccuuugagcaccacgaagccguuuuugcgcaaggccgagcacugcauaggguaagugcuggaagccccggcaucuccaguagugaaaucaauuucgucugccauggugggcaggggagaugguaguuuuuccgugggaacuacacaaaaaguuuguguuugcuuuuuaacaacggguauguaggcagggaaacgucucauuucggacaaguuaugugccaagcaucaugggcccguuauuucugcauguaaggaacacccacccuagacuaguggccacuuucuaacucuggccucuacaaacuuuuccagcuacugcuuggggaggugggaugagaagucgcagaggagcucgcugaggguggggacacccgcccugggcgcuccuccgugcuggaaacagcagguugcggcccccaucgccccaccgcagaagccggcgaccuucccccgccgcccagcccucggccgccgccccgaacccuacugcgggggacccagcccaggccgcagguccccgcgaaggaugcgggguaacagaaccuggccagcagcacccggcccucugcuagcuggcgcgcaccccgcccuccacccuucaacgucgccgccgcggccgcacaggcgcccccuguucugccggcauccagggcucagcucggcccggcccggccccacuagggccugagccccggcgggucccgcgcucgccucuguucccccauccauucuccuucuuucucucggucagcgcucaguucugggcgccuuccccggcccugccucacucuggccccauccccaccagcuuuuccccaccagcuuuuccccaggucuucaccuuucagcuggcaaagagcgccuuucgucugcgcacccgcgcugguccccuacagcagcggcgccggcagcggcgguggcggccgcggcaguuccaagagacggggcggggccgccacacuuuccacaccccagccuccccgcccuuacccgcccccacucagcccuauuuccgggauaggccccggagcgucacaggcaccgcccucucgggcuaccauuggcuaccagauucccgaggcuccgcccagucacgugaagagcgcccuggcaaccccacgugcugcggauuagugcacuuccggcguggagcgcacuuucagcagucugguugccgagggugagcucgcuggcagaggaacuugcgccuuccaacucuuagguuuguugcguucgggucgcagucgacuuuaaugggaaccaagcaaagcacccaauggccccugccaucaggugcguggcaguuaucacaugacgaucgucagaacucgcgaggcgcgcagauucagcgagugccaguguggcuggcugugaagcgaacuuuggguucgagcuucugguucagcuugcagccuuucuugggguucgaaccuccuccugguccuuaaagaagaauucagg

SEQ ID NO: 19391 - RNA, 3168 nt, Homo sapiens
uccacucucucaauacaguauuauuaaaaccucuucucuuggucaauagaauauggcuauuuuaagcugcugaaauuuuccaucugcaauggaaauguguacauuauggcaauaauagaauuacuaaaaugaaucaaguaaauuuugaaaaguuaaagucuauuuuaccauauuugauaacuacacagcaccugaaaaucaaguaacaacuuucagacgaaauuugggguggggaggcaacaaaggaaaucagcgugaugggaaaauaauguaguuaaggacaaagugcauaaguauuagucauagaauuuaacaauacuucucauuaaucacaaaauuuagaaaaaugauaauauuauuuaauuuuuaagcagaaguguacugcccauaucucugggaacauaaaagaaaagcaauauagaguuuuaacauuuaaaaagucagguucucuguaaugguauuauuucucuuaauugaaucaagcaaagauaguccagaaagcaaagacagauauggucauuuuagaaaacggaacuaaguagacaaagaacagcuuuuaaaaaguuuaacuaccuaauaauaauaauucauaauguugaaaagcuacugaugucaaauugccacaaacauucugcuaguucauuagugaaaaggugggggggggugucaaaaccucuggauaaaggaaaucagcaauauaaacagaaaaucaaaugcuaccaauugccuaggcaugucuggacuuguuuuaugaaagcucacuuucacuugaggaaauucuagcaugugucucccccaguguuaucuacagguuucccucaaaauaaagauccuucucaaagaacagaggcacaaaaggccuccuaccagaggugacaguuaccugauuuaaagaaaaaauucuugccaaacacagauuuacccauuaucacauuugaucuuuacaauuuuuaaagaguagcuugauaucccaaauuuauuucuuguuauauuuaacaaucaacacaaugucgacuccucaaaaaaaucuauguaugacaauugcaucaaauauuaguacauuugcaaacaaaaauuaguauaaaauauaaaucuuaaaaugaauaaaaccaagucuucagugaaugcaugaaugauggaauacagagacccaaaacaugcaacucagaucuguucaacuguugcauugguuuaaaagggacuaauuugaagacuggcauaaauauucuucaaaucuuaaaaaccagucacuuugaugcuugcgauggcauaaaugaaggauuuaugcugguuaauguccugguuuggaaaggagcuaagacgacauuaaagaaaaucaaagcuucacaagguacccuguuuaaagaaaauuaauugucauagcauacuuaguuuuaaugauuggacuggggccuacucuucacauacuguguuaaagacaaucucuugucucauuuggagaaaucuacagaggaaagagaauagaauaaaggaacagguuaggagcaccucagcaaacuagguaagucuguaauugggaauucuggaaaugagggaaaggcagcgagcauuacucagaggucaucagaacgcagcaagaaggaaugagagggagaaaaguuaaaaaaaauaauaauaauaaucacuugaggcaagguguauccuauaaagaaggcucaaaagaacgcagaaaacuggggaagaggccuuggugaauuggcgaauguuuuucagucuccgcugugacgguuccuaauccuagagaacuguuuacagauuugaaucaaagcuacagacaguucagcgucgcccacauccaccuuacauuccuaagaugugcaugcauacacacgaacccacacacgcaccucaacccgguauggaugccaucacgaaggauggaaucccccgacucccacggggcgggggcaacugagagggccaaggcagcugcacgcacagaugauccaccugguccacgugaaaugccugaaacaagcaaacugauaaauagaagcagcgcaagcccugucacguggagggcagauggaaagagcaucggaaaggaaccgcuaguccccggcgcuccaggggcucguccugaaagcuccgcggcucccaaucgcccgcacuuaccggaacccccgggacgcgccggcagucuccgcgccgcguccgcccgggacgcccgcgacgcccgcccugcgcgcccggcucggcccagcucgacccagccucuucucggagcaacuuucuccgccggccgccgccgagcccccuccgcagccgaaggcugacugucaaaagucaguccaacccgacccacagggaaacagcugcaggaagugacugcggaaccgggaggcgguggaggaggagacugagggcgccggcucggcgucgccacugcgcaugugcuuggcggagcaggcccggcagcgguggcagcgguagcaguggcggcucccgcauccccggcgggcggcgcgugggucaggugcccuggccgcgagcgcaggggcgcgggguuaggccggcguggggaacaaaggcacgagugagaggcgggagggucccgccgccaaucucagcagacagccccgaagagcaguucagcagaugcccuggaaaguuaauccuugguagaagccugggcagagcuuuugcaacuuucaucuccagucauugggauccaaacauuguucauucuguuccucccuuagccugcugguuggcgguuaaggcggcugaguggauccuuuaaacugcugcaacagaaccuuuaaacugcugcucuccccacuuccgccccaggauggaggaagaagagcguggcugccugcccaguaucggccucccucacacaaaacgcccccacccacccacacacacaccuucccuccccuacacgaaagugagcaggagauagaggagacuuucuccugacccccagaggcucaccugcaagacaggaaggaccaggaaaagaguggccaacgcuaggaugucacauccuucauaaccaaccuggacaucuucaauguuaacacugagugaugagcugaggaaauuccggcucuaaacuuauagcguaaauuaacucguaugaagaucugcugggguauuauuuuuguguguggcaaacgauaacaaauauacuacuuuaag

SEQ ID NO: 19392 - RNA, 3168 nt, Homo sapiens
cuuaaaguaguauauuuguuaucguuugccacacacaaaaauaauaccccagcagaucuucauacgaguuaauuuacgcuauaaguuuagagccggaauuuccucagcucaucacucaguguuaacauugaagauguccagguugguuaugaaggaugugacauccuagcguuggccacucuuuuccugguccuuccugucuugcaggugagccucugggggucaggagaaagucuccucuaucuccugcucacuuucguguaggggagggaaggugugugugugggugggugggggcguuuugugugagggaggccgauacugggcaggcagccacgcucuucuuccuccauccuggggcggaaguggggagagcagcaguuuaaagguucuguugcagcaguuuaaaggauccacucagccgccuuaaccgccaaccagcaggcuaagggaggaacagaaugaacaauguuuggaucccaaugacuggagaugaaaguugcaaaagcucugcccaggcuucuaccaaggauuaacuuuccagggcaucugcugaacugcucuucggggcugucugcugagauuggcggcgggacccucccgccucucacucgugccuuuguuccccacgccggccuaaccccgcgccccugcgcucgcggccagggcaccugacccacgcgccgcccgccggggaugcgggagccgccacugcuaccgcugccaccgcugccgggccugcuccgccaagcacaugcgcaguggcgacgccgagccggcgcccucagucuccuccuccaccgccucccgguuccgcagucacuuccugcagcuguuucccugugggucggguuggacugacuuuugacagucagccuucggcugcggagggggcucggcggcggccggcggagaaaguugcuccgagaagaggcugggucgagcugggccgagccgggcgcgcagggcgggcgucgcgggcgucccgggcggacgcggcgcggagacugccggcgcgucccggggguuccgguaagugcgggcgauugggagccgcggagcuuucaggacgagccccuggagcgccggggacuagcgguuccuuuccgaugcucuuuccaucugcccuccacgugacagggcuugcgcugcuucuauuuaucaguuugcuuguuucaggcauuucacguggaccagguggaucaucugugcgugcagcugccuuggcccucucaguugcccccgccccgugggagucgggggauuccauccuucgugauggcauccauaccggguugaggugcguguguggguucguguguaugcaugcacaucuuaggaauguaagguggaugugggcgacgcugaacugucuguagcuuugauucaaaucuguaaacaguucucuaggauuaggaaccgucacagcggagacugaaaaacauucgccaauucaccaaggccucuuccccaguuuucugcguucuuuugagccuucuuuauaggauacaccuugccucaagugauuauuauuauuauuuuuuuuaacuuuucucccucucauuccuucuugcugcguucugaugaccucugaguaaugcucgcugccuuucccucauuuccagaauucccaauuacagacuuaccuaguuugcugaggugcuccuaaccuguuccuuuauucuauucucuuuccucuguagauuucuccaaaugagacaagagauugucuuuaacacaguaugugaagaguaggccccaguccaaucauuaaaacuaaguaugcuaugacaauuaauuuucuuuaaacaggguaccuugugaagcuuugauuuucuuuaaugucgucuuagcuccuuuccaaaccaggacauuaaccagcauaaauccuucauuuaugccaucgcaagcaucaaagugacugguuuuuaagauuugaagaauauuuaugccagucuucaaauuagucccuuuuaaaccaaugcaacaguugaacagaucugaguugcauguuuugggucucuguauuccaucauucaugcauucacugaagacuugguuuuauucauuuuaagauuuauauuuuauacuaauuuuuguuugcaaauguacuaauauuugaugcaauugucauacauagauuuuuuugaggagucgacauuguguugauuguuaaauauaacaagaaauaaauuugggauaucaagcuacucuuuaaaaauuguaaagaucaaaugugauaauggguaaaucuguguuuggcaagaauuuuuucuuuaaaucagguaacugucaccucugguaggaggccuuuugugccucuguucuuugagaaggaucuuuauuuugagggaaaccuguagauaacacugggggagacacaugcuagaauuuccucaagugaaagugagcuuucauaaaacaaguccagacaugccuaggcaauugguagcauuugauuuucuguuuauauugcugauuuccuuuauccagagguuuugacacccccccccaccuuuucacuaaugaacuagcagaauguuuguggcaauuugacaucaguagcuuuucaacauuaugaauuauuauuauuagguaguuaaacuuuuuaaaagcuguucuuugucuacuuaguuccguuuucuaaaaugaccauaucugucuuugcuuucuggacuaucuuugcuugauucaauuaagagaaauaauaccauuacagagaaccugacuuuuuaaauguuaaaacucuauauugcuuuucuuuuauguucccagagauaugggcaguacacuucugcuuaaaaauuaaauaauauuaucauuuuucuaaauuuugugauuaaugagaaguauuguuaaauucuaugacuaauacuuaugcacuuuguccuuaacuacauuauuuucccaucacgcugauuuccuuuguugccuccccaccccaaauuucgucugaaaguuguuacuugauuuucaggugcuguguaguuaucaaauaugguaaaauagacuuuaacuuuucaaaauuuacuugauucauuuuaguaauucuauuauugccauaauguacacauuuccauugcagauggaaaauuucagcagcuuaaaauagccauauucuauugaccaagagaagagguuuuaauaauacuguauugagagagugga

SEQ ID NO: 19393 - RNA, 2638 nt, Homo sapiens
aucuaaagccaacuuccauaugccaguagucugcaugaaagaacaaacuuucaaccugcauuuaagaagaccccaaggauuaacagacguuaauuaucuuacucuaaaugcaaguuagugauuuuguuuuagaaaaccccgucaagaucacuaauugauggaugcccauuaauacaccuguauuugcauuucagcgguaaaagacaagcagguuuucggcacagaagagagccgcuuugccaagucuuuucaaaacgucaauaugcuucaaguaauaccaaagcugagagauuccucuugauuuccaaacugucuagguggccugagugguuuuccgccggcagcagccuccuaccuuuaguuugugugccuauauccaugaguggggauuaauuagccggguuggagcugaaggaggcugucgugacgagcccaguggcgauuggccgcccgccugccuggcccugccuuuauaauuuccacacgagugcaucugggcucuuagacaaaccaacagcagcuucuucugacauauacacacgcacacucaccccggacacacacucagcacacuuuuccuccauuugauuaacagugcugcacacacaaugauuacgggaaagcgcaaauaaauacggaaaggggugcuuauuuugacuacuggaagagcuuugcugggucucagcgcaacuuuuguuuuuuauuccugagaaggugaucucuccaugcgguucucucacacaaggauucuuuaaaagaggaagagagacaagcagaggggggaggacagucuuucacuuuaagaacggcugggcucaaagauaaaaggaagggaaaagcagcagcagcagcagcagcagcagcagcagcagcagcagcagcagcagcagcagcagggaaaccaacgcugcagcacuuccgaaaggcauuuuugauccauuucugaguguugcggcccguuucuccaccgaaguuggcuccagcucuagcagccgcauuggaucccacagcuuacugcgagacuccgguguacaauccggaucucugccccaacaugauugcggcccaggccaagcuggucuaccaucugaauaaauacuacaacgaaaaaugccaagccaggaaagcugccauugccaaaacuauccgggaagucugcaaaguaguuuccgacguacugaaggaaguggaagugcaggagccgcgguucaucagcucucucaacgagauggacaaucgcuacgagggccucgaggucaucucccccaccgaauuugaaguggugcuuuaucucaaccaaauggggguguucaacuucguggacgauggcucacugcccggcugcgcggugcugaaguugagcgacgggcgcaagaggagcaugucccucuggguggaauucauuaccgccuccggcuaccucucggcgcgcaaaauccgguccagguuucagacgcugguggcucaagcgguagacaaauguagcuaccgggaugugguaaagaugguggcagacaccagcgaagugaaacugagaauccgagauagguacguggugcagaucacgccggccuuuaaaugcaccgggaucuggccgaggagugcugcccacuggccacuuccccacauccccuggccgggacccaaccggguggcggaggucaaggcggaagguuucaaucucuuguccaaggagugccacuccuuggccggcaagcagagcucggcggagagcgacgccugggugcugcaguucgcggaggcagagaacagacugcagauggggggcugcagaaagaagugccucuccauccucaaaaccuuaagggaucgucaccuugaacugccgggccagcccuugaacaauuaccauaugaagacucugguuuccuacgagugugaaaagcauccccgagagucggacugggacgagucuugccugggugaucggcugaacgggauuuugcugcaacuuaucuccugccugcagugccggcgguguccccacuacuuucuaccgaacuuagaucuguuucaaggcaaaccucacucagcucuggaaaacgcugccaaacaaacguggcgacuggcaagagagauccugaccaacccgaaaaguuuggaaaaacuuuagaggaugauuuaaucaagagccgaaauuauuacccuucucaaaguccuuauuaaguguaaacuucuguucaauuccuaauauuccacuccgcagugcaaacaaucucuuccuuuaaaaaggaauaauaauacaauauuuaaacaucaucucacccacccccacaaggggagaaaaaguaggggaagcggauggagaaaaacccaaagccacuaguauuagaagacuucuuuccacacgauuuccuaucucccuugaaaaguacaccguaacacuccguaaacagcccagcuguaacgccagaccgagacgaacacucugccuaacuaucaaaggauuauagcaauccuggugauuuaggugcaucugucugugaguaaacacgauuuggauaugccaucugaaagaaacuguaauguauauuuugauuuguaacaaauauugugaucucacauugucuuugaaaguguggauguugguguuuugugauuuggugaacagaacuua

SEQ ID NO: 19394 - RNA, 2638 nt, Homo sapiens
uaaguucuguucaccaaaucacaaaacaccaacauccacacuuucaaagacaaugugagaucacaauauuuguuacaaaucaaaauauacauuacaguuucuuucagauggcauauccaaaucguguuuacucacagacagaugcaccuaaaucaccaggauugcuauaauccuuugauaguuaggcagaguguucgucucggucuggcguuacagcugggcuguuuacggaguguuacgguguacuuuucaagggagauaggaaaucguguggaaagaagucuucuaauacuaguggcuuuggguuuuucuccauccgcuuccccuacuuuuucuccccuugugggggugggugagaugauguuuaaauauuguauuauuauuccuuuuuaaaggaagagauuguuugcacugcggaguggaauauuaggaauugaacagaaguuuacacuuaauaaggacuuugagaaggguaauaauuucggcucuugauuaaaucauccucuaaaguuuuuccaaacuuuucggguuggucaggaucucucuugccagucgccacguuuguuuggcagcguuuuccagagcugagugagguuugccuugaaacagaucuaaguucgguagaaaguaguggggacaccgccggcacugcaggcaggagauaaguugcagcaaaaucccguucagccgaucacccaggcaagacucgucccaguccgacucucggggaugcuuuucacacucguaggaaaccagagucuucauaugguaauuguucaagggcuggcccggcaguucaaggugacgaucccuuaagguuuugaggauggagaggcacuucuuucugcagccccccaucugcagucuguucucugccuccgcgaacugcagcacccaggcgucgcucuccgccgagcucugcuugccggccaaggaguggcacuccuuggacaagagauugaaaccuuccgccuugaccuccgccacccgguugggucccggccaggggauguggggaaguggccagugggcagcacuccucggccagaucccggugcauuuaaaggccggcgugaucugcaccacguaccuaucucggauucucaguuucacuucgcuggugucugccaccaucuuuaccacaucccgguagcuacauuugucuaccgcuugagccaccagcgucugaaaccuggaccggauuuugcgcgccgagagguagccggaggcgguaaugaauuccacccagagggacaugcuccucuugcgcccgucgcucaacuucagcaccgcgcagccgggcagugagccaucguccacgaaguugaacacccccauuugguugagauaaagcaccacuucaaauucggugggggagaugaccucgaggcccucguagcgauuguccaucucguugagagagcugaugaaccgcggcuccugcacuuccacuuccuucaguacgucggaaacuacuuugcagacuucccggauaguuuuggcaauggcagcuuuccuggcuuggcauuuuucguuguaguauuuauucagaugguagaccagcuuggccugggccgcaaucauguuggggcagagauccggauuguacaccggagucucgcaguaagcugugggauccaaugcggcugcuagagcuggagccaacuucgguggagaaacgggccgcaacacucagaaauggaucaaaaaugccuuucggaagugcugcagcguugguuucccugcugcugcugcugcugcugcugcugcugcugcugcugcugcugcugcugcugcugcuuuucccuuccuuuuaucuuugagcccagccguucuuaaagugaaagacuguccuccccccucugcuugucucucuuccucuuuuaaagaauccuugugugagagaaccgcauggagagaucaccuucucaggaauaaaaaacaaaaguugcgcugagacccagcaaagcucuuccaguagucaaaauaagcaccccuuuccguauuuauuugcgcuuucccguaaucauugugugugcagcacuguuaaucaaauggaggaaaagugugcugaguguguguccggggugagugugcguguguauaugucagaagaagcugcuguugguuugucuaagagcccagaugcacucguguggaaauuauaaaggcagggccaggcaggcgggcggccaaucgccacugggcucgucacgacagccuccuucagcuccaacccggcuaauuaauccccacucauggauauaggcacacaaacuaaagguaggaggcugcugccggcggaaaaccacucaggccaccuagacaguuuggaaaucaagaggaaucucucagcuuugguauuacuugaagcauauugacguuuugaaaagacuuggcaaagcggcucucuucugugccgaaaaccugcuugucuuuuaccgcugaaaugcaaauacagguguauuaaugggcauccaucaauuagugaucuugacgggguuuucuaaaacaaaaucacuaacuugcauuuagaguaagauaauuaacgucuguuaauccuuggggucuucuuaaaugcagguugaaaguuuguucuuucaugcagacuacuggcauauggaaguuggcuuuagau

SEQ ID NO: 19395 - RNA, 2561 nt, Homo sapiens
gccagaaauccggucccggcaaagcuagacgcucugcaaugacaggcguucccagcuagggacuccuggcugcuuggagcuugaaaacaccuggcgugguucucgagggcccuagaggcuccugcuacggacuggucggcucugggguuguaggcagaaggcucuaagcggucggaaggguuuccugugugucagcaacuucacuuugccgagauagcuggcggaagagggaaggagcgcucgcgggccaaucgccugccagcagccaccuuggagcgcaccccucucccucgccgccgacuccgguagcagcgugccggcagaggcugaacacacucggccucggcggagaccugcuccccagaagacgccuccugcuucccacugcgcccuggaggacgcgggcuggcugcugggcgagcucggcggaggcacgccccucgccuccccgcggagugcggacucgccccggugcccaaacuccgcccacccucuagggagcuccgcucucccgccuaaccccggcacuccggacagagcugggccuggggaagggguuccugaacuacgcggacgccgaacgggacgcgcugcagaagcgcacgagucugcggccacgcgcgcuccgauggcugccaggagcugagcucagggugggcggaggaagcgguuagacgccccgaaacugagcugcacguuucuaagguagggaggaggaagaugcccccaauuaaguugaucuuugagccaaggaggcuggggagcagccuccccaagcuagagcccugcagagcgaguuucccuugaccucgcugcgccucuggcgcgcucugcagcgcggacccgcggccccucgggaaagcgcagucggaaaguuauccgcggcgguucccugcgcgcccuguuguguaagcucggcguugccagcggacggagaaguugcuggcuugcccgauagcccaguucgguggcggcccggggcggauuucauggcccgcggcgaacgcggggccagagcuggcgugggcgagccccugcgcgcccccucccgcggggauccaguucgccugcucccuuccgcucgcuggcuuuuccgaugcuugcugcgccccuggccgccgcugcccucucgccgccuccuaccccucggagccgccgccuaagucgaggaggagagaaugaccgaggugcuguggccggcuguccccaacgggacggacgcugccuuccuggccgguccggguucguccugggggaacagcacggucgccuccacugccgccgucuccucgucguucaaaugcgccuugaccaagacgggcuuccaguuuuacuaccugccggcugucuacaucuugguauucaucaucggcuuccugggcaacagcguggccaucuggauguucgucuuccacaugaagcccuggagcggcaucuccguguacauguucaauuuggcucuggccgacuucuuguacgugcugacucugccagcccugaucuucuacuacuucaauaaaacagacuggaucuucggggaugccauguguaaacugcagagguucaucuuucaugugaaccucuauggcagcaucuuguuucugacaugcaucagugcccaccgguacagcggugugguguacccccucaagucccugggccggcucaaaaagaagaaugcgaucuguaucagcgugcugguguggcucauuguggugguggcgaucucccccauccucuucuacucagguaccgggguccgcaaaaacaaaaccaucaccuguuacgacaccaccucagacgaguaccugcgaaguuauuucaucuacagcaugugcacgaccguggccauguucuguguccccuuggugcugauucugggcuguuacggauuaauugugagagcuuugauuuacaaagaucuggacaacucuccucugaggagaaaaucgauuuaccugguaaucauuguacugacuguuuuugcugugucuuacaucccuuuccaugugaugaaaacgaugaacuugagggcccggcuugauuuucagaccccagcaaugugugcuuucaaugacaggguuuaugccacguaucaggugacaagaggucuagcaagucucaacaguuguguggaccccauucucuauuucuuggcgggagauacuuucagaaggagacucucccgagccacaaggaaagcuucuagaagaagugaggcaaauuugcaauccaagagugaagacaugacccucaauauuuuaccugaguucaagcagaauggagauacaagccugugaaggcacaagaaucuccaaacaccucucuguuguaauaugguaggaugcuuaacagaaucaaguacuuuuccccucuuuaacuuucuaguuuagaaaaaaaucaaaccaagaaaauagugaguuaaaaaaauaauagaaguagaaaugcccacauccacacuuagcuuguuuggguuugcuuucacagucucucuuccuucugacuagaaguauguauaauaaaacaauacuaccuaguuaaacauuuacuuucucuuuugc

SEQ ID NO: 19396 - RNA, 2561 nt, Homo sapiens
gcaaaagagaaaguaaauguuuaacuagguaguauuguuuuauuauacauacuucuagucagaaggaagagagacugugaaagcaaacccaaacaagcuaaguguggaugugggcauuucuacuucuauuauuuuuuuaacucacuauuuucuugguuugauuuuuuucuaaacuagaaaguuaaagaggggaaaaguacuugauucuguuaagcauccuaccauauuacaacagagagguguuuggagauucuugugccuucacaggcuuguaucuccauucugcuugaacucagguaaaauauugagggucaugucuucacucuuggauugcaaauuugccucacuucuucuagaagcuuuccuuguggcucgggagagucuccuucugaaaguaucucccgccaagaaauagagaaugggguccacacaacuguugagacuugcuagaccucuugucaccugauacguggcauaaacccugucauugaaagcacacauugcuggggucugaaaaucaagccgggcccucaaguucaucguuuucaucacauggaaagggauguaagacacagcaaaaacagucaguacaaugauuaccagguaaaucgauuuucuccucagaggagaguuguccagaucuuuguaaaucaaagcucucacaauuaauccguaacagcccagaaucagcaccaaggggacacagaacauggccacggucgugcacaugcuguagaugaaauaacuucgcagguacucgucugagguggugucguaacaggugaugguuuuguuuuugcggaccccgguaccugaguagaagaggaugggggagaucgccaccaccacaaugagccacaccagcacgcugauacagaucgcauucuucuuuuugagccggcccagggacuugaggggguacaccacaccgcuguaccggugggcacugaugcaugucagaaacaagaugcugccauagagguucacaugaaagaugaaccucugcaguuuacacauggcauccccgaagauccagucuguuuuauugaaguaguagaagaucagggcuggcagagucagcacguacaagaagucggccagagccaaauugaacauguacacggagaugccgcuccagggcuucauguggaagacgaacauccagauggccacgcuguugcccaggaagccgaugaugaauaccaagauguagacagccggcagguaguaaaacuggaagcccgucuuggucaaggcgcauuugaacgacgaggagacggcggcaguggaggcgaccgugcuguucccccaggacgaacccggaccggccaggaaggcagcguccgucccguuggggacagccggccacagcaccucggucauucucuccuccucgacuuaggcggcggcuccgagggguaggaggcggcgagagggcagcggcggccaggggcgcagcaagcaucggaaaagccagcgagcggaagggagcaggcgaacuggauccccgcgggagggggcgcgcaggggcucgcccacgccagcucuggccccgcguucgccgcgggccaugaaauccgccccgggccgccaccgaacugggcuaucgggcaagccagcaacuucuccguccgcuggcaacgccgagcuuacacaacagggcgcgcagggaaccgccgcggauaacuuuccgacugcgcuuucccgaggggccgcggguccgcgcugcagagcgcgccagaggcgcagcgaggucaagggaaacucgcucugcagggcucuagcuuggggaggcugcuccccagccuccuuggcucaaagaucaacuuaauugggggcaucuuccuccucccuaccuuagaaacgugcagcucaguuucggggcgucuaaccgcuuccuccgcccacccugagcucagcuccuggcagccaucggagcgcgcguggccgcagacucgugcgcuucugcagcgcgucccguucggcguccgcguaguucaggaaccccuuccccaggcccagcucuguccggagugccgggguuaggcgggagagcggagcucccuagagggugggcggaguuugggcaccggggcgaguccgcacuccgcggggaggcgaggggcgugccuccgccgagcucgcccagcagccagcccgcguccuccagggcgcagugggaagcaggaggcgucuucuggggagcaggucuccgccgaggccgaguguguucagccucugccggcacgcugcuaccggagucggcggcgagggagaggggugcgcuccaagguggcugcuggcaggcgauuggcccgcgagcgcuccuucccucuuccgccagcuaucucggcaaagugaaguugcugacacacaggaaacccuuccgaccgcuuagagccuucugccuacaaccccagagccgaccaguccguagcaggagccucuagggcccucgagaaccacgccagguguuuucaagcuccaagcagccaggagucccuagcugggaacgccugucauugcagagcgucuagcuuugccgggaccggauuucuggc

SEQ ID NO: 19397 - RNA, 2462 nt, Homo sapiens
uccaaaggggaaagagaaaaaguacucaauggagcauuuucuuaggcauaaagggaauugagucagaacuugaaguugaauaugacccaccaaauuaacuuuuuauaguuauuggguuuuccugaagaaccaugguauuuuaauaauucaauuuuuuagaaaauauauauauuauuagagccgggugagguggcacacaccugaaguccucgcuacucugcaggcuuagguaggaggaucauuugagcccagggguuccaguccagccugggaaacauaaaguggccuugucucuauuuuucaagcaagaaaaaagaaaaaaauauauuauccaaaauggcuuaguagagcuucacucuugaauuucuucaaauccucugaugaaagaaucguacuagaauauacaacaaacuucguggcugcaucaacgauacuuaaaaccuuguaaagggcauuauuaugggcauuuuuaaccaauuaggauaauuuauaaguuaaaaguagaugaacuuaccuguggaauuccagaugaaauuaaagcuuaaguuuuuuguuguuuucuguauuccaugcuuaauuaaaacacucagaucuguugugaacuacugaacagaagaacagaaaaaaauauauaugagucauaacauuaggaauuaugacaucuaaaaucaauguuguauacuuagcaaguuguuuuuggagccauuuauuacauaucaacacuuuuuucauuuuuggaaaagccuugauccucucuucucgcuuucaaaucaccucaugcucuaaucugaaauuauacuuggacacuguuuuuuuguuuuuuguuuguuuuggagauggagucucacucuguugcccaggcuggagugcaauggcacaaucucggcucacugcaaccucugccucccggguucgagcaauucuccugccucagccccccgaggaacugggauuucaggugugugccaccacacccagcuaauuuuguauauuuaguagagacgggguuucaccacguuggccaagccgaucucgaacucccgaccugaggugaucugcccgccucggccucccaaagugcuggaauuacuggcgugagccaccgcgcccggccuggaugcuguuuugacaacaguguuuauuuucaggucuggaguuauccaauggccauucauuugaacgaacauuuuagucuaugaggggaaaaaagucauagucucuuaucuguuaguaauaaacgauucuguucuccagacugauacgcguucaguaauuugugcuuuuaucaggcaucgacacaugcauacuaagagcacaaauucagcgcccuucuuuugcuuaagccuccugggagaagcuaaaaaacuuguucccaguugaacacugcaaacccaaauuuuccuuaccucugaaaacagaaaaaaagacaugguuuggcaauuucuuccuugauagcuuuucccacaacgcagccaccuccuaaacgcaggcaaucugugcaaaacgcagaggaaacaaaaucaugaaagcccugcaaaucucccuccuaaauccaacauuaagaaggcgaacggauacugaauucaaagacuacccguacuugaggauggcaucauuccuuacugcuuggaaaagugagacuccguugcaccucuaggaaucuuuuuaaaacgcccuguauguuccuuaacacugccuguaggaauccuguagcccuagccccgugggauuuccuucucucuccgcccguucuccacauuccccacuuaguuucacauuccuucccaaucccuccgacaucccugcgccggggcccuucccuagcgcuccgggaaagcguucgccgcaggccuguuaggggcccaccaauaccguaacaccguucccguccucuuccucggcaccgcugcaaacgccccgggucgcuacccggauuugacgguggcuggagcggcacgggcgacgcaaggcagguauugcacccuggggcaaggcaagguggacaaccagcggaugcggcgcggccgcggccugggccugggcccuccgcgucgcccacugccccacugggccccuucucccgcgcucaccggaggcgggcagcugcucgucaccgagacccgagacccacggugcggcggcucaaccugggccacgcuccgcucuagaggagugggcggugccucccggccuagcugccggggucuaggcguuuccgaggacggcgcguuccgggaaaggcggguccgguggcuauacccuccacccaguggcaggacucaaccgccucggagacccugcagggccgcccuucucacucaccuccugugcucggcgcgcacccagcucggaagcgggaagguggccggcguucucucccugcgcacacacgcagccuccccgcauccgcacgcacggccgggcgcgcgcagaccacgcgccagggccgcggccggaagccc

SEQ ID NO: 19398 - RNA, 2462 nt, Homo sapiens
gggcuuccggccgcggcccuggcgcguggucugcgcgcgcccggccgugcgugcggaugcggggaggcugcgugugugcgcagggagagaacgccggccaccuucccgcuuccgagcugggugcgcgccgagcacaggaggugagugagaagggcggcccugcagggucuccgaggcgguugaguccugccacuggguggaggguauagccaccggacccgccuuucccggaacgcgccguccucggaaacgccuagaccccggcagcuaggccgggaggcaccgcccacuccucuagagcggagcguggcccagguugagccgccgcaccgugggucucgggucucggugacgagcagcugcccgccuccggugagcgcgggagaaggggcccaguggggcagugggcgacgcggagggcccaggcccaggccgcggccgcgccgcauccgcugguuguccaccuugccuugccccagggugcaauaccugccuugcgucgcccgugccgcuccagccaccgucaaauccggguagcgacccggggcguuugcagcggugccgaggaagaggacgggaacgguguuacgguauuggugggccccuaacaggccugcggcgaacgcuuucccggagcgcuagggaagggccccggcgcagggaugucggagggauugggaaggaaugugaaacuaaguggggaauguggagaacgggcggagagagaaggaaaucccacggggcuagggcuacaggauuccuacaggcaguguuaaggaacauacagggcguuuuaaaaagauuccuagaggugcaacggagucucacuuuuccaagcaguaaggaaugaugccauccucaaguacggguagucuuugaauucaguauccguucgccuucuuaauguuggauuuaggagggagauuugcagggcuuucaugauuuuguuuccucugcguuuugcacagauugccugcguuuaggagguggcugcguugugggaaaagcuaucaaggaagaaauugccaaaccaugucuuuuuuucuguuuucagagguaaggaaaauuuggguuugcaguguucaacugggaacaaguuuuuuagcuucucccaggaggcuuaagcaaaagaagggcgcugaauuugugcucuuaguaugcaugugucgaugccugauaaaagcacaaauuacugaacgcguaucagucuggagaacagaaucguuuauuacuaacagauaagagacuaugacuuuuuuccccucauagacuaaaauguucguucaaaugaauggccauuggauaacuccagaccugaaaauaaacacuguugucaaaacagcauccaggccgggcgcgguggcucacgccaguaauuccagcacuuugggaggccgaggcgggcagaucaccucaggucgggaguucgagaucggcuuggccaacguggugaaaccccgucucuacuaaauauacaaaauuagcugggugugguggcacacaccugaaaucccaguuccucggggggcugaggcaggagaauugcucgaacccgggaggcagagguugcagugagccgagauugugccauugcacuccagccugggcaacagagugagacuccaucuccaaaacaaacaaaaaacaaaaaaacaguguccaaguauaauuucagauuagagcaugaggugauuugaaagcgagaagagaggaucaaggcuuuuccaaaaaugaaaaaaguguugauauguaauaaauggcuccaaaaacaacuugcuaaguauacaacauugauuuuagaugucauaauuccuaauguuaugacucauauauauuuuuuucuguucuucuguucaguaguucacaacagaucugaguguuuuaauuaagcauggaauacagaaaacaacaaaaaacuuaagcuuuaauuucaucuggaauuccacagguaaguucaucuacuuuuaacuuauaaauuauccuaauugguuaaaaaugcccauaauaaugcccuuuacaagguuuuaaguaucguugaugcagccacgaaguuuguuguauauucuaguacgauucuuucaucagaggauuugaagaaauucaagagugaagcucuacuaagccauuuuggauaauauauuuuuuucuuuuuucuugcuugaaaaauagagacaaggccacuuuauguuucccaggcuggacuggaaccccugggcucaaaugauccuccuaccuaagccugcagaguagcgaggacuucaggugugugccaccucacccggcucuaauaauauauauauuuucuaaaaaauugaauuauuaaaauaccaugguucuucaggaaaacccaauaacuauaaaaaguuaauuuggugggucauauucaacuucaaguucugacucaauucccuuuaugccuaagaaaaugcuccauugaguacuuuuucucuuuccccuuugga

SEQ ID NO: 19399 - RNA, 2636 nt, Homo sapiens
ccaagccgagccauauauuuucauugccuguggcuaugcagcgucaguaagcuaaaaauacuuuucuuucuucuaaguugggaagagcaaguuaaguccaaacaaucggauguguaucauuuucucucaucuuaaauuuuuuacuagaaaacacucaaaauaacugaagcaaagaagaggcaucuguuucauaucugcacacacauacacagaaacaucccucuagcuugcaucuaucuaccuagcaauauuaaacaagcuauauuugcaucaucagcaaagucugccaacauuucaccacuuacagcuauuuauuauuauuuuuugguuggggagaaagcugcauaaguauugaaaacuaaccacaaguaaaagcuugcaaaaaaaauauguauaggauacguccuuaacaagaggacauggugcugacuuugaauuuacguuaaaaguaaauucaaauucaaauucugaauuuacauuuaaaguaaauuauguuugugaaaauuacauuaaauuagauucuaaaauaggauagaaacuuuaaguucuucuacaggucuugcucaaguuggguuugcugugcauggcaaagugaaaaccuguguuucuccucuuuggcuucccgaagcuaacuguaacauacaugcaucucugugaugaaguaaaagcuacuuaggaagacaaguaaaccuguuuuuaaagaaauaaacuacugcaggauggugaaugguauguaguguggacuuuucccacacauccagcaucucuaaagacauccuauuaaauuaaaagaauaagaaauaagaaacuagcagguccagaucuagguuccuuccauucgacugggccaugacuuuaauuaagcugcugggucauggcuuaauuuucccuugaaaaacagcacaguuugagaaaucucugccaaacucuucauuuuuuaagcaacugacaaagucaacaagaaagcaaauaccuagaauccacggaacaaugcuccucagagcagggcuggcagaagcggcggagggcuaccaguuucccugccccgauugcagcugggccuuugacaagagcucggguaaaggacuaucugugcacccgcccaccaaacgcccagcgggacgaugggcuggugcuacgaaguucuaaaccuaaccgcugggaggaagaagcgggaggaugagaaugucaucuccccugacacucuggugccggcaguccugaaacgcucaccucugacgucccugaaggucagagguggcaaccacagugccaauagcucaccaaagccacuuuuccugcccggguggaggcgcggggcaaaguuggccaccggcugcgcgcgucccguuagccguaccuuguaacugggcggagagggacuccuggugcugcugguacuugagcgccaccgccucggcuuuccgcagcugcgucugcagcucguaguagagcaucgcgccguagagaaagccgaacacgacggucagcagcagcagcgucuggaaaauccgcuucugcuuucgggagcacaucccguuucccauagucccgccuggacccaaagccgcggccgcccccgccgucuccuccccuugguccgagcgagcgucucagcagcggccgccgcaguagguggccagacgcagcaugaggaggagaugccagacacaaaagccggcccggaggggaaguggcgcccgcucagcccccgcgcggcgcggggcgcgcagccaucgacgccgcccgggcagcugcagccaaacuucugcgaggcucguucuccgcgaaugcccggggccgggaggaggcccuccgcauacuucagagccggcugcccucgcgccuguccccagaugccuccugccuuuuuuccuucuucccacuuuuuggccccgcugcccccgggcaguucuuggagucccgcccuggccacuccccgcccuaucgcggcggcucccacugcacgacuuuguugccaccuaagggagggggugcgcgcccaacaaagggaccaggacuccgggccgcgcccccgugcggccugcccaauggguggaagggugggggccagcugucucggcugguuuuggggacggcacagcggugucacugacgggucggcuggugccucugccgccccgccaccuccugcccaacuuacgugucacccacggcccggcuauucuggccaacgggauuccgggaggaagucccacucggccuccuugcucauugggcccguccgagcagacgcucccucccuucggggaggcagugccgggcucgauuggaugccggcuuuguccguccgaccccagggccgcaccuucccucccagugccggggccggcuaggggcucugugggcagcgcggccgccuggcgccggggugcgcccacguggagucggagagggugggaagaggcaggcggaagggcgaagggcggggagcuuugggugggcgggggacuuguccgggccugagucugggugagguucggugaacacguguguguguguguguguguguguguguguguuccaguucucguucggaacgcacguggagagcggaguaaaauguguguaugaacgaaagaauggauggcaguaacugugugcacucugcugag

SEQ ID NO: 19400 - RNA, 2636 nt, Homo sapiens
cucagcagagugcacacaguuacugccauccauucuuucguucauacacacauuuuacuccgcucuccacgugcguuccgaacgagaacuggaacacacacacacacacacacacacacacacacguguucaccgaaccucacccagacucaggcccggacaagucccccgcccacccaaagcuccccgcccuucgcccuuccgccugccucuucccacccucuccgacuccacgugggcgcaccccggcgccaggcggccgcgcugcccacagagccccuagccggccccggcacugggagggaaggugcggcccuggggucggacggacaaagccggcauccaaucgagcccggcacugccuccccgaagggagggagcgucugcucggacgggcccaaugagcaaggaggccgagugggacuuccucccggaaucccguuggccagaauagccgggccgugggugacacguaaguugggcaggagguggcggggcggcagaggcaccagccgacccgucagugacaccgcugugccguccccaaaaccagccgagacagcuggcccccacccuuccacccauugggcaggccgcacgggggcgcggcccggaguccuggucccuuuguugggcgcgcacccccucccuuagguggcaacaaagucgugcagugggagccgccgcgauagggcggggaguggccagggcgggacuccaagaacugcccgggggcagcggggccaaaaagugggaagaaggaaaaaaggcaggaggcaucuggggacaggcgcgagggcagccggcucugaaguaugcggagggccuccucccggccccgggcauucgcggagaacgagccucgcagaaguuuggcugcagcugcccgggcggcgucgauggcugcgcgccccgcgccgcgcgggggcugagcgggcgccacuuccccuccgggccggcuuuugugucuggcaucuccuccucaugcugcgucuggccaccuacugcggcggccgcugcugagacgcucgcucggaccaaggggaggagacggcgggggcggccgcggcuuuggguccaggcgggacuaugggaaacgggaugugcucccgaaagcagaagcggauuuuccagacgcugcugcugcugaccgucguguucggcuuucucuacggcgcgaugcucuacuacgagcugcagacgcagcugcggaaagccgaggcgguggcgcucaaguaccagcagcaccaggagucccucuccgcccaguuacaagguacggcuaacgggacgcgcgcagccgguggccaacuuugccccgcgccuccacccgggcaggaaaaguggcuuuggugagcuauuggcacugugguugccaccucugaccuucagggacgucagaggugagcguuucaggacugccggcaccagagugucaggggagaugacauucucauccucccgcuucuuccucccagcgguuagguuuagaacuucguagcaccagcccaucgucccgcugggcguuuggugggcgggugcacagauaguccuuuacccgagcucuugucaaaggcccagcugcaaucggggcagggaaacugguagcccuccgccgcuucugccagcccugcucugaggagcauuguuccguggauucuagguauuugcuuucuuguugacuuugucaguugcuuaaaaaaugaagaguuuggcagagauuucucaaacugugcuguuuuucaagggaaaauuaagccaugacccagcagcuuaauuaaagucauggcccagucgaauggaaggaaccuagaucuggaccugcuaguuucuuauuucuuauucuuuuaauuuaauaggaugucuuuagagaugcuggaugugugggaaaaguccacacuacauaccauucaccauccugcaguaguuuauuucuuuaaaaacagguuuacuugucuuccuaaguagcuuuuacuucaucacagagaugcauguauguuacaguuagcuucgggaagccaaagaggagaaacacagguuuucacuuugccaugcacagcaaacccaacuugagcaagaccuguagaagaacuuaaaguuucuauccuauuuuagaaucuaauuuaauguaauuuucacaaacauaauuuacuuuaaauguaaauucagaauuugaauuugaauuuacuuuuaacguaaauucaaagucagcaccauguccucuuguuaaggacguauccuauacauauuuuuuuugcaagcuuuuacuugugguuaguuuucaauacuuaugcagcuuucuccccaaccaaaaaauaauaauaaauagcuguaaguggugaaauguuggcagacuuugcugaugaugcaaauauagcuuguuuaauauugcuagguagauagaugcaagcuagagggauguuucuguguaugugugugcagauaugaaacagaugccucuucuuugcuucaguuauuuugaguguuuucuaguaaaaaauuuaagaugagagaaaaugauacacauccgauuguuuggacuuaacuugcucuucccaacuuagaagaaagaaaaguauuuuuagcuuacugacgcugcauagccacaggcaaugaaaauauauggcucggcuugg

SEQ ID NO: 19401 - RNA, 2701 nt, Homo sapiens
gguggcuggagauucgagggaaaacgaaguucgccgaggcggccucgggcgggcaggucccgggcuccaucacagggcacacgcggcuaccagggacgcagccccccaacacacacacacacacacacacacacacacacacacacacacacacccucucccacucaugccuggcaacccagcagaaacuucggacuggggcaaaacaagcccgggccccggcggcacgcggggcuaggcgcguucccgccaguaccuggucgcgaggccgcucgcggggugcccugcgugccccccacucccgcagcccgcgcccugcucgcucacugugggggcgcagcggccaggcuucucuguuuguuguuuaaagaaauccuagggcgggcgagcggcggcaucuaggggagggggcgcagccagaauucccuuccagcaagcgcgugaggggcauucucaacgcaaaaccagacccagaaaguagugaccagcccuccucggauuacccuucauuggcuccucccuugcuccccccacccuccagauuugcauaaaaaaggccaagaaaacucuggcugugccccagcaacggcucauucugcucccccgggucggagccccccggagcugcgcgcgggcuugcagcgccucgcccgcgcuguccucccggugucccgcuucuccgcgccccagccgccggcugccagcuuuucggggccccgagucgcacccagcgaagagagcgggcccgggacaagcucgaacuccggccgccucgcccuuccccggcuccgcucccucugcccccucggggucgcgcgcccacgaugcugcagggcccuggcucgcugcugcugcucuuccucgccucgcacugcugccugggcucggcgcgcgggcucuuccucuuuggccagcccgacuucuccuacaagcgcagcaauugcaagcccaucccugccaaccugcagcugugccacggcaucgaauaccagaacaugcggcugcccaaccugcugggccacgagaccaugaaggaggugcuggagcaggccggcgcuuggaucccgcuggucaugaagcagugccacccggacaccaagaaguuccugugcucgcucuucgcccccgucugccucgaugaccuagacgagaccauccagccaugccacucgcucugcgugcaggugaaggaccgcugcgccccggucauguccgccuucggcuuccccuggcccgacaugcuugagugcgaccguuucccccaggacaacgaccuuugcaucccccucgcuagcagcgaccaccuccugccagccaccgaggaagguaagccuucccucuugcuuccccacucccugcugggcugagacgcucccaggagaucccgccccugccacgcaucccagugcaucccugcuuggggugccaguagcgggaagggcagaaguucugccugaccuggucugucaucacaacaagccuguaucaaauuugaggcaccccucccacgccgcccaagucucgcgcauucuccucccgaguuguaccagcuauacuuaagggcaguuuaaaaauaaaacaaacaaacaaaaacaacaaaacuaaaaaaacgaagaacugaacggcgguuuaaaaaaaaauagauacacgauuauuguuaaagaugcuagcacuggagcugcgcagagcguuggaagugguguuugguggaggaguuuguggugagcauucuggccagaggccccucgcucagccucauucugcaccuuccuaccacugggcaggauucuagucacaggaacauuuccuguacagaaaggaaaaccaggaugcacaaguagauaaccuuuuaagggucuuuuuguccuuugucaauuuagauuuuggaaauaaaaccgggacuggcacggaguguguggaaaauugaacauugguuguaacugcucagauacuugaggaagagggcauaaagggaaucucuggaaaucacuuuucuauugcuaucaguuuuuaacuuaggagugguuuugauuagcuggagaaaaucaugcaaaagagauucccaaguuuuuagaaaacggagggagaguuccugugcaaaaaccaucaaagcaaugaaaaccucaugggcucucaauauuuuuucugaaaggaaaacauauacaaugccucugagcugauuuggguccccuggguuggaaaagggagcuuccuaaucccuuucagggcuucagcagccucucccuuucaaucucuaguaguuuuccuacagacaucauuaguuaaagcaaaugcaaaguucuuuagcaaucuuuccuggcagggaccaugaguuugcaaucaucuuauugguuagauuucuaauuuauugcaaauguuuggcauuuuucaaacauuuguccaacauguaccauagaccaaccaauacagguuaguaauauuuuauauacauccugagagcuccuaauuggaaauguuugauuuuguuugggugaggggacuuaagggcaguuuuauguauguugcuuuuauuucuucccacuaucagcagcaacauuacgcaucuuacauuucuccaaaaagccacuuuucuccuucaaaauaaaaguuuauguucuucaaaauuccagcuuugugauuuuucuaauuugauaaauaacgcuucuauuaagucacauaguuuucuaugaacauuaaauuu

SEQ ID NO: 19402 - RNA, 2701 nt, Homo sapiens
aaauuuaauguucauagaaaacuaugugacuuaauagaagcguuauuuaucaaauuagaaaaaucacaaagcuggaauuuugaagaacauaaacuuuuauuuugaaggagaaaaguggcuuuuuggagaaauguaagaugcguaauguugcugcugauagugggaagaaauaaaagcaacauacauaaaacugcccuuaaguccccucacccaaacaaaaucaaacauuuccaauuaggagcucucaggauguauauaaaauauuacuaaccuguauugguuggucuaugguacauguuggacaaauguuugaaaaaugccaaacauuugcaauaaauuagaaaucuaaccaauaagaugauugcaaacucauggucccugccaggaaagauugcuaaagaacuuugcauuugcuuuaacuaaugaugucuguaggaaaacuacuagagauugaaagggagaggcugcugaagcccugaaagggauuaggaagcucccuuuuccaacccaggggacccaaaucagcucagaggcauuguauauguuuuccuuucagaaaaaauauugagagcccaugagguuuucauugcuuugaugguuuuugcacaggaacucucccuccguuuucuaaaaacuugggaaucucuuuugcaugauuuucuccagcuaaucaaaaccacuccuaaguuaaaaacugauagcaauagaaaagugauuuccagagauucccuuuaugcccucuuccucaaguaucugagcaguuacaaccaauguucaauuuuccacacacuccgugccagucccgguuuuauuuccaaaaucuaaauugacaaaggacaaaaagacccuuaaaagguuaucuacuugugcauccugguuuuccuuucuguacaggaaauguuccugugacuagaauccugcccagugguaggaaggugcagaaugaggcugagcgaggggccucuggccagaaugcucaccacaaacuccuccaccaaacaccacuuccaacgcucugcgcagcuccagugcuagcaucuuuaacaauaaucguguaucuauuuuuuuuuaaaccgccguucaguucuucguuuuuuuaguuuuguuguuuuuguuuguuuguuuuauuuuuaaacugcccuuaaguauagcugguacaacucgggaggagaaugcgcgagacuugggcggcgugggaggggugccucaaauuugauacaggcuuguugugaugacagaccaggucaggcagaacuucugcccuucccgcuacuggcaccccaagcagggaugcacugggaugcguggcaggggcgggaucuccugggagcgucucagcccagcagggaguggggaagcaagagggaaggcuuaccuuccucgguggcuggcaggagguggucgcugcuagcgagggggaugcaaaggucguuguccugggggaaacggucgcacucaagcaugucgggccaggggaagccgaaggcggacaugaccggggcgcagcgguccuucaccugcacgcagagcgaguggcauggcuggauggucucgucuaggucaucgaggcagacgggggcgaagagcgagcacaggaacuucuugguguccggguggcacugcuucaugaccagcgggauccaagcgccggccugcuccagcaccuccuucauggucucguggcccagcagguugggcagccgcauguucugguauucgaugccguggcacagcugcagguuggcagggaugggcuugcaauugcugcgcuuguaggagaagucgggcuggccaaagaggaagagcccgcgcgccgagcccaggcagcagugcgaggcgaggaagagcagcagcagcgagccagggcccugcagcaucgugggcgcgcgaccccgagggggcagagggagcggagccggggaagggcgaggcggccggaguucgagcuugucccgggcccgcucucuucgcugggugcgacucggggccccgaaaagcuggcagccggcggcuggggcgcggagaagcgggacaccgggaggacagcgcgggcgaggcgcugcaagcccgcgcgcagcuccggggggcuccgacccgggggagcagaaugagccguugcuggggcacagccagaguuuucuuggccuuuuuuaugcaaaucuggaggguggggggagcaagggaggagccaaugaaggguaauccgaggagggcuggucacuacuuucugggucugguuuugcguugagaaugccccucacgcgcuugcuggaagggaauucuggcugcgcccccuccccuagaugccgccgcucgcccgcccuaggauuucuuuaaacaacaaacagagaagccuggccgcugcgcccccacagugagcgagcagggcgcgggcugcgggaguggggggcacgcagggcaccccgcgagcggccucgcgaccagguacuggcgggaacgcgccuagccccgcgugccgccggggcccgggcuuguuuugccccaguccgaaguuucugcuggguugccaggcaugagugggagaggguguguguguguguguguguguguguguguguguguguguguguguuggggggcugcgucccugguagccgcgugugcccugugauggagcccgggaccugcccgcccgaggccgccucggcgaacuucguuuucccucgaaucuccagccacc

SEQ ID NO: 19403 - RNA, 2807 nt, Homo sapiens
ugccgcccccgcccagccucuccgaguuguuccagcagggggcgccguugccucacuuagaucccuaacccccggaaccccgcagcucccaagccccucucugaguacggaguggucccacuggauccaguucaggguucaauggagcuagggccagcuacggcucaagaucugggguccgccugcggguggggucgccagguguccggcaccaaggaguugaaugcaccgagucagguuggggauggguggggaacaggcgagacgugaggaacucgggugggggacagccauacacgagcccugagcaucugcgcccgcagcuagcuccccccgccucugcggagagcgcgauucaagugcuggcuuugcguccgcuuccccauccacuuacuagcgcaggagaaggcuaucucgguccccagagaagccuggacccacacgcgggcuagauccagagguugguggcgggggcgcagggccccccaggugggggggggcggagcgggaggcggggccacuucaauccugggcaggggcgguuccguacaggguauaaaagcuguccgcgcgggagcccaggccagcuuugggguugucccuggacuugucuugguuccagaaccugacgacccggcgacggcgacgucucuuuugacuaaaagacaguguccagugcuccagccuaggagucuacggggaccgccucccgcgccgccaccaugcccaacuucucuggcaacuggaaaaucauccgaucggaaaacuucgaggaauugcucaaagugcuggguaaggaaauguucgagggcccagguggggcaagggggggcucuggaguccucgaaguuggggaugagaaagacagcgggaccacaaucagggcgugagacacugggugccugcauccccgaaaaacgugccaggcguccgggucccggggcucugggcacgacgccuaaaucccgcuuucuccugcgggggcccaccggugccaacacugcggugacucacggccugugaaucacguagaaaccagaagcgcgagguuggccucugggggaaggggaggcuggccucagcggccggacucggcgggccgaggcaccuggcucucugcaguucagaagcugcgggcugguggagccacgaacccugcauccagacugggagcccgguucccuacccugcccagccgcucggagacauuccaaucuccuucccggugccccccucgguaacccaauccccagggcaggcucauuaccccucggcgcccagcucugccugcgaggugaucugcugccccagcgcccccugagccccacuuuccucccccucugcacuuuccacucugcucuccccaccccccaucugugagacaaguauuuucauacagcgagcagcuccagaguucuaaaaucgcuagggauaauuaucacuuucuuggauuucaacaaaugguuucgugugaaaccccaaucccacauuuccaaaaaucuagguucccaccuaccucccccgaccauagaucggcugcagcccaauuggguguguuggucaaagguggggaaaacuaagucaauccagacugccuuucccacuuuuccagcccaccuucugugugcccucugggccaacugggcuagacaucuggggcaggggagagugccaggaccuggugacugggagaggacucugggggagagauggacguuaguuaaggaccccagccacugggagcguaagggcaggccugcugccuucaauuccugcacucaacagagagacgguaguucggcuggguugggcgagaggggagggagggaaggcaccccucucccuggacuauaggagugagucuggaucuaagacaggucuggaaugcugcagagagagcagggaucuccaucaguccuugccguuaguucuuccugcgaucuaaccacaauacuucuuggagucauaucagucuuucuugcucuguccuugcuaaacuuaaagacaaaaagaaauuuucucuuuggaaagccuagaugccacucccuccucaucuucucuggauucuggccccuguccucaguggaugaggugguggucugguacacccccaggccccagcugaagaguaagauucaaggccccaauccugcugucugucuucagucuguuuguccucccugcagggucucucugagccacgugcccuccucaggcccugcagggggcagauuaaaaacagauccauuagacaaacacaguccugagccagcuaaggccggcuaagcugggcccucagcuccacaggcaccaggggcucgcugaaaggaugucuccucugaacccagccuugccucugcaggaacuucgguccuggcacaccccucuuagcucuagucaaggguccaucucaauaagacuuggggaccugucauuucuuccuagacacaagaguucagcagccaacaauggggguccugggcuccccaggggcaaggcuuccucucucccucucucuucuguuugcaguaggguagguaugcuuuggcacugaggggaaagaggauuuguuucucuaggaacccaggucuggaggagguccagggaguuggccagaucaggggcagggaaauccugcuaccuggcagagggcccuuucacccccgccuagugcaucccuggcucuacuccaggacagggcggcagaucaggccaggugagguggguguguggagcuuagaccuggagcccauccagagaggcccccugcucugcacgucuuccuuucagaggggugcugucuccua

SEQ ID NO: 19404 - RNA, 2807 nt, Homo sapiens
uaggagacagcaccccucugaaaggaagacgugcagagcagggggccucucuggaugggcuccaggucuaagcuccacacacccaccucaccuggccugaucugccgcccuguccuggaguagagccagggaugcacuaggcgggggugaaagggcccucugccagguagcaggauuucccugccccugaucuggccaacucccuggaccuccuccagaccuggguuccuagagaaacaaauccucuuuccccucagugccaaagcauaccuacccuacugcaaacagaagagagagggagagaggaagccuugccccuggggagcccaggacccccauuguuggcugcugaacucuugugucuaggaagaaaugacagguccccaagucuuauugagauggacccuugacuagagcuaagaggggugugccaggaccgaaguuccugcagaggcaaggcuggguucagaggagacauccuuucagcgagccccuggugccuguggagcugagggcccagcuuagccggccuuagcuggcucaggacuguguuugucuaauggaucuguuuuuaaucugcccccugcagggccugaggagggcacguggcucagagagacccugcagggaggacaaacagacugaagacagacagcaggauuggggccuugaaucuuacucuucagcuggggccuggggguguaccagaccaccaccucauccacugaggacaggggccagaauccagagaagaugaggagggaguggcaucuaggcuuuccaaagagaaaauuucuuuuugucuuuaaguuuagcaaggacagagcaagaaagacugauaugacuccaagaaguauugugguuagaucgcaggaagaacuaacggcaaggacugauggagaucccugcucucucugcagcauuccagaccugucuuagauccagacucacuccuauaguccagggagaggggugccuucccucccuccccucucgcccaacccagccgaacuaccgucucucuguugagugcaggaauugaaggcagcaggccugcccuuacgcucccaguggcugggguccuuaacuaacguccaucucucccccagaguccucucccagucaccagguccuggcacucuccccugccccagaugucuagcccaguuggcccagagggcacacagaaggugggcuggaaaagugggaaaggcagucuggauugacuuaguuuuccccaccuuugaccaacacacccaauugggcugcagccgaucuauggucgggggagguaggugggaaccuagauuuuuggaaaugugggauugggguuucacacgaaaccauuuguugaaauccaagaaagugauaauuaucccuagcgauuuuagaacucuggagcugcucgcuguaugaaaauacuugucucacagaugggggguggggagagcagaguggaaagugcagagggggaggaaaguggggcucagggggcgcuggggcagcagaucaccucgcaggcagagcugggcgccgagggguaaugagccugcccuggggauuggguuaccgaggggggcaccgggaaggagauuggaaugucuccgagcggcugggcaggguagggaaccgggcucccagucuggaugcaggguucguggcuccaccagcccgcagcuucugaacugcagagagccaggugccucggcccgccgaguccggccgcugaggccagccuccccuucccccagaggccaaccucgcgcuucugguuucuacgugauucacaggccgugagucaccgcaguguuggcaccggugggcccccgcaggagaaagcgggauuuaggcgucgugcccagagccccgggacccggacgccuggcacguuuuucggggaugcaggcacccagugucucacgcccugauuguggucccgcugucuuucucauccccaacuucgaggacuccagagcccccccuugccccaccugggcccucgaacauuuccuuacccagcacuuugagcaauuccucgaaguuuuccgaucggaugauuuuccaguugccagagaaguugggcaugguggcggcgcgggaggcgguccccguagacuccuaggcuggagcacuggacacugucuuuuagucaaaagagacgucgccgucgccgggucgucagguucuggaaccaagacaaguccagggacaaccccaaagcuggccugggcucccgcgcggacagcuuuuauacccuguacggaaccgccccugcccaggauugaaguggccccgccucccgcuccgcccccccccaccuggggggcccugcgcccccgccaccaaccucuggaucuagcccgcguguggguccaggcuucucuggggaccgagauagccuucuccugcgcuaguaaguggauggggaagcggacgcaaagccagcacuugaaucgcgcucuccgcagaggcggggggagcuagcugcgggcgcagaugcucagggcucguguauggcugucccccacccgaguuccucacgucucgccuguuccccacccauccccaaccugacucggugcauucaacuccuuggugccggacaccuggcgaccccacccgcaggcggaccccagaucuugagccguagcuggcccuagcuccauugaacccugaacuggauccagugggaccacuccguacucagagaggggcuugggagcugcgggguuccggggguuagggaucuaagugaggcaacggcgcccccugcuggaacaacucggagaggcugggcgggggcggca

SEQ ID NO: 19405 - RNA, 4153 nt, Homo sapiens
aaaugcauagcaccaggcagacaguaggagcucaguuuacagcaugaauggugggugcucuuauacucagaauuccaucugcuccucccagugccagacuccuuccucgaacccagagccuucucccauaguaucucuuuagccucuucugccuucuagacugucccugccuccagggacaccauacucaccuggccuuuuccaggagggccuccuagaccgaacgcaaguaagcacagcuucuccugagcccacccucuccucuacuuccuccccaccauuauuuguaaggaaacuccucucuuuacuccccaacauucuccaucccccuuccuuggcugccuccucccuucuucuucccagccucuccuuucugccuggcacgggcuuucccaccggaacucuuggcucagaaaucaguugggacaaagccccugucucugccagucuggccucuauccagccccucccuucccccacccuaccuuuugugaaagccuugggcuggaggguggacuaaggggggggagaauaaaugggaggggcuaccccuuccuaccccuggcuaucagaagcucuagaacccagaauauuccuccaaagaucucgaagcacuuacacucucauaaaaaggauguguugugacauugagaaauggagacugaggcucagagaaggauagggcugacccuggaucccuaguaaagccaagucaggcacgagggcaaugugcucccaggagagaagacucagagcuacaucaucuuuaaggguugggcuaaacuuagaagagcauggagauccagguaugccauggaauaggccaaugaugcagcaagagaauugaagguuagacuacaggcaggacuuccuagagaucagguuuauuccacuggcugugcacucccauuccaggcccacuguuuaucccccaucuucccugcccucucagcaucugccuucauaccugucccugcacuuuccuaagccugagaugaugggaaauuuccuacuuuucccagauccucccaccucccugccaucauaacccccaucucccccacugugucuggauaucauucccuagggucagaguugggagaggaguggcacaaccagaugcuuagggccucucucugaccuuucagagggaggagguucuugauggggccagauuagaggugcggagaccagcuccaggcauuggggugcuugggaggacuguucuggggcuggaguggggaccauugggcaggagcagccagugcccaccgggugcugggaagacuguuugccaugcaucugagcugugccagggccugggccuggcccccuucuggugcccucccucccuucucucugggcuggagcuggagcugcucacagaccuggcucccaucucucugacgggcagcccagagacccauauaguuggagucauuuuggggccaacacccuggaccacccuuucaccucugucugacagugggagagugagggaagagggccuaaggccaaugaggaccuaacugcucuggaacauggagggcaaccuacccuugaccccaaaaaugggagucacugaccagugaggccaagaggguagccccgugcaguucugagagagcucugucucuccagucucgggccucagccucccaauugcagcuaggagcccugaggaaacucagacuuccccacauccgguaccagccucagaacccagggguccaggguucuguggccuucucuaucccacacaccacucaucuccacuuccucuucucuuccuccagagcaggccacaccucuccaacucuaacccugagagcucagcagucaugcgguccguucccuugacgccacaacaucccccucucuguuucagcuccagcgucuguaucucugcccuuguuuugaauuucuugagcuguucaggaaacuuuccucuugucacaucauuucugucugacccgggauguccaucucccucacagucuucauagacccaacccagagaguuaagaccaggucucucucucucucucucucucucucucucucuguguguguguguguguguguguguguaggcaugcacguguguacacacaucuaacaacacccaccaccuccaugcugaaugcccaucagccggcagccaaggucugucccauaggaacugagcuccagcacucagcagggucagcagggaggcacaagaagccagagcuuuggcuauagcaggagggaagcucucugcuacccccuuaacggcuucaugaggagcaacaugagccuacacaauauaagcagggccuuagggccuguagaaguaauugcaaucaucauauaaauaguccuuuuuauuggaagcaaaacuaauaauacuauuagcaaugacaccagccgagcaguugcagaucccucucguauagaaucugaaauguggaugaugcuguuauaaauagcaaaguuagccauagcaacauaggcacugguaauacugugggugggucuaaggguaacacuguucccugaucuuacugucaucaucugcaaucuaaguaaugcagauaauaauggugccccuuggacuugacgccaaucucuugguccuauuagaaccauguaggcagagcuauuccaauaggugggggaauaccugacaggauauggaaauaccugggagagggaauucccaggccccuggcagugcuaggaaggaaugcaauagugguaaccgaauuccagcuaauaguuacugaugucuaccugagccaguucuccuaaaugcuuccuguggauaaccucaacugugagaaaaagauuguuuauguuuugcucauuacaccgaugaggaacccgagguucagagaagucaacuaacuaccccaaggucacagagcaaggagccgaguugggauuccagccgaaaugggcacuccgaccacccccuagagcggcucugaucggcuguccugccggacuacaguaagguguccccagaaggguugcuggccgcugcuccuggagcugccugugcgugggggcacggaggcaaggacugauccggaacgcuaccgcccugccugggacaaggucggaaaucucggcggccgcgcugggacaggagcgcgcagcagggaagaugcgaggacccgagggguugcugaucagacugcgagcagcaggggggcugccacuggcagagcuggaagcauguagaucagagauggcagcagcagcugcaggcgcucggggcuguccagcagccuaccccgcugcggugucaggagucgacgaguugggugccccagagccucgaggcaagggcugacaggcggggggcgcagaccaggcaggcacucccuucucccuguccccgaccccacggcgggcggcggggcugcggaggcacucaccuacccagggcugggguugggucgcggcacugcgaaguuugucgccuccuccgggggucuccuccgggugcacggcucaguccugcagcugcagcugagacugcggcggagacugcgcgagcgugaggagaggcuggggccgcaggacauucggaagagggcgccggcccucccggcgcagcacaaaacccccuuucuuccccccgccccugccccgcccuccccggggccgcccccgcccccuggucgggagcgcggggcucucgggacggucacgggacccgcugccuucucugcuucggcuccggcagcagcggcgagagcaaggacgagcgaaguaggacaucguucagcggaugagaagccgagggcuuggaguagggaggaggggcaggaggggcggggagggagcguucgcccagcguucgcugagcuaaaggaugacgauguugcagcuggagggguggaaguuggacaacuggagagucuucucguuguucaaagaagaaggaggagggagucaauuagacuguaagaaguggaugaagggagaaugggggcuuugcuccugaaaagagacacccuuucuaauaaaaaaaauggaaaacucuuuucuggaggcagaauggggugcaaaggaccguagcuaccucccuggaggcagcuaugauugggcauuggcuccuguggugcucccacucccugcacagaggaggagcugacuuugc

SEQ ID NO: 19406 - RNA, 4153 nt, Homo sapiens
gcaaagucagcuccuccucugugcagggagugggagcaccacaggagccaaugcccaaucauagcugccuccagggagguagcuacgguccuuugcaccccauucugccuccagaaaagaguuuuccauuuuuuuuauuagaaagggugucucuuuucaggagcaaagcccccauucucccuucauccacuucuuacagucuaauugacucccuccuccuucuucuuugaacaacgagaagacucuccaguuguccaacuuccaccccuccagcugcaacaucgucauccuuuagcucagcgaacgcugggcgaacgcucccuccccgccccuccugccccuccucccuacuccaagcccucggcuucucauccgcugaacgauguccuacuucgcucguccuugcucucgccgcugcugccggagccgaagcagagaaggcagcgggucccgugaccgucccgagagccccgcgcucccgaccagggggcgggggcggccccggggagggcggggcaggggcggggggaagaaaggggguuuugugcugcgccgggagggccggcgcccucuuccgaauguccugcggccccagccucuccucacgcucgcgcagucuccgccgcagucucagcugcagcugcaggacugagccgugcacccggaggagacccccggaggaggcgacaaacuucgcagugccgcgacccaaccccagcccuggguaggugagugccuccgcagccccgccgcccgccguggggucggggacagggagaagggagugccugccuggucugcgccccccgccugucagcccuugccucgaggcucuggggcacccaacucgucgacuccugacaccgcagcgggguaggcugcuggacagccccgagcgccugcagcugcugcugccaucucugaucuacaugcuuccagcucugccaguggcagccccccugcugcucgcagucugaucagcaaccccucggguccucgcaucuucccugcugcgcgcuccugucccagcgcggccgccgagauuuccgaccuugucccaggcagggcgguagcguuccggaucaguccuugccuccgugcccccacgcacaggcagcuccaggagcagcggccagcaacccuucuggggacaccuuacuguaguccggcaggacagccgaucagagccgcucuaggggguggucggagugcccauuucggcuggaaucccaacucggcuccuugcucugugaccuugggguaguuaguugacuucucugaaccucggguuccucaucgguguaaugagcaaaacauaaacaaucuuuuucucacaguugagguuauccacaggaagcauuuaggagaacuggcucagguagacaucaguaacuauuagcuggaauucgguuaccacuauugcauuccuuccuagcacugccaggggccugggaauucccucucccagguauuuccauauccugucagguauucccccaccuauuggaauagcucugccuacaugguucuaauaggaccaagagauuggcgucaaguccaaggggcaccauuauuaucugcauuacuuagauugcagaugaugacaguaagaucagggaacaguguuacccuuagacccacccacaguauuaccagugccuauguugcuauggcuaacuuugcuauuuauaacagcaucauccacauuucagauucuauacgagagggaucugcaacugcucggcuggugucauugcuaauaguauuauuaguuuugcuuccaauaaaaaggacuauuuauaugaugauugcaauuacuucuacaggcccuaaggcccugcuuauauuguguaggcucauguugcuccucaugaagccguuaaggggguagcagagagcuucccuccugcuauagccaaagcucuggcuucuugugccucccugcugacccugcugagugcuggagcucaguuccuaugggacagaccuuggcugccggcugaugggcauucagcauggaggugguggguguuguuagauguguguacacacgugcaugccuacacacacacacacacacacacacacagagagagagagagagagagagagagagagagaccuggucuuaacucucuggguugggucuaugaagacugugagggagauggacaucccgggucagacagaaaugaugugacaagaggaaaguuuccugaacagcucaagaaauucaaaacaagggcagagauacagacgcuggagcugaaacagagagggggauguuguggcgucaagggaacggaccgcaugacugcugagcucucaggguuagaguuggagagguguggccugcucuggaggaagagaagaggaaguggagaugaguggugugugggauagagaaggccacagaacccuggaccccuggguucugaggcugguaccggauguggggaagucugaguuuccucagggcuccuagcugcaauugggaggcugaggcccgagacuggagagacagagcucucucagaacugcacggggcuacccucuuggccucacuggucagugacucccauuuuuggggucaaggguagguugcccuccauguuccagagcaguuagguccucauuggccuuaggcccucuucccucacucucccacugucagacagaggugaaagggugguccaggguguuggccccaaaaugacuccaacuauaugggucucugggcugcccgucagagagaugggagccaggucugugagcagcuccagcuccagcccagagagaagggagggagggcaccagaagggggccaggcccaggcccuggcacagcucagaugcauggcaaacagucuucccagcacccggugggcacuggcugcuccugcccaaugguccccacuccagccccagaacaguccucccaagcaccccaaugccuggagcuggucuccgcaccucuaaucuggccccaucaagaaccuccucccucugaaaggucagagagaggcccuaagcaucugguugugccacuccucucccaacucugacccuagggaaugauauccagacacagugggggagauggggguuaugauggcagggaggugggaggaucugggaaaaguaggaaauuucccaucaucucaggcuuaggaaagugcagggacagguaugaaggcagaugcugagagggcagggaagaugggggauaaacagugggccuggaaugggagugcacagccaguggaauaaaccugaucucuaggaaguccugccuguagucuaaccuucaauucucuugcugcaucauuggccuauuccauggcauaccuggaucuccaugcucuucuaaguuuagcccaacccuuaaagaugauguagcucugagucuucucuccugggagcacauugcccucgugccugacuuggcuuuacuagggauccagggucagcccuauccuucucugagccucagucuccauuucucaaugucacaacacauccuuuuuaugagaguguaagugcuucgagaucuuuggaggaauauucuggguucuagagcuucugauagccagggguaggaagggguagccccucccauuuauucuccccccccuuaguccacccuccagcccaaggcuuucacaaaagguagggugggggaagggaggggcuggauagaggccagacuggcagagacaggggcuuugucccaacugauuucugagccaagaguuccggugggaaagcccgugccaggcagaaaggagaggcugggaagaagaagggaggaggcagccaaggaagggggauggagaauguuggggaguaaagagaggaguuuccuuacaaauaaugguggggaggaaguagaggagagggugggcucaggagaagcugugcuuacuugcguucggucuaggaggcccuccuggaaaaggccaggugaguauggugucccuggaggcagggacagucuagaaggcagaagaggcuaaagagauacuaugggagaaggcucuggguucgaggaaggagucuggcacugggaggagcagauggaauucugaguauaagagcacccaccauucaugcuguaaacugagcuccuacugucugccuggugcuaugcauuu

SEQ ID NO: 19407 - RNA, 2520 nt, Homo sapiens
gggugggggccggggcgggaccaaagcccagccaacuggggggucucgaggcgggacuggcggggcuggggcccggcuucgggaccggaguuccuugaagguggugacuucccgaggaggugccgaggagccgcccggcgaccccgagggggggagcucggugucgggcgagaagacuaugagccagucacugcgaucuuucuucgccugcgggacaaggggcagcccugggccccgcuugcgcuucugggccagcucguggaaggacgugauuguccgguggggcaccggcuccucgcugacgucacuucuccauccuccaucaauuuucccugcaucuguuuucgagccagaaucaguuauucuuguguugguuuuccaaccagagucgaauuuuucagguucacuuuuccagcuagaguuaacauucccguuguuuuuccaaccaguguuauuguuuucagugguuuuccauucagcuuuaguuuucucugugucaauuuuccaaauuggguuaaucuuccaacugggcuccguuuucccagcgucgauuuucccaucauccgccucuaagagcucagagguagggagauccugcuccgcccucucguccucuuccuccaagccuggggaagggacguccuggcagguggucagggcguugcaguucgaguccaggccaggaucgggugaagaagaagcuccggagcaggaaucaggagagcagcagaagcuguccggugagcaggugccagggccugcugaagccaguggggagcccugcuccagggggaugauacugggcugagggugggcauccucaucaccagggaggucccgcaaguagacugagacaggggacucaucggggcuaagaucugagcaggagcugagugaggaggagcagccugggucugagggagaggcagcccccucuuccuccugugacggguccugccgguuuucuaggcccggaccgugcuccuggcagcaccggcagggcacagcugggcuguuggaauuggcguccaccagggugccacugcaggggccccugcucuccuugcccccagugucuccuggaggagggggugugcucaaaggccccuccuguagcucaggacggcgggacaagugcaggcccagggagacgugcuggagguggaugugguugagguugcagaguaaagcucucugaggggacagcaugaugcuagcggcgaugggauggcuucuagagaaccagaaggguagggucucucacauccaccuaccuggcaaccacaggugcagaccuagaagacagagguggugaagcccggccagugaggacaagagcugcggggaaggacaccgaggugacuugacggcagcagcaggccugaaggcucuggcugcuuuggaagauauuucaaugagaugcaaaucgcaaucgacugaccauuaguuuccacugcaguguuugcagauggagucgaauguaaccccccgggaauggagccgggagggucagagaacgcggcugcgcucuggaucuccgaaggggggcgggggccuggaagagguccgggcccagaauggaccuccaggucccugcugccgcaaucuggcccugcccuccagccuaccccuuacucccagaggaagggacccagggagacccacccagaugcccugaaaggagguggaggauggggguggggcaauacgcagaguuugucuggugaaugcaggaaaggggugggggcuggagaggaaaaggauggagcagccgucagcuugucaacuccgcaucugcuggcugccucggccgggcuccagccugcgcccucgccccucggaacagcgguauguccauucucuccgcauucgucuccaucguucagccaccaccgcacccuuucucuauucauuucuccugcucccuuguccugccccgccccucgugcccagguccaucggucuacacccaugggccgagcccuccucaccaggguccuccuggaaccgcuccggccuugggcuuguccgcggcucccacgguccccgcccggcggggcacagagcgggaggggaggggcacuagcacaaccuacccugcgcugcgcagcugcaccccuucgcgcaugggcguggcguagcucagacccgcccccagcguuuagcgucuuuugucacccaccuagaggguuugauauauccuaagcuuuuggccccuggguccugguuccgugcagcgaguccucccagcaccccacccugcacauucuggaaagagccagacucuggcugggccgagcaagaacagaaccacaagaagguuacacgauuauuuauugagagccuccucuccccgcccuugcaaucucuaggucacuuucuccgcuuguagauuuugcgcgcaagccccagaaagacggcugggggcaggggugcugcguacuguucaaugagagccauaauguggcuguaacugucuuccucauauugcaagaacacugcuggcagauccagcuccuc

SEQ ID NO: 19408 - RNA, 2520 nt, Homo sapiens
gaggagcuggaucugccagcaguguucuugcaauaugaggaagacaguuacagccacauuauggcucucauugaacaguacgcagcaccccugcccccagccgucuuucuggggcuugcgcgcaaaaucuacaagcggagaaagugaccuagagauugcaagggcggggagaggaggcucucaauaaauaaucguguaaccuucuugugguucuguucuugcucggcccagccagagucuggcucuuuccagaaugugcaggguggggugcugggaggacucgcugcacggaaccaggacccaggggccaaaagcuuaggauauaucaaacccucuaggugggugacaaaagacgcuaaacgcugggggcgggucugagcuacgccacgcccaugcgcgaaggggugcagcugcgcagcgcaggguagguugugcuagugccccuccccucccgcucugugccccgccgggcggggaccgugggagccgcggacaagcccaaggccggagcgguuccaggaggacccuggugaggagggcucggcccauggguguagaccgauggaccugggcacgaggggcggggcaggacaagggagcaggagaaaugaauagagaaagggugcggugguggcugaacgauggagacgaaugcggagagaauggacauaccgcuguuccgaggggcgagggcgcaggcuggagcccggccgaggcagccagcagaugcggaguugacaagcugacggcugcuccauccuuuuccucuccagcccccaccccuuuccugcauucaccagacaaacucugcguauugccccacccccauccuccaccuccuuucagggcaucugggugggucucccugggucccuuccucugggaguaagggguaggcuggagggcagggccagauugcggcagcagggaccuggagguccauucugggcccggaccucuuccaggcccccgccccccuucggagauccagagcgcagccgcguucucugacccucccggcuccauucccgggggguuacauucgacuccaucugcaaacacugcaguggaaacuaauggucagucgauugcgauuugcaucucauugaaauaucuuccaaagcagccagagccuucaggccugcugcugccgucaagucaccucgguguccuuccccgcagcucuuguccucacuggccgggcuucaccaccucugucuucuaggucugcaccugugguugccagguagguggaugugagagacccuacccuucugguucucuagaagccaucccaucgccgcuagcaucaugcuguccccucagagagcuuuacucugcaaccucaaccacauccaccuccagcacgucucccugggccugcacuugucccgccguccugagcuacaggaggggccuuugagcacacccccuccuccaggagacacugggggcaaggagagcaggggccccugcaguggcacccugguggacgccaauuccaacagcccagcugugcccugccggugcugccaggagcacgguccgggccuagaaaaccggcaggacccgucacaggaggaagagggggcugccucucccucagacccaggcugcuccuccucacucagcuccugcucagaucuuagccccgaugaguccccugucucagucuacuugcgggaccucccuggugaugaggaugcccacccucagcccaguaucaucccccuggagcagggcuccccacuggcuucagcaggcccuggcaccugcucaccggacagcuucugcugcucuccugauuccugcuccggagcuucuucuucacccgauccuggccuggacucgaacugcaacgcccugaccaccugccaggacgucccuuccccaggcuuggaggaagaggacgagagggcggagcaggaucucccuaccucugagcucuuagaggcggaugaugggaaaaucgacgcugggaaaacggagcccaguuggaagauuaacccaauuuggaaaauugacacagagaaaacuaaagcugaauggaaaaccacugaaaacaauaacacugguuggaaaaacaacgggaauguuaacucuagcuggaaaagugaaccugaaaaauucgacucugguuggaaaaccaacacaagaauaacugauucuggcucgaaaacagaugcagggaaaauugauggaggauggagaagugacgucagcgaggagccggugccccaccggacaaucacguccuuccacgagcuggcccagaagcgcaagcggggcccagggcugccccuugucccgcaggcgaagaaagaucgcagugacuggcucauagucuucucgcccgacaccgagcucccccccucggggucgccgggcggcuccucggcaccuccucgggaagucaccaccuucaaggaacuccggucccgaagccgggccccagccccgccagucccgccucgagaccccccaguuggcugggcuuuggucccgccccggcccccaccc

SEQ ID NO: 19409 - RNA, 2578 nt, Homo sapiens
cggcugccgcagugagggagccggggagcccgggcgcagcggcaacaaaggcccgggaagcgaggcgggggcggcggcagccuccuggcccggugugcgcccccuccuaccucugccggcccaggcccgcacggaguagagaggacagaaaggaggcucccggaacccgggcucccccacccgcucccugagcuuucaccugcgcccagguguaugcgggggaggggaaccugaucaacaccuccccccaccaaaccuauucccgcauccuccccggcucuggcuuccccuaagaacgcugaggugcuccaaggguggcggggaacccggggccccucaccugcgagcucuccguuccccgccagacucuagcgggguggggggcggacgugugagucugggggagggggcugagcuagauagagcuggaaagucagcccccagcgccccccggaguucuuggagucccgcuccgggggggaggggccacguccccacccccgagguuuccaugggaagcgagaggggggcgucguuggcucauccccacccccagucugacacuccgggcgcgaggagggagagagggggaggcgcggagccccaaacaacaaagagcggagcggcgagcggcagccccuccuccgagagguugggggucgcggccgcccggcccucccgguccccuccccuggggucuggccauuugcucccuggucggucggucccuggggugggcagccagaggcagugcugccgccaccgcccgggcaggugugacagugacccccgcguccccagggaucucccccuacuaacacacagacacacacugauguggccagggagauacacacggcggcuuggcggggaggagaagacaagggcagcaaggacugagcagaaugaggacccggccccgcagccagcacccggccaccgcgccacacaccccgggaaaccacacggccgcccugacacccgcccagaccgcggcggcgccaacagccaccccagcccagacgcagcuggccgcgcggacagcgaccgcagccccuuccccgacccgcagcccgcucccacccccagacgaucgccgacgcagacacacaaaucacacacucagacacacacgcacacugacagccgcgcacgcccgcucacacuuggagccauucgccguccccagcccgggcgugugugugcgugugugacacaccgacaucucucugccgccuuccgucucgccgguaccccacguucccauccuaaccaagcagcauucccagggccccccaacucagcgacccagcccuagcucacccuagccgggcuuauccacacaaccaagacaacccauucgccuuccuucuagggaggugcucggucggacucccugccucagcucuggaccccacuuuuaaaagcaggaguccuagacagaaccccuggaagcccucauggccaaaaacaggucaucccugggccccaaaaugcagcggccuauccccagcacagcgcuacccccaaaccccagcccaacuggugggacuaugggacaggggcaugcuauuccagcggcgggugcggagagaagccaagaugggguggggggccccuccagcagccuccuccacacggcccgagcgcuccuuacuauagcccaacagccucuucagacacccccgaguuuccuagacgcccacagagugcgucccccucuccguccccucccagcccccagcucuggucucccaggacucccaccccgggaucccccaggacuucucgggcccaccggcucccccucucacugagacgggacgcgcggacucccaggguccccgacucacugcugguuggagcuguuccaguacaccgcaugccgguuucccagcgccccuccgggcccuugggccagcagcggcagcagcggcacgggcacgagcagcagcagcagcagcagcggagccgccgccauccccggagccgccgccgccgccgccccccgacugagccccgcgcucccggcuucuccgcuucccagcucccugcugccgccgccgucggcccccagccuuaggccacgcccccagcccuucccuccgcccuccugggcgcgcccccgaagccccgccccuggcgcgcccccgacaggccccgucccgcuccggucgggagcgcgcgacgcgugggagguggggaccguacugcccccucgggaaagaccagcgcgugccucgucucuccuucuugaguucaguuugcuacaacugguccugggucuuuugcuccccaggcugaauuucccagaaggauuugggaacccaagauaaggaucucgaucucagggaagcccaaucaucucugggaaugaggggaaggagaagacuugagaagaaguuggggauccaggaccucuuaguaaguagggcuggaccccuucccuucugaaaacuguggcccucugcugcguccaugcccccuuuucccgugugcaugaggacucaggugggcacagaagggugguggagaaguccucagcuggcaccaaggcuuugacagcuggugaccugaa

SEQ ID NO: 19410 - RNA, 2578 nt, Homo sapiens
uucaggucaccagcugucaaagccuuggugccagcugaggacuucuccaccacccuucugugcccaccugaguccucaugcacacgggaaaagggggcauggacgcagcagagggccacaguuuucagaagggaagggguccagcccuacuuacuaagagguccuggauccccaacuucuucucaagucuucuccuuccccucauucccagagaugauugggcuucccugagaucgagauccuuaucuuggguucccaaauccuucugggaaauucagccuggggagcaaaagacccaggaccaguuguagcaaacugaacucaagaaggagagacgaggcacgcgcuggucuuucccgagggggcaguacgguccccaccucccacgcgucgcgcgcucccgaccggagcgggacggggccugucgggggcgcgccaggggcggggcuucgggggcgcgcccaggagggcggagggaagggcugggggcguggccuaaggcugggggccgacggcggcggcagcagggagcugggaagcggagaagccgggagcgcggggcucagucggggggcggcggcggcggcggcuccggggauggcggcggcuccgcugcugcugcugcugcugcucgugcccgugccgcugcugccgcugcuggcccaagggcccggaggggcgcugggaaaccggcaugcgguguacuggaacagcuccaaccagcagugagucggggacccugggaguccgcgcgucccgucucagugagagggggagccggugggcccgagaaguccugggggaucccggggugggaguccugggagaccagagcugggggcugggaggggacggagagggggacgcacucugugggcgucuaggaaacucgggggugucugaagaggcuguugggcuauaguaaggagcgcucgggccguguggaggaggcugcuggaggggccccccaccccaucuuggcuucucuccgcacccgccgcuggaauagcaugccccugucccauagucccaccaguugggcugggguuuggggguagcgcugugcuggggauaggccgcugcauuuuggggcccagggaugaccuguuuuuggccaugagggcuuccagggguucugucuaggacuccugcuuuuaaaagugggguccagagcugaggcagggaguccgaccgagcaccucccuagaaggaaggcgaauggguugucuugguuguguggauaagcccggcuagggugagcuagggcugggucgcugaguuggggggcccugggaaugcugcuugguuaggaugggaacgugggguaccggcgagacggaaggcggcagagagaugucggugugucacacacgcacacacacgcccgggcuggggacggcgaauggcuccaagugugagcgggcgugcgcggcugucagugugcgugugugucugagugugugauuugugugucugcgucggcgaucgucugggggugggagcgggcugcgggucggggaaggggcugcggucgcuguccgcgcggccagcugcgucugggcugggguggcuguuggcgccgccgcggucugggcgggugucagggcggccgugugguuucccgggguguguggcgcgguggccgggugcuggcugcggggccggguccucauucugcucaguccuugcugcccuugucuucuccuccccgccaagccgccguguguaucucccuggccacaucagugugugucuguguguuaguagggggagaucccuggggacgcgggggucacugucacaccugcccgggcgguggcggcagcacugccucuggcugcccaccccagggaccgaccgaccagggagcaaauggccagaccccaggggaggggaccgggagggccgggcggccgcgacccccaaccucucggaggaggggcugccgcucgccgcuccgcucuuuguuguuuggggcuccgcgccucccccucucucccuccucgcgcccggagugucagacuggggguggggaugagccaacgacgccccccucucgcuucccauggaaaccucggggguggggacguggccccucccccccggagcgggacuccaagaacuccggggggcgcugggggcugacuuuccagcucuaucuagcucagcccccucccccagacucacacguccgccccccaccccgcuagagucuggcggggaacggagagcucgcaggugaggggccccggguuccccgccacccuuggagcaccucagcguucuuaggggaagccagagccggggaggaugcgggaauagguuugguggggggagguguugaucagguuccccucccccgcauacaccugggcgcaggugaaagcucagggagcgggugggggagcccggguuccgggagccuccuuucuguccucucuacuccgugcgggccugggccggcagagguaggagggggcgcacaccgggccaggaggcugccgccgcccccgccucgcuucccgggccuuuguugccgcugcgcccgggcuccccggcucccucacugcggcagccg

SEQ ID NO: 19411 - RNA, 2812 nt, Homo sapiens
uguaccugcggauuuccccucucagccaacuccagccucugcucccccucugcuccucacuucucuaaagcgaaacaucucacagucauuugcuccaugcuuccuguacgauuucuuuauuuuuacucuccaguuugugggcugagucugugugggugugggagaggggcuggguauuucuacuucucugcauuuuccuucugagcugggaggacuuucacuuccuccccagucucucaguucugccuuucaugggcuguucaggccaugagaccaccucuccuaauccuuccugagcaccagggaaauggaaaacugacuguaacuggcugcccuggaagggccuagcauccacucaggagcaacaggugguggcaacuacagcaguaacaguaaccucccuggggcaggagccuugggcuggcgugacagcagcagaggcagccaagggagcccugcuugcuccugaggccauccgagcccuggaaccugucuugcaucccucuaacaccaccaugggcaagccugggccuccacuucccucccucagccuuuucugucccagcacucagccagacaagagugacucucagcuugccccaaugcccccagcucugccugcugaucuaguucuauauuugagagucuuagacaucuaccacacuggagcacagagccacgggagggguuggccuccaucaccggggccugacaaccugccaucccgccaucccaaccucccugaaccucagucuccucuuucaaacaaaguuauauguagauacaguggaggauuagaaaacauugaaugggugccccaaucaacagugucuguuacuggcaggaguuauaaauguguauugaaaauggaaucccuucuuuuuuucuuccaaucauaaggaccacaaccauccaaaaagcaaagagagccucagacacuccagcucagccucuaguugcagaaagucaccuccucaaagggagagaucaguguucaccuaggacuggaauucagugugaucuagugguugaaagucuuagccuucagccuccccagccugucagcuguuccagaagccugucagcugccccuuaguuuucugcuguguccucaaagaagcacugggacccuaaaauaaaccucuggagagccaguugcccaacucuuccagaagagagacuagacacgcagcugggcaugcggccagagcccaagaaaagccugguuugccaggggcagauuacagucaacgggagcaguaagugccucugcccucucccucacggguccuucucuuuucuagaggggaguccagcacgugccagccccaggaggucucacucccuugccagccucccgacucaauucccaggacuggggcacuuggcuucccagaguugguggcugccaaagugacuccgugcagcgggaagauccgugacucagcgcccgugaugucagucccuucauagucagggcacugucauccacacaugcacccgcggggguggggggaggaccaggcgagguggacccccaaugcagagggagaagaggggcgcugguacaaaggacuccccaggcggguacaucaccccgcuggggcgcgcccucucgggcagucuccccuuagaguaaccugggacgcgguuguguaaaggcuccugggggcacugggaaggaagcucgagagucagguuugcaaggacacaguccuguacacagaccgcaggguucccgcacagcuucaccgggcauuccggggagcgcuccggaccaagggagcaagcgcagcagggggcgcaagagccacuacccgcgaccacacagcuagguacccgcggggccucaaggcagccacagaaaaggggauccgucgcaccuccuuuccucccuccagccucccacagacugcggugaccaaggcgguuucccccagccgcuagcugccccagcccuccaggugcgcccgaagcccuuacccugcgcagggcagcgccuuggggccagcgccgcucccggcgcggccagcagggcagccagcagcgcgcagccgacggccagcaugcuuccuccucggcuaccacuccauggucccgcagaggcggacaggcuaaugggaaccgggcggcagggguggcaggggcggggcggggcggugggcgggcaggcgggcucaggccccgggggcagcccccauccgcaggagcccggcucucuacacacacugcgagucccucggccccgcgccgcgcucggcuccucucccucuggcccggcucagugucagugcgacuucccacucgcacaugacucagagcggcggacgguccuggcaacgcaggaaaacauuugaggaacucgcgcuggagcgucucugggccgucccagggugcgguuacgaaagccggagcggauggcgcaacagccccgcgcaccggccgaccgaggggguggcuuccugccacagcgccgcaccugagcggggagaacaggggaccgccagccccaccagagcccuuccucccgguucuguugaugagaaaagggcguaucagccaccagugggcaguggccuaguuuugauuuuugguuucgugaacgggauuacgcugugaaaggcacaccuggagagcccucgaggaggcgauguuccucuuacccuuaggguaaaacagugcuugguagcccgguugcccacuggaaucagccaggagcccuaaaacccaccaaugucugggucgggucuccagagauucugauuucaucggucuggggugaggcuugggcaucggaagacucaccaccgua

SEQ ID NO: 19412 - RNA, 2812 nt, Homo sapiens
uacgguggugagucuuccgaugcccaagccucaccccagaccgaugaaaucagaaucucuggagacccgacccagacauugguggguuuuagggcuccuggcugauuccagugggcaaccgggcuaccaagcacuguuuuacccuaaggguaagaggaacaucgccuccucgagggcucuccaggugugccuuucacagcguaaucccguucacgaaaccaaaaaucaaaacuaggccacugcccacugguggcugauacgcccuuuucucaucaacagaaccgggaggaagggcucugguggggcuggcgguccccuguucuccccgcucaggugcggcgcuguggcaggaagccacccccucggucggccggugcgcggggcuguugcgccauccgcuccggcuuucguaaccgcacccugggacggcccagagacgcuccagcgcgaguuccucaaauguuuuccugcguugccaggaccguccgccgcucugagucaugugcgagugggaagucgcacugacacugagccgggccagagggagaggagccgagcgcggcgcggggccgagggacucgcaguguguguagagagccgggcuccugcggaugggggcugcccccggggccugagcccgccugcccgcccaccgccccgccccgccccugccaccccugccgcccgguucccauuagccuguccgccucugcgggaccauggagugguagccgaggaggaagcaugcuggccgucggcugcgcgcugcuggcugcccugcuggccgcgccgggagcggcgcuggccccaaggcgcugcccugcgcaggguaagggcuucgggcgcaccuggagggcuggggcagcuagcggcugggggaaaccgccuuggucaccgcagucugugggaggcuggagggaggaaaggaggugcgacggauccccuuuucuguggcugccuugaggccccgcggguaccuagcuguguggucgcggguaguggcucuugcgcccccugcugcgcuugcucccuugguccggagcgcuccccggaaugcccggugaagcugugcgggaacccugcggucuguguacaggacuguguccuugcaaaccugacucucgagcuuccuucccagugcccccaggagccuuuacacaaccgcgucccagguuacucuaaggggagacugcccgagagggcgcgccccagcggggugauguacccgccuggggaguccuuuguaccagcgccccucuucucccucugcauuggggguccaccucgccugguccuccccccacccccgcgggugcauguguggaugacagugcccugacuaugaagggacugacaucacgggcgcugagucacggaucuucccgcugcacggagucacuuuggcagccaccaacucugggaagccaagugccccaguccugggaauugagucgggaggcuggcaagggagugagaccuccuggggcuggcacgugcuggacuccccucuagaaaagagaaggacccgugagggagagggcagaggcacuuacugcucccguugacuguaaucugccccuggcaaaccaggcuuuucuugggcucuggccgcaugcccagcugcgugucuagucucucuucuggaagaguugggcaacuggcucuccagagguuuauuuuagggucccagugcuucuuugaggacacagcagaaaacuaaggggcagcugacaggcuucuggaacagcugacaggcuggggaggcugaaggcuaagacuuucaaccacuagaucacacugaauuccaguccuaggugaacacugaucucucccuuugaggaggugacuuucugcaacuagaggcugagcuggagugucugaggcucucuuugcuuuuuggaugguugugguccuuaugauuggaagaaaaaaagaagggauuccauuuucaauacacauuuauaacuccugccaguaacagacacuguugauuggggcacccauucaauguuuucuaauccuccacuguaucuacauauaacuuuguuugaaagaggagacugagguucagggagguugggauggcgggauggcagguugucaggccccggugauggaggccaaccccucccguggcucugugcuccagugugguagaugucuaagacucucaaauauagaacuagaucagcaggcagagcugggggcauuggggcaagcugagagucacucuugucuggcugagugcugggacagaaaaggcugagggagggaaguggaggcccaggcuugcccauggugguguuagagggaugcaagacagguuccagggcucggauggccucaggagcaagcagggcucccuuggcugccucugcugcugucacgccagcccaaggcuccugccccagggagguuacuguuacugcuguaguugccaccaccuguugcuccugaguggaugcuaggcccuuccagggcagccaguuacagucaguuuuccauuucccuggugcucaggaaggauuaggagagguggucucauggccugaacagcccaugaaaggcagaacugagagacuggggaggaagugaaaguccucccagcucagaaggaaaaugcagagaaguagaaauacccagccccucucccacacccacacagacucagcccacaaacuggagaguaaaaauaaagaaaucguacaggaagcauggagcaaaugacugugagauguuucgcuuuagagaagugaggagcagagggggagcagaggcuggaguuggcugagaggggaaauccgcagguaca

SEQ ID NO: 19413 - RNA, 2372 nt, Homo sapiens
gaauaaagccacugagcuguaaacucauauguaaauucuucuuuucuggucccauuagcucuagaggaaacuccucaucaccaggaggcucugcucccuacauucugagaugguuagggaagggugggagucagggcagggucuacucuagauugaggguggugggugggcacaggcagccaggcuggcagggacaggaugaaagugaagcauuguguguagagaagagagcugccagcugggucacaugccaggcucucgugcaguccugucugacgcaaaggcugagggucugcagguccagccccucccuacggccaaacugccucaagaagaaaacgaaggccuucaugguuuaugcugcaauauucauacuacuagaaacucuggagaaaaauccuaaauuccuuccucucucugucucuuauucccuuaaauuccucaaacuugugagauguccugcucuuauccuugaccuauucugcuagcccaagggagagcuggaggcagccucucauuuuaccauaucugugggaccccccaacaacucaaacucccuggucuguaaaggugccuguccacucuggucagagccucaacacacuuauucugucucuuccuccucuuucccucuuuuuuucuuucuccucagaugagauuugugacucuccauuuggcugccugccugcccccauccucucugcauuugccuucugcucucuggacacccaccucacccugcucuuuccacaaaccucaguuacacaccuaguaugugcuggacacugugcuaggcacaggaaacacaaaaaugaggucuaggaguuccuggggacacuccuggagcgcuucagccuguucucccaagaaucccuccucaucuccugggagcuccugaaaguccuuuguaaacuguaaaaugucaaacaaauguugacucuuacugccacuuucagaggauaacuggggaguuagucgcuccacagaaugaagagggaaucuuggccaaaaggggaugaauuggagaucagggucugaguugggcaggaaguauucuucccccuacccccaucuauccaucuuuuuacuccaggccucuuugacucccuauuuggaggaguuuguaaauaaagaaguccaggaguccugccugggaccagggcagugggggaaagagcucuggagaaaaucuguagccugcaaagagauuccagcacuugcauguguacacacucugccugccugccgcuaguucuccccgaccuccaauaacaacaaggcuggagagacaaaagguaaagaagggaaguggucuccuccacaccccacucuuuuuuccucaucucugagccuauuauuccagccucuaggcuuccuuucacaccucuccuccccccauuaagcacaccuggcgacaugugaacaucagcacaaauccacacacagacauuuaguuguaccuacccccaucugcagccaggauccaaaucaccuccagcaggagggcggagaacaacauagugucccaggaaggggugcaggggacugggaauuugaggacuagaggacuaggacaggcagagagagagggagggaggagugagagagagagagagagagcgagcgagcuccuggcgugaguguauuuaucucugcuucucuugcugucucugucucugugggcuuccaggggauucgguguucaguaggguaucauggguuucuggauccccaggacaaaucucuugcugccucuuugcccucucucuuuaucucccucugcagucuccacuccacuagcuggccagcgacuuuacaacugccuccugcuuuuaagguggcucugaacugguguauguggggacgggggugcugccugggcugcuggugaacagcuccuuaaauagccaauuaggcaugcaggauggccccacucggagcuggagcgcggcaaguuucacuggagcccuggcccuggcucaggagcccagcuggggugagcucuuccuuccucugcuagucacacagaugcuguuuagauggguguucccuggagcaggcagggucaaggaaggggcuuugggguucaacucagcccccucaaaaggacacuguauuuucauccccccgccugauuucuccucugaggagcagcucccugggugguaugcggcagaugguggggguaccuguucccaauucccugcauaaucugagcugcccuggaaugggaagaguccagaauuaggagauauauaacaagaaggaauuagggacucagggugcaggggagggguggaggaagucaauaacuaaaaccugaguuguguccuaaguucuaaggaagagaagugaggcaaggagaacucauc

SEQ ID NO: 19414 - RNA, 2372 nt, Homo sapiens
gaugaguucuccuugccucacuucucuuccuuagaacuuaggacacaacucagguuuuaguuauugacuuccuccaccccuccccugcacccugagucccuaauuccuucuuguuauauaucuccuaauucuggacucuucccauuccagggcagcucagauuaugcagggaauugggaacagguacccccaccaucugccgcauaccacccagggagcugcuccucagaggagaaaucaggcggggggaugaaaauacaguguccuuuugagggggcugaguugaaccccaaagccccuuccuugacccugccugcuccagggaacacccaucuaaacagcaucugugugacuagcagaggaaggaagagcucaccccagcugggcuccugagccagggccagggcuccagugaaacuugccgcgcuccagcuccgaguggggccauccugcaugccuaauuggcuauuuaaggagcuguucaccagcagcccaggcagcacccccguccccacauacaccaguucagagccaccuuaaaagcaggaggcaguuguaaagucgcuggccagcuaguggaguggagacugcagagggagauaaagagagagggcaaagaggcagcaagagauuuguccuggggauccagaaacccaugauacccuacugaacaccgaauccccuggaagcccacagagacagagacagcaagagaagcagagauaaauacacucacgccaggagcucgcucgcucucucucucucucucucacuccucccucccucucucucugccuguccuaguccucuaguccucaaauucccaguccccugcaccccuuccugggacacuauguuguucuccgcccuccugcuggaggugauuuggauccuggcugcagauggggguagguacaacuaaaugucuguguguggauuugugcugauguucacaugucgccaggugugcuuaauggggggaggagaggugugaaaggaagccuagaggcuggaauaauaggcucagagaugaggaaaaaagagugggguguggaggagaccacuucccuucuuuaccuuuugucucuccagccuuguuguuauuggaggucggggagaacuagcggcaggcaggcagaguguguacacaugcaagugcuggaaucucuuugcaggcuacagauuuucuccagagcucuuucccccacugcccuggucccaggcaggacuccuggacuucuuuauuuacaaacuccuccaaauagggagucaaagaggccuggaguaaaaagauggauagauggggguagggggaagaauacuuccugcccaacucagacccugaucuccaauucauccccuuuuggccaagauucccucuucauucuguggagcgacuaacuccccaguuauccucugaaaguggcaguaagagucaacauuuguuugacauuuuacaguuuacaaaggacuuucaggagcucccaggagaugaggagggauucuugggagaacaggcugaagcgcuccaggaguguccccaggaacuccuagaccucauuuuuguguuuccugugccuagcacaguguccagcacauacuagguguguaacugagguuuguggaaagagcagggugagguggguguccagagagcagaaggcaaaugcagagaggaugggggcaggcaggcagccaaauggagagucacaaaucucaucugaggagaaagaaaaaaagagggaaagaggaggaagagacagaauaaguguguugaggcucugaccagaguggacaggcaccuuuacagaccagggaguuugaguuguuggggggucccacagauaugguaaaaugagaggcugccuccagcucucccuugggcuagcagaauaggucaaggauaagagcaggacaucucacaaguuugaggaauuuaagggaauaagagacagagagaggaaggaauuuaggauuuuucuccagaguuucuaguaguaugaauauugcagcauaaaccaugaaggccuucguuuucuucuugaggcaguuuggccguagggaggggcuggaccugcagacccucagccuuugcgucagacaggacugcacgagagccuggcaugugacccagcuggcagcucucuucucuacacacaaugcuucacuuucauccugucccugccagccuggcugccugugcccacccaccacccucaaucuagaguagacccugcccugacucccacccuucccuaaccaucucagaauguagggagcagagccuccuggugaugaggaguuuccucuagagcuaaugggaccagaaaagaagaauuuacauaugaguuuacagcucaguggcuuuauuc

SEQ ID NO: 19415 - RNA, 2649 nt, Homo sapiens
ggcaaaauaaagcccagaguacucugucaauuucacuuuuuaaccaggcccacuguagcauugaaacuggcucuaaaaaagcauaguaucaauaugccuagucccucuuuccugugcccuucccagcaggagacagcuggcuccaugaccagucagaugguccugacucauaggacaccagauauccuaggcugaggucauuccauccuuuccucugucucuguaccuaaaagcaaggaucaacuacgcuuuugcccccagacucugcucuuugggcaaauacaaacaagcaauggaugucuuauuccucuuacccuuucacuauuauguuuuucucuuugauguguaggaaguucucccugauucguaacuagaguuuccugcaauuaagaaguucggggaagacaggagauacacuuugacacuuguuuuuuuuuuuuuuuuuuuuuuuuuuuuaauuagaaagccagaaaauuguggagaaaacuuucuggaggauuugugauugggcagagguaacucuuaaaaauaaauccuccuggccaggcacgguggcucacaccuguaaucccagcacuuugggaggcugaggcgggugguucacuugaggccaggaguuuugagagcagccuggucaacaacgcgaaacacugucucuacaaaaaauacaaaaacuagccagacaugguggcacccaccuguagucccagcuacuccaaggaugaggugggaggaucacuugagccugggagguggaagcugaagugagcugugauugagccacugcauuccugccuggaugacagaccaagaaaagugcccucaccucacuccuaagacuuuccaucaccaacuugcuaguuuuguguaaacagcuagguuucaauacccuuaagagggaucucuuuggcuguggcacagcuuaguucuucccuagaugccucaguagauguucuuuuagaugaguacuuugucucaggguguguguguguauguuucaauaccauaaaagguuuuauuuaccuaaauauaaucuacugaauaaggaugucuacugcagaaagcagaagagguuagaacucagggaggacuucccaguuagcccugggugagggaacacagaauaccucccgugagggcgggaggaagggccacucuaaccgguacacaggacagucuuccaggcuauacugacugccuuuggacagucacagaggcagggaauggaaugacuucuaaccacuguaggggcaauucugauuucuccacauuaguacacguuauugaucccaagacuuagggaaaaaagggagaugggucuggauucaauuaucauagcucaggucuugacacaguguagacugugguuuucaugguuaacuacacagccaaagcuauccaaagacauacagggguucuuaacuccauuucucucccuucugauacaaauggaggggugggcaggaaguggguagaaaauggguuccuugccuuuuuuaaaugggguggggguggggaacagagagcauacugguuagggacacuggcuucaacgaaaauaacugccacucacacacccgaggucacaggggccugacggcggggugcguguuuucugugauucagggcggaugcgccacggacaggaccugugcacgcuccugccacagacaggaaaggggaggcuggcuggguuaagguggggggacaggaagggguggcgaauaggcuaaacuguuucagcagaaauagaaaagaaauccuauaugcaggaggccagguuagggugggaggcagcaagggacacuuagaacuucuggggcaucuugggaggggcuuaucguuguuagaaagguauuugcaaacaaaaaaacacugaguaagcggccaacucaacuucuaauucucacucuggucuucucauuaaaggguggccuuucucugcagaugagauggggguagagaggagaccacugaacuugccuuuggaacaaaacggggguggaguaagcuaggcgagcccuuggggagugacaaagugggggcuaugagaaaacggagaguuagaggcaagaggcacccaccuccuucucagagauguagagcugguccccuuucagcaccacauagcgguuuuuccaaaucucccugaaaaucccuuucccgcagaauuuccggacccagccgaccuucucgggcggugcaggcugcugguuuccauccugaggucccugccccaggacaagaugagaagcgggcgguuaggagauuccagccggcgcuuccucuccguccgucucucacgaccgccucggcggcccagucuccuccgaaggcugcggccggggggcggggggccgccccagguucgcucccacuucggaaagguuuucacuccgaggaacuccccccgcuccccucccccgcucccgaauaaacaaccggggcugcaaguggcaggggcgccggccgggcgcggagaggcucccagguucccuccaggcccugcgcccccgccgccccguccucgccgcgcggggacuaacggcguuucucugguuuucucucccauugucuccucgccacggcggagcgcgaggcaaacgcucgcccggcgcccgggggcgggggaggugcgggucgugggga

SEQ ID NO: 19416 - RNA, 2649 nt, Homo sapiens
uccccacgacccgcaccucccccgcccccgggcgccgggcgagcguuugccucgcgcuccgccguggcgaggagacaaugggagagaaaaccagagaaacgccguuaguccccgcgcggcgaggacggggcggcgggggcgcagggccuggagggaaccugggagccucuccgcgcccggccggcgccccugccacuugcagccccgguuguuuauucgggagcgggggaggggagcggggggaguuccucggagugaaaaccuuuccgaagugggagcgaaccuggggcggccccccgccccccggccgcagccuucggaggagacugggccgccgaggcggucgugagagacggacggagaggaagcgccggcuggaaucuccuaaccgcccgcuucucaucuuguccuggggcagggaccucaggauggaaaccagcagccugcaccgcccgagaaggucggcuggguccggaaauucugcgggaaagggauuuucagggagauuuggaaaaaccgcuauguggugcugaaaggggaccagcucuacaucucugagaaggaggugggugccucuugccucuaacucuccguuuucucauagcccccacuuugucacuccccaagggcucgccuagcuuacuccacccccguuuuguuccaaaggcaaguucaguggucuccucucuacccccaucucaucugcagagaaaggccacccuuuaaugagaagaccagagugagaauuagaaguugaguuggccgcuuacucaguguuuuuuuguuugcaaauaccuuucuaacaacgauaagccccucccaagaugccccagaaguucuaagugucccuugcugccucccacccuaaccuggccuccugcauauaggauuucuuuucuauuucugcugaaacaguuuagccuauucgccaccccuuccuguccccccaccuuaacccagccagccuccccuuuccugucuguggcaggagcgugcacagguccuguccguggcgcauccgcccugaaucacagaaaacacgcaccccgccgucaggccccugugaccucgggugugugaguggcaguuauuuucguugaagccagugucccuaaccaguaugcucucuguuccccacccccaccccauuuaaaaaaggcaaggaacccauuuucuacccacuuccugcccaccccuccauuuguaucagaagggagagaaauggaguuaagaaccccuguaugucuuuggauagcuuuggcuguguaguuaaccaugaaaaccacagucuacacugugucaagaccugagcuaugauaauugaauccagacccaucucccuuuuuucccuaagucuugggaucaauaacguguacuaauguggagaaaucagaauugccccuacagugguuagaagucauuccauucccugccucugugacuguccaaaggcagucaguauagccuggaagacuguccuguguaccgguuagaguggcccuuccucccgcccucacgggagguauucuguguucccucacccagggcuaacugggaaguccucccugaguucuaaccucuucugcuuucugcaguagacauccuuauucaguagauuauauuuagguaaauaaaaccuuuuaugguauugaaacauacacacacacacccugagacaaaguacucaucuaaaagaacaucuacugaggcaucuagggaagaacuaagcugugccacagccaaagagaucccucuuaaggguauugaaaccuagcuguuuacacaaaacuagcaaguuggugauggaaagucuuaggagugaggugagggcacuuuucuuggucugucauccaggcaggaaugcaguggcucaaucacagcucacuucagcuuccaccucccaggcucaagugauccucccaccucauccuuggaguagcugggacuacaggugggugccaccaugucuggcuaguuuuuguauuuuuuguagagacaguguuucgcguuguugaccaggcugcucucaaaacuccuggccucaagugaaccacccgccucagccucccaaagugcugggauuacaggugugagccaccgugccuggccaggaggauuuauuuuuaagaguuaccucugcccaaucacaaauccuccagaaaguuuucuccacaauuuucuggcuuucuaauuaaaaaaaaaaaaaaaaaaaaaaaaaaaacaagugucaaaguguaucuccugucuuccccgaacuucuuaauugcaggaaacucuaguuacgaaucagggagaacuuccuacacaucaaagagaaaaacauaauagugaaaggguaagaggaauaagacauccauugcuuguuuguauuugcccaaagagcagagucugggggcaaaagcguaguugauccuugcuuuuagguacagagacagaggaaaggauggaaugaccucagccuaggauaucugguguccuaugagucaggaccaucugacuggucauggagccagcugucuccugcugggaagggcacaggaaagagggacuaggcauauugauacuaugcuuuuuuagagccaguuucaaugcuacagugggccugguuaaaaagugaaauugacagaguacucugggcuuuauuuugcc

SEQ ID NO: 19417 - RNA, 2652 nt, Homo sapiens
acucugcaaagauaggagaggggcuaugaacuaccucugcuauggaucuuauucaaagucagcuaccuccuagauacuaucuguagaaccuaaauguaauauucagcauagcagggaugaacaugguaaaugaaagguauccaauugcccacuguaauuuuuaaaggccaggagcucaacauuauugaaaaugcuggagggcugccuggaguaggcagugaccacagagucacacaagcuggaauuggauauccaacuugucugucauauuucucuccucccucccugacuuggcacucaauacuccauauucuuucuaauccucuaacccuccccacucccccaacucccacacccuacccccaccaacguuccuggaauuuuggacuuagcuauuuuuaaaaccgucaacucaguagccaccucccucccugcucagcuguccaguacucuggccagccauauacucccccuuccccccauaccaaaccuucucugguucccugaccucagugagacagcagccggccuggggaccugggggagacacggaggacccccuggcuggagcugacccacagaguagggaaucauggcuggagaauuggauagcagaguaauguuugaccucuggaaacaguaagucaaaaugaaauugcaauuccuuuaauaagcuuuuauauugaaguuagacuuuuauaaaauuacaaacaccuacuuggaugucucucguccaaaugcugggaucucucccuaccaaggugccccaaucuccauuucucuuucugucuuauuucuuucuggccucuggccucuagcuuuuugaaguuuaauucucugucucuccucuggcagucuuagcccucucuuuaccuuauuaccucaagacuccugaugaaguuuuagaaggaguucccuacguccucuauucuguaguuuucuuaccaaggccaaauaugaccucagaugaugagucacugauacccuucuauccugcccccacuuagcaaugcccuucacauugagauuccaagcaugggggcugcucccuguaaaugauuucuccccacaacucuagucccuccauucuauucucccucuugcaggacucuucccccaaucauauccuuacccauaagauaggggaguuaggcaggagggauuuagccccucuccaacuccugucaucauaaaagacugagaacuucagaauuugaaaagaagagauuaauggaaggagugauauuugggaaaauacaagaacuguugacuuagaaaaaacaaauauugauuugcauguuugguuugcaucccauuauuccaugagagagggagauuaaaauugcagcucucuagagcugaugaaaagagauugguuuccuuuucauuugaauacugauauucuagacgggauggguaugccacccuuaauccuucuuguguucugacacaaaggaggaaaagaaauguaugacuccuagagggcaucuccuccuaauggagagggacaaauaagaaguauguuucugaaauauuuucagguccuaauuuuacuaggguacccacuaggauuacugguaucugaucuagccccaugauuccuccaucuuugacauaccugcuguuugguagcucagaauggagcaauacaguggacucugcccccuugaguucacucaaccuucccuccacccccaccuagggguauugcacaagggcccuaaaaguggccacaggaacagggcaaagaggcuuaacugccacacuuauaguuugaggaacuccaaucuccccaaauuccagucuguucauccuuuucuugaucuccccagauucacuccacauuauccuuaccaaucuucaauucuucucucucuccauguccagccaaauuucuuuuuucagucacuuacagggcuuccggucaaaauucacuagguaggagggucaucagcugggaagaaccggcgccugggaaaccuggcuggauagguaugggggagccaggccaguccccuagucccagguccucccauggcagucccccaacucuaagcacucucacucuccugcugcuccucuguggacaugguaaggaagggccagggaaggguuuggggaaaucuagaggguaggcugcuauguaggggugggcaugugagccugaaugagugaggagagauaggcgcugagagucccgaucacucgcccugcucucaaauacuaauauuuuauuucccguucagucuggggaaggccacuggggaagcccuuggucgacaggcagaagagauguggcaggcuuacacacuuuuaguaagacagccgagagaacuagggacuaggggguugggggcuggggaaggcccuuaguuagguuuuaggaaggcuggaaaccccugaugagauuuggaagaguuaugagcaaacuacacuccgauagagcagaggucugaggaccgucucacaauccucucccuucugucuuuagcucauucucaaugcaagauccuccgcugcaaugcugaguacguaucguccacucugagccuuagagguggggguucaucaggagcacuucgaggaggaggaggaggaggccgggguggaggggugggcucuggcggccucugucgagcccuccgcuccuau

SEQ ID NO: 19418 - RNA, 2652 nt, Homo sapiens
auaggagcggagggcucgacagaggccgccagagcccaccccuccaccccggccuccuccuccuccuccucgaagugcuccugaugaacccccaccucuaaggcucagaguggacgauacguacucagcauugcagcggaggaucuugcauugagaaugagcuaaagacagaagggagaggauugugagacgguccucagaccucugcucuaucggaguguaguuugcucauaacucuuccaaaucucaucagggguuuccagccuuccuaaaaccuaacuaagggccuuccccagcccccaacccccuagucccuaguucucucggcugucuuacuaaaaguguguaagccugccacaucucuucugccugucgaccaagggcuuccccaguggccuuccccagacugaacgggaaauaaaauauuaguauuugagagcagggcgagugaucgggacucucagcgccuaucucuccucacucauucaggcucacaugcccaccccuacauagcagccuacccucuagauuuccccaaacccuucccuggcccuuccuuaccauguccacagaggagcagcaggagagugagagugcuuagaguugggggacugccaugggaggaccugggacuaggggacuggccuggcucccccauaccuauccagccagguuucccaggcgccgguucuucccagcugaugacccuccuaccuagugaauuuugaccggaagcccuguaagugacugaaaaaagaaauuuggcuggacauggagagagagaagaauugaagauugguaaggauaauguggagugaaucuggggagaucaagaaaaggaugaacagacuggaauuuggggagauuggaguuccucaaacuauaaguguggcaguuaagccucuuugcccuguuccuguggccacuuuuagggcccuugugcaauaccccuagguggggguggagggaagguugagugaacucaagggggcagaguccacuguauugcuccauucugagcuaccaaacagcagguaugucaaagauggaggaaucauggggcuagaucagauaccaguaauccuaguggguacccuaguaaaauuaggaccugaaaauauuucagaaacauacuucuuauuugucccucuccauuaggaggagaugcccucuaggagucauacauuucuuuuccuccuuugugucagaacacaagaaggauuaaggguggcauacccaucccgucuagaauaucaguauucaaaugaaaaggaaaccaaucucuuuucaucagcucuagagagcugcaauuuuaaucucccucucucauggaauaaugggaugcaaaccaaacaugcaaaucaauauuuguuuuuucuaagucaacaguucuuguauuuucccaaauaucacuccuuccauuaaucucuucuuuucaaauucugaaguucucagucuuuuaugaugacaggaguuggagaggggcuaaaucccuccugccuaacuccccuaucuuauggguaaggauaugauugggggaagaguccugcaagagggagaauagaauggagggacuagaguuguggggagaaaucauuuacagggagcagcccccaugcuuggaaucucaaugugaagggcauugcuaagugggggcaggauagaaggguaucagugacucaucaucugaggucauauuuggccuugguaagaaaacuacagaauagaggacguagggaacuccuucuaaaacuucaucaggagucuugagguaauaagguaaagagagggcuaagacugccagaggagagacagagaauuaaacuucaaaaagcuagaggccagaggccagaaagaaauaagacagaaagagaaauggagauuggggcaccuugguagggagagaucccagcauuuggacgagagacauccaaguagguguuuguaauuuuauaaaagucuaacuucaauauaaaagcuuauuaaaggaauugcaauuucauuuugacuuacuguuuccagaggucaaacauuacucugcuauccaauucuccagccaugauucccuacucugugggucagcuccagccaggggguccuccgugucucccccagguccccaggccggcugcugucucacugaggucagggaaccagagaagguuugguauggggggaagggggaguauauggcuggccagaguacuggacagcugagcagggagggagguggcuacugaguugacgguuuuaaaaauagcuaaguccaaaauuccaggaacguugguggggguagggugugggaguugggggaguggggaggguuagaggauuagaaagaauauggaguauugagugccaagucagggagggaggagagaaauaugacagacaaguuggauauccaauuccagcuugugugacucuguggucacugccuacuccaggcagcccuccagcauuuucaauaauguugagcuccuggccuuuaaaaauuacagugggcaauuggauaccuuucauuuaccauguucaucccugcuaugcugaauauuacauuuagguucuacagauaguaucuaggagguagcugacuuugaauaagauccauagcagagguaguucauagccccucuccuaucuuugcagagu

SEQ ID NO: 19419 - RNA, 2532 nt, Homo sapiens
cccaaacugguaagaagcaaucaagagucccaaaaagcaaacugcugucugagccagauaaagaugggcagcgguuacuucauguugucucaacaaagacccugaagaugccaaguccccagccagaccaagcucaugaaggcaaaagguagcuuugaucucacucagaacuuugaaagguuuuucuccucaucccccuucuccccuuucccuuucuaaaagaauguuucaagccagauguaagauauaggccucucuguucccccaaccagaacccccccuccuugccuuccccaacacugcagagauuuaaaaaaaaaaaauucaaaagagauuuuucugaaacaggaaaacaggggguggggguugggauaaggagagacggcaucuugaaaugauaggaaucugcagcccaagcuggcgggccccucggccagcuaccccucacccuucagccaagauuccaagucaagaggagaaaagccacagggugcaaggagagaagagaccacauuucggggaggggggcuugcacgggaagaagaacggaguaaggaaaggacgggaggcacugccugguggagaggggcaauagccuaguccaagaggccaguuugauuguggggugaagaggaaagacugagucuuuucuagguucaacucucccugcuuugcccucuccccaugguggggaagaagggaaagcagcuccuucuccuacgggaaggugaugagugccauccaaggaguagggggcagggaggauucuaaaaagaacagacacgagacauccaguggaucuguaaugccuuuuugccucaucugcccucuugugaagugucuggagucuagggccugcaagaaaucuggggagggggucucuuaguaucuugggacuccgcagcccucuggcucuuggaggggagaaaugggagaugggaaagaauaggaagaagggagggaggcaaaguuuccuaagugacauccucaaaacgguggcugaagacaaaugccuagauaaugcaaacccaugcguuuuguuuguuuuaauugugggaguuaaugggguaaauuuugccucgauuccauuucuaagccucggcugggugcugcugccucaccaaagccuuccugugguaugggugggcuagacuagcgagcugccccuuucuccaccucucagagggcgaccuuaggcgauuggggcccuggcgaagcuauugcgggcccuggaagguuauucguuccuugaacucacccugagggaaacucggaagguagcuucugcccuaaggggcuugagcugaaauagaggggguacagcacguggaggccuaaggagccgcgaccaccgggcauccuugcuccgaaugcccagcgccuuucucaccagucguguaagacgcggcgccucacccucccgccaccccgcgacuucagauuucagugacaguccugcccgaaucgucuccaacccgucgaagcaacagccuggucccgugagcagccagucccuccaggcgccuccggccucuccuaccaagcgccucacccgcccagccugagagccacacuuaccaccaggacgugucuacgcgggccggcagcgucagcagcagcaggagcagaaggcaggcaagaccuaggcgggccgaagcccgggagccgucgggggccgcgggcgacggcacagggaccggggcgcuggcgcgccgaagcgggagcugcgcagcuuccuccgcaccacccggucucagcauagcuccccgaagacucccgccgcgcagcccggaggggcguggacggggcaccuucuggggguacucaggcugcuccuaccucaccccccuggggggccaugguguucgccggcggcuggggaccuaggaucaccugggguccagagcccgggaggaggauccccgagaggggcgcaaguugcgauguccggaagccgacgacggcgugccgaacccggggucuggggcgcgcugccugaggaccgggugcggugucagggggucugcggcgcugaagggagcugcgggccuagugugcggacagccccuucggccgcgggcucucauuggacgggacggggcggggccgaggccggggacacgcgcggcccuuagggcggcuccgcccgcgccaagcccggggcgcuccgcgacgcccuagguguagcagccgccuccgccccucggggcucccgcgcgccaccgcgcugcacccccaccugcucccgcacgcugcgacgggacgccgcggcucccuccugcgccccaagcgcccagucccugccgacaccgcgccaccggguccuagcgcccuucacucagcagccccacuucuaugggugacggccaggcuggcggagcgggaaggggaugcgggcacuucccuccuguccccaaccuacagugacaccggcgcugagcacggaggaugcacucauuuccuccauccuugcgcuucugugaaauggguagagucccugccaccgggaguuggaggucuuaacuaccuuuu

SEQ ID NO: 19420 - RNA, 2532 nt, Homo sapiens
aaaagguaguuaagaccuccaacucccgguggcagggacucuacccauuucacagaagcgcaaggauggaggaaaugagugcauccuccgugcucagcgccggugucacuguagguuggggacaggagggaagugcccgcauccccuucccgcuccgccagccuggccgucacccauagaaguggggcugcugagugaagggcgcuaggacccgguggcgcggugucggcagggacugggcgcuuggggcgcaggagggagccgcggcgucccgucgcagcgugcgggagcaggugggggugcagcgcgguggcgcgcgggagccccgaggggcggaggcggcugcuacaccuagggcgucgcggagcgccccgggcuuggcgcgggcggagccgcccuaagggccgcgcguguccccggccucggccccgccccgucccguccaaugagagcccgcggccgaaggggcuguccgcacacuaggcccgcagcucccuucagcgccgcagacccccugacaccgcacccgguccucaggcagcgcgccccagaccccggguucggcacgccgucgucggcuuccggacaucgcaacuugcgccccucucggggauccuccucccgggcucuggaccccaggugauccuagguccccagccgccggcgaacaccauggccccccaggggggugagguaggagcagccugaguacccccagaaggugccccguccacgccccuccgggcugcgcggcgggagucuucggggagcuaugcugagaccggguggugcggaggaagcugcgcagcucccgcuucggcgcgccagcgccccggucccugugccgucgcccgcggcccccgacggcucccgggcuucggcccgccuaggucuugccugccuucugcuccugcugcugcugacgcugccggcccgcguagacacguccuggugguaaguguggcucucaggcugggcgggugaggcgcuugguaggagaggccggaggcgccuggagggacuggcugcucacgggaccaggcuguugcuucgacggguuggagacgauucgggcaggacugucacugaaaucugaagucgcgggguggcgggagggugaggcgccgcgucuuacacgacuggugagaaaggcgcugggcauucggagcaaggaugcccgguggucgcggcuccuuaggccuccacgugcuguacccccucuauuucagcucaagccccuuagggcagaagcuaccuuccgaguuucccucagggugaguucaaggaacgaauaaccuuccagggcccgcaauagcuucgccagggccccaaucgccuaaggucgcccucugagagguggagaaaggggcagcucgcuagucuagcccacccauaccacaggaaggcuuuggugaggcagcagcacccagccgaggcuuagaaauggaaucgaggcaaaauuuaccccauuaacucccacaauuaaaacaaacaaaacgcauggguuugcauuaucuaggcauuugucuucagccaccguuuugaggaugucacuuaggaaacuuugccucccucccuucuuccuauucuuucccaucucccauuucuccccuccaagagccagagggcugcggagucccaagauacuaagagacccccuccccagauuucuugcaggcccuagacuccagacacuucacaagagggcagaugaggcaaaaaggcauuacagauccacuggaugucucgugucuguucuuuuuagaauccucccugcccccuacuccuuggauggcacucaucaccuucccguaggagaaggagcugcuuucccuucuuccccaccauggggagagggcaaagcagggagaguugaaccuagaaaagacucagucuuuccucuucaccccacaaucaaacuggccucuuggacuaggcuauugccccucuccaccaggcagugccucccguccuuuccuuacuccguucuucuucccgugcaagccccccuccccgaaauguggucucuucucuccuugcacccuguggcuuuucuccucuugacuuggaaucuuggcugaagggugagggguagcuggccgaggggcccgccagcuugggcugcagauuccuaucauuucaagaugccgucucuccuuaucccaacccccacccccuguuuuccuguuucagaaaaaucucuuuugaauuuuuuuuuuuuaaaucucugcaguguuggggaaggcaaggaggggggguucugguugggggaacagagaggccuauaucuuacaucuggcuugaaacauucuuuuagaaagggaaaggggagaagggggaugaggagaaaaaccuuucaaaguucugagugagaucaaagcuaccuuuugccuucaugagcuuggucuggcuggggacuuggcaucuucagggucuuuguugagacaacaugaaguaaccgcugcccaucuuuaucuggcucagacagcaguuugcuuuuugggacucuugauugcuucuuaccaguuuggg

SEQ ID NO: 19421 - RNA, 2623 nt, Homo sapiens
ugccacucaaggucuggagugaaugguauggaugaaagggaccgcucaggaagacaaccucccuggaggagagcaaggugggagcaaugcuuaaccccaagggcugucuggcuuugaugacauuugaggcaucaguguggggaaagugcagccacuacaugagaggcugacuucgaagcuggccaaaggggauaccccuggaccuggggccuccauucugccucaggaggaucuggacagacagugggggguuaacacucuggcuugcaucuggcugggcaggcucuccucugacugccucuuccucccaccccuagcccuggcuucugccuggggagcagcccucagaaggaaucucugcugcaggcucagagaugcuaggacaccucaguccagcuguccagccuccucugccaccuauccuauuccauuucaucuucccccucaacaaggccucuggagagaccuggcagaaccgggcccuuggacuuccccugucuaaacacagcccccuugucuuucucuucuuuccucauggucuccccuucagccccgaagcuuugcuuucugccuauggcuaacccuucucccuuccccucucaacucuaucuccucucucucagugaggcacuuucuuucuguggacccacucuucccuuucucucucaccucaccugcagcccgcucuccucuacccccaaauaauuuucugcucuuuuccccccagguuuccccucucauuuucuuccaggacuccucagaagcaaaucuauuaugagcccacugacuggucaugaacagugccacccucacuuucuauggcugcaucugcuaccgccacaguuggggcagggcgucccuuacgcagucaggagcagacccugccccuggacacagcucugcaacaccaaacccucuuuccauuuuccucaagcacugcaaaccaccauaaaccaccacaaagcccagaaucuccccaaccgaugaaaccagaauuugcaagaaaaagagauucugagcuagccccaagcagccccggggguggggggcuguuugccggcuguugccgucccccaccccaccccccaaacagccacccaaguccuccguagcuccugccugugggcuggaacaagcaguggcuugccccucuccgucccucugccagcaagucccuggcguucuauaagcugguugacccccugaacuuucccugcccagaagcgcccacuccucagcagggccuuggaagcacguguguggccgaugaggaaggugcccaccggggagggcacacacucagcgcacagccacuccgcccgugccuuggugguggcggguagggagagaggcagggcacccuggcugagcgggggcuccugccugcagguggcucaguguuccccuccgugcaauggggugagcagcccuccguuucccagggaagccuggcagucccggugcagcugcagggccgccaccggccuccgcccuggcgccagggcccaguccgugcgcaaaggcgguucguccgcggcgggaacgccgggccagugcagccggcgcgcccaggcugucggcuccgaggggccgcucccggccgccuggccgccgagcccccgccccagcccgucccgggcccagcgccgcggccgucgcuuaccgugggagggcagcgcccggcggcgcccggcgcggucauacgggcagcugggucccggccgggcgcgucggccgcccucgcucgcucgcucgcucgcuggcugcugcggagugggcgccccggccgagggccgcaccgcuguccugggaugcggagagcggcucuggcgccgagaggacccaggcaaacuuucacuuuccccgggccgagccucacuggccagcccucggcacagccuuuuaagagaggacuggggggcaugugguuuaugggaaaucacccuggccaggcgccagacacacacauacacacacacacacacacacugacacagacacacacacuccagaggcccacucagccgccuucccccgccuccccucccccacccgccggccggccagccccgcucgcgcgucuuccuagucacccucugucuucugcgcugcacuuccaagccuucagcaaacgagcgcgggcuccaccgcguccccacccugccuuccccgcgcccucugcggaccgacccuuuccuuccgcgcucuccaggcugauucagugcuagcgcucuaugaucgucccaagggacuuucccuccaggccugaaaauccccaaaucuuagcagaaaacggaccgagagcagggacaagcacugggaagggagggaaauccuuugaagacgcccccaccccauucucggagugccgaaaggaguccaguguuacuugcucccucguggagccugagucagcagguuugccggcagcccccuucuuccucugcagcccccaagcagcccggccagcuucaagucccauucugggagggaggccagcuaccuggccaggaagggagcagcuguguccugugacagcaagcuggggggcucuucccugggugccagcagacacuucaaggcaccugacccuuagaugaugaaaaugcuggcugguacccau

SEQ ID NO: 19422 - RNA, 2623 nt, Homo sapiens
auggguaccagccagcauuuucaucaucuaagggucaggugccuugaagugucugcuggcacccagggaagagccccccagcuugcugucacaggacacagcugcucccuuccuggccagguagcuggccucccucccagaaugggacuugaagcuggccgggcugcuugggggcugcagaggaagaagggggcugccggcaaaccugcugacucaggcuccacgagggagcaaguaacacuggacuccuuucggcacuccgagaauggggugggggcgucuucaaaggauuucccucccuucccagugcuugucccugcucucgguccguuuucugcuaagauuuggggauuuucaggccuggagggaaagucccuugggacgaucauagagcgcuagcacugaaucagccuggagagcgcggaaggaaagggucgguccgcagagggcgcggggaaggcaggguggggacgcgguggagcccgcgcucguuugcugaaggcuuggaagugcagcgcagaagacagagggugacuaggaagacgcgcgagcggggcuggccggccggcgggugggggaggggaggcgggggaaggcggcugagugggccucuggagugugugugucugugucaguguguguguguguguguguaugugugugucuggcgccuggccagggugauuucccauaaaccacaugccccccaguccucucuuaaaaggcugugccgagggcuggccagugaggcucggcccggggaaagugaaaguuugccuggguccucucggcgccagagccgcucuccgcaucccaggacagcggugcggcccucggccggggcgcccacuccgcagcagccagcgagcgagcgagcgagcgagggcggccgacgcgcccggccgggacccagcugcccguaugaccgcgccgggcgccgccgggcgcugcccucccacgguaagcgacggccgcggcgcugggcccgggacgggcuggggcgggggcucggcggccaggcggccgggagcggccccucggagccgacagccugggcgcgccggcugcacuggcccggcguucccgccgcggacgaaccgccuuugcgcacggacugggcccuggcgccagggcggaggccgguggcggcccugcagcugcaccgggacugccaggcuucccugggaaacggagggcugcucaccccauugcacggaggggaacacugagccaccugcaggcaggagcccccgcucagccagggugcccugccucucucccuacccgccaccaccaaggcacgggcggaguggcugugcgcugagugugugcccuccccggugggcaccuuccucaucggccacacacgugcuuccaaggcccugcugaggagugggcgcuucugggcagggaaaguucagggggucaaccagcuuauagaacgccagggacuugcuggcagagggacggagaggggcaagccacugcuuguuccagcccacaggcaggagcuacggaggacuuggguggcuguuugggggguggggugggggacggcaacagccggcaaacagccccccacccccggggcugcuuggggcuagcucagaaucucuuuuucuugcaaauucugguuucaucgguuggggagauucugggcuuuguggugguuuauggugguuugcagugcuugaggaaaauggaaagaggguuugguguugcagagcuguguccaggggcagggucugcuccugacugcguaagggacgcccugccccaacuguggcgguagcagaugcagccauagaaagugaggguggcacuguucaugaccagucagugggcucauaauagauuugcuucugaggaguccuggaagaaaaugagaggggaaaccuggggggaaaagagcagaaaauuauuuggggguagaggagagcgggcugcaggugaggugagagagaaagggaagaguggguccacagaaagaaagugccucacugagagagaggagauagaguugagaggggaagggagaaggguuagccauaggcagaaagcaaagcuucggggcugaaggggagaccaugaggaaagaagagaaagacaagggggcuguguuuagacaggggaaguccaagggcccgguucugccaggucucuccagaggccuuguugagggggaagaugaaauggaauaggauagguggcagaggaggcuggacagcuggacugagguguccuagcaucucugagccugcagcagagauuccuucugagggcugcuccccaggcagaagccagggcuaggggugggaggaagaggcagucagaggagagccugcccagccagaugcaagccagaguguuaaccccccacugucuguccagauccuccugaggcagaauggaggccccagguccagggguauccccuuuggccagcuucgaagucagccucucauguaguggcugcacuuuccccacacugaugccucaaaugucaucaaagccagacagcccuugggguuaagcauugcucccaccuugcucuccuccagggagguugucuuccugagcggucccuuucauccauaccauucacuccagaccuugaguggca

SEQ ID NO: 19423 - RNA, 2660 nt, Homo sapiens
gcauuagucgcgccugcgcacggcccuguggagccgcggaggcaagggacggagaacggggcggaggcggagucagggcgcccgcgcgugggccccgcccccuuaugucggguauaaagccccucccgcucacaguuucccuaguccucgaaggcucggaagcccgucaccaugucgugcgagucgucuaugguucucggguacugggauauucguggggugagugccgucucaacgguagagccgcucggucaaagagacugacgcggagagggcgggucucuggguccgcgaucuccagcaggagcagcucuacgcgggagccuuuucgagcugccgagccacggaugucgaccccugcccagccucugggaucgcgggcccuguggggaggggcggaggagaccacgccggagccgggccuaggggccgcuuaaccaccgccccggcaggacgcagggacucggcagccccgggccggggaacguuagcgggcggggguugggaaugggugggagcugcgcagucgcugaaccgcugucuuccccagcuggcgcacgccauccgccugcuccuggaguucacggauaccucuuaugaggagaaacgguacacgugcggggaagguaaugccgcuccgcgugcccgugcagccaagcuggcccuccaccugcccuggucuucuuacgcccagagggugguggcgucgcgccaaggccgggugggacguuugccccaaucugggugaauagagacacauccuuuaucuggaacuggggguucucuuuuuaacauagcccaaacccgucuuaaugcuuaaccaaauagggcucagaggcucaaugguuaugcuuuuggggccugggaauuugagguauugggaccaagucauuucuuuagaucuuuugcucuugucaggugggguauuaaggagguugggucccacuuaauuccgucucuuacagcuccugacuaugaucgaagccaauggcuggaugugaaauucaagcuagaccuggacuuuccuaauguaaguggcuuuaguagagguggcgggcagaagggaaagccuucaaguauauccauccuugccucucuccugccugguacagaaggaugcaaaauaggggaucuuaacccggauagaauaaauagaauucagggguccuugaacuggauggauauguauuuucauucccauuaaccacuagcaaaaguuauuuccuuuuauugugaagagagacaauaagugacauugguuauuagccaugucugucacuuugucacuaguagaaaucagguauuuucuuuuuuguguguuucuuguucuuuuguuuugagacagugucucacucugucgcucaggcuggagugcaguggcgcaaucacagcucacugcagccucaaccucccaggcucaagcaguccucccaccucagccucccaaggagcugggacuacaggcacacaccacuaugcccagcuaauuuuuguauuuuuguaagagacgggguuuugccauguuacccaggcugauccugaacuucugggcucaaacaguccucccaccucggccuuccaaaguguugggauuacaggcaugagccacugugcccagccugaaaucagguaguuucauauucuauaacaugcguugcagauauuuuaagugauauuuauauacauguaaguaaauauauacauauaauguuauuuacuuugagauuauguuagucauuacaucugcuugcuauuuaaugcacuaauaggcacauguuacucuuauuugaauuuuuaaaaauauuuuuugauuguguaaauuaucuauuuugcuucaugcauuuaacaacuuuauucugagaaaagguccauggcaugcacauacacucacacauacacacaccaauuuaagaaccccugucuagaaucuuguggacccaguugcuaccuucuacuuauuuucuuuuuucuccuaacacagcaucuucucacucuuguucacugcccugcaaguguucuuuuccccuggagagagagguagggaaucaagagagaggcagguuguucauuuguccuguccuuuuccuuucagcugcccuaccuccuggaugggaagaacaagaucacccagagcaaugccaucuugcgcuacaucgcucgcaagcacaacaugugugagugggguagggcuggugagggaccccaggcugguaguuugucugagaguggaugaugccaagggugauuuguugucauuuggccuacagguggugagacugaagaagaaaagauucgaguggacaucauagagaaccaaguaauggauuuccgcacacaacugauaaggcucuguuacagcucugaccacgugaguuuccuuagcacacaucugcugaauggaguaucagaaaaagggguauuuaggaacccaaggguuaucucuguuccauucugcugcugcuaccuucccaccaauccagauuguuagaauaagaaacagaacuuauauuuuuugguuuguuuugucauguaauucuggugcuggugccucuucuuucuaaacuccucuuuccccacccugccauccucaagugaaggcaaugagaacccaccuagagaaggggcuacuaaguguccaucacuggccugugcccugauua

SEQ ID NO: 19424 - RNA, 2660 nt, Homo sapiens
uaaucagggcacaggccagugauggacacuuaguagccccuucucuagguggguucucauugccuucacuugaggauggcaggguggggaaagaggaguuuagaaagaagaggcaccagcaccagaauuacaugacaaaacaaaccaaaaaauauaaguucuguuucuuauucuaacaaucuggauuggugggaagguagcagcagcagaauggaacagagauaacccuuggguuccuaaauaccccuuuuucugauacuccauucagcagaugugugcuaaggaaacucacguggucagagcuguaacagagccuuaucaguugugugcggaaauccauuacuugguucucuaugauguccacucgaaucuuuucuucuucagucucaccaccuguaggccaaaugacaacaaaucacccuuggcaucauccacucucagacaaacuaccagccuggggucccucaccagcccuaccccacucacacauguugugcuugcgagcgauguagcgcaagauggcauugcucugggugaucuuguucuucccauccaggagguagggcagcugaaaggaaaaggacaggacaaaugaacaaccugccucucucuugauucccuaccucucucuccaggggaaaagaacacuugcagggcagugaacaagagugagaagaugcuguguuaggagaaaaaagaaaauaaguagaagguagcaacuggguccacaagauucuagacagggguucuuaaauugguguguguaugugugaguguaugugcaugccauggaccuuuucucagaauaaaguuguuaaaugcaugaagcaaaauagauaauuuacacaaucaaaaaauauuuuuaaaaauucaaauaagaguaacaugugccuauuagugcauuaaauagcaagcagauguaaugacuaacauaaucucaaaguaaauaacauuauauguauauauuuacuuacauguauauaaauaucacuuaaaauaucugcaacgcauguuauagaauaugaaacuaccugauuucaggcugggcacaguggcucaugccuguaaucccaacacuuuggaaggccgaggugggaggacuguuugagcccagaaguucaggaucagccuggguaacauggcaaaaccccgucucuuacaaaaauacaaaaauuagcugggcauaguggugugugccuguagucccagcuccuugggaggcugaggugggaggacugcuugagccugggagguugaggcugcagugagcugugauugcgccacugcacuccagccugagcgacagagugagacacugucucaaaacaaaagaacaagaaacacacaaaaaagaaaauaccugauuucuacuagugacaaagugacagacauggcuaauaaccaaugucacuuauugucucucuucacaauaaaaggaaauaacuuuugcuagugguuaaugggaaugaaaauacauauccauccaguucaaggaccccugaauucuauuuauucuauccggguuaagauccccuauuuugcauccuucuguaccaggcaggagagaggcaaggauggauauacuugaaggcuuucccuucugcccgccaccucuacuaaagccacuuacauuaggaaaguccaggucuagcuugaauuucacauccagccauuggcuucgaucauagucaggagcuguaagagacggaauuaagugggacccaaccuccuuaauaccccaccugacaagagcaaaagaucuaaagaaaugacuuggucccaauaccucaaauucccaggccccaaaagcauaaccauugagccucugagcccuauuugguuaagcauuaagacggguuugggcuauguuaaaaagagaacccccaguuccagauaaaggaugugucucuauucacccagauuggggcaaacgucccacccggccuuggcgcgacgccaccacccucugggcguaagaagaccagggcagguggagggccagcuuggcugcacgggcacgcggagcggcauuaccuuccccgcacguguaccguuucuccucauaagagguauccgugaacuccaggagcaggcggauggcgugcgccagcuggggaagacagcgguucagcgacugcgcagcucccacccauucccaacccccgcccgcuaacguuccccggcccggggcugccgagucccugcguccugccggggcggugguuaagcggccccuaggcccggcuccggcguggucuccuccgccccuccccacagggcccgcgaucccagaggcugggcaggggucgacauccguggcucggcagcucgaaaaggcucccgcguagagcugcuccugcuggagaucgcggacccagagacccgcccucuccgcgucagucucuuugaccgagcggcucuaccguugagacggcacucaccccacgaauaucccaguacccgagaaccauagacgacucgcacgacauggugacgggcuuccgagccuucgaggacuagggaaacugugagcgggaggggcuuuauacccgacauaagggggcggggcccacgcgcgggcgcccugacuccgccuccgccccguucuccgucccuugccuccgcggcuccacagggccgugcgcaggcgcgacuaaugc

SEQ ID NO: 19425 - RNA, 2687 nt, Homo sapiens
ggaagcuuuucagaaucccuccaagggagaggaguccauggucuaauaaccucauuguuucccuuauccuuugacagucugucucaaauucuguuggauccauuugucuaauuuaaugguaaaauugcuuauaauggcucuuccaguucuggaugccagucacucagagccuuaauaucauuuuuauauggcucccucuggcacuugagugguggaucagaacagggaaggggccaaaggcaaaagagcucaaucagcaauuggucuaaccacucuugaggcaguaagaaagguggagaguccccaccaggucccagaguuugcacuugggagcucccaggcuggcccgauaaucccaaaugcacuuuugccccuggguuccagauuugauuauucucauccaaaccaugauuuaagaacuggugucacagugcuaauucuugucuccaaagcccuguagaacucaauccuccucaguauuaaugguaacuuauucccuagcugaauucuguacugagagcacauuaauuaaguuauucacacaccauuugguauguggauugucuaauuuaaaaucucuucugcaauagugcacuaaaugcccccuacaagucuuuaugauuugagaaauugacugcaccuguccacauuccuaauuuauacccaggaggccuuaggcacuggccuagugaagcaagauaguauuuccacuagacuguaacaggggaaacugaggaccugagcaagugacuuuuucaaggucacaaaguaagucuaaccuagggccauauucuggcacaccaaacuauuuagagcauaaggagacccuaggaagguucugaucaacaucuaacuaguguuggaaauugaaguccagagaaaugaauugcccaaggugacauagcuggaaaaggccagucuaggucuggaucccagggccccagcuucucagaucaguguuccauuuuauucuacaugccacauuuuagccaugccgugauuuuuauucuuauuuuuuucuuuuauuuaaucauagaaccacaagcuccguucauucauucauccacucccucacucauuuacaggaacucggauuacuccagugaccucaaaagggaacggcgagccgagagccuguccccugagcccaguacuugcaggaucauccaggcccugguggguuugggggcaggacgguuuccaucgccugcuuccuucccuccuuugcccucugcggcuucccucuuggugaagagcggaccucguccccgucguccuucuccccccucccgucaccaaggagugguaugugcaggaucagaguucuggaaagguuacacccggguccucucgcccgggugaaaugugagcgcccugggcaaaggcuccuugcacauagaaggaccgaauccgggacuccgcaugccucgcucuucacccuccugccacuaaguccggagaagcagccccagcccgccccucccccgcccaccugucgccgccccccacccuuccgccguggcccggccgcagcaccuccccagcccccacccuggcuccauugcuucaggucagcgucacagcccaggcucccgaaauagcccggggccggggcagcgacucacccacuggagaacuuugaugaagcccagcggcuccuccagccgccgccagcgcagccccacgaguaggcgguccaccugcggagacacagccggccggggggucagggcgguggggaacccugggaaggcgcugguccccuugccccacucacacgcgguccaggggugggauaagugugcagcccgacaucuagguggagaggggcgggugagaguccugggcgcgcagggacuaccugcuggcgcggcgacuuguccgccgugcggccggcgcucucggucgaggacaugcuggcgcggcgagcgcugggcgcggcgugguggcuuggcucucuggccgggaggcggcggacacggcgggggagcggggagcugcagguccggggcagagcaggcgagcggggccggagcgcgagcggccgucggugggccggaguccagucuggcuggcuggcuggcugggacgcgggggcgcugcuguucgugcucucagaggcugcggccgccgcggugccccgccggcagcagaaagcccccgacucggauucaaacuucugucaaacucgcagcgaacuuggccgccgggucacguggcgugcgcucccgaacccuccucccgcccccucugcucccuuucuccgcucgccgggcaccuuaaagggaccagaggccuccgugguuaguuccgccgcggggcgggggggacuccggguccuccucgccgaagccuccgggaccgguccccaccgagacaccgcggccgucggaaacccuagccaggcgcaccuggacgcacaggcuucagguuuauccuucccuauuuuccuggauugcaaacugcccagcgccgguuuuucuccucuuccauaccagaauauccagaacguaaaagauucucaaaaggcacgaucagggcugugaaacaagguucuaagccucacgauuaacauaccgccaguaccgacaaaagggcgauagaauauaagcugcugauuuuuuauccugucuagcuagguauuguuuugauuuuuuuuuaaaacaacaaaagacauuuguauguua

SEQ ID NO: 19426 - RNA, 2687 nt, Homo sapiens
uaacauacaaaugucuuuuguuguuuuaaaaaaaaaucaaaacaauaccuagcuagacaggauaaaaaaucagcagcuuauauucuaucgcccuuuugucgguacuggcgguauguuaaucgugaggcuuagaaccuuguuucacagcccugaucgugccuuuugagaaucuuuuacguucuggauauucugguauggaagaggagaaaaaccggcgcugggcaguuugcaauccaggaaaauagggaaggauaaaccugaagccugugcguccaggugcgccuggcuaggguuuccgacggccgcggugucucgguggggaccggucccggaggcuucggcgaggaggacccggagucccccccgccccgcggcggaacuaaccacggaggccucuggucccuuuaaggugcccggcgagcggagaaagggagcagagggggcgggaggaggguucgggagcgcacgccacgugacccggcggccaaguucgcugcgaguuugacagaaguuugaauccgagucgggggcuuucugcugccggcggggcaccgcggcggccgcagccucugagagcacgaacagcagcgcccccgcgucccagccagccagccagccagacuggacuccggcccaccgacggccgcucgcgcuccggccccgcucgccugcucugccccggaccugcagcuccccgcucccccgccguguccgccgccucccggccagagagccaagccaccacgccgcgcccagcgcucgccgcgccagcauguccucgaccgagagcgccggccgcacggcggacaagucgccgcgccagcagguagucccugcgcgcccaggacucucacccgccccucuccaccuagaugucgggcugcacacuuaucccaccccuggaccgcgugugaguggggcaaggggaccagcgccuucccaggguuccccaccgcccugaccccccggccggcugugucuccgcagguggaccgccuacucguggggcugcgcuggcggcggcuggaggagccgcugggcuucaucaaaguucuccagugggugagucgcugccccggccccgggcuauuucgggagccugggcugugacgcugaccugaagcaauggagccagggugggggcuggggaggugcugcggccgggccacggcggaaggguggggggcggcgacaggugggcgggggaggggcgggcuggggcugcuucuccggacuuaguggcaggagggugaagagcgaggcaugcggagucccggauucgguccuucuaugugcaaggagccuuugcccagggcgcucacauuucacccgggcgagaggacccggguguaaccuuuccagaacucugauccugcacauaccacuccuuggugacgggaggggggagaaggacgacggggacgagguccgcucuucaccaagagggaagccgcagagggcaaaggagggaaggaagcaggcgauggaaaccguccugcccccaaacccaccagggccuggaugauccugcaaguacugggcucaggggacaggcucucggcucgccguucccuuuugaggucacuggaguaauccgaguuccuguaaaugagugagggaguggaugaaugaaugaacggagcuugugguucuaugauuaaauaaaagaaaaaaauaagaauaaaaaucacggcauggcuaaaauguggcauguagaauaaaauggaacacugaucugagaagcuggggcccugggauccagaccuagacuggccuuuuccagcuaugucaccuugggcaauucauuucucuggacuucaauuuccaacacuaguuagauguugaucagaaccuuccuagggucuccuuaugcucuaaauaguuuggugugccagaauauggcccuagguuagacuuacuuugugaccuugaaaaagucacuugcucagguccucaguuuccccuguuacagucuaguggaaauacuaucuugcuucacuaggccagugccuaaggccuccuggguauaaauuaggaauguggacaggugcagucaauuucucaaaucauaaagacuuguagggggcauuuagugcacuauugcagaagagauuuuaaauuagacaauccacauaccaaauggugugugaauaacuuaauuaaugugcucucaguacagaauucagcuagggaauaaguuaccauuaauacugaggaggauugaguucuacagggcuuuggagacaagaauuagcacugugacaccaguucuuaaaucaugguuuggaugagaauaaucaaaucuggaacccaggggcaaaagugcauuugggauuaucgggccagccugggagcucccaagugcaaacucugggaccugguggggacucuccaccuuucuuacugccucaagagugguuagaccaauugcugauugagcucuuuugccuuuggccccuucccuguucugauccaccacucaagugccagagggagccauauaaaaaugauauuaaggcucugagugacuggcauccagaacuggaagagccauuauaagcaauuuuaccauuaaauuagacaaauggauccaacagaauuugagacagacugucaaaggauaagggaaacaaugagguuauuagaccauggacuccucucccuuggagggauucugaaaagcuucc

SEQ ID NO: 19427 - RNA, 2511 nt, Homo sapiens
auaccagcccaccaccacuuuggcuggugauggagaagcgguuucgaguauugccacuggugaucugguaggugaugacacuaugagcaucacgguccacagcugacaccgucaccacgcuggugcccacagcugcauccucauugagccgcacuguguacucugguuggguaaagguuggauuguugucguugacauccaggacagucacgcugacacuggccgaggcagugagugcuggagugccauggucucgagcuucuaccccaaagcuguagaaaucaacuuccucccgguccaguucagcagccacagagauccagccugugccauuguugauggugaaggggaagucaugucccaccccagcaaggcgguauuccaggcgggcauugucaccagcaucagcgucgauagccuggacauggagaaccagguagccuaaggggacacucuccaggacaguagccuggaaaggggugcugacgaagaugggggcauugucguugauauccaggaccuguacugucaccaagccagagacauuagagagugggggacggccaccauccugugcucgcacccguaggguguacuccuuggucgucucauagucaagagggcucaccacauccagagcuccagucugggcauccagauaaaacuguccccgagcauugccacucaugaugcuauagugcaccacggcauugcuccccuugucucgauccgaggcugugacucggaguacuggggccccuggagucacauccucccucaccuggaccacauagcgcuucucacuaaacuggggggcauuaucauugucauccuccacagaaaggaaaacagcggcugugguacuccgaggacccgggucccgacccuggucacuugccucuaccgucagcugguaggauuccaccucuucccgauccacagggccacggguucggaucaccccagagcgagggucgaucucaaagacuucagaggggcugcccccagaccccuccagcaggcgguacagaauauuggcauugggaggggcaucaccauccguggcccugacagugagcaccucauagccaaccuccagguucucccugaggcucuccuuguacuccugcugcucgaacacagggucauggucauuggugucaguaaccaagauggugaguguagccagggcacuucgucggggcaugccgugguccugcgccgugacccugaagacgugggugcucuuggucucacgauccagcuccucggcugugguuacugcaccagugacuggguccagggagaagaacugguuggagcggcuaucaaagagggcauccaugguguacuccagucgaccugccucacccucguccgggucgauggcccucagggaugcaacaggggugccugcuggcugguucuccggcacuguggccugguagcuggggggcuggaacuggggggcuguauuuacauuccuuuuccgacgcccacccagggacucuucuggugaccuuuccccugcccugagcccgggggccugugccagcuugcaggacuggcaucugagccguggagccuuuaagcacgggugcuccucgggcagugugagcuugcccuguggggaaagguggccuccaaugcccaggaggcgacagcuccaggggcagccuucaggagcuggugguaggggaauaugggccucggauucuggacaccaaacccucaggccaucguggugggguaccagguggccagucagcucagugcccgcaucccugcagcggcugguguagagccagagguucgacgcugaggauggacagagccagcccaugggggcgcaggcccccgaagagccucguccccuggaccccaaggaacgacagggccccacuuggucucccaauaguggcggcggcagcagcagcagcaacagcagcagcagcggcggcggcggcguugggagggggacgccgguggccgggcuccgcaucucucccagcucccggccggcggccgggucaacggcggcggcggcuccuccuccggcuccugccggccccgccgcgccucaugcccgggccagggcgccaguccccgggggccucccgugcgccccgcggggccugcgucuggauggcucggcgggaccccgcgcugcacccuccgacgagcccgggcucccacugcccccugagccagacccgcucccgggucacccugagcaccgcgggcugccgccgcgccuccaccugcgcuccgggcacucaccaccugcgcccgggggccccgcggcgccccuggccuugccgggccccggguuccggagccggggugcccccuccgccccuaugggaucgcccaccugcgcccgcguagccgugcgccccgaccccggcccggccccggcggcccccgacggucccgcgccgcccgcucgcgccccgcguccccgccgcggcugcugccugucgccgcggccccgggcccagccccgcgcuc

SEQ ID NO: 19428 - RNA, 2511 nt, Homo sapiens
gagcgcggggcugggcccggggccgcggcgacaggcagcagccgcggcggggacgcggggcgcgagcgggcggcgcgggaccgucgggggccgccggggccgggccggggucggggcgcacggcuacgcgggcgcaggugggcgaucccauaggggcggagggggcaccccggcuccggaacccggggcccggcaaggccaggggcgccgcggggcccccgggcgcagguggugagugcccggagcgcagguggaggcgcggcggcagcccgcggugcucagggugacccgggagcgggucuggcucagggggcagugggagcccgggcucgucggagggugcagcgcggggucccgccgagccauccagacgcaggccccgcggggcgcacgggaggcccccggggacuggcgcccuggcccgggcaugaggcgcggcggggccggcaggagccggaggaggagccgccgccgccguugacccggccgccggccgggagcugggagagaugcggagcccggccaccggcgucccccucccaacgccgccgccgccgcugcugcugcuguugcugcugcugcugccgccgccacuauugggagaccaaguggggcccugucguuccuugggguccaggggacgaggcucuucgggggccugcgcccccaugggcuggcucuguccauccucagcgucgaaccucuggcucuacaccagccgcugcagggaugcgggcacugagcugacuggccaccugguaccccaccacgauggccugaggguuugguguccagaauccgaggcccauauuccccuaccaccagcuccugaaggcugccccuggagcugucgccuccugggcauuggaggccaccuuuccccacagggcaagcucacacugcccgaggagcacccgugcuuaaaggcuccacggcucagaugccaguccugcaagcuggcacaggcccccgggcucagggcaggggaaaggucaccagaagagucccugggugggcgucggaaaaggaauguaaauacagccccccaguuccagccccccagcuaccaggccacagugccggagaaccagccagcaggcaccccuguugcaucccugagggccaucgacccggacgagggugaggcaggucgacuggaguacaccauggaugcccucuuugauagccgcuccaaccaguucuucucccuggacccagucacuggugcaguaaccacagccgaggagcuggaucgugagaccaagagcacccacgucuucagggucacggcgcaggaccacggcaugccccgacgaagugcccuggcuacacucaccaucuugguuacugacaccaaugaccaugacccuguguucgagcagcaggaguacaaggagagccucagggagaaccuggagguuggcuaugaggugcucacugucagggccacggauggugaugccccucccaaugccaauauucuguaccgccugcuggaggggucugggggcagccccucugaagucuuugagaucgacccucgcucuggggugauccgaacccguggcccuguggaucgggaagagguggaauccuaccagcugacgguagaggcaagugaccagggucgggacccggguccucggaguaccacagccgcuguuuuccuuucuguggaggaugacaaugauaaugccccccaguuuagugagaagcgcuaugugguccaggugagggaggaugugacuccaggggccccaguacuccgagucacagccucggaucgagacaaggggagcaaugccguggugcacuauagcaucaugaguggcaaugcucggggacaguuuuaucuggaugcccagacuggagcucuggauguggugagcccucuugacuaugagacgaccaaggaguacacccuacgggugcgagcacaggaugguggccgucccccacucucuaaugucucuggcuuggugacaguacagguccuggauaucaacgacaaugcccccaucuucgucagcaccccuuuccaggcuacuguccuggagaguguccccuuaggcuaccugguucuccauguccaggcuaucgacgcugaugcuggugacaaugcccgccuggaauaccgccuugcuggggugggacaugacuuccccuucaccaucaacaauggcacaggcuggaucucuguggcugcugaacuggaccgggaggaaguugauuucuacagcuuugggguagaagcucgagaccauggcacuccagcacucacugccucggccagugucagcgugacuguccuggaugucaacgacaacaauccaaccuuuacccaaccagaguacacagugcggcucaaugaggaugcagcugugggcaccagcguggugacggugucagcuguggaccgugaugcucauagugucaucaccuaccagaucaccaguggcaauacucgaaaccgcuucuccaucaccagccaaagugguggugggcugguau

SEQ ID NO: 19429 - RNA, 2668 nt, Homo sapiens
gagugauccaggcuuuuuguguagcuuuuccuuggcuggagagggccucggaaaccgcagccuuaaacaagucagaggagagagucagggaaagagccacagcauacuggcauaauucauucuagcuaaggcacugcuccaauuguguuguuguugauuuguuuuaaagaaacuuggggagagcucagggagagagauuuuuuuuaaaaaucaaauuaucuuuuuucuuccuuuuuuuucuuuuuucaaaaaaggaagagggggaagaaaaagagagggagaaacucuauggccacauucacucaaagggaaaugggaauuacgauguuggcuguggguugacaaaaaaaaaaagaugaugaaaaggaaaacaaggagugggaggaaugggaaaccuagagaacuacaccccauuuuaacuccacuccugcccucucaccaccccacacccccucacccccggauuuccagccaugagauucucugaagcagucaccagcuuagcugcacgcucaauaccagcccacgucucuccucggaaaagacucaacugccagucugagggcgaagacacacaccucugucccccaugcccacccccagccccccaguucaaagauacuagcaccaccuccuaauugccaugugccaugcaagaaaucagauuugcaggaaaaucauuugaaagcguaagccauuugggggcucuauuaauaacucucuaggagcaggugugcuuaggguccgagggcgcagugaggugugggcagccaggcccgccccgccuugcuguaaacaggaaagcuuagcgccuccgugaagcgacugccuuuucuuucuucuucuuauucuccccgccuccccccgcgcccccccaccccaccccccaccccaagccagggcaaguaaauuuaaagguauucaguuaaaaccauucauaacagauugcagcaaaucccagaaguuucguacauuaguugauugcauaaauauuuuuugcuuuguuuaguuuagccaaaacauacacaaaagagagaaaucaaacuacucaugacagccauaauacaugcuaccacauuucuaauuucgauugcaaaacuacucuucagaaacucacauuaaacugcucccuggugcauugcuaaauuugcgugggcaguuuuauuuacugcagucccccaacacguugacuccucuccuaggacuagaaaguuacaaagaaacuuucuaagacggcacuggucagcagaagucuacuucuaaguugcuuaaauauuucaagguaaugcagcaaugcaauaaaaugagguaauagagaugagaacaaucccagcaacuccgcgaacagcagaggcugcucaagccaagaagcuccgcauuuucccccaacuaauuuuauacccugcuccugggcaguacuaauuuaagccauuacccacgcuccacaccacccaccauauucuuugucuauaggauuuccaaaauuuaacgccuucccuccuauuccuccgaccaacugcaauuuucacugccccuacacccguagguuccacaguugggaauuaaccuuuuuucugaacuccauaaaucacaagugcccaagaacaaucugaucgagaugggcuccuuaguagcccagagaugcaaauuuucagcgcccggagaugcauguuuucuaaguuuuuguuugccucguucgacuuaaaaauucguuucugacaccuaagcccuaccacaaccgggcuccccgcgcccgcgacccccgccauucgccgcccccuaccucgcucaagcagggcgaaguugcguucggagagcccgggaucuguacggcucgcuucgcaucuugcugcugcccccgacugacugcguagugcucucgcaaacuuacucgagucgggguccccucccuccgcagcggagcacuccaauggccagucccgcucgccgcggccaguucccugccugcuacgcgaagucacccagcgccgcgccaaggcugggugguuucuucaggaagaggcugggagggguuaaugccuuaaccccccacgcccucugucagcugggggcccccggaucugaacugcugagacgcacuguccaggaaagaucuggggcagaagcaaaaaaaaaaaaaaaaaaaaaaaaaagaaccccuccuccccaaacaacaaaugaaagaaaaaaagagagagagagaaggggcggagcccgguaaccccuggauucuacuguauaaaucacugcccucgcccagauagacgcugaucccuggcuguggagaggauucucccgagccccugaaaaaaaaaaaagguggagagacuuugaaaacuuuucucucgaaaagucugaggaggcagaggacggcccggagucucguagcgcaccgcccuggucccacaccccccgcagcccuaggaggaucggugugcugagcuuguggccaggagcuccccgagccacuuucgcgcgagcagcagaaaaccugagccgcggcccggcgagugucggcggcgcucuggggaggagaggcugggaaggggcugcgagagguacggaggagacaagcagcccgggagggagaaugaaccgggagguuccuguacuccccccgccaccccagauccucgugcuacucgcaacugcggucugaggggcagug

SEQ ID NO: 19430 - RNA, 2668 nt, Homo sapiens
cacugccccucagaccgcaguugcgaguagcacgaggaucugggguggcggggggaguacaggaaccucccgguucauucucccucccgggcugcuugucuccuccguaccucucgcagccccuucccagccucuccuccccagagcgccgccgacacucgccgggccgcggcucagguuuucugcugcucgcgcgaaaguggcucggggagcuccuggccacaagcucagcacaccgauccuccuagggcugcggggggugugggaccagggcggugcgcuacgagacuccgggccguccucugccuccucagacuuuucgagagaaaaguuuucaaagucucuccaccuuuuuuuuuuuucaggggcucgggagaauccucuccacagccagggaucagcgucuaucugggcgagggcagugauuuauacaguagaauccagggguuaccgggcuccgccccuucucucucucucuuuuuuucuuucauuuguuguuuggggaggagggguucuuuuuuuuuuuuuuuuuuuuuuuuuugcuucugccccagaucuuuccuggacagugcgucucagcaguucagauccgggggcccccagcugacagagggcgugggggguuaaggcauuaaccccucccagccucuuccugaagaaaccacccagccuuggcgcggcgcugggugacuucgcguagcaggcagggaacuggccgcggcgagcgggacuggccauuggagugcuccgcugcggagggaggggaccccgacucgaguaaguuugcgagagcacuacgcagucagucgggggcagcagcaagaugcgaagcgagccguacagaucccgggcucuccgaacgcaacuucgcccugcuugagcgagguagggggcggcgaauggcgggggucgcgggcgcggggagcccgguugugguagggcuuaggugucagaaacgaauuuuuaagucgaacgaggcaaacaaaaacuuagaaaacaugcaucuccgggcgcugaaaauuugcaucucugggcuacuaaggagcccaucucgaucagauuguucuugggcacuugugauuuauggaguucagaaaaaagguuaauucccaacuguggaaccuacggguguaggggcagugaaaauugcaguuggucggaggaauaggagggaaggcguuaaauuuuggaaauccuauagacaaagaauauggugggugguguggagcguggguaauggcuuaaauuaguacugcccaggagcaggguauaaaauuaguugggggaaaaugcggagcuucuuggcuugagcagccucugcuguucgcggaguugcugggauuguucucaucucuauuaccucauuuuauugcauugcugcauuaccuugaaauauuuaagcaacuuagaaguagacuucugcugaccagugccgucuuagaaaguuucuuuguaacuuucuaguccuaggagaggagucaacguguugggggacugcaguaaauaaaacugcccacgcaaauuuagcaaugcaccagggagcaguuuaaugugaguuucugaagaguaguuuugcaaucgaaauuagaaaugugguagcauguauuauggcugucaugaguaguuugauuucucucuuuuguguauguuuuggcuaaacuaaacaaagcaaaaaauauuuaugcaaucaacuaauguacgaaacuucugggauuugcugcaaucuguuaugaaugguuuuaacugaauaccuuuaaauuuacuugcccuggcuuggggugggggguggggugggggggcgcggggggaggcggggagaauaagaagaagaaagaaaaggcagucgcuucacggaggcgcuaagcuuuccuguuuacagcaaggcggggcgggccuggcugcccacaccucacugcgcccucggacccuaagcacaccugcuccuagagaguuauuaauagagcccccaaauggcuuacgcuuucaaaugauuuuccugcaaaucugauuucuugcauggcacauggcaauuaggagguggugcuaguaucuuugaacuggggggcugggggugggcaugggggacagaggugugugucuucgcccucagacuggcaguugagucuuuuccgaggagagacgugggcugguauugagcgugcagcuaagcuggugacugcuucagagaaucucauggcuggaaauccgggggugagggggugugggguggugagagggcaggaguggaguuaaaaugggguguaguucucuagguuucccauuccucccacuccuuguuuuccuuuucaucaucuuuuuuuuuuugucaacccacagccaacaucguaauucccauuucccuuugagugaauguggccauagaguuucucccucucuuuuucuucccccucuuccuuuuuugaaaaaagaaaaaaaaggaagaaaaaagauaauuugauuuuuaaaaaaaaucucucucccugagcucuccccaaguuucuuuaaaacaaaucaacaacaacacaauuggagcagugccuuagcuagaaugaauuaugccaguaugcuguggcucuuucccugacucucuccucugacuuguuuaaggcugcgguuuccgaggcccucuccagccaaggaaaagcuacacaaaaagccuggaucacuc

SEQ ID NO: 19431 - RNA, 2173 nt, Homo sapiens
gcgacgaucaacguugaagaucaccgcucgcaaccccgggccuggcgccggguaggggcgcggcgcucgauuuccuucccugccuccgccgucccccuggugcgcaugcucagcucagcucggcccucgccuuugauuuauuuuuuuucugggcggccgcugcgacccgggacugacuucgggaugggaaguggagcccccggagcugcuaccguggcggcggcgcugugaggagcagccagggggaggcagcugcggcucgccggugaguauccgggaagcgccaccauggggcuccguaagaagagcaccaagaacccccccguucucagccaggaauucauccugcagaaucaugcggacaucgucuccugcguggggauguucuuccugcuggggcuuguguucgagggaacagcagaagcauccaucguguuucucacucuucagcacaguguugcugucccugcagcagaggaacaagccacgggcucaaagucccucuauuauuauggugucaaagauuuggccacgguuuucuucuacaugcugguggcaaucauuauucaugccacaauucaggaauauguguuggauaaaauuaacaagagaaugcaguucaccaaagcgaaacaaaacaaguuuaacgagucuggucaguuuaguguguucuacuuuuuuucuuguauuuggggcacauucauuuuaaucucugaaaacugccugucagacccaacucuuauauggaaggcucguccccauagcaugaugacauuucaaaugaaguuuuucuacauaucccaguuggcuuacugguuucaugcuuuuccugaacucuacuuccagaaaaccaaaaaacaagacaucccucgucaacuugucuacauuggucuucaccucuuccacauuacuggagcuuaucucuuguacuugaaucauuugggacuucuucuuuugguacugcauuauuuuguugaauuacuuucccacaugugcggccuguuuuacuuuagugaugaaaaguaccagaaaggcauaucucugugggccauuguguuuaucuuggguagacuugugacuuuaauuguuuccguacucacuguuggguuucaccuggcuggaucgcagaaucggaauccugaugcccuuacuggaaauguaaauguguuggcagcuaaaauugcuguucugucguccaguugcacgauccaagccuacguaacauggaacuuaauuacucucuggcuucagagguggguagaagauucuaauauucaggccucauguaugaaaaagaaacggucgagaucuucuaaaaaaagaacagaaaacggagugggaguggaaacuucaaauagaguagacuguccgccaaagaggaaagagaaaucuucauaaucuuugcaagcgcauugauuaaugucugcaaaggaaucugcucuuugagguuucuuucugcacuagagauuuuucuguuuuugaaaauaguucgugcucuucgguuuuuguuauugaacuguuucauguauuuuuuaaagacauuugaggggaggaggauuauuaugaaugggaaaaaaagauuuugguugagacuaaauuacucaucgucaaaauaaugucaaaauaguuuuggggaucaccacuauauuuuguuuugauuuuuaaccuuucaacauuuuccuaaugauuugcagagauaacugcacaauuuugcauaucaaugauacugguucuuacucccaccaguguuucauaauacuaacaagauggucucuccuagcaagauuauguguuuaaugcuugcuuugggguaaaauaaaaguacgaaaaagguggaagucaaaucaguauucuguaauuguuagaauuuauuuuuuaagaacuuacaacucagaaaagauugcuagacucaccaaaauaauaaauguucuuuauuuuacagguagugauuauuagugcuucauccccauuuaaaaaaacacaguacuaauggguaacacauauggagguuugcugccauauauauugcaucaaaauaucauuaauuaauauaaaaauauuaaaaucauuccuguccauuccacuuguaaaugggaauucaugaaauuaaauauuacuuuaaaaaggacauugaacuuagucuuuuuuaaaaauguuuauuaaaaaugauucc

SEQ ID NO: 19432 - RNA, 2173 nt, Homo sapiens
ggaaucauuuuuaauaaacauuuuuaaaaaagacuaaguucaauguccuuuuuaaaguaauauuuaauuucaugaauucccauuuacaaguggaauggacaggaaugauuuuaauauuuuuauauuaauuaaugauauuuugaugcaauauauauggcagcaaaccuccauauguguuacccauuaguacuguguuuuuuuaaauggggaugaagcacuaauaaucacuaccuguaaaauaaagaacauuuauuauuuuggugagucuagcaaucuuuucugaguuguaaguucuuaaaaaauaaauucuaacaauuacagaauacugauuugacuuccaccuuuuucguacuuuuauuuuaccccaaagcaagcauuaaacacauaaucuugcuaggagagaccaucuuguuaguauuaugaaacacuggugggaguaagaaccaguaucauugauaugcaaaauugugcaguuaucucugcaaaucauuaggaaaauguugaaagguuaaaaaucaaaacaaaauauaguggugauccccaaaacuauuuugacauuauuuugacgaugaguaauuuagucucaaccaaaaucuuuuuuucccauucauaauaauccuccuccccucaaaugucuuuaaaaaauacaugaaacaguucaauaacaaaaaccgaagagcacgaacuauuuucaaaaacagaaaaaucucuagugcagaaagaaaccucaaagagcagauuccuuugcagacauuaaucaaugcgcuugcaaagauuaugaagauuucucuuuccucuuuggcggacagucuacucuauuugaaguuuccacucccacuccguuuucuguucuuuuuuuagaagaucucgaccguuucuuuuucauacaugaggccugaauauuagaaucuucuacccaccucugaagccagagaguaauuaaguuccauguuacguaggcuuggaucgugcaacuggacgacagaacagcaauuuuagcugccaacacauuuacauuuccaguaagggcaucaggauuccgauucugcgauccagccaggugaaacccaacagugaguacggaaacaauuaaagucacaagucuacccaagauaaacacaauggcccacagagauaugccuuucugguacuuuucaucacuaaaguaaaacaggccgcacaugugggaaaguaauucaacaaaauaaugcaguaccaaaagaagaagucccaaaugauucaaguacaagagauaagcuccaguaauguggaagaggugaagaccaauguagacaaguugacgagggaugucuuguuuuuugguuuucuggaaguagaguucaggaaaagcaugaaaccaguaagccaacugggauauguagaaaaacuucauuugaaaugucaucaugcuauggggacgagccuuccauauaagaguugggucugacaggcaguuuucagagauuaaaaugaaugugccccaaauacaagaaaaaaaguagaacacacuaaacugaccagacucguuaaacuuguuuuguuucgcuuuggugaacugcauucucuuguuaauuuuauccaacacauauuccugaauuguggcaugaauaaugauugccaccagcauguagaagaaaaccguggccaaaucuuugacaccauaauaauagagggacuuugagcccguggcuuguuccucugcugcagggacagcaacacugugcugaagagugagaaacacgauggaugcuucugcuguucccucgaacacaagccccagcaggaagaacauccccacgcaggagacgauguccgcaugauucugcaggaugaauuccuggcugagaacggggggguucuuggugcucuucuuacggagccccaugguggcgcuucccggauacucaccggcgagccgcagcugccucccccuggcugcuccucacagcgccgccgccacgguagcagcuccgggggcuccacuucccaucccgaagucagucccgggucgcagcggccgcccagaaaaaaaauaaaucaaaggcgagggccgagcugagcugagcaugcgcaccagggggacggcggaggcagggaaggaaaucgagcgccgcgccccuacccggcgccaggcccgggguugcgagcggugaucuucaacguugaucgucgc

SEQ ID NO: 19433 - RNA, 2672 nt, Homo sapiens
cguggcucgcaggccucccggaguccagggcgcccugauuggccagcugcgccucgcgaccuccauucauuaauaaauuagcggcacgcuccagccgagcgcgagccaccaaucacaauggacagcggcggcgacaacagccgcagcuugagccucugcggccgcugcggcuucgccagcuccggccgcagcccggagcuccaacaggagcuuuagaaccauuuuauguugauuagauaaagggggaaaagagaggcggggguggugggaggaggaggauggauggcagggccaagggagggggaaaggcggugaagaaagaggaagaaaugaaugaugauaaugcaaugaaaagaauaagccagaggagggaaaagcgggggagaaggggggcaggacugacaggaggaggaggcgguggcgggggaggagggggcccggggcagaucugauuguuuucuuggugguauauaagggguuuuaaggagagucgugugccagacacgcagccacugaaccacaagcagcuucgcguuaacuggagugccugggagucgcgugccaggagccgcacggccagggacugacugacagacagacacgcaccaccaccacaacacacgagacccgggcgggccgccgccgccgccgccggggcucuuggcaaacucgccggucgcagaggucccccgcggagcugcgccacaguagcgccgggcuugcagcuuucacgccgggcgaaggacccggcgcugcgcucgcagcugcgcggagauucccggcacaggccaaagucacagcaacgcugaggcacaguuagagccaacuaaguaaguauucgagccaccgcuuccaacuacgcaggugguuuccccgcacucaguccaaccacacccgcacgcccucugcuccgcgcagaaucuuugucgcggaggccgcagucccuucucggggagggaacgcaggaccgcccgcggagggcaggacccggcugacuggcagcagggucacagcgagcgcuagcggcgcuccugaccuugguuagcacugccuggguuucuuccuucgccuuccugcuccgcgccauucggagcuggucuucucgggugcgcgccggagcacgccccugugacacgaagaucgcgccucuguuucuuuccuuacaccucacugccuuuuuccccuuucucucuucgguaggauguucgucaaauccgagaccuuggaguugaaggaggaagaggacguguuagugcugcucggaucggccucccccgccuuggcggcccugaccccgcugucauccagcgccgacgaagaagaggaggaggagccgggcgcgucaggcggggcgcgucggcagcgcggggcugaggccgggcagggggcgcggggcggcguggcugcgggugcggagggcugccggcccgcacggcugcugggucugguacacgauugcaaacggcgcccuucccgggcgcgggccgucucccgaggcgccaagacggccgagacggugcagcgcaucaagaagacccguagacugaaggccaacaaccgcgagcgaaaccgcaugcacaaccucaacgcggcacuggacgcgcugcgcgaggugcuccccacguuccccgaggacgccaagcucaccaagaucgagacccugcgcuucgcccacaacuacaucugggcacucaccgagacccugcgccuggcggaucacugcgggggcggcggcgggggccugccgggggcgcucuucuccgaggcaguguugcugagcccgggaggagccagcgccgcccugagcagcagcggagacagccccucgcccgccuccacguggaguugcaccaacagccccgcgccguccuccuccguguccuccaauuccaccucccccuacagcugcacuuuaucgcccgccagcccggccgggucagacauggacuauuggcagcccccaccucccgacaagcaccgcuaugcaccucaccuccccauagccagggauuguaucuagagcugccauuucugcuacccacgccaggccuuaguggguucccuuuccuguccccagucgagcccuccucccuuccccugccccuccuuuccacgcccuggaaaccaucucacuucacagggcagguguagccuuucugauuccucgguuguuucuugcauuucuuggcuuuggguauccuucauucagacgggcucugauuuacugaaggugugauggagcuuauugucaaagccaaggguggcguuuugggggcgcuucuugagacgaaaaagacccugggaagagaugaugguggcauaucuaaagaguuugcagagcggacugacgcuccuccccuuucucuuuaacgccgaaggacuuggugcaguucgugugaaucucacagggggaaugcaacugguuccugugaucucuucaccuuugcuucuacauagagauguuaaugucgaguagaaagaaauguaucuuagcaucugaaugauuuugcugguaauaauauuauccacagauuugcaauggcuggcaucugcuuuauucccauugcugucugcaggcugugggaauuucaccugucaaaccaaacuucccucucugaugugcacuuuguucuguuucccagauucgucacaaugccuauuguccuguccuu

SEQ ID NO: 19434 - RNA, 2672 nt, Homo sapiens
aaggacaggacaauaggcauugugacgaaucugggaaacagaacaaagugcacaucagagagggaaguuugguuugacaggugaaauucccacagccugcagacagcaaugggaauaaagcagaugccagccauugcaaaucuguggauaauauuauuaccagcaaaaucauucagaugcuaagauacauuucuuucuacucgacauuaacaucucuauguagaagcaaaggugaagagaucacaggaaccaguugcauucccccugugagauucacacgaacugcaccaaguccuucggcguuaaagagaaaggggaggagcgucaguccgcucugcaaacucuuuagauaugccaccaucaucucuucccagggucuuuuucgucucaagaagcgcccccaaaacgccacccuuggcuuugacaauaagcuccaucacaccuucaguaaaucagagcccgucugaaugaaggauacccaaagccaagaaaugcaagaaacaaccgaggaaucagaaaggcuacaccugcccugugaagugagaugguuuccagggcguggaaaggaggggcaggggaagggaggagggcucgacuggggacaggaaagggaacccacuaaggccuggcguggguagcagaaauggcagcucuagauacaaucccuggcuauggggaggugaggugcauagcggugcuugucgggaggugggggcugccaauaguccaugucugacccggccgggcuggcgggcgauaaagugcagcuguagggggagguggaauuggaggacacggaggaggacggcgcggggcuguuggugcaacuccacguggaggcgggcgaggggcugucuccgcugcugcucagggcggcgcuggcuccucccgggcucagcaacacugccucggagaagagcgcccccggcaggcccccgccgccgcccccgcagugauccgccaggcgcagggucucggugagugcccagauguaguugugggcgaagcgcagggucucgaucuuggugagcuuggcguccucggggaacguggggagcaccucgcgcagcgcguccagugccgcguugagguugugcaugcgguuucgcucgcgguuguuggccuucagucuacgggucuucuugaugcgcugcaccgucucggccgucuuggcgccucgggagacggcccgcgcccgggaagggcgccguuugcaaucguguaccagacccagcagccgugcgggccggcagcccuccgcacccgcagccacgccgccccgcgcccccugcccggccucagccccgcgcugccgacgcgccccgccugacgcgcccggcuccuccuccucuucuucgucggcgcuggaugacagcggggucagggccgccaaggcgggggaggccgauccgagcagcacuaacacguccucuuccuccuucaacuccaaggucucggauuugacgaacauccuaccgaagagagaaaggggaaaaaggcagugagguguaaggaaagaaacagaggcgcgaucuucgugucacaggggcgugcuccggcgcgcacccgagaagaccagcuccgaauggcgcggagcaggaaggcgaaggaagaaacccaggcagugcuaaccaaggucaggagcgccgcuagcgcucgcugugacccugcugccagucagccggguccugcccuccgcgggcgguccugcguucccuccccgagaagggacugcggccuccgcgacaaagauucugcgcggagcagagggcgugcgggugugguuggacugagugcggggaaaccaccugcguaguuggaagcgguggcucgaauacuuacuuaguuggcucuaacugugccucagcguugcugugacuuuggccugugccgggaaucuccgcgcagcugcgagcgcagcgccggguccuucgcccggcgugaaagcugcaagcccggcgcuacuguggcgcagcuccgcgggggaccucugcgaccggcgaguuugccaagagccccggcggcggcggcggcggcccgcccgggucucguguguuguggugguggugcgugucugucugucagucagucccuggccgugcggcuccuggcacgcgacucccaggcacuccaguuaacgcgaagcugcuugugguucaguggcugcgugucuggcacacgacucuccuuaaaaccccuuauauaccaccaagaaaacaaucagaucugccccgggcccccuccucccccgccaccgccuccuccuccugucaguccugccccccuucucccccgcuuuucccuccucuggcuuauucuuuucauugcauuaucaucauucauuucuuccucuuucuucaccgccuuucccccucccuuggcccugccauccauccuccuccucccaccacccccgccucucuuuucccccuuuaucuaaucaacauaaaaugguucuaaagcuccuguuggagcuccgggcugcggccggagcuggcgaagccgcagcggccgcagaggcucaagcugcggcuguugucgccgccgcuguccauugugauugguggcucgcgcucggcuggagcgugccgcuaauuuauuaaugaauggaggucgcgaggcgcagcuggccaaucagggcgcccuggacuccgggaggccugcgagccacg

SEQ ID NO: 19435 - RNA, 2401 nt, Homo sapiens
guccugauuugcuccccaaaaguacguuucugucuccccgcugcccuggcgcucccccuuugauuuauuagggcugccggguuggcgcagauugcuuuuucuucucuuccaucccauccucccuucugguccuccuuuccacagugggaguccgugcuccugcuccucgguuggcuccuaagugccccgccagguccccucuccuuucgcucucccggcuccggcucccgacucuucggcccgcuggcaucugcuucccuccccugccucguuucucgucgccccugcucgcuccccccggcgcucgcccgggcgcugugcucgcuccuggaucgccagccgcgcagccgggcucggccggccgcccgcgcgccacugugcaguggaguuugguggaaucucugcugacgucacgucacuccccacacggaguaggagcagagggaagagagagggaugagagggagggagaggagagagagugcgagaccgagcgagaaagcuggagaggagcagaaagaaacugccaguggcggcuagauuucggaggccccagugcacccguggacuccuucggaacuuggcacccucaggagcccugcaguccucucaggcccggcuuucgggcgcuugccgugcagccggaggcucggcucgcuggaaaucgccccgggaagcagugggacgcggagacagcagcucucucccgguagccgguaaguggaggccaucuaucccgcagggaugugagauaaugcgagucuggaaauuuguuccacuucggagaaucuucaccguaggugauuuguggcuuuuggggcuaaguuucgcccaagguaacgcagucggcaaacagaccuugcaaagcccuguuccuuucgucccccgccacagacacuaacaaucuacagggugcugaagucgagagggaagccagaccguggcuggcauuuaaaacgagguaucuucccuuaaaucucggugccaacacugcaggaacaaauccucgggccaaggauuagcauucucaagauaaagggcuggguacaaaguuucagcuacuggaagauuagcccccuucccauuguuauccauugggaaaaaaaagaaaagaaaaagauuccaucuuaacuggcaguuagugaccucucaggcccaagcgaauuaccugggagccaggccuggaugccaagcucucaccauuucuuuggauuguaacuccuuuaaauugaucaccagucaacuccaaucuggcacuucaggagauacacuuuaaauggaugcagagaauuauuuuccagcuggagauuaagaaaaaaauuuucgauucuaaaccuccgaaauauguuccucuuuuccaguuuaaccacuuuacuuucuuaagcaauuuagaaaucaaacuaucauaagguggugugauuuuuuuuuacucuuuugugugaguauugucuuacuaaacuaaacggaaaaaacuuuuaccauuauaaauguaaauaucagaauucauacauucuaaaauauuuuuaugaaaaauuaaucugauuuaaagaaauuuccuugcauuuguuuuagucuaucaaucaaaacuaaagaugcuuuuaucacacaaaauaucauuuuggcagaaauccaucuaaaauucaaauaccaauaauaucaagaaaacaaagcacauaagcaaaauaaauugaagauuuuuguugauguaacaugagcauacaacauuucaauaaccaaacuuucccuaaaaaauuaaauagccacuucauuuguggaauguuuuacuuuaacucagcaaaauuacacuuaaauuauuuaggugcuuuguuccuuaaguuaagcguguuugucuucaaauguuccuaaagcacuuauauuaauugguuguaaagaacgcauacacaugguaaaauacagaacugaacugagcaguauuuuaauuuccuuaaauaauuacuuacuacaaauuaauuuacuggcuaauuucacaauuuaguucauuuaaaacacauguuccugugcuguuuauuuuuaaacuuuccauuaaagauuuuguuaugggguaacaaaguguaugaaaaggggggaaaugugaaaggaucugggauuauucgaacuguauuuuuccugcacuuucagucuugcgguagucaucagaaauuauuuuuuagcaaauuguuuuauuucuuagggcuugccugccugcuuugccaugguuccucguccuccguuagccguguagugcuuuuugugugcucacaauauaaaacccaaguuggccaaaacaagaguccuuggcauauacauuccaacuagaacaugaacuuugggggugagaacuaccucccaucaggaaaagucucccaucucaauuugugagauuagccauugaagccaguuc

SEQ ID NO: 19436 - RNA, 2401 nt, Homo sapiens
gaacuggcuucaauggcuaaucucacaaauugagaugggagacuuuuccugaugggagguaguucucacccccaaaguucauguucuaguuggaauguauaugccaaggacucuuguuuuggccaacuuggguuuuauauugugagcacacaaaaagcacuacacggcuaacggaggacgaggaaccauggcaaagcaggcaggcaagcccuaagaaauaaaacaauuugcuaaaaaauaauuucugaugacuaccgcaagacugaaagugcaggaaaaauacaguucgaauaaucccagauccuuucacauuuccccccuuuucauacacuuuguuaccccauaacaaaaucuuuaauggaaaguuuaaaaauaaacagcacaggaacauguguuuuaaaugaacuaaauugugaaauuagccaguaaauuaauuuguaguaaguaauuauuuaaggaaauuaaaauacugcucaguucaguucuguauuuuaccauguguaugcguucuuuacaaccaauuaauauaagugcuuuaggaacauuugaagacaaacacgcuuaacuuaaggaacaaagcaccuaaauaauuuaaguguaauuuugcugaguuaaaguaaaacauuccacaaaugaaguggcuauuuaauuuuuuagggaaaguuugguuauugaaauguuguaugcucauguuacaucaacaaaaaucuucaauuuauuuugcuuaugugcuuuguuuucuugauauuauugguauuugaauuuuagauggauuucugccaaaaugauauuuugugugauaaaagcaucuuuaguuuugauugauagacuaaaacaaaugcaaggaaauuucuuuaaaucagauuaauuuuucauaaaaauauuuuagaauguaugaauucugauauuuacauuuauaaugguaaaaguuuuuuccguuuaguuuaguaagacaauacucacacaaaagaguaaaaaaaaaucacaccaccuuaugauaguuugauuucuaaauugcuuaagaaaguaaagugguuaaacuggaaaagaggaacauauuucggagguuuagaaucgaaaauuuuuuucuuaaucuccagcuggaaaauaauucucugcauccauuuaaaguguaucuccugaagugccagauuggaguugacuggugaucaauuuaaaggaguuacaauccaaagaaauggugagagcuuggcauccaggccuggcucccagguaauucgcuugggccugagaggucacuaacugccaguuaagauggaaucuuuuucuuuucuuuuuuuucccaauggauaacaaugggaagggggcuaaucuuccaguagcugaaacuuuguacccagcccuuuaucuugagaaugcuaauccuuggcccgaggauuuguuccugcaguguuggcaccgagauuuaagggaagauaccucguuuuaaaugccagccacggucuggcuucccucucgacuucagcacccuguagauuguuagugucuguggcgggggacgaaaggaacagggcuuugcaaggucuguuugccgacugcguuaccuugggcgaaacuuagccccaaaagccacaaaucaccuacggugaagauucuccgaaguggaacaaauuuccagacucgcauuaucucacaucccugcgggauagauggccuccacuuaccggcuaccgggagagagcugcugucuccgcgucccacugcuucccggggcgauuuccagcgagccgagccuccggcugcacggcaagcgcccgaaagccgggccugagaggacugcagggcuccugagggugccaaguuccgaaggaguccacgggugcacuggggccuccgaaaucuagccgccacuggcaguuucuuucugcuccucuccagcuuucucgcucggucucgcacucucucuccucucccucccucucaucccucucucuucccucugcuccuacuccguguggggagugacgugacgucagcagagauuccaccaaacuccacugcacaguggcgcgcgggcggccggccgagcccggcugcgcggcuggcgauccaggagcgagcacagcgcccgggcgagcgccggggggagcgagcaggggcgacgagaaacgaggcaggggagggaagcagaugccagcgggccgaagagucgggagccggagccgggagagcgaaaggagaggggaccuggcggggcacuuaggagccaaccgaggagcaggagcacggacucccacuguggaaaggaggaccagaagggaggaugggauggaagagaagaaaaagcaaucugcgccaacccggcagcccuaauaaaucaaagggggagcgccagggcagcggggagacagaaacguacuuuuggggagcaaaucaggac

SEQ ID NO: 19437 - RNA, 2482 nt, Homo sapiens
guuuuucaaauuuucuaguuuuaaguaacgugucuccuuuuuauauggggugggggauuggaaauggauguagugagacacaaagagugggugucuuguugauccuuguaccuuucucuucuugaccauuccacucucuucucccaagccuucgacuccuagccucaucucuucaccuuuggguucguacuaaaagccggaucgccuugggcugggcaggagcugaauucccgggagcuugccuguguagacccagugcgcacggcgaggcaguagcccggccccgcacugcugauaggugcaggcaggacagucccuccaccgcggcucggggcguccugauuggugcggagccacgucagucgcacccggagaagggucugggaggaggcggaggcggagagggcuggggagggccgcggcggagugacgucucggcaccaggaagcccgccucugguuuuaagauguuaggccaacagggaagcgcggagccgcagaucugguccgucgcucgccugggugccuggagcugagcugcggcaaggcccggcuccuguucgaccgcccgaggggugugcgugugcgcguugcggagggugcgcucagagggccgcgucguggcugcagcggcugcugccgccgcaggggaucuaauaucaccuaccugucccugucacucuugacacuucucugucagggcugccgcguggggggggggcgggcagagcgcggucggcguuagcuuuccuuauuggagggguucuugggggagggagggagagaagaagggggucuuugcccacucuuguuucgcuuuggagcuuggaagccugcucccuaaagacgcucugaguggugcccuucugcccacaucccaugucuucguuugcccgcugacuuuccgucuccggacuuuuucgcuugagccuuccggaggagacgggggcagcuuggcuugagaacucggcggggguugcguccccuggcucuccccgcagcggggaaacuccgcgccuagagcgcgacccggagcgggcagcggcggcuacgggggcucggcggggcaguagccaaggacuaguagagcgucgcgcucccucguccaugaacugcaugaaaggcccgcuucacuuggagcaccgagcagcggggaccaagcugucggccgucuccucaucuuccugucaccauccccagccguuagccauggcuucgguucuggcucccggucagccccggucgcuggacuccuccaagcacaggcuggaggugcacaccaucuccgacaccuccagcccggaggccgcagguaaggcgccgcgccgcccugcagacauucccgcucagcugcucugcgccacccgcucccucucgccccaaggaagucagccccuccggggggaggcguggugggaguggucguucgccuggcuccccgcagaacuuccgggagccggaauuuugacuaccccgcaucccuuuaguucucccucgaccggcccggcuccuggggcgcuaagggcgcgagcaauucugccgcccucucuauucguacccuggccucccuucuguuuccugggucacaaaaaucccagcaucuugauucgaggaccuucagaggccgccgaccucugucccuguuuuccucucggcuuucagcucccgaggagcuccacucguuaggaaauugccugaaaccacucagaaaugcccuucgcgaagaggcauuuuuuuuuuuuuuuugggaaagggccggcgaacuucggugcccaaccgaauccccacaucuuuuccuagccuucccaaaccgcauggaaaucugagcuuucugcgagggggaggggggucuguaaaccacgcgcgugugcgcgucccaggagauuuggugugucugcgcagagguguauaaauauacuugaaagcacaggcuauaaaagugaaugugccgcugcagugagauaaacauguaaauaaaacgugcggcgcugggggaggggaggaaauggggcgcggacacccacacuugcgccugcacaccccacaggcgcagcgcuccucgcggcccggagccgccgcgcgcacccuccuccggcgccaggcagcccagcucuuccacggcuucugccgccgguccaguuggcguccgcguugcaggugggcaugcugacgggaaaguguguguguuucguuuucagagaaagauaaaagccagcaggggaagaaugaggacgugggcgccgaggacccgucuaagaagaagcggcaaaggcggcagcggacucacuuuaccagccagcagcuccaggagcuggaggccacuuuccagaggaaccgcuacccggacauguccacacgcgaagaaaucgcuguguggaccaaccuuacggaagcccgaguccggguaggagccagcacggagucugggagggauggggggaggauguuguggagguacaggccaaguagaccaggagagaaug

SEQ ID NO: 19438 - RNA, 2482 nt, Homo sapiens
cauucucuccuggucuacuuggccuguaccuccacaacauccuccccccaucccucccagacuccgugcuggcuccuacccggacucgggcuuccguaagguugguccacacagcgauuucuucgcguguggacauguccggguagcgguuccucuggaaaguggccuccagcuccuggagcugcuggcugguaaagugaguccgcugccgccuuugccgcuucuucuuagacggguccucggcgcccacguccucauucuuccccugcuggcuuuuaucuuucucugaaaacgaaacacacacacuuucccgucagcaugcccaccugcaacgcggacgccaacuggaccggcggcagaagccguggaagagcugggcugccuggcgccggaggagggugcgcgcggcggcuccgggccgcgaggagcgcugcgccuguggggugugcaggcgcaaguguggguguccgcgccccauuuccuccccucccccagcgccgcacguuuuauuuacauguuuaucucacugcagcggcacauucacuuuuauagccugugcuuucaaguauauuuauacaccucugcgcagacacaccaaaucuccugggacgcgcacacgcgcgugguuuacagaccccccucccccucgcagaaagcucagauuuccaugcgguuugggaaggcuaggaaaagauguggggauucgguugggcaccgaaguucgccggcccuuucccaaaaaaaaaaaaaaaaugccucuucgcgaagggcauuucugagugguuucaggcaauuuccuaacgaguggagcuccucgggagcugaaagccgagaggaaaacagggacagaggucggcggccucugaagguccucgaaucaagaugcugggauuuuugugacccaggaaacagaagggaggccaggguacgaauagagagggcggcagaauugcucgcgcccuuagcgccccaggagccgggccggucgagggagaacuaaagggaugcgggguagucaaaauuccggcucccggaaguucugcggggagccaggcgaacgaccacucccaccacgccuccccccggaggggcugacuuccuuggggcgagagggagcggguggcgcagagcagcugagcgggaaugucugcagggcggcgcggcgccuuaccugcggccuccgggcuggaggugucggagauggugugcaccuccagccugugcuuggaggaguccagcgaccggggcugaccgggagccagaaccgaagccauggcuaacggcuggggauggugacaggaagaugaggagacggccgacagcuugguccccgcugcucggugcuccaagugaagcgggccuuucaugcaguucauggacgagggagcgcgacgcucuacuaguccuuggcuacugccccgccgagcccccguagccgccgcugcccgcuccgggucgcgcucuaggcgcggaguuuccccgcugcggggagagccaggggacgcaacccccgccgaguucucaagccaagcugcccccgucuccuccggaaggcucaagcgaaaaaguccggagacggaaagucagcgggcaaacgaagacaugggaugugggcagaagggcaccacucagagcgucuuuagggagcaggcuuccaagcuccaaagcgaaacaagagugggcaaagacccccuucuucucucccucccucccccaagaaccccuccaauaaggaaagcuaacgccgaccgcgcucugcccgccccccccccacgcggcagcccugacagagaagugucaagagugacagggacagguaggugauauuagauccccugcggcggcagcagccgcugcagccacgacgcggcccucugagcgcacccuccgcaacgcgcacacgcacaccccucgggcggucgaacaggagccgggccuugccgcagcucagcuccaggcacccaggcgagcgacggaccagaucugcggcuccgcgcuucccuguuggccuaacaucuuaaaaccagaggcgggcuuccuggugccgagacgucacuccgccgcggcccuccccagcccucuccgccuccgccuccucccagacccuucuccgggugcgacugacguggcuccgcaccaaucaggacgccccgagccgcgguggagggacuguccugccugcaccuaucagcagugcggggccgggcuacugccucgccgugcgcacugggucuacacaggcaagcucccgggaauucagcuccugcccagcccaaggcgauccggcuuuuaguacgaacccaaaggugaagagaugaggcuaggagucgaaggcuugggagaagagaguggaauggucaagaagagaaagguacaaggaucaacaagacacccacucuuugugucucacuacauccauuuccaaucccccaccccauauaaaaaggagacacguuacuuaaaacuagaaaauuugaaaaac

SEQ ID NO: 19439 - RNA, 2926 nt, Homo sapiens
uuaagguuaaaacaccuucacagaaauaguucugcuaugaucuaaugucaaauuucagacaguuaaauaccccaucccccaacacacaaggguaggagaaaaaacgggagggaaagaugcuuucuuaaguagaaauagcaccagcuaacaccaacaauucucaaggcugccacucacaggauaguuucugaagcuugaaauaaaacagauuccucaaagacccacaccuguuacuggggugaaagccagguuugacugauucaccauaaacugaaaaguauuaaguaagacaugucaaagcagaaaaaauuucugccucauauaaaagguggaugggggaaggagcagaaagguuucucaaaaaucaaguguaacagagcucuuuuugagacauaacuguggcagaaacaaaaaaaacaaaaaaguacuagaaaaaagucuaaauaaaaccaaggagaguuuaaaguguagcugauaucucaaguauccuugugguuugaaacgugcuuagaucaacaauucauaguauuuuccucucuaauguaaauaaugccuaaagaaaguaauuucaggauacagauuuauccaccugauuacacguugacacauuauuugcuaaauuguuuccuuguuuagagucacaccuaaaugacuuuuuuccucuggguaucaacauuuuaauuugcuguuuuagacaucuuuuuaaaguuacaaaaagcuauaugcauucacaucauaugcauaucuugugauggguuucuuguugcaaauaugugugcaagaaaugcauaacauacccaaaugugagcacagaauugcuuuuaaaaauaaaauaaaaaggucuacacucuggcugcuaucacguuuucuuaaagucuccuuaucuuuuucaauuccccuuuucuuuuaccugccuuucuacccccaggcccaaaguacaaaauaaccccgaacuuucuauuuccuccgaccagguagugaacaagcagcugugcuuuuucuuggcgcuccacugguuccccuccguucgccuccggguacaagaaagcgaaucaauuguggaauugauucguuccaagauuaaagguaaaacaggugcggcaucuuucuuuaggacuaggcagggaccuacacggaggggugggggcagaggucgcugaaggaaggcgaccgggcgacggugugcgccagaguaaaaccucuuuucgcagcagccaucugcacccgggacgagccuagucuguaauugcacagaggugagggggaccgagcacacccucccgacagacccagugucucucacacaccggagcggccccggagcgcgggaggaccggcugagugacagcggagacgcggcccgagguuguuggaaccugucacagcacgccgccgucaggcucgcccgagucugaggagcggcgcagugugugcgcucucacacacacauccacacacucaugcucacauucacggagcgcccacccuccgguccucauuuugagucuccuucccucaagaaaaccaaauggagaggcccacaaaucucccccguagcccagucgcugacucgcacccacucucugugugagcggccccgagagcccugagcagagcccgggccuccccccgggggccuggaagcuuccccagugaagagccgucuaguucaggcgcgggaguuucccggguaagggauguuucgcgcgucaccucggcguagguggcuaaaccgcgcccucagagccgagaucccaggcuccagcggcuccucucccucaguccuaauucccgagccggggcgagucgcccucggggggccgcggauggggucccagacucgcaagggcgcgcccucuccgccucgggcgggcacucggagccgcuggaccgcucuccucgcgccacgcugugcgguggcccaacuucuggauggaggagacgccucucugaccacgaaaccccgcggggaaaagugacccaagacagugagugugaaauuagcgcgggaaggaggagagggcgccccggggcccagcucaccucccgucgaacucggcggccgccugcagguagagcgaggauaccagcaccagcgccaggagaaaauccauguugggcagcggguccuggggcgcagcgcaguggcgcgcgaggaacagguugggguggugggcgccgaugggaggcgccccucugagagucucgaggaacccccagcccucgccgcccgggcuacugcugccgcucccggaggacagcggcgaggcgcgcggccggagcaggucugcugcgcggcgcccggagcccccucccgcucccuucuagcuaggggaggcgcugcagggguagcugcaccgcccgcggggaggggcgccaggggcgggcagggggugcgcgugcgcccgacucgccgcccucccagccccgggcgaagggugagcgcgcuccgcuccucccgggggcccagcggggcaggcaacucgggggcaggggcgcugcgggacggcaguggcucuuggggguuagccaagcagggcgagccccagccugggagaaaaguugcaaacccucucugggagagggaaagcagggugcccagcaggaaaggggaguggaggaggaaaggagcccgaggcguaggugcacgcuccgcagguuccgcccgaacagguggugacugcaggggcgagcaguagcuuucaccggagggcggagaagcccuagagcagagagguuuauggggcuggagcugagcagugucugcauuuacuaaaaccacagcacgacuuggacaaauuagcgaaggcaaacucugggaguuugcuuuucccgcagaguuggcaaaggcauauuuuuuauuuuguaacuaaccaaaagaaauauuuggcucuccagucggguuuugaagaagaaaugagcagac

SEQ ID NO: 19440 - RNA, 2926 nt, Homo sapiens
gucugcucauuucuucuucaaaacccgacuggagagccaaauauuucuuuugguuaguuacaaaauaaaaaauaugccuuugccaacucugcgggaaaagcaaacucccagaguuugccuucgcuaauuuguccaagucgugcugugguuuuaguaaaugcagacacugcucagcuccagccccauaaaccucucugcucuagggcuucuccgcccuccggugaaagcuacugcucgccccugcagucaccaccuguucgggcggaaccugcggagcgugcaccuacgccucgggcuccuuuccuccuccacuccccuuuccugcugggcacccugcuuucccucucccagagaggguuugcaacuuuucucccaggcuggggcucgcccugcuuggcuaacccccaagagccacugccgucccgcagcgccccugcccccgaguugccugccccgcugggcccccgggaggagcggagcgcgcucacccuucgcccggggcugggagggcggcgagucgggcgcacgcgcacccccugcccgccccuggcgccccuccccgcgggcggugcagcuaccccugcagcgccuccccuagcuagaagggagcgggagggggcuccgggcgccgcgcagcagaccugcuccggccgcgcgccucgccgcuguccuccgggagcggcagcaguagcccgggcggcgagggcuggggguuccucgagacucucagaggggcgccucccaucggcgcccaccaccccaaccuguuccucgcgcgccacugcgcugcgccccaggacccgcugcccaacauggauuuucuccuggcgcuggugcugguauccucgcucuaccugcaggcggccgccgaguucgacgggaggugagcugggccccggggcgcccucuccuccuucccgcgcuaauuucacacucacugucuugggucacuuuuccccgcgggguuucguggucagagaggcgucuccuccauccagaaguugggccaccgcacagcguggcgcgaggagagcgguccagcggcuccgagugcccgcccgaggcggagagggcgcgcccuugcgagucugggaccccauccgcggccccccgagggcgacucgccccggcucgggaauuaggacugagggagaggagccgcuggagccugggaucucggcucugagggcgcgguuuagccaccuacgccgaggugacgcgcgaaacaucccuuacccgggaaacucccgcgccugaacuagacggcucuucacuggggaagcuuccaggcccccggggggaggcccgggcucugcucagggcucucggggccgcucacacagagagugggugcgagucagcgacugggcuacgggggagauuugugggccucuccauuugguuuucuugagggaaggagacucaaaaugaggaccggagggugggcgcuccgugaaugugagcaugaguguguggaugugugugugagagcgcacacacugcgccgcuccucagacucgggcgagccugacggcggcgugcugugacagguuccaacaaccucgggccgcgucuccgcugucacucagccgguccucccgcgcuccggggccgcuccggugugugagagacacugggucugucgggagggugugcucggucccccucaccucugugcaauuacagacuaggcucgucccgggugcagauggcugcugcgaaaagagguuuuacucuggcgcacaccgucgcccggucgccuuccuucagcgaccucugcccccaccccuccguguaggucccugccuaguccuaaagaaagaugccgcaccuguuuuaccuuuaaucuuggaacgaaucaauuccacaauugauucgcuuucuuguacccggaggcgaacggaggggaaccaguggagcgccaagaaaaagcacagcugcuuguucacuaccuggucggaggaaauagaaaguucgggguuauuuuguacuuugggccuggggguagaaaggcagguaaaagaaaaggggaauugaaaaagauaaggagacuuuaagaaaacgugauagcagccagaguguagaccuuuuuauuuuauuuuuaaaagcaauucugugcucacauuuggguauguuaugcauuucuugcacacauauuugcaacaagaaacccaucacaagauaugcauaugaugugaaugcauauagcuuuuuguaacuuuaaaaagaugucuaaaacagcaaauuaaaauguugauacccagaggaaaaaagucauuuaggugugacucuaaacaaggaaacaauuuagcaaauaaugugucaacguguaaucagguggauaaaucuguauccugaaauuacuuucuuuaggcauuauuuacauuagagaggaaaauacuaugaauuguugaucuaagcacguuucaaaccacaaggauacuugagauaucagcuacacuuuaaacucuccuugguuuuauuuagacuuuuuucuaguacuuuuuuguuuuuuuuguuucugccacaguuaugucucaaaaagagcucuguuacacuugauuuuugagaaaccuuucugcuccuucccccauccaccuuuuauaugaggcagaaauuuuuucugcuuugacaugucuuacuuaauacuuuucaguuuauggugaaucagucaaaccuggcuuucaccccaguaacaggugugggucuuugaggaaucuguuuuauuucaagcuucagaaacuauccugugaguggcagccuugagaauuguugguguuagcuggugcuauuucuacuuaagaaagcaucuuucccucccguuuuuucuccuacccuuguguguugggggaugggguauuuaacugucugaaauuugacauuagaucauagcagaacuauuucugugaagguguuuuaaccuuaa

SEQ ID NO: 19441 - RNA, 2596 nt, Homo sapiens
agagaaggaaaguuaggggugauauuucucuuucuucaaaaagauguucacaucccacccaccugccaggcaacagucuacacgucccugaaggaacuuacuuucaggcugcuguacacuggcuguccacaaggccgcaccucacaaauccggguuucuuucacaaggcggcacucaggguugucauugguaacucguguggagauaccaguuccacaggucuuugagcacugggaccaugaaguuguuugaacaauacauuucuggccuuguaaaggguuguauaggaugcgaggcuccauuccaaaaacuagagacauauaagagggaagacuucucagaggcauaccgacacaaacaggcucaagcacucauuucuacaaagauuuagaccagaaaugcaucucaguacagugucugaagugcucagucuccacuuaccagggagccgcuucagugagcugccuuuuccaacugcaaucaauucauuguuucucgucaacuccaccucggaggcaucgaaucccagcuccuugccaaggaggccguccugguccuccaugggguccuugauacuauccucgucacagacccacuccucgcagcacugcccgguaacuuugaccagccgaggguugggacagcccaaguuggggagagauaguucuuggggacacagaggaaugcagcccacggcgccaucaauacaugugcacugauguuuacaguugggcuggaaacuuuccccguuuugguagauucuggaguuauauucacagggucugcccucugacugagcugcaaagaucaccaaaagagaaagguagaaggggauaaaguuaagauuccaaaccaccgccugaaacucauacauauuuucugcuguuaaauucaauuuaugguaaaguucccuacaauuccccggagacuccagaccagaacaauaaguuagucaggaaucacuuuuccguaugcgcuuucguugggcccagacacacugaauugcauuccagacugcugaaaucaugugccuuucugccaagcuaccaacaacaaagcaucaccauacauggucucagaauuacuaaacuucuggacuauggggacuaguauuuuuuuuaaaggggccaaaccacaagcaucuuaccucugcagauccccuucagagcgguggagcuggcgccgaaguugcauuccagccccuugguguggucgcagggcugcguuuugcugcaguccucguugagcugcuuggcgcagaccuuacagcagccgcagccgucccggaccagcccgacucccggcgcgcacuugggcgccuccagggggcaguggcaggcagcggggcagguggagagcgccuggaagggggagaagauacgcgugagacucggcgcggugcgcaggaggggcgccgcggcugccgcagugagggacgggggucuccgacccuaucgacggggagccucugaucucguccagcccggccaccucggaaggcugcucccaccaagaggucccgacacgucuucggggggagggggagagugcuuaaagaaacggcuacccgcaaacgaucgcgaacuuuuuaacuuuuccugccgugggcaaucugggaccaggggaaggggcuggagagcggacggggaauagguggcaaaaggagaguccaacucaccagccuggucaaguggagaagggugacgacuaaggcgagcgcccuggcgaugcgggagcucauuguggcgcgcaggaguagcccggggcgagcgcggcgacgaagacgccaacaagcuggugugcagcggacaggccgugcgcagcggggucgggguggcggcgcggugggcccggugggcagggaggcgagggcugggcggcgggcgggcgucuuucgcucgaggucccggcggagaaggcgcggagggcgcgggcgcugcucgggggcgcucucgcucgcggucugcccaggcgccccggagcccgccuuuuauacgggccggcggaggcgccgcguguugcagugacgucggcucugucugcgcguuccagaauucucaaacaucucaggaaugcugguuggcgcgggcugcugccaagcgccuccccuggcuccauugcaccuuugugugugugugugugugugugugugugugugugugugugugugugugugugugucugugugugugucugucucccagacccgucaagaaaacaguucggggggugugugugugugugugugugugugugugugugucccagacccgucaagaaaacaguucguuuuuuccaccuuaaauuacgacuuauguugggaaggguucuuuggggcgugaugguggugaugguaguuggagggucgugaggggcgaggggggccaguucagaacuuugccuggacugggugggugggaggaccugagagggaggaacaaaagucguuuuguuuggugaugcgaguugaccgggcagccacugaagcccucacccgggaaggcagugagcuguuugcuuuuuuacagcgaaggugagaggcaaguuaucuguugaaagaguagaacggggaagaggagugugucucugagucagg

SEQ ID NO: 19442 - RNA, 2596 nt, Homo sapiens
ccugacucagagacacacuccucuuccccguucuacucuuucaacagauaacuugccucucaccuucgcuguaaaaaagcaaacagcucacugccuucccgggugagggcuucaguggcugcccggucaacucgcaucaccaaacaaaacgacuuuuguuccucccucucagguccucccacccacccaguccaggcaaaguucugaacuggccccccucgccccucacgacccuccaacuaccaucaccaccaucacgccccaaagaacccuucccaacauaagucguaauuuaagguggaaaaaacgaacuguuuucuugacgggucugggacacacacacacacacacacacacacacacacaccccccgaacuguuuucuugacgggucugggagacagacacacacacagacacacacacacacacacacacacacacacacacacacacacacacacacacacaaaggugcaauggagccaggggaggcgcuuggcagcagcccgcgccaaccagcauuccugagauguuugagaauucuggaacgcgcagacagagccgacgucacugcaacacgcggcgccuccgccggcccguauaaaaggcgggcuccggggcgccugggcagaccgcgagcgagagcgcccccgagcagcgcccgcgcccuccgcgccuucuccgccgggaccucgagcgaaagacgcccgcccgccgcccagcccucgccucccugcccaccgggcccaccgcgccgccaccccgaccccgcugcgcacggccuguccgcugcacaccagcuuguuggcgucuucgucgccgcgcucgccccgggcuacuccugcgcgccacaaugagcucccgcaucgccagggcgcucgccuuagucgucacccuucuccacuugaccaggcuggugaguuggacucuccuuuugccaccuauuccccguccgcucuccagccccuuccccuggucccagauugcccacggcaggaaaaguuaaaaaguucgcgaucguuugcggguagccguuucuuuaagcacucucccccuccccccgaagacgugucgggaccucuuggugggagcagccuuccgagguggccgggcuggacgagaucagaggcuccccgucgauagggucggagacccccgucccucacugcggcagccgcggcgccccuccugcgcaccgcgccgagucucacgcguaucuucucccccuuccaggcgcucuccaccugccccgcugccugccacugcccccuggaggcgcccaagugcgcgccgggagucgggcugguccgggacggcugcggcugcuguaaggucugcgccaagcagcucaacgaggacugcagcaaaacgcagcccugcgaccacaccaaggggcuggaaugcaacuucggcgccagcuccaccgcucugaaggggaucugcagagguaagaugcuugugguuuggccccuuuaaaaaaaauacuaguccccauaguccagaaguuuaguaauucugagaccauguauggugaugcuuuguuguugguagcuuggcagaaaggcacaugauuucagcagucuggaaugcaauucagugugucugggcccaacgaaagcgcauacggaaaagugauuccugacuaacuuauuguucuggucuggagucuccggggaauuguagggaacuuuaccauaaauugaauuuaacagcagaaaauauguaugaguuucaggcggugguuuggaaucuuaacuuuauccccuucuaccuuucucuuuuggugaucuuugcagcucagucagagggcagacccugugaauauaacuccagaaucuaccaaaacggggaaaguuuccagcccaacuguaaacaucagugcacauguauugauggcgccgugggcugcauuccucuguguccccaagaacuaucucuccccaacuugggcugucccaacccucggcuggucaaaguuaccgggcagugcugcgaggagugggucugugacgaggauaguaucaaggaccccauggaggaccaggacggccuccuuggcaaggagcugggauucgaugccuccgagguggaguugacgagaaacaaugaauugauugcaguuggaaaaggcagcucacugaagcggcucccugguaaguggagacugagcacuucagacacuguacugagaugcauuucuggucuaaaucuuuguagaaaugagugcuugagccuguuugugucgguaugccucugagaagucuucccucuuauaugucucuaguuuuuggaauggagccucgcauccuauacaacccuuuacaaggccagaaauguauuguucaaacaacuucauggucccagugcucaaagaccuguggaacugguaucuccacacgaguuaccaaugacaacccugagugccgccuugugaaagaaacccggauuugugaggugcggccuuguggacagccaguguacagcagccugaaaguaaguuccuucagggacguguagacuguugccuggcaggugggugggaugugaacaucuuuuugaagaaagagaaauaucaccccuaacuuuccuucucu

SEQ ID NO: 19443 - RNA, 2748 nt, Homo sapiens
aagauuugaggugauacccagggaagagcuagcugcuacccagugagcucugcucaaguuccucaacaaugcaaaaggaagauuaguagcauuuugggagcuuggugaaucaaauagauuaaguaugaaaaaaacccauuugaauaggcaugauuaaaagucagucauauuaauucgcuaacucacauaauuuaaguaaauaugauacuacuuuggggucagucugugugauuagaaaaauuagacuagaauccauauaaccuuuauucagauggcagagaaagcuaggggagggggcugagccccugacauguugagcaggcaaagcucaaaauaugugugacugggcacagggaauuauggggucagaaaguggagucuucuauguggcauguuuuggauuuuucuuccuccuucugugucuaaaauucuuuauccacaagaucuauccuuauauuuguagcacuggcucaauuuuuaggcauagguuaaaagcucaugacuacaggagaaagaagaaagaugggugaaggggauuguuucuccuauugaagaugaaacauuuuucucauaguuuaaauauacaaccuuccuaugugucuucucuuuaaugccaaguuagcacaggucaaagaaacaaacauuuaaccugaaauauauaccacagauauuuggaaacuguuccuugguuuucuccccauuucaaacaucuacauaagguaaaauuuccucaauuccagguggaacccaaagcagcuuggaugaauacauuauucucuaugagcuuuuuaagucaccauaaaauuucaacaaauuucaaaagcaaugcaaaggaauugucaggggagcugguaaaagugaagcuaccugagucucgagguuggagauucagacucaguagagcaccagaggugauucgacagcccauggggaaccaugaucagaaugaaaguuauuuuguccucagcuuuuucuuuccccaacccccuguagugcaguguaucuuuggacuguugucacccauuggacacuggccacuucucuuguuccuuucucauagccaaauuaaacuguuguuuuaguuacuauuacaaagggcaguugaaacagaaguugaauuccagcaucacuggcuagugagacaguuugaacucuuuccugucuacgguuauuucgccuuccucuccccguaccccuuuuccaucccuuugcucucuccuauuuacaggugaggguagggaaugagggaccugagguuaagagagcuggggaacauaaaucuaaagaaaggcaccgaaaugucacuaacaaaaaauuacauuauuugugggaaagaugggaagaugacugcguguggaggggcccuuagcugggauauguuaggaguuguggugacagccaucuuccuucugacagcccaggagagaacccagugcuauccgaggugcugaacagaggacuucucgggguucccgaauucccaggguuaaaacaaacuugguuugugcggcgacaccgcuacccuuaccgguccccagauagucgcggauccccgaagcuaagagccagggcaggacuucagucaguguuccaggaacagcugagacacccaggucaccacgggcucgcgccgcugcggcuccgacccggugcgaaccgccauacgcgccgcgcggugggccggaggcaguccgcguacuguugcggaaacucugucucacaaggugcgcaacacucgccgcgcgcaacacucaccaggaaguugaugucggccgggcgcacuaggcgguagcugcacgucgcgcaauccuggcugcauucggcccgcacggucgccaggagcccggggccgagcaacagcagccaagugcaaagugucaggaaccgcgccauggacugcgaggagagagggacgcgugcuucgagccugccugggcgcagaacggggucccucggcaggacccucgccgcgacagccucagcaggggaucgucgagcaaaagcccgcaggaaugcuccuuucuggggccccgcccucccggccgacagcuuuuagguagacguggaggcgacucagaucgccucgcgguucccgggauggcgcggucgcccccaacgcgaggcugccuggggcacccggcucuuuuccugggcguccgcggcccagggcaagauuccggagagaacgccgcagaccaggggcgagagagcgggagccgggggaggcaggacauugacuggggucacaaagaagaaccagggaacgcuguuggggaacccaugcaaugaaaugugaagggaaagagggcgggcagacguccccaaacccgcucagcaaagacaagcuucgggcaaauucacucacguugacgcuguucggauggagcaggccaauuggaaaagccggguucagacacgacucuagagggaagagaagaaggcaagugugaggagggcgggcgucggggagaagcgggcccgggugugcuggcggacguagggccucaccgucgcgguccucagcgucucugcggggucacgggccaggcugcggggcucugagcgccugccucgccgucccggggcuuaacggcugcuggagccacuuuauaauuagccccaaaccgaaggaggcgcgcgcgccccaaucgccggcgggcugcagcugacgcaggcccuacgccagccccgcgccgacgccuucgcgggaggggucggucccccagcacccgcgcgccgcuccccccg

SEQ ID NO: 19444 - RNA, 2748 nt, Homo sapiens
cggggggagcggcgcgcgggugcugggggaccgaccccucccgcgaaggcgucggcgcggggcuggcguagggccugcgucagcugcagcccgccggcgauuggggcgcgcgcgccuccuucgguuuggggcuaauuauaaaguggcuccagcagccguuaagccccgggacggcgaggcaggcgcucagagccccgcagccuggcccgugaccccgcagagacgcugaggaccgcgacggugaggcccuacguccgccagcacacccgggcccgcuucuccccgacgcccgcccuccucacacuugccuucuucucuucccucuagagucgugucugaacccggcuuuuccaauuggccugcuccauccgaacagcgucaacgugagugaauuugcccgaagcuugucuuugcugagcggguuuggggacgucugcccgcccucuuucccuucacauuucauugcauggguuccccaacagcguucccugguucuucuuugugaccccagucaauguccugccucccccggcucccgcucucucgccccuggucugcggcguucucuccggaaucuugcccugggccgcggacgcccaggaaaagagccgggugccccaggcagccucgcguugggggcgaccgcgccaucccgggaaccgcgaggcgaucugagucgccuccacgucuaccuaaaagcugucggccgggagggcggggccccagaaaggagcauuccugcgggcuuuugcucgacgauccccugcugaggcugucgcggcgaggguccugccgagggaccccguucugcgcccaggcaggcucgaagcacgcgucccucucuccucgcaguccauggcgcgguuccugacacuuugcacuuggcugcuguugcucggccccgggcuccuggcgaccgugcgggccgaaugcagccaggauugcgcgacgugcagcuaccgccuagugcgcccggccgacaucaacuuccuggugaguguugcgcgcggcgaguguugcgcaccuugugagacagaguuuccgcaacaguacgcggacugccuccggcccaccgcgcggcgcguauggcgguucgcaccgggucggagccgcagcggcgcgagcccguggugaccugggugucucagcuguuccuggaacacugacugaaguccugcccuggcucuuagcuucggggauccgcgacuaucuggggaccgguaaggguagcggugucgccgcacaaaccaaguuuguuuuaacccugggaauucgggaaccccgagaaguccucuguucagcaccucggauagcacuggguucucuccugggcugucagaaggaagauggcugucaccacaacuccuaacauaucccagcuaagggccccuccacacgcagucaucuucccaucuuucccacaaauaauguaauuuuuuguuagugacauuucggugccuuucuuuagauuuauguuccccagcucucuuaaccucaggucccucauucccuacccucaccuguaaauaggagagagcaaagggauggaaaagggguacggggagaggaaggcgaaauaaccguagacaggaaagaguucaaacugucucacuagccagugaugcuggaauucaacuucuguuucaacugcccuuuguaauaguaacuaaaacaacaguuuaauuuggcuaugagaaaggaacaagagaaguggccaguguccaaugggugacaacaguccaaagauacacugcacuacaggggguuggggaaagaaaaagcugaggacaaaauaacuuucauucugaucaugguuccccaugggcugucgaaucaccucuggugcucuacugagucugaaucuccaaccucgagacucagguagcuucacuuuuaccagcuccccugacaauuccuuugcauugcuuuugaaauuuguugaaauuuuauggugacuuaaaaagcucauagagaauaauguauucauccaagcugcuuuggguuccaccuggaauugaggaaauuuuaccuuauguagauguuugaaauggggagaaaaccaaggaacaguuuccaaauaucugugguauauauuucagguuaaauguuuguuucuuugaccugugcuaacuuggcauuaaagagaagacacauaggaagguuguauauuuaaacuaugagaaaaauguuucaucuucaauaggagaaacaauccccuucacccaucuuucuucuuucuccuguagucaugagcuuuuaaccuaugccuaaaaauugagccagugcuacaaauauaaggauagaucuuguggauaaagaauuuuagacacagaaggaggaagaaaaauccaaaacaugccacauagaagacuccacuuucugaccccauaauucccugugcccagucacacauauuuugagcuuugccugcucaacaugucaggggcucagcccccuccccuagcuuucucugccaucugaauaaagguuauauggauucuagucuaauuuuucuaaucacacagacugaccccaaaguaguaucauauuuacuuaaauuaugugaguuagcgaauuaauaugacugacuuuuaaucaugccuauucaaauggguuuuuuucauacuuaaucuauuugauucaccaagcucccaaaaugcuacuaaucuuccuuuugcauuguugaggaacuugagcagagcucacuggguagcagcuagcucuucccuggguaucaccucaaaucuu

SEQ ID NO: 19445 - RNA, 2531 nt, Homo sapiens
uccccucucaccaugcgcaccugcaacacaagcaguggucguucucccccgcaccuuggccaggcccacaacccaaacagaaaguuuauccuccaccccaacccaacacaggaaagugguuguuuuugguuuggccagaccacuaugggcuacugggaggaggagaauuccuuaggaccuugcuucggggagggagaaagaggaaagucuaccuaugcuaacaguacucccacuucccugcgccccaccuugacgacacggggaggggagagggguguugagagcauccucccugagugcuuaggcacaucuuguaccaaguuguccccuaccccagcucucccauuugcaguucugagagcagccguaacaccacgguagagacauuucuaggucagucccagggcccagagcguacccccgacaaacaaacaaaaaaauuaucucaugccuccuguauucugugugcaucgcaccuaguugccugugagcccugcagcuaaagucucggaacaaagcccaagcggggaaaagcuugcccgcagcuggcaggccauuuaaaagcaauuaaaacgcguuuaaagaggaaugcgcggugggcaccaaaccccgcuuuagacuguaguggggggcgugauugcaggaggagcgaggugcaagucccgcuggcuggacaccggagcuuuuuacuagaaagcuccaagcaaggcaagcuaaagccaaggaagccaaaguccuuucuucuaccccagacuucugccuucauuucccggucgcuguuugccgaccuuuggcuccugggacgcccccaaagcgggcgagugcuauaagucucucuggucaggggucgcgacgguguguggagugugggagucaaagcuagugguuuggcccuggcgccucccgguugggccucuggacucucagagccccgcugcagacgcucugacccugugccccgcgcgaaugggcgcgccucgcccuuggagcccgcgucagagccaguaccuugcucauccucucuccauaugccgcauacccacaagccgacaucggcaagggaaaaaaaaauaucugaggagguucuaggaacugagagccucccaaagauuuuuuuuuucaggaaaaaaaauuacuuuaaggcgaaauuaggccucaaauuaacauauugaagggcagaagggaagaaagggucucgaugcccugagcccccagaaagagggugcuuuugcagagagagcugcggacagcgugcgggggugggcuucuggcuucugacugaggagacccgagagcgcaggggaaaacacaagcugcgaauggucccggcaccuacagcgcucagugcaccccacccagggcugucgccucucggccacauccucuccucucagcccgaccccguccagcucucacaguuaaagaggcuacuugcucagaauaauaggaguccccuuccacccggcagaauuagcagguaacgacucaaucacucccuuccuccacuuucucucguaccccuuucccgggucagggcacugagaggcgaauggcagugggcagaggucugaauggucaauaccuuuuucuuaggcccgggcucccugcggucugacagguacuugcccagcuugaagguaccaggcaccgguccgaggcgcaagccggccgggaugcagcagucggcacucacgcugguggcuggcgcucuggcggcuccgugcauuguugccgccgccaccaggcaggcgcucgggugcuccagguccuuggaagggcgcgagugacagagcuggagcugcgcgcuagccagagagccgcgccccgacgugcguccuccgcccgcggagugacgcgggcgggcaugcacugcgccuuuucaaucggggcgggagccuuuuggcaccgcuagcgcaagggcgcggaguuuggugagagaguugcgcugcgaagcagcugcagagucccacccgagagggucacauggagugguucccucagcccccugcauaaucgaggccgcugaauggcuagcacacaaugguccaggcgaccuucccauuccuaaaaauccaauuugucaagggcgaagaaaaggcacuggugaaucaaagguccggcgggaccauuaauccucagcaugggguauuguccuccagacaguuacgauauuuuaagugacaaauccacuguauaauuucuccauaaauuuuacuuccuuuuauuguuccccgacaaaccaguuuugggaaauaagugacuacuuuaagucuacuuggcugauuccuuugagccuugaucuacuucaaagauuuuuaauucucuccccuuggcuuuauuguaaaggagauuaaacaaagagauggagacuguuuggaggacuuguuaacuacuauugauuucuggcgugugccauacagaaauuaggcagguacuugaugggaaaacaccagaaaauaccuacacuuuuuaaauaacaaccauauuaccauuucaggggauuggguucaggccagucgucuauucagaac

SEQ ID NO: 19446 - RNA, 2531 nt, Homo sapiens
guucugaauagacgacuggccugaacccaauccccugaaaugguaauaugguuguuauuuaaaaaguguagguauuuucugguguuuucccaucaaguaccugccuaauuucuguauggcacacgccagaaaucaauaguaguuaacaaguccuccaaacagucuccaucucuuuguuuaaucuccuuuacaauaaagccaaggggagagaauuaaaaaucuuugaaguagaucaaggcucaaaggaaucagccaaguagacuuaaaguagucacuuauuucccaaaacugguuugucggggaacaauaaaaggaaguaaaauuuauggagaaauuauacaguggauuugucacuuaaaauaucguaacugucuggaggacaauaccccaugcugaggauuaauggucccgccggaccuuugauucaccagugccuuuucuucgcccuugacaaauuggauuuuuaggaaugggaaggucgccuggaccauugugugcuagccauucagcggccucgauuaugcagggggcugagggaaccacuccaugugacccucucgggugggacucugcagcugcuucgcagcgcaacucucucaccaaacuccgcgcccuugcgcuagcggugccaaaaggcucccgccccgauugaaaaggcgcagugcaugcccgcccgcgucacuccgcgggcggaggacgcacgucggggcgcggcucucuggcuagcgcgcagcuccagcucugucacucgcgcccuuccaaggaccuggagcacccgagcgccugccugguggcggcggcaacaaugcacggagccgccagagcgccagccaccagcgugagugccgacugcugcaucccggccggcuugcgccucggaccggugccugguaccuucaagcugggcaaguaccugucagaccgcagggagcccgggccuaagaaaaagguauugaccauucagaccucugcccacugccauucgccucucagugcccugacccgggaaagggguacgagagaaaguggaggaagggagugauugagucguuaccugcuaauucugccggguggaaggggacuccuauuauucugagcaaguagccucuuuaacugugagagcuggacggggucgggcugagaggagaggauguggccgagaggcgacagcccuggguggggugcacugagcgcuguaggugccgggaccauucgcagcuuguguuuuccccugcgcucucgggucuccucagucagaagccagaagcccacccccgcacgcuguccgcagcucucucugcaaaagcacccucuuucugggggcucagggcaucgagacccuuucuucccuucugcccuucaauauguuaauuugaggccuaauuucgccuuaaaguaauuuuuuuuccugaaaaaaaaaaucuuugggaggcucucaguuccuagaaccuccucagauauuuuuuuuucccuugccgaugucggcuuguggguaugcggcauauggagagaggaugagcaagguacuggcucugacgcgggcuccaagggcgaggcgcgcccauucgcgcggggcacagggucagagcgucugcagcggggcucugagaguccagaggcccaaccgggaggcgccagggccaaaccacuagcuuugacucccacacuccacacaccgucgcgaccccugaccagagagacuuauagcacucgcccgcuuugggggcgucccaggagccaaaggucggcaaacagcgaccgggaaaugaaggcagaagucugggguagaagaaaggacuuuggcuuccuuggcuuuagcuugccuugcuuggagcuuucuaguaaaaagcuccgguguccagccagcgggacuugcaccucgcuccuccugcaaucacgccccccacuacagucuaaagcgggguuuggugcccaccgcgcauuccucuuuaaacgcguuuuaauugcuuuuaaauggccugccagcugcgggcaagcuuuuccccgcuugggcuuuguuccgagacuuuagcugcagggcucacaggcaacuaggugcgaugcacacagaauacaggaggcaugagauaauuuuuuuguuuguuugucggggguacgcucugggcccugggacugaccuagaaaugucucuaccgugguguuacggcugcucucagaacugcaaaugggagagcugggguaggggacaacuugguacaagaugugccuaagcacucagggaggaugcucucaacaccccucuccccuccccgugucgucaagguggggcgcagggaagugggaguacuguuagcauagguagacuuuccucuuucucccuccccgaagcaagguccuaaggaauucuccuccucccaguagcccauaguggucuggccaaaccaaaaacaaccacuuuccuguguuggguugggguggaggauaaacuuucuguuuggguugugggccuggccaaggugcgggggagaacgaccacugcuuguguugcaggugcgcauggugagagggga

SEQ ID NO: 19447 - RNA, 3186 nt, Homo sapiens
ggguacaguguguuccguggugaaaagcuugugaaggaggaaugcagguuuuagagucucacuccacguugcugcuauuccuauuugagaauugcccccccaccaccgccacuccccuacucccacaaaagccuugaaauauuuuauucaugugggauuacagucuaugcaacaaugagacaugaggagguggccaugaauagcccccgaguguguuauacacugagaccuuuuccaaagggcugcagaggaauuauuuagucuaagcagccacgagucaugugauuucuucagaaacauuuacgucuggguaggccugcuuuuuaaauauucuuggugggaagcacuuugaaccauaaaggcacacuaaaagacaauugcuauggagacugcgccuccacugugcauuuaucugaguucuccgccuggggcucuugagcguccacaggguguccugggcacgcugcucuggggugggggaucugggcgccacaguguugggaggccacccgcuugggacccuagcucaggacuguaagcaggaggcauccgcccacgguagacgcucugcgggcgugugggagugggacggcgggggggacauugagggugugcggcgcccccuccccugccugugcggggaccacgugaaggagaggcgcgugggggccccuggcgcgcagccgcggugggugacggccggcgucccgggggccccguguacggggcgugugucggugugagucugggagggugcaggggccccgcgccuccccggucuccucgugcgugugcgugugcgugugcauguguguccucggcccagcgccccgccgaguggugcccgcggccgggcgagcgcgcgcgcgcccgugcgggguguguaugugaguaugugacagugugugucaggugacucgggucacgcagucucucucucucucccuccuccgggaggaacugccgcgcuccggcugacuccuccgccggcgggcggggcgggggagggggcuucgggcgcgcugggaaccgcgggacccggaccugggcgccgcccgccgggggacgcgcggcccccgcuuccgccgggccccgcugagcucuagacaaaccuccgcuucagaaauaggcugcgggcggccggcuaggaggcuuggcccccaccccgggacccccgccguccccgggccggccggccggugggcacgaugagccaggugcuggggaagccgcagccgcaggacgaggacgacgcggaggaggaggaggaggaggaugagcugguggggcuagcggacuacggagacgggcccgacuccuccgacgccgauccggacagcggcacagaggagggaggugagcgcccggcccccgcguccucggcucgcgccccuuuccuccccuuggcgccuucccgcccccagcccggccgugcgcgagccaccgacuuggaggggguccaggggagcggguccaguugaggguuugggguggggagggacgccaaaagcccgaccucgagcugccaaaugagggagcgcggugcugguggcggaggggcaaccaggaucgguggaaaaggggaaggagggaguaagcgucugggcuggaggagcgcgcgcuucugccccuuucagagccggugccucccgcgccccucaccccaagcucuccgcagcgucuggcgguuggggaggggaggggaccgcgggcgcgcccugggaccucucucccagaacggugcuguugaagccagggucagaugucguggcuaaaaaaaggcagccggcggcggcgugacuggcagggucgucggcagcugcgggugucagucucgccccgcgucgccgcgggaggggcccacccagguaguggcuggggagacccgcggggcggcggggggaugcucgccaagcuguugugggagucuccgagaggccgcagauuucccgggauccacgcaaacaccguugucaggacaccuuaucugcucucgguaucaccaccuggacauggcagugccugcccgggagugagcgcgcggcggggaauucuuugcuucaauagugaagcaaacucuuuuuccuguucuagaagcggguuuuagcaaucguucagcuugugggggcuuccugcauuuucuuaagguguaaggaaguugagagccuuuuaguauuccagagagguuaaacuuuuuuuaguuucccucagaagcgagcaaaaguuccuuuacuguaaggucacuuggaaaggucaauagaaagcggcuguuaaacaugauguuauucucagugaaacuguaugcauccaagagaaggaacuaacuuuaauguuucacacugaagaaauugugugagagauacaaguaccuuugugacuauugauuuuuaaagaacuuuuauugagaauucacugaacuuauuuuaaauucucuaugcaaagcuuuucucacuaggguaguuucauuauucuacaucuggcaggcacgacuuucaaugaaucagaaaggaaauaaaguuaacuaugccuugcgccugguagaugagaaagcagccucucaagucacccuuuuucauagcguuuucucucuugggaugauuugugcuaauuccucauuugcuuaaacugaugugugcaccuuugugcuuucugucuucugcacucccgguaauuggucuuaccguugagcaccaggccacauuuuuguagauaaaggcuuucagccguuuuauuggagucucuagagcuaccuuccguaauuaaauuguucagucgccucauuauuauucaaauuccauuuguuagcuccucccagauucuuagaagacuccggagagaugcagaauagggauguauuugcaagguauuugaaaugguggacacaguagggugugugugggauucucuuuuuuaaaaaagaaaaaaagugggggggcggaggggccauauccaggagggaaagcccuguaauuugauacuguccugaggccuggaggguccagaaaaaguacuggaccccucguuuauucugcaguucuuuaagugggcacuuuuaaaauuugauuuggggacuugaaauugaagugaaauuaaagcccugcuugagggaugggauucccggaacaaagggcuuccccagagcccagacuuggaggcuccuuagcuguuaacguaaaggcaaacuug

SEQ ID NO: 19448 - RNA, 3186 nt, Homo sapiens
caaguuugccuuuacguuaacagcuaaggagccuccaagucugggcucuggggaagcccuuuguuccgggaaucccaucccucaagcagggcuuuaauuucacuucaauuucaaguccccaaaucaaauuuuaaaagugcccacuuaaagaacugcagaauaaacgagggguccaguacuuuuucuggacccuccaggccucaggacaguaucaaauuacagggcuuucccuccuggauauggccccuccgcccccccacuuuuuuucuuuuuuaaaaaagagaaucccacacacacccuacuguguccaccauuucaaauaccuugcaaauacaucccuauucugcaucucuccggagucuucuaagaaucugggaggagcuaacaaauggaauuugaauaauaaugaggcgacugaacaauuuaauuacggaagguagcucuagagacuccaauaaaacggcugaaagccuuuaucuacaaaaauguggccuggugcucaacgguaagaccaauuaccgggagugcagaagacagaaagcacaaaggugcacacaucaguuuaagcaaaugaggaauuagcacaaaucaucccaagagagaaaacgcuaugaaaaagggugacuugagaggcugcuuucucaucuaccaggcgcaaggcauaguuaacuuuauuuccuuucugauucauugaaagucgugccugccagauguagaauaaugaaacuacccuagugagaaaagcuuugcauagagaauuuaaaauaaguucagugaauucucaauaaaaguucuuuaaaaaucaauagucacaaagguacuuguaucucucacacaauuucuucagugugaaacauuaaaguuaguuccuucucuuggaugcauacaguuucacugagaauaacaucauguuuaacagccgcuuucuauugaccuuuccaagugaccuuacaguaaaggaacuuuugcucgcuucugagggaaacuaaaaaaaguuuaaccucucuggaauacuaaaaggcucucaacuuccuuacaccuuaagaaaaugcaggaagcccccacaagcugaacgauugcuaaaacccgcuucuagaacaggaaaaagaguuugcuucacuauugaagcaaagaauuccccgccgcgcgcucacucccgggcaggcacugccauguccagguggugauaccgagagcagauaagguguccugacaacgguguuugcguggaucccgggaaaucugcggccucucggagacucccacaacagcuuggcgagcauccccccgccgccccgcgggucuccccagccacuaccugggugggccccucccgcggcgacgcggggcgagacugacacccgcagcugccgacgacccugccagucacgccgccgccggcugccuuuuuuuagccacgacaucugacccuggcuucaacagcaccguucugggagagaggucccagggcgcgcccgcgguccccuccccuccccaaccgccagacgcugcggagagcuuggggugaggggcgcgggaggcaccggcucugaaaggggcagaagcgcgcgcuccuccagcccagacgcuuacucccuccuuccccuuuuccaccgauccugguugccccuccgccaccagcaccgcgcucccucauuuggcagcucgaggucgggcuuuuggcgucccuccccaccccaaacccucaacuggacccgcuccccuggacccccuccaagucgguggcucgcgcacggccgggcugggggcgggaaggcgccaaggggaggaaaggggcgcgagccgaggacgcgggggccgggcgcucaccucccuccucugugccgcuguccggaucggcgucggaggagucgggcccgucuccguaguccgcuagccccaccagcucauccuccuccuccuccuccuccgcgucguccucguccugcggcugcggcuuccccagcaccuggcucaucgugcccaccggccggccggcccggggacggcgggggucccggggugggggccaagccuccuagccggccgcccgcagccuauuucugaagcggagguuugucuagagcucagcggggcccggcggaagcgggggccgcgcgucccccggcgggcggcgcccagguccgggucccgcgguucccagcgcgcccgaagcccccucccccgccccgcccgccggcggaggagucagccggagcgcggcaguuccucccggaggagggagagagagagagacugcgugacccgagucaccugacacacacugucacauacucacauacacaccccgcacgggcgcgcgcgcgcucgcccggccgcgggcaccacucggcggggcgcugggccgaggacacacaugcacacgcacacgcacacgcacgaggagaccggggaggcgcggggccccugcacccucccagacucacaccgacacacgccccguacacggggcccccgggacgccggccgucacccaccgcggcugcgcgccaggggcccccacgcgccucuccuucacgugguccccgcacaggcaggggagggggcgccgcacacccucaaugucccccccgccgucccacucccacacgcccgcagagcgucuaccgugggcggaugccuccugcuuacaguccugagcuagggucccaagcggguggccucccaacacuguggcgcccagaucccccaccccagagcagcgugcccaggacacccuguggacgcucaagagccccaggcggagaacucagauaaaugcacaguggaggcgcagucuccauagcaauugucuuuuagugugccuuuaugguucaaagugcuucccaccaagaauauuuaaaaagcaggccuacccagacguaaauguuucugaagaaaucacaugacucguggcugcuuagacuaaauaauuccucugcagcccuuuggaaaaggucucaguguauaacacacucgggggcuauucauggccaccuccucaugucucauuguugcauagacuguaaucccacaugaauaaaauauuucaaggcuuuugugggaguaggggaguggcgguggugggggggcaauucucaaauaggaauagcagcaacguggagugagacucuaaaaccugcauuccuccuucacaagcuuuucaccacggaacacacuguaccc

SEQ ID NO: 19449 - RNA, 2663 nt, Homo sapiens
acccggacgagcggcgcgcgcggggcccaggcggggggcgggaggaagcgccgggcagcgccggccgccagggcccaggagaagcggagcagagaggagcggggacacgggcggggccgccguagcuccggaugggaccagcgcccgggcccguuaguccaagcaggagcuccgggagaauccuucacagggagauuuaccccugccuuccccugcccuccggcccaggccucgcuucgcuccccgccugcccaugaucccaguccuuccgcggcgcgggcacccucccaccuuacccccuugguccuauguggcgcagcgcccuccugcccucccggcccuuucagcugugagguucccccaggccguuucuuuguaccacccgccccccacccccaccccaucccagucccagauccccuuuuccuucucagcuuuagauuuaucaggcuucuucaccucgcacuguccccauccuggccgcaggcccccucggucccucccucccccugccaccccguucucaguccucaguccuugcccuaggcugguagcccacuccuugcccgccccccgccuuccucccaucucccccuccucuccccggcccccagcaccuucugcaucccagccuaccuagccuacuccuccucuuccuggcccucuuccccaggcuccaggcuggggggugcucgcgucuccccuguaggccagagcagccccaaguucugggggcgguggggcugcugcuuuauccccauggcgcugccaucacuucugcuguugguggcagcccuggcagguggggugcguccucccggggcgcggaaccugacgcuggcgguggugcugccagaacacaaccugagcuaugccugggccuggccacgggugggacccgcuguggcacuagcuguggaggcucugggccgggcacugcccguggaccugcgguuugucagcuccgaacuggaaggcgccugcucugaguaccuggcaccgcugagcgcuguggaccucaagcuguaccaugaccccgaccugcuguuaggucccgguugcguguacccugcugccucuguggcccgcuuugccucccacuggcgccuuccccugcugacugcgggugcuguggccucugguuuuucggcuaagaaugaccauuaucguacccugguucgcacuggccccucugcucccaagcugggugaguuuguggugacacuacacgggcacuucaauuggacugcccgugcugccuugcuguaccuggaugcucgcacagaugaccggccucacuacuucaccaucgagggcgucuuugaggcccugcagggcagcaaccucagugugcagcaccagguguaugcccgagagccagggggccccgagcaggccacccacuucauccgggccaacgggcgcagugaguguggccugggcuauuuuagggucaugggaggagggucgcugugucccuaaagcucagcacuggggaacuguagauggagauaggcauugagcagcuguauguggugguugggaucaagaagcacacguggacagagcaccugugagagggccaaggcuucaucaugggagcuugugaacacccuaggcagaugcaaacaaggaagaagagagcaugaggggugaagccuuguaucaagguggaaugugaaaaugaggggauauuaaguuucgggagcaauguuugugcccuagaguagugaaugugauugauagccacucugaaaugugcccugucugugaucagagcuaccacccagacugggcgccaagaccccuuggugguguaaaaauaaugagggcuccaugaacggacucagggcucagcagauuugggaaagacagauaaagcucauacugagaaaucugugcugucugugccuuugagcccagggaagggcagggaagagucagggagcaggccgguuggguggggagcagcaagggaggcucugggaaagggaggggcuugagagugacagcucccuuccucuggggucuggacaggcucugacuucugccagaugguccauauggccccaggguacuuaugguggacuccaagaggggugggcuggggagcaucugcuuugggguugauagguuagggcacucucuuucuugcugaagagggacaucccagugauucagagagggggcugugugggggaccuggauaccuucucagggugcuccucugucauguaccugcucccaguuguguauaucugcggcccucuggagaugcugcaugagauccugcuucaggcccagagggagaaucugaccaauggggauuaugucuucuuuuaccuggaugucuuuggggagagucuccgugcaggccccacacgugcuacaggccggcccuggcaggacaaucgcacccgggaacaggcccaggcccucagagaggccuuucagguaucauuugagccaaaucugaaggaggagggggaagaggugcuucgcuggaaauucucucucacaagacccuaaagaaacccuaggaaccaggcaggaauugugagccacaggaguaaaaugaacagaggcauucugagucuagugucacccuuucuuacuucucuacuuuugugacucuuagugugcuugcugccaagacugacuuu

SEQ ID NO: 19450 - RNA, 2663 nt, Homo sapiens
aaagucagucuuggcagcaagcacacuaagagucacaaaaguagagaaguaagaaagggugacacuagacucagaaugccucuguucauuuuacuccuguggcucacaauuccugccugguuccuaggguuucuuuagggucuugugagagagaauuuccagcgaagcaccucuucccccuccuccuucagauuuggcucaaaugauaccugaaaggccucucugagggccugggccuguucccgggugcgauuguccugccagggccggccuguagcacguguggggccugcacggagacucuccccaaagacauccagguaaaagaagacauaauccccauuggucagauucucccucugggccugaagcaggaucucaugcagcaucuccagagggccgcagauauacacaacugggagcagguacaugacagaggagcacccugagaagguauccaggucccccacacagcccccucucugaaucacugggaugucccucuucagcaagaaagagagugcccuaaccuaucaaccccaaagcagaugcuccccagcccaccccucuuggaguccaccauaaguacccuggggccauauggaccaucuggcagaagucagagccuguccagaccccagaggaagggagcugucacucucaagccccucccuuucccagagccucccuugcugcuccccacccaaccggccugcucccugacucuucccugcccuucccugggcucaaaggcacagacagcacagauuucucaguaugagcuuuaucugucuuucccaaaucugcugagcccugaguccguucauggagcccucauuauuuuuacaccaccaaggggucuuggcgcccagucugggugguagcucugaucacagacagggcacauuucagaguggcuaucaaucacauucacuacucuagggcacaaacauugcucccgaaacuuaauauccccucauuuucacauuccaccuugauacaaggcuucaccccucaugcucucuucuuccuuguuugcaucugccuaggguguucacaagcucccaugaugaagccuuggcccucucacaggugcucuguccacgugugcuucuugaucccaaccaccacauacagcugcucaaugccuaucuccaucuacaguuccccagugcugagcuuuagggacacagcgacccuccucccaugacccuaaaauagcccaggccacacucacugcgcccguuggcccggaugaaguggguggccugcucggggcccccuggcucucgggcauacaccuggugcugcacacugagguugcugcccugcagggccucaaagacgcccucgauggugaaguagugaggccggucaucugugcgagcauccagguacagcaaggcagcacgggcaguccaauugaagugcccguguagugucaccacaaacucacccagcuugggagcagaggggccagugcgaaccaggguacgauaauggucauucuuagccgaaaaaccagaggccacagcacccgcagucagcaggggaaggcgccagugggaggcaaagcgggccacagaggcagcaggguacacgcaaccgggaccuaacagcaggucggggucaugguacagcuugagguccacagcgcucagcggugccagguacucagagcaggcgccuuccaguucggagcugacaaaccgcagguccacgggcagugcccggcccagagccuccacagcuagugccacagcgggucccacccguggccaggcccaggcauagcucagguuguguucuggcagcaccaccgccagcgucagguuccgcgccccgggaggacgcaccccaccugccagggcugccaccaacagcagaagugauggcagcgccauggggauaaagcagcagccccaccgcccccagaacuuggggcugcucuggccuacaggggagacgcgagcaccccccagccuggagccuggggaagagggccaggaagaggaggaguaggcuagguaggcugggaugcagaaggugcugggggccggggagaggagggggagaugggaggaaggcggggggcgggcaaggagugggcuaccagccuagggcaaggacugaggacugagaacgggguggcagggggagggagggaccgagggggccugcggccaggauggggacagugcgaggugaagaagccugauaaaucuaaagcugagaaggaaaaggggaucugggacugggaugggguggggguggggggcgggugguacaaagaaacggccugggggaaccucacagcugaaagggccgggagggcaggagggcgcugcgccacauaggaccaaggggguaaggugggagggugcccgcgccgcggaaggacugggaucaugggcaggcggggagcgaagcgaggccugggccggagggcaggggaaggcagggguaaaucucccugugaaggauucucccggagcuccugcuuggacuaacgggcccgggcgcuggucccauccggagcuacggcggccccgcccguguccccgcuccucucugcuccgcuucuccugggcccuggcggccggcgcugcccggcgcuuccucccgccccccgccugggccccgcgcgcgccgcucguccgggu

SEQ ID NO: 19451 - RNA, 2485 nt, Homo sapiens
cggcugcugcggcggaauguacaccggguccaauucuggccgcaggagcucggccacgaagccgcccgaggggcucacgucguugauguccgccagguugaagggagccgucggagggggagcggacucccugccauagaggaggccuccgcccgugccgcccggcgccacgcccgggucguucccggcccggaucggauaggugaagcugcagguggagggcgcgcuggcagggccgcugcucgacggcgacgacgaagaggaggcugacgcugacgaggacacgguggcggccacugacuccggaggaugggucagcgaauuggagagaauaaaguccagguccaggagaucguugaacuccucggucucucuccgagguaggggcgccagguugcuaccgccgcaagccgcaccggcuccgccgcucuccaggucuguggccacggucgccgccgccaggucauaggggcggccgggaagcacugggggaagucgcuucaugugggagagcuccucccgccagcgcugcggggacagggcgggagagaccugucaguggugguccccuguugccacccgacauacugacgugcuggcgggccacgcgcgacugcaccgcccagacauggggacuggucaggcaggaagcacccgggaacccagggcgccagcgcugcaaucucggcccacucccgggucgaagaagaggugaugcgucuguauugcggguguuauguccugucugcccaauugcgugugagcgagcgccgcggcuggucccucccccuccaggucccguggacguccccggaauuggcacaccgaggcucucucggugcgcucucgccacggggccgccuacgcgcuaaacucacucuggcccagccagugucuggggacgcggccaccucccgcccgguggcccgagagcgcccgcccuaccgacagcgcgcccggggacuggugaagacccggcuugcgccccaggcggcuccgcagugcucgcaccacgggcauacacagcugagccaaggacacggaagcuaucccgggaagguugcggaguccgcgcgguggccgcuccuuacccucguucaguggcucuuggugaccccaaggcuccgcccgcccccaccacacccacgaaaacccaccgggcguucccggcggcccggagcgauacucacguuauucggggcaccugcuugacgcagugucuucucccuucccgccgggccagacgcgaacguggagaaagaugggagcagcgcgucgcugacagccaugucagacucgccagguggcugccugcgagcaaggcagggagcggagacaggagagucaggggcggcuuucggccgucguuccggcgcgucccaccgguccucaccccucccugcucccagcgccgcgcgccucaccuaccucauuaaugugggggcccagaagguccucggcagcccgaagcagcuggggcaccugaaccccaaagucaacgaagagaagaaacgaagccaaaacccaaaaccccaaauuggccgagauccuucuucuuuggauuaaauauaacuuggaagcgucuuuuuuaaaaaguuccuuuguauacaaaaguucuuagaaaaguuguaaacgcaaaaauagacaaucagcaaggcgaguaaguagguccgguggccgggcugcgcucucuuccacucagcagcgucccccaccacugucgcggucgccucgagugcugccgugggcgcaggggcuguggccggggcggugggcgggcggugccgccaggugagacuggcugccguggcgcggagcugcgaacuggucggcggcgcaaggcgcggacuccggugaguuguguggagcgcgcgcggccaugggcgcgggccacgggcgggugggaggguggggggccagaggggcgggggagggucacucggcggcucccggugccgccgccgcccgccaccgccucugcuccccgcgcgcccgcagacacguucguucucucuggucgggaaacugccggccgccggcgcgcguuccuuacuuauaacuuccuucgcuacagccuuuuccuccgccuucucccaugccccgccccucccuuucuucucuccgccccccccgaggcucccuuccaucguugcuauggcagcuaaaucaacaaacucggcgcacgugggggcgggggaggggaaggaggggcgcgggcggggcugggccgggccgugacgccagccaggcagcuggcgggcuggagccgagcugacgccggcggcaguggugucggcggcggcggcggcguccgccccagcgcggggcgcgaggaaccgggcgcagguucggucgcugcgcgaccagggccguacucaccgccauugucggcucccuggguucgaagcccgcgaagacugguggggucagcgggcggcacggucacgcguccgcaccccugcuagcauacgcgcuugccgcgcug

SEQ ID NO: 19452 - RNA, 2485 nt, Homo sapiens
cagcgcggcaagcgcguaugcuagcaggggugcggacgcgugaccgugccgcccgcugaccccaccagucuucgcgggcuucgaacccagggagccgacaauggcggugaguacggcccuggucgcgcagcgaccgaaccugcgcccgguuccucgcgccccgcgcuggggcggacgccgccgccgccgccgacaccacugccgccggcgucagcucggcuccagcccgccagcugccuggcuggcgucacggcccggcccagccccgcccgcgccccuccuuccccucccccgcccccacgugcgccgaguuuguugauuuagcugccauagcaacgauggaagggagccucggggggggcggagagaagaaagggaggggcggggcaugggagaaggcggaggaaaaggcuguagcgaaggaaguuauaaguaaggaacgcgcgccggcggccggcaguuucccgaccagagagaacgaacgugucugcgggcgcgcggggagcagaggcgguggcgggcggcggcggcaccgggagccgccgagugacccucccccgccccucuggccccccacccucccacccgcccguggcccgcgcccauggccgcgcgcgcuccacacaacucaccggaguccgcgccuugcgccgccgaccaguucgcagcuccgcgccacggcagccagucucaccuggcggcaccgcccgcccaccgccccggccacagccccugcgcccacggcagcacucgaggcgaccgcgacaguggugggggacgcugcugaguggaagagagcgcagcccggccaccggaccuacuuacucgccuugcugauugucuauuuuugcguuuacaacuuuucuaagaacuuuuguauacaaaggaacuuuuuaaaaaagacgcuuccaaguuauauuuaauccaaagaagaaggaucucggccaauuugggguuuuggguuuuggcuucguuucuucucuucguugacuuugggguucaggugccccagcugcuucgggcugccgaggaccuucugggcccccacauuaaugagguaggugaggcgcgcggcgcugggagcagggaggggugaggaccggugggacgcgccggaacgacggccgaaagccgccccugacucuccugucuccgcucccugccuugcucgcaggcagccaccuggcgagucugacauggcugucagcgacgcgcugcucccaucuuucuccacguucgcgucuggcccggcgggaagggagaagacacugcgucaagcaggugccccgaauaacgugaguaucgcuccgggccgccgggaacgcccgguggguuuucguggguguggugggggcgggcggagccuuggggucaccaagagccacugaacgaggguaaggagcggccaccgcgcggacuccgcaaccuucccgggauagcuuccguguccuuggcucagcuguguaugcccguggugcgagcacugcggagccgccuggggcgcaagccgggucuucaccaguccccgggcgcgcugucgguagggcgggcgcucucgggccaccgggcgggagguggccgcguccccagacacuggcugggccagagugaguuuagcgcguaggcggccccguggcgagagcgcaccgagagagccucggugugccaauuccggggacguccacgggaccuggagggggagggaccagccgcggcgcucgcucacacgcaauugggcagacaggacauaacacccgcaauacagacgcaucaccucuucuucgacccgggagugggccgagauugcagcgcuggcgcccuggguucccgggugcuuccugccugaccaguccccaugucugggcggugcagucgcgcguggcccgccagcacgucaguaugucggguggcaacaggggaccaccacugacaggucucucccgcccuguccccgcagcgcuggcgggaggagcucucccacaugaagcgacuucccccagugcuucccggccgccccuaugaccuggcggcggcgaccguggccacagaccuggagagcggcggagccggugcggcuugcggcgguagcaaccuggcgccccuaccucggagagagaccgaggaguucaacgaucuccuggaccuggacuuuauucucuccaauucgcugacccauccuccggagucaguggccgccaccguguccucgucagcgucagccuccucuucgucgucgccgucgagcagcggcccugccagcgcgcccuccaccugcagcuucaccuauccgauccgggccgggaacgacccgggcguggcgccgggcggcacgggcggaggccuccucuauggcagggaguccgcucccccuccgacggcucccuucaaccuggcggacaucaacgacgugagccccucgggcggcuucguggccgagcuccugcggccagaauuggacccgguguacauuccgccgcagcagccg

SEQ ID NO: 19453 - RNA, 2528 nt, Homo sapiens
uuaaaacaaggauaauuccuaccuaucugccucacaagguugcuaugagggcaaaagugagaucauguauauaaaaguggcuuuaaacugacaagcaccagaaaaacauacauuacguguauaacuacuuucauauggaaauucagaagcggcuuuaacaacguaagcuucauaaagcuugcaacaccucacccaugcuuuauuccauuuaaaacccacaucaucuucaaauaacaccuuucuuguuuuugccauaaacugaagggcagcauugggagaaaaaaaaaaagggaaagaaagaaaacccuugggggggagaacacucaaaacgcaaucagaaauuaucucacauguccuauguccuaugaaacuucgguauuuaugaccccagcguggguccgcggcgccccggaacuacacuucccacaaagcauugaggcgaaccccggcggcgggcggggcggccugggauucagggugaccaccgcucuccccagacagggaccgccguccccgggaaggcugcaccgcguacgaucgagggggcacuaacucuccuuucugaaagcgcugucaccccgugguuucuccugcgguucgaccggcgacccucuccgcccucccugcuccaucugagggucaccgccuauucgugaccuuucggcugauuacuagagugucacaaaaaggcaccuucucccccuucccgaaagcuccauuucuauaacucaaccagccgucggggacccggggccaggcggggucagacgggacgggcggacacugcccgucaccccggggcuccggcccucccgccagccgaggcucagugggcagggggcugggcucccccgaccccgggccagggcggaucgcgggcagagguggcuccgcccggggcuccgguuucaauuucgcaacgugacggugcaaaccugaggccuacaaacgccagcggcgacgguccgcgccccgcccguccgccaggcccgggcuccccagcuccccguacgccgcggccgccgcccgcccaccgggccuggcgccccagcccucaugcggccgccggcccccggcaccgcgcggcgcccguuccggcucgcggccgcagguucggccgcggcacuuacucagcucauccugggaggcggaggcggcggccgcagccauguugcgccggggagggaacgagggaggggcugggggggcagggcgcggccggggggcucgcggcucgcggugcggcaggggccgcgagccgccuccguucacucggcgcggaccgcgcugugccccgaggcccgcccgccgccgccgccugcguccuccgcgucgcgagcgucgcccuucgcugcccccgcgagcucgcgacucgggcgcucccgcagccucgcgccucugcggagccgcugccgcugccgccgccgccgucugugcggccgaauccccgugcgccaggcccgcgcggcggcucugcgacuccgcgccgcgcucgcccaacucacgccgguuuuauauuuagaaagagcugagccauccucccagcggcccccccgccgggccccucgcgcgcccgcccgcccucgcucgcucgcggcucguccugcccaccugucgccgcccgccccgcgugcgcuccccgcgcggacucgacacgcggcggccugugcgggcggcccggccuaaccgcgccgccgcgcgcgcagggccagucccccgcggcccgggggcgggccucugaccugagucggagccggucuccaugccgcggacgcugcgcucggcgccgcgaggugagggcuguagagcgaggcguucggcgggccgggccccggggagccgcgcgccgcaguccgugaggggcugggccgagcgggcccgggcugcccuagcggccgggggaaauccucgaggcggggccggagcgcccuuuuccgaggucugcggcugucacguuggcugggcccgaccuggggaaacacgccuguccaaaggaagagacguggacucagaaaaguagagccgggcucggagucggcgggaggaagccccgcccugcgccucccgccgaacuucucggccccggcgcugacucagucccggacgagccccugcgccgcagcggcccccgacagcccaguucugguguggagguggcuggugcucccaaaacggcuagcgggagcaggggguccacucagcccugcaaaaguuagauaaggcaagauuccuaaaguucacauggaaguaucuaugccuaugugagcucugagauuuuguucagauacccuauguucuuuucgguaacuagagugauuuauuuucgauaugcugauuuuaacuuucugccuucgcuuuguccgugaggucauguacacuugcaaaaugaaauucaaauucagggguugcauaauugcuguacuuuaagugaugguacugucauaacaaauuagauacaagaucagauacuuuuuuuauauaagaagaaaucaagucuuaaauagauugaaauugcauuuauuccuuaa

SEQ ID NO: 19454 - RNA, 2528 nt, Homo sapiens
uuaaggaauaaaugcaauuucaaucuauuuaagacuugauuucuucuuauauaaaaaaaguaucugaucuuguaucuaauuuguuaugacaguaccaucacuuaaaguacagcaauuaugcaaccccugaauuugaauuucauuuugcaaguguacaugaccucacggacaaagcgaaggcagaaaguuaaaaucagcauaucgaaaauaaaucacucuaguuaccgaaaagaacauaggguaucugaacaaaaucucagagcucacauaggcauagauacuuccaugugaacuuuaggaaucuugccuuaucuaacuuuugcagggcugaguggacccccugcucccgcuagccguuuugggagcaccagccaccuccacaccagaacugggcugucgggggccgcugcggcgcaggggcucguccgggacugagucagcgccggggccgagaaguucggcgggaggcgcagggcggggcuuccucccgccgacuccgagcccggcucuacuuuucugaguccacgucucuuccuuuggacaggcguguuuccccaggucgggcccagccaacgugacagccgcagaccucggaaaagggcgcuccggccccgccucgaggauuucccccggccgcuagggcagcccgggcccgcucggcccagccccucacggacugcggcgcgcggcuccccggggcccggcccgccgaacgccucgcucuacagcccucaccucgcggcgccgagcgcagcguccgcggcauggagaccggcuccgacucaggucagaggcccgcccccgggccgcgggggacuggcccugcgcgcgcggcggcgcgguuaggccgggccgcccgcacaggccgccgcgugucgaguccgcgcggggagcgcacgcggggcgggcggcgacaggugggcaggacgagccgcgagcgagcgagggcgggcgggcgcgcgaggggcccggcgggggggccgcugggaggauggcucagcucuuucuaaauauaaaaccggcgugaguugggcgagcgcggcgcggagucgcagagccgccgcgcgggccuggcgcacggggauucggccgcacagacggcggcggcggcagcggcagcggcuccgcagaggcgcgaggcugcgggagcgcccgagucgcgagcucgcgggggcagcgaagggcgacgcucgcgacgcggaggacgcaggcggcggcggcgggcgggccucggggcacagcgcgguccgcgccgagugaacggaggcggcucgcggccccugccgcaccgcgagccgcgagccccccggccgcgcccugcccccccagccccucccucguucccuccccggcgcaacauggcugcggccgccgccuccgccucccaggaugagcugaguaagugccgcggccgaaccugcggccgcgagccggaacgggcgccgcgcggugccgggggccggcggccgcaugagggcuggggcgccaggcccggugggcgggcggcggccgcggcguacggggagcuggggagcccgggccuggcggacgggcggggcgcggaccgucgccgcuggcguuuguaggccucagguuugcaccgucacguugcgaaauugaaaccggagccccgggcggagccaccucugcccgcgauccgcccuggcccggggucgggggagcccagcccccugcccacugagccucggcuggcgggagggccggagccccggggugacgggcaguguccgcccgucccgucugaccccgccuggccccggguccccgacggcugguugaguuauagaaauggagcuuucgggaagggggagaaggugccuuuuugugacacucuaguaaucagccgaaaggucacgaauaggcggugacccucagauggagcagggagggcggagagggucgccggucgaaccgcaggagaaaccacggggugacagcgcuuucagaaaggagaguuagugcccccucgaucguacgcggugcagccuucccggggacggcggucccugucuggggagagcgguggucacccugaaucccaggccgccccgcccgccgccgggguucgccucaaugcuuugugggaaguguaguuccggggcgccgcggacccacgcuggggucauaaauaccgaaguuucauaggacauaggacaugugagauaauuucugauugcguuuugaguguucucccccccaaggguuuucuuucuuucccuuuuuuuuuuucucccaaugcugcccuucaguuuauggcaaaaacaagaaagguguuauuugaagaugauguggguuuuaaauggaauaaagcaugggugagguguugcaagcuuuaugaagcuuacguuguuaaagccgcuucugaauuuccauaugaaaguaguuauacacguaauguauguuuuucuggugcuugucaguuuaaagccacuuuuauauacaugaucucacuuuugcccucauagcaaccuugugaggcagauagguaggaauuauccuuguuuuaa

SEQ ID NO: 19455 - RNA, 2544 nt, Homo sapiens
gggggcggggaaggcagggcagcgacagucgcacagucccgcggacgcucccaggcccacgcccugacucgcucacacccacccacacucacacccacccgcucccugggccccagggcccggauccagccugggugggggggucuccgggcgggccgcagcgcccuccgugccccggggaugcuggcgcacagugcggagcggaguugcgcgucucucgucccuuuguugacaauucccugaaccaacuugaguuuggccggcucggccgcggcccugacgucacgcacggucacguggccccgccucccgcuggaucuuuaaguagaaaguaaucuaucaggccaguccuuaaaacgggacuuucgacuaccggggcuucggcgucccugacacccagcccccugcccccccgcuacugucccugcccgcgcccucccgagcugcucggcgcccggcgucccgcgcccgccuggaccgcuccugcgccccacgccagggccagaggccgaggaaggcgggcuaagugagggggcgcggcguggagaaccgccggggccgggagcgguagcgagcgccuaguaccgagcgccagggacggcaggaguucgcggagcgcggccgcugggggcggacggcagagcccgcgccacgcgaugcggggccgccgagugugagcugagcccagcgggccccaagccaccugcggcccccuccccucucccugccccccaucuuucgggggcacucaaacccucuuccccugagcuccguggcagcccccgaacacccucaucgcccgcugcccccuccccgccgccgcuaccaaccccgaggagggaugacccucuccggcggcggcagcgccagcgacauguccggccagacggugcugacggccgaggacguggacaucgauguggugggcgagggcgacgacgggcuggaagagaaggacagcgacgcagguugcgauagccccgcggggccgccggagcugcgccuggacgaggcggacgaggugcccccggcggcaccccaucacggacagccucagccgccccaccagcagccccugacauugcccaaggaggcggccggagccggggccggaccggggggcgacgugggcgcgccggaggcggacggcugcaagggcgguguuggcggcgaggagggcggcgcgagcggcggcgggccuggcgcgggcagcgguucggcgggaggccuggccccgagcaagcccaagaacagccuagugaagccgccuuacucguacaucgcgcucaucaccauggccauccugcagagcccgcagaagaagcugacccugagcggcaucugcgaguucaucagcaaccgcuuccccuacuacagggagaaguuccccgccuggcagaacagcauccgccacaaccucucacucaacgacugcuucgucaagaucccccgcgagccgggcaacccgggcaagggcaacuacuggacccuggacccgcaguccgaggacauguucgacaacggcagcuuccugcggcgccggaaacgcuucaagcgccaccagcaggagcaccugcgcgagcagacggcgcucaugaugcagagcuucggcgcuuacagccuggcggcggcggccggcgccgcgggacccuacggccgccccuacggccugcacccugcggcggcggccggugccuauucgcacccggcagcggcggcggccgcggcugcugcggcggcgcuccaguacccguacgcgcugccgccgguggcaccggugcugccucccgcugugccgcugcugcccucgggcgagcugggccgcaaagcggccgccuucggcucacagcucggcccgggccugcagcugcagcucaauagccugggcgccgccgcggccgcugcgggcacagcgggcgccgcgggcaccaccgcgucgcucaucaaguccgagccaagcgcgcggccgucguucagcaucgagaacaucauaggugggggccccgcggcuccugggggcucggcggugggcgcuggggucgccggcggcacuggggguucagggggcggcagcacggcgcagucguuucugcggccacccgggaccgugcagucggcagcgcucauggccacccaccaaccgcugucgcugagccggacgacugccaccaucgcgcccauucuuagcgugccacucuccggacaguuucugcagcccgcagccucggccgccgccgcugcugcggccgccgcucaagccaaauggccggcgcaauagggacgcgccaauggccgggacccaggguccggcggcggccucgagcaacaaaugcaccuccaggcugcgcgcccugucccaagcccggucccggucccgcugcccaauccuggacucugccucuccccaauuuccuuuccccugagcccccaacgccuaccuuccgcggccuccauccccucgcgcacaccuaagcuggucgagcaaacucaccgcgcgcccgccggggauagcuuuccauacagguaaaaccgaaaaccgaauuu

SEQ ID NO: 19456 - RNA, 2544 nt, Homo sapiens
aaauucgguuuucgguuuuaccuguauggaaagcuauccccggcgggcgcgcggugaguuugcucgaccagcuuaggugugcgcgaggggauggaggccgcggaagguaggcguugggggcucaggggaaaggaaauuggggagaggcagaguccaggauugggcagcgggaccgggaccgggcuugggacagggcgcgcagccuggaggugcauuuguugcucgaggccgccgccggacccugggucccggccauuggcgcgucccuauugcgccggccauuuggcuugagcggcggccgcagcagcggcggcggccgaggcugcgggcugcagaaacuguccggagaguggcacgcuaagaaugggcgcgaugguggcagucguccggcucagcgacagcgguugguggguggccaugagcgcugccgacugcacggucccggguggccgcagaaacgacugcgccgugcugccgcccccugaacccccagugccgccggcgaccccagcgcccaccgccgagcccccaggagccgcggggcccccaccuaugauguucucgaugcugaacgacggccgcgcgcuuggcucggacuugaugagcgacgcgguggugcccgcggcgcccgcugugcccgcagcggccgcggcggcgcccaggcuauugagcugcagcugcaggcccgggccgagcugugagccgaaggcggccgcuuugcggcccagcucgcccgagggcagcagcggcacagcgggaggcagcaccggugccaccggcggcagcgcguacggguacuggagcgccgccgcagcagccgcggccgccgccgcugccgggugcgaauaggcaccggccgccgccgcagggugcaggccguaggggcggccguagggucccgcggcgccggccgccgccgccaggcuguaagcgccgaagcucugcaucaugagcgccgucugcucgcgcaggugcuccugcugguggcgcuugaagcguuuccggcgccgcaggaagcugccguugucgaacauguccucggacugcggguccaggguccaguaguugcccuugcccggguugcccggcucgcgggggaucuugacgaagcagucguugagugagagguuguggcggaugcuguucugccaggcggggaacuucucccuguaguaggggaagcgguugcugaugaacucgcagaugccgcucagggucagcuucuucugcgggcucugcaggauggccauggugaugagcgcgauguacgaguaaggcggcuucacuaggcuguucuugggcuugcucggggccaggccucccgccgaaccgcugcccgcgccaggcccgccgccgcucgcgccgcccuccucgccgccaacaccgcccuugcagccguccgccuccggcgcgcccacgucgccccccgguccggccccggcuccggccgccuccuugggcaaugucaggggcugcugguggggcggcugaggcuguccgugauggggugccgccgggggcaccucguccgccucguccaggcgcagcuccggcggccccgcggggcuaucgcaaccugcgucgcuguccuucucuuccagcccgucgucgcccucgcccaccacaucgauguccacguccucggccgucagcaccgucuggccggacaugucgcuggcgcugccgccgccggagagggucaucccuccucgggguugguagcggcggcggggagggggcagcgggcgaugaggguguucgggggcugccacggagcucaggggaagaggguuugagugcccccgaaagauggggggcagggagaggggagggggccgcagguggcuuggggcccgcugggcucagcucacacucggcggccccgcaucgcguggcgcgggcucugccguccgcccccagcggccgcgcuccgcgaacuccugccgucccuggcgcucgguacuaggcgcucgcuaccgcucccggccccggcgguucuccacgccgcgcccccucacuuagcccgccuuccucggccucuggcccuggcguggggcgcaggagcgguccaggcgggcgcgggacgccgggcgccgagcagcucgggagggcgcgggcagggacaguagcgggggggcagggggcugggugucagggacgccgaagccccgguagucgaaagucccguuuuaaggacuggccugauagauuacuuucuacuuaaagauccagcgggaggcggggccacgugaccgugcgugacgucagggccgcggccgagccggccaaacucaaguugguucagggaauugucaacaaagggacgagagacgcgcaacuccgcuccgcacugugcgccagcauccccggggcacggagggcgcugcggcccgcccggagacccccccacccaggcuggauccgggcccuggggcccagggagcgggugggugugagugugggugggugugagcgagucagggcgugggccugggagcguccgcgggacugugcgacugucgcugcccugccuuccccgccccc

SEQ ID NO: 19457 - RNA, 2949 nt, Homo sapiens
gugucaguucuggaaacccaguucuaaugcaccuggggugaccuccucucucugggccucaguuucucaugacuaaaagaaaaggauuggucuaaaaauuauuuucugcuugccaaaaaauauuuucauucuaaauucgauucccacaaaauaaccauugaaugaaugaauaaaugaacuugaggaggcuccuguuccaaacuuccaccagagaagaaacauccucaagggcuugguucagguggucauacagccucugcuuacucaccucucaggaugggguacucacuauuuccagaacaguuguuuuggagcagugguaacuugaaaugcccuuucuuauccuggccacaaccccacaacaucccucgagaaagucaaaggcucagggaacaaggaagagggcuauacugagcugaguaaggacuugccauccugccacccagcacacucagacagaagcgugggcaggcagcugugaguggcagaauuuuccccucugccccaggagcugugguuuggagcaaagacaaugucaccaacaggucacacugcagacagggacaaaacugcaagugauccccccggggcuugcauuguaaguucacucauggucaacagaacuuucccuucaucuccccaucugcugccacugagccguagggacgauugucaccucccuuuuaaagauuaggcaauggaggcucaaggauaagugacuugucaagcaccacagcuagugagaggaagccaagauucaaccccacaucugacuccaagcugggggacacagaaccucagccaaguccugggcugguaauacuuagaaaaagcuaguggucucgccccgggaagaagcuucccacagccugagggccagaagcuggcagaguuguugagcaaacucgccccgcacacggucggcagacagccaggugggcugaggcgccgggcucagcuccggggucccaguaccaggcgcaccaccuccggcuccagagcaccaagggcccuucccugccugaguccuaaaggacgccaaugggccucgagaauaccuccgccccuucuccccugccccuucagcugguucuuuucuucggcugaaacagauggaauacuagagcaugaguucugugucauaaagaaauugccucgugcucccagcaucugccguccuucccaccccgccccugucucggguagggccuucucuccaggcccuccacccuccgcugcccauguuuuccaaaccaaaucggaacccacuauaauggcaagcccgcuuucucugugccuggugcaguucccaguacguuccaggcauucacuccuucacccaccugugccgcggcgaggcagaaacugggaaaucugggcaggauauccuggcagugcucugcucgcccuuccucggccuccgggucucccaaccccgcgaaccuucccacugaauagcgcagccgcacgccccagcaaguccccaaagagccggccguccccgcucuccaccgugcuccccacuacccguccucccccgccgccuugccugcaguccccaagaucgugccaagcgaagagcccucggcgaccugcacuccacuuccucucuuacauggggggaaacugaggcccgagaggaaacagcaccgcaccgucccggcugcggguucgccccggccucccaucccuacacccgcaccuuggcgcagcgguggaagguggcugugguuccgugcucgggugcuucggccaggccguccuccucggaacgcaaggcuagcaccagcuccucguagucgccguccucguccuccugcgcacgggcgcccgcgggacccaggagcagcagcagcagcagcagcaguggcagcggccaccaggaccgccuggagcugacggugcccaugagggccaggggagagguugcuguccuggcgaggagaccuagaggccgugcgcgguccacgccggcggcgccuugagccuugcgguggggaggacugugcaggagcugaaguucaggagcagggcgcgugaaggggcgcgcggaauccuggcugggagcugggagccgcugcugcaacgacgcgucccggcccgcccgagccagucucacugccuggcucacuccuccaggcucagacccugaacugaacggcggcgcccgccugcaaccaugagcgccucgacgucgcugcggaaaccuucuagggugugggugcuugacgccuggggcgcgcagaucacgccaccagagccccaucggacgauccuaucugauuaaacauuaacggaacccccggacuggaggaucagguuucggccucgcccuccccaaacagcgucagauuacgcgcagagggaagaaaaaacucccaaauccuaacugggcuggaaggcaggccggcgcccuaggggcuccuccucucccgccucucacccugcgugggaugccagacuccaaguucugccgggcccaccuuuucaguguuuccuggguccaccuugucuccugcugaccagugagacuucugaaucaauccuacuguggacuccucgcugcccaccgaauucuuuccacuggccuuaaccuggcagccuucuaaacuuagccuggacccccuccggccucugcccuuuaugcacccugcacacugaccuuaccaacuagcugcuccuugaagagauugcuugcuuuugauguccagccuacaugcauuucaagggauuuauacuacaaagauucagguuuuaaguuugcaaagacgucauauagguacauucagaauucuaugguaggcacaagcucagcuuuccagaagauucaauuugcaaagauuccuuuuacacaccauguucaagaaaucaacuggacaagcauccaguaaacaccuauuguguaccaggcaggaggaugaaaaggggaaagagagcuccuggccucag

SEQ ID NO: 19458 - RNA, 2949 nt, Homo sapiens
cugaggccaggagcucucuuuccccuuuucauccuccugccugguacacaauagguguuuacuggaugcuuguccaguugauuucuugaacaugguguguaaaaggaaucuuugcaaauugaaucuucuggaaagcugagcuugugccuaccauagaauucugaauguaccuauaugacgucuuugcaaacuuaaaaccugaaucuuuguaguauaaaucccuugaaaugcauguaggcuggacaucaaaagcaagcaaucucuucaaggagcagcuaguugguaaggucagugugcagggugcauaaagggcagaggccggaggggguccaggcuaaguuuagaaggcugccagguuaaggccaguggaaagaauucggugggcagcgaggaguccacaguaggauugauucagaagucucacuggucagcaggagacaagguggacccaggaaacacugaaaaggugggcccggcagaacuuggagucuggcaucccacgcagggugagaggcgggagaggaggagccccuagggcgccggccugccuuccagcccaguuaggauuugggaguuuuuucuucccucugcgcguaaucugacgcuguuuggggagggcgaggccgaaaccugauccuccaguccggggguuccguuaauguuuaaucagauaggaucguccgauggggcucugguggcgugaucugcgcgccccaggcgucaagcacccacacccuagaagguuuccgcagcgacgucgaggcgcucaugguugcaggcgggcgccgccguucaguucagggucugagccuggaggagugagccaggcagugagacuggcucgggcgggccgggacgcgucguugcagcagcggcucccagcucccagccaggauuccgcgcgccccuucacgcgcccugcuccugaacuucagcuccugcacaguccuccccaccgcaaggcucaaggcgccgccggcguggaccgcgcacggccucuaggucuccucgccaggacagcaaccucuccccuggcccucaugggcaccgucagcuccaggcgguccugguggccgcugccacugcugcugcugcugcugcugcuccugggucccgcgggcgcccgugcgcaggaggacgaggacggcgacuacgaggagcuggugcuagccuugcguuccgaggaggacggccuggccgaagcacccgagcacggaaccacagccaccuuccaccgcugcgccaaggugcggguguagggaugggaggccggggcgaacccgcagccgggacggugcggugcuguuuccucucgggccucaguuuccccccauguaagagaggaaguggagugcaggucgccgagggcucuucgcuuggcacgaucuuggggacugcaggcaaggcggcgggggaggacggguaguggggagcacgguggagagcggggacggccggcucuuuggggacuugcuggggcgugcggcugcgcuauucagugggaagguucgcgggguugggagacccggaggccgaggaagggcgagcagagcacugccaggauauccugcccagauuucccaguuucugccucgccgcggcacaggugggugaaggagugaaugccuggaacguacugggaacugcaccaggcacagagaaagcgggcuugccauuauaguggguuccgauuugguuuggaaaacaugggcagcggaggguggagggccuggagagaaggcccuacccgagacaggggcggggugggaaggacggcagaugcugggagcacgaggcaauuucuuuaugacacagaacucaugcucuaguauuccaucuguuucagccgaagaaaagaaccagcugaaggggcaggggagaaggggcggagguauucucgaggcccauuggcguccuuuaggacucaggcagggaagggcccuuggugcucuggagccggagguggugcgccugguacugggaccccggagcugagcccggcgccucagcccaccuggcugucugccgaccgugugcggggcgaguuugcucaacaacucugccagcuucuggcccucaggcugugggaagcuucuucccggggcgagaccacuagcuuuuucuaaguauuaccagcccaggacuuggcugagguucugugucccccagcuuggagucagaugugggguugaaucuuggcuuccucucacuagcuguggugcuugacaagucacuuauccuugagccuccauugccuaaucuuuaaaagggaggugacaaucgucccuacggcucaguggcagcagauggggagaugaagggaaaguucuguugaccaugagugaacuuacaaugcaagccccggggggaucacuugcaguuuugucccugucugcagugugaccuguuggugacauugucuuugcuccaaaccacagcuccuggggcagaggggaaaauucugccacucacagcugccugcccacgcuucugucugagugugcuggguggcaggauggcaaguccuuacucagcucaguauagcccucuuccuuguucccugagccuuugacuuucucgagggauguugugggguuguggccaggauaagaaagggcauuucaaguuaccacugcuccaaaacaacuguucuggaaauagugaguaccccauccugagaggugaguaagcagaggcuguaugaccaccugaaccaagcccuugaggauguuucuucucugguggaaguuuggaacaggagccuccucaaguucauuuauucauucauucaaugguuauuuugugggaaucgaauuuagaaugaaaauauuuuuuggcaagcagaaaauaauuuuuagaccaauccuuuucuuuuagucaugagaaacugaggcccagagagaggaggucaccccaggugcauuagaacuggguuuccagaacugacac

SEQ ID NO: 19459 - RNA, 2648 nt, Homo sapiens
ucauggagaacaguggagggagcccagcaguggaagccugaacacccaggucccggucucagucuccuucuaccugguagcgugacuucaggcaagucacuuccucucucuggaccucaguuccuccaucuaaaaaccaccuggcuugguacccucuggccaagacaugccauguuccacagcccugaaccccuaaccccagcuuucaacccccgacucuggcuucugggagcucacucugucuaguggagccaggacacaaaccaggagugagacuagaagggucuccccuccaagaaaugcugggguaggggacacaugagaggcuaggcccaacacugccccagugccuuggacagcaccagucaccccagaccuugugggccuggccuucagaucccccucggcagccugcggagccagcaggcccugaccuguccagcaagauacuucaggaacuuaaccgaaguccaaagugcuucuaccucccgggcguagggcaggaguggcagaaaggaauaagagcauacuacaggggugaggcucacaccgaggaggucuagcaaaccagacuaccuuuccugccccuucccucagacgggacccacugggccgcaggccugcacccaaccaaaaguucaucauaggguggggucggggaagacauuaccaccagcugccaccucugggggcaggaggaccaccagguuggggagggggcucuccaacugcaaagggccaagcucacuugccucaggguccaagggucaccccagggcuugggcgagauuccagccuacacgggggguccuggccacccaugaaggagacaggcccacugccacacacacagcucccgaagguuccacacugcucgagggcaggguggugggacagcaggauuauuuccucaugccaggggucuuugcuggaaauccuggacccauucugagccccucuugccggcccucucccccagaucugaggaucuagcuccuuacaaugccauguuuauagagccccuuccaaauaaauguuucccaguucccccaaaacucccauccucaacccuccacauccgcccccccacccccaucccgcgcagcucugaggaaaccggcaguuaacuuuucccaaaaauccugcaaaggcagcuggcugggggagaaaugggccucgagauccuuucgcggcauuucaccgccuuccaaaaaaaaaaaaaaagaaagaaagaaagaaagagaagcaaagcaaagcaaacuuucggaguuaacuuuaaauucccagcccuccccccucaaaucgcccggcagcuucccuuuuuuuuuuucuuuaaagugcaauugcauugugucucaccuccccgaaaggcucgcggcucucgccaaagaaaaggaaaaaagccaacccuucgggugcccccucugcuuccagccgccucucccacauucucagacaguuuuauuaaaauuuucagacaaaagaaaaacaaaaauggcagccuggcuuauuuuuaaaacaggacagggacgccauauucugcagaucugcaaaaaaagggagaaauccggcacuggcugcuccaccgggccggcugcaaagugcgcgaaccgcgccguuugcaauccguuuauuugcauuaugccccaugaaucauuguuuaccggagaauugcagcaggguuugaauagcccggcuuaagaaaacacacacacacgcgcgcgcacacacacacacgcacacacacucggagaccagccccagacacgccgcgggagacacuuccuaccccgcgcgccccgcugccgccgccgccgccgccgcucugggccgggcccgaggcgcaggcggccccgggcccucggagcgccccggcccgcgcugacagcgcccgcgccccggcccggcccccgcccgcaacucggcgcaacuuucccgcgggcaggcgcccgccgccgcugggcccgcuccccgcgcgccccgggcccgcacggaccuggcugugcuggcggcgccuccgggacgcggccgcagccccgcgcccggcggcccgagcagggccgggcuggggcuccggcacaggcuccgggcucgggcuccggcucuggcucgcugcggagccgcgcgcaaaccuuccgggucgccugcuguucacuucuggguucugcaagcgccgaggcggcggcggcggcggcggcgggaggcugggucugcagcgccgcgcggcccccagugcgcucggcgagcccccgcgccaggcgcccggcuccgggggggccgcgucgggcccccgccucuccggcugcgcagcccguccggccccgggggcucccgcgagugggcagcgccgggcgcuggcgacugcgcgagaggggagggggccgggcggggggcgggggcgggccgcgcgcuggggcccccacucgggccccggggccucgucucgcgcucgccgucgccgccgccgccgccgccgccaccgccuggcaaaguugcgcugcgccccccgcccgcgccgcgccggaggcagagccacaaaggaacuccucgccccccuccgcccgccugagccgcgcggggagggcaccggcgcccggcccuaggacagccccuuccccagcgcgggggcucccggggccccggcggcc

SEQ ID NO: 19460 - RNA, 2648 nt, Homo sapiens
ggccgccggggccccgggagcccccgcgcuggggaaggggcuguccuagggccgggcgccggugcccuccccgcgcggcucaggcgggcggaggggggcgaggaguuccuuuguggcucugccuccggcgcggcgcgggcggggggcgcagcgcaacuuugccaggcgguggcggcggcggcggcggcggcgacggcgagcgcgagacgaggccccggggcccgagugggggccccagcgcgcggcccgcccccgccccccgcccggcccccuccccucucgcgcagucgccagcgcccggcgcugcccacucgcgggagcccccggggccggacgggcugcgcagccggagaggcgggggcccgacgcggcccccccggagccgggcgccuggcgcgggggcucgccgagcgcacugggggccgcgcggcgcugcagacccagccucccgccgccgccgccgccgccgccucggcgcuugcagaacccagaagugaacagcaggcgacccggaagguuugcgcgcggcuccgcagcgagccagagccggagcccgagcccggagccugugccggagccccagcccggcccugcucgggccgccgggcgcggggcugcggccgcgucccggaggcgccgccagcacagccagguccgugcgggcccggggcgcgcggggagcgggcccagcggcggcgggcgccugcccgcgggaaaguugcgccgaguugcgggcgggggccgggccggggcgcgggcgcugucagcgcgggccggggcgcuccgagggcccggggccgccugcgccucgggcccggcccagagcggcggcggcggcggcggcagcggggcgcgcgggguaggaagugucucccgcggcgugucuggggcuggucuccgagugugugugcgugugugugugugcgcgcgcguguguguguguuuucuuaagccgggcuauucaaacccugcugcaauucuccgguaaacaaugauucauggggcauaaugcaaauaaacggauugcaaacggcgcgguucgcgcacuuugcagccggcccgguggagcagccagugccggauuucucccuuuuuuugcagaucugcagaauauggcgucccuguccuguuuuaaaaauaagccaggcugccauuuuuguuuuucuuuugucugaaaauuuuaauaaaacugucugagaaugugggagaggcggcuggaagcagagggggcacccgaaggguuggcuuuuuuccuuuucuuuggcgagagccgcgagccuuucggggaggugagacacaaugcaauugcacuuuaaagaaaaaaaaaaagggaagcugccgggcgauuugaggggggagggcugggaauuuaaaguuaacuccgaaaguuugcuuugcuuugcuucucuuucuuucuuucuuucuuuuuuuuuuuuuuuggaaggcggugaaaugccgcgaaaggaucucgaggcccauuucucccccagccagcugccuuugcaggauuuuugggaaaaguuaacugccgguuuccucagagcugcgcgggaugggggugggggggcggauguggaggguugaggaugggaguuuugggggaacugggaaacauuuauuuggaaggggcucuauaaacauggcauuguaaggagcuagauccucagaucugggggagagggccggcaagaggggcucagaauggguccaggauuuccagcaaagaccccuggcaugaggaaauaauccugcugucccaccacccugcccucgagcaguguggaaccuucgggagcuguguguguggcagugggccugucuccuucauggguggccaggaccccccguguaggcuggaaucucgcccaagcccuggggugacccuuggacccugaggcaagugagcuuggcccuuugcaguuggagagcccccuccccaaccuggugguccuccugcccccagagguggcagcuggugguaaugucuuccccgaccccacccuaugaugaacuuuugguugggugcaggccugcggcccagugggucccgucugagggaaggggcaggaaagguagucugguuugcuagaccuccucggugugagccucaccccuguaguaugcucuuauuccuuucugccacuccugcccuacgcccgggagguagaagcacuuuggacuucgguuaaguuccugaaguaucuugcuggacaggucagggccugcuggcuccgcaggcugccgagggggaucugaaggccaggcccacaaggucuggggugacuggugcuguccaaggcacuggggcaguguugggccuagccucucauguguccccuaccccagcauuucuuggaggggagacccuucuagucucacuccugguuuguguccuggcuccacuagacagagugagcucccagaagccagagucggggguugaaagcugggguuagggguucagggcuguggaacauggcaugucuuggccagaggguaccaagccaggugguuuuuagauggaggaacugagguccagagagaggaagugacuugccugaagucacgcuaccagguagaaggagacugagaccgggaccuggguguucaggcuuccacugcugggcucccuccacuguucuccauga

SEQ ID NO: 19461 - RNA, 2651 nt, Homo sapiens
cucccucugggugggggcgggggcugggacuggggucagagggcgcggagccccgcggggggcgcacuggggcccgccccgccccgggccccuccuccguuccgcccgcgcugggggcggcccggcggcggcggcggcggcgcacgcuuccugcgggcgcggccgcugugggcgcggagcugcgaggcggagccgggcggccgagccgggagcccgcgagccuagagcgcgucgguccagccgccgggccgcgccgccgccaagcagccgccccgcgcgccgcgccucgggaacaaaggcgcccgcccgccgcccgccgcccgcgcccgcgccgccgccaugaagccggggccgccgcaccgugccggggccgcccacggggccggcgccggggccggggccgcggccgggcccggggcccgcgggcugcuccugccaccgcugcugcugcugcugcuggcggggcgcgccgcgggggugagugacacgcgcccggauccccgccacggcuccccggggccgccccccgcgcggggugccgguccccgcccgcgacccccccuccgggaccccgcucccucccccccggcugcuucccccggggccgcggucccugccaccccucgacccucccccgagcgccccuuucugcacccugcuccccccccuccggaaucucccccuagcuggcauccgcggggagaggccgcccccgccgcuggucaucuucggggggcgcaucucuccuuccuuuugggaccccuccccagagggaaucccgggagggaacccgaucgcggguccucagcccuguucccccaccucccaguggcuccgggaacugucuccccggggacgaagcgggaccccugcgcuggccugggaggcgcgagaaggacccggcggcgggcugggggucgccgucccggcugggugugucuuggggugggagugagccuggcuuuugccucgugggugugcccagaccauggccacuuuuugggaaucggaucgguuccccuuccgaggggagggugugcauuugguucuucccagggucgcggcagccggccagggcagugggcccgggaaggggagguggagguggagggugacuuggugaaggugaccugaggggggagugaggguaacccugugugugggcgugugugggcguguguggccaacucagugaggggugcggggaccuguggggcgugugcaggugaaggaugugucugccacauggguggaugccagcgugcccucccguccguggucgugggagggugacccauugugcaugaugugugccugugccuggcugggccacuguuggcuauggccguguguggcugcagugggugagggugugugugugaaagaccucuggugggcgugugcuuggacccaugaaugugugugagugcacauagcagcgugugcaugcaggugcaugggggacccuggacauaggacgaggaccccugaggggaaccaagcaugugcagguggaggugaugguauguaugaggugacccuugagugucccuuugagugaccguagcagccaugcuuggucccagcuccgucagggauggcagagaaaggaaggaccucaucccccuuugagggauccaggccccagaugaguucuuguuggacaaguguccagguucuggcucaggcgggcuggggauuucuagguccagccucccagguugguuccaggagcuaugcuguccugcaucccccaggcugaaaaggacccaggccucucaagcaacacugggugcccagccgcccucugcaaguuccuucccuuucccagccucagugggccagucaguaagacaggaggaggacaggcaggggcuccaagcuugcuucuuggauggacaggccccuccucagccuuccccaucuagggggcugucagcuggagggaggggaaguguugagggcugaccugugugaagugccugcuggccaggaugucucauucccagcucuccccuaaguggggugagaggaagaggucccugggagggauagagacccagcacacccuagcagcuggggucgccuucucagccaaauuucugaaagaccauccuuaaaaucaaaggcuugggaaucacacaacccuggguuccaauccugcuacccccgccgauucguggcaugguuugggcagguccucuuacuucucugacccuugguugucccucugugaaauggggcuaaugaccccuuccucagagggcaaaaauucaaugggaugacugacgaguguccugagaaggagcucaggagucauguggugugcacaugaaugaaaggggcucaggacagaaagcuuuagacuuggaggccagguggagcgcugggcaggccacuuuccuugcugaauaaggcuaauaauucauacuccacgaggugguggaaggacuuagugagagcauuuaauagccucaugcacaguagggccucgcaacacgggugaccugaaucugagagguguggcucagacccaguguuggguggcagaucaagcagacccugggagucugagcccagaggcugaaaugguggguggggccugggggagggcagguacuggggcgccuggugagguggugggaagugga

SEQ ID NO: 19462 - RNA, 2651 nt, Homo sapiens
uccacuucccaccaccucaccaggcgccccaguaccugcccucccccaggccccacccaccauuucagccucugggcucagacucccagggucugcuugaucugccacccaacacugggucugagccacaccucucagauucaggucacccguguugcgaggcccuacugugcaugaggcuauuaaaugcucucacuaaguccuuccaccaccucguggaguaugaauuauuagccuuauucagcaaggaaaguggccugcccagcgcuccaccuggccuccaagucuaaagcuuucuguccugagccccuuucauucaugugcacaccacaugacuccugagcuccuucucaggacacucgucagucaucccauugaauuuuugcccucugaggaaggggucauuagccccauuucacagagggacaaccaagggucagagaaguaagaggaccugcccaaaccaugccacgaaucggcggggguagcaggauuggaacccaggguugugugauucccaagccuuugauuuuaaggauggucuuucagaaauuuggcugagaaggcgaccccagcugcuagggugugcugggucucuaucccucccagggaccucuuccucucaccccacuuaggggagagcugggaaugagacauccuggccagcaggcacuucacacaggucagcccucaacacuuccccucccuccagcugacagcccccuagauggggaaggcugaggaggggccuguccauccaagaagcaagcuuggagccccugccuguccuccuccugucuuacugacuggcccacugaggcugggaaagggaaggaacuugcagagggcggcugggcacccaguguugcuugagaggccuggguccuuuucagccugggggaugcaggacagcauagcuccuggaaccaaccugggaggcuggaccuagaaauccccagcccgccugagccagaaccuggacacuuguccaacaagaacucaucuggggccuggaucccucaaagggggaugagguccuuccuuucucugccaucccugacggagcugggaccaagcauggcugcuacggucacucaaagggacacucaagggucaccucauacauaccaucaccuccaccugcacaugcuugguuccccucagggguccucguccuauguccagggucccccaugcaccugcaugcacacgcugcuaugugcacucacacacauucauggguccaagcacacgcccaccagaggucuuucacacacacacccucacccacugcagccacacacggccauagccaacaguggcccagccaggcacaggcacacaucaugcacaaugggucacccucccacgaccacggacgggagggcacgcuggcauccacccauguggcagacacauccuucaccugcacacgccccacagguccccgcaccccucacugaguuggccacacacgcccacacacgcccacacacaggguuacccucacuccccccucaggucaccuucaccaagucacccuccaccuccaccuccccuucccgggcccacugcccuggccggcugccgcgacccugggaagaaccaaaugcacacccuccccucggaaggggaaccgauccgauucccaaaaaguggccauggucugggcacacccacgaggcaaaagccaggcucacucccaccccaagacacacccagccgggacggcgacccccagcccgccgccggguccuucucgcgccucccaggccagcgcaggggucccgcuucguccccggggagacaguucccggagccacugggaggugggggaacagggcugaggacccgcgaucggguucccucccgggauucccucuggggaggggucccaaaaggaaggagagaugcgccccccgaagaugaccagcggcgggggcggccucuccccgcggaugccagcuagggggagauuccggaggggggggagcagggugcagaaaggggcgcucgggggagggucgagggguggcagggaccgcggccccgggggaagcagccgggggggagggagcggggucccggagggggggucgcgggcggggaccggcaccccgcgcggggggcggccccggggagccguggcggggauccgggcgcgugucacucacccccgcggcgcgccccgccagcagcagcagcagcagcgguggcaggagcagcccgcgggccccgggcccggccgcggccccggccccggcgccggccccgugggcggccccggcacggugcggcggccccggcuucauggcggcggcgcgggcgcgggcggcgggcggcgggcgggcgccuuuguucccgaggcgcggcgcgcggggcggcugcuuggcggcggcgcggcccggcggcuggaccgacgcgcucuaggcucgcgggcucccggcucggccgcccggcuccgccucgcagcuccgcgcccacagcggccgcgcccgcaggaagcgugcgccgccgccgccgccgccgggccgcccccagcgcgggcggaacggaggaggggcccggggcggggcgggccccagugcgccccccgcggggcuccgcgcccucugaccccagucccagcccccgcccccacccagagggag

SEQ ID NO: 19463 - RNA, 2514 nt, Homo sapiens
gggagcaagguaagauagguguagagagguggagagugggcaucacccagcaggcaguagacagugaagggcaaccagcaggcggcaaaggcuccaagcaccacggccaguguggcaaugcccuugcggguggccacauagugggaggcaggcagcaggugccgcugaagggcaaucugcugggcauggcggcagacgaugcggcagauuugggcguagagcugcagcaugaugccaaacaccaugaagaaggcaauggccagaacuaccagaugguucuuggagaguggauaaaccacgccacauguggucaggccauccaggcaguuccaggccagcacaggcagcagccccaggcccagggcaccuccccacacuaaggccagcaucacauagguccgugucacuguugucucugaauaguaggugagggcauuguacagagaaagguagcggucgacagugauggccaguagacugccgaugcuggcgguaaaggccauugccagcacgccaaccagcaccaggcucaucuccgcugagccgaugcagaagacagcagcaaagugcaggaccaggcccaggccugccagcaggucugccacggccaggcugcccaccagcaggaacaugggggcacggaaggcaggagugcccacgaugauggccaccacuagcgcauucucgcaggacaccagggugccugagaugcagagcaccacaucccaggccuuaggcgagggcaguggugcggcuggaccugugggccccucugcugggcccacgcugcuuacauucacguugccugagccagcugagagccaggccagagggcugccugcaccccacaucaugguaccugcaggagaaaggccuugugagaagcugaccaagcugggugaugggaguuggggucuggagggggugaggugcuucucaggauacguggugggagucucuccucaggauaccugauagagucccaaugccuuauccccacauucaugcccuggggcucuucccaggauaccgcuguccccuccaaugcccccaggccucuaaacaggggucucuuccuggggaucccuguccuagguccugcaggucucuuuuucccacgugugugaccagaggagagacagaagaagggguacuauaaguggaagagggccauaggauccaggggaugcccccgaaggcucaagauugggguagggaaacaucuaccccaucagggagacugagcagcuccgcucccucccaucagagaugaugaugcuagcucgugccugaggcucccagaccccucacgauuuucaguacugccagccuuagacuccgcccccagggaaugcgcgugaagcucccgccagccaucaccccgcacucccgcgguaacaccugggaacucagccccccaccccccacccucccagacuucuguuccuggcuggacccuucuuuccgccugaaucucuaggucucugggcagaccccccugcuggaagacuggaucccugagucagaugccuccuucugcccggacaccuggauuuugggccugacucugccuccugccuggauaccuggauuccuaaauuggacaccuccugcuguucggaccccugggucccugccccagacgccuccugccggcuuaaccucagaugaccaucagucccuccagggccucgggucccugcaggaaugcuuacccuucgccgggucauccaacucaaccccagcacucgagcacuugggcccaagccugcuaacccagaaucgccuaaacccagaauucccaccucgaacucgaaccccggccggccacuaggagccuuccgccggcccagugccccagcauccugcgugcccuucaggaccccuggugcccgcggcggggcccgcuacucaccgcucaggaccaggcgcggccgggccgcggggaggcuccgcucggguccuggcggcgcagggcgugcguggaccccgagaagcccccgcggccgcgggagaagcggcgugagucaccccgccccgcccccggccaccgguucggugacgucagcgguccgaucagccaaugggcgcggcgcgcuggggcgcagcgcgcguugcgcggcauaguaauaaggccucgcaccgcccgcucccccauucauaaaaagcgaccguggcugcggccccgcccccucccgagucugcccgcgcuguccuugacgcggcgcccucugcgggccggggguuucagaggcgccggugcgagagccuugaagucucagagaggcugcagggaacgugguggaagaguggaaagggggcccggcuaggcuguggggugaugggacccuuggguggcagagaggcugacgagauccaggugacgaaggaagagcuugugauggggcugguugggcuucccuggugagaaugacaggguuuccaagaugauggggcccugaggugacgaugacagggagcacgagggagcggggagguggguggcagugacga

SEQ ID NO: 19464 - RNA, 2514 nt, Homo sapiens
ucgucacugccacccaccuccccgcucccucgugcucccugucaucgucaccucagggccccaucaucuuggaaacccugucauucucaccagggaagcccaaccagccccaucacaagcucuuccuucgucaccuggaucucgucagccucucugccacccaagggucccaucaccccacagccuagccgggcccccuuuccacucuuccaccacguucccugcagccucucugagacuucaaggcucucgcaccggcgccucugaaacccccggcccgcagagggcgccgcgucaaggacagcgcgggcagacucgggagggggcggggccgcagccacggucgcuuuuuaugaaugggggagcgggcggugcgaggccuuauuacuaugccgcgcaacgcgcgcugcgccccagcgcgccgcgcccauuggcugaucggaccgcugacgucaccgaaccgguggccgggggcggggcggggugacucacgccgcuucucccgcggccgcgggggcuucucgggguccacgcacgcccugcgccgccaggacccgagcggagccuccccgcggcccggccgcgccugguccugagcggugaguagcgggccccgccgcgggcaccagggguccugaagggcacgcaggaugcuggggcacugggccggcggaaggcuccuaguggccggccgggguucgaguucgaggugggaauucuggguuuaggcgauucuggguuagcaggcuugggcccaagugcucgagugcugggguugaguuggaugacccggcgaaggguaagcauuccugcagggacccgaggcccuggagggacugauggucaucugagguuaagccggcaggaggcgucuggggcagggacccagggguccgaacagcaggagguguccaauuuaggaauccagguauccaggcaggaggcagagucaggcccaaaauccagguguccgggcagaaggaggcaucugacucagggauccagucuuccagcaggggggucugcccagagaccuagagauucaggcggaaagaaggguccagccaggaacagaagucugggagggugggggguggggggcugaguucccagguguuaccgcgggagugcggggugauggcuggcgggagcuucacgcgcauucccugggggcggagucuaaggcuggcaguacugaaaaucgugaggggucugggagccucaggcacgagcuagcaucaucaucucugaugggagggagcggagcugcucagucucccugaugggguagauguuucccuaccccaaucuugagccuucgggggcauccccuggauccuauggcccucuuccacuuauaguaccccuucuucugucucuccucuggucacacacgugggaaaaagagaccugcaggaccuaggacagggauccccaggaagagaccccuguuuagaggccugggggcauuggaggggacagcgguauccugggaagagccccagggcaugaauguggggauaaggcauugggacucuaucagguauccugaggagagacucccaccacguauccugagaagcaccucacccccuccagaccccaacucccaucacccagcuuggucagcuucucacaaggccuuucuccugcagguaccaugauguggggugcaggcagcccucuggccuggcucucagcuggcucaggcaacgugaauguaagcagcgugggcccagcagaggggcccacagguccagccgcaccacugcccucgccuaaggccugggauguggugcucugcaucucaggcacccugguguccugcgagaaugcgcuagugguggccaucaucgugggcacuccugccuuccgugcccccauguuccugcuggugggcagccuggccguggcagaccugcuggcaggccugggccugguccugcacuuugcugcugucuucugcaucggcucagcggagaugagccuggugcugguuggcgugcuggcaauggccuuuaccgccagcaucggcagucuacuggccaucacugucgaccgcuaccuuucucuguacaaugcccucaccuacuauucagagacaacagugacacggaccuaugugaugcuggccuuaguguggggaggugcccugggccuggggcugcugccugugcuggccuggaacugccuggauggccugaccacauguggcgugguuuauccacucuccaagaaccaucugguaguucuggccauugccuucuucaugguguuuggcaucaugcugcagcucuacgcccaaaucugccgcaucgucugccgccaugcccagcagauugcccuucagcggcaccugcugccugccucccacuauguggccacccgcaagggcauugccacacuggccguggugcuuggagccuuugccgccugcugguugcccuucacugucuacugccugcugggugaugcccacucuccaccucucuacaccuaucuuaccuugcuccc

SEQ ID NO: 19465 - RNA, 1940 nt, Homo sapiens
acaggaacgcaagccgaccucggggggucuccggccugagaggggaacaugaucaagcccagggcagccgccagucggagggggcagacgcggccccaguagccucuggagacccucuuccgaggcaaggagccacauuccugccgucgggaccaccaaagcggauuucuacaaacuaaagucgagaacuuuucggcggcgaggcggcgcaccccgcgcgggagagggggcgcaggcgucaccccguccucacucagcaacacccggcgccgcgccgggcgaaggcuggcaaacuucucgcggccggcaggugggcuccgcgggccccaugggcgcaggcacaggugugcggggccacagccgggccuuuugcagccggcgaccgcccccccuuccccgcgggcuuuugcacacgacgcgccgacggcagcuucacacggguuggcgagggccggauaaagccggcggccgcggggcgcagcggcugacccgagacacgggagcgcuuggcacgcggagccagagccggagcugcagccgcagcgggagccgggggagcucaggggccgcaggagccgggccggagugagcgcaccucgcggggcccucggggcaggugggugagcgccacccggagucccgcgcgcaacuuucagggcgcacucggcggggcggcugcgcggcugccgggacucggcgcgggacugcauggaggccaaggagaagcagcaucuguuggacgccaggccggcaauccgguaaggcgagagccuggggacgggcgggaauuuuggcggcagccgacgcaccuccgcauuugccauccuagcagugguugguuuuggcugcggcuugagcugggaccaugcaggagggguggggugaggugagggaacgaagauaaugggcuguggcccaaggaccgucucucccuuggggcgcagcccagauucugaccccugcccgcggggggccuggggccgggggauuggcgguucccaugccuggagucccgccccgcccagcacuuugccccaggcagccccgccccggggaggcccugugucccaagugcgcuggagggggccugcuguucucccagagccugcgcucuguuccuuccccgcgcuccacuggacagcacgccccuuggccgguucccagggucuucaccuccucuggccucugaagggccccgggccccaggacucccauuccccuaucauccccgucugaauacaggcuucucaccucugguuugucgagcucggagcguccuuagcuauuuuucccaguggacacaaggccucacagagaaaugggacuagagucggcccuccuuaccucaucucagagcugagcguucccucucuuccccucuggccaggucauacacgggaucucuguggcaggaaggggcuggcuggauuccucugccccgaccuggccuggacuugcaggccauugagcuggcugcccagagcaaccaucacugccaugcucagaaggguccugacagucacugugaccccaagaaggggaaggcccagcgccagcuguauguagccucugccaucugccuguuguucaugaucggagaagucguugguaagcacuuuugggcuaauuaaaugaaguuggugcauggauagacuggauguucccagcaauacugacacuaaaagccccaauuacugaacacacacuacaguaagccuuuauauacacauuaucugaugcaggucuaacaacaaccuguguucucacaugggugacguuauucuccuuacuuuacagaugaugaaacugaggcauguucaggugaaguaacuugccaaagaucacgcacaacucguagcuaagggaaggccugaauuccuagaagggaagagcauuuacugaguaucugcuauguuuuccagucccuauuugaacuugau

SEQ ID NO: 19466 - RNA, 1940 nt, Homo sapiens
aucaaguucaaauagggacuggaaaacauagcagauacucaguaaaugcucuucccuucuaggaauucaggccuucccuuagcuacgaguugugcgugaucuuuggcaaguuacuucaccugaacaugccucaguuucaucaucuguaaaguaaggagaauaacgucacccaugugagaacacagguuguuguuagaccugcaucagauaauguguauauaaaggcuuacuguaguguguguucaguaauuggggcuuuuagugucaguauugcugggaacauccagucuauccaugcaccaacuucauuuaauuagcccaaaagugcuuaccaacgacuucuccgaucaugaacaacaggcagauggcagaggcuacauacagcuggcgcugggccuuccccuucuuggggucacagugacugucaggacccuucugagcauggcagugaugguugcucugggcagccagcucaauggccugcaaguccaggccaggucggggcagaggaauccagccagccccuuccugccacagagaucccguguaugaccuggccagaggggaagagagggaacgcucagcucugagaugagguaaggagggccgacucuagucccauuucucugugaggccuuguguccacugggaaaaauagcuaaggacgcuccgagcucgacaaaccagaggugagaagccuguauucagacggggaugauaggggaaugggaguccuggggcccggggcccuucagaggccagaggaggugaagacccugggaaccggccaaggggcgugcuguccaguggagcgcggggaaggaacagagcgcaggcucugggagaacagcaggcccccuccagcgcacuugggacacagggccuccccggggcggggcugccuggggcaaagugcugggcggggcgggacuccaggcaugggaaccgccaaucccccggccccaggccccccgcgggcaggggucagaaucugggcugcgccccaagggagagacgguccuugggccacagcccauuaucuucguucccucaccucaccccaccccuccugcauggucccagcucaagccgcagccaaaaccaaccacugcuaggauggcaaaugcggaggugcgucggcugccgccaaaauucccgcccguccccaggcucucgccuuaccggauugccggccuggcguccaacagaugcugcuucuccuuggccuccaugcagucccgcgccgagucccggcagccgcgcagccgccccgccgagugcgcccugaaaguugcgcgcgggacuccggguggcgcucacccaccugccccgagggccccgcgaggugcgcucacuccggcccggcuccugcggccccugagcucccccggcucccgcugcggcugcagcuccggcucuggcuccgcgugccaagcgcucccgugucucgggucagccgcugcgccccgcggccgccggcuuuauccggcccucgccaacccgugugaagcugccgucggcgcgucgugugcaaaagcccgcggggaagggggggcggucgccggcugcaaaaggcccggcuguggccccgcacaccugugccugcgcccauggggcccgcggagcccaccugccggccgcgagaaguuugccagccuucgcccggcgcggcgccggguguugcugagugaggacggggugacgccugcgcccccucucccgcgcggggugcgccgccucgccgccgaaaaguucucgacuuuaguuuguagaaauccgcuuugguggucccgacggcaggaauguggcuccuugccucggaagagggucuccagaggcuacuggggccgcgucugcccccuccgacuggcggcugcccugggcuugaucauguuccccucucaggccggagaccccccgaggucggcuugcguuccugu

SEQ ID NO: 19467 - RNA, 2101 nt, Homo sapiens
aaagaguuucuguacaagcucaccacaucccacaggcccccagucccuuauauaugucaagggccucucacuggcaggaaauucuuuagaucugaccugcgucauauuugcuauaaccaaaggcuguuucuuugagagguuaauccccaaaauuagacacgggagcagcuuccagcugugacugugaggcccuucugaggcauuugaugagguugaucauaaacuuuuacuuaaaacucagaauucucauacugaaggcuuuggagauaggcaauucuggaucaaaauacuggcucuuuccggcuggguggccugagaaaaauuacuuaaccugucugagcuuucgugccugguacacaaacacuuaaaugcuaacaacuagcauauuuuauuauaaucauuauuuauauaagugcuuagcacagaguaagcacuauacaacuguauguggggaaaaaaaauauuaggguaggagguuuggaaugagucguguuuuauguuuugaaagauccccaggggagaauuccaaaaccuaccuuagacaacccuugcuucaaguccccaucuuaauggaagugcucucugccaucuaaccuggcucccuccugcugcugcagcugaggccuaagucuaccaggacuaccugguucucccaucucaguccugccuucuacccucguuuuugggcuugcgucuauuccagcccccucccauccagcccccaaggcaaaagguucacuuacugcccagguccagggucuugcucacagcgcccaucccaggggcaggcagaggagccagugucugcugugcgccacccaccccucuccucuuccagggcuagcagggcuaccccgggcugggggcuguguugccgcagcuggccaggagccccaccucgcaacgggugggcuucagggagaaaagggagggccacaucaaagccgggccggaaggaguccaccguggggcuggccucagccaccauagccugucccagcuggaagguccuggggcagggagccggguggagacggaggaccagaugguuccugccccuguuccauugcagaggcauugagcugcacucuccagucugggcguccaggcugaggaggaggaggaggcaggccccagcagggcugaauguguagaagcgagagcccucaauggaagccaggauccugcgaugagucucagagaugguuccaaccgcuggguacacgaauaccuuaaggccaucgccccugcacuuugagguaucaaagcaagauucccaguugcagcugccaccaugaggggcuugaggaggugaaacggcaucuucugggagcucuccaggcugggagaagcucugcaggagcucugcauccagccagcggggccagccuugggaagccccgggccgaggucugggaggcaaugccaggcggagaagggagaagccucccagcaggacaagcaggagccaggaggcugacagugccagccacagggacuuucuucuccuccacgacugcauguggccacccacagucagggcuagggaagcugggaggccucugccagcaagcaggaagagcagggccuggggcgggagaccagagcugggaccgaccugcuaguccugugcugucauuguacagaugggaagacugaggcccaucgagaccaggccgccugucuaaggucagauagugagucaccagccaggcaggaggaggccaggugggacccagcuugcuggccuggccccccugcucucaggacucugccuucucggccuuuggacaaccaagccagccuuuucccucccagcagggaccccugccccugggcacugcucuggcugacgcaaccccuguccagaaugcagggccgugucccccugcccuccuggcugcaccccuugaccuugcccucaacugagaggagggcugucugccaggccauggggaccagucagagcucccacaggaggcggcuuggccagggacaggcuggagggagcugggcuggucuucccacuccuccccuugccugagcagcccuggcugccccugugcccgcuggcagacgcuucugggcuguggccccugug

SEQ ID NO: 19468 - RNA, 2101 nt, Homo sapiens
cacaggggccacagcccagaagcgucugccagcgggcacaggggcagccagggcugcucaggcaaggggaggagugggaagaccagcccagcucccuccagccugucccuggccaagccgccuccugugggagcucugacugguccccauggccuggcagacagcccuccucucaguugagggcaaggucaaggggugcagccaggagggcagggggacacggcccugcauucuggacagggguugcgucagccagagcagugcccaggggcaggggucccugcugggagggaaaaggcuggcuugguuguccaaaggccgagaaggcagaguccugagagcaggggggccaggccagcaagcugggucccaccuggccuccuccugccuggcuggugacucacuaucugaccuuagacaggcggccuggucucgaugggccucagucuucccaucuguacaaugacagcacaggacuagcaggucggucccagcucuggucucccgccccaggcccugcucuuccugcuugcuggcagaggccucccagcuucccuagcccugacuguggguggccacaugcagucguggaggagaagaaagucccuguggcuggcacugucagccuccuggcuccugcuuguccugcugggaggcuucucccuucuccgccuggcauugccucccagaccucggcccggggcuucccaaggcuggccccgcuggcuggaugcagagcuccugcagagcuucucccagccuggagagcucccagaagaugccguuucaccuccucaagccccucaugguggcagcugcaacugggaaucuugcuuugauaccucaaagugcaggggcgauggccuuaagguauucguguacccagcgguuggaaccaucucugagacucaucgcaggauccuggcuuccauugagggcucucgcuucuacacauucagcccugcuggggccugccuccuccuccuccucagccuggacgcccagacuggagagugcagcucaaugccucugcaauggaacaggggcaggaaccaucugguccuccgucuccacccggcucccugccccaggaccuuccagcugggacaggcuaugguggcugaggccagccccacgguggacuccuuccggcccggcuuugauguggcccucccuuuucucccugaagcccacccguugcgagguggggcuccuggccagcugcggcaacacagcccccagcccgggguagcccugcuagcccuggaagaggagagggguggguggcgcacagcagacacuggcuccucugccugccccugggaugggcgcugugagcaagacccuggaccugggcaguaagugaaccuuuugccuugggggcuggaugggagggggcuggaauagacgcaagcccaaaaacgaggguagaaggcaggacugagaugggagaaccagguaguccugguagacuuaggccucagcugcagcagcaggagggagccagguuagauggcagagagcacuuccauuaagauggggacuugaagcaaggguugucuaagguagguuuuggaauucuccccuggggaucuuucaaaacauaaaacacgacucauuccaaaccuccuacccuaauauuuuuuuuccccacauacaguuguauagugcuuacucugugcuaagcacuuauauaaauaaugauuauaauaaaauaugcuaguuguuagcauuuaaguguuuguguaccaggcacgaaagcucagacagguuaaguaauuuuucucaggccacccagccggaaagagccaguauuuugauccagaauugccuaucuccaaagccuucaguaugagaauucugaguuuuaaguaaaaguuuaugaucaaccucaucaaaugccucagaagggccucacagucacagcuggaagcugcucccgugucuaauuuuggggauuaaccucucaaagaaacagccuuugguuauagcaaauaugacgcaggucagaucuaaagaauuuccugccagugagaggcccuugacauauauaagggacugggggccugugggauguggugagcuuguacagaaacucuuu

SEQ ID NO: 19469 - RNA, 2558 nt, Homo sapiens
ccucccuccucucucccuccccucccccuccgccccucgcagccccgccgcucgcagcucccagucugccuccccgaaccggcgccgccgcccgcacucgccgcaggaccggcccgcccggcucccggggugcgcccuccucggucccgcgcccuccgggcucgcagggacgucuccucccucccggcucgcggccccgcccggcccggcccccgcccagagccccagcgcgccgaggaugugaguccugcucgccucuggcggagcagcagccacucgcgcgcggagccggagcgcagcgcagcgcagccgcgggcgcucuccgggccgcucgcgcgagugccgcgcucuugcccuagcggcgucccccggccucucgccggcgccaccgccgcagcagcccgcgggccguccccggccggccgcccccggccccagcgccgcugacccuguccgccgcgggcggggacgcgggcggaggaggcgccgcggcggagcccccggacgcgaccaugucggaggugcugcccuacggcgacgagaagcugagccccuacggcgacggcggcgacgugggccagaucuucuccugccgccugcaggacaccaacaacuucuucggcgccgggcagaacaagcggccgcccaagcugggccagaucggccggagcaagcggggugaguucgcggcccccuugucugacacccccuuuuucccgcgccgcggccugaacaaggguugcggaggucucccacccgcuggagcccguucagaccugacggaaucccuucuugcagaauugggggaucccgcacugcggguccggcugaagcgggucgcaggaacgcgucccccuaagccggauccccggcugggucacccugggggcguggcggcuucuagcagcagcugggggucuccacccgcgcggcaaaguuugcuuuuugauuugcgccccccacccccgccuuuugcgcaguguagucacagcugcacucgcuccauaacccuguggggagggggucccagggacccccaggggacggcguggggaccugcguggggaggaucccauuccugcggggaaggcuaggguguucgggucgcacgggcuuuucauuguuacuuggcuugggaggggguuugccaggccugggcgauccgcgcgagagcuggaaaagccccagagaggcggagacgcagagaggcuccgagaggagcuccagagacgcggggacaaugagggggaccgacggcugcagagagagacugagacgcagggauggaggggaggggguacgcgggagaccgaggguggcagagaccgagacaaagcucccgagaggggagcugaagcgggagagacagagccgaggacgcgcguuuggggaggacgcagaagccgccgaaacaauaagggcgaccgacaccuuagacagggagagacagagaccucgaucggcugccggccgucgcgccgagggacgauggagggacugagaaaggcgaggcuaagucgagacgguaagagaggccgagguuacggcaugugucccuggcaggcagcgaagggaggcucugaccucugcggcagcggggagcgcggggcggccgagucagucggccagcggcugggagagggcgcgcaggagggggcgcccgcccaggccaggcccuaacccccacccgcugcgcgucgugggaaccgguuuuggcguccccuccugguuccgcucaucuccgcaccuagccuugcccaccggagcugcgcucgggacuuaccuggggucccgagacccaaagacuuuggcucccucuccuaucccagcuccagacauuucugucuaaauuagugcgccuggugcggggaggacgcgggccagugcgcgcccuggcugcagcaggagcggcuggguuggcgcccucuguuuccuuuucucagaauggagcugggacgcaggcuggaggauagaggguggugggugguucagaggaaagcagggaagggaccccuggcagggacggaggauggagcuguuucaccgcgcagugagcccugcucccucgcccucuccucucccgaccucccacucugggcauaacgggaaaugucagagaccucuggcuaggccccagcgcgcucaccucucuuuuccccccuuuuuuugcaguuguuauugaagaugauaggauugaugacgugcugaaaaauaugaccgacaaggcaccuccuggugucuaacucccccaaagacaaugaguuaagggagagaauaagaacggcgguaacaguuauuggcaaaaagcaugaaaagagaaagcacuuugaaauuuauuacuagcuugcuacccacgaugaaaucaacaaccuguaucugguaucaggccgggagacagaugaggcgagaggaggaggaggaggaggagaaggcucugggcuccucugcaaaaauaaaaauaaaaaaauaaauaaaauuuuaaaaauaauaaaaauucacuauauacacauauaaagaaauaaaaagaagucucaguugcagcuauuugucaaaauuaa

SEQ ID NO: 19470 - RNA, 2558 nt, Homo sapiens
uuaauuuugacaaauagcugcaacugagacuucuuuuuauuucuuuauauguguauauagugaauuuuuauuauuuuuaaaauuuuauuuauuuuuuuauuuuuauuuuugcagaggagcccagagccuucuccuccuccuccuccuccucucgccucaucugucucccggccugauaccagauacagguuguugauuucaucguggguagcaagcuaguaauaaauuucaaagugcuuucucuuuucaugcuuuuugccaauaacuguuaccgccguucuuauucucucccuuaacucauugucuuugggggaguuagacaccaggaggugccuugucggucauauuuuucagcacgucaucaauccuaucaucuucaauaacaacugcaaaaaaaggggggaaaagagaggugagcgcgcuggggccuagccagaggucucugacauuucccguuaugcccagagugggaggucgggagaggagagggcgagggagcagggcucacugcgcggugaaacagcuccauccuccgucccugccaggggucccuucccugcuuuccucugaaccacccaccacccucuauccuccagccugcgucccagcuccauucugagaaaaggaaacagagggcgccaacccagccgcuccugcugcagccagggcgcgcacuggcccgcguccuccccgcaccaggcgcacuaauuuagacagaaaugucuggagcugggauaggagagggagccaaagucuuugggucucgggaccccagguaagucccgagcgcagcuccggugggcaaggcuaggugcggagaugagcggaaccaggaggggacgccaaaaccgguucccacgacgcgcagcggguggggguuagggccuggccugggcgggcgcccccuccugcgcgcccucucccagccgcuggccgacugacucggccgccccgcgcuccccgcugccgcagaggucagagccucccuucgcugccugccagggacacaugccguaaccucggccucucuuaccgucucgacuuagccucgccuuucucagucccuccaucgucccucggcgcgacggccggcagccgaucgaggucucugucucucccugucuaaggugucggucgcccuuauuguuucggcggcuucugcguccuccccaaacgcgcguccucggcucugucucucccgcuucagcuccccucucgggagcuuugucucggucucugccacccucggucucccgcguacccccuccccuccaucccugcgucucagucucucucugcagccgucggucccccucauuguccccgcgucucuggagcuccucucggagccucucugcgucuccgccucucuggggcuuuuccagcucucgcgcggaucgcccaggccuggcaaacccccucccaagccaaguaacaaugaaaagcccgugcgacccgaacacccuagccuuccccgcaggaaugggauccuccccacgcagguccccacgccguccccugggggucccugggacccccuccccacaggguuauggagcgagugcagcugugacuacacugcgcaaaaggcggggguggggggcgcaaaucaaaaagcaaacuuugccgcgcggguggagacccccagcugcugcuagaagccgccacgcccccagggugacccagccggggauccggcuuagggggacgcguuccugcgacccgcuucagccggacccgcagugcgggaucccccaauucugcaagaagggauuccgucaggucugaacgggcuccagcgggugggagaccuccgcaacccuuguucaggccgcggcgcgggaaaaagggggugucagacaagggggccgcgaacucaccccgcuugcuccggccgaucuggcccagcuugggcggccgcuuguucugcccggcgccgaagaaguuguugguguccugcaggcggcaggagaagaucuggcccacgucgccgccgucgccguaggggcucagcuucucgucgccguagggcagcaccuccgacauggucgcguccgggggcuccgccgcggcgccuccuccgcccgcguccccgcccgcggcggacagggucagcggcgcuggggccgggggcggccggccggggacggcccgcgggcugcugcggcgguggcgccggcgagaggccgggggacgccgcuagggcaagagcgcggcacucgcgcgagcggcccggagagcgcccgcggcugcgcugcgcugcgcuccggcuccgcgcgcgaguggcugcugcuccgccagaggcgagcaggacucacauccucggcgcgcuggggcucugggcgggggccgggccgggcggggccgcgagccgggagggaggagacgucccugcgagcccggagggcgcgggaccgaggagggcgcaccccgggagccgggcgggccgguccugcggcgagugcgggcggcggcgccgguucggggaggcagacugggagcugcgagcggcggggcugcgaggggcggagggggaggggagggagagaggagggagg

SEQ ID NO: 19471 - RNA, 2172 nt, Homo sapiens
ucugcgcuccucggcggagcgggugggaaggaugaguccucgggguggagaaggaggagcggguccccggguaccgcucacccggccuuaggagcccgggagcgcgcguagggacgcggaguugaggcucuccaucugcggccagggaaagggauacagucccccgggccccucccggccgcucggaacccaccccaggcgcguccccgcgggcgcgcgcuccaggcggggccgacgggcucggaggcgcgcgcccgcugccggguccgccgcgcgcgcucccuccgcuccucucccccgccccucccgggcccgcgcgcucccaggguccgccgcgcgcgcgccucgcgucgcuccccauccccgccccucccgccgccaccccgcccccggccggguacccucgccggacccgagagagagcgccgccgccaucuuaguugcugccgcugccuucagcaagacgcugcucugaggcggggagggcgccgcguccugagcgcgcggcccagcgucacggcggcggcggcggcggcuccuccuuggacccccggagcuccccgcgccgcggagcagcuagccccaggccccuagagccccgagagcuccgagagcuccgcucggcgucccgcgcgccucccugccgcucccgccccgggcuggcgaugcugcgccgccccgcucccgcgcuggccccggccgcccggcugcugcuggccgggcugcugugcggcggcggggucugggccgcgcgagguaagccccggggcugggccgggccgcugggucggugcgggauucggguccgggugcaggauucgggucccggugcggggauucggguccgggugcgggaguagggccggaugccgggauucgagccgggaugcggggagucggguccgagcgcagggagccgggucagggcgugggguucggguugggggucgggcucgcggagccggggccagggcgcaggagacugugggcgcgcgcugcaggcgucccggggaagccaggcuccgucccgggcggggcuccugagccugggcugcccccacugcagcccauggugguggcugcgcugauuugggggaacgugcagacgggccgaagggucaguccgcccugcucagcggcgcacgcaggcuggggcugcaccccugggugagaugcucuguguacgugugcucagaugugcaucaggcggggggugcacgcacaguuuuggugugugcuuacauaagagcccacuccuccgcaucccguuuccaagaucccgauucuguguugcugcaccgcggacaccacgacuucgccccuuuccgccuccucccagaguccuucagacguugucuguuuccaguggagccgaggcugaaacuuagugcuucccucccaccuuuucacccaaaggugaaaucgcgaugagauuugcgaccgcgggcucacccaguguuagaaaucuccgucucugcuaccccuggugccuuggugcuguuuuucugacggucauuuagaccguggaggguuagauguucucuacaaaaacgagaaaccucucugguuuuuuaggauuguaggaccgaaauuauuuuauggcucggugggaaguaguauuucuuggcuaauuuauuauuagcuuuuaaccuucauccacuuaaccuuuuaaaccuugcaugccucugcuauugacuggucuugccaacgaaaagcuuacgcauugcagauacaguauuugcuucugaguggaucuugaaaucguaaacauuuuccuuggccuuagagcagaguaaucuagguguagucuguagaaucuacuguaggcuuaaaucuguuguucugauuuuuuuuuaaucaaaagaaauuuuggggaggaggauugauagaaaucuagaugaaauggucauauuugaauuuagcaagcuuuuuaaaaauucuuauuuucccuucccuggcgugacauaaggagagaaguaugguguucacgaauuaaagggcagaggcggcaaaugcaucuuuuguuccauguuccuuucuaaacaucgaggaugauaaacuuugaauacuucuuuuauuucauuucuaacauucuguugacucugucaaauucagaucuuagucacuaaguaucucauugcuggccauuugauuuuuaaaaguaacaucaag

SEQ ID NO: 19472 - RNA, 2172 nt, Homo sapiens
cuugauguuacuuuuaaaaaucaaauggccagcaaugagauacuuagugacuaagaucugaauuugacagagucaacagaauguuagaaaugaaauaaaagaaguauucaaaguuuaucauccucgauguuuagaaaggaacauggaacaaaagaugcauuugccgccucugcccuuuaauucgugaacaccauacuucucuccuuaugucacgccagggaagggaaaauaagaauuuuuaaaaagcuugcuaaauucaaauaugaccauuucaucuagauuucuaucaauccuccuccccaaaauuucuuuugauuaaaaaaaaaucagaacaacagauuuaagccuacaguagauucuacagacuacaccuagauuacucugcucuaaggccaaggaaaauguuuacgauuucaagauccacucagaagcaaauacuguaucugcaaugcguaagcuuuucguuggcaagaccagucaauagcagaggcaugcaagguuuaaaagguuaaguggaugaagguuaaaagcuaauaauaaauuagccaagaaauacuacuucccaccgagccauaaaauaauuucgguccuacaauccuaaaaaaccagagagguuucucguuuuuguagagaacaucuaacccuccacggucuaaaugaccgucagaaaaacagcaccaaggcaccagggguagcagagacggagauuucuaacacugggugagcccgcggucgcaaaucucaucgcgauuucaccuuugggugaaaaggugggagggaagcacuaaguuucagccucggcuccacuggaaacagacaacgucugaaggacucugggaggaggcggaaaggggcgaagucgugguguccgcggugcagcaacacagaaucgggaucuuggaaacgggaugcggaggagugggcucuuauguaagcacacaccaaaacugugcgugcaccccccgccugaugcacaucugagcacacguacacagagcaucucacccaggggugcagccccagccugcgugcgccgcugagcagggcggacugacccuucggcccgucugcacguucccccaaaucagcgcagccaccaccaugggcugcagugggggcagcccaggcucaggagccccgcccgggacggagccuggcuuccccgggacgccugcagcgcgcgcccacagucuccugcgcccuggccccggcuccgcgagcccgacccccaacccgaaccccacgcccugacccggcucccugcgcucggacccgacuccccgcaucccggcucgaaucccggcauccggcccuacucccgcacccggacccgaauccccgcaccgggacccgaauccugcacccggacccgaaucccgcaccgacccagcggcccggcccagccccggggcuuaccucgcgcggcccagaccccgccgccgcacagcagcccggccagcagcagccgggcggccggggccagcgcgggagcggggcggcgcagcaucgccagcccggggcgggagcggcagggaggcgcgcgggacgccgagcggagcucucggagcucucggggcucuaggggccuggggcuagcugcuccgcggcgcggggagcuccggggguccaaggaggagccgccgccgccgccgccgugacgcugggccgcgcgcucaggacgcggcgcccuccccgccucagagcagcgucuugcugaaggcagcggcagcaacuaagauggcggcggcgcucucucucggguccggcgaggguacccggccgggggcgggguggcggcgggaggggcggggauggggagcgacgcgaggcgcgcgcgcggcggacccugggagcgcgcgggcccgggaggggcgggggagaggagcggagggagcgcgcgcggcggacccggcagcgggcgcgcgccuccgagcccgucggccccgccuggagcgcgcgcccgcggggacgcgccugggguggguuccgagcggccgggaggggcccgggggacuguaucccuuucccuggccgcagauggagagccucaacuccgcgucccuacgcgcgcucccgggcuccuaaggccgggugagcgguacccggggacccgcuccuccuucuccaccccgaggacucauccuucccacccgcuccgccgaggagcgcaga

SEQ ID NO: 19473 - RNA, 2659 nt, Homo sapiens
aaagguggccuacauuccuucccaugccacagauagguauggguggccugggcuccccuggcccaggcuucuccgggccccucaguguguucgcuggccuucuuccacccugcggcgagaacccugaaggagggagacguggggcuagcggcagggguggagcucggaagugggguucgggggacaggggguucauccaacacccuggacagagcccuccuuggccccgccccauaggggaacuccuccuggcuggcucuguggaucccuccagucaucucucugcccggcaguucgcagugugguucgcgggcguggccguugccccgccagccggucgggggaggggagcccggagcagaugggcgggggacgccagccaguuugccgcagcaacggccacgcggcgcgaaggcgguccugggcgggccacuggggcccgcacccaaaacuguccugcccgcgcgucacaugagcccugacugucuugcgggcgagaacccggaccccuagccggugggaaugaaaacgagcuccgagggcuccagggcugccucugcuucucuaggauuccguuuccccacccaaagccuggagugggguaaccaaaagacucuuaacuaggcaagccgccgaaggguucuacgggcuccuuagagccgggcguccagcgacuggggcccuuguccaggcucggccuguucccagcgucgaggacuggagcaagucacgaccuuucuccggaacucggauuucccguccagcucagcccuucacccgauaaagcagcugggggugcaagucccucccgcugcugucccucaugggagcucccguaaccgcuggguccccugcugcggcccagggcggggcucagagaagacgcugaacccgagccuggggaaugaaugaagggcagcauuggagaggagggaccguagcuccagucaggcaaggccuggccccaccuggcccuccugcccucggggucacgcagcgaaggcccccgauggcgccuuuaccacucucccgcaggugcucggggaaaacugggggccgccaccccgcgguagacaggacgcaaaggcggggagcgggauccccgggggcgucgcggucuccccucccggcuccacccugcgcaggaacaaaggcaggaggugggaccagcgggcggccggacuccgcggggcggggcggggcgggcgagccgcucccuuaaagcucggccgcgggcggggcgcgcacucgucuggcaccagcccgggccgcgcccgggaccucauuucggaccucgguuucccuuugcguggggcucgcagcugccaccgcuuccccgcggagcauggggcugccucgccgggcaggggacgcggcggagcugcgcaagguggguaccggggacugggggcggggcuggggacuccggggacccgucuaaccaccgcgccgcccguccgcagagccugaagccgcugcuggagaagcgccggcgcgcgcgcaucaaccagagccugagccagcuuaaggggcucauccugccgcugcugggccgggaggugagcgcgcccgggcggagggcagaggguccuggggcgcggagcgggggcagggggacggggugcuccugcgggaggaacccaccaggggguuccgcgcggcgcccgaggcggagccuggguggggugggcgcgucggagcggacccccagcaggccacggcgcgccccacacccagcucccgacuagagcgagggugcgcacgguagccggccaaaguucugucuuggugguucucugucgcucuuccucguggccgggcgcagaacuccaacugcucgaagcuagagaaggcagacguccuggaaaugaccgugcgcuuccugcaggagcugccugcguccucauggcccacggcagcgccccgugagugagcccucccugcccugccgcgcgcucugcaccccgcacccggcacccuaccccgcgccucacgcggcucuccgcccgcagugccuugcgacagcuaccgcgagggcuacagcgccuguguggcgcgccuggcccgcgugcugcccgccugccguguccuggagcccgccgugagcgcgcgccugcuggagcaccuguggcggagagcggccagcgccacccuggacggcgggcgcgcuggggauuccaguggcccgucugcccccgccccagcgcccgcgucugccccagagcccgcauccgcuccggugcccucgccgcccucgccucccugcggcccuggccucuggcggccgugguagccccucggccgauccacagacccugccgacugcuugggaccuuggggcacuggacagguugaagcucuugguggcggcugcuguucccaucauuaggggccagcccaguacccacacccaggccggaagccggcuguuugugacuggcguggcagacugaaagcccuggggcuggggcucggcucagggaauaaaaggagcgucccugcuucacccccaacuuggcuggagaagaaaggacaagaggcagcagggugaagaagaagccccccaucccagcugguggagauaguucuggaacuggaccccgcagcugcgugggcagccgacacacccaccccagcacuggcaccagaccagagccag

SEQ ID NO: 19474 - RNA, 2659 nt, Homo sapiens
cuggcucuggucuggugccagugcuggggugggugugucggcugcccacgcagcugcgggguccaguuccagaacuaucuccaccagcugggauggggggcuucuucuucacccugcugccucuuguccuuucuucuccagccaaguugggggugaagcagggacgcuccuuuuauucccugagccgagccccagccccagggcuuucagucugccacgccagucacaaacagccggcuuccggccuggguguggguacugggcuggccccuaaugaugggaacagcagccgccaccaagagcuucaaccuguccagugccccaaggucccaagcagucggcagggucuguggaucggccgaggggcuaccacggccgccagaggccagggccgcagggaggcgagggcggcgagggcaccggagcggaugcgggcucuggggcagacgcgggcgcuggggcgggggcagacgggccacuggaauccccagcgcgcccgccguccaggguggcgcuggccgcucuccgccacaggugcuccagcaggcgcgcgcucacggcgggcuccaggacacggcaggcgggcagcacgcgggccaggcgcgccacacaggcgcuguagcccucgcgguagcugucgcaaggcacugcgggcggagagccgcgugaggcgcgggguagggugccgggugcggggugcagagcgcgcggcagggcagggagggcucacucacggggcgcugccgugggccaugaggacgcaggcagcuccugcaggaagcgcacggucauuuccaggacgucugccuucucuagcuucgagcaguuggaguucugcgcccggccacgaggaagagcgacagagaaccaccaagacagaacuuuggccggcuaccgugcgcacccucgcucuagucgggagcuggguguggggcgcgccguggccugcuggggguccgcuccgacgcgcccaccccacccaggcuccgccucgggcgccgcgcggaacccccugguggguuccucccgcaggagcaccccgucccccugcccccgcuccgcgccccaggacccucugcccuccgcccgggcgcgcucaccucccggcccagcagcggcaggaugagccccuuaagcuggcucaggcucugguugaugcgcgcgcgccggcgcuucuccagcagcggcuucaggcucugcggacgggcggcgcggugguuagacggguccccggaguccccagccccgcccccaguccccgguacccaccuugcgcagcuccgccgcguccccugcccggcgaggcagccccaugcuccgcggggaagcgguggcagcugcgagccccacgcaaagggaaaccgagguccgaaaugaggucccgggcgcggcccgggcuggugccagacgagugcgcgccccgcccgcggccgagcuuuaagggagcggcucgcccgccccgccccgccccgcggaguccggccgcccgcuggucccaccuccugccuuuguuccugcgcaggguggagccgggaggggagaccgcgacgcccccggggaucccgcuccccgccuuugcguccugucuaccgcgggguggcggcccccaguuuuccccgagcaccugcgggagagugguaaaggcgccaucgggggccuucgcugcgugaccccgagggcaggagggccagguggggccaggccuugccugacuggagcuacggucccuccucuccaaugcugcccuucauucauuccccaggcucggguucagcgucuucucugagccccgcccugggccgcagcaggggacccagcgguuacgggagcucccaugagggacagcagcgggagggacuugcacccccagcugcuuuaucgggugaagggcugagcuggacgggaaauccgaguuccggagaaaggucgugacuugcuccaguccucgacgcugggaacaggccgagccuggacaagggccccagucgcuggacgcccggcucuaaggagcccguagaacccuucggcggcuugccuaguuaagagucuuuugguuaccccacuccaggcuuuggguggggaaacggaauccuagagaagcagaggcagcccuggagcccucggagcucguuuucauucccaccggcuagggguccggguucucgcccgcaagacagucagggcucaugugacgcgcgggcaggacaguuuugggugcgggccccaguggcccgcccaggaccgccuucgcgccgcguggccguugcugcggcaaacuggcuggcgucccccgcccaucugcuccgggcuccccucccccgaccggcuggcggggcaacggccacgcccgcgaaccacacugcgaacugccgggcagagagaugacuggagggauccacagagccagccaggaggaguuccccuauggggcggggccaaggagggcucuguccaggguguuggaugaacccccugucccccgaaccccacuuccgagcuccaccccugccgcuagccccacgucucccuccuucaggguucucgccgcaggguggaagaaggccagcgaacacacugaggggcccggagaagccugggccaggggagcccaggccacccauaccuaucuguggcaugggaaggaauguaggccaccuuu

SEQ ID NO: 19475 - RNA, 2516 nt, Homo sapiens
cacgcugaagacgccaaugcgcaccaugagcuucuccagcuucucggucuuggugccaucgugcuucaugauggugcggaugcggaagagcgacacaaagccggccagcagaaaggacgugccgauaaacagguacacgaagaggggcgccagcacgaagccacgcagcgcguccacguuguuaagccccacgaagcacacuccgcucagcacaucgccguccaccuggcccagcgccaggauggugauggucuugauggccggcacagcccaggcggccaggugaaaauacugugaguuggcuucgauggccucguggccccacuucaugccagccgccaggaaccaggugagcgacaggaucacccaccagauggagcuggccaugcugaagaaguagagcaucaugaagaggauggugcagcccuccuucuuggugcccugcgccacagugcgugccccguccucggcgaacuugucauuacacaccacucggucuuccaggaggaagccggcgauguaggccacggccacggccguguaacagccggacaagaagaugaugggccgcuccggguagcugaagcgccgcauguccaccagguacguaagcaccgugaagagcguggaggcgcagcacagcacugaccaaaugccaauccaggugcgcgagaagcgcagcuccucgggcccgaaguacaugagcccauacaccuuggucggcucacaaggugcgccgcaguccuucucccccaggaagugguaguugagguaggagggcaccuugagggcgcgcgggcaggagaacuugccucgcuccgacgcgccggcgccccccgggaagccgccacggugcccuccgccgccgugcugaggguugcugguccagaacucuggaagcagcgagggcgucggggugcccuugucggacguguucuggcccacgcacagcucgccggcgccgugcaccgggaacuucucacacuugagcgugucuggccacuggaagccgaacuuguucaugagcgccucgcagcccuggcgcgcgcgcucgcacagggagcggcagggcggcagcgccugcucuagcacggugcacacgggcgcguacauggagcacaggaagaacuugagcucagcggaacacugcacuuucacuagaggguagaacuggugcaccuccaggcccgcguccuccugguucguguggcccagcagguugggcaugauggucugguuguacgcgauguccgugcacagcgggauggagaugggcuggcaauagccgugguccgggacggagaugccccgcucgccguuguacugcugcccgcucuguugcugcugaggcggcggcggcgguugcugccccggcccgggccccuggccuggccccuggcccgccgccugggcccggacccccagcagcagcggagccuccagcagccaaagcagcagcagcagcuggcgcgccaaucgccgggggucaacuggcgggcggcggcggccaccggcguccccgcugcccuccuccgccagccgggccgagagcgccccggcacaaaguucccagcucgcgccaccgccggcggcccgggacuucuuaggcgccuccuccucagccauacuuucucggcuccucucuuggcgccgcuccgcuggggcugccaggggcacggccggcggcggcucccccugcggccagggagaccucugcgcgggugcccuccgucgagcccaagccgcuuucggcccgcucccccggcuccuguucugcguaccgcagccgccgccgccgcggaaacuugcgauucaugaagcgcgggcggcggggagaacccggguggcuagggcgcgccggggucgugucccgccuuccuggcccucggcucgcuggcucccggcuggcggcgccgcgcuaguggccgcggccccguagagagcgcaacucuccgcagcccagcgggcucggcuccccccugcgccuccgccuccuucuccgccgccgccgccugaccauuugugucaaucccucaacucgcucccucuccucugccucgcgcgcccucggaccgguuuccaggcgccccguagucugucuuucaccaggagggaggagccuugaaaccgacgcagaacuggaggcucagggaccgucgcccaaucgcggcuccggcuucccggcgcaaagggagccggccgccuccucgccagagcgaaagccagcggcaggagggcgggguaggaggaggcgggaggaggaggaaguaguggugguggcacuacucaggcacaaagaguaggauugcucugaagcgggacaggcuugguugcuuuugcuuuuucagaagaaaaaggcgaggauacguaggagaauggucccauaugcugcuggagauaaugaauaggagucagaggaccgcgggacuucgcuuuucuuuuauuuuauccauuaucauguuuaaaaauccugcucuuaacgcugguuaccaacagcaaaccggguucugcuucca

SEQ ID NO: 19476 - RNA, 2516 nt, Homo sapiens
uggaagcagaacccgguuugcuguugguaaccagcguuaagagcaggauuuuuaaacaugauaauggauaaaauaaaagaaaagcgaagucccgcgguccucugacuccuauucauuaucuccagcagcauaugggaccauucuccuacguauccucgccuuuuucuucugaaaaagcaaaagcaaccaagccugucccgcuucagagcaauccuacucuuugugccugaguagugccaccaccacuacuuccuccuccucccgccuccuccuaccccgcccuccugccgcuggcuuucgcucuggcgaggaggcggccggcucccuuugcgccgggaagccggagccgcgauugggcgacggucccugagccuccaguucugcgucgguuucaaggcuccucccuccuggugaaagacagacuacggggcgccuggaaaccgguccgagggcgcgcgaggcagaggagagggagcgaguugagggauugacacaaauggucaggcggcggcggcggagaaggaggcggaggcgcaggggggagccgagcccgcugggcugcggagaguugcgcucucuacggggccgcggccacuagcgcggcgccgccagccgggagccagcgagccgagggccaggaaggcgggacacgaccccggcgcgcccuagccacccggguucuccccgccgcccgcgcuucaugaaucgcaaguuuccgcggcggcggcggcugcgguacgcagaacaggagccgggggagcgggccgaaagcggcuugggcucgacggagggcacccgcgcagaggucucccuggccgcagggggagccgccgccggccgugccccuggcagccccagcggagcggcgccaagagaggagccgagaaaguauggcugaggaggaggcgccuaagaagucccgggccgccggcgguggcgcgagcugggaacuuugugccggggcgcucucggcccggcuggcggaggagggcagcggggacgccgguggccgccgccgcccgccaguugacccccggcgauuggcgcgccagcugcugcugcugcuuuggcugcuggaggcuccgcugcugcuggggguccgggcccaggcggcgggccaggggccaggccaggggcccgggccggggcagcaaccgccgccgccgccucagcagcaacagagcgggcagcaguacaacggcgagcggggcaucuccgucccggaccacggcuauugccagcccaucuccaucccgcugugcacggacaucgcguacaaccagaccaucaugcccaaccugcugggccacacgaaccaggaggacgcgggccuggaggugcaccaguucuacccucuagugaaagugcaguguuccgcugagcucaaguucuuccugugcuccauguacgcgcccgugugcaccgugcuagagcaggcgcugccgcccugccgcucccugugcgagcgcgcgcgccagggcugcgaggcgcucaugaacaaguucggcuuccaguggccagacacgcucaagugugagaaguucccggugcacggcgccggcgagcugugcgugggccagaacacguccgacaagggcaccccgacgcccucgcugcuuccagaguucuggaccagcaacccucagcacggcggcggagggcaccguggcggcuucccggggggcgccggcgcgucggagcgaggcaaguucuccugcccgcgcgcccucaaggugcccuccuaccucaacuaccacuuccugggggagaaggacugcggcgcaccuugugagccgaccaagguguaugggcucauguacuucgggcccgaggagcugcgcuucucgcgcaccuggauuggcauuuggucagugcugugcugcgccuccacgcucuucacggugcuuacguaccugguggacaugcggcgcuucagcuacccggagcggcccaucaucuucuuguccggcuguuacacggccguggccguggccuacaucgccggcuuccuccuggaagaccgagugguguguaaugacaaguucgccgaggacggggcacgcacuguggcgcagggcaccaagaaggagggcugcaccauccucuucaugaugcucuacuucuucagcauggccagcuccaucuggugggugauccugucgcucaccugguuccuggcggcuggcaugaaguggggccacgaggccaucgaagccaacucacaguauuuucaccuggccgccugggcugugccggccaucaagaccaucaccauccuggcgcugggccagguggacggcgaugugcugagcggagugugcuucguggggcuuaacaacguggacgcgcugcguggcuucgugcuggcgccccucuucguguaccuguuuaucggcacguccuuucugcuggccggcuuugugucgcucuuccgcauccgcaccaucaugaagcacgauggcaccaagaccgagaagcuggagaagcucauggugcgcauuggcgucuucagcgug

SEQ ID NO: 19477 - RNA, 2060 nt, Homo sapiens
gaugcuaggggcacagaaagaagagaucugcugaugccagccuuccaaccauuucccagcuuggccaagagccagcucugguauucgugaaggaacagauccugggugaagcuagagggaaggccgcagaggcaaaaggagagaggagcuaggccaggggucagcgacugacccucgcggccaguguacagggguugcaacugggagccuagggggccccaaggcaucuccaggcccaaucuaccucugggcuuuucucaagcucucccuaggauuacugcgguuuccuccuggcgccucucgucuuggacagccaugccccccuccaugcugcacuaauggcucagccuggggcccuagggaccucuccuaccccccagacugcucugucggcccccuuuccccccuacugcugaaacccaauccucugcagcagcgccggcucagcaccgccggcucagcaccgcuccgcagccccugccugccacggucagcuacgucccaccuggucugcugcggaguccccagcccagugccuagcccaguggagccaccgccuguuccucgggaaggaacagugggaccugaccggccagaucaccuccuccaauccugccaggcuagugccucccugccuuccaaccuuggcugucucccacccucucuucuccucuccuugccuggccuccugaauccuaucuuagccuccuuagcccccugacugacucucucucgcuucuuccaagccucuguagcugguuccgcuccuggguucuggccaugaagcccaccucaggcccagaggaggcccggcggccagccucggacauccgcguguucgccagcaacugcucgaugcacgggcugggccacgucuucgggccaggcagccugagccugcgccgggggaugugggcagcggccgugguccugucaguggccaccuuccucuaccagguggcugagagggugcgcuacuacagggaguuccaccaccagacugcccuggaugagcgagaaagccaccggcucaucuucccggcugucacccugugcaacaucaacccacugcgccgcucgcgccuaacgcccaacgaccugcacugggcugggucugcgcugcugggccuggaucccgcagagcacgccgccuuccugcgcgcccugggccggcccccugcaccgcccggcuucaugcccagucccaccuuugacauggcgcaacucuaugcccgugcugggcacucccuggaugacaugcugcuggacugucgcuuccguggccaaccuugugggccugagaacuucaccacggugagcugaccucccuaccuauccugccagggacccagagagccgaccagucccugcccagcacccacaauucccuagccagcacaggcucccccaaagccaggggaccucuuccuuccuaccagccauggacuccccaccccccagugccacuccgugcagcccaggaagcuguccuccuuggggcuuucucugucucccagcccgaggggagcaugugaggccacacugaccccggcuggcccuaggccugaggucuggcccagggaggcccugcuccuggggcuggggguccuccauggugggaccauucuggggcagaagaccccuaucucugccaggagguggggggggcuugcuuucccucugccuuuucaacauacugccagccccggaggacagccacaggggcccauuuccuuuuccugcaguucccagagaaacacagaaaaaccuguaggcugugcccugggcuuugguggggauuggcgggguggaggagcugaguugaugggcucccaagagcguccugcaacaugugcccacuggagcguggggcugggggcauugagaugcgggcuucaguauucaaagaagagacgcaaacauaccaugagguggggagaggucccaugaccaugugccugccugggggagauggccaucacccugucugcccgccccagaucuucacccggaugggaaagugcuacacauuuaacucuggcgcugauggggcagagcug

SEQ ID NO: 19478 - RNA, 2060 nt, Homo sapiens
cagcucugccccaucagcgccagaguuaaauguguagcacuuucccauccgggugaagaucuggggcgggcagacagggugauggccaucucccccaggcaggcacauggucaugggaccucuccccaccucaugguauguuugcgucucuucuuugaauacugaagcccgcaucucaaugcccccagccccacgcuccagugggcacauguugcaggacgcucuugggagcccaucaacucagcuccuccaccccgccaauccccaccaaagcccagggcacagccuacagguuuuucuguguuucucugggaacugcaggaaaaggaaaugggccccuguggcuguccuccggggcuggcaguauguugaaaaggcagagggaaagcaagccccccccaccuccuggcagagauaggggucuucugccccagaauggucccaccauggaggacccccagccccaggagcagggccucccugggccagaccucaggccuagggccagccggggucaguguggccucacaugcuccccucgggcugggagacagagaaagccccaaggaggacagcuuccugggcugcacggaguggcacugggggguggggaguccauggcugguaggaaggaagagguccccuggcuuugggggagccugugcuggcuagggaauugugggugcugggcagggacuggucggcucucugggucccuggcaggauagguagggaggucagcucaccguggugaaguucucaggcccacaagguuggccacggaagcgacaguccagcagcaugucauccagggagugcccagcacgggcauagaguugcgccaugucaaaggugggacugggcaugaagccgggcggugcagggggccggcccagggcgcgcaggaaggcggcgugcucugcgggauccaggcccagcagcgcagacccagcccagugcaggucguugggcguuaggcgcgagcggcgcaguggguugauguugcacagggugacagccgggaagaugagccgguggcuuucucgcucauccagggcagucuggugguggaacucccuguaguagcgcacccucucagccaccugguagaggaagguggccacugacaggaccacggccgcugcccacaucccccggcgcaggcucaggcugccuggcccgaagacguggcccagcccgugcaucgagcaguugcuggcgaacacgcggauguccgaggcuggccgccgggccuccucugggccugaggugggcuucauggccagaacccaggagcggaaccagcuacagaggcuuggaagaagcgagagagagucagucagggggcuaaggaggcuaagauaggauucaggaggccaggcaaggagaggagaagagagggugggagacagccaagguuggaaggcagggaggcacuagccuggcaggauuggaggaggugaucuggccggucaggucccacuguuccuucccgaggaacaggcgguggcuccacugggcuaggcacugggcuggggacuccgcagcagaccaggugggacguagcugaccguggcaggcaggggcugcggagcggugcugagccggcggugcugagccggcgcugcugcagaggauuggguuucagcaguaggggggaaagggggccgacagagcagucugggggguaggagaggucccuagggccccaggcugagccauuagugcagcauggaggggggcauggcuguccaagacgagaggcgccaggaggaaaccgcaguaauccuagggagagcuugagaaaagcccagagguagauugggccuggagaugccuuggggcccccuaggcucccaguugcaaccccuguacacuggccgcgagggucagucgcugaccccuggccuagcuccucucuccuuuugccucugcggccuucccucuagcuucacccaggaucuguuccuucacgaauaccagagcuggcucuuggccaagcugggaaaugguuggaaggcuggcaucagcagaucucuucuuucugugccccuagcauc

SEQ ID NO: 19479 - RNA, 2488 nt, Homo sapiens
cgccggagcggggagcggggccgcgucccucucagcgccagcucuacuugagccccacgagccgcugucccccuggcgcgcucggggccgcgggacgggcgcacgccgccuucuccuagucaaguauccgagccgccccgaaacucgggcggcgagucggccacgggaaguuuauucuccggcuccuuuucuaaaaggaagaaacagaaguuucucccagcggacagcuuuucuuuccgccuuuuuggcccugucugaaaucggggguccccagggcuggcaggccaggcucgcugggcuccuaaucuuuuuuuuaauuuccaauuuuugauugggccguggguccccgcugagcuccggcugcgcgcgggggcgggagggcgcgcgcaggggagggaccgagagacgcgccgacuuuuuagagggagggaucggguggacaacuggucccgcggcgcucgcagagccggaaagaagugcuguaagggacgcucgggggacgcuguuccugaggugucgccgccucccuguccucgcccuccgcggugggggagaaacccaggagcgaagcccagagcccgcggcgcggccggcggacgaacgagcgcgcagcagccggugcgcggccgcggcgagggcgggggaagaaaaacacccuguuuccucuccggcccccaccgcggaucauguaccaggauuaucccgggaacuuugacaccucgucccggggcagcagcggcucuccugcgcacgccgaguccuacuccagcggcggcggcggccagcagguaggugcgggccccggugcaccuggcggcgcgggcggaccccugcccucuucucgccgccacugccucuuuugcuuucuuuucuuuuucuuggcgagaaaauaccuacgggccaccguuguaaguucuggauuuucguccuccccuucccccccacccccuuuuaaacuaggggauuggagagugggcuugaagagacaacaugcccuuuuccucucacguuauauuuuacccagauagacuccuggaauuguaggcccccuaccaggagccuguuaccuccuuccaagaacuacucccccuccccagugucugcccccccccccccaccccugccccgcgucuucucucugggugguggacagacaagaaaaucuuugcacccacuggcaccucucgacauccugggacccuauuccuucaggaaagcccucucucucuccuccccguucuccaucagucauaacuccuuucugaaagggguuggggacccagaaacaugguuggacuccuucaaguaaucuggagcgagggcgagggcugccgcucugggaaucaggugcgaaggucaggaaggaagaagccagccuugguuggcucaugccgccugugugcccccugccugccugccugcccccccgccgacccgucuucuguaaggaucacggacaggaggcugcacugccccccaggaacgaaggagcaccuugagggucuggggguaccuggagcaaggagaccggcagagggaagagggggucgggugggggaagagacaucacgcaggcuccugggugguucuggaagcagaaaacaacuuguuucuaaagcagccggacugguuugcacuggagggauugugcgugugaucucuguguuuauaaauaccaggaaggugcuguuggcgggggggugcugauggcgugucugcccucugcugcagcucccccacccgcucugucucgagagagagcuggguuaacgcaggcccaauacaacaugaagcccaccguggucagcaucuguggagucuagcauaguuggcugcagcaagggaugcucaugcuccauaaggcgguggccuuggccucuagaaggggcuagggugggcuuccagggagggguggacucagcuggaaagaauuuuggaacguggcucucuuuuggaucugaugggggggucccuuguuccaaagugauucccuauaccuggugaguccccaaaauggcuuuucugucuucccucugccucccauggugcuccuauaagcacccacaguagagacagccuagucuguucauugagggugcagucaaugcacccuucguaaugagcaccaaggugaugaguuuaaaauccgaaaaguuguugauuauguuugcuucccagccccgcuagugguuuguguugaauguaaacauaaugagggaauagguugaagucuguacccacucccuccgucucccguucgacaaaccccaaacgccugucugucuccuccucccugaaaucaggaagggaucuuuugauuucuucucuguucuuuucccuaaugugucuuuagcagugaucauuggaguauuacaaucucacugccugguuuagcauagacccuggggccuggagggaagucagaccggacaucagugccccaacugaauaaucugugucacuagggcuuugagcccaggaugugagc

SEQ ID NO: 19480 - RNA, 2488 nt, Homo sapiens
gcucacauccugggcucaaagcccuagugacacagauuauucaguuggggcacugauguccggucugacuucccuccaggccccagggucuaugcuaaaccaggcagugagauuguaauacuccaaugaucacugcuaaagacacauuagggaaaagaacagagaagaaaucaaaagaucccuuccugauuucagggaggaggagacagacaggcguuugggguuugucgaacgggagacggagggaguggguacagacuucaaccuauucccucauuauguuuacauucaacacaaaccacuagcggggcugggaagcaaacauaaucaacaacuuuucggauuuuaaacucaucaccuuggugcucauuacgaagggugcauugacugcacccucaaugaacagacuaggcugucucuacugugggugcuuauaggagcaccaugggaggcagagggaagacagaaaagccauuuuggggacucaccagguauagggaaucacuuuggaacaagggacccccccaucagauccaaaagagagccacguuccaaaauucuuuccagcugaguccaccccucccuggaagcccacccuagccccuucuagaggccaaggccaccgccuuauggagcaugagcaucccuugcugcagccaacuaugcuagacuccacagaugcugaccacggugggcuucauguuguauugggccugcguuaacccagcucucucucgagacagagcgggugggggagcugcagcagagggcagacacgccaucagcacccccccgccaacagcaccuuccugguauuuauaaacacagagaucacacgcacaaucccuccagugcaaaccaguccggcugcuuuagaaacaaguuguuuucugcuuccagaaccacccaggagccugcgugaugucucuucccccacccgacccccucuucccucugccggucuccuugcuccagguacccccagacccucaaggugcuccuucguuccuggggggcagugcagccuccuguccgugauccuuacagaagacgggucggcgggggggcaggcaggcaggcagggggcacacaggcggcaugagccaaccaaggcuggcuucuuccuuccugaccuucgcaccugauucccagagcggcagcccucgcccucgcuccagauuacuugaaggaguccaaccauguuucuggguccccaaccccuuucagaaaggaguuaugacugauggagaacggggaggagagagagagggcuuuccugaaggaauagggucccaggaugucgagaggugccagugggugcaaagauuuucuugucuguccaccacccagagagaagacgcggggcaggggugggggggggggggcagacacuggggagggggaguaguucuuggaaggagguaacaggcuccugguagggggccuacaauuccaggagucuaucuggguaaaauauaacgugagaggaaaagggcauguugucucuucaagcccacucuccaauccccuaguuuaaaagggggugggggggaaggggaggacgaaaauccagaacuuacaacgguggcccguagguauuuucucgccaagaaaaagaaaagaaagcaaaagaggcaguggcggcgagaagagggcagggguccgcccgcgccgccaggugcaccggggcccgcaccuaccugcuggccgccgccgccgcuggaguaggacucggcgugcgcaggagagccgcugcugccccgggacgaggugucaaaguucccgggauaauccugguacaugauccgcggugggggccggagaggaaacaggguguuuuucuucccccgcccucgccgcggccgcgcaccggcugcugcgcgcucguucguccgccggccgcgccgcgggcucugggcuucgcuccuggguuucucccccaccgcggagggcgaggacagggaggcggcgacaccucaggaacagcgucccccgagcgucccuuacagcacuucuuuccggcucugcgagcgccgcgggaccaguuguccacccgaucccucccucuaaaaagucggcgcgucucucggucccuccccugcgcgcgcccucccgcccccgcgcgcagccggagcucagcggggacccacggcccaaucaaaaauuggaaauuaaaaaaaagauuaggagcccagcgagccuggccugccagcccuggggacccccgauuucagacagggccaaaaaggcggaaagaaaagcuguccgcugggagaaacuucuguuucuuccuuuuagaaaaggagccggagaauaaacuucccguggccgacucgccgcccgaguuucggggcggcucggauacuugacuaggagaaggcggcgugcgcccgucccgcggccccgagcgcgccagggggacagcggcucguggggcucaaguagagcuggcgcugagagggacgcggccccgcuccccgcuccggcg

SEQ ID NO: 19481 - RNA, 2500 nt, Homo sapiens
uuuucagcuuguccucugaugcauuuguucaccucauuguacuaaaacacaaagaaacugucucguauaaaaaucagaaggaaguuuagaaaucagaaagaaguuuagaaaaguuuagaaaucagaaggaaguuuagaaaaaaauuauggaacacaugaaaaaaaaaacaagaauaaacuaaagggcacugcugaauagacagacaacagcaacaguaagggggcucuggucccccuuacuaacucugccaagaugacaguuguuugaauucuccaacccuucuucugcuccucugucaaaggaggauuucgcauaggguucgcaggcuagcgaucuaauagguaaagcaccuggcacgcagcuggaaggcuaucuggggucugucugcuucugcuagcaucaauacucugagcucaacuccaccggggcuccuaggauaaccgggacagaaaggacggugagaaaagaaaaaugaguaacaucacacaaguugaaucauaugagguugacgauauucacaucuuccauccaaaaaaccgacaauuucuuaugauucaacccaacauaucgcagcgguuguucgugucgcaugagucucggggggcacucaagaacuacgaucgugcacuugcuuucuuaacaaagaacagcugccgcccucaggaacuccagcaaaccuuucuccagaaaggucagucgccuuagcgggcuccaggagcaaccuguugcagaaugaagccuggggcgccggcuuccccgcccuuuaccuccaaaccaccuccaggccaagcccccuccaggccuagcucccuucugggcggaagccucucgcgagcugcgggacacaaaagaaugagcggcggggcgggcgcgggaagccaagagacuccaggaauucgcagccgcgcaggggaggggguugccggaguaacuuggcugcucugagcgcgucggcgccaguuccccgccgcggccccuguugggcaccgaucgggggcgaucuugccagagagaagggguucuggagcuaguuccucccuccgauccgacucccugccccuccagacacgggcuuucggggaaacugaucccgagccucugacuuucuacagccgugaagcuccuggucuguccacgcuccucuuuguuguccggucggcguguucuggcagggugcgccuugagcaccccaguucuccaucuagcgauagccgcggguccccgcgcaugcaagcagaagggccguggagcgagaggcugggaaggugcuucaagccaggggugcaugcuuucucccacggacgcggggagauggccucgcuuuguacccccauaucccuacucccgcuguggucggcugcacaguguuggcccauuuccgcacucagccagggaagcucagcgccucacguccccggggccaucccuagaguuuccuuuaccgcagacucguucccaagacccuggcgagucucaccucggucaccguucuccccgagagcgaguccgaagucucuggggccccgguccaguucgcacacucaccuccgacucccgcuccggaaccacggccgccggcuacccccacccccgcccccauccccaguggauggaaagaagacccaagcggggcgucgcgggccaccacucagacuaaaaaguuuggguuggacgggcaccggcaccaccacgcucuccccgcaguuccucuggcccccagccgcuguccgggcccgcaccaccugcugaggggccagggaggcggcgcagauggcuaggguaaggggggcgcagagcgaacccguccacuccucacuguacacccccaguacaguggaaggagugcgcucagccccgcgccuggucagcagaugccucucucgcuccgggaugaggacccagcuacucaccgugcacccggcucccgcuccugcucccgcccuagucaccgcugccgccgcccuucccuuagcucgccagacccuggcucgugaauuauuuaugacccggcuucugggaccaccgcgacggcuuucggagagcccgccucccacugccggccgcggaggggcucaggcggcgcugcggccggacccucggacguggcgggaggcaggagaaaggcccgggugcccggggggacccguugcggcuuccucugucccggacggggaccuagguauggggccgccguaauggaaaggauuccuuaaacauacucaccgcggcgggagagcugagagcauggccaggugccgcguggggaucugccucagucacuuaaagaucgcgaaacccgagcccuggacgcacucugauuggaccggcugagcugcuucgccacguagcccuggggcgcccaccagcaccuggacagcauccauuuccuguagaggugccugcucaacccccugcacucccuucuugcaacgcuugcgccucuuuuccccccgcagagucccuuacuuagaaugcagcuacccuccuaaaaacucuccu

SEQ ID NO: 19482 - RNA, 2500 nt, Homo sapiens
aggagaguuuuuaggaggguagcugcauucuaaguaagggacucugcggggggaaaagaggcgcaagcguugcaagaagggagugcaggggguugagcaggcaccucuacaggaaauggaugcuguccaggugcuggugggcgccccagggcuacguggcgaagcagcucagccgguccaaucagagugcguccagggcucggguuucgcgaucuuuaagugacugaggcagauccccacgcggcaccuggccaugcucucagcucucccgccgcggugaguauguuuaaggaauccuuuccauuacggcggccccauaccuagguccccguccgggacagaggaagccgcaacggguccccccgggcacccgggccuuucuccugccucccgccacguccgaggguccggccgcagcgccgccugagccccuccgcggccggcagugggaggcgggcucuccgaaagccgucgcgguggucccagaagccgggucauaaauaauucacgagccagggucuggcgagcuaagggaagggcggcggcagcggugacuagggcgggagcaggagcgggagccgggugcacggugaguagcuggguccucaucccggagcgagagaggcaucugcugaccaggcgcggggcugagcgcacuccuuccacuguacuggggguguacagugaggaguggacggguucgcucugcgccccccuuacccuagccaucugcgccgccucccuggccccucagcagguggugcgggcccggacagcggcugggggccagaggaacugcggggagagcgugguggugccggugcccguccaacccaaacuuuuuagucugagugguggcccgcgacgccccgcuugggucuucuuuccauccacuggggaugggggcggggguggggguagccggcggccgugguuccggagcgggagucggaggugagugugcgaacuggaccggggccccagagacuucggacucgcucucggggagaacggugaccgaggugagacucgccagggucuugggaacgagucugcgguaaaggaaacucuagggauggccccggggacgugaggcgcugagcuucccuggcugagugcggaaaugggccaacacugugcagccgaccacagcgggaguagggauauggggguacaaagcgaggccaucuccccgcguccgugggagaaagcaugcaccccuggcuugaagcaccuucccagccucucgcuccacggcccuucugcuugcaugcgcggggacccgcggcuaucgcuagauggagaacuggggugcucaaggcgcacccugccagaacacgccgaccggacaacaaagaggagcguggacagaccaggagcuucacggcuguagaaagucagaggcucgggaucaguuuccccgaaagcccgugucuggaggggcagggagucggaucggagggaggaacuagcuccagaaccccuucucucuggcaagaucgcccccgaucggugcccaacaggggccgcggcggggaacuggcgccgacgcgcucagagcagccaaguuacuccggcaacccccuccccugcgcggcugcgaauuccuggagucucuuggcuucccgcgcccgccccgccgcucauucuuuugugucccgcagcucgcgagaggcuuccgcccagaagggagcuaggccuggagggggcuuggccuggaggugguuuggagguaaagggcggggaagccggcgccccaggcuucauucugcaacagguugcuccuggagcccgcuaaggcgacugaccuuucuggagaaagguuugcuggaguuccugagggcggcagcuguucuuuguuaagaaagcaagugcacgaucguaguucuugagugccccccgagacucaugcgacacgaacaaccgcugcgauauguuggguugaaucauaagaaauugucgguuuuuuggauggaagaugugaauaucgucaaccucauaugauucaacuugugugauguuacucauuuuucuuuucucaccguccuuucugucccgguuauccuaggagccccgguggaguugagcucagaguauugaugcuagcagaagcagacagaccccagauagccuuccagcugcgugccaggugcuuuaccuauuagaucgcuagccugcgaacccuaugcgaaauccuccuuugacagaggagcagaagaaggguuggagaauucaaacaacugucaucuuggcagaguuaguaagggggaccagagcccccuuacuguugcuguugucugucuauucagcagugcccuuuaguuuauucuuguuuuuuuuuucauguguuccauaauuuuuuucuaaacuuccuucugauuucuaaacuuuucuaaacuucuuucugauuucuaaacuuccuucugauuuuuauacgagacaguuucuuuguguuuuaguacaaugaggugaacaaaugcaucagaggacaagcugaaaa

SEQ ID NO: 19483 - RNA, 2821 nt, Homo sapiens
uugccugcuggagacagaacggagaguggauggauauagcgggcguggacggacagcgacagaagcugauaacagcacagaagggcaaagucugcucagcagcccccaaaauaaacuugagccuggcaaucggcgcagaaccccagcagucagcagcuucggugcaaagcaacuaacaccugaaggcuuccaaaagcagcagggcucucucuagcgggggagccuuuucgaccagagaggagccagaagggggccucagugcagccuccacuccacucaauucccggaguuaccuuggcgggcuccacgcuccgagagacgcuguugcucuaugaggcgugucuguguuucucuaguucgcggcuccagcagucgcgccaaggggcagcugcuacuccugccagauacaccaguuaucacaggccgcucccaggccugcgggggcccugagaauucgcaacaagccccgggcagcagggcucggcuggcgcugaggccccgccuggccaugcccauuggcggaggcugccccgggggcggggucagggcgccccauucccagaccccgcagccccgcccgccgcgggugcguguggagaggcccaggugaggagcaagcgcccgcguuccggaagcccgcucccggggccaugggggcacaggugaggcugccgcccggagagcccugccgagaagguuugugucugcccugagccgagggaccuggcagcuggguggcgaagagaccgggugggcgguccccggacacuugcggagacuggaaaggggggcuguaccgacucuaaacguagucguucacucauucauucauucagucagucggccguccagccaggcguucaacacuuauuuaugggugccuaggcgauucgggcugugcuggaaaaccugaguggaauaaggcaggugggacucccacucgauucgcgaggccgaccaguguaaauuaccgcgugcugcgugugggacggggaaacucaggaugcuaugggaagaaucccgagucccucugagaaggacguuuccucugacucaggcucccuuccagagucugcggccgacgucacccggugggcagagggcgugucugccuggggggcccgugggaguucugcgcugcgcccugcgcuggcucccggggaucgagcaccgcgagagguugggcgcccggggccgcgggggugggcguugggcaagucugggccgcccacgucucuccucuuccuuggaaaugaaaaggucuccaaacccaugagccugucugacucgcugugcagucacucuggcugcuuaaggcgagagccguacuggagaggaaaccuggaaccgggagcacucguuugcaggcucuucuuacugcuucucaccugagccccgugaaaucucugggcgaggcuccuugcccuucgccaaguguucgcaacacuggcggguuuucugcagucuccauacagaaggccccgauaaaaguagggaaggggguagggggagcgacuggaaggauguagauacauugaaaugaugguuuucgccguaccaaggggaaagcagcuuuuuaauuuaccugauaaugcaguaaaggggaagggaggcagugaaaggcaugguaagaacuacuauauauauacacauauauauauaguucccuuacacauauauauauauauauauguauauacauauacaccuuugcaaaggugcucgcaacuucccuaguuuccucuccucuugacucuuccagcuuauuccuuuuuaacaagugagcucguccaaaccaugcuagcaaggaagagaagggacaccaaaaaaaggagaaaaaugccugaacaauucacaagcuauuaaaaaaaauuuuuuaaggccgcuggaucuagaauuauuuucuagucuuuuuuucugaaaaagagcaauaacgccugaacaacucacaaacuauuaaaaaacaaaaauuuuaaggcagcugaaucuagaauuauuuccuagagagucagguugugugcccuuuuucuaaauaauuucuaacccagcaaaucugacaguuacuaacacacccacacuuguuuacccaaggaucuguaaguaaggaagguauaugaauuacacccacuuguuugagcuucuggauguuuuuccugcuuugcuuaugcauugaguuccaacaagaaacauuuaagcuccaggcuuaauaccugugauuaaccaugguaauuaauugugugaaaagcuggugagaaagacuuagaaaucugaaugcacguuauuaguagugggaagagauuaggcuuuggcaucagacagucugagcuguaacuuagcuuccuugagcauuuuccugucuauaaauugggggucaucccuccaguuuacaguucugaagaguaggugcaggugggauuacauaugaacuacaccacucagagcuugacauggaguaaacaaagacucaauuuuucacuuguucauucaaauaacaagagucccaugugccaagcacuggcauaggugcugggauagagggaucugcaagacagucuggucccagacucuaggacuagguuccugcucucaggcaccuuacuguucagauggcagcuacuaugcaagaaacaaaguaauuuaaaagaucauuauaauagcaguaauguaucaagaguguugggauguuuagauuggguauucaaugaaagccccuuacgaaagugauauucaagcugagacccaaaugacaaggggucagucaugagaucugaagauagaacauuccaguugaacuuccaugaagaaaaaguuaauuucauac

SEQ ID NO: 19484 - RNA, 2821 nt, Homo sapiens
guaugaaauuaacuuuuucuucauggaaguucaacuggaauguucuaucuucagaucucaugacugaccccuugucauuugggucucagcuugaauaucacuuucguaaggggcuuucauugaauacccaaucuaaacaucccaacacucuugauacauuacugcuauuauaaugaucuuuuaaauuacuuuguuucuugcauaguagcugccaucugaacaguaaggugccugagagcaggaaccuaguccuagagucugggaccagacugucuugcagaucccucuaucccagcaccuaugccagugcuuggcacaugggacucuuguuauuugaaugaacaagugaaaaauugagucuuuguuuacuccaugucaagcucugagugguguaguucauauguaaucccaccugcaccuacucuucagaacuguaaacuggagggaugacccccaauuuauagacaggaaaaugcucaaggaagcuaaguuacagcucagacugucugaugccaaagccuaaucucuucccacuacuaauaacgugcauucagauuucuaagucuuucucaccagcuuuucacacaauuaauuaccaugguuaaucacagguauuaagccuggagcuuaaauguuucuuguuggaacucaaugcauaagcaaagcaggaaaaacauccagaagcucaaacaaguggguguaauucauauaccuuccuuacuuacagauccuuggguaaacaaguguggguguguuaguaacugucagauuugcuggguuagaaauuauuuagaaaaagggcacacaaccugacucucuaggaaauaauucuagauucagcugccuuaaaauuuuuguuuuuuaauaguuugugaguuguucaggcguuauugcucuuuuucagaaaaaaagacuagaaaauaauucuagauccagcggccuuaaaaaauuuuuuuuaauagcuugugaauuguucaggcauuuuucuccuuuuuuuggugucccuucucuuccuugcuagcaugguuuggacgagcucacuuguuaaaaaggaauaagcuggaagagucaagaggagaggaaacuagggaaguugcgagcaccuuugcaaagguguauauguauauacauauauauauauauauauguguaagggaacuauauauauauguguauauauauaguaguucuuaccaugccuuucacugccucccuuccccuuuacugcauuaucagguaaauuaaaaagcugcuuuccccuugguacggcgaaaaccaucauuucaauguaucuacauccuuccagucgcucccccuacccccuucccuacuuuuaucggggccuucuguauggagacugcagaaaacccgccaguguugcgaacacuuggcgaagggcaaggagccucgcccagagauuucacggggcucaggugagaagcaguaagaagagccugcaaacgagugcucccgguuccagguuuccucuccaguacggcucucgccuuaagcagccagagugacugcacagcgagucagacaggcucauggguuuggagaccuuuucauuuccaaggaagaggagagacgugggcggcccagacuugcccaacgcccacccccgcggccccgggcgcccaaccucucgcggugcucgauccccgggagccagcgcagggcgcagcgcagaacucccacgggccccccaggcagacacgcccucugcccaccgggugacgucggccgcagacucuggaagggagccugagucagaggaaacguccuucucagagggacucgggauucuucccauagcauccugaguuuccccgucccacacgcagcacgcgguaauuuacacuggucggccucgcgaaucgagugggagucccaccugccuuauuccacucagguuuuccagcacagcccgaaucgccuaggcacccauaaauaaguguugaacgccuggcuggacggccgacugacugaaugaaugaaugagugaacgacuacguuuagagucgguacagccccccuuuccagucuccgcaaguguccggggaccgcccacccggucucuucgccacccagcugccaggucccucggcucagggcagacacaaaccuucucggcagggcucuccgggcggcagccucaccugugcccccauggccccgggagcgggcuuccggaacgcgggcgcuugcuccucaccugggccucuccacacgcacccgcggcgggcggggcugcggggucugggaauggggcgcccugaccccgcccccggggcagccuccgccaaugggcauggccaggcggggccucagcgccagccgagcccugcugcccggggcuuguugcgaauucucagggcccccgcaggccugggagcggccugugauaacugguguaucuggcaggaguagcagcugccccuuggcgcgacugcuggagccgcgaacuagagaaacacagacacgccucauagagcaacagcgucucucggagcguggagcccgccaagguaacuccgggaauugaguggaguggaggcugcacugaggcccccuucuggcuccucucuggucgaaaaggcucccccgcuagagagagcccugcugcuuuuggaagccuucagguguuaguugcuuugcaccgaagcugcugacugcugggguucugcgccgauugccaggcucaaguuuauuuugggggcugcugagcagacuuugcccuucugugcuguuaucagcuucugucgcuguccguccacgcccgcuauauccauccacucuccguucugucuccagcaggcaa

SEQ ID NO: 19485 - RNA, 3367 nt, Homo sapiens
ucacuggagguuuuugagcacaaauucagaguguuaaaggugugggcauuuguacgagagagaagaaagaggaguaccaguaaguaagcugcuggggauguuguaguaauggaggauugagguuaagaggaccuaaacuaaagugggaugaaaaaggagagauuaaguagauacuuuaagagaagacuuaacagaauuuguagucagguuccaaaaaagaaccucaggcuucugacagcccuaacagaugggcaacuuaaaaguguuagccaaaguuugaauauagguccacauaaaagagagaaaggacaaaauucaucccuccugagacguagucuuuacucuucucugccaaaccaugcacauuacugucuucaucuugaugcauuuaacauuuauugaauaguuacuauaagccaggugcuccaagcuaccaggaugaacauaguguccacccucaaggagcuuaauuacaggccagucagguagacagacaaggugacuaacaguucacaaagcaugacaagugcuguaguggagcaaugcauacaauacagaaaggguacagaagaggaaugcaucuccaccuagcaggcaagggcaucagggaaaguuucuaagaaaagcugaagguugaguuaacucuugaaggauggacaggaguuaaccaggcaaaagagcuaagaaggucacucuaggcagaggaagaagcauggagacuuugagaggcaaccaucucugggagaacuaauuuuggucacuuuauguggauggugagaaggauagguguagggaugaagcaagaaauacaaugagagaugugcuuaggggccaguaagcaacauaaauaccaugacaagaacaauggacuuuauccugaaggcaaaggggaacuacugaagaguuaaaauagguuuccuauacaaucagauuugcauuguaguaaaaucacuccaaaaagagaugaacuggaacugaagagccuagaagugaagauaucaacagcagguuucucuaagagucccaaugagguacugacugagguuugacuuugaagcugaagucuggggaaagguguuaagagguagaacugucaggaucucgugauuguuuggauaugaguguggcacaaaggggucgaagaugacucccaaauaggacuggcuauauaauuuguggggcccagggggaaaagaaaauguggggcucacuguuuaaaucucaagcccaggacagcagaacauuaaaccaagugcagguccuucucagcucccuuaaaauggccuugguccuaaguuucuggcuagguuaaacaagugaauggaugguuguagccuuuuuaauaguaaguaugacagaguccaguuuugaacauuuuugaguuugaggugccuauggaaaauucaguuaaguucagggcuggagacguaaugcguaaauuugaaguggagacugaguaacggaucagacugccccacuuauguguaaagcaaaaauagaaccagauggaaaaacaaucaucugaaacagaagcugauaacuuaggcgggaaaugaggaaagccaaggcacaauuuaaauaccaacuccaagaaguuuugucuccuuucaguuucacucauuccucuauguuuuauuuuacuguuacaaaucugcagccugccuauugucuuuagcugauuuuuucugcauguauuuggcuguaugacuuuaagcuccuugaagagagauuuuacgucuuuuaucuucagaaugagcccuccagugacauauaucuaauaggucucuaaaaaguuaauuaucuaagaaaaucguuccaaaggucaaaacuugacucauuuuuuucaacaauguuuuagaaugagacuuuuuaaagagaaacuacuauaauuguucaaaggaaaaguaaguuagguaagggggaaaguuacugaaaauuaucuguauuacaauaaaucacccuagcgauuacguguauguauauauuaacacacacacauaugcauguacauguaugcauacguauaacuagauuuuggggggaugaggagccuuuuaaaccauucuaaguuacaaguuuacaaugcaggucaggaaaucuuggauaaaucauuuuuaaaagugaacaggagauaguuuuagacuggugacuaaaucuucaaaaaccaaagcgugaggggaaaucugggaugucugcauauuggagauggcagaaacaaaaaacaaagauggcaagcugacaccggggcaacagcugacccguuucuuguaagaggagccuucucgcuggggcugcgguuauuuuuauccaaaucucugcuggcggcugaacgggguacgucccuggcacgucccagcgcaggcuuccaggcuggcucgaccgccucccaggcucuccggaaggagaccccuccucacccccuccgaggaucagccaggccgggccgagcccgaggccgccccuggcuccuggucccuagcuugugccagcauccucggcggggcacagcuccucccgccccgccccgccccgaucggccccgccgaacccagacccugcggcccgcgccccccgcacccccggccagggcucccgcgggcccagccggcaggacgcggccucccccgcuccuccagcccgcggccgcggcgguacucacagaccuguucugcagccgccgccgccgcugccgccaucuucccgcgcccgccgccgccgagcuccccgcccgacugugcccgccccuccgcgaccgcacccugcgcgccugcgcuugcgcccuggcggggacugggggcacccgcugcucacacccuccccuccccagcccgcaucccugacgacccgcaucccagcccugcgggcucaggcucugcggcggccccugcaccuaggaccuuggccuggggcgcguuguauugcacaggggccagaaggggccuauggggauuccgcuccaccccgggccgccugcagauuccucagaaagggcacccucaaaaaucgaggacgcuucuccccuuccccuuuguuccccaucgcugaaagaucggugccauccggagcugugaggcucucuuuguuucucggaccaaggucuccuuggcuagggugggaggggccgauaucgagaccacaaguggacgcggaccggcguggugacugcgugggcagaagugaacgaguggucacuuagguggcuggagucuugaagacugagaguccucaaggaggacguugaauccuucgggcugcuugacuucggaggccuaugaagucugauguuuuuauccugcgauacuggggauggauuuuucauuuaguguuggagauaguguuaccauguauauccucgggaaccuaauug

SEQ ID NO: 19486 - RNA, 3367 nt, Homo sapiens
caauuagguucccgaggauauacaugguaacacuaucuccaacacuaaaugaaaaauccauccccaguaucgcaggauaaaaacaucagacuucauaggccuccgaagucaagcagcccgaaggauucaacguccuccuugaggacucucagucuucaagacuccagccaccuaagugaccacucguucacuucugcccacgcagucaccacgccgguccgcguccacuuguggucucgauaucggccccucccacccuagccaaggagaccuugguccgagaaacaaagagagccucacagcuccggauggcaccgaucuuucagcgauggggaacaaaggggaaggggagaagcguccucgauuuuugagggugcccuuucugaggaaucugcaggcggcccgggguggagcggaauccccauaggccccuucuggccccugugcaauacaacgcgccccaggccaagguccuaggugcaggggccgccgcagagccugagcccgcagggcugggaugcgggucgucagggaugcgggcuggggaggggagggugugagcagcgggugcccccaguccccgccagggcgcaagcgcaggcgcgcagggugcggucgcggaggggcgggcacagucgggcggggagcucggcggcggcgggcgcgggaagauggcggcagcggcggcggcggcugcagaacaggucugugaguaccgccgcggccgcgggcuggaggagcgggggaggccgcguccugccggcugggcccgcgggagcccuggccgggggugcggggggcgcgggccgcagggucuggguucggcggggccgaucggggcggggcggggcgggaggagcugugccccgccgaggaugcuggcacaagcuagggaccaggagccaggggcggccucgggcucggcccggccuggcugauccucggagggggugaggaggggucuccuuccggagagccugggaggcggucgagccagccuggaagccugcgcugggacgugccagggacguaccccguucagccgccagcagagauuuggauaaaaauaaccgcagccccagcgagaaggcuccucuuacaagaaacgggucagcuguugccccggugucagcuugccaucuuuguuuuuuguuucugccaucuccaauaugcagacaucccagauuuccccucacgcuuugguuuuugaagauuuagucaccagucuaaaacuaucuccuguucacuuuuaaaaaugauuuauccaagauuuccugaccugcauuguaaacuuguaacuuagaaugguuuaaaaggcuccucauccccccaaaaucuaguuauacguaugcauacauguacaugcauauguguguguguuaauauauacauacacguaaucgcuagggugauuuauuguaauacagauaauuuucaguaacuuucccccuuaccuaacuuacuuuuccuuugaacaauuauaguaguuucucuuuaaaaagucucauucuaaaacauuguugaaaaaaaugagucaaguuuugaccuuuggaacgauuuucuuagauaauuaacuuuuuagagaccuauuagauauaugucacuggagggcucauucugaagauaaaagacguaaaaucucucuucaaggagcuuaaagucauacagccaaauacaugcagaaaaaaucagcuaaagacaauaggcaggcugcagauuuguaacaguaaaauaaaacauagaggaaugagugaaacugaaaggagacaaaacuucuuggaguugguauuuaaauugugccuuggcuuuccucauuucccgccuaaguuaucagcuucuguuucagaugauuguuuuuccaucugguucuauuuuugcuuuacacauaaguggggcagucugauccguuacucagucuccacuucaaauuuacgcauuacgucuccagcccugaacuuaacugaauuuuccauaggcaccucaaacucaaaaauguucaaaacuggacucugucauacuuacuauuaaaaaggcuacaaccauccauucacuuguuuaaccuagccagaaacuuaggaccaaggccauuuuaagggagcugagaaggaccugcacuugguuuaauguucugcuguccugggcuugagauuuaaacagugagccccacauuuucuuuucccccugggccccacaaauuauauagccaguccuauuugggagucaucuucgaccccuuugugccacacucauauccaaacaaucacgagauccugacaguucuaccucuuaacaccuuuccccagacuucagcuucaaagucaaaccucagucaguaccucauugggacucuuagagaaaccugcuguugauaucuucacuucuaggcucuucaguuccaguucaucucuuuuuggagugauuuuacuacaaugcaaaucugauuguauaggaaaccuauuuuaacucuucaguaguuccccuuugccuucaggauaaaguccauuguucuugucaugguauuuauguugcuuacuggccccuaagcacaucucucauuguauuucuugcuucaucccuacaccuauccuucucaccauccacauaaagugaccaaaauuaguucucccagagaugguugccucucaaagucuccaugcuucuuccucugccuagagugaccuucuuagcucuuuugccugguuaacuccuguccauccuucaagaguuaacucaaccuucagcuuuucuuagaaacuuucccugaugcccuugccugcuagguggagaugcauuccucuucuguacccuuucuguauuguaugcauugcuccacuacagcacuugucaugcuuugugaacuguuagucaccuugucugucuaccugacuggccuguaauuaagcuccuugaggguggacacuauguucauccugguagcuuggagcaccuggcuuauaguaacuauucaauaaauguuaaaugcaucaagaugaagacaguaaugugcaugguuuggcagagaagaguaaagacuacgucucaggagggaugaauuuuguccuuucucucuuuuauguggaccuauauucaaacuuuggcuaacacuuuuaaguugcccaucuguuagggcugucagaagccugagguucuuuuuuggaaccugacuacaaauucuguuaagucuucucuuaaaguaucuacuuaaucucuccuuuuucaucccacuuuaguuuagguccucuuaaccucaauccuccauuacuacaacauccccagcagcuuacuuacugguacuccucuuucuucucucucguacaaaugcccacaccuuuaacacucugaauuugugcucaaaaaccuccaguga

SEQ ID NO: 19487 - RNA, 2501 nt, Homo sapiens
aacggcgcaaccgcuuggagauuucucccgagggcccuauuucucguugggccgaguuuguagaagggacauuucuugauucuagauuuauauucucucuggguauuaaaugcaauuuuguauguuccuuuucuucuuuucaaagagaauacaaaacuauagcagucuaagaaaauaaccccaaaauggggaggcaaacucauucuggaaaugaugggcuguuuguaguuucacaaaaccucuuucccggcagagcaccaacaccucccccuuccaccaccccccaucccaucuggucugcuucuccccgccccccaguuguugucgaagucuggggguugggacuggacccccugauugcguaagagcaaaaagcgaaggcgcaaucuggacacugggagauucggagcgcagggaguuugagagaaacuuuuauuuugaagagaccaagguugagggggggcuuauuuccugacagcuauuuacuuagagcaaaugauuaguuuuagaaggauggacuauaacauugaaucaauuacaaaacgcgguuuuugagcccauuacuguuggagcuacagggagagaaacagaggaggagacugcaagagaucauuggaggccgugggcacgcucuuuacuccaugugugggacauucauugcggaauaacaucggaggagaagguaagggaaaagaaaaaaugauuuuuuguuuauaagggaagucccugaucagacucugggacuggagaaagcgaaguaacuucaaacuuugggcgacaagaaaaaaaaaaaggagcuggauuccaguuguguguccagagaguaauuuuuuuuuuucggaauaaacuucacuuggggacgggugggagauaaccauagaguuagaaagucuagguauuuuuuuuaaacacacauuuuccagaccuauuuuuaaaaacaauguuuuucuaacaacccuauggccucccaaagaaauuguuuaggcuuacauuuuugagguuucuuuugggagugggggugguguucgugaauacugggccgaacaccaaggaacuggggguggaggcagagguguuugcccucuucuuggcaguggguccuggaaggcgacagguuuuaaaugaguguuuucauuccucgccugcgguuuggcgggacagcgcugcagcccaugguguggagcgcggcugggggaccagggggagguggggagaggggagcguggaggggagcguggaggggggcgcgcgaagggguugcggggcgcaggaggcgggcugggcucggcuggagaccggaccucgguguuggccuacagcacagggagccggccgaaugcgcgugauuacuggacggcgcugcucugggagagagucggggccagauuuggcgcggcggugaggcggcugcgggacaagcagaggcgcgcgggcgugggcaaggguuuggggcgcucuggagcgguuuguugggucagugaggugccagggagagcgggugccugccgggcagugugcucggguugcacgcccuagcgcgggggcgacagcggcggcgcgggcgggcggucuggaauaaugacaaacacauuuggcccugagugaagaagucgucgucgccucgcauuccagcaacugggauuugaggaauuucgaaccgcacaccaaggggcccucauugugcuccguggcccccgcccccgccugucuucccgcgcccccuccucgguggaaucauuucugcauugcccgggggcucugcuuucgcucaguucuggccgcaggcaggaagagaggaaaggucuccaggaaggugccgaacuucuugugaggaaguuagggacgacuuggaacuggggaaacuuguuugcagguaagacagaaaggugggagguaaaccauauucucccuccgggcacccgagcccuggacacccccuacccggcacccuucuccgcgcgggggugcguggcacuugccgucugagcucgcccagcgcugcucgguccucucuaguuggccuuuuuuccauuccucucccugccggcuucagagccgucugugcguacuucuccuuccucugcugucuacccccauggaaaccagauuuacacacgaaauuaacuccgcccggcugcgcccagggagcgggcggcguccauuuggcauugaauaugugggaucagcuguucuauuccgggagggugucggccaggucggagcgacgaguguggcccaacccgaguacguugccagagggagccaggagccugggccgggccaggugugcgagagcugccgauggccuggccucgcgucuuggucgggaaggacuugcuggccuggcaggcugugcguugugcaucccucccgcagccagagcgccggucccgcacuucgcuccccgaauugugcuaagaccucaggaugugcgcaaggagugccuggaagaacuugccacucacuccaucuuccugggugggaggcaagcauggaugggg

SEQ ID NO: 19488 - RNA, 2501 nt, Homo sapiens
ccccauccaugcuugccucccacccaggaagauggagugaguggcaaguucuuccaggcacuccuugcgcacauccugaggucuuagcacaauucggggagcgaagugcgggaccggcgcucuggcugcgggagggaugcacaacgcacagccugccaggccagcaaguccuucccgaccaagacgcgaggccaggccaucggcagcucucgcacaccuggcccggcccaggcuccuggcucccucuggcaacguacucggguugggccacacucgucgcuccgaccuggccgacacccucccggaauagaacagcugaucccacauauucaaugccaaauggacgccgcccgcucccugggcgcagccgggcggaguuaauuucguguguaaaucugguuuccauggggguagacagcagaggaaggagaaguacgcacagacggcucugaagccggcagggagaggaauggaaaaaaggccaacuagagaggaccgagcagcgcugggcgagcucagacggcaagugccacgcacccccgcgcggagaagggugccggguaggggguguccagggcucgggugcccggagggagaauaugguuuaccucccaccuuucugucuuaccugcaaacaaguuuccccaguuccaagucgucccuaacuuccucacaagaaguucggcaccuuccuggagaccuuuccucucuuccugccugcggccagaacugagcgaaagcagagcccccgggcaaugcagaaaugauuccaccgaggagggggcgcgggaagacaggcgggggcgggggccacggagcacaaugagggccccuuggugugcgguucgaaauuccucaaaucccaguugcuggaaugcgaggcgacgacgacuucuucacucagggccaaauguguuugucauuauuccagaccgcccgcccgcgccgccgcugucgcccccgcgcuagggcgugcaacccgagcacacugcccggcaggcacccgcucucccuggcaccucacugacccaacaaaccgcuccagagcgccccaaacccuugcccacgcccgcgcgccucugcuugucccgcagccgccucaccgccgcgccaaaucuggccccgacucucucccagagcagcgccguccaguaaucacgcgcauucggccggcucccugugcuguaggccaacaccgagguccggucuccagccgagcccagcccgccuccugcgccccgcaaccccuucgcgcgccccccuccacgcuccccuccacgcuccccucuccccaccucccccuggucccccagccgcgcuccacaccaugggcugcagcgcugucccgccaaaccgcaggcgaggaaugaaaacacucauuuaaaaccugucgccuuccaggacccacugccaagaagagggcaaacaccucugccuccacccccaguuccuugguguucggcccaguauucacgaacaccacccccacucccaaaagaaaccucaaaaauguaagccuaaacaauuucuuugggaggccauaggguuguuagaaaaacauuguuuuuaaaaauaggucuggaaaauguguguuuaaaaaaaauaccuagacuuucuaacucuaugguuaucucccacccguccccaagugaaguuuauuccgaaaaaaaaaaauuacucucuggacacacaacuggaauccagcuccuuuuuuuuuuucuugucgcccaaaguuugaaguuacuucgcuuucuccagucccagagucugaucagggacuucccuuauaaacaaaaaaucauuuuuucuuuucccuuaccuucuccuccgauguuauuccgcaaugaaugucccacacauggaguaaagagcgugcccacggccuccaaugaucucuugcagucuccuccucuguuucucucccuguagcuccaacaguaaugggcucaaaaaccgcguuuuguaauugauucaauguuauaguccauccuucuaaaacuaaucauuugcucuaaguaaauagcugucaggaaauaagcccccccucaaccuuggucucuucaaaauaaaaguuucucucaaacucccugcgcuccgaaucucccaguguccagauugcgccuucgcuuuuugcucuuacgcaaucaggggguccagucccaacccccagacuucgacaacaacuggggggcggggagaagcagaccagaugggauggggggugguggaagggggagguguuggugcucugccgggaaagagguuuugugaaacuacaaacagcccaucauuuccagaaugaguuugccuccccauuuugggguuauuuucuuagacugcuauaguuuuguauucucuuugaaaagaagaaaaggaacauacaaaauugcauuuaauacccagagagaauauaaaucuagaaucaagaaaugucccuucuacaaacucggcccaacgagaaauagggcccucgggagaaaucuccaagcgguugcgccguu

SEQ ID NO: 19489 - RNA, 4288 nt, Homo sapiens
uaguaauaauaauuagaaaggauugacuuucagaaauuuuucucaagucaaagcuuccacuacuaugguuccaacuuuucucucuuuuuuuuaauuuuauuauuauuauacuuuaaguuuuaggguacaugugcacaaugugcagguuaguuacauaucuauacaugugccaugcuggugugcugcacccauuaacucgucauuuagcauuagguacaucuccuaaugcuaucccuccccccuccccccagcccacaacaguccccagagugugauguuccccuuccuguguccauguguucuccuuguucaauucccaccuaugagugagaacaugcgguguuugguuuuuuguccuugcgauaguuuacugagaaugaugauuuccaauuucauccacgucccuacaaaggacaugaacucauccuuuuuuauggcugcauaguauuccaugguguauaugugccacauuuucuuaauccagucuaucauuguuggacauuuggguugguuccaagucuuugcuauugugaauagugcugcaauaaacauucgugugcaugugucuuuauagcagcaugauuuauaguccuuuggguauauacccaguaaugggacggcugggucaaaugguauuuguaguucuagaucccugaggaaucgccacacugacuuccacacugguugaacuaguuuacagucccaccaacaguguaaaaguguucccauuucuccacauccucuccagcaccuguuguuuccugacuuuuuaaugauugccauucuaacuggugugagaugguaucucauugugguuuugauuugcauuucucugauggccagugauggugagcauuguuucauguguuuuuuggcugcauaaaugucuugagaagugucuguucauguccuucauccacuuuuugaugggguuguuuguuuuuuuguuguaaauuuguuugaguucauuguagguucuggauauuagcccuuugucagaugaguaggucgcgaaaauuuucucccauuuuguagguugccuguucacucugaugguaguuucuuuugcugugcagaagcucuugaguuuaauuagaucccauuugucaauuuuggcuuuuguugccauugcuuuugguguuuuauacaugaagaccuugcccaugccuauguccugaauggguaaugccuagguuuucuucuaggguuuuuaugguuucaggucuaacguuuaagucuuuaauccaucuugaauuaauuuuuguauaagguguaaggaagggauccaguuucagcuuucuacauauggcuagccaguuuucccagcaccauuuauuaaauagggaauccuuucccuauugcuuguuuuucucagguuugucaaagaucagauaguuguagauaugcggcauuauuucugagggcucuguucuguuccauugaucuauaucucuguuuugguaccaguaccaugcuguuuugguuacuguagccuuguaguauaguuugaagucagguagcgugaugccuccagcuugguucuuuuggcuuaggauugacuuggccaugcgggcucuuuuuugguuccauaugaacuuucaaguaguuuuuuccaauucugugaagaaagucauugguagcuugauggggaugguauugaaucuauaaguuaccuugggcaguauggccauauucacgauauugauuuuuccuacccaugagcauggaauauucuuccauuuguuuguauccucuuuuauuucauugagcagugguuuguaguucuccuugaagagguccuucaugucccuuguaaguuggauuccuagguauuuuauucucuuugaagcaauugugaaugggaguucacucaugauuuggcucucuguuuguuuguuauugguguauaagaaugcuugugauuuuugugcauugauuuuguauccugagacuuugcugaaguugcuuaucagcuuaaggagauuuugggcugagaccaugucucuguuuguuuguuauugguguauaagaaugcuugugauuuuugugcauugauuuuguauccugagacuuugcugaaguugcuuaucagcuuaaggagauuuugggcugagaccaugggguuuucuagauauacaauuauguaauuugcaaauagggacaauuugacuuccucuuuuccuaauugaauacccuuuauuuccuucuccugccuaauuguccuggccauuggagaggaggagcaucucccagacagcugcgugccucagagaagccagccucgcuaaccccucaagcccaggggaugagacccugcugaaucgcugcucuauuuuggcuggagccacagcucccuccaccgcggggcggggcuaaaauguccucccccuuaagggagcaggcagcuccucccagccacccaccccaccaauucccauccucccgccccccuccaccaaccccuucuuuccacacugcccccugaguucagggaauuuccccagcaucccaaagcuugaguuuccugccagucgggagggaugaaugcagauaaagggagugcagaaggcacgaggaaaccaaagugcucuguauccuccagucuccgcgccuccacccagcucaggaacccgcgaacccucucuugaccacuaugagccucccguccagccgcgcggcccgugucccggguccuucgggcuccuugugcgcgcugcucgcgcugcugcuccugcugacgccgccggggccccucgccagcggugagagcuccuggcacuggggugcaucccagccucugcggggccgcugcguuccagggaacucucccagcaaccugcccuauaaaaaugucuuucuuccccagcugguccugucucugcugugcugacagagcugcguugcacuuguuuacgcguuacgcugagaguaaaccccaaaacgauugguaaacugcagguguuccccgcaggcccgcagugcuccaagguggaagugguguaaguucuccuguguugcuguguccacugugacuuaggcaaguccuccagccugggucgucaaccuuuguggcucaugggugcauccucuuuuucuuuacuucagagccucccugaagaacgggaagcaaguuugucuggacccggaagccccuuuucuaaagaaagucauccagaaaauuuuggacagguauuugucccuuugaucuuugugguguuuuaauaucuucuauggaaagcauauacuucacaauguccuuauucucucuguaggauuuagacuaugcuuagaauuauaagguuguuaagaagaauaaggaaacuuuuuuucuggaauguucuggguaaaccuuuaucaccaaucuuacaugccugaacaauuacacagagcucauuacugacaucuauuuuuugucugcucuuugcuuuuauugauuuuuuucccccaccaaacgcuuuugaaaaccaaauguagcauacaagagugugggaauugguuauacuaauauaacucuuuucucaacaguggaaacaagaaaaacugaguaacaaaaaagaccaugcaucauaaaauugcccagucuucagcggagcaguuuucuggagaucccuggacccaguaagaauaagaaggaaggguugguuuuuuuccauuuucuacauggauucccuacuuugaagagugugggggaaagccuacgcuucucccugaaguuuacagcucagcuaaugaaguacuaauauaguauuuccacuauuuacuguuauuuuaccugauaaguuauugaacccuuuggcaauugaccauauugugagcaaagaaucacugguuauuagucuuucaaugaauauugaauugaagauaacuauuguauuucuaucauacauuccuuaaagucuuaccgaaaaggcuguggauuucguauggaaauaauguuuuauuagugugcuguugagggagguauccuguuguucuuacucacucuucucauaaaauaggaaauauuuuaguucuguuucuuggggaauauguuacucuuuacccuaggaugcuauuuaaguuguacuguauuagaacacugggugugucauaccguuaucugugcagaauauauuuccuuauucagaauuucuaaaaauuuaaguucuguaagggcuaauauauucucuuccuaugguuuuagacguuugaugucuucuuaguauggcauaaugucaugauuuacucauuaaacuuugauuuuguaugcuauuuuuucacuauaggaugacuauaauucuggucacua

SEQ ID NO: 19490 - RNA, 4288 nt, Homo sapiens
uagugaccagaauuauagucauccuauagugaaaaaauagcauacaaaaucaaaguuuaaugaguaaaucaugacauuaugccauacuaagaagacaucaaacgucuaaaaccauaggaagagaauauauuagcccuuacagaacuuaaauuuuuagaaauucugaauaaggaaauauauucugcacagauaacgguaugacacacccaguguucuaauacaguacaacuuaaauagcauccuaggguaaagaguaacauauuccccaagaaacagaacuaaaauauuuccuauuuuaugagaagagugaguaagaacaacaggauaccucccucaacagcacacuaauaaaacauuauuuccauacgaaauccacagccuuuucgguaagacuuuaaggaauguaugauagaaauacaauaguuaucuucaauucaauauucauugaaagacuaauaaccagugauucuuugcucacaauauggucaauugccaaaggguucaauaacuuaucagguaaaauaacaguaaauaguggaaauacuauauuaguacuucauuagcugagcuguaaacuucagggagaagcguaggcuuucccccacacucuucaaaguagggaauccauguagaaaauggaaaaaaaccaacccuuccuucuuauucuuacuggguccagggaucuccagaaaacugcuccgcugaagacugggcaauuuuaugaugcauggucuuuuuuguuacucaguuuuucuuguuuccacuguugagaaaagaguuauauuaguauaaccaauucccacacucuuguaugcuacauuugguuuucaaaagcguuuggugggggaaaaaaaucaauaaaagcaaagagcagacaaaaaauagaugucaguaaugagcucuguguaauuguucaggcauguaagauuggugauaaagguuuacccagaacauuccagaaaaaaaguuuccuuauucuucuuaacaaccuuauaauucuaagcauagucuaaauccuacagagagaauaaggacauugugaaguauaugcuuuccauagaagauauuaaaacaccacaaagaucaaagggacaaauaccuguccaaaauuuucuggaugacuuucuuuagaaaaggggcuuccggguccagacaaacuugcuucccguucuucagggaggcucugaaguaaagaaaaagaggaugcacccaugagccacaaagguugacgacccaggcuggaggacuugccuaagucacaguggacacagcaacacaggagaacuuacaccacuuccaccuuggagcacugcgggccugcggggaacaccugcaguuuaccaaucguuuugggguuuacucucagcguaacgcguaaacaagugcaacgcagcucugucagcacagcagagacaggaccagcuggggaagaaagacauuuuuauagggcagguugcugggagaguucccuggaacgcagcggccccgcagaggcugggaugcaccccagugccaggagcucucaccgcuggcgaggggccccggcggcgucagcaggagcagcagcgcgagcagcgcgcacaaggagcccgaaggacccgggacacgggccgcgcggcuggacgggaggcucauaguggucaagagaggguucgcggguuccugagcuggguggaggcgcggagacuggaggauacagagcacuuugguuuccucgugccuucugcacucccuuuaucugcauucaucccucccgacuggcaggaaacucaagcuuugggaugcuggggaaauucccugaacucagggggcaguguggaaagaagggguugguggaggggggcgggaggaugggaauuggugggguggguggcugggaggagcugccugcucccuuaagggggaggacauuuuagccccgccccgcgguggagggagcuguggcuccagccaaaauagagcagcgauucagcagggucucauccccugggcuugagggguuagcgaggcuggcuucucugaggcacgcagcugucugggagaugcuccuccucuccaauggccaggacaauuaggcaggagaaggaaauaaaggguauucaauuaggaaaagaggaagucaaauugucccuauuugcaaauuacauaauuguauaucuagaaaaccccauggucucagcccaaaaucuccuuaagcugauaagcaacuucagcaaagucucaggauacaaaaucaaugcacaaaaaucacaagcauucuuauacaccaauaacaaacaaacagagacauggucucagcccaaaaucuccuuaagcugauaagcaacuucagcaaagucucaggauacaaaaucaaugcacaaaaaucacaagcauucuuauacaccaauaacaaacaaacagagagccaaaucaugagugaacucccauucacaauugcuucaaagagaauaaaauaccuaggaauccaacuuacaagggacaugaaggaccucuucaaggagaacuacaaaccacugcucaaugaaauaaaagaggauacaaacaaauggaagaauauuccaugcucauggguaggaaaaaucaauaucgugaauauggccauacugcccaagguaacuuauagauucaauaccauccccaucaagcuaccaaugacuuucuucacagaauuggaaaaaacuacuugaaaguucauauggaaccaaaaaagagcccgcauggccaagucaauccuaagccaaaagaaccaagcuggaggcaucacgcuaccugacuucaaacuauacuacaaggcuacaguaaccaaaacagcaugguacugguaccaaaacagagauauagaucaauggaacagaacagagcccucagaaauaaugccgcauaucuacaacuaucugaucuuugacaaaccugagaaaaacaagcaauagggaaaggauucccuauuuaauaaauggugcugggaaaacuggcuagccauauguagaaagcugaaacuggaucccuuccuuacaccuuauacaaaaauuaauucaagauggauuaaagacuuaaacguuagaccugaaaccauaaaaacccuagaagaaaaccuaggcauuacccauucaggacauaggcaugggcaaggucuucauguauaaaacaccaaaagcaauggcaacaaaagccaaaauugacaaaugggaucuaauuaaacucaagagcuucugcacagcaaaagaaacuaccaucagagugaacaggcaaccuacaaaaugggagaaaauuuucgcgaccuacucaucugacaaagggcuaauauccagaaccuacaaugaacucaaacaaauuuacaacaaaaaaacaaacaaccccaucaaaaaguggaugaaggacaugaacagacacuucucaagacauuuaugcagccaaaaaacacaugaaacaaugcucaccaucacuggccaucagagaaaugcaaaucaaaaccacaaugagauaccaucucacaccaguuagaauggcaaucauuaaaaagucaggaaacaacaggugcuggagaggauguggagaaaugggaacacuuuuacacuguuggugggacuguaaacuaguucaaccaguguggaagucaguguggcgauuccucagggaucuagaacuacaaauaccauuugacccagccgucccauuacuggguauauacccaaaggacuauaaaucaugcugcuauaaagacacaugcacacgaauguuuauugcagcacuauucacaauagcaaagacuuggaaccaacccaaauguccaacaaugauagacuggauuaagaaaauguggcacauauacaccauggaauacuaugcagccauaaaaaaggaugaguucauguccuuuguagggacguggaugaaauuggaaaucaucauucucaguaaacuaucgcaaggacaaaaaaccaaacaccgcauguucucacucauaggugggaauugaacaaggagaacacauggacacaggaaggggaacaucacacucuggggacuguugugggcuggggggaggggggagggauagcauuaggagauguaccuaaugcuaaaugacgaguuaaugggugcagcacaccagcauggcacauguauagauauguaacuaaccugcacauugugcacauguacccuaaaacuuaaaguauaauaauaauaaaauuaaaaaaaagagagaaaaguuggaaccauaguaguggaagcuuugacuugagaaaaauuucugaaagucaauccuuucuaauuauuauuacua

SEQ ID NO: 19491 - RNA, 2571 nt, Homo sapiens
accccagcccccccaacacccgcccucgcccuccagucccccgcgccccccaagccccacccucccucucccgcgguccgcgggcuccaccaagcgcccaccugcugcgcugcggcggcggcuccggggccugaacccgggucugaacccgggccucggcgccgugggggguggacccgggagcgcggccggagaggggagucagggucagcuccccgcaggcgccccgacccccgccuccgcgcccaucccgcgcguccccgccgccccaagagcguccuaagacacccggggaaacgccuucccugugaugccgcggacccagucccgucgcggacacggcggggcgggcggggguggcagcguccgaggcggcgcgggcccuuuaaggcggccggccucguuagcauacauuugcauggccccgccccgccgcuugaggcugccgcgcggggcucaguccggcgggggcgccgcggagagcggagggcgccgggcugcggaacgcgaagcggagggcgcgggacccugcacgccgcccgcgggcccaugugagcgccaugcggcgccgcgcagcccggggacccggcccgccgcccccagggcccggacucucgcggcugccgcugccgcugcugcugcugcuggcgcuggggacccgcgggggcugcgccgcgcccgcacccgcgccgcgcgccgaggaccucagccugggaguggugagcgcgcgggcgggacgggcgcggagcuccugggccggagccgggggucuccgcgggccggguggcggggaccgggaagaccccagcagugcacgucggcgucgcgcgggagcccuggcgcccuggacccauuuccuggguggggagacugaggcagggacgcgggcugagcgaccgggcgagcgcacgcgaguccuggggaggcgccggcugccgucccggcuccgugcgcugggagcgcgccgcagccgcaggagcccguggaguugugagggggucgcccacccggagcccgggucgccggcuugcagcagccccggagcagccgggcugggcgagagcaggcaucgcggccgccccgagcucugcgcgcugcgugcguuccgggugggaguggcgggggcaggagcacgcacccacaaagcgaggaagggcaggggcuacggagugggggcaccccgaaagccuugagcccccgaguuugcucgguugaggguguugggggcacagggaugcuggcccccagcuccccacuggacaaggaccuggcccucagccuccuuccccuccaccccaggucggccaggcuggcccugccuugcccugguacagugcugagccgggggcgcggggagagccuuccucacuccacacccaguagcuguccccagcucagcuuagaaacccugccugggggcagcgacguggccucuuccuacagcccccuccccuguuccgcagccgggacucgcgucuccuguggacccggaagauuuagagcacacgucguggggucagcgcccccccgcuggggcggccgggugaacucccgcuggguucguugguuccuucugaggcuccugccccaccgcugccuucaauggacuccuacccagggagucgggccaggagccgaggccuccccgccccacacaaguacucggccuggcccucguccgcggacagucucccagugggguccuggcagggccccucgcccagcgcaguggacauucaggagcuccaaaaccuugggguccaagcaagucagcgcagguguauuucaggcagucgaggcauauggaggggccacuuggguggcacccgcagccccugugguuggcaggacuuggccagggggucuggaugggaagccgauuuggccaccguuugccccaggccccgaagccaucugggagggugcuggccacugucccugcugcccgcguccaggugccugcagguccccacaguggcuuccuuccagccaggcagccugugaacuuggggugccccccuccaccuccucaagacccuuuuguaggugcggaucucccggaucccccacugagaaucacgcccugggggccuggggucuccagcuguggagggaggugaacccaggcccgccuuccagguccgagggugccgcagaaggggccggggcaaugccagggaaggacucaagguggggcccacacacucaggaggauggacccccggccgagccauguuggcugaucagacccagugcgguuuggaaguuucucgccacccaccugccccccugcccggagagagugggucaggcgcccuccucucggcugguaccugcgccucggucucuccuggcaccccgggggucacccgccccgcgcccugcgacagcaccgagcggaggauguggcuccccagccuggccgggggcagugaguggggccccgguguccagccggagagggaggacgcugcgggcagcccccugccuggagccccgcuccgugucgggcccggccuggcguggagccuccguccugccgcggcuuccugcucacacuggcggugcggg

SEQ ID NO: 19492 - RNA, 2571 nt, Homo sapiens
cccgcaccgccagugugagcaggaagccgcggcaggacggaggcuccacgccaggccgggcccgacacggagcggggcuccaggcagggggcugcccgcagcguccucccucuccggcuggacaccggggccccacucacugcccccggccaggcuggggagccacauccuccgcucggugcugucgcagggcgcggggcgggugacccccggggugccaggagagaccgaggcgcagguaccagccgagaggagggcgccugacccacucucuccgggcaggggggcagguggguggcgagaaacuuccaaaccgcacugggucugaucagccaacauggcucggccggggguccauccuccugagugugugggccccaccuugaguccuucccuggcauugccccggccccuucugcggcacccucggaccuggaaggcgggccuggguucaccucccuccacagcuggagaccccaggcccccagggcgugauucucagugggggauccgggagauccgcaccuacaaaagggucuugaggagguggaggggggcaccccaaguucacaggcugccuggcuggaaggaagccacuguggggaccugcaggcaccuggacgcgggcagcagggacaguggccagcacccucccagauggcuucggggccuggggcaaacgguggccaaaucggcuucccauccagacccccuggccaaguccugccaaccacaggggcugcgggugccacccaaguggccccuccauaugccucgacugccugaaauacaccugcgcugacuugcuuggaccccaagguuuuggagcuccugaauguccacugcgcugggcgaggggcccugccaggaccccacugggagacuguccgcggacgagggccaggccgaguacuuguguggggcggggaggccucggcuccuggcccgacucccuggguaggaguccauugaaggcagcgguggggcaggagccucagaaggaaccaacgaacccagcgggaguucacccggccgccccagcgggggggcgcugaccccacgacgugugcucuaaaucuuccggguccacaggagacgcgagucccggcugcggaacaggggagggggcuguaggaagaggccacgucgcugcccccaggcaggguuucuaagcugagcuggggacagcuacuggguguggagugaggaaggcucuccccgcgcccccggcucagcacuguaccagggcaaggcagggccagccuggccgaccugggguggaggggaaggaggcugagggccagguccuuguccaguggggagcugggggccagcaucccugugcccccaacacccucaaccgagcaaacucgggggcucaaggcuuucggggugcccccacuccguagccccugcccuuccucgcuuugugggugcgugcuccugcccccgccacucccacccggaacgcacgcagcgcgcagagcucggggcggccgcgaugccugcucucgcccagcccggcugcuccggggcugcugcaagccggcgacccgggcuccgggugggcgacccccucacaacuccacgggcuccugcggcugcggcgcgcucccagcgcacggagccgggacggcagccggcgccuccccaggacucgcgugcgcucgcccggucgcucagcccgcgucccugccucagucuccccacccaggaaauggguccagggcgccagggcucccgcgcgacgccgacgugcacugcuggggucuucccgguccccgccacccggcccgcggagacccccggcuccggcccaggagcuccgcgcccgucccgcccgcgcgcucaccacucccaggcugagguccucggcgcgcggcgcgggugcgggcgcggcgcagcccccgcggguccccagcgccagcagcagcagcagcggcagcggcagccgcgagaguccgggcccugggggcggcgggccggguccccgggcugcgcggcgccgcauggcgcucacaugggcccgcgggcggcgugcagggucccgcgcccuccgcuucgcguuccgcagcccggcgcccuccgcucuccgcggcgcccccgccggacugagccccgcgcggcagccucaagcggcggggcggggccaugcaaauguaugcuaacgaggccggccgccuuaaagggcccgcgccgccucggacgcugccacccccgcccgccccgccguguccgcgacgggacuggguccgcggcaucacagggaaggcguuuccccgggugucuuaggacgcucuuggggcggcggggacgcgcgggaugggcgcggaggcgggggucggggcgccugcggggagcugacccugacuccccucuccggccgcgcucccggguccaccccccacggcgccgaggcccggguucagacccggguucaggccccggagccgccgccgcagcgcagcaggugggcgcuugguggagcccgcggaccgcgggagagggaggguggggcuuggggggcgcgggggacuggagggcgagggcggguguugggggggcuggggu

SEQ ID NO: 19493 - RNA, 2456 nt, Homo sapiens
uuucauccccaggagugucccacgucaccuuuucugcacccgugccaccuggaccccuaaggggacgguacucugccacacucccacaugccucuccucccaugccacccgucugugucguggccggggaugcaugaccccuuggccuugcgcuaacuucaccagccucgagcgagaccgacaggguguccaaguguguccguccgucugugaaagucgucccugcguuugucugugccugucacugcaugaggucguccgucugcgcgugucugucuccacgggcuucuguccgucugucugucacgugggugucuacuccgccgcugcaggucuuugggucgcgucugucacugcgcucugucgucggucggcgucuggcacuggagugcgucugggccccggggucuccgggucucggcuccaagggagggagagagaggggagguggccacccgggagagcggggaggggcgggggcggagacagugggcgggggcgggcgggggcgcugugaggcccggagggggugugugcggggggccggaggcggcggcugucagagucggcucagccugcgccggggaacaucggccgccuccagcucccggcgcggcccggcccggcccggcucggccgccucaggugagucucccuccccgcccgggacucuccuuaaggcccggguccggggcaccgugcgcuccccgagggguccaggccccccuaacgggacggcucccgcuuccccgggccugccccgcgccgcccuccgcugccccgcacucguccggaacucuuccccggccgccucacacucaccgacgcccacgcaggagcccgagcccgcgggaacggccgccgccucugcgcuccgauucccgcggggacccccgagcaccccuuccccgaucgcucccuaguccggggccacuggaagacacccccuaauuggggcgguacccgagcugcgcagguucccggcgccgggcugggcacccccauccccagggccacaagccagcgccccugcgcagcgccccgcagaggcccccuccgaggcccaggacgcccccucccgcggagacuccaucucuauuuuuugggaaggggaggcucggcggaagccccgaguuauaauuagcgccacucggguuuccuaguuaaucuccagcagcaccaccaccccccgcucagggcggcgggggcugggcuaggagugaccggcgggagaggggggaguucccacccggggaauuuugauccuuuggcuggagaugccggaaccguagcagcugcugcccccaaaauagcgcccccgccccugcagccggggaucuccggagucccgggaacgcaggcgucccggcucgcccuucaggcggcucugcaaggcccucgagcccccaggcccccuccccaaguucccggcuccuggcucggggcggggagcgccgaccuuuucucggucucuacugcccuccgccggcggcggcgugcacggcagcuucagacggauggggggcucucgaguccugggggacgcgggcuggcgagccuguuugcuggggcugggcugggagcgugcgcagcugaugggaacccgcgggcaucagcgcucggugccagacauuggaugagaaggggcaggguuggguggggaguggacuaggcaggauuugggggaccccgggaccugaggcuuccacacccugaaugcccagcccaccgccccccagggccccgggucuggccgacccaggagagcggggcugcgcuucaggccgccgcaagcucccccagcggcgcugcccguccgugaggccgcgcccugucggguggccuguucguggacugaggcuucuggugcccucacugcacgagcugggcccggcccaguuccgggaagaggugagggcaguggaccccugcggagcagagagggugcuccucucuguucccugcauuugucuggauaugggugucugccugaucucuuuccccuccugcccgcuggccuguguccuugucucugccugucuccuucccucccucccucucuccccucaucuuugccaaccugccccaccuccucugcagcugagcgauaacccuugggccgacagugcccuaaucuccucccuccuggcuucucgaccgacccuucacccuuucccuuucuuucucccagcagacgccgccugcccugcagccaugaggcccccgcagugucugcugcacacgccuucccuggcuuccccacuccuucuccuccuccucuggcuccuggguggaggagugggggcugagggccgggaggaugcagagcugcuggugacggugcgugggggccggcugcggggcauucgccugaagacccccgggggcccugucucugcuuuccugggcauccccuuugcggagccacccaugggaccccgucgcuuucugccacc

SEQ ID NO: 19494 - RNA, 2456 nt, Homo sapiens
gguggcagaaagcgacggggucccauggguggcuccgcaaaggggaugcccaggaaagcagagacagggcccccgggggucuucaggcgaaugccccgcagccggcccccacgcaccgucaccagcagcucugcauccucccggcccucagcccccacuccuccacccaggagccagaggaggaggagaaggaguggggaagccagggaaggcgugugcagcagacacugcgggggccucauggcugcagggcaggcggcgucugcugggagaaagaaagggaaagggugaagggucggucgagaagccaggagggaggagauuagggcacugucggcccaaggguuaucgcucagcugcagaggagguggggcagguuggcaaagaugaggggagagagggagggagggaaggagacaggcagagacaaggacacaggccagcgggcaggaggggaaagagaucaggcagacacccauauccagacaaaugcagggaacagagaggagcacccucucugcuccgcagggguccacugcccucaccucuucccggaacugggccgggcccagcucgugcagugagggcaccagaagccucaguccacgaacaggccacccgacagggcgcggccucacggacgggcagcgccgcugggggagcuugcggcggccugaagcgcagccccgcucuccugggucggccagacccggggcccuggggggcggugggcugggcauucaggguguggaagccucaggucccggggucccccaaauccugccuaguccacuccccacccaacccugccccuucucauccaaugucuggcaccgagcgcugaugcccgcggguucccaucagcugcgcacgcucccagcccagccccagcaaacaggcucgccagcccgcgucccccaggacucgagagccccccauccgucugaagcugccgugcacgccgccgccggcggagggcaguagagaccgagaaaaggucggcgcuccccgccccgagccaggagccgggaacuuggggagggggccugggggcucgagggccuugcagagccgccugaagggcgagccgggacgccugcguucccgggacuccggagauccccggcugcaggggcgggggcgcuauuuugggggcagcagcugcuacgguuccggcaucuccagccaaaggaucaaaauuccccgggugggaacuccccccucucccgccggucacuccuagcccagcccccgccgcccugagcggggggugguggugcugcuggagauuaacuaggaaacccgaguggcgcuaauuauaacucggggcuuccgccgagccuccccuucccaaaaaauagagauggagucuccgcgggagggggcguccugggccucggagggggccucugcggggcgcugcgcaggggcgcuggcuuguggcccuggggaugggggugcccagcccggcgccgggaaccugcgcagcucggguaccgccccaauuagggggugucuuccaguggccccggacuagggagcgaucggggaaggggugcucggggguccccgcgggaaucggagcgcagaggcggcggccguucccgcgggcucgggcuccugcgugggcgucggugagugugaggcggccggggaagaguuccggacgagugcggggcagcggagggcggcgcggggcaggcccggggaagcgggagccgucccguuaggggggccuggaccccucggggagcgcacggugccccggacccgggccuuaaggagagucccgggcggggagggagacucaccugaggcggccgagccgggccgggccgggccgcgccgggagcuggaggcggccgauguuccccggcgcaggcugagccgacucugacagccgccgccuccggccccccgcacacacccccuccgggccucacagcgcccccgcccgcccccgcccacugucuccgcccccgccccuccccgcucucccggguggccaccuccccucucucucccucccuuggagccgagacccggagaccccggggcccagacgcacuccagugccagacgccgaccgacgacagagcgcagugacagacgcgacccaaagaccugcagcggcggaguagacacccacgugacagacagacggacagaagcccguggagacagacacgcgcagacggacgaccucaugcagugacaggcacagacaaacgcagggacgacuuucacagacggacggacacacuuggacacccugucggucucgcucgaggcuggugaaguuagcgcaaggccaaggggucaugcauccccggccacgacacagacggguggcaugggaggagaggcaugugggaguguggcagaguaccguccccuuagggguccagguggcacgggugcagaaaaggugacgugggacacuccuggggaugaaa

SEQ ID NO: 19495 - RNA, 2630 nt, Homo sapiens
ccggcgguggggccccuccgggcggccaggcggagcugcgcgaggcggcgcacacggcgucuuggcggggaggagacaggccgcggaagaaauagaaagggggaaagaaaaaagggaaaaaaaaauaaaguaacaaguuucagaaagucgccucgcccuucaggaucggggggugccgacugaguggccagaaaugaaaucgggaguagccccuuuccacugaaaaaugaaauccaaacuccuuccgccggcggcuucaggcucccgggaccuggcucggaaaagugaccggcggcgguggcgcgcugcgccccagcccggacucugccucggcggcugccggguccucccgaaaccggggagggcuccucggcugcgcccagacggcguaaauacaaaccuccuauuuuauuccuaggcgucaaaugcuccgggguuuaaaaccgugaagccuugccacaaacgguccgaagugucucccaaaacacucuggcacuaucugauccgcaaaguuuaauauuuaaccuuuuggagaccucgccucccuuuuccgaguuugguuuuuccugagcucgccuugaaccgccgacggaaugguguuuuucugggggugggaggagggaggguccaaagcggguuuauuauuuuuaaagaggcucgugguccccccccuuucuccccccggggggcacugugagucccagagcucgaguccgaggacccgagacguggcauucucgccuaaggacuggaaagaauccuacaaaacaagcuuugguuucauuuuccaacgcccuggccugagcuccugcagcccgaggaccuggccuggcgugggggauuugggggaugucaagaggggaaggaaagggaucaagggucucgcuccuacucuagcuuccccccccacaaccaccccccaaaauaaccuacaaagaaagccuuugcaacgcgggccugccaaggggcgccucccccaccuuuggguaaaucccccuguaguuccagguuaaagcuguuuguuuaaaagauuuguccuuugccgauucucgugaggaugggagggggucuuggagcccacccuucccucgaucucugucugcagcagcucacauuccugauuccgggaggccugggcucucuuaagagaagccgaucacgccaaagccaccggcucccgggugcccgcccggcgcccugcacuccgcgcccagccccccgagcaggagacccccucggcugcaaaaccccuagccaaacccgccggccuuccucuccagccucccuccccaacuuugcuaagggugccuauuuuaacccgguuuugguuacaaacacccccucccucccucucucccaucaggcucugguuaccagauucgcguuuacuuuggaaaaaucuaagaucgccacauccgaggauacaugucuuaaggaggcgaugagcuucccgugauuuuuuuuuguaagagauucuuuggguagcuuucuuuaaaagccagcgccucguaguaugcccaggcgccccaguuuggggaagucggggugaagcccccuggaacacccucacacuggcaaagaagcugccucggcuaucugcgggcuccgcugcguucuccuuacuuuucucccccucuuaaauggaguuaaaauggcugaauuccggcuuuuaauuaaaaacagccuauaaucgaaaacgucucggcgucccgggcucccccgccgccugcugggaaccgagagaggaaccgccgccccucggccgggccaggagggccggagcggggcugggggcucgcgugggugcccggggcccagcagcccacccccaccccucccggggcgcccccuccccgccggcccugguccccgauucugcaauccggagccagacaguagcggggauccccccccgcgcaccccgaggggcaggcgugguuggggggcgagcuggagaaguuuggagaccaucgcgcccggccgggggccggcaggcugaccggcggcguaccuggcgcggcuggguucacggcuccaggcuccggcgacaacgacuccggcggcggccccggcucccggcgcagcuaggcgccccugcugcccgccaucccgcggccgccgcuccccuccgccacccgcagccgccucacacuuuuugcccgccuuuccuuuuuuugguagaaaaccgcuccccgggccgagcgcucggcgcgccaacuccuccgcccucccgcggcccggcucccgcagcccccggaaaagccagcuuuccucccgccgagcuccccgcuuuuuaauaaaauccagguagcgccgguuuaaagaaucccaaaucuccauauacagcccgggauuggaaaagguacauuacacaaccccccuuucaaguuccucucgcaggaucuaaaaaaaaaaaaaaaaaggcagcggaggggggugguuggaggggguugggggagggggagcccucuccggcaaagaaacacgcauuguucccgggugcccgcccccccccccagcccggcccccggccgccgcgcauuggccgcgcgcgccgccaaucacgcgcauguaaacaccuuggcccacagccauuccuauaaaaccaauuacggaccuaggggcuccag

SEQ ID NO: 19496 - RNA, 2630 nt, Homo sapiens
cuggagccccuagguccguaauugguuuuauaggaauggcugugggccaagguguuuacaugcgcgugauuggcggcgcgcgcggccaaugcgcggcggccgggggccgggcugggggggggggcgggcacccgggaacaaugcguguuucuuugccggagagggcucccccucccccaacccccuccaaccaccccccuccgcugccuuuuuuuuuuuuuuuuuagauccugcgagaggaacuugaaagggggguuguguaauguaccuuuuccaaucccgggcuguauauggagauuugggauucuuuaaaccggcgcuaccuggauuuuauuaaaaagcggggagcucggcgggaggaaagcuggcuuuuccgggggcugcgggagccgggccgcgggagggcggaggaguuggcgcgccgagcgcucggcccggggagcgguuuucuaccaaaaaaaggaaaggcgggcaaaaagugugaggcggcugcggguggcggaggggagcggcggccgcgggauggcgggcagcaggggcgccuagcugcgccgggagccggggccgccgccggagucguugucgccggagccuggagccgugaacccagccgcgccagguacgccgccggucagccugccggcccccggccgggcgcgauggucuccaaacuucuccagcucgccccccaaccacgccugccccucggggugcgcggggggggauccccgcuacugucuggcuccggauugcagaaucggggaccagggccggcggggagggggcgccccgggaggggugggggugggcugcugggccccgggcacccacgcgagcccccagccccgcuccggcccuccuggcccggccgaggggcggcgguuccucucucgguucccagcaggcggcgggggagcccgggacgccgagacguuuucgauuauaggcuguuuuuaauuaaaagccggaauucagccauuuuaacuccauuuaagagggggagaaaaguaaggagaacgcagcggagcccgcagauagccgaggcagcuucuuugccagugugaggguguuccagggggcuucaccccgacuuccccaaacuggggcgccugggcauacuacgaggcgcuggcuuuuaaagaaagcuacccaaagaaucucuuacaaaaaaaaaucacgggaagcucaucgccuccuuaagacauguauccucggauguggcgaucuuagauuuuuccaaaguaaacgcgaaucugguaaccagagccugaugggagagagggagggaggggguguuuguaaccaaaaccggguuaaaauaggcacccuuagcaaaguuggggagggaggcuggagaggaaggccggcggguuuggcuagggguuuugcagccgagggggucuccugcucggggggcugggcgcggagugcagggcgccgggcgggcacccgggagccgguggcuuuggcgugaucggcuucucuuaagagagcccaggccucccggaaucaggaaugugagcugcugcagacagagaucgagggaagggugggcuccaagacccccucccauccucacgagaaucggcaaaggacaaaucuuuuaaacaaacagcuuuaaccuggaacuacagggggauuuacccaaaggugggggaggcgccccuuggcaggcccgcguugcaaaggcuuucuuuguagguuauuuuggggggugguuguggggggggaagcuagaguaggagcgagacccuugaucccuuuccuuccccucuugacaucccccaaaucccccacgccaggccagguccucgggcugcaggagcucaggccagggcguuggaaaaugaaaccaaagcuuguuuuguaggauucuuuccaguccuuaggcgagaaugccacgucucggguccucggacucgagcucugggacucacagugccccccggggggagaaaggggggggaccacgagccucuuuaaaaauaauaaacccgcuuuggacccucccuccucccacccccagaaaaacaccauuccgucggcgguucaaggcgagcucaggaaaaaccaaacucggaaaagggaggcgaggucuccaaaagguuaaauauuaaacuuugcggaucagauagugccagaguguuuugggagacacuucggaccguuuguggcaaggcuucacgguuuuaaaccccggagcauuugacgccuaggaauaaaauaggagguuuguauuuacgccgucugggcgcagccgaggagcccuccccgguuucgggaggacccggcagccgccgaggcagaguccgggcuggggcgcagcgcgccaccgccgccggucacuuuuccgagccaggucccgggagccugaagccgccggcggaaggaguuuggauuucauuuuucaguggaaaggggcuacucccgauuucauuucuggccacucagucggcaccccccgauccugaagggcgaggcgacuuucugaaacuuguuacuuuauuuuuuuuucccuuuuuucuuucccccuuucuauuucuuccgcggccugucuccuccccgccaagacgccgugugcgccgccucgcgcagcuccgccuggccgcccggaggggccccaccgccgg

SEQ ID NO: 19497 - RNA, 2728 nt, Homo sapiens
ggggaccguugcauccggaggcggccgucgugcggcuccuucccgccucgagagugagguggccgggccuugacgagaaggcccacgccugccgcggggguggcucgcgauggcagucgggguucgagucccgccuggggggcugcuccugcuggagaaaacgccucccugagggcggcggcaaacgcgcagcgaggccccgugccgcgccagaagccacccugagaaaggggcaccgggacaccgagggguucccacuuucuccucagccugugacgcccgcguccucggguggguucgaggggcgccugggcacggccagccgaggcucucgagagccccagugucguuuuccaccucaggccuccuuuccugaggcagagcccgggaccucgcgcucucgccucaggcuccggcccacgcucccgcccggccgccaggcgcgcaacggaaagcgcccccgccccgccccgcuccgcccacugcgugacgcgcacccggccgagccaaucagagcucguggcgcgcgccccacacgccggcccccuccgccccucagcuuaagaaagggcgcgcggacccggcaggccagagugccgagcagcgcggugggugcggcugugagacggcaggagacuucugccccgcggugcacgcgacccucgagacgacagcgcggcuacugccagcagcgaaggcgccucccgcggagcgccccgacggcgcccgcucgcccaugccgagcugagcgcggcagcggcggcgggaugcuggcgcugcuggccgccagcguggcgcucgccguggccgcuggggcccaggacagcccggcgcccgguagccgcuucgugugcacggcacugcccccagaggcggugcacgccggcugcccgcugcccgcgaugcccaugcagggcggcgcgcagagucccgaggaggagcugagggccgcggugcugcagcugcgcgagaccgucgugcagcagaaggagacgcugggcgcgcagcgcgaggccauccgcgagcucacgggcaagcuagcgcgcugcgaggggcuggcgggcggcaaggcgcgcggcgcgggggccacgggcaaggacacuaugggcgaccugccgcgggaccccggccacgucguggagcagcucagccgcucgcugcagacccucaaggaccgccuggagagccucgagguagcggcccgcggggagcgcgggggaccuggaauggggacgcucccgagucgggggcggaagacucgggaggauggggaaagggggccuggcccuggggagggugugaucguccgugggggugagcuggacuugagggugaaaggcggggaucuagauccugcucgggaacuccccugcgugguaucccuucccacaccgcugcucuugcuggaaggaaacguuuaaauuccacccccgcgcgucgggacugccagcgggauccgccgagcacuucccgagguccgggcuagcgaacccagacggccaagccgcgggcgccaaauacccggggacgcgguagccucuauccucuugcaaaucuccaaaucuccgcgagccgggaugcgcucccgcaggccgugcggguugcugcgaggcugccgcgggaggucagcugccccgggcaugugguguuucuuucuuuaaaucaggucaggcugagcuagagggggcggaagucugggggcggaggucgcagggaggcgagcgcagggggucaccggcgaccccagagcgcgcauuagaggggcaaccucugguuaacuucaaagacucccgugucugcaaguuggaccauuuuaaggugcucuuccggauugcuucaggggaagggaccucauucccuucucucucucucucucccccccucccccccucccccuccgucccccccccccgccccccgcucccgccuccgucucaucucuaucucugaaaaugcgugcaguuuggaacuuugagagaaaaaucuucaauuauuuuucaucuuuaggcuccacccuuuuuaagaaguguggacacugcuguuaauagccuuugugaaaauacuucucagcaaaacuagguuuaaauuacaggugguaauuauugcaaaaaugacucuaggguuucuuuuggcgugagggcugaauacaguauuuccagcaucuguauauccccugauucauugugauugcuaacagcuaacauuucuggagcacuaaauaugagucaggcacaucauuuaauuuuuuaauccuuggaacaaugaauggcaugaggcaggucccauuaugugcauuucacaauuuggaacacuuuguggagaaagguaaauagcuugccaugaacucauggguaggcagccugccacagccuccagaaccacaugaugguaggggagaaagagaaauaggaagugaggauuuagaaacagcauuaaaaacaaagauugcuggaguucagaauagcaacguuuuagaucugucauuuuccagaaacaucucugcaugcauaguuauuuaccuuggugccagaccggaacuugggggcuguuuucauuucuaggugaaagcuccuuggcuuuguguaaccaucgauuuacucuuaaaaaagaaaaaaaauccuggagcugaguuuuggucucuacccaacauagaauucuaggcguugguuagaauauugacuuuuuaguaagaggagaaaaacggcuuuuugagaagggaaaauuagau

SEQ ID NO: 19498 - RNA, 2728 nt, Homo sapiens
aucuaauuuucccuucucaaaaagccguuuuucuccucuuacuaaaaagucaauauucuaaccaacgccuagaauucuauguuggguagagaccaaaacucagcuccaggauuuuuuuucuuuuuuaagaguaaaucgaugguuacacaaagccaaggagcuuucaccuagaaaugaaaacagcccccaaguuccggucuggcaccaagguaaauaacuaugcaugcagagauguuucuggaaaaugacagaucuaaaacguugcuauucugaacuccagcaaucuuuguuuuuaaugcuguuucuaaauccucacuuccuauuucucuuucuccccuaccaucaugugguucuggaggcuguggcaggcugccuacccaugaguucauggcaagcuauuuaccuuucuccacaaaguguuccaaauugugaaaugcacauaaugggaccugccucaugccauucauuguuccaaggauuaaaaaauuaaaugaugugccugacucauauuuagugcuccagaaauguuagcuguuagcaaucacaaugaaucaggggauauacagaugcuggaaauacuguauucagcccucacgccaaaagaaacccuagagucauuuuugcaauaauuaccaccuguaauuuaaaccuaguuuugcugagaaguauuuucacaaaggcuauuaacagcaguguccacacuucuuaaaaaggguggagccuaaagaugaaaaauaauugaagauuuuucucucaaaguuccaaacugcacgcauuuucagagauagagaugagacggaggcgggagcggggggcgggggggggggacggagggggagggggggagggggggagagagagagagagaagggaaugaggucccuuccccugaagcaauccggaagagcaccuuaaaaugguccaacuugcagacacgggagucuuugaaguuaaccagagguugccccucuaaugcgcgcucuggggucgccggugacccccugcgcucgccucccugcgaccuccgcccccagacuuccgcccccucuagcucagccugaccugauuuaaagaaagaaacaccacaugcccggggcagcugaccucccgcggcagccucgcagcaacccgcacggccugcgggagcgcaucccggcucgcggagauuuggagauuugcaagaggauagaggcuaccgcguccccggguauuuggcgcccgcggcuuggccgucuggguucgcuagcccggaccucgggaagugcucggcggaucccgcuggcagucccgacgcgcggggguggaauuuaaacguuuccuuccagcaagagcagcggugugggaagggauaccacgcaggggaguucccgagcaggaucuagauccccgccuuucacccucaaguccagcucacccccacggacgaucacacccuccccagggccaggcccccuuuccccauccucccgagucuuccgcccccgacucgggagcguccccauuccaggucccccgcgcuccccgcgggccgcuaccucgaggcucuccaggcgguccuugagggucugcagcgagcggcugagcugcuccacgacguggccggggucccgcggcaggucgcccauaguguccuugcccguggcccccgcgccgcgcgccuugccgcccgccagccccucgcagcgcgcuagcuugcccgugagcucgcggauggccucgcgcugcgcgcccagcgucuccuucugcugcacgacggucucgcgcagcugcagcaccgcggcccucagcuccuccucgggacucugcgcgccgcccugcaugggcaucgcgggcagcgggcagccggcgugcaccgccucugggggcagugccgugcacacgaagcggcuaccgggcgccgggcuguccugggccccagcggccacggcgagcgccacgcuggcggccagcagcgccagcaucccgccgccgcugccgcgcucagcucggcaugggcgagcgggcgccgucggggcgcuccgcgggaggcgccuucgcugcuggcaguagccgcgcugucgucucgagggucgcgugcaccgcggggcagaagucuccugccgucucacagccgcacccaccgcgcugcucggcacucuggccugccggguccgcgcgcccuuucuuaagcugaggggcggagggggccggcguguggggcgcgcgccacgagcucugauuggcucggccgggugcgcgucacgcagugggcggagcggggcggggcgggggcgcuuuccguugcgcgccuggcggccgggcgggagcgugggccggagccugaggcgagagcgcgaggucccgggcucugccucaggaaaggaggccugagguggaaaacgacacuggggcucucgagagccucggcuggccgugcccaggcgccccucgaacccacccgaggacgcgggcgucacaggcugaggagaaagugggaaccccucggugucccggugccccuuucucaggguggcuucuggcgcggcacggggccucgcugcgcguuugccgccgcccucagggaggcguuuucuccagcaggagcagccccccaggcgggacucgaaccccgacugccaucgcgagccacccccgcggcaggcgugggccuucucgucaaggcccggccaccucacucucgaggcgggaaggagccgcacgacggccgccuccggaugcaacggucccc

SEQ ID NO: 19499 - RNA, 2669 nt, Homo sapiens
ucugucccauuguugcagaaacauccaacugauugcacuuuuucuucuucucucgucaacucguaacuccuaucucaaguucacccacaggucuagugacuccggcuggcugcugcggggcgaggagacucgcagaaugccugacuagaggccacucgcgcgcucuggacgguggccguaucuccagggucugagccccggagccgcaguccugccgcagagcgccuggagccgcgagcagcuagcagcccggcgaagcgcacagccucggcgauagucagcuccgcggccucugcucccgccccucccggccgcuccgggaaggggcggagacgaggaggagcugggacggccgccgcgcucccgggcgcaccaagcccuuuaaaagccgcgggccuugacaguucugcaggcagccgccgcggucccggaccucuagucccgcacucccagcuggcgagccggcuccgggugcggcgaggcccagcccucucggauugcgcgccggaccccgggacgcgcuccaugcggccgcucagcauguccgggcacuuucugcucgcacccauccccgaguccuccucggacuaccuacugcccaaggacaucaaacuggcggugcugggcgccggccgcgugggcaagagcggugagugcggcggggacccccgggcggcuucgcuccccggcuccggccgcgaccacugggggcgcugcggagagagggcgccucggccgaagcagagggcgcgggugcagguagaaucgggcugcuuucgcgcugggugggucccgguccgucccggccugcuucccuggcguuuccuggugcaucuacuccugggaucucggcgggauuggcgccuguucggggauggggugcgggagaggugucccgccagucguacucgcggccaagcccgcggcaccacggcuuugcggagccucuggaagcgagcagugcccacgguucugcacccuucacuccccccaguuuguccgaggugccuggguuugacaggcuuguucuacuccuucgguugauuuuccuauuuccuuuucagcaaugaucgugcgcuuccugaccaagagauucauuggagacuaugaaccgaauacaggugagaauacuuucacgcucccugcuuuuaugcuugcguguuucuuuuuacggaugggaguuugagaauuaaaaagcaaacucuacuucauucuccaggcaagcuguauucacggcuggucuaugucgagggggaccagcucucccugcagauccaggauacucccgggggcguccagguaagaaccgccaggggcaaacagcucacccccacccgugagaccaccccagugggcacagcacguagggcgcccaugcugggcgcaggggucugagcaaggcaucuaaaccgaccugugcguuuagagggaggaaugggcuguccacagguggggccagugguugggguguuagaaacucucuaagggggaggcaugguuagaagcagccuccucuuguuaagcaccugacuuaacuucacuuugcaacccuggugggccaucacuacuuaagcaggucucaccauuucuuccggagguagccauggaaccauuaacaaagaaaaaaacguuuaaaacaaaacaaaacaaaacaaaaaaagagguaggauucugaugggagagacucuucuccccuggcaagcucugcuuuuuuugagacggaguuucacucuugcccaggcuggagugcaguggcuggaucucagcucacugcaacuuccgccuccuagguuccagcgauucuccucgauucuccugcuucagucucccgaguagcugggacuacaggcacccgccggaacucccagcuauuuaucuauuuauuuauuuauuaguagagaugggguuucacuauguuggccaggcuggucucgaacuccugaccucaagugauccgcccaccucggccucccaaaguggugggauuauaggcaugagccacagcgcccggcccaagcacugcugaacugcugcuguuaauggcuguucccucaagucaguaauugcaaucagauaaccccuuggcagagggucuagaauguaacuuguuuauuaaccaguuacuaauugcuacuccguucuccagaggaaaggucuuguggaagaacccuaagaaaggaauuucuuucuguaacauucuuaagaagugcauguuaaaaauguuuuuaugaguuugggaauagauauuuaucuuggcuuauuuucaaaguuuuguuuauuaugaguuaguguuuccuaaaacuugagccauucugguuugaggucauucuucagucagccaugguucaccagagacugccugacaagcaagggguuuaaaaauaaugcagggauaacagcuaauaaaguaacucaggcagggaguuugccugggaaucuguucuuuccauaucaaaagccugcuucugcagaagcuggguggaaacugaaaacuguauuuagagauuucuuuuucaaguguuucuucaaggguugccuugauguuguuuugaguuuaucucccacugaggguuuccuugacuggaucucauuuugauguuuucucagauccaagacagccucccccaggucgucgauucccuguccaaaugcgugcagugggccgaggg

SEQ ID NO: 19500 - RNA, 2669 nt, Homo sapiens
cccucggcccacugcacgcauuuggacagggaaucgacgaccugggggaggcugucuuggaucugagaaaacaucaaaaugagauccagucaaggaaacccucagugggagauaaacucaaaacaacaucaaggcaacccuugaagaaacacuugaaaaagaaaucucuaaauacaguuuucaguuuccacccagcuucugcagaagcaggcuuuugauauggaaagaacagauucccaggcaaacucccugccugaguuacuuuauuagcuguuaucccugcauuauuuuuaaaccccuugcuugucaggcagucucuggugaaccauggcugacugaagaaugaccucaaaccagaauggcucaaguuuuaggaaacacuaacucauaauaaacaaaacuuugaaaauaagccaagauaaauaucuauucccaaacucauaaaaacauuuuuaacaugcacuucuuaagaauguuacagaaagaaauuccuuucuuaggguucuuccacaagaccuuuccucuggagaacggaguagcaauuaguaacugguuaauaaacaaguuacauucuagacccucugccaagggguuaucugauugcaauuacugacuugagggaacagccauuaacagcagcaguucagcagugcuugggccgggcgcuguggcucaugccuauaaucccaccacuuugggaggccgaggugggcggaucacuugaggucaggaguucgagaccagccuggccaacauagugaaaccccaucucuacuaauaaauaaauaaauagauaaauagcugggaguuccggcgggugccuguagucccagcuacucgggagacugaagcaggagaaucgaggagaaucgcuggaaccuaggaggcggaaguugcagugagcugagauccagccacugcacuccagccugggcaagagugaaacuccgucucaaaaaaagcagagcuugccaggggagaagagucucucccaucagaauccuaccucuuuuuuuguuuuguuuuguuuuguuuuaaacguuuuuuucuuuguuaaugguuccauggcuaccuccggaagaaauggugagaccugcuuaaguagugauggcccaccaggguugcaaagugaaguuaagucaggugcuuaacaagaggaggcugcuucuaaccaugccucccccuuagagaguuucuaacaccccaaccacuggccccaccuguggacagcccauuccucccucuaaacgcacaggucgguuuagaugccuugcucagaccccugcgcccagcaugggcgcccuacgugcugugcccacugggguggucucacgggugggggugagcuguuugccccuggcgguucuuaccuggacgcccccgggaguauccuggaucugcagggagagcuggucccccucgacauagaccagccgugaauacagcuugccuggagaaugaaguagaguuugcuuuuuaauucucaaacucccauccguaaaaagaaacacgcaagcauaaaagcagggagcgugaaaguauucucaccuguauucgguucauagucuccaaugaaucucuuggucaggaagcgcacgaucauugcugaaaaggaaauaggaaaaucaaccgaaggaguagaacaagccugucaaacccaggcaccucggacaaacuggggggagugaagggugcagaaccgugggcacugcucgcuuccagaggcuccgcaaagccguggugccgcgggcuuggccgcgaguacgacuggcgggacaccucucccgcaccccauccccgaacaggcgccaaucccgccgagaucccaggaguagaugcaccaggaaacgccagggaagcaggccgggacggaccgggacccacccagcgcgaaagcagcccgauucuaccugcacccgcgcccucugcuucggccgaggcgcccucucuccgcagcgcccccaguggucgcggccggagccggggagcgaagccgcccggggguccccgccgcacucaccgcucuugcccacgcggccggcgcccagcaccgccaguuugauguccuugggcaguagguaguccgaggaggacucggggaugggugcgagcagaaagugcccggacaugcugagcggccgcauggagcgcgucccgggguccggcgcgcaauccgagagggcugggccucgccgcacccggagccggcucgccagcugggagugcgggacuagagguccgggaccgcggcggcugccugcagaacugucaaggcccgcggcuuuuaaagggcuuggugcgcccgggagcgcggcggccgucccagcuccuccucgucuccgccccuucccggagcggccgggaggggcgggagcagaggccgcggagcugacuaucgccgaggcugugcgcuucgccgggcugcuagcugcucgcggcuccaggcgcucugcggcaggacugcggcuccggggcucagacccuggagauacggccaccguccagagcgcgcgaguggccucuagucaggcauucugcgagucuccucgccccgcagcagccagccggagucacuagaccugugggugaacuugagauaggaguuacgaguugacgagagaagaagaaaaagugcaaucaguuggauguuucugcaacaaugggacaga

SEQ ID NO: 19501 - RNA, 2540 nt, Homo sapiens
gcugacuggagacagcauacuuuugggguguaagggcgauaauagaaagaaggggaccaggaccaaguggacagaggauaugagggugugcgcccauggggaucuguagaagagaggccgcgggggugcaaaaucaguaaggugaacgggcugauggccaaugcaaagccaaaggggaguaagaaauaaagagaaaggaaagaauauuaaaucgcgggagaaugagaaaauaaacccgcaaaagggagaggagggggcgagggcgccuguuacggcgugggugggguugacaagaauagaguacauuaugcaguucauuuaguuaacaagugaaauaaugaggaagcgugcagagugaaugccaagagaaaaggcacaaaaacccuauugagaggccccggccgcuccuggcguaguccaucacauggcaauaguccuauuuaagccgcgccgccggcgccuuucagcaccacuagcgcuggccagcaccccgcgcucuuugggcggugcccacggcagcagaggcuacuguuucagccuaggucucagccgcgcguucagccuccugggcagaggcagcugcgggauaccgcggccagggaaagcgcguggagagccgaaaggugcggugggcgcagagggcgggcuggcugcggggcgaccgcgcgccggggccaugccgcgcuccuuccugguggacucgcuagugcugcgcgaggcgggcgagaagaaggcgcccgagggcagcccgccgccgcucuuccccuacgcugugcccccgccgcacgcgcugcacggucucucgccuggcgccugccacgcgcgcaaggcugggcugcugugcgugugcccgcucugcgucaccgccucgcagcugcaugggccccccgggccgcccgcgcugccucuacucaaggcuuccuucccacccuucggcucgcaguacugccacgcgccccugggccgccagcacucugcugugucgcccggggucgcucacggcccggccgccgcugcugcugccgccgcgcucuaccagaccuccuacccgcugccugaccccaggcaguuccacugcaucucuguggguaagcggggccgccgcgcagagggaccgggcagaggugauccgaagcaggauggagagccagagauggaggaagagggacccugggcuuucugggggcggugagggucaugucggggacuaaggggggcgcuugggguggagugaggauagagggccgggacacaacgccaggaggcggaugagggcagacguccagguccuggagugugggccgggguaagugagggcugggauccaaggcucuccaugaaggggaagggguuccagggcugcaugacuccgggagaaucaggaucucggagcuggacaaggagcgcucacuguagcucugcuguggauuguguuggggcgaagagauggguaagaggucaaagucguaggauucuggcgaccgccuaccaagggauuggguccacagcacagaggucugaucgcuuccuucucugcucugccaccuccagacagcagcucuaaccagcugcccagcagcaagaggaugcgcacggcuuucaccagcacgcagcugcuagagcuggagcgcgaguucgcuucuaauauguaccugucccgccuacgucgcaucgagaucgcgaccuaccugaaucuguccgagaagcaggugaagaucugguuucagaaccgccgagugaagcacaagaaggagggcaagggcagcaaccaucguggcggcggcggcgggggugccggugguggcgggagcgcaccgcaaggcugcaagugcgcaucgcucuccucagccaagugcuccgaggaugacgacgaauugcccaugucuccguccuccucagggaaggacgaccgggaucuuacggucacucccuaggcgcgugucucccuaggucgcccaccccaagaccucccugcgccucggagacuaguccugggacucagcgcugauucccaggcacccgcagccaaaccacugccuggcauggauuuggcacugcuuugcagaggucccgggccugggcagggcugagagcuuggcagagacuggaccauggcguccccgccccagggcucgcucguguccaaagccaacuccaagcugugaacacuguaagcgcucgaguccuccugggcagugcagcaccgcggcccccgcccgcaagccugcuuggcgcagcgccuugcuggcagccggcgccuccuagcccgcccucucugggcuggcuugggcuuccucgcuuacucuacucuccuccgcucucggucaaggucggcggccuuggaugcucguucgcuucucuuuuuaaaaugucuuuuugucccuccccaccucuuuccugugaucauuuauucacucggcccccgcccgccaacacacacauuuaugaacccccacuuuuuuuuuccuucuccuuuucccuuccccuccucagggagccuccuccuucagucaguccauuugucccuugaucuggccuug

SEQ ID NO: 19502 - RNA, 2540 nt, Homo sapiens
caaggccagaucaagggacaaauggacugacugaaggaggaggcucccugaggaggggaagggaaaaggagaaggaaaaaaaaaguggggguucauaaauguguguguuggcgggcgggggccgagugaauaaaugaucacaggaaagagguggggagggacaaaaagacauuuuaaaaagagaagcgaacgagcauccaaggccgccgaccuugaccgagagcggaggagaguagaguaagcgaggaagcccaagccagcccagagagggcgggcuaggaggcgccggcugccagcaaggcgcugcgccaagcaggcuugcgggcgggggccgcggugcugcacugcccaggaggacucgagcgcuuacaguguucacagcuuggaguuggcuuuggacacgagcgagcccuggggcggggacgccaugguccagucucugccaagcucucagcccugcccaggcccgggaccucugcaaagcagugccaaauccaugccaggcagugguuuggcugcgggugccugggaaucagcgcugagucccaggacuagucuccgaggcgcagggaggucuuggggugggcgaccuagggagacacgcgccuagggagugaccguaagaucccggucguccuucccugaggaggacggagacaugggcaauucgucgucauccucggagcacuuggcugaggagagcgaugcgcacuugcagccuugcggugcgcucccgccaccaccggcacccccgccgccgccgccacgaugguugcugcccuugcccuccuucuugugcuucacucggcgguucugaaaccagaucuucaccugcuucucggacagauucagguaggucgcgaucucgaugcgacguaggcgggacagguacauauuagaagcgaacucgcgcuccagcucuagcagcugcgugcuggugaaagccgugcgcauccucuugcugcugggcagcugguuagagcugcugucuggagguggcagagcagagaaggaagcgaucagaccucugugcuguggacccaaucccuugguaggcggucgccagaauccuacgacuuugaccucuuacccaucucuucgccccaacacaauccacagcagagcuacagugagcgcuccuuguccagcuccgagauccugauucucccggagucaugcagcccuggaaccccuuccccuucauggagagccuuggaucccagcccucacuuaccccggcccacacuccaggaccuggacgucugcccucauccgccuccuggcguugugucccggcccucuauccucacuccaccccaagcgccccccuuaguccccgacaugacccucaccgcccccagaaagcccagggucccucuuccuccaucucuggcucuccauccugcuucggaucaccucugcccggucccucugcgcggcggccccgcuuacccacagagaugcaguggaacugccuggggucaggcagcggguaggaggucugguagagcgcggcggcagcagcagcggcggccgggccgugagcgaccccgggcgacacagcagagugcuggcggcccaggggcgcguggcaguacugcgagccgaagggugggaaggaagccuugaguagaggcagcgcgggcggcccggggggcccaugcagcugcgaggcggugacgcagagcgggcacacgcacagcagcccagccuugcgcgcguggcaggcgccaggcgagagaccgugcagcgcgugcggcgggggcacagcguaggggaagagcggcggcgggcugcccucgggcgccuucuucucgcccgccucgcgcagcacuagcgaguccaccaggaaggagcgcggcauggccccggcgcgcggucgccccgcagccagcccgcccucugcgcccaccgcaccuuucggcucuccacgcgcuuucccuggccgcgguaucccgcagcugccucugcccaggaggcugaacgcgcggcugagaccuaggcugaaacaguagccucugcugccgugggcaccgcccaaagagcgcggggugcuggccagcgcuaguggugcugaaaggcgccggcggcgcggcuuaaauaggacuauugccaugugauggacuacgccaggagcggccggggccucucaauaggguuuuugugccuuuucucuuggcauucacucugcacgcuuccucauuauuucacuuguuaacuaaaugaacugcauaauguacucuauucuugucaaccccacccacgccguaacaggcgcccucgcccccuccucucccuuuugcggguuuauuuucucauucucccgcgauuuaauauucuuuccuuucucuuuauuucuuacuccccuuuggcuuugcauuggccaucagcccguucaccuuacugauuuugcacccccgcggccucucuucuacagauccccaugggcgcacacccucauauccucuguccacuugguccugguccccuucuuucuauuaucgcccuuacaccccaaaaguaugcugucuccagucagc

SEQ ID NO: 19503 - RNA, 2458 nt, Homo sapiens
acgaugaugguuugguuuacaugaaguucaaacauaggcaaaagcaauccauggcaucagaagucagaauaguggcuaccuggggaggggguacugacagagaggguggagcuagaauugcucuauaucucagucugaucgugguuauuugggcacguacauaugugaaaacuaaugaaauuguacucuuaagaugugugcauauuuacugugugccaauuauacuucauuuagaaauaucuggagagagagacauagaaauuucugaauucuuuccuaaauagaaaagaauuccaugcagcuuaaauaucguugcaaguauugaugcuuauaccuuuagaaagcccauuaugcuucugaaaaaugcacuuacuacuuaauaucauacauaauagaaagcuaacauuuuguauuaacggaaucuggaaaacauauuguacuacacauuugaaauuacagauuuacuaacuaguaaagauaacuauuuaagaacuaaaaugucuuuguuuuucaacucuuuucccccgauuuccauuuuuuacuuuuuauauuucagaauuauuuguaacaaaagcuauuggauauaauuccugcacuucuauauugcaagcauuuucucuauuuaccacagagacuucaaguccuagcauuucagagcugaaggggacucggacggacucccucacugcacagaugaggacgcggaggccgggggaggugagugucagucccaagguugcagaccuaggacagggaccggagcugccgggcacccagaacucugucgccuucaacccaaauucgauucaguccucucaucuuuccaaauagaaagcugacgcgaaccgaugggaagauuuuuuuuuucaauaacaacuaugcuacccagcagauucuuuggggacaguccucggaguccuugaaaaccccuuugggguuuaugccaggauaagaagagacuagaagaaagggacagcuaguauuuuaauauguaaaucuguuugcauaauauuuccuagguaaacuauucguugauccaaccaaaauucggcggggcugggggguaucguuauugaggaugacucgcucuaggggagaacgcggacgcauuuucccaucagaguucccuccauaaaucaaaaccucaaaagaagaguuaaagacgacacccaggugucuacaguauccaagggccgggccaggagagguccuuggccaccuggcgccgaguucgcggccgcagacucccacggacggcccagcacccgagcgcgcgggccgagcugccccagacccggcgcagcgccucggcgaggccgucugcgaaguccgggccgccacucgggaccgcggcccgagccagaggagagacuucggagaagagggaagaggacgcggggugggaaacgccggggccgcaggcaaguagugggcgaguccggagggcgcgaaagaggggaggggcgcgggaggcaauggaaggagcgagcgcggggaggagcgaggcggcugggccggaggaggcgcgcgcccggguccacacugcggggugggggcugagggaccgcgaggggcugcgagcgagcgagcggggccuuaccgagcagcggcagcuggccgccgucgcgcgccaacgccggcauggccuccggagcccgggguccccaggccgcgccggcccagcccugcgaugccgccuggagcggcgcgccucgcgcugcagguggcucucuuaaggaugcgcgucaccgaccgcaaauucccucggacuggugcaaaguggaaggggggaggaacccucuccccagaggcagggaccgaggcgggagcggagagguugggcagagccgagcagccggugccuggcgcagcgcugcagccgagcccacgugcccgccgcgguccgcagccugugcucggcggcccccggggcuccccgacugcggcggggaagauugggcgcggucccgccggagaaguugcacuggcuccgcggcucugccgccuugcugccccugugaguccccgaacucugucguuuggauccggggcguggggacugcagggagccacaaaccacccuccuagugcgcugggaucuuugaggcccugagaaaggcgcugaauccgcucggcacgcuggcaacucccgccagcgcacaggcgagcauuccauuaagaaccauuccauucuuaauuguggacugauuuccuuugucucugccuccaucuccuaggaugcucaggacccagucagcggcgggaucaagaaaaacaggcaggguuucaaugucaaccaaggcaauuagggagguuaacaaacagccuucaaaacaaaacacacagaaaauacaucccagaggauguugcgaaucauccgcucaauaguucuuguucuucaucgcauaauuuuucgaguugaaaauuauuauuauuuucuuugcaauaaguugaggau

SEQ ID NO: 19504 - RNA, 2458 nt, Homo sapiens
auccucaacuuauugcaaagaaaauaauaauaauuuucaacucgaaaaauuaugcgaugaagaacaagaacuauugagcggaugauucgcaacauccucugggauguauuuucuguguguuuuguuuugaaggcuguuuguuaaccucccuaauugccuugguugacauugaaacccugccuguuuuucuugaucccgccgcugacuggguccugagcauccuaggagauggaggcagagacaaaggaaaucaguccacaauuaagaauggaaugguucuuaauggaaugcucgccugugcgcuggcgggaguugccagcgugccgagcggauucagcgccuuucucagggccucaaagaucccagcgcacuaggagggugguuuguggcucccugcaguccccacgccccggauccaaacgacagaguucggggacucacaggggcagcaaggcggcagagccgcggagccagugcaacuucuccggcgggaccgcgcccaaucuuccccgccgcagucggggagccccgggggccgccgagcacaggcugcggaccgcggcgggcacgugggcucggcugcagcgcugcgccaggcaccggcugcucggcucugcccaaccucuccgcucccgccucggucccugccucuggggagaggguuccuccccccuuccacuuugcaccaguccgagggaauuugcggucggugacgcgcauccuuaagagagccaccugcagcgcgaggcgcgccgcuccaggcggcaucgcagggcugggccggcgcggccuggggaccccgggcuccggaggccaugccggcguuggcgcgcgacggcggccagcugccgcugcucgguaaggccccgcucgcucgcucgcagccccucgcggucccucagcccccaccccgcaguguggacccgggcgcgcgccuccuccggcccagccgccucgcuccuccccgcgcucgcuccuuccauugccucccgcgccccuccccucuuucgcgcccuccggacucgcccacuacuugccugcggccccggcguuucccaccccgcguccucuucccucuucuccgaagucucuccucuggcucgggccgcggucccgaguggcggcccggacuucgcagacggccucgccgaggcgcugcgccgggucuggggcagcucggcccgcgcgcucgggugcugggccguccgugggagucugcggccgcgaacucggcgccagguggccaaggaccucuccuggcccggcccuuggauacuguagacaccugggugucgucuuuaacucuucuuuugagguuuugauuuauggagggaacucugaugggaaaaugcguccgcguucuccccuagagcgagucauccucaauaacgauaccccccagccccgccgaauuuugguuggaucaacgaauaguuuaccuaggaaauauuaugcaaacagauuuacauauuaaaauacuagcugucccuuucuucuagucucuucuuauccuggcauaaaccccaaagggguuuucaaggacuccgaggacuguccccaaagaaucugcuggguagcauaguuguuauugaaaaaaaaaaucuucccaucgguucgcgucagcuuucuauuuggaaagaugagaggacugaaucgaauuuggguugaaggcgacagaguucugggugcccggcagcuccggucccuguccuaggucugcaaccuugggacugacacucaccucccccggccuccgcguccucaucugugcagugagggaguccguccgaguccccuucagcucugaaaugcuaggacuugaagucucugugguaaauagagaaaaugcuugcaauauagaagugcaggaauuauauccaauagcuuuuguuacaaauaauucugaaauauaaaaaguaaaaaauggaaaucgggggaaaagaguugaaaaacaaagacauuuuaguucuuaaauaguuaucuuuacuaguuaguaaaucuguaauuucaaauguguaguacaauauguuuuccagauuccguuaauacaaaauguuagcuuucuauuauguaugauauuaaguaguaagugcauuuuucagaagcauaaugggcuuucuaaagguauaagcaucaauacuugcaacgauauuuaagcugcauggaauucuuuucuauuuaggaaagaauucagaaauuucuaugucucucucuccagauauuucuaaaugaaguauaauuggcacacaguaaauaugcacacaucuuaagaguacaauuucauuaguuuucacauauguacgugcccaaauaaccacgaucagacugagauauagagcaauucuagcuccacccucucugucaguacccccuccccagguagccacuauucugacuucugaugccauggauugcuuuugccuauguuugaacuucauguaaaccaaaccaucaucgu

SEQ ID NO: 19505 - RNA, 2651 nt, Homo sapiens
gcuccggcugcgccacgcuaucgagucuucccucccuccuucucugcccccuccgcucccgcuggagcccuccacccuacaaguggccuacagggcacaggugaggcgggacuggacagcuccugcuuugaucgccggagaucugcaaauucugcccaugucggggcugcagagcacuccgacgugucccauaguguuuccaaacuuggaaagggcgggggagggcgggaggaugcggagggcggagguaugcagacaacgagucagaguuuccccuugaaagccucaaaaguguccacguccucaaaaagaauggaaccaauuuaagaagccagccccguggccacgucccuucccccauucgcucccuccucugcgcccccgcaggcuccucccagcuguggcugcccgggcccccagccccagcccucccauugguggaggcccuuuuggaggcacccuagggccagggaaacuuuugccguauaaauagggcagauccgggcuuuauuauuuuagcaccacggcagcaggagguuucggcuaaguuggagguacuggccacgacugcaugcccgcgcccgccaggugauaccuccgccggugacccaggggcucugcgacacaaggagucugcaugucuaagugcuagacaugcucagcuuuguggauacgcggacuuuguugcugcuugcaguaaccuuaugccuagcaacaugccaauguaagugccuucagcuuguuugggggagacuggguagagagguuagaugggagggcacccugcccugaaaaggaaaaccuguaaccugaauuccagguacacuuggagggcagacucucaggcaugugggaaaacgccggaauugauaagaaacauggaaauuacuuuaaaaaaugaaaacauaaaagccuugccaaaaguuagggaacuuuuccucuaaguucagagugagacaguuaacucggucuggcuccucagcuuaguaacccccaaagggagcggaaggucuuuuucccuaaggaugagauauuaacgaccaaugugguggaggaagucaagggccugcaccccacaggccccauaaccgcacugauguccaccuuguaaaacuugaggccugcguuagaaagcccuucaacugaguaauguaaaacucaccuccuaagagcuuuuaucuucugggcauuguaaggcuuguccggaggaggaggaugacgaugcugauaugaugaugguuauaaggcgcccucuggaggaaggaaaaugaaaguacaggggacagggccuuaagcagauggaaucccaauuaaagcuucuacggauuuauacagauuaaugaucagcauuucugguuggagccuuucccaguggcuagucagugaacccuggaaagaagaauggaugcuacuuggaguggguacauucugaaaaguaauauaagugucucaauucacuuucuagucauggaaaugguaacauuuuuuaacucaaaucugcucuaaauuuuguuugagccugagaauuaccccuuugacauguucccagugauaagcaaacauuaugaacgcagcaaguugagaaauaucaacauugagaugagacucaagagaccgggguuuuucccaugagucugacaccaauuugcugcgugacuuugggcaagucaaacggccuuuucuaaaaugugagacagagauuaaagggaccccaaggccacuuuccagcucuagguuccauggccagacuuucaugucaacagagaaugaagaagaucaguccguuuucaucuugaaaauggcugccaaagugcuagacaaagauauugacuagaugggggaugguauugucugaccacacccaguacuccaaaaaguuguuccacccacacagcacggugucuaccacugcauaauuucuaaugcauuugugugcuugugugugugugugugugugugugugugucugugugucugugugucucuucccccuucauucacuuuuaguauacauacuguggauacuaaggaguaauugcagugaacaaauucacauuaccgaguucauauuuuuaaugagaucuugagagugggaggaaagagucggcuccuagagaauaaaaugaaggcagacuuagggaaauuugaagguacaaaggcaacuuaccuucugaucaacagccaaccacagucuggaauaaauguuaucaaacacacauucuucaaaaugguccaugucugaguaauuaaaaggcaaauuuccaaaaucauaaggacuuccguuaaucaagucaggcauaauuauucuuccuacugauggacacaaugaaguaaacauaucauucuuguaauuuaacaguaauucucguaaauugcccuuaaaugucagugcuggaugugguccacccuccuaaauugugacuguugcaacagauguucucacuucaaauaacgcacuucuuggccaccuaauuaaagcaauuuuuggggugauucauccuacugcaagcuuggccacacuuguauccuguauuaaccuauaauuuuuguaccguaggagaagaauucacucuuuaaggacuuauaacaauuauggcaaaaggggggauaguacuuuuguuuauuuuuucuauuauuuuucaagaucuuua

SEQ ID NO: 19506 - RNA, 2651 nt, Homo sapiens
uaaagaucuugaaaaauaauagaaaaaauaaacaaaaguacuauccccccuuuugccauaauuguuauaaguccuuaaagagugaauucuucuccuacgguacaaaaauuauagguuaauacaggauacaaguguggccaagcuugcaguaggaugaaucaccccaaaaauugcuuuaauuagguggccaagaagugcguuauuugaagugagaacaucuguugcaacagucacaauuuaggaggguggaccacauccagcacugacauuuaagggcaauuuacgagaauuacuguuaaauuacaagaaugauauguuuacuucauuguguccaucaguaggaagaauaauuaugccugacuugauuaacggaaguccuuaugauuuuggaaauuugccuuuuaauuacucagacauggaccauuuugaagaauguguguuugauaacauuuauuccagacugugguuggcuguugaucagaagguaaguugccuuuguaccuucaaauuucccuaagucugccuucauuuuauucucuaggagccgacucuuuccucccacucucaagaucucauuaaaaauaugaacucgguaaugugaauuuguucacugcaauuacuccuuaguauccacaguauguauacuaaaagugaaugaagggggaagagacacacagacacacagacacacacacacacacacacacacacacaagcacacaaaugcauuagaaauuaugcagugguagacaccgugcuguguggguggaacaacuuuuuggaguacuggguguggucagacaauaccaucccccaucuagucaauaucuuugucuagcacuuuggcagccauuuucaagaugaaaacggacugaucuucuucauucucuguugacaugaaagucuggccauggaaccuagagcuggaaaguggccuuggggucccuuuaaucucugucucacauuuuagaaaaggccguuugacuugcccaaagucacgcagcaaauuggugucagacucaugggaaaaaccccggucucuugagucucaucucaauguugauauuucucaacuugcugcguucauaauguuugcuuaucacugggaacaugucaaagggguaauucucaggcucaaacaaaauuuagagcagauuugaguuaaaaaauguuaccauuuccaugacuagaaagugaauugagacacuuauauuacuuuucagaauguacccacuccaaguagcauccauucuucuuuccaggguucacugacuagccacugggaaaggcuccaaccagaaaugcugaucauuaaucuguauaaauccguagaagcuuuaauugggauuccaucugcuuaaggcccuguccccuguacuuucauuuuccuuccuccagagggcgccuuauaaccaucaucauaucagcaucgucauccuccuccuccggacaagccuuacaaugcccagaagauaaaagcucuuaggaggugaguuuuacauuacucaguugaagggcuuucuaacgcaggccucaaguuuuacaagguggacaucagugcgguuauggggccuguggggugcaggcccuugacuuccuccaccacauuggucguuaauaucucauccuuagggaaaaagaccuuccgcucccuuuggggguuacuaagcugaggagccagaccgaguuaacugucucacucugaacuuagaggaaaaguucccuaacuuuuggcaaggcuuuuauguuuucauuuuuuaaaguaauuuccauguuucuuaucaauuccggcguuuucccacaugccugagagucugcccuccaaguguaccuggaauucagguuacagguuuuccuuuucagggcagggugcccucccaucuaaccucucuacccagucucccccaaacaagcugaaggcacuuacauuggcauguugcuaggcauaagguuacugcaagcagcaacaaaguccgcguauccacaaagcugagcaugucuagcacuuagacaugcagacuccuugugucgcagagccccugggucaccggcggagguaucaccuggcgggcgcgggcaugcagucguggccaguaccuccaacuuagccgaaaccuccugcugccguggugcuaaaauaauaaagcccggaucugcccuauuuauacggcaaaaguuucccuggcccuagggugccuccaaaagggccuccaccaaugggagggcuggggcugggggcccgggcagccacagcugggaggagccugcgggggcgcagaggagggagcgaaugggggaagggacguggccacggggcuggcuucuuaaauugguuccauucuuuuugaggacguggacacuuuugaggcuuucaaggggaaacucugacucguugucugcauaccuccgcccuccgcauccucccgcccucccccgcccuuuccaaguuuggaaacacuaugggacacgucggagugcucugcagccccgacaugggcagaauuugcagaucuccggcgaucaaagcaggagcuguccagucccgccucaccugugcccuguaggccacuuguaggguggagggcuccagcgggagcggagggggcagagaaggagggagggaagacucgauagcguggcgcagccggagc

SEQ ID NO: 19507 - RNA, 2460 nt, Homo sapiens
aggcuucaaggagguggcccugggccgugacccuacuucugucggcgucuguucgggcgcccgcagaagccagacucuugggcagggaagacgcuaaccgaggucuccaaaguucaaagacccacaagcaaacugcuccuucacuucagcagcaagcggucggggccgccgcagacagagggucgauuaugcaacccccauaaucucgcugcagaucugcgagggcacagaugugucugguuucuuuuacaaauagacuuaauauguucuuggcaaaaaaaaaaaaaaaaaaaagaaaucuuccacuuaugcacggaauacagagagagugaaagaaacguagacaccucaacccggggcucucuuuuaaaguucagcaagagucacacacugagaaggaaccgguggugggguguuuucguaggaaaggggcggcaggucaggaugagauucucacugucaugaguauggguuugggcgggagggggagggauugccaaacgcguguuguacaaaccugcccuggggcuacaacuccccuuccucaaaacuaccaccccucuggaacugacggagaaccucuccagggugugugugugugugugugugugugugugugugugugucaaguuccagggagaaguguggaggaugagggcuguggucucaauucugccagaguaggggaugcuaauauuagcaggauuauuaaugugcuggugggaagagaucaaaccuuaccaauaaaaccucuccgccgagccucaugccuuucucuuaccgcccaagcucacuaacccucuuaaacucucuaaguaaguuucaaagcggacgaaaaaggaggacggaaagacaaauugugggcgccuauggagacagaaaaaaaaaucuauccuacaacgugaccccucagcaacccuccuccaccuuuaaauggcuuuuuguuuuuggaaaugccuggauaaaccgcaaaacucucggcgcgcucuucucuggcuggcuacaacuccuuaacccccccacccccacccagcgugcucagggcacccgcaccgugcuagcuuguggcggcucucaaacuaauccugacugaguuuuugaggcagccuucuauucccacucgcaccaacccagcacgcuuaccaaaauucccaaguaaccuucucuuuguuacgcaaacgccaggagcugcuugauucuuucuucucuccaccccuauccccuuuccagccuagccggcuuccuggccgggcaagcugggaauucagcgacugaagggccuuggaaggugccggaggggagagacgcuaguucgaaccuccacagggcucuccuacuaaaaaucccuaaaaugcuggcccgagaaacucucuuuguuggagggucugaguccuacucccuucugccgcgugcgcccccacugccgugaaccgcugugacccccaaucuaccaccccaucucgcgcccccagcguccuagucgcccuguaucugcccagccuucccccuguccauguaccuggcugguugguggcgcuugggacgcgguuguaggcgccgccguacuggugguaggagcuagcguagcuauagucggcauaagcuuuggcuggguagcucccggcggagccguucacgccgugauacugauacugguagggguugagagcuuugccauaggaagccgagguaggagagcaguagccgugcggggcuccccccguagggcuguaguagucagaaucgguagcugaagacucgggcaaaguuggcgauuccugagacggauggugcauagcugcggacgucuggaacggagcuuggaagucgccggaucggaugcuggggacccuucugucaaacacuccugucaucgcucacgggcggcggcagcggcuguccuugcuguuguggcggcggcagcugcccuaguuggcuguggggcugcucuggucuaagcagacauggcugugggagcgagggaggaggaggaagaggaggaggagagaaggaggaggcggcggccgcggcgaggaggagacugggagucgugaagucucugucuccggccggcugacugcuggcugaggcgcagcacagccuugguuaaauccuuaauugcgcgcuuacgcacagcgggguggaucugguucuauuggccagggccucgggagcaacaguaacacccuaacucguccaacuaguuuuagcacaacaaagcauugcuuaaaaagggggugggggguacugaggggguguguguguuugugugugugcgcgcccgcgcgcuuguguguguuuuugcuuguuguggaguggggaggggucuuagucuaucuguuuuuaguaaauuccaaagacaucgcagaagccacagcacaaggcucugugaugucuggggacaauguguuccaaucagaagccucaaaagugcacauguuuugggaaugaggugggcga

SEQ ID NO: 19508 - RNA, 2460 nt, Homo sapiens
ucgcccaccucauucccaaaacaugugcacuuuugaggcuucugauuggaacacauuguccccagacaucacagagccuugugcuguggcuucugcgaugucuuuggaauuuacuaaaaacagauagacuaagaccccuccccacuccacaacaagcaaaaacacacacaagcgcgcgggcgcgcacacacacaaacacacacacccccucaguaccccccacccccuuuuuaagcaaugcuuuguugugcuaaaacuaguuggacgaguuaggguguuacuguugcucccgaggcccuggccaauagaaccagauccaccccgcugugcguaagcgcgcaauuaaggauuuaaccaaggcugugcugcgccucagccagcagucagccggccggagacagagacuucacgacucccagucuccuccucgccgcggccgccgccuccuccuucucuccuccuccucuuccuccuccucccucgcucccacagccaugucugcuuagaccagagcagccccacagccaacuagggcagcugccgccgccacaacagcaaggacagccgcugccgccgcccgugagcgaugacaggaguguuugacagaaggguccccagcauccgauccggcgacuuccaagcuccguuccagacguccgcagcuaugcaccauccgucucaggaaucgccaacuuugcccgagucuucagcuaccgauucugacuacuacagcccuacggggggagccccgcacggcuacugcucuccuaccucggcuuccuauggcaaagcucucaaccccuaccaguaucaguaucacggcgugaacggcuccgccgggagcuacccagccaaagcuuaugccgacuauagcuacgcuagcuccuaccaccaguacggcggcgccuacaaccgcgucccaagcgccaccaaccagccagguacauggacagggggaaggcugggcagauacagggcgacuaggacgcugggggcgcgagauggggugguagauugggggucacagcgguucacggcagugggggcgcacgcggcagaagggaguaggacucagacccuccaacaaagagaguuucucgggccagcauuuuagggauuuuuaguaggagagcccuguggagguucgaacuagcgucucuccccuccggcaccuuccaaggcccuucagucgcugaauucccagcuugcccggccaggaagccggcuaggcuggaaaggggauagggguggagagaagaaagaaucaagcagcuccuggcguuugcguaacaaagagaagguuacuugggaauuuugguaagcgugcuggguuggugcgagugggaauagaaggcugccucaaaaacucagucaggauuaguuugagagccgccacaagcuagcacggugcgggugcccugagcacgcuggguggggguggggggguuaaggaguuguagccagccagagaagagcgcgccgagaguuuugcgguuuauccaggcauuuccaaaaacaaaaagccauuuaaagguggaggaggguugcugaggggucacguuguaggauagauuuuuuuuucugucuccauaggcgcccacaauuugucuuuccguccuccuuuuucguccgcuuugaaacuuacuuagagaguuuaagaggguuagugagcuugggcgguaagagaaaggcaugaggcucggcggagagguuuuauugguaagguuugaucucuucccaccagcacauuaauaauccugcuaauauuagcauccccuacucuggcagaauugagaccacagcccucauccuccacacuucucccuggaacuugacacacacacacacacacacacacacacacacacacacccuggagagguucuccgucaguuccagaggggugguaguuuugaggaaggggaguuguagccccagggcagguuuguacaacacgcguuuggcaaucccucccccucccgcccaaacccauacucaugacagugagaaucucauccugaccugccgccccuuuccuacgaaaacaccccaccaccgguuccuucucagugugugacucuugcugaacuuuaaaagagagccccggguugaggugucuacguuucuuucacucucucuguauuccgugcauaaguggaagauuucuuuuuuuuuuuuuuuuuuuugccaagaacauauuaagucuauuuguaaaagaaaccagacacaucugugcccucgcagaucugcagcgagauuauggggguugcauaaucgacccucugucugcggcggccccgaccgcuugcugcugaagugaaggagcaguuugcuugugggucuuugaacuuuggagaccucgguuagcgucuucccugcccaagagucuggcuucugcgggcgcccgaacagacgccgacagaaguagggucacggcccagggccaccuccuugaagccu

SEQ ID NO: 19509 - RNA, 2618 nt, Homo sapiens
aucacccuucagaccguauggaauccccuagacaaaucuacucagccuuucugugauagguuaucugggugugaauuccaccaccaccucccccucguccccgcccacaaaaaauauauuaagacuuggcccaacuagauuuuacaggcgacagagauguaaagaaacaauuuauggcuugcacaauuaucuaaaauucccgcaaacaagcaguucccuaaguaguaugucauaauuuucuuaucuaugaguagaagcacgugcauuuauuuauaucccuagauuaacuucaagucuaauuuuacugccaguaguauccagggguggauuucuuuguucuaauuacaaauggaacuugagcuagaucaaaggcauuuuaagaaggucaaauuuuacuucucugaaaaauaaaggguguuaucccauguaauuaauuaaugcuuagccaugcccuuuggcgcauuauccgguggcugcagaaaaccagagccagccguucccaccuguuggugcagugaaacuuacuuacccaaaagagcagauugagggcguagagcaggcagcgcagacacuucacggaaucuucucuggccauugugagccccguaagggagaagccccauccuuucaccacauccuacucccaagggcaaaacggcagcgaucugcagggggcgggggagagagaacacgggacaucucaccaucacgcuucccacagccugcccgucccuccuccacccgcccucagcaggguccagagggucccgaggcccagugcauucgagacaucgccucaucaaaaaucauuuguuaaaaucauaaugguaacuaaacucccaaaaguuccaaaccggcuucagauaacaccugcugggaaaagaaaagagcaacuauccggaugaaugaagucgcacaguaaacucgcguucucaggggacacgcggcggagcccugugcauucugaugagacgcucuugaaaaccucccucacuccacgccccuccucgaggacagcugugcucggcacuguccugaaggugagaaaccacacugcccccuaccccggacacgucagaggcgccaccggcaagcccgagagaaugagcgcccuucuaguuaggacaguuccugggcacuccaacuccgcaccccucuaccccgucccgcagcucgggugugaaugcaagggacuggggcggcggggcgggggcgggggcgggggcgagggggcagcgcggaguugagauuccgcccggcuacuaggguuucucugggagaacgugagaaaugauguuuucggccccagaaugauggauuagccugggacagugggcggggggcggggggcgccggggaauuagggccgaugcagcugugcagacgccggguuagucauucaaaccccgcuucccccgcccgggacgcucccgcgaccccucgcucaaagccgcccgcggagcacaaagcgagcgcggccaccgacccagccaucgcguccgcgcgcccccggcagggcgcgaggggaagcgccggcggcagggagccccagagccagcccuuaaguaguuuagcacacagcgcggagggcagccgccggcgggcuggcgggacagcgggcaggaaaggcgacagacgcguggccacuuaccgucggcgcugggcccggugccccacgcccgccuggggauagucggggacgcacggcgggggcucaucggggcagggaacuucuucgcggagagccggagggcugcauuggcuucagcuggagacgcuucuuucucuuccucuccccccgccgccgccgucgccgccuccugggaaaaagaaaaaaaaaaaaaaaaguccugggcagcaguugcuggaaagucucugcuaagccaccucccagcgccgcugucccucccaaguccucuccgaguccggacgaggcagcggcggcagccagggccagcugcacaaacucucagcgcaugcucgagccgcuggcugccgggguuggguccuaguggguguuucuugucccucucacccagcgagaguccccaaagggacgcuucaccucugcaggauaggguccagaagauaaugccuaggaacuugggagaaguccgugcaguaaaucccuuuaaaaugguggcgucgaaggaauggaggcuggguuauaagcauagagaagcaggcuuuuauuauaugauaauauuuguguuugagaaggggggugaagggguggcccaacccaauuccugcaaugagaaacuaguuuucacaaccuuuauggagccaccuccugugauuuguuauuaacauggugcccuaugauccuucuuauugcuuuguugcccucccggauuuuuuuuuuuuuaaguucuuucccacuuucauagugcacuaauagcauuuacggaaacaucagaguaaucaugugcagucugacaugcagaagaggaggaaagaacauuuuuaacucuuagaaguaacucaagcuuuccaaaauuucucacgauaagauuguuuugaguuaacugggugauuuauuuugaaauguguacauaguaguggaucuuuggaaaaucuaauuuuuuuaaacuagaaauucaugaaguauuacacag

SEQ ID NO: 19510 - RNA, 2618 nt, Homo sapiens
cuguguaauacuucaugaauuucuaguuuaaaaaaauuagauuuuccaaagauccacuacuauguacacauuucaaaauaaaucacccaguuaacucaaaacaaucuuaucgugagaaauuuuggaaagcuugaguuacuucuaagaguuaaaaauguucuuuccuccucuucugcaugucagacugcacaugauuacucugauguuuccguaaaugcuauuagugcacuaugaaagugggaaagaacuuaaaaaaaaaaaaauccgggagggcaacaaagcaauaagaaggaucauagggcaccauguuaauaacaaaucacaggagguggcuccauaaagguugugaaaacuaguuucucauugcaggaauuggguugggccaccccuucaccccccuucucaaacacaaauauuaucauauaauaaaagccugcuucucuaugcuuauaacccagccuccauuccuucgacgccaccauuuuaaagggauuuacugcacggacuucucccaaguuccuaggcauuaucuucuggacccuauccugcagaggugaagcgucccuuuggggacucucgcugggugagagggacaagaaacacccacuaggacccaaccccggcagccagcggcucgagcaugcgcugagaguuugugcagcuggcccuggcugccgccgcugccucguccggacucggagaggacuugggagggacagcggcgcugggagguggcuuagcagagacuuuccagcaacugcugcccaggacuuuuuuuuuuuuuuuucuuuuucccaggaggcggcgacggcggcggcggggggagaggaagagaaagaagcgucuccagcugaagccaaugcagcccuccggcucuccgcgaagaaguucccugccccgaugagcccccgccgugcguccccgacuauccccaggcgggcguggggcaccgggcccagcgccgacgguaaguggccacgcgucugucgccuuuccugcccgcugucccgccagcccgccggcggcugcccuccgcgcugugugcuaaacuacuuaagggcuggcucuggggcucccugccgccggcgcuuccccucgcgcccugccgggggcgcgcggacgcgauggcugggucgguggccgcgcucgcuuugugcuccgcgggcggcuuugagcgaggggucgcgggagcgucccgggcgggggaagcgggguuugaaugacuaacccggcgucugcacagcugcaucggcccuaauuccccggcgccccccgccccccgcccacugucccaggcuaauccaucauucuggggccgaaaacaucauuucucacguucucccagagaaacccuaguagccgggcggaaucucaacuccgcgcugcccccucgcccccgcccccgcccccgccccgccgccccagucccuugcauucacacccgagcugcgggacgggguagaggggugcggaguuggagugcccaggaacuguccuaacuagaagggcgcucauucucucgggcuugccgguggcgccucugacguguccgggguagggggcagugugguuucucaccuucaggacagugccgagcacagcuguccucgaggaggggcguggagugagggagguuuucaagagcgucucaucagaaugcacagggcuccgccgcguguccccugagaacgcgaguuuacugugcgacuucauucauccggauaguugcucuuuucuuuucccagcagguguuaucugaagccgguuuggaacuuuugggaguuuaguuaccauuaugauuuuaacaaaugauuuuugaugaggcgaugucucgaaugcacugggccucgggacccucuggacccugcugagggcggguggaggagggacgggcaggcugugggaagcgugauggugagaugucccguguucucucucccccgcccccugcagaucgcugccguuuugcccuugggaguaggauguggugaaaggauggggcuucucccuuacggggcucacaauggccagagaagauuccgugaagugucugcgcugccugcucuacgcccucaaucugcucuuuuggguaaguaaguuucacugcaccaacaggugggaacggcuggcucugguuuucugcagccaccggauaaugcgccaaagggcauggcuaagcauuaauuaauuacaugggauaacacccuuuauuuuucagagaaguaaaauuugaccuucuuaaaaugccuuugaucuagcucaaguuccauuuguaauuagaacaaagaaauccaccccuggauacuacuggcaguaaaauuagacuugaaguuaaucuagggauauaaauaaaugcacgugcuucuacucauagauaagaaaauuaugacauacuacuuagggaacugcuuguuugcgggaauuuuagauaauugugcaagccauaaauuguuucuuuacaucucugucgccuguaaaaucuaguugggccaagucuuaauauauuuuuugugggcggggacgagggggagguggugguggaauucacacccagauaaccuaucacagaaaggcugaguagauuugucuaggggauuccauacggucugaagggugau

SEQ ID NO: 19511 - RNA, 2522 nt, Homo sapiens
ccccaggcuguuuucuguccagugggccccaugugcugguuuguagguguuguaguuaauauggucaugaauugugggcagcacuacugcccccucaccugauacaccggacggagcugcuguugcugcugcggauguugcugcugggaugucuucguccaccuggauuaucucaacaguccgggcggcugugacuguacuccgcugcuggugccgcuuacgaaguuuauagaagacaaucaacauggcggcagcuagcagagucacugccacaaagcagccaaugaugaucuugguggucuucaugacuucauccaggcuggucugcaucuugucaguggugucugucgcggguacugccaccugcuugggcacacggguagucugaaugagcaccgugguagaggugguauaugccggcugguaaccaguggacgugguaggaacaggcuuguacuuucgcguuguguccucaggcgagaucuccguggucuccacuguuacuguggugaagaagcuguaguuggagguguuaagcucagccgugcucacauugagguaggccgaggcguuggaguugccugcaacauuggucaccaugcauguguacaccccagugucugaaagcagcacgugggaaaaguucaaggugccgucguugaggacagagauccuuggguggcgggaggcguggcugagcacugucccauugggcagcaaccacuucacggaggacauagggggaguccgacacuuaaguucugccauccgacccucagaaauguugaggucucgaggugcguccaugaugaagggggcagagcacuggaaggaggccugguccaccuccacgagguagcggccucgcaugugcaugggagcaugacagcggccacagcagguggaauugguggguauauacucucgaagccaccaggcuagccacagaaugucacaaucacaguuccaaggguugugguguagaugcaacuccaccagguaccucagcgggguaaagaggucauggggcaaagaagagagguuauugugggccaaguugaguuccacaagugaagccagcccgucaaaagcauuccgcucaaucaggcugaccugugaguucaugacccagagcuucuugagggagcucaggccauggaaggagccaggccugaucucagggaagugguucccugacaucuccagcuccuccagccccaccaggggggugagauugggcaugucuuuaauguugcacaugcccaaguucagauacuugagguugaacagccccucaaaagcucccucagagauauacuccagcuucuugagcucccccaaguccaggcgcaugagggagggcacccgguugaaggcguaagaggggaugcuuucgaugggguuguugcgaagccagagcucccgcagcuuggacagguauucaaaggccccgcuagggaugacugucagccaguugucgaacagcuccaggguguugaggcuggccaggccguugaaggcccccaccucaaucugccggauggaguuccugcccaacugcaggaccuccaggugguggagguggcggaaggugucggccuggaucaucuggauguuguucuccaugagguugagguaccggguguucgagggaauacccugcgggaccucggagaggccccggcgcgugcacaccaccuugcugaacugguuacugcacgagcagacggaggggcaguucuggggcccggcugaggcggcagcagcgauggcugcacacagaauccacacuugcgccgugagguagacgaacgggagcaggauggcauuccaggugugguggugcacaguuaccugccacaagagcuucaugguguggcacguucauaauucaccaucgccugggauuuuggcucggaaaggagaaccagcccuaccccggcuuaagugagcuaggagcuccucuuuccaucuggagaaggagguggggagggggcgauuagagagacggagcggaucggccgaaaaaaauccugccaaacucgagcggccccuggucucccaacccacccucaaggcaagcccuccgaaagcuacgacucucccacacugcaaccguccccacccaguucgccgucaccuaccucggaaggaaggcaggaaagcacuggcgugguguccuuaagcuuucuccacgggagcugggcaccucguucccauuccgacuucuuaguuuuaauuaacaaaagggggaaguggugggggcggggagggcagaggggaggggaggggaggggagggaaggggugggggagacaaaauggccucuaguaaauccggagccggagccggcgaagccgcggaguugaggcgcgccugggagagccaaggcccggcgggcuaugcaggugcaugccccccccuccgcccaaggagcggcgccaccagcgcuucccggcuuuguccuuggacccuggcaccggcucgcuccagccgcgggggaaggcgcuucaucgccaaag

SEQ ID NO: 19512 - RNA, 2522 nt, Homo sapiens
cuuuggcgaugaagcgccuucccccgcggcuggagcgagccggugccaggguccaaggacaaagccgggaagcgcugguggcgccgcuccuugggcggaggggggggcaugcaccugcauagcccgccgggccuuggcucucccaggcgcgccucaacuccgcggcuucgccggcuccggcuccggauuuacuagaggccauuuugucucccccaccccuucccuccccuccccuccccuccccucugcccuccccgcccccaccacuucccccuuuuguuaauuaaaacuaagaagucggaaugggaacgaggugcccagcucccguggagaaagcuuaaggacaccacgccagugcuuuccugccuuccuuccgagguaggugacggcgaacuggguggggacgguugcagugugggagagucguagcuuucggagggcuugccuugaggguggguugggagaccaggggccgcucgaguuuggcaggauuuuuuucggccgauccgcuccgucucucuaaucgcccccuccccaccuccuucuccagauggaaagaggagcuccuagcucacuuaagccgggguagggcugguucuccuuuccgagccaaaaucccaggcgauggugaauuaugaacgugccacaccaugaagcucuuguggcagguaacugugcaccaccacaccuggaaugccauccugcucccguucgucuaccucacggcgcaaguguggauucugugugcagccaucgcugcugccgccucagccgggccccagaacugccccuccgucugcucgugcaguaaccaguucagcaagguggugugcacgcgccggggccucuccgaggucccgcaggguauucccucgaacacccgguaccucaaccucauggagaacaacauccagaugauccaggccgacaccuuccgccaccuccaccaccuggagguccugcaguugggcaggaacuccauccggcagauugaggugggggccuucaacggccuggccagccucaacacccuggagcuguucgacaacuggcugacagucaucccuagcggggccuuugaauaccuguccaagcugcgggagcucuggcuucgcaacaaccccaucgaaagcauccccucuuacgccuucaaccgggugcccucccucaugcgccuggacuugggggagcucaagaagcuggaguauaucucugagggagcuuuugaggggcuguucaaccucaaguaucugaacuugggcaugugcaacauuaaagacaugcccaaucucaccccccugguggggcuggaggagcuggagaugucagggaaccacuucccugagaucaggccuggcuccuuccauggccugagcucccucaagaagcucugggucaugaacucacaggucagccugauugagcggaaugcuuuugacgggcuggcuucacuuguggaacucaacuuggcccacaauaaccucucuucuuugccccaugaccucuuuaccccgcugagguaccugguggaguugcaucuacaccacaacccuuggaacugugauugugacauucuguggcuagccugguggcuucgagaguauauacccaccaauuccaccugcuguggccgcugucaugcucccaugcacaugcgaggccgcuaccucguggagguggaccaggccuccuuccagugcucugcccccuucaucauggacgcaccucgagaccucaacauuucugagggucggauggcagaacuuaagugucggacucccccuauguccuccgugaagugguugcugcccaaugggacagugcucagccacgccucccgccacccaaggaucucuguccucaacgacggcaccuugaacuuuucccacgugcugcuuucagacacugggguguacacaugcauggugaccaauguugcaggcaacuccaacgccucggccuaccucaaugugagcacggcugagcuuaacaccuccaacuacagcuucuucaccacaguaacaguggagaccacggagaucucgccugaggacacaacgcgaaaguacaagccuguuccuaccacguccacugguuaccagccggcauauaccaccucuaccacggugcucauucagacuacccgugugcccaagcagguggcaguacccgcgacagacaccacugacaagaugcagaccagccuggaugaagucaugaagaccaccaagaucaucauuggcugcuuuguggcagugacucugcuagcugccgccauguugauugucuucuauaaacuucguaagcggcaccagcagcggaguacagucacagccgcccggacuguugagauaauccagguggacgaagacaucccagcagcaacauccgcagcagcaacagcagcuccguccgguguaucaggugagggggcaguagugcugcccacaauucaugaccauauuaacuacaacaccuacaaaccagcacauggggcccacuggacagaaaacagccugggg

SEQ ID NO: 19513 - RNA, 2541 nt, Homo sapiens
ucaagcaauggcugggaggcacacacaaccccccgcccccccgcaggcuucuccuucauuggcccgggcaaggucccugcuuccucucaggccgucucugcacaagcacacacacuucccuucccuguccacagguggacaaugcccugggcuaggagccagcccucgcaggcccugucaacagccugccaccaacuagucuagaaaauucugugaacaccagaucaguggguuuugcccuaaucacuggccucaguuuccccauuuaccucuucagcccgugcgggguguggagggagcauauuucauuccugacaguuugguguguuggguguggauggagaacugucggcccuccccgccaccuuccagcgcggcggcaccgggggcccagggggugggcgcccucaaccccgucccgccgcccgggcggcgcgggggaggggcggcgggggcggggcguccugugcggcgcggcccccacccgcgggccgggcggcauuccugggaggccggcgcucugacguggacccgggggccgcgggcgcggcgggggggcggcgguccgggggcuucuuaaaccccccgccccggcccagcccgcccuucccgagcaccgcuccggcccuggagggagagagagccagagagcggccgagcgccuaggaggcccgccgagccucgccgagccccgccagccccggcgcgagagaaguuggagaggagagcagcgcagcgcagcgagucccguggucgcgccccaacagcgcccgacagcccccgauagcccaaaccgcggcccuagccccggccgcacccccagcccgcgccagcaugaugaacaacagcggcuacucagacgccggccucggccugggcgaugagacagacgagaugccguccacggagaaggaccuggcggaggacgcgccguggaagaagauccagcagaacacauucacgcgcuggugcaaugagcaccucaagugcgugggcaagcgccugaccgaccugcagcgcgaccucagcgacgggcuccggcucaucgcgcugcucgaggugcucagccagaagcgcauguaccgcaaguuccauccgcgccccaacuuccgccaaaugaagcuggagaacguguccguggcccucgaguuccucgagcgcgagcacaucaagcucguguccauaggucagugccgggggcgagggcacgggcgcugcggggauagggucgucccauggggcaggggcacaggugcggggugggcgcgcggggagcugagagacagggcggagggcaccccccgguauagagagaagacccuggccccggcccucccacccaucgacaagggccaugggcacugccugcacaccccucuggggacagcgagcacucccugggugccccggggaguccaggccuuaggguuugcgagcccuccagcugccgccuccccaugcacauucccaccucccgccucggcucaccguucccuuuccuuccaucgggcaacccuagcccacacucgggaggacagaaccagugccugucacugauuccugggggcaucuccccgcccccaacaaaacaaguggcuucccagcuucacagccccuccgcgggcugggagagggcugaagacagguccccaaccacugcccgcgucugcgggcucuggggccgaggggagcuggcgcgggaggcccucuucgugcaugugcucagcagcuggguucaggcccgggggccaggacaggcagggcccagccucagaaaccuaaaaaggcacugagcgagcgcggggagacuuaaccccugucuguccuccuccugcuucagccugcgguggagggggcuuccgcaaguccaggcccugccccagcccacccccuaccgcgggauuggcugcagcuaacggucugggcugcggggagggagggaaaggccuguggaagggaggaagucuuugaguguaaccagauuuggaagguguguagugcagggugggggcggggaggcacucuagucuugggagcagagacgccaagggugggcuuggaguggcaggaggcuguccugcccucagaguccugcagucaucccugaggcugggggccuggggaagauccccccgcccaccccuguggagagcucuuaagaacccugcugggauuugcaggacgagguccuuggacggugcaccccacggccccaggaggggaguuucauguggggccaggugggccccacacaggauguucccugagauuucuccagaugacuugaugucugucagccccacucucccuuggggccaucucuaggccuccugauauagcagcugaggucagcccagggcccuuugccccguccaguccccucccuagcccuuacccccuccugccccaauacugcccccccaccccacccgccugcccuguccuggaaauagcccugccuccgugacacagcagaugucucugagcuuuccagaaggacaaggcugagggcagggggugggggagggagccuggagugug

SEQ ID NO: 19514 - RNA, 2541 nt, Homo sapiens
cacacuccaggcucccucccccacccccugcccucagccuuguccuucuggaaagcucagagacaucugcugugucacggaggcagggcuauuuccaggacagggcaggcggguggggugggggggcaguauuggggcaggaggggguaagggcuagggaggggacuggacggggcaaagggcccugggcugaccucagcugcuauaucaggaggccuagagauggccccaagggagaguggggcugacagacaucaagucaucuggagaaaucucagggaacauccuguguggggcccaccuggccccacaugaaacuccccuccuggggccguggggugcaccguccaaggaccucguccugcaaaucccagcaggguucuuaagagcucuccacaggggugggcggggggaucuuccccaggcccccagccucagggaugacugcaggacucugagggcaggacagccuccugccacuccaagcccacccuuggcgucucugcucccaagacuagagugccuccccgcccccacccugcacuacacaccuuccaaaucugguuacacucaaagacuuccucccuuccacaggccuuucccucccuccccgcagcccagaccguuagcugcagccaaucccgcgguagggggugggcuggggcagggccuggacuugcggaagcccccuccaccgcaggcugaagcaggaggaggacagacagggguuaagucuccccgcgcucgcucagugccuuuuuagguuucugaggcugggcccugccuguccuggcccccgggccugaacccagcugcugagcacaugcacgaagagggccucccgcgccagcuccccucggccccagagcccgcagacgcgggcagugguuggggaccugucuucagcccucucccagcccgcggaggggcugugaagcugggaagccacuuguuuuguugggggcggggagaugcccccaggaaucagugacaggcacugguucuguccucccgagugugggcuaggguugcccgauggaaggaaagggaacggugagccgaggcgggaggugggaaugugcauggggaggcggcagcuggagggcucgcaaacccuaaggccuggacuccccggggcacccagggagugcucgcuguccccagaggggugugcaggcagugcccauggcccuugucgaugggugggagggccggggccagggucuucucucuauaccggggggugcccuccgcccugucucucagcuccccgcgcgcccaccccgcaccugugccccugccccaugggacgacccuauccccgcagcgcccgugcccucgcccccggcacugaccuauggacacgagcuugaugugcucgcgcucgaggaacucgagggccacggacacguucuccagcuucauuuggcggaaguuggggcgcggauggaacuugcgguacaugcgcuucuggcugagcaccucgagcagcgcgaugagccggagcccgucgcugaggucgcgcugcaggucggucaggcgcuugcccacgcacuugaggugcucauugcaccagcgcgugaauguguucugcuggaucuucuuccacggcgcguccuccgccagguccuucuccguggacggcaucucgucugucucaucgcccaggccgaggccggcgucugaguagccgcuguuguucaucaugcuggcgcgggcugggggugcggccggggcuagggccgcgguuugggcuaucgggggcugucgggcgcuguuggggcgcgaccacgggacucgcugcgcugcgcugcucuccucuccaacuucucucgcgccggggcuggcggggcucggcgaggcucggcgggccuccuaggcgcucggccgcucucuggcucucucucccuccagggccggagcggugcucgggaagggcgggcugggccggggcgggggguuuaagaagcccccggaccgccgcccccccgccgcgcccgcggcccccggguccacgucagagcgccggccucccaggaaugccgcccggcccgcgggugggggccgcgccgcacaggacgccccgcccccgccgccccucccccgcgccgcccgggcggcgggacgggguugagggcgcccacccccugggcccccggugccgccgcgcuggaagguggcggggagggccgacaguucuccauccacacccaacacaccaaacugucaggaaugaaauaugcucccuccacaccccgcacgggcugaagagguaaauggggaaacugaggccagugauuagggcaaaacccacugaucugguguucacagaauuuucuagacuaguugguggcaggcuguugacagggccugcgagggcuggcuccuagcccagggcauuguccaccuguggacagggaagggaagugugugugcuugugcagagacggccugagaggaagcagggaccuugcccgggccaaugaaggagaagccugcgggggggcgggggguugugugugccucccagccauugcuuga

SEQ ID NO: 19515 - RNA, 2389 nt, Homo sapiens
ccauccagggccgggaagccagcacaggcugaaacgcaggggaaggccacagacaugcgccagguggagcugcuuucaggggucuggggucuggcugagagucuuuucagggagaacaugagcagcccccauccccugacucucugcaccugucagaaaggccacaacuuuuggagaaugugcucagggaaggacaacugcucccgcccccaacccugagcacgguuuuccaggcuugugacagggguuccugggggcucccacauuggguggggugggcuucaaaagugggacuuggcugcauuuucugaagggugugagaaaugugcuggcaaggccccugcuaacuuugaacacaccagauccagugaagacagccugucccugcuucuagaagacacuauguccaggaaagagggacggggcaccucugagcucuggccugggguuaggggcggccacuuucaccuuuucacuuugauccuucuccugcagcccagaaaguaaaggcaggaggggaagaggcagacauaggucccuccuccaggcagggaugggcagggaaguugagggucuggagcggaggcaauaggaacagagagaggaggagggagagggaugggucuuucccaccauggcagcucauuagugaggccaggccuggaguggcuuaaaaggguuucucacagacacuaggccugugagacaggggaacaaugucacccacugucaccaucaaaggcagaggggauucuaggcuaaaauugaacuugcuuugucccaaguucccuggcuugguuaaugccaucacacauacccaguuacuuaagccagaaagcuggggcucagcuccccuauuuuguugccugaguuguccccuaauacaucccccccuucuccucucuccaccaucuccauucagaaggcugaagacaaagcgucccugccuccaucugugccccuucucuccacucgaccuuucugaaucacacagccgaagucucccaggagcaagucccgcugggauggaucacaagcaccgcccaccuuuccagccccgcuacuucuggcuuauaucagggauucuaacucaguucccgcacccugggcgaauacuggcccucaaaccccaggugcccuuucccaucuccgucccucuacuggggauccugucacccggaauggcacccggucucaguccuucccaagcacacagagggcggccacgaugggcgucucagcaucugaaaccuucuacccaaucuagacucccguggggccucauccugcugcccagggccccuccucccaggccacuccuccaguucugcuuaaguaggcaggcaggauaugggagcccgggagaagcugaauccucugggaccccuaggugaagcuagggccagccucgccuggagagaccugcagaaagagcuccgaguggcacaaacuuggcugguccccaaggaauugucccggguuccccucuuagccuccccuggccccgugccggcaccgagcccuccauucccgccuguccugcuccggggagggccagacacagaugcaaagucagcuuccacagcgggccccuuuucucccccuccuucgucaagacaaauaauuaacuucagacucccagaugccagggcagccgcacucucucccgccgccggcugcaggaaccgccccccucuccugaacccccugcuuuggccguggucuuccccacccugcucgcucccccgacggggaggacggagcuggccagggaggcgcgcgaaccucaggcagggcuaagagcagagcccccagccccucucggcccccucaggccgggcugauaggagggagggggcgcaccuggccggaccccaagccucccgcaccuggacucaccuuccgcgcccgcggccagcgccagggcccccgaggugcaggagaagggacagcgcagcggccccgaccccggccaugcuagcuccgccucgcucggcucgccgucugucgucgcggcucagcaggcgcuggggaaggcgggguggggacacacaggccgcucccacccaggcuuuguucagggagggcucaaaccccccaccgcgcgcgccuuucccaugcacaccuccacccgccccgggcccggccgguccugaccccagagagcagcuccagcucgcaggaagcccaacggggguguaggccuugucuccgcuuaagauccaggaggagacccugaaaagaaaauaaacccaaguccaccccucucgggauccuagagagucucccugcccuuuuagguuacuccaucgcccuaggguuuccagaucgauuuuuccucucucucacaaguuuacagaagaagcagacugagcuggguuuagauccc

SEQ ID NO: 19516 - RNA, 2389 nt, Homo sapiens
gggaucuaaacccagcucagucugcuucuucuguaaacuugugagagagaggaaaaaucgaucuggaaacccuagggcgauggaguaaccuaaaagggcagggagacucucuaggaucccgagagggguggacuuggguuuauuuucuuuucagggucuccuccuggaucuuaagcggagacaaggccuacacccccguugggcuuccugcgagcuggagcugcucucuggggucaggaccggccgggcccggggcggguggaggugugcaugggaaaggcgcgcgcggugggggguuugagcccucccugaacaaagccugggugggagcggccuguguguccccaccccgccuuccccagcgccugcugagccgcgacgacagacggcgagccgagcgaggcggagcuagcauggccggggucggggccgcugcgcugucccuucuccugcaccucgggggcccuggcgcuggccgcgggcgcggaaggugaguccaggugcgggaggcuugggguccggccaggugcgcccccucccuccuaucagcccggccugagggggccgagaggggcugggggcucugcucuuagcccugccugagguucgcgcgccucccuggccagcuccguccuccccgucgggggagcgagcaggguggggaagaccacggccaaagcaggggguucaggagaggggggcgguuccugcagccggcggcgggagagagugcggcugcccuggcaucugggagucugaaguuaauuauuugucuugacgaaggagggggagaaaaggggcccgcuguggaagcugacuuugcaucugugucuggcccuccccggagcaggacaggcgggaauggagggcucggugccggcacggggccaggggaggcuaagaggggaacccgggacaauuccuuggggaccagccaaguuugugccacucggagcucuuucugcaggucucuccaggcgaggcuggcccuagcuucaccuaggggucccagaggauucagcuucucccgggcucccauauccugccugccuacuuaagcagaacuggaggaguggccugggaggaggggcccugggcagcaggaugaggccccacgggagucuagauuggguagaagguuucagaugcugagacgcccaucguggccgcccucugugugcuugggaaggacugagaccgggugccauuccgggugacaggauccccaguagagggacggagaugggaaagggcaccugggguuugagggccaguauucgcccagggugcgggaacugaguuagaaucccugauauaagccagaaguagcggggcuggaaaggugggcggugcuugugauccaucccagcgggacuugcuccugggagacuucggcugugugauucagaaaggucgaguggagagaaggggcacagauggaggcagggacgcuuugucuucagccuucugaauggagaugguggagagaggagaagggggggauguauuaggggacaacucaggcaacaaaauaggggagcugagccccagcuuucuggcuuaaguaacuggguaugugugauggcauuaaccaagccagggaacuugggacaaagcaaguucaauuuuagccuagaauccccucugccuuugauggugacagugggugacauuguuccccugucucacaggccuagugucugugagaaacccuuuuaagccacuccaggccuggccucacuaaugagcugccauggugggaaagacccaucccucucccuccuccucucucuguuccuauugccuccgcuccagacccucaacuucccugcccaucccugccuggaggagggaccuaugucugccucuuccccuccugccuuuacuuucugggcugcaggagaaggaucaaagugaaaaggugaaaguggccgccccuaaccccaggccagagcucagaggugccccgucccucuuuccuggacauagugucuucuagaagcagggacaggcugucuucacuggaucugguguguucaaaguuagcaggggccuugccagcacauuucucacacccuucagaaaaugcagccaagucccacuuuugaagcccaccccacccaaugugggagcccccaggaaccccugucacaagccuggaaaaccgugcucaggguugggggcgggagcaguuguccuucccugagcacauucuccaaaaguuguggccuuucugacaggugcagagagucaggggaugggggcugcucauguucucccugaaaagacucucagccagaccccagaccccugaaagcagcuccaccuggcgcaugucuguggccuuccccugcguuucagccugugcuggcuucccggcccuggaugg

SEQ ID NO: 19517 - RNA, 2729 nt, Homo sapiens
cggucaagguaguagugagaggaggugggacaggcgaccacgccgcugccccugggaugacuggaaggcgacuuaggggagcuggggcgagacaggugcaggguuugaggaugagaaaggcacagagugacuagaggauucccgccugcaagcacaucuggaaggggugucuggauccugggggcagcgacuguguucuagggcgagagccacccucgccagggguguaggcaggcgagaggagggccuggagcugugggucggccacacugcgcccucauuugugugcagccccggaggaccagaguggggaagcaccccacccucucccagggcccaacugagcacugcagcgggagguacgggguugucaaaugacaguuuugccauuccagauugccaaaagagccaguggccagucuagggcaccgcgccgucuggcaucucccuggaggcccugggccuggcccgaggcucagcccggaucugcaguugccaggucagugcggggcccggaguggauucgcggggcggggcggggcacugcccgcgcccggagcucagcagcagcugcccaggggcgggggcggcaagacgcggaagugcccggcagguuggcggaccggcgggaggcgcagccugggcagagcucagcuuggucccgccgcccggccggugcucccuggcgcagccacgcaggcgcaccgcagacaggugggucccggccgccgcgcucuccucucugcguccgcgcccggcgcgccccgaggguggcgggagcggugccggcuacugcccccaagucuaggccuagacugggccccgcgccccccaggcaccugcgggcggcgggaugaagacuggaguagggcgggguccgcguccagcugcgccuggaaagcgagcucgggggggugccuacagcagggugcgcccggccggccugggacuuccaaagcgccucccacgccccgaucgguuuggggugcuggcgcccggggagcccagugacccaggcggcggagugggcagcgcugcggggggcgccggcucugcugcucucccucccccucgccaucgcccagaauggggguucccgggagccccgcuggaggcuggcuuggaccacagaggagcgaggcccgauccuuacuuucgaugcacucgcccuugcucuuaccgggccacccucacccuuucggaaaagagguugagguuaaagcguucaucccccgggaucuucaggccaauggcaggaacugugcaagaguuugggggaagauggugucagguagaggcugcgucccugggcucgcggccgggaauggcagacucucgucccccgagcagcggaaaaggauggggcgcaauaguuccugggcugguuuccucagguccugucccagaacuuaagaaggcaacaaugaagaggcuaaacguggaggaaaagugaggcuagcauggccgggaugcguggggagaugguugucuccggaccccgggaggggcgggagcggguaccugggagcagaggcuggagugggggacuuucccagccucgcggccacgcugaacacagcagggcgaggaccggggugcugcuccuccagcagcaggaggagagguccagaggccgacucuggagguggggguggcuccgcgggcuggcccagggggugugccccagcggagcacgcgggaggggugggggcggaggggaggggggagcaggggcggaggacugggcugggccugggcuccucgagggcccagaauggggauaagugaccagaaccagagagggcucggcuguaucgauguaggaaacuguagccccucaggaggcccucuggcaagaccuccccuuccugcccccacccccaguaguuauggggccuggggugcuggggcugagggguuccaagagucaagggaagcacugggaaaucaccccuuuuuaucuaaaggcccuacuuugggguuuuuccccuguacccuggucuuccccuacccugacccugggaggaagcugaaagaagcuucuuucugggcaccuuuugccccagagccucagccugucuggaccaggugggcagcagggcccagggugugggcagcugacccggaggggugggauuugggggucagggccuguacagggaaccccuuguccucucccugagcuggguguggguuugcaaggagacaugugacccagaccaacccugggagcagcagggcgccugcugucuggccacucuuacuaggacugcuguggcacuuccuccccuagugggucccuggugcccaugaauugcagcuccugggugguggugggggcacugucuccugggacuccagcauggcccuggggugagcugugggcuuaccccaccucagcagguccucuagggcugcccacuggaugcuucgcugccucacacaauuguagggacuuccucaggcuguuggauuuccccaccuuccggggcucagguccauugacuuaggucuagggcuccauacauuucacccagagacuccggagccuggcaggcagaccuguucugacaccgaacuuccaaagucaugggccuugauugggguggucugaauuagaccuagcccuuuucugggcagaagggagcuucuaggaggauggaugcuguucggguuagagcucguguggaccuagcugcaggcaaaagccuugaggcugagucccuucu

SEQ ID NO: 19518 - RNA, 2729 nt, Homo sapiens
agaagggacucagccucaaggcuuuugccugcagcuagguccacacgagcucuaacccgaacagcauccauccuccuagaagcucccuucugcccagaaaagggcuaggucuaauucagaccaccccaaucaaggcccaugacuuuggaaguucggugucagaacaggucugccugccaggcuccggagucucugggugaaauguauggagcccuagaccuaagucaauggaccugagccccggaagguggggaaauccaacagccugaggaagucccuacaauugugugaggcagcgaagcauccagugggcagcccuagaggaccugcugaggugggguaagcccacagcucaccccagggccaugcuggagucccaggagacagugcccccaccaccacccaggagcugcaauucaugggcaccagggacccacuaggggaggaagugccacagcaguccuaguaagaguggccagacagcaggcgcccugcugcucccaggguuggucugggucacaugucuccuugcaaacccacacccagcucagggagaggacaagggguucccuguacaggcccugacccccaaaucccaccccuccgggucagcugcccacacccugggcccugcugcccaccugguccagacaggcugaggcucuggggcaaaaggugcccagaaagaagcuucuuucagcuuccucccagggucaggguaggggaagaccaggguacaggggaaaaaccccaaaguagggccuuuagauaaaaaggggugauuucccagugcuucccuugacucuuggaaccccucagccccagcaccccaggccccauaacuacugggggugggggcaggaaggggaggucuugccagagggccuccugaggggcuacaguuuccuacaucgauacagccgagcccucucugguucuggucacuuauccccauucugggcccucgaggagcccaggcccagcccaguccuccgccccugcuccccccuccccuccgcccccaccccucccgcgugcuccgcuggggcacacccccugggccagcccgcggagccacccccaccuccagagucggccucuggaccucuccuccugcugcuggaggagcagcaccccgguccucgcccugcuguguucagcguggccgcgaggcugggaaagucccccacuccagccucugcucccagguacccgcucccgccccucccgggguccggagacaaccaucuccccacgcaucccggccaugcuagccucacuuuuccuccacguuuagccucuucauuguugccuucuuaaguucugggacaggaccugaggaaaccagcccaggaacuauugcgccccauccuuuuccgcugcucgggggacgagagucugccauucccggccgcgagcccagggacgcagccucuaccugacaccaucuucccccaaacucuugcacaguuccugccauuggccugaagaucccgggggaugaacgcuuuaaccucaaccucuuuuccgaaagggugaggguggcccgguaagagcaagggcgagugcaucgaaaguaaggaucgggccucgcuccucugugguccaagccagccuccagcggggcucccgggaacccccauucugggcgauggcgagggggagggagagcagcagagccggcgccccccgcagcgcugcccacuccgccgccugggucacugggcuccccgggcgccagcaccccaaaccgaucggggcgugggaggcgcuuuggaagucccaggccggccgggcgcacccugcuguaggcacccccccgagcucgcuuuccaggcgcagcuggacgcggaccccgcccuacuccagucuucaucccgccgcccgcaggugccuggggggcgcggggcccagucuaggccuagacuugggggcaguagccggcaccgcucccgccacccucggggcgcgccgggcgcggacgcagagaggagagcgcggcggccgggacccaccugucugcggugcgccugcguggcugcgccagggagcaccggccgggcggcgggaccaagcugagcucugcccaggcugcgccucccgccgguccgccaaccugccgggcacuuccgcgucuugccgcccccgccccugggcagcugcugcugagcuccgggcgcgggcagugccccgccccgccccgcgaauccacuccgggccccgcacugaccuggcaacugcagauccgggcugagccucgggccaggcccagggccuccagggagaugccagacggcgcggugcccuagacuggccacuggcucuuuuggcaaucuggaauggcaaaacugucauuugacaaccccguaccucccgcugcagugcucaguugggcccugggagaggguggggugcuuccccacucugguccuccggggcugcacacaaaugagggcgcaguguggccgacccacagcuccaggcccuccucucgccugccuacaccccuggcgaggguggcucucgcccuagaacacagucgcugcccccaggauccagacaccccuuccagaugugcuugcaggcgggaauccucuagucacucugugccuuucucauccucaaacccugcaccugucucgccccagcuccccuaagucgccuuccagucaucccaggggcagcggcguggucgccugucccaccuccucucacuacuaccuugaccg

SEQ ID NO: 19519 - RNA, 2507 nt, Homo sapiens
gagcuggaaggauuuggagaagcgcaaaccccaaacccagguucuucuccauggggccccgggauacguuggaaaaucuaaccaaagcaggaaaaacuggcgggccuggagaacggggcagagauggaacagaaguccccguugacuucaggcauccccugucuuucccauccugagccaggagaaaaguccgcuuccugcagacgaccucagaccaagcaaggugcccgccgagucucuccuugcagguccggcccacgauuuccacucaucucuuucccccgggcgcggggcggcggcaggcggggucaccagaucccccuagcccgggccccuccaggcgccagggacgcugacgcucgcgcucuuccucucucgccuccccuccccaccucuccgcuccuucguccagucccucccccagccucggcgcaggggggccgggcuuggcuccgcgaggcccgugcauuccagagagcccagcgagcuagagcaacaaaggagccgggucgccggcggggagaguucggggggcugcggcgcgcuggggcgaagguggcugcugggccgcgggcuggcgcgggggcggagccggagcugcacucgcacccccggcccgcgucuggccucccucgcggggcggggagguggcuuuaauggugggagagggaauggggcuggggauugggggcccaggggucuccuagggcugaagacaacuuggauugcgaggcuagggcuuggggagucgugcaucccguuccgggccuccgcagcccaacaugggccccggguuccaaaguuugcgaaguugggcgccgaggggccggggcgcgcggagcguccgggggggcccgggcccggauucucugggcgcacaggucgccugagccgccuccgcggccgccgaggucgugcguguggccggggggcuccgaggagcaggcgggggcgccggggcuuuugcugaguuggcgggguuggccauggccgcugcccgcccagcgcgggggccggagcucccgcuccuggggcugcugcugcugcugcugcugggggacccgggccggggggcggccucgagcgggaacgcgaccgggccugggccucggagcgcgggcgggagcgcgaggaggagcgcggcggugacuggcccuccgccgccgcugagccacugcggccgggcugcccccugcgagccgcugcgcuacaacgugugccugggcucggugcugcccuacggggccaccuccacacugcuggccggagacucggacucccaggaggaagcgcacggcaagcucgugcucuggucggguaagugcggcggagccgggucuggggggcgggaggugccgcgguaagaugggggcacccuuggaaagaacaggcucaggccugaguuuuggagagggcggggacagcacccgggagaguuggagggacagaucccgaaacuuugggggcagguuacgugcaggaugggacccucggucaugggaaaaggagggcaaggaaguugacgaagcgggucacaaagggccugagcuggugggugagcaaaggauggcggggaugaggggcccgugaggagguggcucuaagccacgggaaaagacauuuuguaagaagaggagaugcuccaccuauucuggaagcagggugccgggggauucaaggagguguugaagacccuggggaaauuggaguuggagaggaaaaggggagggaugacggaggaagagguuuagacauuuggagggaaggguagggggacaugaucgagugaaguuuugaaggaaaagaaaccucccuagugaugaauuauuaaaagguaaccagaaaguucuggaaaucuugauuugggagacaggaaugaagccuagagaacugugaucuugucuggcuuucacgggagauuucauucaguuugugcaucugaaaaaccggcccucugacgcaugcaggagguuaugaaggaauaagaccuuucuaacaguuauuuguguuuucuuuggaaauuugguuaccgaggcuggucagggcuguggaaggacgcuuaagucuggaguguugagagccuguggacacuuccauggugguuugaagucccaaagcccccucacuggaguggcagagucugaaaaacugcacacugaacccaaauguccuuccuuagcaguguggaguauacucucccccaccugucacuuuucuagaugaggcuuggagggugcugaggaagggagcuggccuuaucagcccucgcuucuagccaguaugauucuaaaacuguccugggaaaaagaaaagaaaaccaggagccaggagcagaacugggagccucccucuuuugacagggcugggguaccccaucucuuagcucugcccagggggcuggugaggacccuaauguagggaguguauguaggccgccugucauugacaaguucucggccuuugucagauguuggacaaggccauaagguuccuggcuuggugcagau

SEQ ID NO: 19520 - RNA, 2507 nt, Homo sapiens
aucugcaccaagccaggaaccuuauggccuuguccaacaucugacaaaggccgagaacuugucaaugacaggcggccuacauacacucccuacauuaggguccucaccagcccccugggcagagcuaagagaugggguaccccagcccugucaaaagagggaggcucccaguucugcuccuggcuccugguuuucuuuucuuuuucccaggacaguuuuagaaucauacuggcuagaagcgagggcugauaaggccagcucccuuccucagcacccuccaagccucaucuagaaaagugacaggugggggagaguauacuccacacugcuaaggaaggacauuuggguucagugugcaguuuuucagacucugccacuccagugagggggcuuugggacuucaaaccaccauggaaguguccacaggcucucaacacuccagacuuaagcguccuuccacagcccugaccagccucgguaaccaaauuuccaaagaaaacacaaauaacuguuagaaaggucuuauuccuucauaaccuccugcaugcgucagagggccgguuuuucagaugcacaaacugaaugaaaucucccgugaaagccagacaagaucacaguucucuaggcuucauuccugucucccaaaucaagauuuccagaacuuucugguuaccuuuuaauaauucaucacuagggagguuucuuuuccuucaaaacuucacucgaucaugucccccuacccuucccuccaaaugucuaaaccucuuccuccgucaucccuccccuuuuccucuccaacuccaauuuccccagggucuucaacaccuccuugaaucccccggcacccugcuuccagaauagguggagcaucuccucuucuuacaaaaugucuuuucccguggcuuagagccaccuccucacgggccccucauccccgccauccuuugcucacccaccagcucaggcccuuugugacccgcuucgucaacuuccuugcccuccuuuucccaugaccgagggucccauccugcacguaaccugcccccaaaguuucgggaucugucccuccaacucucccgggugcuguccccgcccucuccaaaacucaggccugagccuguucuuuccaagggugcccccaucuuaccgcggcaccucccgccccccagacccggcuccgccgcacuuacccgaccagagcacgagcuugccgugcgcuuccuccugggaguccgagucuccggccagcaguguggagguggccccguagggcagcaccgagcccaggcacacguuguagcgcagcggcucgcagggggcagcccggccgcaguggcucagcggcggcggagggccagucaccgccgcgcuccuccucgcgcucccgcccgcgcuccgaggcccaggcccggucgcguucccgcucgaggccgccccccggcccgggucccccagcagcagcagcagcagcagccccaggagcgggagcuccggcccccgcgcugggcgggcagcggccauggccaaccccgccaacucagcaaaagccccggcgcccccgccugcuccucggagccccccggccacacgcacgaccucggcggccgcggaggcggcucaggcgaccugugcgcccagagaauccgggcccgggcccccccggacgcuccgcgcgccccggccccucggcgcccaacuucgcaaacuuuggaacccggggcccauguugggcugcggaggcccggaacgggaugcacgacuccccaagcccuagccucgcaauccaaguugucuucagcccuaggagaccccugggcccccaauccccagccccauucccucucccaccauuaaagccaccuccccgccccgcgagggaggccagacgcgggccgggggugcgagugcagcuccggcuccgcccccgcgccagcccgcggcccagcagccaccuucgccccagcgcgccgcagccccccgaacucuccccgccggcgacccggcuccuuuguugcucuagcucgcugggcucucuggaaugcacgggccucgcggagccaagcccggccccccugcgccgaggcugggggagggacuggacgaaggagcggagagguggggaggggaggcgagagaggaagagcgcgagcgucagcgucccuggcgccuggaggggcccgggcuagggggaucuggugaccccgccugccgccgccccgcgcccgggggaaagagaugaguggaaaucgugggccggaccugcaaggagagacucggcgggcaccuugcuuggucugaggucgucugcaggaagcggacuuuucuccuggcucaggaugggaaagacaggggaugccugaagucaacggggacuucuguuccaucucugccccguucuccaggcccgccaguuuuuccugcuuugguuagauuuuccaacguaucccggggccccauggagaagaaccuggguuugggguuugcgcuucuccaaauccuuccagcuc

SEQ ID NO: 19521 - RNA, 2653 nt, Homo sapiens
ccgggcggcggcgggcgcgcgcgggggcggcagagagcgggcgcgcccccgcugcccggcgccgcgaccgcgccuccaccgccccgggcaccgccggccgcgcgccccggcaggccgggggcgggagggcagagggcaccacccuguuuaccgccacggccccgccccgccagcgcccgcucccggaaacggucucccgggagagggccggcgagugcgcacccacccgcggcggggaacgccggcccugcgugggaggcgcccggcuccggcggcccgccgcccccggcugcugcgugucacccccgucacgacucugcuacgcacuucgcccccagcuuucagcuccggcgcuuccgcagaccccucacguggcugccgccucccugccauggcacuccccggcgaccggggcugcggccccuagcgcugcgagggaucccgagccugugcccaccccaccuuggacgucacccuccucggaccacccaacccacaccuuccgccuagggcggggcgaggggaggacggcuacgagcugucaggagccuccagcuuuccccgugacgaagcucacccucgcccugaugucgccacucacccagcagcgggcugcgagcuggagcagacguuaacaccgagggaggacugaagggaacgucuugauuuuucuccuuaauuugccacagacacagggaaaaaaaaaaaaaaacaaaaacagcagacgcagcucuaccuuugcgcuggcuuuaaagcuuuuaagcuccccacgucauccuaccccaugcaacagacuuaccgaauagcaaugcccaccccacacaccugcuagguaacucgccuucuggaaaucgggggccccacccaccccgccuucuggaaaccugcgccuggggugggguugaagagacacugucugguauccuaaagucagagggcgugaggagaccggcgcccuucgccccacccaggcgcgcugcacccuccgguccccgucucuagagugcaccaaggcauccugcgucccugccggagaaaagagggacggggccagaggcccgaguuccagggaguugcugauuccaguggagaaccgagacaccgcguccuuucuaauuaauaagcacgccacccccuaccuccaacccccccccccgccccgccuuuauuucuuguugacagcaaaggugggggacgugggagaaaggcaagaguugucucuagguucgggauguugggcugcgcggagggaagaggugggaucucgaaauggaaacaguccccccuuccuccccccuccccuccuccuccuccuccuccucuucuucuguuuaccucaaguuugaauuuuaucugcgcaacauuagcuggaaugcggacauugaaaaaaaaaaaaaaacacucucucagcccggcagcagcuccggaggagccauguggcaucaagccacagcaaaggggaaaaagugcucuuagcaacacaaacauggcgaaaucgcucucacaagccggguucccgcgacagcccuaccuucccccgcucgccuuccgaacguccuggccaggaaccgcagaccccuuccgggggacggcgagggggccccgggcugagcgagggugggcgcacggggcgugcuaaggggaaauugacuagccagccgaucagcuccgccggcagcggaggggacgccuucuucacgcccugagaucgcaaaggagagcaaaauucccaucccaaaguccugcgggaccggcuuccccacccgacgaacuuaccccagggcugaacgcacgcugcuuuagcuccuugccucguuccuuccucccgggcgcgacgcgaggugaaaaugaugcgcacguagauuuguagagcguauucuugagaauuucccugggaugaaucgggaggagcgguggagacuccggagacaggugccgcgcuggucugggcugccggcuaaaaguuguccuccgcgcggugggcggugggguccccggccagggccaaggaccccggcucccugccccccggcgucgcccacuugucacgccaggcugcugcgugcacucggcugcaggggagguggcguaguuucucuuccucccaccucuucucacucacuuguuuuuguagccgugggcuccccuaaugcuuuccucuccacaauguuguuucauuauaucauguccaucaugugacaccagagaggccucucuauggaaacuuaaaggggcucccacgugacugcagcagcaacaacagcagcaggacuggcggcggcggccgcagcggcguccguaccuccacccaccgggagccccucgaagcaucccggaggggcuucuggcgcugcaggagccccgaucggggagccacagcauccgggagccguggugucugugcgugcguggagccugugcucaugacauaggaagccgaacagaaggagcguccucaaauccuuuccuacagucaccaaacccacgcucuguuaaaaugacauuucguggcuccuacuuuguuuccccggagagcaaugaguuuucuaucaggccugauuuaguuugacaaaagucaaaaagaaaaacuggauuugucccucugcgaguucagucagaucgcugggaaaacagaaaugacaaaacaauaaua

SEQ ID NO: 19522 - RNA, 2653 nt, Homo sapiens
uauuauuguuuugucauuucuguuuucccagcgaucugacugaacucgcagagggacaaauccaguuuuucuuuuugacuuuugucaaacuaaaucaggccugauagaaaacucauugcucuccggggaaacaaaguaggagccacgaaaugucauuuuaacagagcguggguuuggugacuguaggaaaggauuugaggacgcuccuucuguucggcuuccuaugucaugagcacaggcuccacgcacgcacagacaccacggcucccggaugcuguggcuccccgaucggggcuccugcagcgccagaagccccuccgggaugcuucgaggggcucccgguggguggagguacggacgccgcugcggccgccgccgccaguccugcugcuguuguugcugcugcagucacgugggagccccuuuaaguuuccauagagaggccucucuggugucacaugauggacaugauauaaugaaacaacauuguggagaggaaagcauuaggggagcccacggcuacaaaaacaagugagugagaagaggugggaggaagagaaacuacgccaccuccccugcagccgagugcacgcagcagccuggcgugacaagugggcgacgccggggggcagggagccgggguccuuggcccuggccggggaccccaccgcccaccgcgcggaggacaacuuuuagccggcagcccagaccagcgcggcaccugucuccggagucuccaccgcuccucccgauucaucccagggaaauucucaagaauacgcucuacaaaucuacgugcgcaucauuuucaccucgcgucgcgcccgggaggaaggaacgaggcaaggagcuaaagcagcgugcguucagcccugggguaaguucgucggguggggaagccggucccgcaggacuuugggaugggaauuuugcucuccuuugcgaucucagggcgugaagaaggcguccccuccgcugccggcggagcugaucggcuggcuagucaauuuccccuuagcacgccccgugcgcccacccucgcucagcccggggcccccucgccgucccccggaaggggucugcgguuccuggccaggacguucggaaggcgagcgggggaagguagggcugucgcgggaacccggcuugugagagcgauuucgccauguuuguguugcuaagagcacuuuuuccccuuugcuguggcuugaugccacauggcuccuccggagcugcugccgggcugagagaguguuuuuuuuuuuuuuucaauguccgcauuccagcuaauguugcgcagauaaaauucaaacuugagguaaacagaagaagaggaggaggaggaggaggaggggaggggggaggaaggggggacuguuuccauuucgagaucccaccucuucccuccgcgcagcccaacaucccgaaccuagagacaacucuugccuuucucccacgucccccaccuuugcugucaacaagaaauaaaggcggggcggggggggggguuggagguaggggguggcgugcuuauuaauuagaaaggacgcggugucucgguucuccacuggaaucagcaacucccuggaacucgggccucuggccccgucccucuuuucuccggcagggacgcaggaugccuuggugcacucuagagacggggaccggagggugcagcgcgccuggguggggcgaagggcgccggucuccucacgcccucugacuuuaggauaccagacagugucucuucaaccccaccccaggcgcagguuuccagaaggcgggguggguggggcccccgauuuccagaaggcgaguuaccuagcagguguguggggugggcauugcuauucgguaagucuguugcaugggguaggaugacguggggagcuuaaaagcuuuaaagccagcgcaaagguagagcugcgucugcuguuuuuguuuuuuuuuuuuuuucccugugucuguggcaaauuaaggagaaaaaucaagacguucccuucaguccucccucgguguuaacgucugcuccagcucgcagcccgcugcugggugaguggcgacaucagggcgagggugagcuucgucacggggaaagcuggaggcuccugacagcucguagccguccuccccucgccccgcccuaggcggaagguguggguugggugguccgaggagggugacguccaagguggggugggcacaggcucgggaucccucgcagcgcuaggggccgcagccccggucgccggggagugccauggcagggaggcggcagccacgugaggggucugcggaagcgccggagcugaaagcugggggcgaagugcguagcagagucgugacgggggugacacgcagcagccgggggcggcgggccgccggagccgggcgccucccacgcagggccggcguuccccgccgcgggugggugcgcacucgccggcccucucccgggagaccguuuccgggagcgggcgcuggcggggcggggccguggcgguaaacaggguggugcccucugcccucccgcccccggccugccggggcgcgcggccggcggugcccggggcgguggaggcgcggucgcggcgccgggcagcgggggcgcgcccgcucucugccgcccccgcgcgcgcccgccgccgcccgg

SEQ ID NO: 19523 - RNA, 2552 nt, Homo sapiens
gaaaaacagugccauccuugaagccagcagugagcuggagucagagcuuugcccacuggugacuuaugaacauuuccuuuuagggcagacagggagggucuugucccacagugccucccacuccucaaaggaaggguggcucagcuuccuuaagcucagaagcacuagggacuaaccccucuuuccugacacagcccaacgcccuucugggugguucuaagaggcuucccaacaaaagguucguaugaaggcccacccugaaguccagcuguccccagaguagggcuaaggagccaccauacucucgugucaucucaacccugcaugucguguggcucuucagugauugccacucugaaagcuguucugacuguuccucacacugcagccccucuuccagggacacacauucuuccccccgccgggaccuucccuuucuagucaggcugguggagucucccgccggccacaggaggaugcccacgccugccugcucccugagugccagcgccugcccacuaccaaagguuuccugcggugcagaggagagacuguacugcccuuccaucuccccuggccccuuagaguccagucccaaacugccggcaccugcucacagcagaaucccuacccugucugugcuguccccgcaguccuccuggcccuagggugaucacaccaccucagcucuuccugcagacaugugcucaggugggcaaaagagaaugagaaaugcaccucucccguggggcugagcugacucuggcuguucccuaggggcuuaagaacaccuguucugguugaguuugcagccaucgccugucccccaaaagggaaagaguaacauuucaccuugaaaagaaacagggaggggauguuucugaggugcagguguuucaugagagacagguacauuuucuaaggugugucuaaaaugcagcccaauccuauucuacgagagagaaguucccguuugaacaaguucccguuugaacaagaggauucgaggggggucucaccaucguagccacgcacuaagaagcgauuguuuuagggacacggagguaggacccccacucagccaggugacucugggacuguggaagguccacuuacgacucuguaccugccccagcacgggcucaaggaguugagccugcacacauuacuuagaaaaaaccucugcaaacggguaaguacaucgcccgcgugggccguggcuggaggcuugucaccugcuucagggacuuccucgggagccucucgccugccucuuugccuggaauuaacgaauacacacuacagccccucauucccuccaacacgaaggaaagguguaaucagaucccgagagucccgcagaagcguggagccucgcggugcggucucccuuuucuuucccaugcaaacccacuuagcaccggcgcgccccuguuugcccgggcagaauccaccgcccacuccucccgaguggagaguggagacgaaucuacgcccaggcccugcaccugccgcgcugcggaguuuggagggggcguggauggugcaaggucagggcuccgugugugaccccggcggugauagggcugcucggggucggaccacgcggcgcgccgggcuucccugcagcucggccgggcagggggcacaugggcacggugggagucccggcggaacccaggccggccacucaccauucugggagggcgacggcgacggcgacggcgacgacggcagcagcggcggcguugacaacaguagcagcagcgccgagagcgccagcgcgcagcgcaucgugucgucgccucugggccgggagcagguggcugcggugccggcggaggauccgcgcguccgggcgguaggagcgugggcgccgcccggggaggccuguggguggcuccggaggccaggcuguggcccggggcucccgagucgcgcugcggcggcucuuccucccugccgcugcagcagagccgggcuggggcgcagagccaguggcagaggagcggcggcggcggcggcugcguccugggcggcgucugcgcggcugcggccccacuggcggcugcggcuacuccuggcccgucccgucagcgccggcccccgcccccgcccccgccccucccccucccccaggagcccgccagcggcggcggccgggccgggcggggccggggccggggcugggcgggcgcugggccgugaacaaugagcagaggaggaaacuccgcccuggagcgcgacgggcgggagggccggcggccuccgcgccuuggggggcugugugugcgcgggggccagggcggggggcuccugcggugcagccgggccccguccacaggugucccgaacagguguguccccccgagugcuucuaagugggcccggcgggaucccccagcacaccgccggggcccucgcacuacgagcaaauccggagcgggcggacccccagccuugcgugguaacugauaaccauucacggccucccgggcugcugcgcguucugcagcgaccccggagaagcucaucucccaccugccaagugc

SEQ ID NO: 19524 - RNA, 2552 nt, Homo sapiens
gcacuuggcaggugggagaugagcuucuccggggucgcugcagaacgcgcagcagcccgggaggccgugaaugguuaucaguuaccacgcaaggcuggggguccgcccgcuccggauuugcucguagugcgagggccccggcggugugcugggggaucccgccgggcccacuuagaagcacucggggggacacaccuguucgggacaccuguggacggggcccggcugcaccgcaggagccccccgcccuggcccccgcgcacacacagccccccaaggcgcggaggccgccggcccucccgcccgucgcgcuccagggcggaguuuccuccucugcucauuguucacggcccagcgcccgcccagccccggccccggccccgcccggcccggccgccgccgcuggcgggcuccugggggagggggaggggcgggggcgggggcgggggccggcgcugacgggacgggccaggaguagccgcagccgccaguggggccgcagccgcgcagacgccgcccaggacgcagccgccgccgccgccgcuccucugccacuggcucugcgccccagcccggcucugcugcagcggcagggaggaagagccgccgcagcgcgacucgggagccccgggccacagccuggccuccggagccacccacaggccuccccgggcggcgcccacgcuccuaccgcccggacgcgcggauccuccgccggcaccgcagccaccugcucccggcccagaggcgacgacacgaugcgcugcgcgcuggcgcucucggcgcugcugcuacuguugucaacgccgccgcugcugccgucgucgccgucgccgucgccgucgcccucccagaauggugaguggccggccuggguuccgccgggacucccaccgugcccaugugcccccugcccggccgagcugcagggaagcccggcgcgccgcgugguccgaccccgagcagcccuaucaccgccggggucacacacggagcccugaccuugcaccauccacgcccccuccaaacuccgcagcgcggcaggugcagggccugggcguagauucgucuccacucuccacucgggaggagugggcgguggauucugcccgggcaaacaggggcgcgccggugcuaaguggguuugcaugggaaagaaaagggagaccgcaccgcgaggcuccacgcuucugcgggacucucgggaucugauuacaccuuuccuucguguuggagggaaugaggggcuguaguguguauucguuaauuccaggcaaagaggcaggcgagaggcucccgaggaagucccugaagcaggugacaagccuccagccacggcccacgcgggcgauguacuuacccguuugcagagguuuuuucuaaguaaugugugcaggcucaacuccuugagcccgugcuggggcagguacagagucguaaguggaccuuccacagucccagagucaccuggcugaguggggguccuaccuccgugucccuaaaacaaucgcuucuuagugcguggcuacgauggugagaccccccucgaauccucuuguucaaacgggaacuuguucaaacgggaacuucucucucguagaauaggauugggcugcauuuuagacacaccuuagaaaauguaccugucucucaugaaacaccugcaccucagaaacauccccucccuguuucuuuucaaggugaaauguuacucuuucccuuuugggggacaggcgauggcugcaaacucaaccagaacagguguucuuaagccccuagggaacagccagagucagcucagccccacgggagaggugcauuucucauucucuuuugcccaccugagcacaugucugcaggaagagcugagguggugugaucacccuagggccaggaggacugcggggacagcacagacaggguagggauucugcugugagcaggugccggcaguuugggacuggacucuaaggggccaggggagauggaagggcaguacagucucuccucugcaccgcaggaaaccuuugguagugggcaggcgcuggcacucagggagcaggcaggcgugggcauccuccuguggccggcgggagacuccaccagccugacuagaaagggaaggucccggcggggggaagaaugugugucccuggaagaggggcugcagugugaggaacagucagaacagcuuucagaguggcaaucacugaagagccacacgacaugcaggguugagaugacacgagaguaugguggcuccuuagcccuacucuggggacagcuggacuucagggugggccuucauacgaaccuuuuguugggaagccucuuagaaccacccagaagggcguugggcugugucaggaaagagggguuagucccuagugcuucugagcuuaaggaagcugagccacccuuccuuugaggagugggaggcacugugggacaagacccucccugucugcccuaaaaggaaauguucauaagucaccagugggcaaagcucugacuccagcucacugcuggcuucaaggauggcacuguuuuuc

SEQ ID NO: 19525 - RNA, 2868 nt, Homo sapiens
agagcagugaucagaauaaaucaaacagcauuauaguaaaaugccugcacaaaaugucuaaauguguuacaaucccuucuuugcacaguagccuuagucugaaaaccaucacucacacacacacacacacacacacacacuccguauacacaaauucacaaagccaugcucacugccugugacugacaaggaaugggggcagguacuagcccucuggcgcuuuuaucaauugauagauaucaauuggccaauaucaauaauugaucaauuaucaguauuauccacccuaucugucuguaauuaguauaaaacuucuuuucucuuucccuucccuaagacucuaccacuggagcuaccaauacuaaaucagaccgugugaaugugcccuuucuauuccuucuaguuacucugaaauauuucccaggauaagucaaaugcugguagcuguuuaccuguaaaugaugggguacaguauaagcaauaugauuaguuacaaaguauugguuuuugucuagcauuacggguaacuuuggucaaaaaagaccaauacuuuucaaacuacugguaucuaggaaucucaaaugcgagucaaccagcaugugugaugaacacuuaaaaaaaagagaaaagagccacugcauuccagccuaggcgacagagugagacacugucugaaaaaaaaaaaaaagagagagaaaaaagaaugcauuacauguagaaggagucagcacuacuucaugaaaugucuauuucaguuacauaaguacuguacguguaugugagcauauugguugugauguaaaauuaacuucacaugauagaucagucaaaagaguuugaaagccauggaauguggcaaagaaacaagcagaagucacaaaggccugaauuguccccacaaacucugucccugcaaauggagcuccacagugaaucccacauucuuccuguguccuacagcugagaaccccaaaauuaccggccuggaacccaucaucagcugccauaccagauuccccuucuccagauccuaaccccuuuuuuucuccacuccaucccaccucaucccagaaagcagccaauauuuucccgcacgaacaggcacuccacacuccagcagcugcccuggagacauugacagucacaccuggguuuccuuaagcccugacaccacgacuccugcgaugacaccuccuucccccaaccccgaacagcagagccacucucagagucagaagucccuagcugacccuccaaggcuuccugggcgcgcagggucguucuuccaccuucugucccccguggacucucaccuggaaaacgcacaccccccugccgggugguuaggcuaagauuaugugggauaagacuuuaauucuccaagcaucuccgaaagacagccuauccggggaggcuucuccuuuaaucagccuucagcugaaucccucagccccaucccuuaaugcucccggcguuaauuccucaaaauaaugcagucagagaaagugaacuuggccgcuaggaaaguuaccccagaggaagcgacggggagcuagggcgagcggggagcgggggacgggguggggggcgagcggggagcgggggacgggguggggggcgagcggggagcgggggacgggauggggggcgagcggggagcucagggcgcucgcccgggggguuuccuccgcacaacgugaaaaaucuucuagcccccaagaaaagaaaacaaaacccaacguggccacaaaccggaugcccugucacugaagugcgaacaccacuguggggcugggacucagaggagaggaggggaggggagaggaggucggcggggcuggaacaaagcccucggggccgcuccgagaggccgcgcgccagcacccagcugcgccccgagggagagagcugaggacuggccgacccccgcccuuccccaagcccgggagcccggggccggcccuggugcggggugcggggccgggagggcaggugcgcgcgcagcgagccccucccccgcgcccccaaagcucgggggcaccccgacccuccccacgcgccuggccccggcgcggcccucacccgagcgggggucgaaggugaccacgaacacggccaccaccugguccuccuccacgucgcccagcuccaggcgcccgggcugcagcagcaccuccggggcggccggcuccucgggcucccgccuccggggcggcuccgcggccggccgggcgcccccgccgccgccccggccccagccucccgccugcggcugcggggccugcggcagggagacggcggggcccucggcccagcgcagcagcggcgccgcgucucccugcuccaccauggcuaggcgaggcggagccgcgggcgcgaggggcggggcgggcgggcugcgggaaccccccucgccuggccgcgccaacgccgccgccgcccgccgggucuggcgcugcccggggccccgccgcggaggcgccuuucccacggagccagagcaggcguccgcggagccggcuucgggaaccgcgagccuauucggaggcgcccgugugcacguccgugugugggacgcgugcggccggaacguucauccuugcguccauacaccugugugcggguggaggugccuucucaccuaggguuccgugguauagcuaccacugugaguuuuuaugucaccauuauuuuuuaaaguccgcugguccuguggaccgugacagauauguauuacauaauccuggauguguggcagaagcugcuucuaagcagaggagugaagcagaggugcucuggcuacccagguguuugcaauauacucaucaauaaacacugaaaaggccauaggguuaaaguuugggaauu

SEQ ID NO: 19526 - RNA, 2868 nt, Homo sapiens
aauucccaaacuuuaacccuauggccuuuucaguguuuauugaugaguauauugcaaacaccuggguagccagagcaccucugcuucacuccucugcuuagaagcagcuucugccacacauccaggauuauguaauacauaucugucacgguccacaggaccagcggacuuuaaaaaauaauggugacauaaaaacucacagugguagcuauaccacggaacccuaggugagaaggcaccuccacccgcacacagguguauggacgcaaggaugaacguuccggccgcacgcgucccacacacggacgugcacacgggcgccuccgaauaggcucgcgguucccgaagccggcuccgcggacgccugcucuggcuccgugggaaaggcgccuccgcggcggggccccgggcagcgccagacccggcgggcggcggcggcguuggcgcggccaggcgagggggguucccgcagcccgcccgccccgccccucgcgcccgcggcuccgccucgccuagccaugguggagcagggagacgcggcgccgcugcugcgcugggccgagggccccgccgucucccugccgcaggccccgcagccgcaggcgggaggcuggggccggggcggcggcgggggcgcccggccggccgcggagccgccccggaggcgggagcccgaggagccggccgccccggaggugcugcugcagcccgggcgccuggagcugggcgacguggaggaggaccaggugguggccguguucguggucaccuucgacccccgcucgggugagggccgcgccggggccaggcgcguggggagggucggggugcccccgagcuuugggggcgcgggggaggggcucgcugcgcgcgcaccugcccucccggccccgcaccccgcaccagggccggccccgggcucccgggcuuggggaagggcgggggucggccaguccucagcucucucccucggggcgcagcugggugcuggcgcgcggccucucggagcggccccgagggcuuuguuccagccccgccgaccuccucuccccuccccuccucuccucugagucccagccccacagugguguucgcacuucagugacagggcauccgguuuguggccacguuggguuuuguuuucuuuucuugggggcuagaagauuuuucacguugugcggaggaaaccccccgggcgagcgcccugagcuccccgcucgccccccaucccgucccccgcuccccgcucgccccccaccccgucccccgcuccccgcucgccccccaccccgucccccgcuccccgcucgcccuagcuccccgucgcuuccucugggguaacuuuccuagcggccaaguucacuuucucugacugcauuauuuugaggaauuaacgccgggagcauuaagggauggggcugagggauucagcugaaggcugauuaaaggagaagccuccccggauaggcugucuuucggagaugcuuggagaauuaaagucuuaucccacauaaucuuagccuaaccacccggcaggggggugugcguuuuccaggugagaguccacgggggacagaagguggaagaacgacccugcgcgcccaggaagccuuggagggucagcuagggacuucugacucugagaguggcucugcuguucgggguugggggaaggaggugucaucgcaggagucguggugucagggcuuaaggaaacccaggugugacugucaaugucuccagggcagcugcuggaguguggagugccuguucgugcgggaaaauauuggcugcuuucugggaugaggugggauggaguggagaaaaaaagggguuaggaucuggagaaggggaaucugguauggcagcugaugauggguuccaggccgguaauuuugggguucucagcuguaggacacaggaagaaugugggauucacuguggagcuccauuugcagggacagaguuuguggggacaauucaggccuuugugacuucugcuuguuucuuugccacauuccauggcuuucaaacucuuuugacugaucuaucaugugaaguuaauuuuacaucacaaccaauaugcucacauacacguacaguacuuauguaacugaaauagacauuucaugaaguagugcugacuccuucuacauguaaugcauucuuuuuucucucucuuuuuuuuuuuuuucagacagugucucacucugucgccuaggcuggaaugcaguggcucuuuucucuuuuuuuuaaguguucaucacacaugcugguugacucgcauuugagauuccuagauaccaguaguuugaaaaguauuggucuuuuuugaccaaaguuacccguaaugcuagacaaaaaccaauacuuuguaacuaaucauauugcuuauacuguaccccaucauuuacagguaaacagcuaccagcauuugacuuauccugggaaauauuucagaguaacuagaaggaauagaaagggcacauucacacggucugauuuaguauugguagcuccagugguagagucuuagggaagggaaagagaaaagaaguuuuauacuaauuacagacagauaggguggauaauacugauaauugaucaauuauugauauuggccaauugauaucuaucaauugauaaaagcgccagagggcuaguaccugcccccauuccuugucagucacaggcagugagcauggcuuugugaauuuguguauacggagugugugugugugugugugugugugugagugaugguuuucagacuaaggcuacugugcaaagaagggauuguaacacauuuagacauuuugugcaggcauuuuacuauaaugcuguuugauuuauucugaucacugcucu

SEQ ID NO: 19527 - RNA, 2533 nt, Homo sapiens
ccaaaaacagugagcagagaaaccaagggugagcuggaggcauuucaccugacuguggggagagaagugauggauuaaaguggagggaagcuggugagcaggaggagaaaagagaacuuuuuaaaauaggaauuaagaaaauaggaauucaagucagagagaagacagaagauggugggagggguggacagggucugagggcugagugggaaacugcaggacucaggggaaggaggguccuuguuacagccgggccagagcuccugguggagggagacuccuggacugagggcaggauggugccgcggagagucuugcggaagaacugcuugggucuucauaaagggacuauucaagcagcagauggcugccugaaccaucugaccguacaggcccuuuauacucaugagguuuuacaauugugaguuuaggggucggcuccauuuuugggaaggggagcauugaauggggcugggcacgaggaggcauucagcacaucagcagggcugggggaaaggaaggggcuuguggugaaccggacugaggagggaggacccuccaaaguuggccugcuguccccuggggcuccgcgggguggugacugggggaaaagaggaaagauggcccuccggacacagcaggaauggggcagguggagaagagccugaggagaagggagacaggggagggcggggugcggggggagaggggagcgggagguggccuuugugagagacggagagcugagucagagcuguggggggcagcggggagggagagagccgcggagaaggggugaaagcagaggaggaggggguauccauggaaauaaaccgggucucagggaaaucaggcuucuggagagugaguuuguuuguaauaauaauacgaauuauucucucagccugaggucaccgggagguguaggcgggagaaauugggaguuggaaaggggaagaaugggggagggggugggagagggccggaugaauucgcugagcggcgagaguggagugggugccugggugggggucaggggcgguagccaggcagaagcuggagggagaagauggauuaggaggcgccucucuucccuccccgcgucaaagguaaauaaagagccggccccgccccgccggcccccgcugacaggugcaggcggguccccggccgccgaggcagggccggccccacccucccgggccgcgggcucccgaccccucccagcgccucgaagcccccaucuccuccccgcgucccccagccccuucccuccacccggcccuggcccugucccuccgggcguggaacccgggcucaucccgcccccgccccagagggaaaacgcacgugaacaaagcgaaucggaggaggcaggaacgacaguaaaaggcaacggagagggagagagagauggggcaaagcacccgagccagauggaggcggcggcgggggguggcguggggggcgugcgaaagaaacucggggcuggcgcggaggccgaggguccuucgcggggggcugcuccggagugggggaugcgaggaggcgcuggggacggcggagcagaggcggauggccuggaggggcagggaugaggggaccgagcgucgggccgagaggcagaggagaggagggcgauggagaggauggagaggaccgcgccugcgggagggcgacggggagaaggaagcgagccgagcgggauggcagccccggaggcgcaagacgagagcgggcaggaaggagggacagagggaccgcgggcggacggaaggaaagugaaggagcuagcagggcaaggcgggugcggagcggggcgcccggaggcgcgaggagagggaugggggagggggucggagggcggcccggggggcccagcccugcccccgcccggccgcgguacccacccacaguccgggagccgaugcagcccauggcuccgggggccgcagagccgggcccucaccgacucggggcgcgcgccggggggagcaccgggagccgcgccgccgccccagccgcucugcagcgccgcggcugucuccgcucggcuccgcuccccccuccccucuccaucccuccccacggcagcuccgucgccgccgccgccgccgccgccgccgccgccuggcucccccgccccggcucggcucgccgcggccggggagggggcggcccggggauuggcugcgccccgcgccuccccgccccugcuccggccgugccggggcgcucccucggggaucuggggccgccgucgccgccccccuccucccgcccgugccaagccccgcucccggggcucucuccuggagaaccccggcuuggguuucaggagccgaggcacgaacccagggccuaccccgagguucugguugauggauuuugcgggccggggucaggggaugcccugagagaaaguggggugguggugagaauaaagccaggcccaagggccuuuggccaccaaauuccgcaaacacuuguuuuccuccuggggccgcaucugggacacacacaggaacgugau

SEQ ID NO: 19528 - RNA, 2533 nt, Homo sapiens
aucacguuccugugugugucccagaugcggccccaggaggaaaacaaguguuugcggaauuugguggccaaaggcccuugggccuggcuuuauucucaccaccaccccacuuucucucagggcauccccugaccccggcccgcaaaauccaucaaccagaaccucgggguaggcccuggguucgugccucggcuccugaaacccaagccgggguucuccaggagagagccccgggagcggggcuuggcacgggcgggaggaggggggcggcgacggcggccccagauccccgagggagcgccccggcacggccggagcaggggcggggaggcgcggggcgcagccaauccccgggccgcccccuccccggccgcggcgagccgagccggggcgggggagccaggcggcggcggcggcggcggcggcggcggcgacggagcugccguggggagggauggagaggggaggggggagcggagccgagcggagacagccgcggcgcugcagagcggcuggggcggcggcgcggcucccggugcuccccccggcgcgcgccccgagucggugagggcccggcucugcggcccccggagccaugggcugcaucggcucccggacuguggguggguaccgcggccgggcgggggcagggcugggccccccgggccgcccuccgacccccucccccaucccucuccucgcgccuccgggcgccccgcuccgcacccgccuugcccugcuagcuccuucacuuuccuuccguccgcccgcggucccucugucccuccuuccugcccgcucucgucuugcgccuccggggcugccaucccgcucggcucgcuuccuucuccccgucgcccucccgcaggcgcgguccucuccauccucuccaucgcccuccucuccucugccucucggcccgacgcucgguccccucaucccugccccuccaggccauccgccucugcuccgccguccccagcgccuccucgcaucccccacuccggagcagccccccgcgaaggacccucggccuccgcgccagccccgaguuucuuucgcacgccccccacgccaccccccgccgccgccuccaucuggcucgggugcuuugccccaucucucucucccucuccguugccuuuuacugucguuccugccuccuccgauucgcuuuguucacgugcguuuucccucuggggcgggggcgggaugagcccggguuccacgcccggagggacagggccagggccggguggagggaaggggcugggggacgcggggaggagaugggggcuucgaggcgcugggaggggucgggagcccgcggcccgggaggguggggccggcccugccucggcggccggggacccgccugcaccugucagcgggggccggcggggcggggccggcucuuuauuuaccuuugacgcggggagggaagagaggcgccuccuaauccaucuucucccuccagcuucugccuggcuaccgccccugacccccacccaggcacccacuccacucucgccgcucagcgaauucauccggcccucucccacccccucccccauucuuccccuuuccaacucccaauuucucccgccuacaccucccggugaccucaggcugagagaauaauucguauuauuauuacaaacaaacucacucuccagaagccugauuucccugagacccgguuuauuuccauggauacccccuccuccucugcuuucaccccuucuccgcggcucucucccuccccgcugccccccacagcucugacucagcucuccgucucucacaaaggccaccucccgcuccccucuccccccgcaccccgcccuccccugucucccuucuccucaggcucuucuccaccugccccauuccugcuguguccggagggccaucuuuccucuuuucccccagucaccaccccgcggagccccaggggacagcaggccaacuuuggaggguccucccuccucaguccgguucaccacaagccccuuccuuucccccagcccugcugaugugcugaaugccuccucgugcccagccccauucaaugcuccccuucccaaaaauggagccgaccccuaaacucacaauuguaaaaccucaugaguauaaagggccuguacggucagaugguucaggcagccaucugcugcuugaauagucccuuuaugaagacccaagcaguucuuccgcaagacucuccgcggcaccauccugcccucaguccaggagucucccuccaccaggagcucuggcccggcuguaacaaggacccuccuuccccugaguccugcaguuucccacucagcccucagacccuguccaccccucccaccaucuucugucuucucucugacuugaauuccuauuuucuuaauuccuauuuuaaaaaguucucuuuucuccuccugcucaccagcuucccuccacuuuaauccaucacuucucuccccacagucaggugaaaugccuccagcucacccuugguuucucugcucacuguuuuugg

SEQ ID NO: 19529 - RNA, 2666 nt, Homo sapiens
ggcccaagaaggccuugaaacgauuucugucagcucuggaaaccagccgcgccacccccucaccuggcaggucugucaccgccaaccccggcccaucagcaccgcaacuccacgccccagcguccuugccugggaaagugcaggcaagauucgauucucuggggagaggcuugagggugggagcccaggguggggagugggaaacuucaucucccagguccuccagcugucacugcccgagcuggugaaauaggagccagcccaggggcgggagugagugucacuuuagggguacugcuuggggagguccucgagaggauccucuuguagcuagaaaaugaucgccucuuccuaaaccccuaccacaaaaccaccucucacccgugccgggcugcccaaggcccggacaccgccccugcugccccuucccugcuccgccuuccgcggcucccccgccccucccccagcagacuccccucccccaucuccccggcagccuucccucugccccgccccucccgcucccucugccuuccgcccucucuccccugcgaaucgggccggcgccucggcuccgcccccggccccgccccucaggcuccgcccgcccgagcccggcagggccaaccccucgaggccccguccgggucggcccuccgcugccaccgccuccccugacccuacgcuccgggccgccucggcggcagcgcuccccucccccucucagacuccaggcugccuuucccuacccucccgguucucccccgcuccaucucccuccccggcugcacacccucucccuuccuuucccccuccucuuuuccuuccucgccaacccccgcccuccuccucucagcucuuuuccccaacccaguucuccucuccccucccuccucuccucccccaccccgguuucccuuccuucuccuuuccucgccucaccucgguucccuuccccucccccuuuccagcccucccccacgucuccccaccgcccucccccuccccccucccuucugcagcucuccuuccccuccgaggcccccgccucccuucccccucugucuccccagcaggcuccagcuucgcuucccuccccguccccaguccccagaaccgcucuuccccuccccccucccaggcugcuucccagcucccggguccuccggcccccaagccugggggucuagggcugacccgcucucucgggaccuucccgcgggcccugcccuccccacuccgucuccccuccgaacaccccuccgcgccucucuucuccgccgcggcgcccccucccuauuucugcuccccucggacuucucaccccucccaaguuuuccucccgacgggacccucagcuccaccucccugccccgccgcccucccaagcagcuccgaucgccgacuucauuccaggucccggcccccuccccagcuccggggcucaccugucagcgcccuccucucccgccccuaccgaguggcccgguccccagcgcccgcuucuuccuccccuucccccucggcccccucccacacucccucucuccuccccucggggcccgucgucccccuucccaccugccucccgcccgacccccucccagcccccgcccuucccuccagcccccccggucuccucuacccccacagcccucacccugcccgcgccggccuugcccucccuuccccccagcccccgaccuccccggacccgcgccccucccccacgcccgccguccgcgccccuacccccggggcugucaccugcgcggagccggccgugacccaaccgcggcgcugagggagacgcgggcggggccgccugcagaggagccuccccggcccuuaccuggcuggccggccgcuccgcccgcgccgcggggacccaggcgcccgggccuccugccccgccggcucugcucacaauggcgcucgccgccugcagcucgggugcugacggccugaaagacugacagacugacagccccgaaacuucgcggggaggagagggauagacgcgcggggagucgaagccgggaaacggcgccugcaagggaggagggaccgagggagcgggcggagagccccggcgcaccgggcugggggaggcaggggcaggggguuucaggaguggggucccaggagggagcaccgugggcuuaggugggcaggugaugguccuaaggcuccgagccuggaguagguguggaagugggagcucaggacgggggaggggaggggaggggaggggagggugaugggagaggggguggaggagggcgaggaggcuggggaggacaggcacucgggcugcggggaagggugccaagggagggugcucgcggccgcggagggaggagccggggaaagguggagcgcgaacggguggggggguggcggggaggaguugggggaacgaggaggggccgugucgggggggagccagcgagucgugcgcugccgucucuaagucgccggugccagccgggugugcagcgccgcgcucccgcgggaggacggcccggggggucggucugggaaacuccggccccgcccccauucuccacccggauuccaccccgauccacccagacccgcagccccucgccuggagucccgaggacccgauucgaaaccagccgcgggagccgugggggcaggcg

SEQ ID NO: 19530 - RNA, 2666 nt, Homo sapiens
cgccugcccccacggcucccgcggcugguuucgaaucggguccucgggacuccaggcgaggggcugcgggucuggguggaucgggguggaauccggguggagaaugggggcggggccggaguuucccagaccgaccccccgggccguccucccgcgggagcgcggcgcugcacacccggcuggcaccggcgacuuagagacggcagcgcacgacucgcuggcucccccccgacacggccccuccucguucccccaacuccuccccgccacccccccacccguucgcgcuccaccuuuccccggcuccucccuccgcggccgcgagcacccucccuuggcacccuuccccgcagcccgagugccuguccuccccagccuccucgcccuccuccacccccucucccaucacccuccccuccccuccccuccccucccccguccugagcucccacuuccacaccuacuccaggcucggagccuuaggaccaucaccugcccaccuaagcccacggugcucccuccugggaccccacuccugaaacccccugccccugccucccccagcccggugcgccggggcucuccgcccgcucccucggucccuccucccuugcaggcgccguuucccggcuucgacuccccgcgcgucuaucccucuccuccccgcgaaguuucggggcugucagucugucagucuuucaggccgucagcacccgagcugcaggcggcgagcgccauugugagcagagccggcggggcaggaggcccgggcgccuggguccccgcggcgcgggcggagcggccggccagccagguaagggccggggaggcuccucugcaggcggccccgcccgcgucucccucagcgccgcgguugggucacggccggcuccgcgcaggugacagccccggggguaggggcgcggacggcgggcgugggggaggggcgcggguccggggaggucgggggcuggggggaagggagggcaaggccggcgcgggcagggugagggcuguggggguagaggagaccgggggggcuggagggaagggcgggggcugggagggggucgggcgggaggcaggugggaagggggacgacgggccccgaggggaggagagagggagugugggagggggccgagggggaaggggaggaagaagcgggcgcuggggaccgggccacucgguaggggcgggagaggagggcgcugacaggugagccccggagcuggggagggggccgggaccuggaaugaagucggcgaucggagcugcuugggagggcggcggggcagggagguggagcugagggucccgucgggaggaaaacuugggaggggugagaaguccgaggggagcagaaauagggagggggcgccgcggcggagaagagaggcgcggagggguguucggaggggagacggaguggggagggcagggcccgcgggaaggucccgagagagcgggucagcccuagacccccaggcuugggggccggaggacccgggagcugggaagcagccugggaggggggaggggaagagcgguucuggggacuggggacggggagggaagcgaagcuggagccugcuggggagacagagggggaagggaggcgggggccucggaggggaaggagagcugcagaagggaggggggagggggagggcgguggggagacgugggggagggcuggaaagggggaggggaagggaaccgaggugaggcgaggaaaggagaaggaagggaaaccggggugggggaggagaggagggaggggagaggagaacuggguuggggaaaagagcugagaggaggagggcggggguuggcgaggaaggaaaagaggagggggaaaggaagggagagggugugcagccggggagggagauggagcgggggagaaccgggaggguagggaaaggcagccuggagucugagagggggaggggagcgcugccgccgaggcggcccggagcguagggucaggggaggcgguggcagcggagggccgacccggacggggccucgagggguuggcccugccgggcucgggcgggcggagccugaggggcggggccgggggcggagccgaggcgccggcccgauucgcaggggagagagggcggaaggcagagggagcgggaggggcggggcagagggaaggcugccggggagaugggggaggggagucugcugggggaggggcgggggagccgcggaaggcggagcagggaaggggcagcaggggcgguguccgggccuugggcagcccggcacgggugagaggugguuuugugguagggguuuaggaagaggcgaucauuuucuagcuacaagaggauccucucgaggaccuccccaagcaguaccccuaaagugacacucacucccgccccugggcuggcuccuauuucaccagcucgggcagugacagcuggaggaccugggagaugaaguuucccacuccccacccugggcucccacccucaagccucuccccagagaaucgaaucuugccugcacuuucccaggcaaggacgcuggggcguggaguugcggugcugaugggccgggguuggcggugacagaccugccaggugaggggguggcgcggcugguuuccagagcugacagaaaucguuucaaggccuucuugggcc

SEQ ID NO: 19531 - RNA, 2931 nt, Homo sapiens
cagcugagagaaggggcagaagccccugaaaccacgggcgggggugggguggggagcgcagcuuugggacccucuagccggagacuuccggcagcugccuccgacuuguucuaaguacaggaaaaaucugugcgcccaguugccucacuccaacagcgcgcaguugugcccggcgaggaugccgcgcuagucguggagaugccccaccacaaagaggauucaggugcuuccuacuccggcacccaguggguugguaguccuguuggcaggagacaagaaucgucugggcugcuccuaucucuggcaggacuagacggggcgugaaggaaagaaggaaagaaggaaagcagggaucgggcacugcccgagggcagauacuugggcuuugguguuguccagcgcgcucggagugcgcugccucgcucacgcggucccaggccccgcuucuucaggcagugccuggggcgggaggguugggguguggguggcucccuaagucgacacucgugcggcugcgguuccagcccccuccccccgccacucaggggcgggaaguggcgggugggagucacccaagcgugacugcccgaggccccuccugccgcggcgaggaagcuccauaaaagcccugucgcgacccgcucucugcaccccauccgcuggcucucaccccucggagacgcucgcccgacagcauaguacuugccgcccagccacgcccgcgcgccagccaccgugagugcuacgacccgucugucuaggggugggagcgaacggggcgcccgcgaacuugcuagagacgcagccucccgcucuguggagcccuggggcccugggaugaucgcgcuccacuccccagcggacuaugccggcuccgcgccccgacgcggaccagcccucuuggcggcuaaauuccacuuguuccucugcuccccucugauuguccacggcccuucucccgggcccuucccgcugggcgguucuucugaguuaccuuuuagcagauauggagggagaacccgggaccgcuaucccaaggcagcuggcggucucccugcgggucgccgccuugaggcccaggaagcggugcgcgguaggaagguuuccccggcagcgccaucgagugaggaaucccuggagcucuagagccccgcgcccugccaccucccuggauucuugggcuccaaaucucuuuggagcaauucuggcccagggagcaauucucuuuccccuuccccaccgcagucgucaccccgaggugaucucugcugucagcguugauccccugaagcuaggcagaccagaaguaacagagaagaaacuuuucuucccagacaagaguuugggcaagaagggagaaaagugacccagcaggaagaacuuccaauucgguuuugaaugcuaaacuggcggggcccccaccuugcacucucgccgcgcgcuucuuggucccugagacuucgaacgaaguugcgcgaaguuuucagguggagcagaggggcaggucccgaccggacggcgcccggagcccgcaagguggugcuagccacuccuggguucucucugcgggacugggacgagagcggauugggggucgcgugugguagcaggaggaggagcgcggggggcagaggagggaggugcugcgcgugggugcucugaauccccaagcccguccguugagccuucugugccugcagaugcuagguaacaagcgacuggggcuguccggacugacccucgcccugucccugcucgugugccugggugcgcuggccgaggcguaccccuccaagccggacaacccgggcgaggacgcaccagcggaggacauggccagauacuacucggcgcugcgacacuacaucaaccucaucaccaggcagaggugggugggaccgcgggaccgauuccgggagcgccagugccugcacaccaggagauccuggggauguuagggaaagggauuguuucuuuuccuucgcucuaucccagggcaggacaguaucaggcacuuagucagcucuagguaaauguuuguacagggcacacucuacacaaaauggguaccuuccauuuugugcaacuacagucacagagucgugauccccagauucagguuccccaggcugguaggcuggcaaucuccucucacucaccucuuaugguuuguugugguucuuacggcaguggggcccgguccagaaaucucgaaaguacccagugaaaggggcaagaaugcgccagagaaaugcuguagggggaaacgcuagcaaggugucuaggagaaacagaacgaccaccaaagaaaaccaaaccaaggaguaaacugcaggguugccacagacauugucagacuuuccggccugcccagggcuaauugaaugacaguauuuagaaaaagacaaauagagcuauuuucuuuucuucuucacuguguuuuuuuugcagucucacucccauauuugaaaauucuagucccaauaauuagagauuuagccugaaaacaguuuaucuaaaaugcagaggucucccuauuuuauagcuggugaauucugaaaagaaagugcccacuugguauuucauuaagaagaaacuuacguugguccaguaacuuuaggaugaauucagggauuacauggaaucugagaaauuguaaacuuuauucugaacauuccgaaagucaaaaugaaaugccauauuuucacucucaacauugacaauuaagggaaaaaucaaauccaaacuauuuuacaaauuacauaggauuuaaauuuuguuuucaaaauugguugaucuuaguucuaaaucauuuaauaucuuauuuuaauuacugagauuaaaugauuuuagucauuugaccguaucuaaaggauaagcccuuuagaagcauuaauguuaguuaacauguuuaaauuauauguuuaaagu

SEQ ID NO: 19532 - RNA, 2931 nt, Homo sapiens
acuuuaaacauauaauuuaaacauguuaacuaacauuaaugcuucuaaagggcuuauccuuuagauacggucaaaugacuaaaaucauuuaaucucaguaauuaaaauaagauauuaaaugauuuagaacuaagaucaaccaauuuugaaaacaaaauuuaaauccuauguaauuuguaaaauaguuuggauuugauuuuucccuuaauugucaauguugagagugaaaauauggcauuucauuuugacuuucggaauguucagaauaaaguuuacaauuucucagauuccauguaaucccugaauucauccuaaaguuacuggaccaacguaaguuucuucuuaaugaaauaccaagugggcacuuucuuuucagaauucaccagcuauaaaauagggagaccucugcauuuuagauaaacuguuuucaggcuaaaucucuaauuauugggacuagaauuuucaaauaugggagugagacugcaaaaaaaacacagugaagaagaaaagaaaauagcucuauuugucuuuuucuaaauacugucauucaauuagcccugggcaggccggaaagucugacaaugucuguggcaacccugcaguuuacuccuugguuugguuuucuuugguggucguucuguuucuccuagacaccuugcuagcguuucccccuacagcauuucucuggcgcauucuugccccuuucacuggguacuuucgagauuucuggaccgggccccacugccguaagaaccacaacaaaccauaagaggugagugagaggagauugccagccuaccagccuggggaaccugaaucuggggaucacgacucugugacuguaguugcacaaaauggaagguacccauuuuguguagagugugcccuguacaaacauuuaccuagagcugacuaagugccugauacuguccugcccugggauagagcgaaggaaaagaaacaaucccuuucccuaacauccccaggaucuccuggugugcaggcacuggcgcucccggaaucggucccgcggucccacccaccucugccuggugaugagguugauguagugucgcagcgccgaguaguaucuggccauguccuccgcuggugcguccucgcccggguuguccggcuuggagggguacgccucggccagcgcacccaggcacacgagcagggacagggcgagggucaguccggacagccccagucgcuuguuaccuagcaucugcaggcacagaaggcucaacggacgggcuuggggauucagagcacccacgcgcagcaccucccuccucugccccccgcgcuccuccuccugcuaccacacgcgacccccaauccgcucucgucccagucccgcagagagaacccaggaguggcuagcaccaccuugcgggcuccgggcgccguccggucgggaccugccccucugcuccaccugaaaacuucgcgcaacuucguucgaagucucagggaccaagaagcgcgcggcgagagugcaaggugggggccccgccaguuuagcauucaaaaccgaauuggaaguucuuccugcugggucacuuuucucccuucuugcccaaacucuugucugggaagaaaaguuucuucucuguuacuucuggucugccuagcuucaggggaucaacgcugacagcagagaucaccucggggugacgacugcgguggggaaggggaaagagaauugcucccugggccagaauugcuccaaagagauuuggagcccaagaauccagggagguggcagggcgcggggcucuagagcuccagggauuccucacucgauggcgcugccggggaaaccuuccuaccgcgcaccgcuuccugggccucaaggcggcgacccgcagggagaccgccagcugccuugggauagcggucccggguucucccuccauaucugcuaaaagguaacucagaagaaccgcccagcgggaagggcccgggagaagggccguggacaaucagaggggagcagaggaacaaguggaauuuagccgccaagagggcugguccgcgucggggcgcggagccggcauaguccgcuggggaguggagcgcgaucaucccagggccccagggcuccacagagcgggaggcugcgucucuagcaaguucgcgggcgccccguucgcucccaccccuagacagacgggucguagcacucacgguggcuggcgcgcgggcguggcugggcggcaaguacuaugcugucgggcgagcgucuccgaggggugagagccagcggauggggugcagagagcgggucgcgacagggcuuuuauggagcuuccucgccgcggcaggaggggccucgggcagucacgcuugggugacucccacccgccacuucccgccccugaguggcggggggagggggcuggaaccgcagccgcacgagugucgacuuagggagccacccacaccccaacccucccgccccaggcacugccugaagaagcggggccugggaccgcgugagcgaggcagcgcacuccgagcgcgcuggacaacaccaaagcccaaguaucugcccucgggcagugcccgaucccugcuuuccuucuuuccuucuuuccuucacgccccgucuaguccugccagagauaggagcagcccagacgauucuugucuccugccaacaggacuaccaacccacugggugccggaguaggaagcaccugaauccucuuugugguggggcaucuccacgacuagcgcggcauccucgccgggcacaacugcgcgcuguuggagugaggcaacugggcgcacagauuuuuccuguacuuagaacaagucggaggcagcugccggaagucuccggcuagagggucccaaagcugcgcuccccaccccacccccgcccgugguuucaggggcuucugccccuucucucagcug

SEQ ID NO: 19533 - RNA, 2478 nt, Homo sapiens
augucaggcagcaaggaaaaugaggagagagagaagaagaaagggagggagggugacagaggagggagaaagagagacagaauagcgaacaaacuuaauguuaaaauuccaagacaaauggaguuaaauaaauuuacgaggaucgaacccauuaauugggccauaaaaaguuuuaugagccucauuuacauacaaugcuaugggcuccacgcaauggcgccuccgcuccaauuaaaaccagaaaggcugcgccgggagucacggggcuaccggcucgcaacagccuggcuccgcucuuccggccccgcgccccgcgcuccgcgcuccccagcgcugcgcuccccgcucccggucccgcuccgccagccuggcccgccuagcgacugcgccuaccugaagaccgcauccagggguagaugcggaaauuggccucagccgcgccaugcagcgcgcccucguccgucuugucgcaggcgccuuuggcgaggucacugcagagcccggggauguuuuggucguaggaggcgcagggcagguugccguaggcgucggcgcccaggccguagccggacgcaaaggggcucugauaaagggggcuguugacauuguauaagcccggaacggucgaggcgaaggcgccggcgcccgccccguagccgcuucucugugaguugggagcaaaggagcaagaagucggcucggcauuuuggaacagagaagcccccgccguauauuugcuaaaaagcgcguucacauaauacgaagaacucauaauuuugaccugugauuuguuguccggcagcuuucagugucgguuuuacgagguagagugauauaugauaacauuacacccccagauuuacaccaaaccccauuuucuuuuggacggagcucgccgcagcacgugaccgcccacaugaccgccuccgccaaucucagcaguccucacagguggucucgcuccgcagggcccgcagccgccuagaauggaagggcaagaggcucaaauaugcggccaaagaauccgcccgcgcccggcgggccuggcgcgucccgcggaaaaagaccuggaggcuccgcgggagcgcccagcuggcggccaaccuccgcacuggggucugcggacgccaggcggcccggccccacgcagcaccccccaccccgcccccccgccgacuccugcuagugagcccuggaccaagcuugggauccuccccaucccucuccuguccgccugcccagacccuggaagggucucugucccccgcaacagccugccccgcgguggccuugugggcaggacucagcuaugagcagaucgacucugcccaagucuucucucacccagguccagugggcgacaggccggacuuagacucggauccagacggggaaggcgcagcaucucuugcagcugcagagagauugccaccgcaaacuggagccaugugguucgaauaaagucaacgucucccagcuuccuuuccuuaaucggaggcacacuguuuauccgcccuaaaggaagcagugaaauauuuaucuauuaaugagacucauuugccaacagauuuauuaacgugggguuccccucccuccucccggacgcuguagugcugcaggcucugugccuucgcuccugggcaccuggcuggcuccagcaguccgauaaauugcuaaagauuccuuuguccuuuccacaacuucugguuccccucuggcgcauggggagccagggcuguuucccccagcuuggaaaaaucucgggccugcacccuuccaggcacucccaauacuggaagguuucugggguaggccggggugccugggaacaauacaugcuuuagagcggauuuggagagggggcucuggcgucuagggacugcaacccacuguggacuuccuuuucuuuugaagacaccgaaaacaaauaggggaaaccacccccuaaaggccacccagcuguggaggcuucaccuauccaaguaccagcucacauggagcugagcgcacaguggucucacuuccucccauccaggccuccaauuccuaccuuccaggccuccgaccccugcaccauguugcaccagcugaagccccugccgcccaccgcucgguggaggaugguggggagaacccuuccccuaaacgccucauaaacugcccggcugcgcuggaagcccggccaccuuuuacugcucagcucgauuacacaccauaaacccgaccucacaauggaauugccccggaaauucuccuguaaauuguagaguuuaguuccuuguguacugagcacuucccaucacuuucagaggguccaggccguccccguuuaccgcacccucucagggggccccaggaauacaaaagguggagggaggguucagaucgggacgccacggagccccaguuccugcgcagugaaccaccggggcuuggguaggaaggcgggggcugguggggcaggugggcgcugggcug

SEQ ID NO: 19534 - RNA, 2478 nt, Homo sapiens
cagcccagcgcccaccugccccaccagcccccgccuuccuacccaagccccggugguucacugcgcaggaacuggggcuccguggcgucccgaucugaacccucccuccaccuuuuguauuccuggggcccccugagagggugcgguaaacggggacggccuggacccucugaaagugaugggaagugcucaguacacaaggaacuaaacucuacaauuuacaggagaauuuccggggcaauuccauugugaggucggguuuaugguguguaaucgagcugagcaguaaaagguggccgggcuuccagcgcagccgggcaguuuaugaggcguuuaggggaaggguucuccccaccauccuccaccgagcggugggcggcaggggcuucagcuggugcaacauggugcaggggucggaggccuggaagguaggaauuggaggccuggaugggaggaagugagaccacugugcgcucagcuccaugugagcugguacuuggauaggugaagccuccacagcuggguggccuuuagggggugguuuccccuauuuguuuucggugucuucaaaagaaaaggaaguccacaguggguugcagucccuagacgccagagcccccucuccaaauccgcucuaaagcauguauuguucccaggcaccccggccuaccccagaaaccuuccaguauugggagugccuggaagggugcaggcccgagauuuuuccaagcugggggaaacagcccuggcuccccaugcgccagaggggaaccagaaguuguggaaaggacaaaggaaucuuuagcaauuuaucggacugcuggagccagccaggugcccaggagcgaaggcacagagccugcagcacuacagcguccgggaggagggaggggaaccccacguuaauaaaucuguuggcaaaugagucucauuaauagauaaauauuucacugcuuccuuuagggcggauaaacagugugccuccgauuaaggaaaggaagcugggagacguugacuuuauucgaaccacauggcuccaguuugcgguggcaaucucucugcagcugcaagagaugcugcgccuuccccgucuggauccgagucuaaguccggccugucgcccacuggaccugggugagagaagacuugggcagagucgaucugcucauagcugaguccugcccacaaggccaccgcggggcaggcuguugcgggggacagagacccuuccagggucugggcaggcggacaggagagggauggggaggaucccaagcuugguccagggcucacuagcaggagucggcgggggggcgggguggggggugcugcguggggccgggccgccuggcguccgcagaccccagugcggagguuggccgccagcugggcgcucccgcggagccuccaggucuuuuuccgcgggacgcgccaggcccgccgggcgcgggcggauucuuuggccgcauauuugagccucuugcccuuccauucuaggcggcugcgggcccugcggagcgagaccaccugugaggacugcugagauuggcggaggcggucaugugggcggucacgugcugcggcgagcuccguccaaaagaaaaugggguuugguguaaaucuggggguguaauguuaucauauaucacucuaccucguaaaaccgacacugaaagcugccggacaacaaaucacaggucaaaauuaugaguucuucguauuaugugaacgcgcuuuuuagcaaauauacggcgggggcuucucuguuccaaaaugccgagccgacuucuugcuccuuugcucccaacucacagagaagcggcuacggggcgggcgccggcgccuucgccucgaccguuccgggcuuauacaaugucaacagcccccuuuaucagagccccuuugcguccggcuacggccugggcgccgacgccuacggcaaccugcccugcgccuccuacgaccaaaacauccccgggcucugcagugaccucgccaaaggcgccugcgacaagacggacgagggcgcgcugcauggcgcggcugaggccaauuuccgcaucuaccccuggaugcggucuucagguaggcgcagucgcuaggcgggccaggcuggcggagcgggaccgggagcggggagcgcagcgcuggggagcgcggagcgcggggcgcggggccggaagagcggagccaggcuguugcgagccgguagccccgugacucccggcgcagccuuucugguuuuaauuggagcggaggcgccauugcguggagcccauagcauuguauguaaaugaggcucauaaaacuuuuuauggcccaauuaauggguucgauccucguaaauuuauuuaacuccauuugucuuggaauuuuaacauuaaguuuguucgcuauucugucucucuuucucccuccucugucacccucccucccuuucuucuucucucucuccucauuuuccuugcugccugacau

SEQ ID NO: 19535 - RNA, 2485 nt, Homo sapiens
cuaucugaggcgucccaaacaccaacuucuggcuccuggccccaacucgagaggcuuccagcgaggacgaaggcaggcucgagagaaaccuggcgggccagcagauccgggaggccggcguggaggcggcggcggauuugaagggaggagacacuuacugggaucgauggggggcuugucuccgccgcucucauucucagcauuguuuucagagaaggcgccuucgcuggguuguuuuucucuaucaacuggaggagaaccacaagcauagucagucagggacaaagugugagugucaagcgugggacagucaccccuucuggccgacagcgguucagguuuaaugccauaaggccggcuggagggcaagcccgcgaaggagagcgcaccgggcgugggcuccagccaggagcgcauguaccugccguccggcgccgccgccgccacgggcgccugggggugcacguaggggugguggugaugguggugguacaccgcagcggguacagcguuggcgcccgccgcgugcacuggguuccacgaggcgccaaacaccgucgccuuggacuggaagcugcacgggcugaagucggggugcucggccagcgucgccgccugccggggaggcuggcccaggguccccggcgcauagcggccaacgcucagcucauccgcggcgucggcgcccagcaggaacgaguccacguaguaguugcccagggccccagugguggccaucaccgugcccagcgccuggcccgcccggcccgacccacggaaauuaugaaacugcagauuucauguaacaacuugguggcaccgggggggaaguacagucaccuaauaaguugccggcgcccgcgcccccauuggccgugcgcgucacgugcccguccagcagaacaauaacgcguaaaucacuccgcacgcuauuaaugguccgauguuuugcagucauaauuuuuauagcaaaagccauauguuuuuauguaaagggaucgugccgcucuacgaugggguuuguuuuaauuguggccaacgacgauuaaaagaucaaaucuagccuugucucuguacucucccgucuccccccccauacacacacuucuuaagcggacuauuuuauaucacaauuaaucacgccaucaagaaggcgcgggucccgcgugcgagugcggccagcggagccccucacauaaaauuagacaauaauugaagccauaaaaaagcagccaaaucgcauugucgcucuacuguauuuaaaucuauauuuaugauauuucauaaggaguuauuguuucagaagccacacaggcuggcgggaagucggaaacgaccaacagauucguuugccucgccguggcucccagcuguaaaaauuuacgaggacuuggaaagguuagacuguuguguuugguuggcgagcucccuguaaauaaucccugcgguccccgggagaggcgaguuuacccgcggccgcccucgaaaagucaaauucaacgcaggauccgucccaaacggagccgccgccggcccuaccagggcacuccaggcagggaccggccgcucagggaguaccgcggguguagguccccacagcuacccgccuggagcgaggggcgcccgggcaacccuuaaauucgccuuugcuacgaggaccccacggaggagcuggccaggagggagcggccagccgccaccagggcgaagguuuugagggccugguugguugugcggcgcgcucgguccccggcccucgaccccacgcacacgcgcgcccagcccgccuuucucaucagcuggcaaucaggauucccaggcgcaggcggcuggcgacccagcccugugcuccagccucagaggcucuaaccaugagcgcugcaagccugguugcgcuccgugaaucccagcuggggaaaaaacuacaaguggcaugaauggaaggcaaguucgguuugggaaaaggcagccucgccuaagagaccccgcagcuccggaaccugggaggcccgcaccgauguggccugucccggggccgcgugagccuuucagggcuccuuccucccuuuccagcugcuacuccgggccucgccuugguuaccuacggggcccggagacucggcggagagguacaaggcccaaagagaggcagccacagcucaaggccagggcuggaaauuagaacggggagggguaaaagggcaucgacuccagucccauuccugggccuggccacguuggggaaguuuauuucucacccguuggggguaaauuaaaaggucgccgccacuccguuaauuggaaggaaacucccccugcccccaauuccuaacagaaagcagcgacuccuagaacagggguaaucaaauucacguguggauacugugccugcaacaguguguuuuucauuagcccacuucccuggcggcgaggcuggcggccucgggcgcuuccaucucucucucucucuuuugccuucauccuc

SEQ ID NO: 19536 - RNA, 2485 nt, Homo sapiens
gaggaugaaggcaaaagagagagagagagauggaagcgcccgaggccgccagccucgccgccagggaagugggcuaaugaaaaacacacuguugcaggcacaguauccacacgugaauuugauuaccccuguucuaggagucgcugcuuucuguuaggaauugggggcagggggaguuuccuuccaauuaacggaguggcggcgaccuuuuaauuuacccccaacgggugagaaauaaacuuccccaacguggccaggcccaggaaugggacuggagucgaugcccuuuuaccccuccccguucuaauuuccagcccuggccuugagcuguggcugccucucuuugggccuuguaccucuccgccgagucuccgggccccguagguaaccaaggcgaggcccggaguagcagcuggaaagggaggaaggagcccugaaaggcucacgcggccccgggacaggccacaucggugcgggccucccagguuccggagcugcggggucucuuaggcgaggcugccuuuucccaaaccgaacuugccuuccauucaugccacuuguaguuuuuuccccagcugggauucacggagcgcaaccaggcuugcagcgcucaugguuagagccucugaggcuggagcacagggcugggucgccagccgccugcgccugggaauccugauugccagcugaugagaaaggcgggcugggcgcgcgugugcguggggucgagggccggggaccgagcgcgccgcacaaccaaccaggcccucaaaaccuucgcccugguggcggcuggccgcucccuccuggccagcuccuccgugggguccucguagcaaaggcgaauuuaaggguugcccgggcgccccucgcuccaggcggguagcuguggggaccuacacccgcgguacucccugagcggccggucccugccuggagugcccugguagggccggcggcggcuccguuugggacggauccugcguugaauuugacuuuucgagggcggccgcggguaaacucgccucucccggggaccgcagggauuauuuacagggagcucgccaaccaaacacaacagucuaaccuuuccaaguccucguaaauuuuuacagcugggagccacggcgaggcaaacgaaucuguuggucguuuccgacuucccgccagccuguguggcuucugaaacaauaacuccuuaugaaauaucauaaauauagauuuaaauacaguagagcgacaaugcgauuuggcugcuuuuuuauggcuucaauuauugucuaauuuuaugugaggggcuccgcuggccgcacucgcacgcgggacccgcgccuucuugauggcgugauuaauugugauauaaaauaguccgcuuaagaaguguguguauggggggggagacgggagaguacagagacaaggcuagauuugaucuuuuaaucgucguuggccacaauuaaaacaaaccccaucguagagcggcacgaucccuuuacauaaaaacauauggcuuuugcuauaaaaauuaugacugcaaaacaucggaccauuaauagcgugcggagugauuuacgcguuauuguucugcuggacgggcacgugacgcgcacggccaaugggggcgcgggcgccggcaacuuauuaggugacuguacuucccccccggugccaccaaguuguuacaugaaaucugcaguuucauaauuuccgugggucgggccgggcgggccaggcgcugggcacggugauggccaccacuggggcccugggcaacuacuacguggacucguuccugcugggcgccgacgccgcggaugagcugagcguuggccgcuaugcgccggggacccugggccagccuccccggcaggcggcgacgcuggccgagcaccccgacuucagcccgugcagcuuccaguccaaggcgacgguguuuggcgccucguggaacccagugcacgcggcgggcgccaacgcuguacccgcugcgguguaccaccaccaucaccaccaccccuacgugcacccccaggcgcccguggcggcggcggcgccggacggcagguacaugcgcuccuggcuggagcccacgcccggugcgcucuccuucgcgggcuugcccuccagccggccuuauggcauuaaaccugaaccgcugucggccagaaggggugacugucccacgcuugacacucacacuuugucccugacugacuaugcuugugguucuccuccaguugauagagaaaaacaacccagcgaaggcgccuucucugaaaacaaugcugagaaugagagcggcggagacaagccccccaucgaucccaguaagugucuccucccuucaaauccgccgccgccuccacgccggccucccggaucugcuggcccgccagguuucucucgagccugccuucguccucgcuggaagccucucgaguuggggccaggagccagaaguugguguuugggacgccucagauag

SEQ ID NO: 19537 - RNA, 2672 nt, Homo sapiens
aagaaaaauagcaaaguuugguucgcaggaguaaggagacagagguggguagggagagggaggagaaaagaggaaaagauggcccagccucaagcucuccagucaacuuggggcgggggaauacauuuuuccguagcuuguaaaaagacuuuucagccaguuugagguuagcugccaggggcagacaguuguaauaaugccgacagaauugaggcuuguaagccgggcuucacacuucuaaaaugcaguuauggauucuuucaucgguguuagaucaaggcaccaaguuaagaaaacaaaagucaaaacaacaauaaaagaaaaaaucaaaagcuuauuuaauuaccgagucccgcugccccugcggaacucgccgcgcgcguuaagcucucuuuucuuucugcggaauuccauuugcauccccucugccugggugucucccucucucagugugugugucucucugucuguuuucacacucuccuccccaaucgagcgaggcccacaccuggcgcaucacugccgagccauuagcugcggguuuccuuucaucuucgcuguggcagacguuucuauuuauccacuugcgcucgccgaguggcgucaccagcgguacuguaaugacgauugcagcaggaggaugacagcuuagaaagaagagggcaauggggcuuccucccagaggcggugcggcacagaggagcgcucgcuucacaaggugacccuagcucccaccgccaccgccgcggucgcgguccagaccgcgcuccagcagcuccgcgcccucccaggcacccggccuuucuuucucccucuugcaaccaagauccguccggccgcuggagacccagggagccgggguuaggaacucacuuggggcuuuccccucccccaccggagagccccgggauggagagccgaaaggacaugguuguguuucuggaugggggucagcuuggcacucugguuggcaagagagucucaaauuuguccgaagccgugggcagcccgcugccggagccgcccgagaaaauggugccccgugguugccugagcccucgggccgucccuccggccacccgggagcgcggcgggggaggcccggaggaggagccgguagauggacucgcaggcagcgcggcggggccgggcgccgagccccagguagcuggggcggccaugcucggcccaggacccccggcccccucagucgacagccucuccggacaggggcaacccaguagcucggacaccgagucggauuucuaugaagaaaucgaggugagcugcaccccggacugcgccaccgggaacgccgaguaccagcacagcaaagguagccaccgugccccuccgcuccccgggccucccacugcgcccacccuucacuucggcgcaggccaggaggaagacacucccuuccccuagggcaggauggcuggggggacccaccugagcaacucucucugcuaucugcguucuggcgggggucuccuacuguguucuggcauuggcgggacugagggugacagcagugccuugagugcggggugcugagggggcggaugcaaguccuggacuugggggauucgaagcucaccccaagcacccaguguuucaacugcucggggaaugcuucaauugcucggggaagacacuuuccccaggcgagggcaagaucaaacgccgauccgggcaguuuguggcuggcaggguguaagaggcauggaggcgcggaagccaggaguccauaaaggaccguaaaauugcggcccacuugggcagcccgggugcugcagcccuccgaccaguuugcacgucggucagagguccaaauuaccuugucacuucccgggcuucgcggcgccaggucggaaauggucccaauggucuaauugccuuuggucuccgguugcauuugaaaaggcagagaucggguccuccccccuuccccuuuccuuccuagucccacuucuccacccaaaggaaaaggagcugcagggggcuggagccccacccuucucagagguaggcccaaaggggggcugguuuaacuggagaaccccuccccaccaaaggcuaaugggaaagggguggauagcccggaagggaguuucccucugugccaacaaucaccuccccagaaggggguagaaaacugggcgcggguuggugggggggaggagaggggagcccaccagcagacacuccuccacagaacuguaggaguggguggaaagagccugggggcgggggggagaaagaccacccccuggucuuggcagccaacgccuuguugaauaccugcaccuaccccuuacuaucuuaucaccgauuucacccagccuccuucccauaacccucagaacaaccuggacuccacucacauauacuaagguaauaaauaagauacucaacaugcauucucacuccagcccugcaauacacggaaccuaguacacauucccacaccuguucuggcagcccgucacacauaagagcaaggaaacucucugaaugcccagcauacuacaaugcacuugacccagaguuuacaacccucuagcacaaaggugcaucucaacucaugugccugucagaagugcacgcccugccaacgggaggcagaaaucucaccuaugcuccagggcaggugggaagggcggcuggga

SEQ ID NO: 19538 - RNA, 2672 nt, Homo sapiens
ucccagccgcccuucccaccugcccuggagcauaggugagauuucugccucccguuggcagggcgugcacuucugacaggcacaugaguugagaugcaccuuugugcuagaggguuguaaacucugggucaagugcauuguaguaugcugggcauucagagaguuuccuugcucuuaugugugacgggcugccagaacaggugugggaauguguacuagguuccguguauugcagggcuggagugagaaugcauguugaguaucuuauuuauuaccuuaguauaugugaguggaguccagguuguucugaggguuaugggaaggaggcugggugaaaucggugauaagauaguaagggguaggugcagguauucaacaaggcguuggcugccaagaccaggggguggucuuucucccccccgcccccaggcucuuuccacccacuccuacaguucuguggaggagugucugcuggugggcuccccucuccucccccccaccaacccgcgcccaguuuucuacccccuucuggggaggugauuguuggcacagagggaaacucccuuccgggcuauccaccccuuucccauuagccuuugguggggagggguucuccaguuaaaccagccccccuuugggccuaccucugagaaggguggggcuccagcccccugcagcuccuuuuccuuuggguggagaagugggacuaggaaggaaaggggaaggggggaggacccgaucucugccuuuucaaaugcaaccggagaccaaaggcaauuagaccauugggaccauuuccgaccuggcgccgcgaagcccgggaagugacaagguaauuuggaccucugaccgacgugcaaacuggucggagggcugcagcacccgggcugcccaagugggccgcaauuuuacgguccuuuauggacuccuggcuuccgcgccuccaugccucuuacacccugccagccacaaacugcccggaucggcguuugaucuugcccucgccuggggaaagugucuuccccgagcaauugaagcauuccccgagcaguugaaacacugggugcuuggggugagcuucgaaucccccaaguccaggacuugcauccgcccccucagcaccccgcacucaaggcacugcugucacccucagucccgccaaugccagaacacaguaggagacccccgccagaacgcagauagcagagagaguugcucagguggguccccccagccauccugcccuaggggaagggagugucuuccuccuggccugcgccgaagugaagggugggcgcagugggaggcccggggagcggaggggcacgguggcuaccuuugcugugcugguacucggcguucccgguggcgcaguccggggugcagcucaccucgauuucuucauagaaauccgacucgguguccgagcuacuggguugccccuguccggagaggcugucgacugagggggccggggguccugggccgagcauggccgccccagcuaccuggggcucggcgcccggccccgccgcgcugccugcgaguccaucuaccggcuccuccuccgggccucccccgccgcgcucccggguggccggagggacggcccgagggcucaggcaaccacggggcaccauuuucucgggcggcuccggcagcgggcugcccacggcuucggacaaauuugagacucucuugccaaccagagugccaagcugacccccauccagaaacacaaccauguccuuucggcucuccaucccggggcucuccggugggggaggggaaagccccaagugaguuccuaaccccggcucccugggucuccagcggccggacggaucuugguugcaagagggagaaagaaaggccgggugccugggagggcgcggagcugcuggagcgcggucuggaccgcgaccgcggcgguggcggugggagcuagggucaccuugugaagcgagcgcuccucugugccgcaccgccucugggaggaagccccauugcccucuucuuucuaagcugucauccuccugcugcaaucgucauuacaguaccgcuggugacgccacucggcgagcgcaaguggauaaauagaaacgucugccacagcgaagaugaaaggaaacccgcagcuaauggcucggcagugaugcgccaggugugggccucgcucgauuggggaggagagugugaaaacagacagagagacacacacacugagagagggagacacccaggcagaggggaugcaaauggaauuccgcagaaagaaaagagagcuuaacgcgcgcggcgaguuccgcaggggcagcgggacucgguaauuaaauaagcuuuugauuuuuucuuuuauuguuguuuugacuuuuguuuucuuaacuuggugccuugaucuaacaccgaugaaagaauccauaacugcauuuuagaagugugaagcccggcuuacaagccucaauucugucggcauuauuacaacugucugccccuggcagcuaaccucaaacuggcugaaaagucuuuuuacaagcuacggaaaaauguauucccccgccccaaguugacuggagagcuugaggcugggccaucuuuuccucuuuucuccucccucucccuacccaccucugucuccuuacuccugcgaaccaaacuuugcuauuuuucuu

SEQ ID NO: 19539 - RNA, 2518 nt, Homo sapiens
gcuggggcuucuugugcaggucuagggacuguggagccgggcccgcggcggcagcgacggaggggcugggcugcuggaggcccgggccccgccgacucagccuuagggcgcugcgguugccuaccagcucccuggcggccccaucccaggccaccccagcuagaaaucgccccugcugcuggagcugcggcugcggcggcagcuccuccgcgagaccugcagguggcgucaucuccuccccugcggccguggguaggggcugccgccugcggucagcggucagggaagcugagggcgagggauccgcgcaggauccauuuugcagcugcuggucauccagguaauccagguauuugccucgcagggccgggggguggcgacacugcacgaagacagugaggagccggcccugcgagugccagucgcccauccagcgcuucaggccucgcagccggcagucgcagguccagccguugccgucuagauccagccgauaaagggcugggcuggcggcgaagauguccccggauagggcgcugagcgcguuguugcgcaggcugagcucgcgcagccggcccagguggccgaagguggccgggugcagggcggacagcucauugccgcucagguccagcgccuccaggcugugcagaggcuccagcagcgcaguuggcagcuggcucagccgauuacccuccaggcgcagcucgcgcagggccuccaagccccaaaaggccucaggcgcgaggugcgugagcugguugccccugagcgagagcaggccgagacguggcaggugcuggaagaugcgcggcccgaggugcugcagguuguuggccgagaggaugagggaggagagggagcgcagcggugcgaagguggccgcguggcgcagggagggcuguagcucguuggcagagagguugaggaagcgcagcuugccuagcugggcgaaggcguucuugcccagaaagcggauccgguuggacuccagauguagguagagcagguugcccaagggagcgaagaccgcguccggcagcgcccccagggcguucccguccagccgcagcuugacuagacucuccaggcccucgaaggagccgcggcuuaggcggcugaucucguucccguuggcguagaggaugcgcagcuugcgcagcggggccagcgugcccggggcgagcgccugcaagagguuguuccccagguacagcucuuccagccgcgagagcuucucgaaggucuuggggugcagagagcggaucugguuguacugcagguccagccgucugagcugccccagacgguggaagucgaaggccgugauguugguuaugaaguugccgccgaggcuguaggugagcacgucgugggggcucggccagcgagcuggucuugggcacuacgcggagcccccuguuggugcacaggagaugcuggggaugcuggcagucgcagcgcuccgggcacacgggcucggcagcggcgggagcgcgaggcagccgcacaccacgagcaggaggcgcaaggcgcgggcagccuccaucgccucccgcccugcgugcagcggccggaucguccucuuggcccgccggcucugugucuccucugcauuccccuuagccuggccagagucgcuaaauggccucuuucggacuucgcagcgccguccagccccuccuccguccuuuguccggaggccggcccgggucucugcaggcgggcuucgcccggccaagucaggcggcgcggggcgcucugcagaccccggguacuacuuguugcauuucuguauaaaacuguuucuccgggugcgcgucggcgggcgggaggagggagcaagacccggcgcuuuuuguuugcagcugaguccggagagcuggauucccuggcgcggauucucccagccgaguggauuccccagcugcaggcgggagccguuccaagagcuucgcggggcgcggcuuggcagcagagccccggcugcucggcccccgcagacggcaccuucucgcucgcggucccggacggggagggcggcuccagugcaauagcucggggagcacgcgggcugcguccggaagggacccaagucugcgagcggagagcaaacggggcggaaauucguucuucccacacucugcccgcggggacgcaggcggagaaagaggagacggcagagggaggacagaccccggcagggggaggaggaaacacuaaguggcuccgcgucuggucagcccgggcccgggaugccaagugagaaaaguagggauuaaaaacagcuguacgggccggacacgcuaggccgggggcgggggaggauuaccgggcuagcaaacgggauuugcagacagagaccuuuuuauuuuagacgaguacaccagccgcuucugagcagugggagcgcgccuggccuuccucguuguuaagucacuugcucuuccaggugccacccugcgggaaguuugggcagcacggaguccgccagcauucuacaggaaguuugggggag

SEQ ID NO: 19540 - RNA, 2518 nt, Homo sapiens
cucccccaaacuuccuguagaaugcuggcggacuccgugcugcccaaacuucccgcaggguggcaccuggaagagcaagugacuuaacaacgaggaaggccaggcgcgcucccacugcucagaagcggcugguguacucgucuaaaauaaaaaggucucugucugcaaaucccguuugcuagcccgguaauccucccccgcccccggccuagcguguccggcccguacagcuguuuuuaaucccuacuuuucucacuuggcaucccgggcccgggcugaccagacgcggagccacuuaguguuuccuccucccccugccggggucuguccucccucugccgucuccucuuucuccgccugcguccccgcgggcagagugugggaagaacgaauuuccgccccguuugcucuccgcucgcagacuugggucccuuccggacgcagcccgcgugcuccccgagcuauugcacuggagccgcccuccccguccgggaccgcgagcgagaaggugccgucugcgggggccgagcagccggggcucugcugccaagccgcgccccgcgaagcucuuggaacggcucccgccugcagcuggggaauccacucggcugggagaauccgcgccagggaauccagcucuccggacucagcugcaaacaaaaagcgccgggucuugcucccuccucccgcccgccgacgcgcacccggagaaacaguuuuauacagaaaugcaacaaguaguacccggggucugcagagcgccccgcgccgccugacuuggccgggcgaagcccgccugcagagacccgggccggccuccggacaaaggacggaggaggggcuggacggcgcugcgaaguccgaaagaggccauuuagcgacucuggccaggcuaaggggaaugcagaggagacacagagccggcgggccaagaggacgauccggccgcugcacgcagggcgggaggcgauggaggcugcccgcgccuugcgccuccugcucguggugugcggcugccucgcgcucccgccgcugccgagcccgugugcccggagcgcugcgacugccagcauccccagcaucuccugugcaccaacagggggcuccgcguagugcccaagaccagcucgcuggccgagcccccacgacgugcucaccuacagccucggcggcaacuucauaaccaacaucacggccuucgacuuccaccgucuggggcagcucagacggcuggaccugcaguacaaccagauccgcucucugcaccccaagaccuucgagaagcucucgcggcuggaagagcuguaccuggggaacaaccucuugcaggcgcucgccccgggcacgcuggccccgcugcgcaagcugcgcauccucuacgccaacgggaacgagaucagccgccuaagccgcggcuccuucgagggccuggagagucuagucaagcugcggcuggacgggaacgcccugggggcgcugccggacgcggucuucgcucccuugggcaaccugcucuaccuacaucuggaguccaaccggauccgcuuucugggcaagaacgccuucgcccagcuaggcaagcugcgcuuccucaaccucucugccaacgagcuacagcccucccugcgccacgcggccaccuucgcaccgcugcgcucccucuccucccucauccucucggccaacaaccugcagcaccucgggccgcgcaucuuccagcaccugccacgucucggccugcucucgcucaggggcaaccagcucacgcaccucgcgccugaggccuuuuggggcuuggaggcccugcgcgagcugcgccuggaggguaaucggcugagccagcugccaacugcgcugcuggagccucugcacagccuggaggcgcuggaccugagcggcaaugagcuguccgcccugcacccggccaccuucggccaccugggccggcugcgcgagcucagccugcgcaacaacgcgcucagcgcccuauccggggacaucuucgccgccagcccagcccuuuaucggcuggaucuagacggcaacggcuggaccugcgacugccggcugcgaggccugaagcgcuggaugggcgacuggcacucgcagggccggcuccucacugucuucgugcagugucgccaccccccggcccugcgaggcaaauaccuggauuaccuggaugaccagcagcugcaaaauggauccugcgcggaucccucgcccucagcuucccugaccgcugaccgcaggcggcagccccuacccacggccgcaggggaggagaugacgccaccugcaggucucgcggaggagcugccgccgcagccgcagcuccagcagcaggggcgauuucuagcugggguggccugggauggggccgccagggagcugguaggcaaccgcagcgcccuaaggcugagucggcggggcccgggccuccagcagcccagccccuccgucgcugccgccgcgggcccggcuccacagucccuagaccugcacaagaagccccagc

SEQ ID NO: 19541 - RNA, 2854 nt, Homo sapiens
aagaccaaccaaaucccauuaauucauuaggcagaacucugccagguacuggacauucggaaacaaauuucagggggucggggcagauggacgggaagcucaugguggguggauguacuacaaauucuauaauccgcaguuauaccuccacuuucugggaaacuucucuccguggccccagggcccuuuaaauguuacuaugcguguuuuccuccauaguuucuggaacagaaccaaacuuucguguagggguuuggcagcgcucauccucacagcccuggggaccgcuggcacaggggcaagcgaggcguucgcacgcgaaggaaacuugcgaggagucagggcggccccgcgcgggggcgggucguagagugggggcccucaaguccuagaacuucagguccuccaugagaauuagaggaagggggauggccaaagacgaccagacguccaccgagcuuccacaggccaggccucgccccuccuccugcggggccacaacgcgggcuccccggcccgggacagcacagccagggcguccgggcgggaggcagggcccggcgcggaggaaggagcccggggccgccgccgccccgcccaccccagcgaggcggagccggcgcccggaggagcaagaggaggaggaggaggagaggucggagccgucuccaggagcccuuagagaccgagucccggcggcgacggcggggcagcgcaccggcaggcgggugaguaccaagcggcgggcgcggguggugagucggguccccgcggggucggggcgcggcgcggggcgucggccagcgaguucgggggccgccuccgagucccgggugcugggaagcgagauggagggagggagcggaggaaggaaggaaggagggaagaguguccugcuggagggcggggacuggucugggcgcugggcgccggagaccggggggagggggaggaaggggccaagggacaccgagacccagaggcagaaacggcgcgcgcgcccucgacgggcggccgcccgagguugcgggaagccgcccccacggcuguggcuggggcuagggcuggggguggaaggaaaggucuccccuugagcucgcuugccuccucgccagccugcggccgugcgccccgcgccggguugggaggcccccaguguucccagccguggcuugugguggugucaggcguuggaggagggcuggcaugugggggcgacagggacgccacgccccucugccuacuuucuaccucccgggaccagccggcgggagcgcagccuuggaauccgcugggcgcugggggucuagcagggaaauagcgggucgcagaggggagagcccauaugacgcaccccgcgagggacccccgaguggggacccgaggcugcuuuucugcagacuguauuugcaagugguaagggggagguugaggcuuagucuugggugauuuuuuuuuuuuuaauuauugccccgacaguuaucccguggggcagggugaauucuguuuuucauuuuaauuagggcauaucaauuaaagcuaacuuuaaaacgcugucacuuagcaccucccgucacucacucgucccucgcuuuguguguccuguaaacuuggcuuaaaucauucauaacucacgauaaggaagccgugauucuuguucacgucgccgcaguggagugaaacuuugcccaacugggacugaguggaggcauugcugcggccggucaucugguggucauccugccgggcgugguuguauacaaacaagugggucgagaaggaaaucucugaacaccagagguagaagggagguuccugcgcccacgugucagggcgcguuuaauggcugcucccagcggaaacaaacgggaauuuauuagaccguguggaguuggacaaacuucacaugauuagcuuccuucccaucaguuacuuccucuccccccugcugucuuugccgacacaguuuauauuuccuggggcgguuguagcuucgccugaauaggcuguguauaaugaaucuuuuggaugucgucagaggcagggucugcgucugugccuucucuauuuuaaaagcggaguuuggcuuuguuuuuaaaagugcuagucaccagacugcacccuugccagcgcuucgcagcucucgaaguaaauuaucgcaggauggcggcccucaccuaggagaaccaggaaggcaggcagcgcuagaacgacgggauugaauuuuacuauugccaaaacaaucacauucaaguaaggagcuguuuuguuuuguuuuuguuuuuuuaaccaaauuauauauacuagcaagccccuuuucuaguaaacuaacguuauucacacacacaauuuuuaaaguaaucaaaaauuuuacagagucuuaagugauaaaaggacuuucagauaaaauguucagucccuuugccuucucuaauaguuaaccagcgccguaaagcccugguuuaaguccaaaaaaugcugaaaagucuacugcgucguuagaccuuauaaauaaugcaguccuauuuuugcuguauuuaacucauguaauuuacuagauaucgaacccccaacagggcacacagcacuuagauuuguguagaaauauaugaaaaugugaaucuguguuucacaagagccugaaaaaaauagaauuauaaaaauuuccuguccagaaagcuccagucuuacuugaaagcucucuaacaauuagauuuguggauuuguguugucacuuguuagagaauaucggugguuuauuaaagugugagagcaaagggcuucauggucagaaaacuugaggaagugguuagccaauaucaaauuaguuuuuuuuaaaauuagaauuauguga

SEQ ID NO: 19542 - RNA, 2854 nt, Homo sapiens
ucacauaauucuaauuuuaaaaaaaacuaauuugauauuggcuaaccacuuccucaaguuuucugaccaugaagcccuuugcucucacacuuuaauaaaccaccgauauucucuaacaagugacaacacaaauccacaaaucuaauuguuagagagcuuucaaguaagacuggagcuuucuggacaggaaauuuuuauaauucuauuuuuuucaggcucuugugaaacacagauucacauuuucauauauuucuacacaaaucuaagugcugugugcccuguuggggguucgauaucuaguaaauuacaugaguuaaauacagcaaaaauaggacugcauuauuuauaaggucuaacgacgcaguagacuuuucagcauuuuuuggacuuaaaccagggcuuuacggcgcugguuaacuauuagagaaggcaaagggacugaacauuuuaucugaaaguccuuuuaucacuuaagacucuguaaaauuuuugauuacuuuaaaaauugugugugugaauaacguuaguuuacuagaaaaggggcuugcuaguauauauaauuugguuaaaaaaacaaaaacaaaacaaaacagcuccuuacuugaaugugauuguuuuggcaauaguaaaauucaaucccgucguucuagcgcugccugccuuccugguucuccuaggugagggccgccauccugcgauaauuuacuucgagagcugcgaagcgcuggcaagggugcagucuggugacuagcacuuuuaaaaacaaagccaaacuccgcuuuuaaaauagagaaggcacagacgcagacccugccucugacgacauccaaaagauucauuauacacagccuauucaggcgaagcuacaaccgccccaggaaauauaaacugugucggcaaagacagcaggggggagaggaaguaacugaugggaaggaagcuaaucaugugaaguuuguccaacuccacacggucuaauaaauucccguuuguuuccgcugggagcagccauuaaacgcgcccugacacgugggcgcaggaaccucccuucuaccucugguguucagagauuuccuucucgacccacuuguuuguauacaaccacgcccggcaggaugaccaccagaugaccggccgcagcaaugccuccacucagucccaguugggcaaaguuucacuccacugcggcgacgugaacaagaaucacggcuuccuuaucgugaguuaugaaugauuuaagccaaguuuacaggacacacaaagcgagggacgagugagugacgggaggugcuaagugacagcguuuuaaaguuagcuuuaauugauaugcccuaauuaaaaugaaaaacagaauucacccugccccacgggauaacugucggggcaauaauuaaaaaaaaaaaaaucacccaagacuaagccucaaccucccccuuaccacuugcaaauacagucugcagaaaagcagccucggguccccacucgggggucccucgcggggugcgucauaugggcucuccccucugcgacccgcuauuucccugcuagacccccagcgcccagcggauuccaaggcugcgcucccgccggcuggucccgggagguagaaaguaggcagaggggcguggcgucccugucgcccccacaugccagcccuccuccaacgccugacaccaccacaagccacggcugggaacacugggggccucccaacccggcgcggggcgcacggccgcaggcuggcgaggaggcaagcgagcucaaggggagaccuuuccuuccacccccagcccuagccccagccacagccgugggggcggcuucccgcaaccucgggcggccgcccgucgagggcgcgcgcgccguuucugccucugggucucggugucccuuggccccuuccucccccuccccccggucuccggcgcccagcgcccagaccaguccccgcccuccagcaggacacucuucccuccuuccuuccuuccuccgcucccucccuccaucucgcuucccagcacccgggacucggaggcggcccccgaacucgcuggccgacgccccgcgccgcgccccgaccccgcggggacccgacucaccacccgcgcccgccgcuugguacucacccgccugccggugcgcugccccgccgucgccgccgggacucggucucuaagggcuccuggagacggcuccgaccucuccuccuccuccuccucuugcuccuccgggcgccggcuccgccucgcuggggugggcggggcggcggcggccccgggcuccuuccuccgcgccgggcccugccucccgcccggacgcccuggcugugcugucccgggccggggagcccgcguuguggccccgcaggaggaggggcgaggccuggccuguggaagcucgguggacgucuggucgucuuuggccaucccccuuccucuaauucucauggaggaccugaaguucuaggacuugagggcccccacucuacgacccgcccccgcgcggggccgcccugacuccucgcaaguuuccuucgcgugcgaacgccucgcuugccccugugccagcgguccccagggcugugaggaugagcgcugccaaaccccuacacgaaaguuugguucuguuccagaaacuauggaggaaaacacgcauaguaacauuuaaagggcccuggggccacggagagaaguuucccagaaaguggagguauaacugcggauuauagaauuuguaguacauccacccaccaugagcuucccguccaucugccccgacccccugaaauuuguuuccgaauguccaguaccuggcagaguucugccuaaugaauuaaugggauuugguuggucuu

SEQ ID NO: 19543 - RNA, 2551 nt, Homo sapiens
uaggacacaccagaguagcaacaugaaacacccacuucugggggaaaaaaaaguguuauaauuugaaauaaaaaaaaaauacaagucuugggaaauuagagaccaaugugauagaaaucuggagggacuuuucacaaaugccgacuucugguuugugccuuucccauauuuuauuaaauucguguuuuauuuuaaaaaauuacagcaacauuaucaaagacaacauauguacaaacauuuuacaaaaaagaacauuaccaauaucaguggcaguaagggcaagcugaagaauaaauagacugaguuuccgggcaaugucuguccucaaagacauccaaacugcguucaggcagcugaaacaggcuucuuucccagugacaagcauauguggucaguaauacaaacgaugguaaaugaggcuacuacauaggcccaguuaacaaacuccucuucuccucggguaggccaugauacaaguggaacucaucaaauaauuuaaacccaaggcgauaacaacgcuauuucccaucuaaacucauuuaagccuucacaaugucgcaauggauucaguuacuugcaaacgaucccggguugucauacagauacuuguuuuuuacacauaacgcuaugccaucccuuccuucacugccccagucagguuuccuguuguuggaccgaaaggggauacauuuuagaaaugcuuccuucaagacagaagugagaaagaaaggagacccugaggccaggaucuauuaaaccuggugugugcgcaaaagggagggggaaggcaggaauuugaaaggauaaacgucuccuuugcgccgaggaaucaggaagcgugacucacuugggucugggacgauaccgaaauccgguaccccaccccauccccugccccgccggguaccuacaagcucgguuccuuucucaacucccccaguuccuugaucuccaccuucuuguacuuccccgacuuucuccgguuggugaucaccaggacggccaugccggcgacgagggccaccacgaccaccacgaugacggcgaugaggccggcggugaggcgcuucauggagaacuucgggggaaucucguccagguaauagaugagcgugcgcuccaccugcagggguucuccgcgcacgcgcaaguccaggccgccgcggcccuggaauagagacucgcccuugaugucccucucgaaguaguaggcggcaucgccgauauccacgucaccggcggccuucugagacguguucugccgcagcucgaucuggauggugggcugcucguagugcacggccgccacgaacuuggggugcagccgauagcgcucgcggaagagccgccucagcucggcguccaggucugagugguugaaggcgccggcgguggggcgguggcgcaggucaaugaggauguggugggugcgcaccagcucaucgcagcguaggcucaggucgcccuuguccgugcggcgcacgcccaccgaguucacgcaccagcacaccgacgucugguugcacuggcgcgccuugaagcggcccucggggucgcagucggggucguagaggccaucguuguccacgagcgcgugcucacucggccgcaccagcgugcgggcguucuugggggcgcucaugcgcgccuugagcagcagacacuuggaggucagcguggagcagucgaccgccaugcccgagcccagcgcgcggcacuggcagcggccgccggggccgucggggcugcacacggucaucuuguuggugggacacgugcaguuguccugcgcggccguguggccggucaccgccgccagcaccagcagcagcagcggcagccgcagcgguggcggcgcgaggccggggccccgagccaugguggggcggaggaacgcggaccggacgcgggcggaugaggcgcggggacucgucggggcucgggcuccggcgucugggauggucugcaggcgucugccgcccggccgcucccuccggcucuuauacucuacccgaccugcccggcugguuccaccaccgaccguccccacugguauuugggugacacaucccgccccccuccccgucccacggaaggccaagccggcccugcgccgcccgcgauaggaucagaacagggaagcugcucccgccuccuccggaccgaaagccgggaaggggagaaccgauacucaccuguaggcuucuggggacccgcccucggcgcggccuccugcuacagaccuggcgcgucugggccgcucucccggcagaaagucuaaagaguuucauugcaaaguguggcucgcgacugucgcgcucuccucuauacgcgacucccuuuucguucuuucccagccccagcccucccuuaauuucucucacucccucucuucuuuguccaguucucacaguagcacacguuuauauaguuuacaguucacaaacauuaucucauccuaacaccaguccugacagguagggacuaucagacccguuuuauaggugguacugaugaggcuuaaagaccugaagucacacugcuaucaacu

SEQ ID NO: 19544 - RNA, 2551 nt, Homo sapiens
aguugauagcagugugacuucaggucuuuaagccucaucaguaccaccuauaaaacgggucugauagucccuaccugucaggacugguguuaggaugagauaauguuugugaacuguaaacuauauaaacgugugcuacugugagaacuggacaaagaagagagggagugagagaaauuaagggagggcuggggcugggaaagaacgaaaagggagucgcguauagaggagagcgcgacagucgcgagccacacuuugcaaugaaacucuuuagacuuucugccgggagagcggcccagacgcgccaggucuguagcaggaggccgcgccgagggcggguccccagaagccuacaggugaguaucgguucuccccuucccggcuuucgguccggaggaggcgggagcagcuucccuguucugauccuaucgcgggcggcgcagggccggcuuggccuuccgugggacggggaggggggcgggaugugucacccaaauaccaguggggacggucggugguggaaccagccgggcaggucggguagaguauaagagccggagggagcggccgggcggcagacgccugcagaccaucccagacgccggagcccgagccccgacgaguccccgcgccucauccgcccgcguccgguccgcguuccuccgccccaccauggcucggggccccggccucgcgccgccaccgcugcggcugccgcugcugcugcuggugcuggcggcggugaccggccacacggccgcgcaggacaacugcacgugucccaccaacaagaugaccgugugcagccccgacggccccggcggccgcugccagugccgcgcgcugggcucgggcauggcggucgacugcuccacgcugaccuccaagugucugcugcucaaggcgcgcaugagcgcccccaagaacgcccgcacgcuggugcggccgagugagcacgcgcucguggacaacgauggccucuacgaccccgacugcgaccccgagggccgcuucaaggcgcgccagugcaaccagacgucggugugcuggugcgugaacucggugggcgugcgccgcacggacaagggcgaccugagccuacgcugcgaugagcuggugcgcacccaccacauccucauugaccugcgccaccgccccaccgccggcgccuucaaccacucagaccuggacgccgagcugaggcggcucuuccgcgagcgcuaucggcugcaccccaaguucguggcggccgugcacuacgagcagcccaccauccagaucgagcugcggcagaacacgucucagaaggccgccggugacguggauaucggcgaugccgccuacuacuucgagagggacaucaagggcgagucucuauuccagggccgcggcggccuggacuugcgcgugcgcggagaaccccugcagguggagcgcacgcucaucuauuaccuggacgagauucccccgaaguucuccaugaagcgccucaccgccggccucaucgccgucaucgugguggucgugguggcccucgucgccggcauggccguccuggugaucaccaaccggagaaagucggggaaguacaagaagguggagaucaaggaacugggggaguugagaaaggaaccgagcuuguagguacccggcggggcaggggauggggugggguaccggauuucgguaucgucccagacccaagugagucacgcuuccugauuccucggcgcaaaggagacguuuauccuuucaaauuccugccuucccccucccuuuugcgcacacaccagguuuaauagauccuggccucagggucuccuuucuuucucacuucugucuugaaggaagcauuucuaaaauguauccccuuucgguccaacaacaggaaaccugacuggggcagugaaggaagggauggcauagcguuauguguaaaaaacaaguaucuguaugacaacccgggaucguuugcaaguaacugaauccauugcgacauugugaaggcuuaaaugaguuuagaugggaaauagcguuguuaucgccuuggguuuaaauuauuugaugaguuccacuuguaucauggccuacccgaggagaagaggaguuuguuaacugggccuauguaguagccucauuuaccaucguuuguauuacugaccacauaugcuugucacugggaaagaagccuguuucagcugccugaacgcaguuuggaugucuuugaggacagacauugcccggaaacucagucuauuuauucuucagcuugcccuuacugccacugauauugguaauguucuuuuuuguaaaauguuuguacauauguugucuuugauaauguugcuguaauuuuuuaaaauaaaacacgaauuuaauaaaauaugggaaaggcacaaaccagaagucggcauuugugaaaagucccuccagauuucuaucacauuggucucuaauuucccaagacuuguauuuuuuuuuuauuucaaauuauaacacuuuuuuuucccccagaaguggguguuucauguugcuacucugguguguccua

SEQ ID NO: 19545 - RNA, 3065 nt, Homo sapiens
uagaggacuauuugggggaauggucuuggcaacacgguucuaggcagguaccacgaucauauagggacucuguagaauuuuaaguagggaggcaagcgcccagguuuguuucuuaugcagaaagugcugagcaacggacagacugaagagguuaggucuggauccagguaaacccuuuaugaggcuaacgcacuagcugaaugagggaugacagcaucccaccuagacaggugcagacagauucccgagguucagguucggacuucaguuucuccgcuggaacgcugaggguggggcagcacccgggucccugcccugcaaacggggccgcugcaggguuccuuuggcggggccggugccccggggagcgcgcaggacgcgcccgccuucagccgggggccagggcgagcgggacggggcgggcccgcgggugcccugaccagcucaccgcccaaucgcugcgggcccgccgagccccggggggcuggggccgccgccgccgccgccagaacgugccgcggcugcgccaacgcgcgaacgccgggcagggcggcgggcgcgcucagucuggcggcggcugccgugagcugacugacguuccgggaacgccgcagcagcccgcgccgcccgcagccuagccgagccgcgccgcccgggccucgcccgcccgccugcccgccauggugucauggaucaucuccaggcuggugguguaaguggccuucucccccgcgccccuccguccccucccuccccgcccccggccccgggcugcgcgcgccccuacagcgcccggucccaguggcucgggcuauuaauacccggcgcagcuaaauuuagcagguacaguagccgccgaggacgccugcgggcggacgggcggcgcaggacgcggcugcugcccaggaggcagccggcgccggcggccgcuugcggggggcugggccgggacggcgagggcuggggcgcucggggguuccgugggggcugcgucucgccgcgcgcuggccgcuuuguuccucagcucggucgauuugcagaggccccgaaugggcgcaccgcggacacgcgucucucuccuuuggcagaaaugugaggucgcccggcgccgcgccccgccgccccagcuuuugucagguggaaaggacagcgcagacgaaccaggggcgcugccuggagggucagcgcggaacggguggagaggcagaggcggggcucccagugggguuggaaaaauccuccuuuuuaggugucugcaucgacagcggcaaaggcagcugggacaugggaagacgcaugugaaucuuggaguaaacgccuggagcccccggcuccgacuccuuuugcaggggauugagagacaggggcagguaccuccaggaaugcacgggaaauuuucaagugacagccacccgcaugguggcgaugacaccucccaggccuugcaggagagcgcagagucaucuagggugaggucugugugaagucauugggggugggcgugggggccgauuuucuccuucaagccccaggaccuguaggcguuugaagagcuuccccgguggauuuauucuccuuuggagauagacguggcuguuccaagucccuguucuucccuaaccauccuggccugagucagaacagauuugccaccugcuguagcuagcaggggcugaaauggguguggggagucuaaggcggggaggaggguggcaggcaccucgggcuuuuucuuugucugagaacacggggcucuggaccccagugauugugcaccaucacuccccacguuuugaaacaccacccaucucccuucccuucuuuacugauuuucccuuccgaaguggaucucagcauugucucccgccaccauucagggcuuuccucccaaagccagugucugugccucucagcccccaagucauuccgugaaggccucuccacagcuguuccugacugcgggguguuugcgcugcaccuugagguggcauguuaaauauuuagaagauuucugcuggcagagccgacaugaauaauacaggaaaguggcugacacgccuugcccagccucaugccugaccaacacugucuugccuucagggugguguuuccucucugggaucgauauugccaguggcuucugggaagcccucaggguggggcuggagaguugagcuggccuggcuggugggcucucuguagguccugcugggcugggagugagggcaucugauccugggucaugugacuaucauuaguuuuauuagcacugggucaugugacuaucauuaguuuuauuagcaccucccucaccccugcccuuuuuuuuuuuuuuuuuuugagaccgagucucgcucugucgcccaggcuggagagugcaguggcacagucucggcucacugaagccuccgccuccuggguucaagcgauucuccugccucagccucccgaguagcugggauuacaagcgccugccaccacgcccagcuaauuuuuguauuuuuaguagagacgggguuucaccauguuggccagccuggucuugaacuccugaccuagugauccgcccgcuucggccucccaaaguucugggauuacaggcgugagcuaccacgcccggcuccucccccuuuuuuacaaugagcaacugauggggguggagaggagaggcauauauuugggaggugucucagggaugugcuguugcuuucuaaaacaaccacacucccuagaaccgagacuucagagaauuuaaaugaacagcauuauguggcccaaggagaguugaugggauuugggauuguuacuuccacuaucaaguccaaaaggucagggauaccacuuaucccccagucccuaauucccuguagaaaccuagcauaagcauauugauuaugaguuaugaacaucauuuuuaauaagcaauaccuguuucaugaagacaauauuuguuaauuacaggaaaauuagaaaagauaaacugaaaaucauccacauuuccaccacacagagauaacuaauaauaaugauggagggcauauucuucaagaaauuuuccuguauug

SEQ ID NO: 19546 - RNA, 3065 nt, Homo sapiens
caauacaggaaaauuucuugaagaauaugcccuccaucauuauuauuaguuaucucugugugguggaaauguggaugauuuucaguuuaucuuuucuaauuuuccuguaauuaacaaauauugucuucaugaaacagguauugcuuauuaaaaaugauguucauaacucauaaucaauaugcuuaugcuagguuucuacagggaauuagggacugggggauaagugguaucccugaccuuuuggacuugauaguggaaguaacaaucccaaaucccaucaacucuccuugggccacauaaugcuguucauuuaaauucucugaagucucgguucuagggagugugguuguuuuagaaagcaacagcacaucccugagacaccucccaaauauaugccucuccucuccacccccaucaguugcucauuguaaaaaagggggaggagccgggcgugguagcucacgccuguaaucccagaacuuugggaggccgaagcgggcggaucacuaggucaggaguucaagaccaggcuggccaacauggugaaaccccgucucuacuaaaaauacaaaaauuagcugggcgugguggcaggcgcuuguaaucccagcuacucgggaggcugaggcaggagaaucgcuugaacccaggaggcggaggcuucagugagccgagacugugccacugcacucuccagccugggcgacagagcgagacucggucucaaaaaaaaaaaaaaaaaaagggcaggggugagggaggugcuaauaaaacuaaugauagucacaugacccagugcuaauaaaacuaaugauagucacaugacccaggaucagaugcccucacucccagcccagcaggaccuacagagagcccaccagccaggccagcucaacucuccagccccacccugagggcuucccagaagccacuggcaauaucgaucccagagaggaaacaccacccugaaggcaagacaguguuggucaggcaugaggcugggcaaggcgugucagccacuuuccuguauuauucaugucggcucugccagcagaaaucuucuaaauauuuaacaugccaccucaaggugcagcgcaaacaccccgcagucaggaacagcuguggagaggccuucacggaaugacuugggggcugagaggcacagacacuggcuuugggaggaaagcccugaaugguggcgggagacaaugcugagauccacuucggaagggaaaaucaguaaagaagggaagggagaugggugguguuucaaaacguggggagugauggugcacaaucacugggguccagagccccguguucucagacaaagaaaaagcccgaggugccugccacccuccuccccgccuuagacuccccacacccauuucagccccugcuagcuacagcagguggcaaaucuguucugacucaggccaggaugguuagggaagaacagggacuuggaacagccacgucuaucuccaaaggagaauaaauccaccggggaagcucuucaaacgccuacagguccuggggcuugaaggagaaaaucggcccccacgcccacccccaaugacuucacacagaccucacccuagaugacucugcgcucuccugcaaggccugggaggugucaucgccaccaugcggguggcugucacuugaaaauuucccgugcauuccuggagguaccugccccugucucucaauccccugcaaaaggagucggagccgggggcuccaggcguuuacuccaagauucacaugcgucuucccaugucccagcugccuuugccgcugucgaugcagacaccuaaaaaggaggauuuuuccaaccccacugggagccccgccucugccucuccacccguuccgcgcugacccuccaggcagcgccccugguucgucugcgcuguccuuuccaccugacaaaagcuggggcggcggggcgcggcgccgggcgaccucacauuucugccaaaggagagagacgcguguccgcggugcgcccauucggggccucugcaaaucgaccgagcugaggaacaaagcggccagcgcgcggcgagacgcagcccccacggaacccccgagcgccccagcccucgccgucccggcccagccccccgcaagcggccgccggcgccggcugccuccugggcagcagccgcguccugcgccgcccguccgcccgcaggcguccucggcggcuacuguaccugcuaaauuuagcugcgccggguauuaauagcccgagccacugggaccgggcgcuguaggggcgcgcgcagcccggggccgggggcggggagggaggggacggaggggcgcgggggagaaggccacuuacaccaccagccuggagaugauccaugacaccauggcgggcaggcgggcgggcgaggcccgggcggcgcggcucggcuaggcugcgggcggcgcgggcugcugcggcguucccggaacgucagucagcucacggcagccgccgccagacugagcgcgcccgccgcccugcccggcguucgcgcguuggcgcagccgcggcacguucuggcggcggcggcggcggccccagccccccggggcucggcgggcccgcagcgauugggcggugagcuggucagggcacccgcgggcccgccccgucccgcucgcccuggcccccggcugaaggcgggcgcguccugcgcgcuccccggggcaccggccccgccaaaggaacccugcagcggccccguuugcagggcagggacccgggugcugccccacccucagcguuccagcggagaaacugaaguccgaaccugaaccucgggaaucugucugcaccugucuaggugggaugcugucaucccucauucagcuagugcguuagccucauaaaggguuuaccuggauccagaccuaaccucuucagucuguccguugcucagcacuuucugcauaagaaacaaaccugggcgcuugccucccuacuuaaaauucuacagagucccuauaugaucgugguaccugccuagaaccguguugccaagaccauucccccaaauaguccucua

SEQ ID NO: 19547 - RNA, 2693 nt, Homo sapiens
ggggguggcacagcguagucaucaguggcaggguuguaggggagcucauagcccuccuccuucacccgagcuuggcaccaccaugcauccuugggcucccgaggcagaucauaaaggcccuggggagggacuggggccaggcccucagguucaucauagaugggauccucuuuggggucugucagcuuggccuucagcaacugcugcugcgcaugcucauacaagucccaauagagagguuucuuccguuguacucccucuccugccugagcagacgugcuguccaaggggucugaguauagggaguccugggaagggcauggagcaaugcgcagggagucuaagggcucagcauacagggcugggggacugucgaggagcucuugggggccagguggggaaggcaacuuccccucugccaccuccccuucaugggagucagcucugagaacaucgugccccuguccggccuuucccugggccuucugccgguggauggcagucucaacugccuggaagaugucauuucccugugccgucuggaaggugaagguuccagggccugaggggcagcggcggccggccucgaaagagaacaugaccuaaggaggguagagggggaaacacauuaccaggagccaucagaggaagugagucacacgccugcacuaguuaggguaucuacaaagaagagaccaccugcgaacagacgcggggucaccggguaggcaagaaagggggauccaaaggucagagcuucccacuuucuguccugccccaccccucccacagcugcccaacccaggaagcccucccggacagccccugcaccuugucccggccauagcgacgcaacagaguguagggccaggacaggaguggcuccaguaucugacucugggcccccacggucaggagagucagccuuucagccuccacccucagcacguaggagccaugcaggccacagcgcucggcggccucaguccucugcaccguuacccagaauugggauccuggaaggcauacacgauuagacagcugcgggggagggacgggggcagcaguggggacccagaggacucaugagcauaguguccaagcacucacucggaagccagaucucagggccuuccuacuucuuacuuccccaugggccccuggguauccacccacuucccaaaggcccucggcccuccuccucuucacuccaucccugcccgggcuucugaggcgucuaccuucccagguagggcuguacaaggaguucuccagcaucuccagggcagaaagcuuagguggguuaucgguaggcgccagaguccagcugccuuucuguaguagagagcaucgagaaacccguaauuuccucagcggggagcgggggucggucugaggcagccccauuucucugccucuguaacugcccccaccccgcaucgccgcagcuccucaccggaaaggcguuucggcacagcgucugcacccaggcugcacuggacggcgcgucggccgccagcaggugcgagcgcugagcaguguccaggcggaaggcaguggcgccgggcucagggggggucuccacggugacgggggccacacucacacacucagccagacggaucacuuugcaguccaggcggcgcgagcucccucggccacccccagagcucgaccccuuauggucaaagaacucgagccgcgcuacgccguggggacuggccggguagagcacggcccaggucuuccuccaccucuagggagagagagagagugcucgagagggaguggcgugcgcaggcggcccgggucccgacggggaaggagguugcggcgcaagucgauuugggaucuggggcuuccaaacgggguugggggcgaaguuucccaaggacgaugccacuccgucuccccaggaccagaaccccuagacuacagacgcuucccgggagugugcaaagcaacuucacgggaaagucacaggcucuccaacucccggcgccgcucuccagcccgcugcccaccucucccuguuucugggcucucucacccacuacuagcccggauaagguucggcauccaugcgccagacuaccuuggucccaaagcgcugacucugcaaaaaaagcggcccuuccaucacugcuccguccauggcccccggcgguuccuuccgcgcuuccuggcccugcggcgggaggcggggcgggaggcggggccggguucccuggaggaguuuccgccccuccccggcccccgccggcagccgcugggggggucgcgguggggugagggagaggagcgagaaggaaugguggagacccccggauuagccgggagcugcagcaccccaggccccuacccgccgucgugggggcgcgccaguggcuccaccgaaaguccucgguuuuggcgcgagggcccuggccucugggcgugguggcugcgcgugacgucauaugcccaaggugacgucagagugaaagccaugacaucaccccgaaagcgccccgggcaccggagagacccacacgggccuccggggcuuuauuuacccuggccgggcccgcccccagccccgcccgagccgggcuguuuagacuccgcuggcccgggacucggagggagggcugggguugaaccgcuucccgccaccaccggggccgccccgccgcccggccgccgcuugcaug

SEQ ID NO: 19548 - RNA, 2693 nt, Homo sapiens
caugcaagcggcggccgggcggcggggcggccccggugguggcgggaagcgguucaaccccagcccucccuccgagucccgggccagcggagucuaaacagcccggcucgggcggggcugggggcgggcccggccaggguaaauaaagccccggaggcccgugugggucucuccggugcccggggcgcuuucggggugaugucauggcuuucacucugacgucaccuugggcauaugacgucacgcgcagccaccacgcccagaggccagggcccucgcgccaaaaccgaggacuuucgguggagccacuggcgcgcccccacgacggcggguaggggccuggggugcugcagcucccggcuaauccgggggucuccaccauuccuucucgcuccucucccucaccccaccgcgacccccccagcggcugccggcgggggccggggaggggcggaaacuccuccagggaacccggccccgccucccgccccgccucccgccgcagggccaggaagcgcggaaggaaccgccgggggccauggacggagcagugauggaagggccgcuuuuuuugcagagucagcgcuuugggaccaagguagucuggcgcauggaugccgaaccuuauccgggcuaguagugggugagagagcccagaaacagggagaggugggcagcgggcuggagagcggcgccgggaguuggagagccugugacuuucccgugaaguugcuuugcacacucccgggaagcgucuguagucuagggguucugguccuggggagacggaguggcaucguccuugggaaacuucgcccccaaccccguuuggaagccccagaucccaaaucgacuugcgccgcaaccuccuuccccgucgggacccgggccgccugcgcacgccacucccucucgagcacucucucucucucccuagagguggaggaagaccugggccgugcucuacccggccaguccccacggcguagcgcggcucgaguucuuugaccauaaggggucgagcucuggggguggccgagggagcucgcgccgccuggacugcaaagugauccgucuggcugagugugugaguguggcccccgucaccguggagacccccccugagcccggcgccacugccuuccgccuggacacugcucagcgcucgcaccugcuggcggccgacgcgccguccagugcagccugggugcagacgcugugccgaaacgccuuuccggugaggagcugcggcgaugcggggugggggcaguuacagaggcagagaaauggggcugccucagaccgacccccgcuccccgcugaggaaauuacggguuucucgaugcucucuacuacagaaaggcagcuggacucuggcgccuaccgauaacccaccuaagcuuucugcccuggagaugcuggagaacuccuuguacagcccuaccugggaagguagacgccucagaagcccgggcagggauggagugaagaggaggagggccgagggccuuugggaaguggguggauacccaggggcccauggggaaguaagaaguaggaaggcccugagaucuggcuuccgagugagugcuuggacacuaugcucaugaguccucuggguccccacugcugcccccgucccucccccgcagcugucuaaucguguaugccuuccaggaucccaauucuggguaacggugcagaggacugaggccgccgagcgcuguggccugcauggcuccuacgugcugaggguggaggcugaaaggcugacucuccugaccgugggggcccagagucagauacuggagccacuccuguccuggcccuacacucuguugcgucgcuauggccgggacaaggugcaggggcuguccgggagggcuuccuggguugggcagcugugggagggguggggcaggacagaaagugggaagcucugaccuuuggaucccccuuucuugccuacccggugaccccgcgucuguucgcagguggucucuucuuuguagauacccuaacuagugcaggcgugugacucacuuccucugauggcuccugguaauguguuucccccucuacccuccuuaggucauguucucuuucgaggccggccgccgcugccccucaggcccuggaaccuucaccuuccagacggcacagggaaaugacaucuuccaggcaguugagacugccauccaccggcagaaggcccagggaaaggccggacaggggcacgauguucucagagcugacucccaugaaggggagguggcagaggggaaguugccuuccccaccuggcccccaagagcuccucgacagucccccagcccuguaugcugagcccuuagacucccugcgcauugcuccaugcccuucccaggacucccuauacucagaccccuuggacagcacgucugcucaggcaggagagggaguacaacggaagaaaccucucuauugggacuuguaugagcaugcgcagcagcaguugcugaaggccaagcugacagaccccaaagaggaucccaucuaugaugaaccugagggccuggccccagucccuccccagggccuuuaugaucugccucgggagcccaaggaugcaugguggugccaagcucgggugaaggaggagggcuaugagcuccccuacaacccugccacugaugacuacgcugugccaccccc

SEQ ID NO: 19549 - RNA, 2555 nt, Homo sapiens
aggugacgucagagugaaagccaugacaucaccccgaaagcgccccgggcaccggagagacccacacgggccuccggggcuuuauuuacccuggccgggcccgcccccagccccgcccgagccgggcuguuuagacuccgcuggcccgggacucggagggagggcugggguugaaccgcuucccgccaccaccggggccgccccgccgcccggccgccgcuugcaugucagcucccugaccgcagaggccuggccuccaugccgcgggaagagaaagcuucauugaacgagccgggagggccagggagggggagggggcgcggcaguggccagcuccacggggagggaggacccagaggaggagaggagggaacuggccgggaggaauggaaggagaaggcggaaugugggagggcucagggggaugugggagggacgaacggagaagggggagagagggggguccagucuccccuggccgagcauuuuuuuuuuuuuuuggaaguccuaggacugaucuccaggaccagcacucuucucccagcccuuaggguccugcucggccaagguagggggagucacgcuaaccgcagagggaaugaguaggggauggagaggauguggagggaccagggaaaacggguggugugggauggagucgaggggaagccacccaacugagaguuugauucuugucaaagggcaagugagacagaguacacggaggaggcacauaccggaggcgggggcuacggguguucgaacagggccgccaggagcgcccuaagggagggggcuccuccgggaggcgcugccccuggguccccaacccagaacaaagcugccuuguuggauugauuguuuggguugggggaagcauguugacgggggcuugcuguagaggggcuguucucagcccuaggcagagaaggccuuggcugaggagccauagcgccuggccucccguugcccggugacagggauggugguguuggcaggaggcugggacaacccuaccccaucccccgcccagccuugaggccuggcccuccugggccucuugacccugcagggcaucugagagccugcguguuggggagggcgugcagcagguucuccaggcgagcuuuggugccagccuucccugccugggaaucugcuggguuaggacucugggcucccauucaggggaucugugaucccagggccgccuagggccccuuacgugccucucugcacaaucaguacagcugucuguccucccucugaguaaauggggucaucuggaucccucccacguccgccccuuggcucuugucaaucccucuccuucucacccgcggugugcuugguuccccuauacugagugcuuaguucuuugccuaucacuuucuauccguugucucucuccucugugucuuucugguuuucucucucucauucccacagucucccuuccucucacauccugucugucugggucuuccucucucucuacgugucucuugcucagucucuaucucuuuuuauugacccuucucugacucucgaucucucauaguugucucuuaucucugggucucucaggcugugccucuaugaccugugccucagcccuuauuuaauguguuucucucccugucucuuggucccuggggcucuuucucuccuguugucucucgcugucucugucuuacucagugucuguuuuucuuucgugacuucucccucucuuucugacucugggccccacucaaucuguuucucucacgcacacuuugucucuggggcacccaggccuucccugccaugcgaccugucagugucuggcaguggagccccugggggcugcugcugugccugcugugcaguucgugcuuggggucuccguccccuuccacgggcccugagaagaaggccgggagccaggggcuucgguuccggcuggcuggcuuccccaggaagcccuacgagggccgcguggagauacagcgagcuggugaauggggcaccaucugcgaugaugacuucacgcugcaggcugcccacauccucugccgggagcugggcuucacagaggccacaggcuggacccacagugccaaauauggcccuggaacaggugagcaaugauccaggcauauccuagauauuuccuauguguggccaaagugcagggaaagggaacacgaggauggcacagccauagggacacacgacaccaagaacagccagcauugaguaaauccauggaugacaaaccaagcaacauaguuacuucccagagcugugugaccuuaggcuagucagugcuuucucugagccucagaugcccuguaugcaaaaugacuagaugaugucuaaguucuuuucugcugcaaaaguaugauccuacaaagccauccacaaaacagcccagauacaggugagcccuguacaaauaaaguacaguuagucucaugggacgcuaagagcagguaaaugauaucuggaugucccaaagucacaaggggucacagacacugcagcuaacaaaaucagguuaugggccagag

SEQ ID NO: 19550 - RNA, 2555 nt, Homo sapiens
cucuggcccauaaccugauuuuguuagcugcagugucugugaccccuugugacuuugggacauccagauaucauuuaccugcucuuagcgucccaugagacuaacuguacuuuauuuguacagggcucaccuguaucugggcuguuuuguggauggcuuuguaggaucauacuuuugcagcagaaaagaacuuagacaucaucuagucauuuugcauacagggcaucugaggcucagagaaagcacugacuagccuaaggucacacagcucugggaaguaacuauguugcuugguuugucauccauggauuuacucaaugcuggcuguucuuggugucgugugucccuauggcugugccauccucguguucccuuucccugcacuuuggccacacauaggaaauaucuaggauaugccuggaucauugcucaccuguuccagggccauauuuggcacuguggguccagccuguggccucugugaagcccagcucccggcagaggaugugggcagccugcagcgugaagucaucaucgcagauggugccccauucaccagcucgcuguaucuccacgcggcccucguagggcuuccuggggaagccagccagccggaaccgaagccccuggcucccggccuucuucucagggcccguggaaggggacggagaccccaagcacgaacugcacagcaggcacagcagcagcccccaggggcuccacugccagacacugacaggucgcauggcagggaaggccugggugccccagagacaaagugugcgugagagaaacagauugaguggggcccagagucagaaagagagggagaagucacgaaagaaaaacagacacugaguaagacagagacagcgagagacaacaggagagaaagagccccagggaccaagagacagggagagaaacacauuaaauaagggcugaggcacaggucauagaggcacagccugagagacccagagauaagagacaacuaugagagaucgagagucagagaagggucaauaaaaagagauagagacugagcaagagacacguagagagagaggaagacccagacagacaggaugugagaggaagggagacugugggaaugagagagagaaaaccagaaagacacagaggagagagacaacggauagaaagugauaggcaaagaacuaagcacucaguauaggggaaccaagcacaccgcgggugagaaggagagggauugacaagagccaaggggcggacgugggagggauccagaugaccccauuuacucagagggaggacagacagcuguacugauugugcagagaggcacguaaggggcccuaggcggcccugggaucacagauccccugaaugggagcccagaguccuaacccagcagauucccaggcagggaaggcuggcaccaaagcucgccuggagaaccugcugcacgcccuccccaacacgcaggcucucagaugcccugcagggucaagaggcccaggagggccaggccucaaggcugggcgggggaugggguaggguugucccagccuccugccaacaccaccaucccugucaccgggcaacgggaggccaggcgcuauggcuccucagccaaggccuucucugccuagggcugagaacagccccucuacagcaagcccccgucaacaugcuucccccaacccaaacaaucaauccaacaaggcagcuuuguucuggguuggggacccaggggcagcgccucccggaggagcccccucccuuagggcgcuccuggcggcccuguucgaacacccguagcccccgccuccgguaugugccuccuccguguacucugucucacuugcccuuugacaagaaucaaacucucaguuggguggcuuccccucgacuccaucccacaccacccguuuucccuggucccuccacauccucuccauccccuacucauucccucugcgguuagcgugacucccccuaccuuggccgagcaggacccuaagggcugggagaagagugcugguccuggagaucaguccuaggacuuccaaaaaaaaaaaaaaaugcucggccaggggagacuggaccccccucucucccccuucuccguucgucccucccacaucccccugagcccucccacauuccgccuucuccuuccauuccucccggccaguucccuccucuccuccucuggguccucccuccccguggagcuggccacugccgcgcccccucccccucccuggcccucccggcucguucaaugaagcuuucucuucccgcggcauggaggccaggccucugcggucagggagcugacaugcaagcggcggccgggcggcggggcggccccggugguggcgggaagcgguucaaccccagcccucccuccgagucccgggccagcggagucuaaacagcccggcucgggcggggcugggggcgggcccggccaggguaaauaaagccccggaggcccgugugggucucuccggugcccggggcgcuuucggggugaugucauggcuuucacucugacgucaccu

SEQ ID NO: 19551 - RNA, 2813 nt, Homo sapiens
uuggguguguaaguauccgacucgccuccugcccgggcguguugccggaggauguggccagcaggcugaacacacaugacaacgugaggcucaaagucaggaaggaauccuuagcgauuauuuuacaguugagggaugagaugcccgggguggacaacccucugguuucggucacaaucagccagccucucgcgcuccagcacccccucuauugcuucgccguggucggugucuucuuuccuucacaccuuugguacagacccagccggcaccgcgcgcaacgccgcuagagccccucagagccccagcucccgaccacccgccggagaauuucgagucccucaggaaagcagcucccauuggccagcccggcccccuccccgcaccucauuggcuacuguccugcaggucccgcccucucggcgccucagguuccagcgagggcguaacggcagugaagugaaaaauggcgggaaaggccgccucugagcuggccgugcaucugcgcaacgcuggcuugggagccggccggugguggaggagcccucgacgacagccucaaggccugccgcuccucacgcgcccggcugccacuagaccauggacgcaggcagccgcgcgcuccaccgcuccgggcccggcgcuccacgccgaucggacgggcgucgcucacaccaccgaggcgagcccggacacugaagccacuuuguuguccucggcccagggcugcagguucugcagcgcgaagagcgacgaguugugcaggcagagaggguccgggggcagcggcggccgcagcggccguggcaacgcguccugcugcagaugcaggagcagccggcccgcgcggugccgcucggccucgcgcuccuccgccgucuggcgccuaagggagggagacgcggggucagcggggcgcccgccgcgucgcuucucaccaggcccugcucgggaaccccaguccgcccucgcccgcgccgcgccucaccgccacuuggugcgucgguucuggaaccacguuuugaccugugcgucggucaugcgcaaggccuuggccagcgccgcccucuccgcagaggccagguacuucuggcgcaggaagcgccgcuccaacuccagcaccugugagcgggagaaggacgugcgcggcuucuuccgcuucggagggguccgguuuugguagggguggccuaugcggcgcgucccagagaagggcgagagcgcagcuaccgggaggaagaaagaccagggcaggauuugcaggguggcccgaggugccacugagaaggccgcgcggcuguccaggccgcagaacucccgcgcccuguccuuacccgggcccuaagcaucagccgagcccuauagccaagaaaggcccuuccccugggaugcgagggagacguccccuguaacuucacccuccccuccccacgcguggacagugggacuacagaggagggcgcgggcaccgacggcagcucccuccccaucaccucucggaggcaggacccagagauuugaguugggggaggauccccugggaggaucuagugggaggugugaaagggguccuugaguuggagcagaaagcuaagaaaugaggagacggggucagagucgggcgugacgcuggaggggucagacaaccucacccgugagccgguccuuggcaaagcggcggccgcuguccauccaggggaaggugagucccgcuaggccuccggcgccgcccaaacccgagggcccaggcacugcaggcgcccccccagcgggcggcggcacaggcagcgggcggugcgcagggacgcggaucacgccgccugggcccacuccggagcugccgggcagcggggcaagugagccggcgggaccguagcccgaggcuccgugguauccacccgagaacgccccauucuccccaugacccuggcccccgcgacccaggccuagaccgcccccugggguuucggggccgcucaggaucugaucgaugccgaagcugauuggcucguggugugggagguuguguggacccagcauccccggcuccaucggucugggccgaggagaaccgccggagguucggugguuggggaggaugccucaggcagcgccagaagcccagcggcggcgcgcuccggagaguggccucaggggcccgcggggcuggccaaggcagggcgccgggguccccgaaacagcagcaucccugugcacccggagcagccgcgcccgugccagccgcugccgggcgucagcgcagggacuugcaucccgggggagcacggccagcuggggccccuggagcuuccuugcuggcucuuaagcgcaaauagacgcugggcugccggcgccgcugcccaagucccggguggagaggguuggccagcuccggcuggggcagugacugacggaucggcccggguggguagugggggcuggggguagggcaggggcggggcccagcaguuaaaggggaagggacgccuguuugcgccaagcgcagggggaaggcuggcuggcggagaugugcggggagggggacagggggccaggguguuaggagccaggcucagcgcgggaggggcccgagcaugggccgcugagucagcggagaugcucaccgcgccuccauccuugcuggccuccgccuuugggcggccuccgccuuugggcugccuccgccucaccggcuuccuccgcaggugccuccucccccagcccccacucuucgccucucgauggauccuucuggccaacucccggauucguugugguccccgccuaaaugcucucgaagaccaaaucucguu

SEQ ID NO: 19552 - RNA, 2813 nt, Homo sapiens
aacgagauuuggucuucgagagcauuuaggcggggaccacaacgaauccgggaguuggccagaaggauccaucgagaggcgaagagugggggcugggggaggaggcaccugcggaggaagccggugaggcggaggcagcccaaaggcggaggccgcccaaaggcggaggccagcaaggauggaggcgcggugagcaucuccgcugacucagcggcccaugcucgggccccucccgcgcugagccuggcuccuaacacccuggcccccugucccccuccccgcacaucuccgccagccagccuucccccugcgcuuggcgcaaacaggcgucccuuccccuuuaacugcugggccccgccccugcccuacccccagcccccacuacccacccgggccgauccgucagucacugccccagccggagcuggccaacccucuccacccgggacuugggcagcggcgccggcagcccagcgucuauuugcgcuuaagagccagcaaggaagcuccaggggccccagcuggccgugcucccccgggaugcaagucccugcgcugacgcccggcagcggcuggcacgggcgcggcugcuccgggugcacagggaugcugcuguuucggggaccccggcgcccugccuuggccagccccgcgggccccugaggccacucuccggagcgcgccgccgcugggcuucuggcgcugccugaggcauccuccccaaccaccgaaccuccggcgguucuccucggcccagaccgauggagccggggaugcuggguccacacaaccucccacaccacgagccaaucagcuucggcaucgaucagauccugagcggccccgaaaccccagggggcggucuaggccugggucgcgggggccagggucauggggagaauggggcguucucggguggauaccacggagccucgggcuacggucccgccggcucacuugccccgcugcccggcagcuccggagugggcccaggcggcgugauccgcgucccugcgcaccgcccgcugccugugccgccgcccgcugggggggcgccugcagugccugggcccucggguuugggcggcgccggaggccuagcgggacucaccuuccccuggauggacagcggccgccgcuuugccaaggaccggcucacgggugagguugucugaccccuccagcgucacgcccgacucugaccccgucuccucauuucuuagcuuucugcuccaacucaaggaccccuuucacaccucccacuagauccucccaggggauccucccccaacucaaaucucuggguccugccuccgagaggugauggggagggagcugccgucggugcccgcgcccuccucuguagucccacuguccacgcguggggaggggagggugaaguuacaggggacgucucccucgcaucccaggggaagggccuuucuuggcuauagggcucggcugaugcuuagggcccggguaaggacagggcgcgggaguucugcggccuggacagccgcgcggccuucucaguggcaccucgggccacccugcaaauccugcccuggucuuucuuccucccgguagcugcgcucucgcccuucucugggacgcgccgcauaggccaccccuaccaaaaccggaccccuccgaagcggaagaagccgcgcacguccuucucccgcucacaggugcuggaguuggagcggcgcuuccugcgccagaaguaccuggccucugcggagagggcggcgcuggccaaggccuugcgcaugaccgacgcacaggucaaaacgugguuccagaaccgacgcaccaaguggcggugaggcgcggcgcgggcgagggcggacugggguucccgagcagggccuggugagaagcgacgcggcgggcgccccgcugaccccgcgucucccucccuuaggcgccagacggcggaggagcgcgaggccgagcggcaccgcgcgggccggcugcuccugcaucugcagcaggacgcguugccacggccgcugcggccgccgcugcccccggacccucucugccugcacaacucgucgcucuucgcgcugcagaaccugcagcccugggccgaggacaacaaaguggcuucaguguccgggcucgccucgguggugugagcgacgcccguccgaucggcguggagcgccgggcccggagcgguggagcgcgcggcugccugcguccauggucuaguggcagccgggcgcgugaggagcggcaggccuugaggcugucgucgagggcuccuccaccaccggccggcucccaagccagcguugcgcagaugcacggccagcucagaggcggccuuucccgccauuuuucacuucacugccguuacgcccucgcuggaaccugaggcgccgagagggcgggaccugcaggacaguagccaaugaggugcggggagggggccgggcuggccaaugggagcugcuuuccugagggacucgaaauucuccggcggguggucgggagcuggggcucugaggggcucuagcggcguugcgcgcggugccggcugggucuguaccaaaggugugaaggaaagaagacaccgaccacggcgaagcaauagagggggugcuggagcgcgagaggcuggcugauugugaccgaaaccagaggguuguccaccccgggcaucucaucccucaacuguaaaauaaucgcuaaggauuccuuccugacuuugagccucacguugucauguguguucagccugcuggccacauccuccggcaacacgcccgggcaggaggcgagucggauacuuacacacccaa

SEQ ID NO: 19553 - RNA, 2811 nt, Homo sapiens
auccccacuauucccaguugcagucgcuccgccaggccagguccucccaaguguugcgcccccgacccaugcagcacuaaucacuuccagccgucaggaccagaaacaacguuucucaggggugggguggggaagagggagccagguuaggagacugagguccuagcugggaucagagaucccagcacagucagcccugauagccuuccucagaacuuugcaaauccccagccgcuggggccagagaaggcaauuuuaucgucuacuaguuuaugagccggagcggcggcuaggcggggagucggcggcauacagcgucuggagguauggcccggccugacugugcacggugcagcgccccgcagcgcggagcagccccguggcccugcucugguggguaguuuggucggcuucugcucuccgcgccugccccagccuguagaaauacccuccccggacaucuaggagcuccagauccaccgcggcccgggguggagaggugggggcgcaggaggaggggcacacgggacucgggcccagagccgggggcggguccgaggcugggggcccggauugggagccgagcacuggggcccaggcguuugcggagccuagcgcaacggacagccggaccgccccagcccggccgaccaugaacucgggacgcgagccccgaacaccccggacacucuuaagcaucgcagacauccuagccccgcgcauggucccccgagcacccucugcgccgcagcuuccagagucggguccggguccaacgucgccgcugugcgcgcuggaggagcugacuaguaaaacuuuccgcggacuugacgcgcgcgcucugcagcccucugaagguauagagccggcaaggucgcggacucugacuuagccuuuuccucaccucucuccuccugguuccccgucucaaaccuuugucccagcccaggccacccacccuaauccuccccuguccucagcccacgugccaggacucgcaccugcgacuucucaccucuccuccguuagucccuagguuccgcggcggcuccggaaggccgccagugccaagggaaaagggcagaccgucgccaacugagcgaccuguugcucuguuccuuguaggcggggcaaucgcgauagagaaaggcaggagagaaagagacaaaaggcuucagccgcaggcgguaaacgagugagccugcaaaggcggcacagaaagcgcuggagagucgagucuuuccgggugaccaagcuccgcuccaagccacucucuucucgaggggagucaaggagcagaaagcccuuggcgcagcacugggcgcgggauuccgcacucugccuuuucucgcucucuguaccucauuaucucccuuuggggccggaggagcgggcucuggugucacuaaggaacuguaaaccgaaugcccgacccgauccauggaagggcaugaucuaaguccuguuaccaccaccacgcugggucggcugcccugacucuuacucgccucugaugucacccucaacuuauagccugcucagccugaggcuccuaaaagccucaaaggcuccaccccagaagguuugacccugcaccucugaaucaucccucccuuccuucacuuccuugccccuacaauaugcccucagccugcugccuuucgcaccccuguggccagcccgcuuugcgccccauauccccaccugggccugacucccgauaagggaucacaguucuggucuccguccgccuuccuggcucucccucuacuucccccaccgccaccggcccgaccccacccccaacuuuucuuuccaggcccagccugauucccggaggcuggaaacugacccccucccuaucccuacagggcgggcagguccggacgcgcugggcccuggucccuucggccgcaaacggcgcaagucacgcacugcguucaccgcgcaacaggugcuggagcuggagcggcgcuucgucuuccagaaguaccuggcgccguccgagcgagacgggcuagcuacgcgacucggccuggccaacgcgcagguggucacuugguuccagaaccggcgagccaagcucaagcgcgauguggaggagaugcgcgccgacgucgccucgcuacgcgcguuguccccggaaguccugugcagcuuagcacugcccgaaggcgcuccagaucccggccucugccucggcccugccggcccugacucccggccccaccugucagacgaggagauacagguggacgauugaagacaaagccgccgccaauccugggcucuggggcccuggacuccucaccucgcgcucugccucuggccagaguuccaggguggaggaaggagguccacuugggccucuuccggcccacaguccagacgcucaccuuucccgguuuuuuuguaaguuuguuuuguugucugagacagggccucgcucugucgcccaggcuggagugccguggagcgaucaccgcucacugcagucgcgaccuccugggcucaagcgauccuccugccucaaccucccgacuagcuggcauuacaggcgugcagcaccaccccaggcuaauuuaaaaaacuuuuuuuuuuagagaggaggucccgcuauguuguccaggcuacuuucccaauauuugagaauaaagucgagacucugccgcaccaugccucuauccagacgcccgccagaagcaagaaacaguaaaaucuguaaagugcuauggggaguccgcacuuggcacugugccagggcuuucaaugcaauguuuccuuuagcccuuauagcaacccuuuaaggua

SEQ ID NO: 19554 - RNA, 2811 nt, Homo sapiens
uaccuuaaaggguugcuauaagggcuaaaggaaacauugcauugaaagcccuggcacagugccaagugcggacuccccauagcacuuuacagauuuuacuguuucuugcuucuggcgggcgucuggauagaggcauggugcggcagagucucgacuuuauucucaaauauugggaaaguagccuggacaacauagcgggaccuccucucuaaaaaaaaaaguuuuuuaaauuagccugggguggugcugcacgccuguaaugccagcuagucgggagguugaggcaggaggaucgcuugagcccaggaggucgcgacugcagugagcggugaucgcuccacggcacuccagccugggcgacagagcgaggcccugucucagacaacaaaacaaacuuacaaaaaaaccgggaaaggugagcgucuggacugugggccggaagaggcccaaguggaccuccuuccuccacccuggaacucuggccagaggcagagcgcgaggugaggaguccagggccccagagcccaggauuggcggcggcuuugucuucaaucguccaccuguaucuccucgucugacagguggggccgggagucagggccggcagggccgaggcagaggccgggaucuggagcgccuucgggcagugcuaagcugcacaggacuuccggggacaacgcgcguagcgaggcgacgucggcgcgcaucuccuccacaucgcgcuugagcuuggcucgccgguucuggaaccaagugaccaccugcgcguuggccaggccgagucgcguagcuagcccgucucgcucggacggcgccagguacuucuggaagacgaagcgccgcuccagcuccagcaccuguugcgcggugaacgcagugcgugacuugcgccguuugcggccgaagggaccagggcccagcgcguccggaccugcccgcccuguagggauagggagggggucaguuuccagccuccgggaaucaggcugggccuggaaagaaaaguuggggguggggucgggccgguggcggugggggaaguagagggagagccaggaaggcggacggagaccagaacugugaucccuuaucgggagucaggcccagguggggauauggggcgcaaagcgggcuggccacaggggugcgaaaggcagcaggcugagggcauauuguaggggcaaggaagugaaggaagggagggaugauucagaggugcagggucaaaccuucugggguggagccuuugaggcuuuuaggagccucaggcugagcaggcuauaaguugagggugacaucagaggcgaguaagagucagggcagccgacccagcgugguggugguaacaggacuuagaucaugcccuuccauggaucgggucgggcauucgguuuacaguuccuuagugacaccagagcccgcuccuccggccccaaagggagauaaugagguacagagagcgagaaaaggcagagugcggaaucccgcgcccagugcugcgccaagggcuuucugcuccuugacuccccucgagaagagaguggcuuggagcggagcuuggucacccggaaagacucgacucuccagcgcuuucugugccgccuuugcaggcucacucguuuaccgccugcggcugaagccuuuugucucuuucucuccugccuuucucuaucgcgauugccccgccuacaaggaacagagcaacaggucgcucaguuggcgacggucugcccuuuucccuuggcacuggcggccuuccggagccgccgcggaaccuagggacuaacggaggagaggugagaagucgcaggugcgaguccuggcacgugggcugaggacaggggaggauuaggguggguggccugggcugggacaaagguuugagacggggaaccaggaggagagaggugaggaaaaggcuaagucagaguccgcgaccuugccggcucuauaccuucagagggcugcagagcgcgcgcgucaaguccgcggaaaguuuuacuagucagcuccuccagcgcgcacagcggcgacguuggacccggacccgacucuggaagcugcggcgcagagggugcucgggggaccaugcgcggggcuaggaugucugcgaugcuuaagaguguccgggguguucggggcucgcgucccgaguucauggucggccgggcuggggcgguccggcuguccguugcgcuaggcuccgcaaacgccugggccccagugcucggcucccaauccgggcccccagccucggacccgcccccggcucugggcccgagucccgugugccccuccuccugcgcccccaccucuccaccccgggccgcgguggaucuggagcuccuagauguccggggaggguauuucuacaggcuggggcaggcgcggagagcagaagccgaccaaacuacccaccagagcagggccacggggcugcuccgcgcugcggggcgcugcaccgugcacagucaggccgggccauaccuccagacgcuguaugccgccgacuccccgccuagccgccgcuccggcucauaaacuaguagacgauaaaauugccuucucuggccccagcggcuggggauuugcaaaguucugaggaaggcuaucagggcugacugugcugggaucucugaucccagcuaggaccucagucuccuaaccuggcucccucuuccccaccccaccccugagaaacguuguuucugguccugacggcuggaagugauuagugcugcaugggucgggggcgcaacacuugggaggaccuggccuggcggagcgacugcaacugggaauaguggggau

SEQ ID NO: 19555 - RNA, 2580 nt, Homo sapiens
caagggcauggccggagacuacaacuccccaaagccuccagagccccgucuggcgcccauccgucgcggguuucugcacagcugacuucaaagaggcgugaccaaaaugagcaggacugggggaaacugagggucgcuuuuaccucuucgccguaauccucuggaccgaauuccuugcaaaguuugggugcagcagcgaccuccagugggcagcugggccguagagagcagucuacaggaaaggaaggcggagccucgucagcgggcucgggacagaugggcuagaguccuccccacucuacccucgacucuccgcccucugcauaaaauccuacucgaaacguucagaccacagguggacccaagaggggcugccucugcccuccuagacccccacuggucuugucauaccgcucaccuagcuugauccgccccacagucuuuggaaucggcgccaucgcaucuacagugacccggaaaugaaagguagucuaguauuugauaccagccaaagggcggggugggacagagugggcggccauguuuguuaggggcagaagccucccauuacggagcacgagagaguccaugaagguccccgcgacucccggacuggagaaaacggcucuugcgauggggcgaaguccgagcugcggcgggcguugguccgugcagggaagugggaaucguuagguucguucuggacccgccgccccauggcccaggcgucucgcucagguagccugccuccacucguuaucgugcccccgcugagggcgcaacccgggggcacuggggaggagcagugggagagaagucgaacgggcggucuucgcugggagguucacugcuggccgagcggaacuucuggagggacgccgugguggccgacgccggcggaugugagcgaggacuacgaggcugaugcugcggccuggaggcgggggcccgcagguggcggcccgaucccucccgcgcugcagcgucuccgggcgguguugcugcggcugcaucgcgagcgggagcagcuccuccaggcccgagacugcgccuaccaccuacagucggcugugcgacucaugaagacccugaguccuggcucgccauccggcggcccuagccccuugccccaguggugccgcgaccugcagcugcacccuucccaaggggcgguucugcgaaucggcccuggggagacucucgagccgcugcugcuagcgcgccccaucggacuagccgcccagugccuggaggcugucaucgagaugcagcuucgcgcucucggccgggagcccgccagcccgggccugucgucccaacucgccgagcugcucuuugcacuucccgccuaccacacacuacagagaaaagccuugagccacgucccaggggccgcacguccuuuccccacgucccgugugcuccgccucuugacgggggagcgggguugccagguggcaagucggcuggacgaggcgcuccaaggaucggcguugagggaccagcuccgcaggcggugccaagaggagggggaucugcuaccagggcugcugggccuggucgggggcguggcggguucagccagcuguggacuagggcucggaggggcuggggccuuguggagccaauacuggacccugcugugggcagccugugcucagagucuggaccuaaaucugggacccuggagggaccccagggcaacagcgcaacagcugagucaggcacugggucagggugagugaugggcuugggugggcguuugggaaggcuggggucucuuccuuccccuuggccaacucacugaccugccauccugaaggcaaaagcaggcccuuuagaaagaacaccccuggguucagacuauagcuucugagcuuucaaggcaaagucuugcuuuccaccccagucccgagucuuggaggaagcaugccuucuugccucaucauugagugggcagggguuguggaaagugagaccuuguuuucaggccccagagucauuucucccacuagcaucccugccucaggagugugagaaggagcuggcaucuuugugucacagacuacuucaucagucgcuuaucuggagcugggaccaaggugagaaggaaggggcacugggggugacauaagucccagguuaccgcuuccccaccacacuauacucucucauccucagguuucugccaggccuugggaucagcucuugggggucagagcagccuucccacauccucuggcacugcugaacuuuugcagcagcucuuuccuccucucuuggaugcccuucgagagcccagguuacgacggauuuucugccagccugcaggugagacgaggggcuggggcuggggacacagagcaguugaggauaucucuuuucuuucacucuguucugaaaucugccucuucccaaagguacuccaugaccccuaagauacucacucugcugcucaaauccccagauccugcgccugucgcccuaggucucuguacccuucagaccaccuugcucugguuccugggcagagcucagcaguacuuggcagcaugggacccagcuuccuuccugcuccug

SEQ ID NO: 19556 - RNA, 2580 nt, Homo sapiens
caggagcaggaaggaagcugggucccaugcugccaaguacugcugagcucugcccaggaaccagagcaagguggucugaaggguacagagaccuagggcgacaggcgcaggaucuggggauuugagcagcagagugaguaucuuaggggucauggaguaccuuugggaagaggcagauuucagaacagagugaaagaaaagagauauccucaacugcucuguguccccagccccagccccucgucucaccugcaggcuggcagaaaauccgucguaaccugggcucucgaagggcauccaagagaggaggaaagagcugcugcaaaaguucagcagugccagaggaugugggaaggcugcucugacccccaagagcugaucccaaggccuggcagaaaccugaggaugagagaguauagugugguggggaagcgguaaccugggacuuaugucacccccagugccccuuccuucucaccuuggucccagcuccagauaagcgacugaugaaguagucugugacacaaagaugccagcuccuucucacacuccugaggcagggaugcuagugggagaaaugacucuggggccugaaaacaaggucucacuuuccacaaccccugcccacucaaugaugaggcaagaaggcaugcuuccuccaagacucgggacugggguggaaagcaagacuuugccuugaaagcucagaagcuauagucugaacccagggguguucuuucuaaagggccugcuuuugccuucaggauggcaggucagugaguuggccaaggggaaggaagagaccccagccuucccaaacgcccacccaagcccaucacucacccugacccagugccugacucagcuguugcgcuguugcccuggggucccuccagggucccagauuuagguccagacucugagcacaggcugcccacagcaggguccaguauuggcuccacaaggccccagccccuccgagcccuaguccacagcuggcugaacccgccacgcccccgaccaggcccagcagcccugguagcagaucccccuccucuuggcaccgccugcggagcuggucccucaacgccgauccuuggagcgccucguccagccgacuugccaccuggcaaccccgcucccccgucaagaggcggagcacacgggacguggggaaaggacgugcggccccugggacguggcucaaggcuuuucucuguagugugugguaggcgggaagugcaaagagcagcucggcgaguugggacgacaggcccgggcuggcgggcucccggccgagagcgcgaagcugcaucucgaugacagccuccaggcacugggcggcuaguccgauggggcgcgcuagcagcagcggcucgagagucuccccagggccgauucgcagaaccgccccuugggaagggugcagcugcaggucgcggcaccacuggggcaaggggcuagggccgccggauggcgagccaggacucagggucuucaugagucgcacagccgacuguaggugguaggcgcagucucgggccuggaggagcugcucccgcucgcgaugcagccgcagcaacaccgcccggagacgcugcagcgcgggagggaucgggccgccaccugcgggcccccgccuccaggccgcagcaucagccucguaguccucgcucacauccgccggcgucggccaccacggcgucccuccagaaguuccgcucggccagcagugaaccucccagcgaagaccgcccguucgacuucucucccacugcuccuccccagugcccccggguugcgcccucagcgggggcacgauaacgaguggaggcaggcuaccugagcgagacgccugggccauggggcggcggguccagaacgaaccuaacgauucccacuucccugcacggaccaacgcccgccgcagcucggacuucgccccaucgcaagagccguuuucuccaguccgggagucgcggggaccuucauggacucucucgugcuccguaaugggaggcuucugccccuaacaaacauggccgcccacucugucccaccccgcccuuuggcugguaucaaauacuagacuaccuuucauuuccgggucacuguagaugcgauggcgccgauuccaaagacuguggggcggaucaagcuaggugagcgguaugacaagaccagugggggucuaggagggcagaggcagccccucuuggguccaccuguggucugaacguuucgaguaggauuuuaugcagagggcggagagucgaggguagaguggggaggacucuagcccaucugucccgagcccgcugacgaggcuccgccuuccuuuccuguagacugcucucuacggcccagcugcccacuggaggucgcugcugcacccaaacuuugcaaggaauucgguccagaggauuacggcgaagagguaaaagcgacccucaguuucccccaguccugcucauuuuggucacgccucuuugaagucagcugugcagaaacccgcgacggaugggcgccagacggggcucuggaggcuuuggggaguuguagucuccggccaugcccuug

SEQ ID NO: 19557 - RNA, 1965 nt, Homo sapiens
acgcaaaauuuccgccuccuuuucuggggccuaagaggaguccagccccuaggcugagcguuucccccguccgccguccacgcguuaaccuguuggauccccaccuguaacgcccuaagggcuagggcggggcugaaggugugugguugagcggggacugagagggcgaauagcuaccccgaagacucuucuguccccaaggucagacucacacucgcccaaggagagcccaguuccaagccuucccuuccgggucuggaaaggguuaagugaggugggccuuccuuccgcccccucuaccucccggcugggauuccaggccuggcuucugcccuuucccuccagccugcccagaacaaagaggcucuuucacacccuugucccggcgucccgggccuucucugacucagaagcuaguggaccuggggagagggggccuuugucgcguccccuugcccccaagcgacugggcccgaggaacccgcguggggccagcgugggggaguaaggggcgaggcccgggaccagggggaggggccugugagcuggggccgccccugggauuagcccggccuucggggacagcucggaggagcuggggcggagccgcagggccuggcggccgccgagugaagugugacuccgugggccuggcguggaggcgggggcgcuaggcugcagcuggcucggaaucggggcugguuuccugucuggaagggaaggggccugcagaagggagcggggacagcagcagacaggcacaccccugccuuccucucucccucuccucccuucucuggaaaagcgagguaauugugagcccaggguggagcgggcuggaugggggcccugaguuggaagggguggcccuagggcugggcugcuuugccaacucaccccuuugucccauucccugggcucacucuccccugagguccucaccuguguggcucuuuuucccaacuuucucaaacuaagcuggaaccccucucgggaagcuccaaccuccugcaaaccccaugacucuagaaccugcaugaggcgucguuucccugcccccuuccaguugugccugccccucacugcccucuccgcacacagauucccuguccaccaggccagggaugugggcgggggcuggggagcggccagagucggaaugaaagggccuuuuucuuccacagcugggagaacagcugccaccaaagcgagacuggacacucugugccuagagcccccucugcagcuggccuuuccuccugggaccccacuuauccucacuucgcuuucuuuuucuucccugccuggcucccggcagggccccggagcagcagugggcgaggaaaauuugucacagcagccagagggguuuaacaggagugcagagggauaagggcagcuucugcccucugcccaagagcuggccaccucuuuaaagacugagggaacagugggaggaggaacugugggacagugugguaccuaucuguccccccucuggagggguugacaagggaaagggcaccggggggcacagagaugcaggacagauugcacauccuggaggaccugaauaugcucuacauucggcagauggcacucagccuggagguaaucccccgacccuuggaguacacaccuccuucacuugcaucccagccccaaucucugcccugcccauuccugcuacagcaugguggggagagccaggccugcuuaaagugggaagagggacaggugguucccuaugccuuguguugggugcaguguguggacccaggcucaguucugcccaucauagucuuauguuugcagcagggucuuuacaccuauuucaggaagcucugugggugaguguaaaugucuguucuggggacaaggguuccuuuuaggcaugggaagaagagaggaguucaaugugagagagguuuacagaaaggauguagccuugcuagagaagagaag

SEQ ID NO: 19558 - RNA, 1965 nt, Homo sapiens
cuucucuucucuagcaaggcuacauccuuucuguaaaccucucucacauugaacuccucucuucuucccaugccuaaaaggaacccuuguccccagaacagacauuuacacucacccacagagcuuccugaaauagguguaaagacccugcugcaaacauaagacuaugaugggcagaacugagccuggguccacacacugcacccaacacaaggcauagggaaccaccugucccucuucccacuuuaagcaggccuggcucuccccaccaugcuguagcaggaaugggcagggcagagauuggggcugggaugcaagugaaggagguguguacuccaagggucgggggauuaccuccaggcugagugccaucugccgaauguagagcauauucagguccuccaggaugugcaaucuguccugcaucucugugccccccggugcccuuucccuugucaaccccuccagaggggggacagauagguaccacacugucccacaguuccuccucccacuguucccucagucuuuaaagagguggccagcucuugggcagagggcagaagcugcccuuaucccucugcacuccuguuaaaccccucuggcugcugugacaaauuuuccucgcccacugcugcuccggggcccugccgggagccaggcagggaagaaaaagaaagcgaagugaggauaaguggggucccaggaggaaaggccagcugcagagggggcucuaggcacagaguguccagucucgcuuugguggcagcuguucucccagcuguggaagaaaaaggcccuuucauuccgacucuggccgcuccccagcccccgcccacaucccuggccugguggacagggaaucugugugcggagagggcagugaggggcaggcacaacuggaagggggcagggaaacgacgccucaugcagguucuagagucaugggguuugcaggagguuggagcuucccgagagggguuccagcuuaguuugagaaaguugggaaaaagagccacacaggugaggaccucaggggagagugagcccagggaaugggacaaaggggugaguuggcaaagcagcccagcccuagggccaccccuuccaacucagggcccccauccagcccgcuccacccugggcucacaauuaccucgcuuuuccagagaagggaggagagggagagaggaaggcaggggugugccugucugcugcuguccccgcucccuucugcaggccccuucccuuccagacaggaaaccagccccgauuccgagccagcugcagccuagcgcccccgccuccacgccaggcccacggagucacacuucacucggcggccgccaggcccugcggcuccgccccagcuccuccgagcuguccccgaaggccgggcuaaucccaggggcggccccagcucacaggccccucccccuggucccgggccucgccccuuacucccccacgcuggccccacgcggguuccucgggcccagucgcuugggggcaaggggacgcgacaaaggcccccucuccccagguccacuagcuucugagucagagaaggcccgggacgccgggacaagggugugaaagagccucuuuguucugggcaggcuggagggaaagggcagaagccaggccuggaaucccagccgggagguagagggggcggaaggaaggcccaccucacuuaacccuuuccagacccggaagggaaggcuuggaacugggcucuccuugggcgagugugagucugaccuuggggacagaagagucuucgggguagcuauucgcccucucaguccccgcucaaccacacaccuucagccccgcccuagcccuuagggcguuacagguggggauccaacagguuaacgcguggacggcggacgggggaaacgcucagccuaggggcuggacuccucuuaggccccagaaaaggaggcggaaauuuugcgu

SEQ ID NO: 19559 - RNA, 2662 nt, Homo sapiens
gaggaggaguuggaagaagagcggggaggggaacggcccggaacucgugcgcgccgaacggcggcgccccaacccauaaacccaucucuugcucagagagaagcgaaggagaggcccagcgaguaaaagccgaggcccuugagccgcuccucggcgcgcgccuucugcuugaggugcaccuugcugugccguuucuucucaucgcugcgcgcgaagcggcggccgcacacgucgcaagcaaaaggcuucucgccggugugggugcgcacgugcguggugagguggucgcugcggcugaaguugcggaggcagaugcggcacuggaaggguuuguggcccguguggaugcgcagguggcgauugagcucgucggagcgcgcaaagcuccgcacacaacucuccaccgggcaagcgaaggccuuggcgugcggccgcgggcagaagcagcgcgugcugcauuugccgccgcggcgccccuugcgucgcgccuuggccugggggaaaggggugggcggcggcggcggcacggguggugcagccacgccacugcuuccagggauguccgccaccagagguuuagggaaguccgccgcggcggcgcugcgaaggcccagcggggaaagcugaggcugcguacuggccagaaacucuccgccgucgccgcuacucccucccuccccacuaggaggggucaggagcccagggaggcccucagcccccuccccuaagucacccggggccagcgggaaagcgucauaggccccgcugggauagagucuguuggcugggacggccggcaguuccgcagggcagcugauggacagcaaguccucaaucuuggucccuauuacgggaaaacgagccuccggggcggccugguagucucccugugacccacaguucccuggggcccccacagaaagcagcucccagggcgcguagggacccuugaaggcagagacagcguccagcgcuggcgaggcgggaggcgcccggaggccgggcuugacgucgggcggggagagcugaggcucauacaggcacugcgagggggcacccgcgcaaggcgaggccucccagaacgccucugggaaaggggcagcgcccagauccggggaguaaagguccggcggacccggcagcaaggcaucggaccccgcaggaaaaggggcauccagcggggaucuggacgcugcugccucuggaccggggaagggugccaggccuaagaugcccgacaugagguugaagagugccuccgggucgugcggguguucgggcacugccugaaugaagaagcuaccgcuguagcugaggccgggagggggugugggcgcaggccccuccaggaagcaggagucggcuaaguccccacuugcgccgcagcuguucaaagcccagcucaagaagucgccugcugaggagggagcaggaaucagcucugggcacaucaaagggugcaccugaguccacagccccuaccuacaaaacucuuggugcccacggauauacacaaagugccuuuugcacauucugauucagcaggggcccgcauacgucccaaggagcacauagaaacaugcacacgcaaaacacacgugcacaggcaaaagggcgcuccgauaaccgcacagguuccugcggaggcgcuggcggcccagugugggugggaaugggggugcgcaccccaggacuccuaagcuucccaucgccccuauucucauagcuccaaugucccagucccuccugguucucagguauggugcgcccccgcgcugcgccgucgucgucugagcaccccugcucgcccuccuuaccuccaggguagccgguggccgcgggagcgucccuggcaggcagccggggcaauucagcgcuggguucggcgcaacagccuucaguggacuugacgaggagcgcgucggguucggaaaacucgcuaagguggagcauggcgcggcgccggcuguggggcgcccggggccucgcccgcugggcuugggggcgcgcggguggcggggaggcuggcgguagggguuccccgcagcgcacagaccuaggcgcccgggcuccuggcuucgggcacucaccucugggaaaggagucggggagccgcggcgcccucgcucgcccgcaccggccucgggcggcggcuccucgccucuccaaagcgcugccgggcucccccagcccacagcccccccacuuauauagcugcggcggcgcuggcuccgggcuuccgacuccccgggccacugccauuuugggaggccccggcccugccgccgugacguaaaugcccaaacauggacacaggaugugugccggggacucccgaaaaggaaagcucgagcugugacguuguuguugucgccgccgccgccaggcucgcgccgcugcgugcgcgcgcgcuccccaggcguggagcgcuggggccgcggaugcgccagucuggggcgcugcgccucaccgggccgaccguccgguagaugcgcuucccaccuggaggcagaggccgaggggcagcaggggaggaccguguuggguuugaaucugcccucugccacuaacuagcuugacacucagucccccuuaacgucaguuucucaccugugcauuuccuguggagagaaacugagagcacauaaauguccaggcgcac

SEQ ID NO: 19560 - RNA, 2662 nt, Homo sapiens
gugcgccuggacauuuaugugcucucaguuucucuccacaggaaaugcacaggugagaaacugacguuaagggggacugagugucaagcuaguuaguggcagagggcagauucaaacccaacacgguccuccccugcugccccucggccucugccuccaggugggaagcgcaucuaccggacggucggcccggugaggcgcagcgccccagacuggcgcauccgcggccccagcgcuccacgccuggggagcgcgcgcgcacgcagcggcgcgagccuggcggcggcggcgacaacaacaacgucacagcucgagcuuuccuuuucgggaguccccggcacacauccuguguccauguuugggcauuuacgucacggcggcagggccggggccucccaaaauggcaguggcccggggagucggaagcccggagccagcgccgccgcagcuauauaagugggggggcugugggcugggggagcccggcagcgcuuuggagaggcgaggagccgccgcccgaggccggugcgggcgagcgagggcgccgcggcuccccgacuccuuucccagaggugagugcccgaagccaggagcccgggcgccuaggucugugcgcugcggggaaccccuaccgccagccuccccgccacccgcgcgcccccaagcccagcgggcgaggccccgggcgccccacagccggcgccgcgccaugcuccaccuuagcgaguuuuccgaacccgacgcgcuccucgucaaguccacugaaggcuguugcgccgaacccagcgcugaauugccccggcugccugccagggacgcucccgcggccaccggcuacccuggagguaaggagggcgagcaggggugcucagacgacgacggcgcagcgcgggggcgcaccauaccugagaaccaggagggacugggacauuggagcuaugagaauaggggcgaugggaagcuuaggaguccuggggugcgcacccccauucccacccacacugggccgccagcgccuccgcaggaaccugugcgguuaucggagcgcccuuuugccugugcacguguguuuugcgugugcauguuucuaugugcuccuugggacguaugcgggccccugcugaaucagaaugugcaaaaggcacuuuguguauauccgugggcaccaagaguuuuguagguaggggcuguggacucaggugcacccuuugaugugcccagagcugauuccugcucccuccucagcaggcgacuucuugagcugggcuuugaacagcugcggcgcaaguggggacuuagccgacuccugcuuccuggaggggccugcgcccacacccccucccggccucagcuacagcgguagcuucuucauucaggcagugcccgaacacccgcacgacccggaggcacucuucaaccucaugucgggcaucuuaggccuggcacccuuccccgguccagaggcagcagcguccagauccccgcuggaugccccuuuuccugcgggguccgaugccuugcugccggguccgccggaccuuuacuccccggaucugggcgcugccccuuucccagaggcguucugggaggccucgccuugcgcgggugcccccucgcagugccuguaugagccucagcucuccccgcccgacgucaagcccggccuccgggcgccucccgccucgccagcgcuggacgcugucucugccuucaagggucccuacgcgcccugggagcugcuuucugugggggccccagggaacugugggucacagggagacuaccaggccgccccggaggcucguuuucccguaauagggaccaagauugaggacuugcuguccaucagcugcccugcggaacugccggccgucccagccaacagacucuaucccagcggggccuaugacgcuuucccgcuggccccgggugacuuaggggagggggcugagggccucccugggcuccugaccccuccuaguggggagggagggaguagcggcgacggcggagaguuucuggccaguacgcagccucagcuuuccccgcugggccuucgcagcgccgccgcggcggacuucccuaaaccucugguggcggacaucccuggaagcaguggcguggcugcaccacccgugccgccgccgccgcccaccccuuucccccaggccaaggcgcgacgcaaggggcgccgcggcggcaaaugcagcacgcgcugcuucugcccgcggccgcacgccaaggccuucgcuugcccgguggagaguugugugcggagcuuugcgcgcuccgacgagcucaaucgccaccugcgcauccacacgggccacaaacccuuccagugccgcaucugccuccgcaacuucagccgcagcgaccaccucaccacgcacgugcgcacccacaccggcgagaagccuuuugcuugcgacgugugcggccgccgcuucgcgcgcagcgaugagaagaaacggcacagcaaggugcaccucaagcagaaggcgcgcgccgaggagcggcucaagggccucggcuuuuacucgcugggccucuccuucgcuucucucugagcaagagauggguuuauggguuggggcgccgccguucggcgcgcacgaguuccgggccguuccccuccccgcucuucuuccaacuccuccuc

SEQ ID NO: 19561 - RNA, 3268 nt, Homo sapiens
ucggaucccauugccaagucagcaccggcaggcacaaagguggcagggccgggagacaccacuuucccgagaguccuauccccacccccaacagggaucgggagagagcaguuagcacagggcucgucucagaugggcuucucaccagcggggugccccuaaccuagaccccuugccucuccaagccuguuucccucucuuucccaguuacuacuuggggcucuuugcacggucuaugguggcacaagaaguggguucggaaacccaguagcugaauugaagcggaggggaggcuuuuccgcaccuacggcuacagggcggcgagagcaggcuugccaggcaacccucgaaaggccuuccgggaagagggggaagagugacgcuugggugugggggcacauccccagcaaccggacgaggccgccacccccaaggcccuccugggcuucggaucccgcgccaaccccucgcccaggucucggagcgaacucuccgcgccaggcgggcggggcggagggaggagggaguugagaguggacggccgggagugggaggaaaagcgcagacgccaggaacgccccgugagugaggagaggagagcgugggagucacgcggagaagccagacccagacgccgaccgggcacugguggcgcugccggggucccggggguuccuggacccccuaccccaggccccuccaaagcaacugggguaaaccagacgcacugugaggccagcgcagcugcuggacacgguccccggcgccgcuccaaccagaccgcgaccgcuaagccccuccuuucgagaaacucuggggccgccccuggaaguggcggggcgaagggaccggaggagggaccggaggagcgaggcgcgcggcgcagcgauggagccggucagcacgggcgcggaggccggcauggagggcgcgggaggugacccguaccggcgaccugcgcggcgcacgcaguggcugcugagcgcccuggcgcaccacuacgggcuggaccgcggcguggagaacgagaucguggugcuggccaccggccuggaccaguaccugcaggaggucuuccaccaccuggacugccgcggcgccggccgucugccccgcgccgacuuccgagcgcucugcgcugugcuggggcugcgcgcggagggggccaccacggccgggcaggcagcaggugacgggaacuccagagaugugacccccggggaugcggccgcugaguuggccacggacggggacucagauaccgaugaagaggcgcgccuggcgcugcgcgccgagccgccggagcucaccuuccgccaguuccacgcgcgccucuguggcuacuucggcacccgugcggggccccggcugccccgcggcgcucucagcgagcacaucgagacgcagauccgccugcgccguccgcgccgccgccgccgcccgcccugcgcgccuggccccgacagcgguccugacugugagcgcguugcgcggcuggaggaggagaauagcagcuugcgcgaguugguggaggaccugcgcgccgcgcugcagagcagugaugcgcgcugccuagcacugcaggugcgcgccggccacgaagggagggugguaacgcccgggagagggcucgaacuaaaagcuggcuggcugcggagcccgacaggacagagucagaggaaggggagacagagggcagccccacaccaucccacuccgcaucagcacacuugcaucuugccccuguuccuccccauuccacuccaguccccaacccuauucuuaccaccuauuccauuccugaaaaccccaaucacacucaaacaaccauaccccacuuuucugcuccaccgccacaucaucgcgucuugccccuuuaaccuaggaauugcaccugucuggguagucucacauauucccuuucaacaagcaucuuucucucuccuuccugccaggcuucugggagguuuaggagacagaagugugaagaaggcccuguccucaccuuuagggauaucccugccuccugggguagacugacagcuccuucugucaaucagcaaagacuuauggggcucccugugggagaaacagagacaagugagaaacagacaauguggcucacacuguggaucaggcacucacgggccaccaagugccugcgggaaccagacccgcucugggcuauugagaagaaaccauggggugagauagggacccagccuuagcaucugggagccgucgacaaacacuuaagcacugugccagccgagcaccaagggcagugcugggccgcaggggucagaggaggaaaggaacagccccuaccccaggcgacaacaggccaggaagaaacugacauuauaugaccccgccuuagcucaggacacugcagagugcagggaaguggcaaggugugguuuucagugucagugugcauggaagccaggguggaggcgggaaacuacuccucugauguggaaucccaaguaacguacugggagccaugggaugcgccugaacggucuuccggcaucucucaugcuugguauuuauugagcaccuacuaugugccagguuuguuuuaggcucugggaacacaccaguaaagacagauagaaaccacccucaaaagccucuagugagcaggcacggggagggcuggaaaugccacuggggggagucuaggagaugaggaaccgccacccggcaggcugaacgccgccaauacaguaggccgagaagagucgcgagguugguacuauagagggaacagaauacaggcgucgugucucaguuuccuucagugaaaaaacguuggggggugggggaugaggaggaaucagagcuugggccucccuggggauguggcgaggguuaaaggagcuuggacgcaccggaccuaagggccuggcacccggaagcagacggcgcaagaaacgugcucaagcgcuucugggugcagaggcauggggccgccgucguggcgggcguucgucuggugcaucuggcuggggcacuuacccccugccccugcugcccuguccccgcaggucggacucuggaagagccaggcgagcacccacgagauggggcacggcgggccggaggcugcggugcgggagcugcgucaggcgcagggcgcccuggcugcggcggaggcccgcgcugggcggcugcgccguggccaggccgaggugcggcggcgcgcggaggaggcccggcagguggugcugcgcagccugcaccgcgugcgagagcuggaggc

SEQ ID NO: 19562 - RNA, 3268 nt, Homo sapiens
gccuccagcucucgcacgcggugcaggcugcgcagcaccaccugccgggccuccuccgcgcgccgccgcaccucggccuggccacggcgcagccgcccagcgcgggccuccgccgcagccagggcgcccugcgccugacgcagcucccgcaccgcagccuccggcccgccgugccccaucucgugggugcucgccuggcucuuccagaguccgaccugcggggacagggcagcaggggcaggggguaagugccccagccagaugcaccagacgaacgcccgccacgacggcggccccaugccucugcacccagaagcgcuugagcacguuucuugcgccgucugcuuccgggugccaggcccuuagguccggugcguccaagcuccuuuaacccucgccacauccccagggaggcccaagcucugauuccuccucaucccccaccccccaacguuuuuucacugaaggaaacugagacacgacgccuguauucuguucccucuauaguaccaaccucgcgacucuucucggccuacuguauuggcggcguucagccugccggguggcgguuccucaucuccuagacuccccccaguggcauuuccagcccuccccgugccugcucacuagaggcuuuugagggugguuucuaucugucuuuacugguguguucccagagccuaaaacaaaccuggcacauaguaggugcucaauaaauaccaagcaugagagaugccggaagaccguucaggcgcaucccauggcucccaguacguuacuugggauuccacaucagaggaguaguuucccgccuccacccuggcuuccaugcacacugacacugaaaaccacaccuugccacuucccugcacucugcaguguccugagcuaaggcggggucauauaaugucaguuucuuccuggccuguugucgccugggguaggggcuguuccuuuccuccucugaccccugcggcccagcacugcccuuggugcucggcuggcacagugcuuaaguguuugucgacggcucccagaugcuaaggcugggucccuaucucaccccaugguuucuucucaauagcccagagcgggucugguucccgcaggcacuugguggcccgugagugccugauccacagugugagccacauugucuguuucucacuugucucuguuucucccacagggagccccauaagucuuugcugauugacagaaggagcugucagucuaccccaggaggcagggauaucccuaaaggugaggacagggccuucuucacacuucugucuccuaaaccucccagaagccuggcaggaaggagagagaaagaugcuuguugaaagggaauaugugagacuacccagacaggugcaauuccuagguuaaaggggcaagacgcgaugauguggcgguggagcagaaaagugggguaugguuguuugagugugauugggguuuucaggaauggaauaggugguaagaauaggguuggggacuggaguggaauggggaggaacaggggcaagaugcaagugugcugaugcggagugggaugguguggggcugcccucugucuccccuuccucugacucuguccugucgggcuccgcagccagccagcuuuuaguucgagcccucucccgggcguuaccacccucccuucguggccggcgcgcaccugcagugcuaggcagcgcgcaucacugcucugcagcgcggcgcgcagguccuccaccaacucgcgcaagcugcuauucuccuccuccagccgcgcaacgcgcucacagucaggaccgcugucggggccaggcgcgcagggcgggcggcggcggcggcgcggacggcgcaggcggaucugcgucucgaugugcucgcugagagcgccgcggggcagccggggccccgcacgggugccgaaguagccacagaggcgcgcguggaacuggcggaaggugagcuccggcggcucggcgcgcagcgccaggcgcgccucuucaucgguaucugaguccccguccguggccaacucagcggccgcauccccgggggucacaucucuggaguucccgucaccugcugccugcccggccgugguggcccccuccgcgcgcagccccagcacagcgcagagcgcucggaagucggcgcggggcagacggccggcgccgcggcaguccaggugguggaagaccuccugcagguacugguccaggccgguggccagcaccacgaucucguucuccacgccgcgguccagcccguaguggugcgccagggcgcucagcagccacugcgugcgccgcgcaggucgccgguacgggucaccucccgcgcccuccaugccggccuccgcgcccgugcugaccggcuccaucgcugcgccgcgcgccucgcuccuccggucccuccuccggucccuucgccccgccacuuccaggggcggccccagaguuucucgaaaggaggggcuuagcggucgcggucugguuggagcggcgccggggaccguguccagcagcugcgcuggccucacagugcgucugguuuaccccaguugcuuuggaggggccugggguaggggguccaggaacccccgggaccccggcagcgccaccagugcccggucggcgucugggucuggcuucuccgcgugacucccacgcucuccucuccucacucacggggcguuccuggcgucugcgcuuuuccucccacucccggccguccacucucaacucccuccucccuccgccccgcccgccuggcgcggagaguucgcuccgagaccugggcgagggguuggcgcgggauccgaagcccaggagggccuuggggguggcggccucguccgguugcuggggaugugcccccacacccaagcgucacucuucccccucuucccggaaggccuuucgaggguugccuggcaagccugcucucgccgcccuguagccguaggugcggaaaagccuccccuccgcuucaauucagcuacuggguuuccgaacccacuucuugugccaccauagaccgugcaaagagccccaaguaguaacugggaaagagagggaaacaggcuuggagaggcaaggggucuagguuaggggcaccccgcuggugagaagcccaucugagacgagcccugugcuaacugcucucucccgaucccuguuggggguggggauaggacucucgggaaaguggugucucccggcccugccaccuuugugccugccggugcugacuuggcaaugggauccga

SEQ ID NO: 19563 - RNA, 2539 nt, Homo sapiens
gccccucucugccccucucggcuccugcuguuccgccgcugucguccgaaccaucccaacccccaguccacccagacagcgcccgagcuaggggagggaacggucuggguagguaacugcgcucggacugaccacguucagcggugaaggagcguggcgggguuagggucucggggagaggccauccagagggugugcggcccgggcuccuggggagggggcaguuggugguuaguuacugcuagggaggcccagagcaucgagggaucccggaguguucgcaagaggggcugcaggggucgggccuuggggugagggucccuuagugguggggcgcguuggcagcaggggccgccaggagcgcgcagggagggggcccgccggcugaggggggccggcccgcgggucagucccggaguccagcgguucgggaauugcggacgcagccaaugggaggcggaggcugggaggcgcgcggcguugauuggcuggcuugggcuucuuaggcgugcgcggcccccgcuucaugucugugcaggagucggcagcuggcgccagggcggccggaggaugccgaggggccggagccgggagggcccgaggccgaggcgcacucuacccccagcuccuacccuguaagccccgccagccuccggacgugcugucccugggcccgucgcccucggggcucccgccggaacuccuucacucucagaggccgagucccuccccuccccacggcugcguguguaaguuugggguuugagagccggcugggggccuggggcgcuccuagcuuugaggggacucuggggggacuuagggcggggggccaggcugcgggcgacugcuuuggugugcuuuguugagagguccugauugugccgcuuaguacugcgcucagggggcugcgugugcauguuuucgggguugagaucaguauguguaucuggcgccaagugugggugugugcgugucgcugggaucaagugccacacugggugcccgggcgccugucuccaacuuuugagucuguguucauguguuugucuaccgggcgggggggcucagugugagugucugacugaagugcugcucugugcguuuguuggggucacuggugucgggacccguccccgggcgugaccccaugugcacgggugugugauucuggagccgcgggucaccacgugagugugcguggcugaacccccucccccgccuuccuuucguuuugagccuugggcuuuccucccacccgggacuggugcucuuucucgccggaucugggcuggggcuccguggcgugcgggacaccucguggugggacuuuggggggugucaggcgcuggcggcacgccucacucccccuuccucgcgcagggccguugccgucugcacccagacccugagccgccgccgccggccauggagguggcgcccgagcagccgcgcuggauggcgcacccggccgugcugaaugcgcagcaccccgacucacaccacccgggccuggcgcacaacuacauggaacccgcgcagcugcugccuccagacgagguggacgucuucuucaaucaccucgacucgcagggcaaccccuacuaugccaaccccgcucacgcgcgggcgcgcgucuccuacagccccgcgcacggugagcacugggcccguggugaugagaacccaggcgccgcgcgccaggcgagggaggggaggagggcccgucugcuugcuucccggauguaggauccgcaggaaucgagcugcugaaaaauuggggcgggagaggugggagcagcggccgauuggggagggucugggacccacaggguuucugcccacuuccagcuggccugugaggguucccuguagggucuguccggugggguuccuucuaugccacuuguccuucagcuuggacugacauuccugauuauuaccggugggguauuauguuucuggcuuucuuuggggaggggaugacugcugguucugggagucgugaucucaaugucugucaggggcgucccuagcucugccuacccugaucuuucugcccacccugauccucucucucuuugcccgcagcccgccugaccggaggccagaugugccgcccacacuuguugcacagcccggguuugcccuggcuggacgggggcaaagcagcccucucugccgcugcggcccaccaccacaaccccuggaccgugagccccuucuccaagacgccacugcaccccucagcugcuggaggcccuggaggcccacucucuguguacccaggggcugggggugggagcgggggaggcagcgggagcucaguggccucccucaccccuacagcagcccacucuggcucccaccuuuucggcuucccacccacgccacccaaagaagugucuccugacccuagcaccacgggggcugcgucuccagccucaucuuccgcgggggguagugcagcccgaggagaggacaaggacggcgucaaguaccaggugucacugacggagagcaugaagauggaaagugg

SEQ ID NO: 19564 - RNA, 2539 nt, Homo sapiens
ccacuuuccaucuucaugcucuccgucagugacaccugguacuugacgccguccuuguccucuccucgggcugcacuaccccccgcggaagaugaggcuggagacgcagcccccguggugcuagggucaggagacacuucuuuggguggcgugggugggaagccgaaaaggugggagccagagugggcugcuguaggggugagggaggccacugagcucccgcugccucccccgcucccacccccagccccuggguacacagagagugggccuccagggccuccagcagcugaggggugcaguggcgucuuggagaaggggcucacgguccagggguugugguggugggccgcagcggcagagagggcugcuuugcccccguccagccagggcaaacccgggcugugcaacaagugugggcggcacaucuggccuccggucaggcgggcugcgggcaaagagagagaggaucagggugggcagaaagaucaggguaggcagagcuagggacgccccugacagacauugagaucacgacucccagaaccagcagucauccccuccccaaagaaagccagaaacauaauaccccaccgguaauaaucaggaaugucaguccaagcugaaggacaaguggcauagaaggaaccccaccggacagacccuacagggaacccucacaggccagcuggaagugggcagaaacccugugggucccagacccuccccaaucggccgcugcucccaccucucccgccccaauuuuucagcagcucgauuccugcggauccuacauccgggaagcaagcagacgggcccuccuccccucccucgccuggcgcgcggcgccuggguucucaucaccacgggcccagugcucaccgugcgcggggcuguaggagacgcgcgcccgcgcgugagcgggguuggcauaguagggguugcccugcgagucgaggugauugaagaagacguccaccucgucuggaggcagcagcugcgcggguuccauguaguugugcgccaggcccggguggugugagucggggugcugcgcauucagcacggccgggugcgccauccagcgcggcugcucgggcgccaccuccauggccggcggcggcggcucagggucugggugcagacggcaacggcccugcgcgaggaagggggagugaggcgugccgccagcgccugacaccccccaaagucccaccacgaggugucccgcacgccacggagccccagcccagauccggcgagaaagagcaccagucccgggugggaggaaagcccaaggcucaaaacgaaaggaaggcgggggaggggguucagccacgcacacucacguggugacccgcggcuccagaaucacacacccgugcacauggggucacgcccggggacgggucccgacaccagugaccccaacaaacgcacagagcagcacuucagucagacacucacacugagcccccccgcccgguagacaaacacaugaacacagacucaaaaguuggagacaggcgcccgggcacccaguguggcacuugaucccagcgacacgcacacacccacacuuggcgccagauacacauacugaucucaaccccgaaaacaugcacacgcagcccccugagcgcaguacuaagcggcacaaucaggaccucucaacaaagcacaccaaagcagucgcccgcagccuggccccccgcccuaaguccccccagaguccccucaaagcuaggagcgccccaggcccccagccggcucucaaaccccaaacuuacacacgcagccguggggaggggagggacucggccucugagagugaaggaguuccggcgggagccccgagggcgacgggcccagggacagcacguccggaggcuggcggggcuuacaggguaggagcuggggguagagugcgccucggccucgggcccucccggcuccggccccucggcauccuccggccgcccuggcgccagcugccgacuccugcacagacaugaagcgggggccgcgcacgccuaagaagcccaagccagccaaucaacgccgcgcgccucccagccuccgccucccauuggcugcguccgcaauucccgaaccgcuggacuccgggacugacccgcgggccggccccccucagccggcgggcccccucccugcgcgcuccuggcggccccugcugccaacgcgccccaccacuaagggacccucaccccaaggcccgaccccugcagccccucuugcgaacacuccgggaucccucgaugcucugggccucccuagcaguaacuaaccaccaacugcccccuccccaggagcccgggccgcacacccucuggauggccucuccccgagacccuaaccccgccacgcuccuucaccgcugaacguggucaguccgagcgcaguuaccuacccagaccguucccuccccuagcucgggcgcugucuggguggacuggggguugggaugguucggacgacagcggcggaacagcaggagccgagaggggcagagaggggc

SEQ ID NO: 19565 - RNA, 2794 nt, Homo sapiens
ggagagagaccccgcggucugcgugcaggagccccagcccaggggcuccucuccuggacaggaggggaucgccgccugguggaacgccaagccaacaguguccccuucccuuuccuggccugagugacaccaaagcuccuucucacccugagaaacaaaggcccccaaagcccuccccacaaggaagaguccaauccccccaaguccuccugcgccagauccugcuauggcucaggcagguugggguguggggcugccauccugcccaguggcucacaacagcagccgggggggaagacagcugcuccuggcacuccgccucccccacaacgggggucaugggagguggucccagugguucugcucccgaccaguccuaggggauccggcucugaaggccuuggaguccugcuccugagaaaaagugccuaccuuugcaggccuuccccuggggcacccgcuccucccggccagcugcucuaagcugcucugugcacgggggcuuuccugggggcucaaaacaggcaggcaacgaccuuggggggccaggaguccagcaaagggcugucugcuuuguccacaggcaccucaugugucccccacccccagagcacacacugaggccacaaacccaggccuccgcccaugcuguccucugcccaaaacgcccuuccugggccccacuggcaccccccaggaauggaagccuggcccugcagcgaaucacugguucacaugccugccucuggcagggggcugggugcuccucaagggccgggcagcaucuuggugccccuggugcagcaccuggccucugccgcacaccccaagccgcaggaaaucgaggggaccugaggcaagcuccucaagggcccggggagcagaaacugcgccccaucccugcaccgacccccaaaccggcuacgugugaaaggagauggggcagcacggagcagccugagccacaggagccgcgcugaggggacagaggcucgaccacguccccuccccggcacacacaccccuuucuuucaaggggcguggccccagaaccccacacaggagccuggggcagaucgccgcccggggccgccccucggagccccuccccuccuuuccagggcugcaccugggaccucacgccgaccgaggggccucccuggaguccccacucccccuuccccuggcagcccgggaucggcccgcugccuccagcuucgccgcacaucaggcccgggacuauccaggaagcaaucggaagccuccgggagaagcggcugacccuggagaggccccgagagggggaggccaaggaggcccgagcggggcggccuccugggcggcacccagagcccaccuccccgcacuccgggccagugggagcgguggcagcuguggucgggaagccgcuccaacuuccaccccgcgccccagggccggccgggggcuuagccugcacgaccuccuccggcccccgcggcccugcugggaggcuccgaucccuauccgggccuggccaccccguccucgcccgcggccagaggucugagccgagguccagcggccgggacgggccuggacaccgcaggggccuccccgcggggccgccgcaaacuuucuccccagccuccguggaggggcagcgcccgccccccgccaccccggagcugccgcggggcucggcgggcccggccggggggcgggggaggccgcggcgcuggaucccgggccgcggucccagccccgccgcacgggggugcggucucuccgcgucggcgccgcgaccgcgcccggacacacgcggacgccugggccggagccgcagggacacgcgggccgcggacacgcgcgccgcaguccccacgcgcgccgcaguccccgcgcacacccccugccugccgccucacgagagggccgccgccggaggccgccccgcgcccacccacgggccgcccggccccggaccccagcccggcccggcccccgcccaccgucccgcgccgcggggaaaguugcgccccgacucacccgccgccccggggcgcgccccgccgccggccaucgccgcgcccagccgcccgcgccgccgccgccguccgccccgccgcggggccgccgaagccgcguaggccgcccaggccgaggccgccgccgcgcccgggcuccgcugcguggccgcgcagccgaugcccagcaugaauggggcgccgagcgccgcgcggcugcggaccggccucgcucucgccgcccgcggagccccgcgccgcgcgcaugcgccgcccagagcccgggggcggggcgggggcggggccggcggcggccuccagagggcgcucugccccgcgccgcgcgccugcaggggcccaccgcgcgucuucaaagggcgauacggcugcccgccucaacucucugggcgccggggccgcgcgggcaguuccgggagccccccgcucucgagcgggcuagcccgcgaccccaggaacagggccuggcucagugugcccaggcuaggagcauggccuccuuucacggggggggaaacugaggcugaaggaggcaaucgcaguucccagaccuugcggggccggguguucccagcucucggccucgcgcguuccgcucugucagaugggcgggcaccugcgcggggagcccgggcgcccccugcaggccccaggcugguggcgcauucccggcuggggacgcagcccagggaggaaagucccgcggcagaggcguggcgagacgcgaacuccggcuguagcguggggcagcggaucuacacggugugagg

SEQ ID NO: 19566 - RNA, 2794 nt, Homo sapiens
ccucacaccguguagauccgcugccccacgcuacagccggaguucgcgucucgccacgccucugccgcgggacuuuccucccugggcugcguccccagccgggaaugcgccaccagccuggggccugcagggggcgcccgggcuccccgcgcaggugcccgcccaucugacagagcggaacgcgcgaggccgagagcugggaacacccggccccgcaaggucugggaacugcgauugccuccuucagccucaguuuccccccccgugaaaggaggccaugcuccuagccugggcacacugagccaggcccuguuccuggggucgcgggcuagcccgcucgagagcggggggcucccggaacugcccgcgcggccccggcgcccagagaguugaggcgggcagccguaucgcccuuugaagacgcgcggugggccccugcaggcgcgcggcgcggggcagagcgcccucuggaggccgccgccggccccgcccccgccccgcccccgggcucugggcggcgcaugcgcgcggcgcggggcuccgcgggcggcgagagcgaggccgguccgcagccgcgcggcgcucggcgccccauucaugcugggcaucggcugcgcggccacgcagcggagcccgggcgcggcggcggccucggccugggcggccuacgcggcuucggcggccccgcggcggggcggacggcggcggcggcgcgggcggcugggcgcggcgauggccggcggcggggcgcgccccggggcggcgggugagucggggcgcaacuuuccccgcggcgcgggacggugggcgggggccgggccgggcugggguccggggccgggcggcccgugggugggcgcggggcggccuccggcggcggcccucucgugaggcggcaggcagggggugugcgcggggacugcggcgcgcguggggacugcggcgcgcguguccgcggcccgcgugucccugcggcuccggcccaggcguccgcguguguccgggcgcggucgcggcgccgacgcggagagaccgcacccccgugcggcggggcugggaccgcggcccgggauccagcgccgcggccucccccgccccccggccgggcccgccgagccccgcggcagcuccgggguggcggggggcgggcgcugccccuccacggaggcuggggagaaaguuugcggcggccccgcggggaggccccugcgguguccaggcccgucccggccgcuggaccucggcucagaccucuggccgcgggcgaggacgggguggccaggcccggauagggaucggagccucccagcagggccgcgggggccggaggaggucgugcaggcuaagcccccggccggcccuggggcgcgggguggaaguuggagcggcuucccgaccacagcugccaccgcucccacuggcccggagugcggggaggugggcucugggugccgcccaggaggccgccccgcucgggccuccuuggccucccccucucggggccucuccagggucagccgcuucucccggaggcuuccgauugcuuccuggauagucccgggccugaugugcggcgaagcuggaggcagcgggccgaucccgggcugccaggggaagggggaguggggacuccagggaggccccucggucggcgugaggucccaggugcagcccuggaaaggaggggaggggcuccgaggggcggccccgggcggcgaucugccccaggcuccugugugggguucuggggccacgccccuugaaagaaaggggugugugugccggggaggggacguggucgagccucuguccccucagcgcggcuccuguggcucaggcugcuccgugcugccccaucuccuuucacacguagccgguuugggggucggugcagggauggggcgcaguuucugcuccccgggcccuugaggagcuugccucagguccccucgauuuccugcggcuuggggugugcggcagaggccaggugcugcaccaggggcaccaagaugcugcccggcccuugaggagcacccagcccccugccagaggcaggcaugugaaccagugauucgcugcagggccaggcuuccauuccuggggggugccaguggggcccaggaagggcguuuugggcagaggacagcaugggcggaggccuggguuuguggccucagugugugcucugggggugggggacacaugaggugccuguggacaaagcagacagcccuuugcuggacuccuggccccccaaggucguugccugccuguuuugagcccccaggaaagcccccgugcacagagcagcuuagagcagcuggccgggaggagcgggugccccaggggaaggccugcaaagguaggcacuuuuucucaggagcaggacuccaaggccuucagagccggauccccuaggacuggucgggagcagaaccacugggaccaccucccaugacccccguugugggggaggcggagugccaggagcagcugucuucccccccggcugcuguugugagccacugggcaggauggcagccccacaccccaaccugccugagccauagcaggaucuggcgcaggaggacuuggggggauuggacucuuccuuguggggagggcuuugggggccuuuguuucucagggugagaaggagcuuuggugucacucaggccaggaaagggaaggggacacuguuggcuuggcguuccaccaggcggcgauccccuccuguccaggagaggagccccugggcuggggcuccugcacgcagaccgcggggucucucucc

SEQ ID NO: 19567 - RNA, 2817 nt, Homo sapiens
gccucugggcaguuuuguagccgggccccucaggcccucacaaugugcccaaggcugcugggcccaucuuccaggggugaucacugaggcucaggcuggcugagguggccggaccccaaccccuggcccugcccugugggcagcagugccaggucuggcacucagagguuaggccgggcgcagggagggugcgggcuccgcagcgagcgcgccgggcggccucuaggagccgggucagcgagucugggcucugagcgagcggcgccggcccggcccccucuccggcgggcggccgagaccccgccccggaggcggaggcggagucaggggagggggccgggggccggcuggucccgccucucgcgccuccgccccgccccgcgcgcacacagccaggggccgcccgggcucucgacgcgccgacggccgggcggacggacggacggacgccgagcgcagugccccgcggugagugcacgcggccccucccgcccggacucauccccgucgguccgcgccucgcagcucaggacucgggggcgcucggacgcaccgacggcucggcggacccucggacgcgccucgcgggcugcccgcgccuccacccgcgccgccgguccgaccgggucucgcucucccggucccagcgcggggacggcccgcgagcgccgcgacccaguguacagaugcgggcacagaggccggcgcggggugggggccagggguccgcgggcggguucccccaccccagguccgcagcuuccuccgcucuggguuucacuucuccccccugggccggcucccaccagucauccccucuggucccacugcccacccccaccccgaccgcaggaccuugccgccccuccaguccagagggccgggucaacccccucggggaaagaagacuagagucccuggucuaacacuacccccuccaucacccccaagucacacucaccgccacacacgcacucacacaagcagaaguuucugcacgcucugcauuggcgcgcccacccugccugucaccacauccucccucucccagccccaugcucaccccgccagcucccccaggccagaaucucucacacucaucucacguccccuuagcacacaaugcuccacacacacaugccuugcacauuggcaccccuccgaggcaugccucuagcagacaguugugucucugauaaacacaugugcccuuacugcccucugacacgcacacacguccgccacacagggguagcuaucacaugcauaucuccaucauauguaucacacaugugucucucacaugcgugugcuccucaaauaccuggaaucacaaacacugggagugccacacacugugagucucacauacgagucacagacccccacgacuucacagucccagccccccuggcacuccaugggcaguccuccccuguccuaggggguggggagccgauuuuggaggagggaggugguuccuccugacagaggcugcuuaccaugggaccuggguggcuguggggagcauggggguggcucagccucaggcugggccugacuccucaccuccgugcauccucucucccuuccccugcuccagucuccgaaauaggggugcccucccucccuuuuuugcugccacaaggaguugcccauaucagcuuugcagugaucacuugggccagucccaagcaggccugagccagcaggcguccccugacaggccaaaaagagaaaaagggaagucaaacaggaugguuugggugcuugugucuacccugaugccccugagaugcugguccgggcccucccagagggagcccugaugaauuggguggcagcugagaaguguucccucagccuggcauggauugggagcugguguguguuuguggcugauaggggcucugggccuuaacuuccccauaugccaaauggggugaagacuccccagcaggaggaagagagggagggggagcuacuccccuggggugcacccuugacuucccgcccuccccuucugcagcugagcugugugaugggggugagcaggggaugaagucaaagaaucuuauucuggaggcacaaaccugccagccccggcuguggcuggcccugcauguuuuguuuggcucucaccauguuauuauuauuuuaaaaaauuaauuagcugccugcauuuacaaauuggcaguuuucacguaaaaguccggauuuccgucuucucuugaaaagucacaaggucugguaguucaggaucugcaucuccuggcuggugcugcccacccccaacccaggggauggggcaggggcgcuguuugguccccguccccaccuggcccucucaugccuucucagcuccugccuggccugcguggccuuugugcggcugugacugcugcaugcauugggcugauuuugcuccauugcccgccucaagcauaggcccaggcugguccuccaugcauggcuggggaagcccugggcgggccuccuacccuucgaggccuuagucguugaagcaaugaguggugcccagggcccugggccacagggcaucuuugugaugguggcagacacuuccugcuaggcugugggggacggugguauggggaccccgugaagcaagagcucaugccagagagcauucuccgaggcaggcuuuauucaucacuuuucuucccagaucccgacaucccuccugcaggguggaacucuugcaccuauuuaagagacggggaaggggagguagagaaagggccucccagcaggcaagggggagagcugggguucagcccaggaucuuuucccucc

SEQ ID NO: 19568 - RNA, 2817 nt, Homo sapiens
ggagggaaaagauccugggcugaaccccagcucucccccuugccugcugggaggcccuuucucuaccuccccuuccccgucucuuaaauaggugcaagaguuccacccugcaggagggaugucgggaucugggaagaaaagugaugaauaaagccugccucggagaaugcucucuggcaugagcucuugcuucacgggguccccauaccaccgucccccacagccuagcaggaagugucugccaccaucacaaagaugcccuguggcccagggcccugggcaccacucauugcuucaacgacuaaggccucgaaggguaggaggcccgcccagggcuuccccagccaugcauggaggaccagccugggccuaugcuugaggcgggcaauggagcaaaaucagcccaaugcaugcagcagucacagccgcacaaaggccacgcaggccaggcaggagcugagaaggcaugagagggccagguggggacggggaccaaacagcgccccugccccauccccuggguugggggugggcagcaccagccaggagaugcagauccugaacuaccagaccuugugacuuuucaagagaagacggaaauccggacuuuuacgugaaaacugccaauuuguaaaugcaggcagcuaauuaauuuuuuaaaauaauaauaacauggugagagccaaacaaaacaugcagggccagccacagccggggcuggcagguuugugccuccagaauaagauucuuugacuucauccccugcucacccccaucacacagcucagcugcagaaggggagggcgggaagucaagggugcaccccaggggaguagcucccccucccucucuuccuccugcuggggagucuucaccccauuuggcauauggggaaguuaaggcccagagccccuaucagccacaaacacacaccagcucccaauccaugccaggcugagggaacacuucucagcugccacccaauucaucagggcucccucugggagggcccggaccagcaucucaggggcaucaggguagacacaagcacccaaaccauccuguuugacuucccuuuuucucuuuuuggccugucaggggacgccugcuggcucaggccugcuugggacuggcccaagugaucacugcaaagcugauaugggcaacuccuuguggcagcaaaaaagggagggagggcaccccuauuucggagacuggagcaggggaagggagagaggaugcacggaggugaggagucaggcccagccugaggcugagccacccccaugcuccccacagccacccaggucccaugguaagcagccucugucaggaggaaccaccucccuccuccaaaaucggcuccccacccccuaggacaggggaggacugcccauggagugccaggggggcugggacugugaagucgugggggucugugacucguaugugagacucacaguguguggcacucccaguguuugugauuccagguauuugaggagcacacgcaugugagagacacaugugugauacauaugauggagauaugcaugugauagcuaccccuguguggcggacgugugugcgugucagagggcaguaagggcacauguguuuaucagagacacaacugucugcuagaggcaugccucggaggggugccaaugugcaaggcauguguguguggagcauugugugcuaaggggacgugagaugagugugagagauucuggccugggggagcuggcggggugagcauggggcugggagagggaggauguggugacaggcagggugggcgcgccaaugcagagcgugcagaaacuucugcuugugugagugcguguguggcggugagugugacuugggggugauggaggggguaguguuagaccagggacucuagucuucuuuccccgaggggguugacccggcccucuggacuggaggggcggcaagguccugcggucggggugggggugggcagugggaccagaggggaugacuggugggagccggcccaggggggagaagugaaacccagagcggaggaagcugcggaccuggggugggggaacccgcccgcggaccccuggcccccaccccgcgccggccucugugcccgcaucuguacacugggucgcggcgcucgcgggccguccccgcgcugggaccgggagagcgagacccggucggaccggcggcgcggguggaggcgcgggcagcccgcgaggcgcguccgaggguccgccgagccgucggugcguccgagcgcccccgaguccugagcugcgaggcgcggaccgacggggaugaguccgggcgggaggggccgcgugcacucaccgcggggcacugcgcucggcguccguccguccguccgcccggccgucggcgcgucgagagcccgggcggccccuggcugugugcgcgcggggcggggcggaggcgcgagaggcgggaccagccggcccccggcccccuccccugacuccgccuccgccuccggggcggggucucggccgcccgccggagagggggccgggccggcgccgcucgcucagagcccagacucgcugacccggcuccuagaggccgcccggcgcgcucgcugcggagcccgcacccucccugcgcccggccuaaccucugagugccagaccuggcacugcugcccacagggcagggccagggguugggguccggccaccucagccagccugagccucagugaucaccccuggaagaugggcccagcagccuugggcacauugugagggccugaggggcccggcuacaaaacugcccagaggc

SEQ ID NO: 19569 - RNA, 2632 nt, Homo sapiens
acacaggccacauuuucuucgaucaagccacaggugcugguuacaacuugugacaccaguuuucucuuuuuaaaacagccauagucaugccuaagguuacugcugugccuuuccuauguucuaggaaaaauguccaauuauucaaccgaaaugcggacuauuuaagcuaggccuuuucuggaaagguacuaaugguucuacagagaugcuaauuacccauaacugaacgggauuugacucaugcaccagauuuguuagaaguaaaagaagacuauucuauucuaccauguuuacacagaagucuaaugccuuuuuuuuccugucaaaucuccuguaagaagugucccacuaaguccuaauaagcccacauccugacagcacagaaaagaaccucuuucgggugaaacaaacagcuuaaaucagccaagccccuggcacccucuccugaagcagcacuucuccaaaacucauuugcaccauuuauggaggagagagucuugagggugggccccaccccacuggaucaucaagcccaauggggccccagggaacacacaggaagggucuggaacacaguuccguaaaaugccaaacaggcguaaaaggacaaacucccagcacucacaggucgccaggaacugucaaagcccucuaacucagggguccucgggggaagacugccuucugccccgcacagagaggcaagucaggccaccacggucuucggggaucaggagacggcuacacacacuaucaacuaauaaauaauguaaacgaaagacuggacccaacagucaccuucauucauuacccacuggaagaccaaggagcucagacaccaaauaguuggauuacaggagaggaaaaggaaacgcacccacauacccccacagacuucuucacacucuucuccagacguuucccacccacccacccgcaaacacacucagcuccagacucccacucacucacccccagauggcccgcacgacgcgugcuggcuaacccccaaaucucuacgacccacgcucgcucgucuccagaccccacgaggcacgcucuucuucuccaggcucucucgcacgccuacucccccggaccuccacgcagaaucucccuuccgccacuccaaccugacagucuuccaacacgcacaagcacgcacaacuccacacacacaacccaguccgcacccccucccugaguacgaacccccgccgcuccauccccaagugacagagccccggggcgcagagagggcggaaagggcggcacucacaggcuccgcguccaggagggcagguccccgggcaacgcagccagcccgcgcccaccgcaguccagcgaguccccagcgcaagugcaggcggccgcgcagggcgcccgcgggccggccgcggcggucaccggcuccagccgaagcaaaagcagccagagaaggagaaggcaaggcgagcggcgcggggccccgagcccuccccggaccggccgcgccaucuugucuggagcgcgcugcgaacuccgggcgcggggacugugaggacccgaacggccgcagacgcgggcgggcccgcggggcgcuccgcucggcucuagacuccgcaccggggcauggcccccgccccaaguucucucugcggccgcggcuccggcacucagcgugcccccggugcccgggccgcuccggagcacccggcgggggccgcaaaccccgcgcccauccgggccggccggcccgcccgcgcuagcugcgaacuccgccgauucgggcaagguguacccagccugcgcucuucguccgcccggggcacgccgagugccgcuaccgacaccggccgagggcagugcugccgcugcgccuggaagacaggcguucagccccgcagcccgagcucggugccggcaggcaucuuccucugggcucggagcgcaaagccguagaccucgggcuggacggcgcggccggccccgcgcugggaggccccagugcgccucgcuguccccacgccgcggccagagagcgcgcgcgcgcgcgcagccucggguuccgcacggcuccuccgcgcagcaagagucccgccgaccucgcagccgaacaaucagccgcuugcuguucgccuccccgcggcccagccccggccggucccccaagccccgcccccggccgcucgcccgcacacacccccuaggcuccgcgcuccgcggccgccugcuggcccacguuggaugcuuugcaacagcgccccgccacgccuccccgccugcugcucauuggcugccggaguccaccguggccagccucgagggccauuggagcgcucgcugugaucccgccccucccgcuucaccggcuaccccgcccccacacucuuuucccacccaaggugugaagggcgggagacugggaggagaaagggagggacggcccccgccucuuaaaggagacacgcagguuguuguuggagaacgggaacgcgggcuggggaaaggaggcgugaagauacgcccucugcgucaagaaggggagagaaaguuaagaggguaaaacgcccccguuuuggggcugucuggccccaaggcuuuuuacguccuccucaggcugcaagcaggacugcagauuagaagcaaaccc

SEQ ID NO: 19570 - RNA, 2632 nt, Homo sapiens
ggguuugcuucuaaucugcaguccugcuugcagccugaggaggacguaaaaagccuuggggccagacagccccaaaacgggggcguuuuacccucuuaacuuucucuccccuucuugacgcagagggcguaucuucacgccuccuuuccccagcccgcguucccguucuccaacaacaaccugcgugucuccuuuaagaggcgggggccgucccucccuuucuccucccagucucccgcccuucacaccuugggugggaaaagagugugggggcgggguagccggugaagcgggaggggcgggaucacagcgagcgcuccaauggcccucgaggcuggccacgguggacuccggcagccaaugagcagcaggcggggaggcguggcggggcgcuguugcaaagcauccaacgugggccagcaggcggccgcggagcgcggagccuagggggugugugcgggcgagcggccgggggcggggcuugggggaccggccggggcugggccgcggggaggcgaacagcaagcggcugauuguucggcugcgaggucggcgggacucuugcugcgcggaggagccgugcggaacccgaggcugcgcgcgcgcgcgcgcucucuggccgcggcguggggacagcgaggcgcacuggggccucccagcgcggggccggccgcgccguccagcccgaggucuacggcuuugcgcuccgagcccagaggaagaugccugccggcaccgagcucgggcugcggggcugaacgccugucuuccaggcgcagcggcagcacugcccucggccggugucgguagcggcacucggcgugccccgggcggacgaagagcgcaggcuggguacaccuugcccgaaucggcggaguucgcagcuagcgcgggcgggccggccggcccggaugggcgcgggguuugcggcccccgccgggugcuccggagcggcccgggcaccgggggcacgcugagugccggagccgcggccgcagagagaacuuggggcgggggccaugccccggugcggagucuagagccgagcggagcgccccgcgggcccgcccgcgucugcggccguucggguccucacaguccccgcgcccggaguucgcagcgcgcuccagacaagauggcgcggccgguccggggagggcucggggccccgcgccgcucgccuugccuucuccuucucuggcugcuuuugcuucggcuggagccggugaccgccgcggccggcccgcgggcgcccugcgcggccgccugcacuugcgcuggggacucgcuggacugcggugggcgcgggcuggcugcguugcccggggaccugcccuccuggacgcggagccugugagugccgcccuuuccgcccucucugcgccccggggcucugucacuuggggauggagcggcggggguucguacucagggagggggugcggacuggguuguguguguggaguugugcgugcuugugcguguuggaagacugucagguuggaguggcggaagggagauucugcguggagguccgggggaguaggcgugcgagagagccuggagaagaagagcgugccucguggggucuggagacgagcgagcgugggucguagagauuuggggguuagccagcacgcgucgugcgggccaucugggggugagugagugggagucuggagcugaguguguuugcgggugggugggugggaaacgucuggagaagagugugaagaagucuguggggguaugugggugcguuuccuuuuccucuccuguaauccaacuauuuggugucugagcuccuuggucuuccaguggguaaugaaugaaggugacuguuggguccagucuuucguuuacauuauuuauuaguugauaguguguguagccgucuccugauccccgaagaccgugguggccugacuugccucucugugcggggcagaaggcagucuucccccgaggaccccugaguuagagggcuuugacaguuccuggcgaccugugagugcugggaguuuguccuuuuacgccuguuuggcauuuuacggaacuguguuccagacccuuccuguguguucccuggggccccauugggcuugaugauccagugggguggggcccacccucaagacucucuccuccauaaauggugcaaaugaguuuuggagaagugcugcuucaggagagggugccaggggcuuggcugauuuaagcuguuuguuucacccgaaagagguucuuuucugugcugucaggaugugggcuuauuaggacuuagugggacacuucuuacaggagauuugacaggaaaaaaaaggcauuagacuucuguguaaacaugguagaauagaauagucuucuuuuacuucuaacaaaucuggugcaugagucaaaucccguucaguuauggguaauuagcaucucuguagaaccauuaguaccuuuccagaaaaggccuagcuuaaauaguccgcauuucgguugaauaauuggacauuuuuccuagaacauaggaaaggcacagcaguaaccuuaggcaugacuauggcuguuuuaaaaagagaaaacuggugucacaaguuguaaccagcaccuguggcuugaucgaagaaaauguggccugugu

SEQ ID NO: 19571 - RNA, 2772 nt, Homo sapiens
gugggcuuggaguccgagccacgcugacugcaaagacgggucucauucccgcagaucgagcucugccggcggcugcgccgcaagccgggcagguggcgagcuugagcccccacgcacagaaagcaggacccccucggcugccuugggccgccaccgccagcaggcccuccgcccgggacuaacuuguuugcuuuucauugguucucauucaguucccgccaucgaaaggccccgucccgcagcuuuccacgcgcgccccacuuuacgccuaagguccucagucucuccaguggggcccugucacagggacaauaagcggcccuccagccggcgucgcucaggcugcggaccucacugcagaccgggccagcggugcggggcccagcggagccugagaaggucaaaggccggagcgcacugcgccucgggagcacagagggagcggaggaggggcgaaggggauggguggggggugccgccgagggagucgcgcgucagagaccccggccacggccagcacucggcuccgggcccgccccucaccgcgcgccccgccccgccccgccuggcucuccccucuaaagcgcccggcgcgcgccucccaccgccgcacuuucacucuccgucagccgcauugcccgcucggcguccggcccccgacccgcgcucguccgcccgcccgcccgcccgcccgcgccaugaacgccaaggucguggucgugcugguccucgugcugaccgcgcucugccucagcgacgguaagugcgcucggcggggaggcccuggcgaggcucugggcuucggcucccgcccggcgcagagccgcggcuccucugccugcgcccgcaguuugcgccgcccgacacaguggggguggaggcagcucgcuuagcugggcgcucuggugcggugucgcguucaaagcccuacuuuugcgccgaggguuugugaccugcagagagcgaccgccugaccucaagcuggcugcagagcgaggucagccgggacaacugggcaggaacgccccaagagagcguucgggacuggcgcgggaaggcgcgaggguggggagccgcggaccccagaccccugccugcccacccuccacccacugccuucccgcugcgggcucgguuuccacaggcgaaugggcuccgagguccugcugcgcacagugcuggaggucgggcggugcauggcgagagcgcgcuuugcaaaguucgccucaugccgcgacuugaggcugugagguccgaugcagccgcgcagccuccgcucccugcgaagccgauccucuccccacacccucgcggggcucuuggccaggcgcgggcgggcugcgcggcgcagcugucgggcuugugccacccgccaggccgcgcuucugcacagcuccgcgguccgcagcgacgcggaccugggcgcgcguccagccgcugucuuccugucucuucucggguucaccugagagaggcccagggacccuccgagccucacacgcccccuccccagcuccccaaacacaccugcagacaggcucuuuugucaccagcuggccaagcgcuuugccccagaaugagagcugcagcaaaguucaaucuccaaggcccugggccacugggaaccguggugucccguuucacugggagagggcuuuuuucuuuucuuucgcugaagagaaacucgcugcgcugucacaggacaccgaugcaaaccaaaauaaacuguugccucugaacacacaaaacaaaacccuguggcucaggccgcugagcuuccuuggcugugaaguuuccugcaaagaguugaaggacacucugagugcucuugcagccgcgggcugugcaggcccagcgcgccucgagcccuuggcuggguuggugcagacguggccccggcguccuagcuggcuuggacugugcgcuggugugagcaggaccagcgcagcugagucgggcuggagaagcugggcagccuggggucguggcggacugccuaaguguuaaggacacagacugaaggcaauugggaauguucgucguugaugaaaagucccugaggcugugucugcacacugacccccccccccccccgcaagucauggggcauguuucuaguuuuuauugcuggauauucuucuguuccuguaaggucucugguuugggcaguuauugacugauuggugggaugagcgcggaggugucacagugcgccgcucugggaaauggugcugcccccuccccggagggcuggagagaggauuggaaugaggaaccucggucuuugaguuaugggugcaacugaccugggggaagcacagagacgugggguucaucccagacuccuccuggccugggaagggugacauggcccucagaguugccccauuggcagccaaguaaccagggcaggagccugggcuccaggcagaucugcuccuuacacacaucgccagaauguuuuguuuuguuuuguuuuccccucaccucacagugccuaugugcccccuauccccacacuuaguccucaagcugcacuacagagagagcuuggccagggguccugccccucccccauuggcugacuuccgucaggcagcugggcccuuggguuucccgggcuuaaacucagggugggcccccuucccaagccugcuuggaggggccagcugggcuccugucucugcauuagacuggagggcuuucugaaaacuccuggagccaagcucacccggucccaaauccgggguaccaucagagccagucaggacu

SEQ ID NO: 19572 - RNA, 2772 nt, Homo sapiens
aguccugacuggcucugaugguaccccggauuugggaccgggugagcuuggcuccaggaguuuucagaaagcccuccagucuaaugcagagacaggagcccagcuggccccuccaagcaggcuugggaagggggcccacccugaguuuaagcccgggaaacccaagggcccagcugccugacggaagucagccaaugggggaggggcaggaccccuggccaagcucucucuguagugcagcuugaggacuaaguguggggauagggggcacauaggcacugugaggugaggggaaaacaaaacaaaacaaaacauucuggcgauguguguaaggagcagaucugccuggagcccaggcuccugcccugguuacuuggcugccaauggggcaacucugagggccaugucacccuucccaggccaggaggagucugggaugaaccccacgucucugugcuucccccaggucaguugcacccauaacucaaagaccgagguuccucauuccaauccucucuccagcccuccggggagggggcagcaccauuucccagagcggcgcacugugacaccuccgcgcucaucccaccaaucagucaauaacugcccaaaccagagaccuuacaggaacagaagaauauccagcaauaaaaacuagaaacaugccccaugacuugcgggggggggggggggucagugugcagacacagccucagggacuuuucaucaacgacgaacauucccaauugccuucagucuguguccuuaacacuuaggcaguccgccacgaccccaggcugcccagcuucuccagcccgacucagcugcgcugguccugcucacaccagcgcacaguccaagccagcuaggacgccggggccacgucugcaccaacccagccaagggcucgaggcgcgcugggccugcacagcccgcggcugcaagagcacucagaguguccuucaacucuuugcaggaaacuucacagccaaggaagcucagcggccugagccacaggguuuuguuuuguguguucagaggcaacaguuuauuuugguuugcaucgguguccugugacagcgcagcgaguuucucuucagcgaaagaaaagaaaaaagcccucucccagugaaacgggacaccacgguucccaguggcccagggccuuggagauugaacuuugcugcagcucucauucuggggcaaagcgcuuggccagcuggugacaaaagagccugucugcagguguguuuggggagcuggggagggggcgugugaggcucggagggucccugggccucucucaggugaacccgagaagagacaggaagacagcggcuggacgcgcgcccagguccgcgucgcugcggaccgcggagcugugcagaagcgcggccuggcggguggcacaagcccgacagcugcgccgcgcagcccgcccgcgccuggccaagagccccgcgaggguguggggagaggaucggcuucgcagggagcggaggcugcgcggcugcaucggaccucacagccucaagucgcggcaugaggcgaacuuugcaaagcgcgcucucgccaugcaccgcccgaccuccagcacugugcgcagcaggaccucggagcccauucgccuguggaaaccgagcccgcagcgggaaggcaguggguggagggugggcaggcaggggucugggguccgcggcuccccacccucgcgccuucccgcgccagucccgaacgcucucuuggggcguuccugcccaguugucccggcugaccucgcucugcagccagcuugaggucaggcggucgcucucugcaggucacaaacccucggcgcaaaaguagggcuuugaacgcgacaccgcaccagagcgcccagcuaagcgagcugccuccacccccacugugucgggcggcgcaaacugcgggcgcaggcagaggagccgcggcucugcgccgggcgggagccgaagcccagagccucgccagggccuccccgccgagcgcacuuaccgucgcugaggcagagcgcggucagcacgaggaccagcacgaccacgaccuuggcguucauggcgcgggcgggcgggcgggcgggcggacgagcgcgggucgggggccggacgccgagcgggcaaugcggcugacggagagugaaagugcggcggugggaggcgcgcgccgggcgcuuuagaggggagagccaggcggggcggggcggggcgcgcggugaggggcgggcccggagccgagugcuggccguggccggggucucugacgcgcgacucccucggcggcaccccccacccauccccuucgccccuccuccgcucccucugugcucccgaggcgcagugcgcuccggccuuugaccuucucaggcuccgcugggccccgcaccgcuggcccggucugcagugagguccgcagccugagcgacgccggcuggagggccgcuuauugucccugugacagggccccacuggagagacugaggaccuuaggcguaaaguggggcgcgcguggaaagcugcgggacggggccuuucgauggcgggaacugaaugagaaccaaugaaaagcaaacaaguuagucccgggcggagggccugcuggcgguggcggcccaaggcagccgaggggguccugcuuucugugcgugggggcucaagcucgccaccugcccggcuugcggcgcagccgccggcagagcucgaucugcgggaaugagacccgucuuugcagucagcguggcucggacuccaagcccac

SEQ ID NO: 19573 - RNA, 2026 nt, Homo sapiens
gucccagacuaaacuccuccccucggcccggcccgccccugggcccgggcuggaagccggaagcgagcaaaguggagccgacucgaacuccaccgcggaaaagaaagccucagaacguucguucgcugcguccccagccggggccgagcccuccgcgacgccagccgggccaugggggccgcacgcagcccgccguccgcugucccggggccccugcuggggcugcuccugcugcuccugggcgugcuggccccggguggcgccucccugcgacuccuggaccaccgggcgcuggucugcucccagccggugagacucgacguggggagcgguagccgccaggaugcugcggacgcggggcaaggucgcggagggccggacggucgggacuacgcgcccgggcuggggaggcaggaaguccgcgccgcgggcuuagaggggcucagagccuugggcacagauaucgcggcgccuggggaggacccucggagcggugggaguugcgguguggaauacgggggggguggguggcacaucgcgcggcgcguguugcacaaccuggcccgccgucgugacuggaggcgggagugacaccuccgcccgggccgcggaguucggggaaggagggcgcggcgcugggccaggccggaggggcggccagggcugauagaaaggggcuguggagaaggggcccggggaggagccaggacgggucuggacccagcuccacgccuugcgccccucacguaccccggcggggcacggucggcccucgggaggcccaucgcgcccucgggagcuucccucaagccgugcccuucaugccgccgacggagccgggcgagcccacgucguccgugcggaagguggagucccucacccgcggcccccagagggaccccgcugucguagagccacgcgggggccggagcgcugagacgcggcaccauguuucggggagagcucugccgagggcggcugagggccaccuccccagaggcgcgaagcccugaggaugggcagaugguucuuaagacggcgcccuucccgccacucccacccccgacuaccaccaccugggucugggaacccggugagagcgcagucggagggucgaacguuuguagcugucaagucguagccccgcugcgcccacaggaagugacccacccgccugccggguaguggccuuucugugagccaggaccaucuuaaggaaaaaaacaaaaaaagagcaaaacgccgugccccuccacaauauacucuccucuuccccgcauccccgaggggaucuuuccuccccuccaccuccaccuccaccuccaccgcugaccccaaggaauaaugcucaguaucugagucagaggauguaaaacaaagggauauuucuccuuauguaguuuuauggaggauuuaccgaaagaagguggagggugagugacuaugucgcagaaaaaaaaaaaaagauguuuuuaucgugaaugauguugagaaauguccugugacuuccacuauugggcaaagcaggucccucugcccugcuagucccuccugcaggcuguguaugaagcguucugauauggaggguuggugcgccuggguugacagccauuggucaggugccugcagaguacagggcgccauacugggaacuggaacuauaaauaaauacucuggggacccuaauauccagagaccuaacccaucuacgggaggaacaaggcuugaaguuagggaacugucuagcaaagcugcuugcacaacugcuaaguguacggaauuccaggaaaaagaaaaauugcuuccaguugggguguccuucauggaaaaggcauuugggcagcccuguggggguagcaggagcauuccaggugguggaaagggccugagccaagguccuuaagugggacaggguacgguguguggccggaauggagggucuguguaauaggacagugagaaaagaugccagaagcggggaugggacucugcugugcguggcgugggagccaagcucugacuuuca

SEQ ID NO: 19574 - RNA, 2026 nt, Homo sapiens
ugaaagucagagcuuggcucccacgccacgcacagcagagucccauccccgcuucuggcaucuuuucucacuguccuauuacacagacccuccauuccggccacacaccguacccugucccacuuaaggaccuuggcucaggcccuuuccaccaccuggaaugcuccugcuacccccacagggcugcccaaaugccuuuuccaugaaggacaccccaacuggaagcaauuuuucuuuuuccuggaauuccguacacuuagcaguugugcaagcagcuuugcuagacaguucccuaacuucaagccuuguuccucccguagauggguuaggucucuggauauuaggguccccagaguauuuauuuauaguuccaguucccaguauggcgcccuguacucugcaggcaccugaccaauggcugucaacccaggcgcaccaacccuccauaucagaacgcuucauacacagccugcaggagggacuagcagggcagagggaccugcuuugcccaauaguggaagucacaggacauuucucaacaucauucacgauaaaaacaucuuuuuuuuuuuuucugcgacauagucacucacccuccaccuucuuucgguaaauccuccauaaaacuacauaaggagaaauaucccuuuguuuuacauccucugacucagauacugagcauuauuccuuggggucagcgguggagguggagguggagguggaggggaggaaagauccccucggggaugcggggaagaggagaguauauuguggaggggcacggcguuuugcucuuuuuuuguuuuuuuccuuaagaugguccuggcucacagaaaggccacuacccggcaggcgggugggucacuuccugugggcgcagcggggcuacgacuugacagcuacaaacguucgacccuccgacugcgcucucaccggguucccagacccagguggugguagucgggggugggaguggcgggaagggcgccgucuuaagaaccaucugcccauccucagggcuucgcgccucuggggagguggcccucagccgcccucggcagagcucuccccgaaacauggugccgcgucucagcgcuccggcccccgcguggcucuacgacagcggggucccucugggggccgcgggugagggacuccaccuuccgcacggacgacgugggcucgcccggcuccgucggcggcaugaagggcacggcuugagggaagcucccgagggcgcgaugggccucccgagggccgaccgugccccgccgggguacgugaggggcgcaaggcguggagcuggguccagacccguccuggcuccuccccgggccccuucuccacagccccuuucuaucagcccuggccgccccuccggccuggcccagcgccgcgcccuccuuccccgaacuccgcggcccgggcggaggugucacucccgccuccagucacgacggcgggccagguugugcaacacgcgccgcgcgaugugccacccaccccccccguauuccacaccgcaacucccaccgcuccgaggguccuccccaggcgccgcgauaucugugcccaaggcucugagccccucuaagcccgcggcgcggacuuccugccuccccagcccgggcgcguagucccgaccguccggcccuccgcgaccuugccccgcguccgcagcauccuggcggcuaccgcuccccacgucgagucucaccggcugggagcagaccagcgcccggugguccaggagucgcagggaggcgccacccggggccagcacgcccaggagcagcaggagcagccccagcaggggccccgggacagcggacggcgggcugcgugcggcccccauggcccggcuggcgucgcggagggcucggccccggcuggggacgcagcgaacgaacguucugaggcuuucuuuuccgcgguggaguucgagucggcuccacuuugcucgcuuccggcuuccagcccgggcccaggggcgggccgggccgaggggaggaguuuagucugggac

SEQ ID NO: 19575 - RNA, 2335 nt, Homo sapiens
cuccugcccagcugcugggacuggggugugauaucccuggagccuggcccugucacugcccuccucuuucccgcaacccaggaaagaagaguaggguaaggggcaggaauagcucaaccucugaaccuguaaggggacagagacuccacagccuaggugucuucccuccugccccaccaggucacuuuuggggcacagccuggacucaccagcacaggguauccucggggauagagucugccagcagugcucugagcagaggcucgaugccggcccccauaagucucaaugcgggaggccacgaguccuuggagggggcccucauguggaggaccaaaggccuucaucccuucucuccugggucaccuccaaagggccauaucuucaauguccaggagaaagagguccccuagggcugcaagagagaaaagaggaauggaagggccauccccaaucagugaauggcaccaggcgggagaccaaggcugguagggggccugggagggaggguauagugggggaggagagggccaagggcuuggucacuuguuggggggaacauggcugccucaucuaugacuuggugggaguaggguagguccagguacauauuggguaggaagccccuuggagauguaccuccucucucacaugugugcauauuugggguacaagcuccugcacuggucucaaaugggaacaagggucacagacaggucucgggcuuucuggauacacccaggugggaggguucuccuugcaccuagauauaaccccauccccuuccccauauaaagcuugggaaaaagcuggagggaggccaugguggguggggugggcugggaguggggguggcuggagacagcccagucugccaccaguuuuuguacagccuguaagccuuuacauauuuacauaguugaaacaacugcugcccccccugcaaaaaagccaccaauauuuugggacaaguaaauauuacaugauauucaaauucaguguccauaaacacaguuuuguuggaauccauccucuucugcuggucuccuaauaaccugugacugcuucuugcuaguugggacagacgguguaggccgcgaagucucuaaucuuuacugucuggccuuuacugaaaggcuugcccaucuccuaccugaacccuccugaccacagacagggaggugaguggggccagcuguccggccacugcccuuagagaccagccaaauagaauuagaguuucuccaguuucgggcuauauauuugguccuccccagacucugggaauaccaccauggagcugggggccaggcguggggcuccaucccuccccccuaaaccuggagggagggcccgcccucgagugggcagggccuggaagaggagaggccuccuaaggggcggugggcucaagaaggcugcgcagguguuugugccccgaccgggugggccugagguccugccucagcccucccuuaccuuccuccgauucaggagcagaggaggaaacguucgcugucccuccugccgccucccaauaguccucccucugagggcgcugucucccucgcacugcucccuacccaggguccugucucagcccagcccccggcuccccuccucccgccuucgggaggccaggccuuccuuccccuucgccccggcuuccaggccccgggucccggccgccccgcccccgggccgcguagcccucccgccgcucaccugugcccacaggugucaccgcacccgcugcccugcgccgcccuccccgcccgcggggcuccccgucgccgucggcuccccggcgaugccagccagccccgaugcccagccugggacugggaucgagcggcccgcgggagccgggcagcgcggguccgggcgaggagggcggggaccgggcuggccccucccuaccgccagcaccgcucggggcagaggggcagaggggcggggcccuggggaccgagcagcccccgcccucacgcagccaccgccuuccccggagaggacagcucacguggcggugcccuccuuuccccuuuucggucgcaccugaacucgacacccgccggccgagcgggagggcugggaccgcgcgcccuccacuccgggccagacccccgcgaggcgcugcaguaaugagggcugaguaaggggcggggcgccgccgggggaggcggcgagggugacaaccuguggcaggcaccccucucuccugcuggucgcggcgaguggccggccguccgguccucccccugccucggccuagaccccuaagcaggcagggagcccgccugccagcuggaggggcagggggccccgucgcugu

SEQ ID NO: 19576 - RNA, 2335 nt, Homo sapiens
acagcgacggggcccccugccccuccagcuggcaggcgggcucccugccugcuuaggggucuaggccgaggcagggggaggaccggacggccggccacucgccgcgaccagcaggagagaggggugccugccacagguugucacccucgccgccucccccggcggcgccccgccccuuacucagcccucauuacugcagcgccucgcgggggucuggcccggaguggagggcgcgcggucccagcccucccgcucggccggcgggugucgaguucaggugcgaccgaaaaggggaaaggagggcaccgccacgugagcuguccucuccggggaaggcgguggcugcgugagggcgggggcugcucgguccccagggccccgccccucugccccucugccccgagcggugcuggcgguagggaggggccagcccgguccccgcccuccucgcccggacccgcgcugcccggcucccgcgggccgcucgaucccagucccaggcugggcaucggggcuggcuggcaucgccggggagccgacggcgacggggagccccgcgggcggggagggcggcgcagggcagcgggugcggugacaccugugggcacaggugagcggcgggagggcuacgcggcccgggggcggggcggccgggacccggggccuggaagccggggcgaaggggaaggaaggccuggccucccgaaggcgggaggaggggagccgggggcugggcugagacaggacccuggguagggagcagugcgagggagacagcgcccucagagggaggacuauugggaggcggcaggagggacagcgaacguuuccuccucugcuccugaaucggaggaagguaagggagggcugaggcaggaccucaggcccacccggucggggcacaaacaccugcgcagccuucuugagcccaccgccccuuaggaggccucuccucuuccaggcccugcccacucgagggcgggcccucccuccagguuuaggggggagggauggagccccacgccuggcccccagcuccauggugguauucccagagucuggggaggaccaaauauauagcccgaaacuggagaaacucuaauucuauuuggcuggucucuaagggcaguggccggacagcuggccccacucaccucccugucuguggucaggaggguucagguaggagaugggcaagccuuucaguaaaggccagacaguaaagauuagagacuucgcggccuacaccgucugucccaacuagcaagaagcagucacagguuauuaggagaccagcagaagaggauggauuccaacaaaacuguguuuauggacacugaauuugaauaucauguaauauuuacuugucccaaaauauugguggcuuuuuugcagggggggcagcaguuguuucaacuauguaaauauguaaaggcuuacaggcuguacaaaaacugguggcagacugggcugucuccagccacccccacucccagcccaccccacccaccauggccucccuccagcuuuuucccaagcuuuauauggggaaggggaugggguuauaucuaggugcaaggagaacccucccaccuggguguauccagaaagcccgagaccugucugugacccuuguucccauuugagaccagugcaggagcuuguaccccaaauaugcacacaugugagagaggagguacaucuccaaggggcuuccuacccaauauguaccuggaccuacccuacucccaccaagucauagaugaggcagccauguuccccccaacaagugaccaagcccuuggcccucuccucccccacuauacccucccucccaggcccccuaccagccuuggucucccgccuggugccauucacugauuggggauggcccuuccauuccucuuuucucucuugcagcccuaggggaccucuuucuccuggacauugaagauauggcccuuuggaggugacccaggagagaagggaugaaggccuuugguccuccacaugagggcccccuccaaggacucguggccucccgcauugagacuuaugggggccggcaucgagccucugcucagagcacugcuggcagacucuauccccgaggauacccugugcuggugaguccaggcugugccccaaaagugaccugguggggcaggagggaagacaccuaggcuguggagucucuguccccuuacagguucagagguugagcuauuccugccccuuacccuacucuucuuuccuggguugcgggaaagaggagggcagugacagggccaggcuccagggauaucacaccccagucccagcagcugggcaggag

SEQ ID NO: 19577 - RNA, 2565 nt, Homo sapiens
aacuggagugaaucagaauagcccaucagugcuuugguauucccagggauccuauaaaagggggugaacuacagcuccaaaacggggagucggagaagugcgcagcagccgcggcagcuccgcgacgcucccuuuggcuacuccuucgcgcacucuaacucacucacucuuuuuuggauuucgucaucuuuucaaaaaaucaauaaaaauauucuggaggcuccggggguccacuucuuggucucauccggauccccagauccuccucuaucauucccgacaauuggaaaaaaugucugggggggucccugcggcccaggggccgcuuuugggggggcgggugaggagagguggggaagagagggggagggaggagaggaggaagagcgccgcagccucggcagcuggagucggagcagggggggaugguuucaaaaaauaauuaaaaaucgaggaaauauccuagaaaagcccuuuuggcgugaaaaccccaaagaagagccaggcuucccgaaacagagguuucgggugccagaaaggucuguauuccgaccccuggggcuuuggaucccgggaggaaacuugaaggggugagcgccgcggcgggaguguccggcugcggcccacaaggacagaaacuagggaacgcggugacgagcgaggggaaagacgggagcagagagcccuggaaagaggcacggggggcucccaccucuccuucaggggugacccgguauccccccuacacacacccccucccccccuuccuaccccacccaaaucuccgcaccgaggaagcuggaaaaccaaacuguaaguaaucuucgugagguggggggugggggagagggcacgauuagaagugggguggccgggauaauggggugcgaggguaagcgggcgacguuucccagccuuuccaaagggaguuugcaaagcaacauggcgaaaccacggcagguccagagcugugcauacgugggcacacggcucgcugggcaaagacuuggagugaggggcaagaagcgguucuuuuggguuccccugaaacacgcguuucuucaaugggacuuccggggcucccgaauuccccguuucucuccuucucccuccucccuccaccuccccggugaagugccagcgcggagucgcgaccacaggcggggaccugaggccaagacgaauuugcucuggccuuuugggggggguugccuuucuacucggggucccgauuucaggccccgacucucuuccuggccgcagcgcaagcagccgcggcggcuucgcaaaagacaggucgcgaggggggugggaagaagaggcagccacaugcaggaacacgcgcgcgggaugcuccccuacccccgcccaggacagccucgcuucucccagauuuuccuccccccucugccuccccaguuuaucuggagaggaacagaaauaaagccacgcgucucgccagaaggcgcgcgguaaacucccgcacaggagccgggaggccggcgcggggauugcccucucccagguuuagggcuccggccggggacccgagcauccggagggguccuggcuccuggcgagcgccaccccccgaccuaccuccagcauccagguggccaccauucugcgcauguaggguuggauguccuucugcacgcacuugaaguaggagcacugcggaagguagcgcuccucgauggugagcagguucugcaggacgcggucgucucggagcagguugcggucccgcacggcccugcggaccggguccaccucguggcacagcagcuccauggccagcccggcggccccucucccuccugcuuuccccggccuggaaaaagguuuuucuguuuuuguuuuuuggaaggggaggggagagcguuccccugaccuccuuccuuuggcuaaauaggggguuuucgggggagaggugagggcagagagagaagguggagcagaagggaggcgaggauuggguggugggcgagcagagccucggggcugccucacucgcaccgguccuccccuuaaaacuggucucgcucuccccugcucgcucuucuccgcucugaagcggugacgcaagcuggcugggcaguuagcucuccucccucuccccgcgcuccccgcucugguuccuccuccccuuuccuccccucccgguccuccccuccuccuuucaaucucucccucccucccuccuuuuccccucucguuauuaaggagaacagcagcuggcccgacccaacuucaaacgcggucccccgccaccccccaccccucucccuccauccagcccugcaugccaggggccccggacagggcaacccacaaaaaacuaccgacuccuauuucugcccucuaauuucacucauucuguagguguagcacgccaaaauacgacccuccaacuuuggcuucuucaaaacggauccuaauccuccugcccuuguauuuaagauccaggaauguaggguagauuaucugaagauggggugaccucagacaauuuagaaauaggucccuuaagugaaaaauaagggagggggugauuuuagaaaa

SEQ ID NO: 19578 - RNA, 2565 nt, Homo sapiens
uuuucuaaaaucacccccucccuuauuuuucacuuaagggaccuauuucuaaauugucugaggucaccccaucuucagauaaucuacccuacauuccuggaucuuaaauacaagggcaggaggauuaggauccguuuugaagaagccaaaguuggagggucguauuuuggcgugcuacaccuacagaaugagugaaauuagagggcagaaauaggagucgguaguuuuuuguggguugcccuguccggggccccuggcaugcagggcuggauggagggagaggggugggggguggcgggggaccgcguuugaaguugggucgggccagcugcuguucuccuuaauaacgagaggggaaaaggagggagggagggagagauugaaaggaggaggggaggaccgggaggggaggaaaggggaggaggaaccagagcggggagcgcggggagagggaggagagcuaacugcccagccagcuugcgucaccgcuucagagcggagaagagcgagcaggggagagcgagaccaguuuuaaggggaggaccggugcgagugaggcagccccgaggcucugcucgcccaccacccaauccucgccucccuucugcuccaccuucucucucugcccucaccucucccccgaaaacccccuauuuagccaaaggaaggaggucaggggaacgcucuccccuccccuuccaaaaaacaaaaacagaaaaaccuuuuuccaggccggggaaagcaggagggagaggggccgccgggcuggccauggagcugcugugccacgagguggacccgguccgcagggccgugcgggaccgcaaccugcuccgagacgaccgcguccugcagaaccugcucaccaucgaggagcgcuaccuuccgcagugcuccuacuucaagugcgugcagaaggacauccaacccuacaugcgcagaaugguggccaccuggaugcuggagguaggucgggggguggcgcucgccaggagccaggaccccuccggaugcucggguccccggccggagcccuaaaccugggagagggcaauccccgcgccggccucccggcuccugugcgggaguuuaccgcgcgccuucuggcgagacgcguggcuuuauuucuguuccucuccagauaaacuggggaggcagaggggggaggaaaaucugggagaagcgaggcuguccugggcggggguaggggagcaucccgcgcgcguguuccugcauguggcugccucuucuucccaccccccucgcgaccugucuuuugcgaagccgccgcggcugcuugcgcugcggccaggaagagagucggggccugaaaucgggaccccgaguagaaaggcaaccccccccaaaaggccagagcaaauucgucuuggccucagguccccgccuguggucgcgacuccgcgcuggcacuucaccggggagguggagggaggagggagaaggagagaaacggggaauucgggagccccggaagucccauugaagaaacgcguguuucaggggaacccaaaagaaccgcuucuugccccucacuccaagucuuugcccagcgagccgugugcccacguaugcacagcucuggaccugccgugguuucgccauguugcuuugcaaacucccuuuggaaaggcugggaaacgucgcccgcuuacccucgcaccccauuaucccggccaccccacuucuaaucgugcccucucccccaccccccaccucacgaagauuacuuacaguuugguuuuccagcuuccucggugcggagauuugggugggguaggaagggggggaggggguguguguaggggggauaccgggucaccccugaaggagaggugggagccccccgugccucuuuccagggcucucugcucccgucuuuccccucgcucgucaccgcguucccuaguuucuguccuugugggccgcagccggacacucccgccgcggcgcucaccccuucaaguuuccucccgggauccaaagccccaggggucggaauacagaccuuucuggcacccgaaaccucuguuucgggaagccuggcucuucuuugggguuuucacgccaaaagggcuuuucuaggauauuuccucgauuuuuaauuauuuuuugaaaccaucccccccugcuccgacuccagcugccgaggcugcggcgcucuuccuccucuccucccucccccucucuuccccaccucuccucacccgcccccccaaaagcggccccugggccgcagggacccccccagacauuuuuuccaauugucgggaaugauagaggaggaucuggggauccggaugagaccaagaaguggacccccggagccuccagaauauuuuuauugauuuuuugaaaagaugacgaaauccaaaaaagagugagugaguuagagugcgcgaaggaguagccaaagggagcgucgcggagcugccgcggcugcugcgcacuucuccgacuccccguuuuggagcuguaguucacccccuuuuauaggaucccugggaauaccaaagcacugaugggcuauucugauucacuccaguu

SEQ ID NO: 19579 - RNA, 2391 nt, Homo sapiens
uccuuugccaugaauuggauugacagaggcgggggaggcuuugcuuucugccccagggaauggcgauucgcguccuggggccgugccggggagaaucggccgaggagaaagaaagagugauagaaaaagagcugcaggaaggaggagaagggagaccuccaucugccgcgggcccggcgcgcugcagcgcagcgcagcgccgagcugcgccucggaauggcccggagcccgcccugcgcccccggcuccuccagcgucagcggcuccugcgcgcgggaugcauugggcaauuuuugaaauccugaaguaggaagagaccccggaggauauaagucggggguggggguggagcagagaaucugugaaagauauucaaagagagaaaaggggaauccugaucguuucugcccgugcuuguuuucaacuugagcgugcuagccuuuaacuugaagaagucucauuggagcaucuagcauucuccaggaguuauucgaaagcugaaacuuucaguggauugugggccuggggagaagaaggauuccgaggguggaauugggaagagcgugcgugcgugugugugugugugugugugcgcgcgcgcgcgugggucggggcgggggcgucggggggccacugggaauucagugaagagggcacccuauaccauggcagugcccggcgacgcugcacgagucagggacaagcccguccacaguggggugagucaagcccccacggcgggccgggacugccaccaucgugcggaccccgcaucgccgcgggacucgggcugccguggcugcuggggagaccuggugcugcagccgcuccggagcucucggaaacuuuccuccgcgcugugcgcgggcucccuguccuuucugcuggcgcugcuggugaggcugguccgcggggaggucggcugugaccuggagcaguguaaggaggcggcggcggcggaggaggaggaagcagccccgggagcagaagggggcgucuucccggggccucggggaggugcucccgggggcggugcgcggcucagccccuggcugcagcccucggcgcugcucuucagucuccugugugccuucuucuggaugggcuuguaccuccugcgcgccggggugcgccugccucuggcugucgcgcugcuggccgccugcugcgggggggaagcgcucguccagauugggcugggcgucggggaggaucacuuacucucacuccccgccgcggggguggugcucagcugcuuggccgccgcgacauggcuggugcugaggcugaggcugggcguccucaugaucgccuugacuagcgcggucaggaccgugucccucauuuccuuagagagguucaaggucgccuggagaccuuaccuggcguaccuggccggcgugcuggggauccucuuggccagguacguggaacaaaucuugccgcaguccgcggaggcggcuccaagggagcauuuggggucccagcugauugcugggaccaaggaagauaucccgguguuuaagaggaggaggcgguccagcuccgucguguccgccgagauguccggcugcagcagcaagucccaucggaggaccucccugcccuguauaccgagggaacagguaagcacuggcaacuccucucucggcucuuggaaacuugaaacacuuggcaaccggcgcagaguggagagaauccgagcgcugggaacuaaagggaagauagccuagaaaacuggucuaacuucagaauuaagaaacuagcagguuuuuuuuuuguuuuuuuuguuuuuuuuuuuuuguuuuuuugcccucucuuucacacaguaguuuuauaaccugaacgacugaaacacaauuaacaaaacuagauggcauguguagggucuuccacagcugggccaacuuuuuagaucugcuacaccugguguauggcuugccuacucuuuucaguacucuuacgcuuuccuuccuuagcagaaauuuuagaauuaaguuuagauuuuagcaaugagugauuuuuuuaacacauagauuuuacuagauuucuacuuuuuaaaaaguaaaaucuuuuuaaugaaaugauauuaaacauuuaugaaaaccaguaaaaagauucuagagcaaagcaagcugugcuugaaggugaggaauugauacacauuuucugguuuugcaguaaguuuuauuuggagagacugcagcugauggugcccaauuuguuuuuaaauauaauuuaggggcauacauuauuacaugcuaguguguuuuguaucacaaacuucaacuuggggaauaauaugucugaacuuuggaauuguucaaaauugucaacugcguuuuagugucaacuaaaaacaaaacaguucucuuuaguaugugcauacuu

SEQ ID NO: 19580 - RNA, 2391 nt, Homo sapiens
aaguaugcacauacuaaagagaacuguuuuguuuuuaguugacacuaaaacgcaguugacaauuuugaacaauuccaaaguucagacauauuauuccccaaguugaaguuugugauacaaaacacacuagcauguaauaauguaugccccuaaauuauauuuaaaaacaaauugggcaccaucagcugcagucucuccaaauaaaacuuacugcaaaaccagaaaauguguaucaauuccucaccuucaagcacagcuugcuuugcucuagaaucuuuuuacugguuuucauaaauguuuaauaucauuucauuaaaaagauuuuacuuuuuaaaaaguagaaaucuaguaaaaucuauguguuaaaaaaaucacucauugcuaaaaucuaaacuuaauucuaaaauuucugcuaaggaaggaaagcguaagaguacugaaaagaguaggcaagccauacaccagguguagcagaucuaaaaaguuggcccagcuguggaagacccuacacaugccaucuaguuuuguuaauuguguuucagucguucagguuauaaaacuacugugugaaagagagggcaaaaaaacaaaaaaaaaaaaacaaaaaaaacaaaaaaaaaaccugcuaguuucuuaauucugaaguuagaccaguuuucuaggcuaucuucccuuuaguucccagcgcucggauucucuccacucugcgccgguugccaaguguuucaaguuuccaagagccgagagaggaguugccagugcuuaccuguucccucgguauacagggcagggagguccuccgaugggacuugcugcugcagccggacaucucggcggacacgacggagcuggaccgccuccuccucuuaaacaccgggauaucuuccuuggucccagcaaucagcugggaccccaaaugcucccuuggagccgccuccgcggacugcggcaagauuuguuccacguaccuggccaagaggauccccagcacgccggccagguacgccagguaaggucuccaggcgaccuugaaccucucuaaggaaaugagggacacgguccugaccgcgcuagucaaggcgaucaugaggacgcccagccucagccucagcaccagccaugucgcggcggccaagcagcugagcaccacccccgcggcggggagugagaguaagugauccuccccgacgcccagcccaaucuggacgagcgcuucccccccgcagcaggcggccagcagcgcgacagccagaggcaggcgcaccccggcgcgcaggagguacaagcccauccagaagaaggcacacaggagacugaagagcagcgccgagggcugcagccaggggcugagccgcgcaccgcccccgggagcaccuccccgaggccccgggaagacgcccccuucugcucccggggcugcuuccuccuccuccgccgccgccgccuccuuacacugcuccaggucacagccgaccuccccgcggaccagccucaccagcagcgccagcagaaaggacagggagcccgcgcacagcgcggaggaaaguuuccgagagcuccggagcggcugcagcaccaggucuccccagcagccacggcagcccgagucccgcggcgaugcgggguccgcacgaugguggcagucccggcccgccgugggggcuugacucaccccacuguggacgggcuugucccugacucgugcagcgucgccgggcacugccaugguauagggugcccucuucacugaauucccaguggccccccgacgcccccgccccgacccacgcgcgcgcgcgcacacacacacacacacacacgcacgcacgcucuucccaauuccacccucggaauccuucuucuccccaggcccacaauccacugaaaguuucagcuuucgaauaacuccuggagaaugcuagaugcuccaaugagacuucuucaaguuaaaggcuagcacgcucaaguugaaaacaagcacgggcagaaacgaucaggauuccccuuuucucucuuugaauaucuuucacagauucucugcuccacccccacccccgacuuauauccuccggggucucuuccuacuucaggauuucaaaaauugcccaaugcaucccgcgcgcaggagccgcugacgcuggaggagccgggggcgcagggcgggcuccgggccauuccgaggcgcagcucggcgcugcgcugcgcugcagcgcgccgggcccgcggcagauggaggucucccuucuccuccuuccugcagcucuuuuucuaucacucuuucuuucuccucggccgauucuccccggcacggccccaggacgcgaaucgccauucccuggggcagaaagcaaagccucccccgccucugucaauccaauucauggcaaagga

SEQ ID NO: 19581 - RNA, 2766 nt, Homo sapiens
ggcgaguccuccccgggaggcuccugcuugauggugacgcggcucgcccccgcgccuuugccuuucucgcgguccggccgggccucggcuucgccgccguagccgcugucgguguccgugucguucucggcggcgagcucggcgcugggcugaguccgcuggaugacgggcacgcaguaggcgaggggcuccagcuucugccccgcgcgcuccaggcagggggcggccgcggacccggcggccgagggagcgccggugccuuugcucagagggaccuguugagucaacagcugcggggugggcaagaacuggguggccacggcgugcaagugguugaucagcuggacacaccgcggcucccuggguguccagcucucaaaccgggagagguauugcaagacuucuuuggcgcauguuugaaaucccgaguggaacgcauccaagucggacugaaugggcgauuucagagaucgcuccccuaggaugaggaagggaugggggugggggacggaggaguggaggcaagaagaaacauacccacguuaaaacaucugcuuaucacgugggcccugcaucgacuaaagugaucucgguuuuuccccaguauucaagugauauaauccaccaguugacgagagaagcgggguggcggaggugcggagcggggagagggcgcucuccucccagcugaaaaccaaaguggagcgggugcaaccgccacuuuaaauccugauuccuccgaguucugcugaaagccucuaggaugcuucgggaaaugggcucguuccaaugaagggaaaguauaagcaauuuaacaaaugagagggaacccaugagcccacggaaagagauggggugcgggugagggaguccugacacugcuccccugugggcugccccgcuucaucaggguaggcuggccucccugaacugacuuaccauucuguaaagcaauuaucuucugaugcuguugcucgguuaaggcgguuaaagcuuuuaaguguuucaaaguuaauuccaagacuacagcuuucuccagaugucccagagucugcaguggugcaaaaaagaaacgggcacuugguuacuuaaaaacacacauuuggcuuaauuggcuguccauucagcacagcaauuuaagcaaacacuuugaaagaaguacuguucuuuuacuucuugagcuuuccacaagacagguuauaaaugauuucuugccuucagcugggagcaccuacuccaguuugcgggaaacucuguacgguauagcacaaguuuuaagucaggaacuuauauuuacauuuauucuuauauuuucugggagucgcaccagacuauuaacacgcccuuggagagcagcaaagaaugaaaaugugcaucuuacugucaauuucagauguucaggcaguaaaucuuucagcugagcaaugcauucauuaauucggucucuucuuuucuuuucuauuaaucugugcgguaauuuguagguauccuuaauauaugagagucauggaaaagagaaaacaguaagcgaaacauucacuuauuggauauuacccucgucugccccccccgcccccccaccauaaaacauacuaugugauaaacuacacccaagaaaccucuuuccucuggacuguucugcaaugcaauuuaaauucagguaugauguuuaauaucccccugagaguacccagcaagccacuuaaaauucacaguuggggaagcucaggggcuggaauauauuugcgggcagagcuucacugugaaaucaauggcucuaauuaacuacccaugcagguuaugaggaauaucgggaacuuacacuuaccuuggugucgucucguuucaugcuccuuuuggguuuacacauauacaaagaggaauaguccagucugcaaaacagaaaucagcaucaggcacccauucggggaggggcucugcccucgccagcuccauaccacuuucuggagaagaaaaaaaucaaaccaaagccuagacagauauucgcaagggugcgugcaccuuacccuauaaaaucucuauguuccaguaacugucucucuugcaaaugaggaauuccuucguccauguucaacugcuguucguuuccucuguuucgauuuuuggggcucuguacaauaaucugugggacgguaggcuugggagaccuuggggggaucugugcgucuccagucucucucucgcucucccucuucagugcaguguugaaagugugaagcaguugguccccccccuccaccgcgcucgcacacacacacgcacacacacgcacacucgcgccggccccacugcgcugguaguuugcucucacuccaggcaguguuuggccacagggcacgcgcgucgccggccagaccagcacccagcucacgugcggaacguaccauccgcgguccagcccggaggggggcgggggaggaggggccgggccgggcgggggcgucgggagaaggcggcgagagaaggcgaacggcaggagggggcggggacaccugaucagggccaccggaaaggaaaaacaacuucggccaagcuauucaucuucccaaaggcgaugcagucggcaggaggaggggggagugggggugcaggggugcggggcagccugagcuuccuuggcuccaaaaugcgacucccuggguucguccguuguuacggugcaggaaugugaacguggcuuuuugcuuuuccaccgauugugcuguugguuugaaccauagaaaggaagugaaaagagaauucgcg

SEQ ID NO: 19582 - RNA, 2766 nt, Homo sapiens
cgcgaauucucuuuucacuuccuuucuaugguucaaaccaacagcacaaucgguggaaaagcaaaaagccacguucacauuccugcaccguaacaacggacgaacccagggagucgcauuuuggagccaaggaagcucaggcugccccgcaccccugcacccccacuccccccuccuccugccgacugcaucgccuuugggaagaugaauagcuuggccgaaguuguuuuuccuuuccgguggcccugaucagguguccccgcccccuccugccguucgccuucucucgccgccuucucccgacgcccccgcccggcccggccccuccucccccgccccccuccgggcuggaccgcggaugguacguuccgcacgugagcugggugcuggucuggccggcgacgcgcgugcccuguggccaaacacugccuggagugagagcaaacuaccagcgcaguggggccggcgcgagugugcgugugugugcgugugugugugcgagcgcgguggaggggggggaccaacugcuucacacuuucaacacugcacugaagagggagagcgagagagagacuggagacgcacagauccccccaaggucucccaagccuaccgucccacagauuauuguacagagccccaaaaaucgaaacagaggaaacgaacagcaguugaacauggacgaaggaauuccucauuugcaagagagacaguuacuggaacauagagauuuuauaggguaaggugcacgcacccuugcgaauaucugucuaggcuuugguuugauuuuuuucuucuccagaaagugguauggagcuggcgagggcagagccccuccccgaaugggugccugaugcugauuucuguuuugcagacuggacuauuccucuuuguauauguguaaacccaaaaggagcaugaaacgagacgacaccaagguaaguguaaguucccgauauuccucauaaccugcauggguaguuaauuagagccauugauuucacagugaagcucugcccgcaaauauauuccagccccugagcuuccccaacugugaauuuuaaguggcuugcuggguacucucagggggauauuaaacaucauaccugaauuuaaauugcauugcagaacaguccagaggaaagagguuucuuggguguaguuuaucacauaguauguuuuauggugggggggcggggggggcagacgaggguaauauccaauaagugaauguuucgcuuacuguuuucucuuuuccaugacucucauauauuaaggauaccuacaaauuaccgcacagauuaauagaaaagaaaagaagagaccgaauuaaugaaugcauugcucagcugaaagauuuacugccugaacaucugaaauugacaguaagaugcacauuuucauucuuugcugcucuccaagggcguguuaauagucuggugcgacucccagaaaauauaagaauaaauguaaauauaaguuccugacuuaaaacuugugcuauaccguacagaguuucccgcaaacuggaguaggugcucccagcugaaggcaagaaaucauuuauaaccugucuuguggaaagcucaagaaguaaaagaacaguacuucuuucaaaguguuugcuuaaauugcugugcugaauggacagccaauuaagccaaauguguguuuuuaaguaaccaagugcccguuucuuuuuugcaccacugcagacucugggacaucuggagaaagcuguagucuuggaauuaacuuugaaacacuuaaaagcuuuaaccgccuuaaccgagcaacagcaucagaagauaauugcuuuacagaaugguaagucaguucagggaggccagccuacccugaugaagcggggcagcccacaggggagcagugucaggacucccucacccgcaccccaucucuuuccgugggcucauggguucccucucauuuguuaaauugcuuauacuuucccuucauuggaacgagcccauuucccgaagcauccuagaggcuuucagcagaacucggaggaaucaggauuuaaaguggcgguugcacccgcuccacuuugguuuucagcugggaggagagcgcccucuccccgcuccgcaccuccgccaccccgcuucucucgucaacugguggauuauaucacuugaauacuggggaaaaaccgagaucacuuuagucgaugcagggcccacgugauaagcagauguuuuaacguggguauguuucuucuugccuccacuccuccgucccccacccccaucccuuccucauccuaggggagcgaucucugaaaucgcccauucaguccgacuuggaugcguuccacucgggauuucaaacaugcgccaaagaagucuugcaauaccucucccgguuugagagcuggacacccagggagccgcgguguguccagcugaucaaccacuugcacgccguggccacccaguucuugcccaccccgcagcuguugacucaacaggucccucugagcaaaggcaccggcgcucccucggccgccggguccgcggccgcccccugccuggagcgcgcggggcagaagcuggagccccucgccuacugcgugcccgucauccagcggacucagcccagcgccgagcucgccgccgagaacgacacggacaccgacagcggcuacggcggcgaagccgaggcccggccggaccgcgagaaaggcaaaggcgcgggggcgagccgcgucaccaucaagcaggagccucccggggaggacucgcc

SEQ ID NO: 19583 - RNA, 2514 nt, Homo sapiens
ucagcacaccugggagcuggggauagagccgggacaucagagaacacccgaccagugccccucauccuccccgcccccuucacugccugccucccaccuuguccccagcccacucccuugcccuuaccuguagagcucccagugcccccgcacucauggccagggugggcagggaauccagguugugguccccgucagcugggaauuugucccucuggcagggaaaaaagcugugagguggccccugcccagccucggggcucccuccaucccccacgccaggcccccaacucuuccccucccucacucugccaccugagagcccagaaccccuccaaguggcugcccgcagacuccucuccguuccucucugccucucacuccugugcuggccccagcccagucucuccuaccagcugugcagccagcugccgcguguccgccaggagagagcgggucaggagcacggugcuguccagcucggcccgagggucuggggaaacucgaggggggccaggugguggcccaggggcgacagcuguaucuggccacaggcucagcacgaccaggaccaggcggcaaacaccugggggcaggauaaggcagagagcucaggcuggacuccgggucugagagaggagggccugggccuggacucccgggucugagggaggaggaacuggggucuggacuccuccugggucugagggaggagaggcugggggccuggacuccuaggucugagggaggaaggccuggggucuggacuccugggucucggggaggagggucuggggccuggacucccggccuuagggaggauggagcuggaggucuuaagucccaggguggaacgcccgcgggcaggucgcagggccaggcgggcuucccucucccucccuggcucuggcugccccgcccgucggagcagacgcggcccggggcggguagacgggccgggcgucucccguccgcccccggacgccggaaucugggccccggggcggggcauggugggggaggcacaggccagaaccugcccccuccccgggccgcgggagcccgagcuggcugggagcaggggaaggagccagaagccaggacggagcccgggagacacggaccucucccacgggagaccccuuagacgcccucccaggagccccgccgggugggcggcagaagcccgggccgcagcgcaccugggcggagaggggcagagccaugggcccggccgggccgcgggagcgggagagcuggcggcggggggcgcggggggcgcggggggcgcggggguccggagcucgcuccccgcagcccaccccggccgccccgcccacccggccacccgccagccaaucagcgcuccccggccgcccgcgccucgcacacccccagcccgccccccgggcccgccagccgucggucuguccgcgccuccgucggccgcaucugcccggcucuccccgcuuuccccccgcgcccagucucucuccuccccccggcuggggucgcuacucccuggcuugcuccgcucuccgcggacccugccucaguuucccuccggagccucucugccggaaucccagggagucucccgguccccgcgggcucccuggggccugggucgaugggggucaccucccucccggcaccagucccugcgucccugccccugcucggucuccgcgucucgcucccucucggggcccugucuggcccgucccuccugcggcgccucugauuggcugccuccauccgcuccugucugugucucucucugcccaucuccuccgccgccuccugucuccgaagcugcucuccuccccggcugccugucuccgggucccucucugugcgacucagcggggucugcucccacccccgccgugggucccucuccucccugccucccuguccccuccacccuccccaugaaccaacuuacaguucauguccccacagggccagggguuccccagggcagggggcagggagccgggggccuuuaacccuucccuguccgcugccgggggagccccgagggucagcugggccgcggccuggggaggggaggcaugugcccugagcagcagggccgcggcagugagggaguguggacgccugggggguuauauagggggcuggggcgggcgggcggggggcaggcggcaggggagggcggccugacacauccugacucacccucccugccugccuuuuccauucagacggagcggcugccuugcagggcucacgccgccgcgcucggaggagggcacggaaggaaaaguuggaaaaguugaaaagggaaagggggggguggucggagaggggcuggugaggucauuggcguccccucccuccaccuccacgggccggagcagacacucaggcucaagcgcuggggcccgacuguggguggggguccggcuggaccaggacuagcagagagagauggggaggcaggaggacggaaaggcagagaaaggccggacggagggacaagacagg

SEQ ID NO: 19584 - RNA, 2514 nt, Homo sapiens
ccugucuugucccuccguccggccuuucucugccuuuccguccuccugccuccccaucucucucugcuaguccugguccagccggacccccacccacagucgggccccagcgcuugagccugagugucugcuccggcccguggagguggagggaggggacgccaaugaccucaccagccccucuccgaccaccccccccuuucccuuuucaacuuuuccaacuuuuccuuccgugcccuccuccgagcgcggcggcgugagcccugcaaggcagccgcuccgucugaauggaaaaggcaggcagggagggugagucaggaugugucaggccgcccuccccugccgccugccccccgcccgcccgccccagcccccuauauaaccccccaggcguccacacucccucacugccgcggcccugcugcucagggcacaugccuccccuccccaggccgcggcccagcugacccucggggcucccccggcagcggacagggaaggguuaaaggcccccggcucccugcccccugcccuggggaaccccuggcccuguggggacaugaacuguaaguugguucauggggaggguggaggggacagggaggcagggaggagagggacccacggcgggggugggagcagaccccgcugagucgcacagagagggacccggagacaggcagccggggaggagagcagcuucggagacaggaggcggcggaggagaugggcagagagagacacagacaggagcggauggaggcagccaaucagaggcgccgcaggagggacgggccagacagggccccgagagggagcgagacgcggagaccgagcaggggcagggacgcagggacuggugccgggagggaggugacccccaucgacccaggccccagggagcccgcggggaccgggagacucccugggauuccggcagagaggcuccggagggaaacugaggcaggguccgcggagagcggagcaagccagggaguagcgaccccagccggggggaggagagagacugggcgcggggggaaagcggggagagccgggcagaugcggccgacggaggcgcggacagaccgacggcuggcgggcccggggggcgggcugggggugugcgaggcgcgggcggccggggagcgcugauuggcuggcggguggccgggugggcggggcggccggggugggcugcggggagcgagcuccggacccccgcgccccccgcgccccccgcgccccccgccgccagcucucccgcucccgcggcccggccgggcccauggcucugccccucuccgcccaggugcgcugcggcccgggcuucugccgcccacccggcggggcuccugggagggcgucuaaggggucucccgugggagagguccgugucucccgggcuccguccuggcuucuggcuccuuccccugcucccagccagcucgggcucccgcggcccggggagggggcagguucuggccugugccucccccaccaugccccgccccggggcccagauuccggcguccgggggcggacgggagacgcccggcccgucuacccgccccgggccgcgucugcuccgacgggcggggcagccagagccagggagggagagggaagcccgccuggcccugcgaccugcccgcgggcguuccacccugggacuuaagaccuccagcuccauccucccuaaggccgggaguccaggccccagacccuccuccccgagacccaggaguccagaccccaggccuuccucccucagaccuaggaguccaggcccccagccucuccucccucagacccaggaggaguccagaccccaguuccuccucccucagacccgggaguccaggcccaggcccuccucucucagacccggaguccagccugagcucucugccuuauccugcccccagguguuugccgccugguccuggucgugcugagccuguggccagauacagcugucgccccugggccaccaccuggccccccucgaguuuccccagacccucgggccgagcuggacagcaccgugcuccugacccgcucucuccuggcggacacgcggcagcuggcugcacagcugguaggagagacugggcuggggccagcacaggagugagaggcagagaggaacggagaggagucugcgggcagccacuuggagggguucugggcucucagguggcagagugagggaggggaagaguugggggccuggcgugggggauggagggagccccgaggcugggcaggggccaccucacagcuuuuuucccugccagagggacaaauucccagcugacggggaccacaaccuggauucccugcccacccuggccaugagugcgggggcacugggagcucuacagguaagggcaagggagugggcuggggacaaggugggaggcaggcagugaagggggcggggaggaugaggggcacuggucggguguucucugaugucccggcucuauccccagcucccaggugugcuga

SEQ ID NO: 19585 - RNA, 2935 nt, Homo sapiens
cuguaaggggcuaucgcgcaagugcagacccucugcuucugccgcaaacggcgggccucaccuggacccggggacucuucaacgaggggcgcuagccuggcccgacugggcgaguccccgcgucccugcccguuccgucgcucaguuccacgacacgcuccccugccgccccgccuguucgcgggugggugggcgcuucccucggcuccccgugacacuuugcagacgcuccccggcgccgggcaugggcgccgccgccgucgguccccgagccggauuccgcgagcgggugggugagcgcggggggccucggccccucggaccccgggcacccgcgggcgggggaugguggccgcguuugcacccccgcccuagugcauguucccgcuggaaucguuccacgaccgcucccccucccacccgcgggacaaagggcgggggcggggggggcgcacccccacgcgugaccuuuccccguacugcgcacgcgcccagcccccaccaccgggggacgguccgcccgcccacgcgagugcgggggaggggugugggggccccgaagguagaggaggcagcgcgcacgggcuggaccuccuccuacccugggaaguuggggcaguuucccccugcaccugccucuuccuuaggccuggcaguggcccgcgaugagagaggguccuuccccuucaggcuaggugucccuggucaggcgaccccuuggggcacccagcaauuuagggcuucagcuuccuuuuccuucgauacccaggagcccacguccccagcucacuucucccccaggaccuaggcggcugggcccccugccccugacuccaggagcccaggaguuugaagcccaggcgcguuuugccucaguccugggguccaggcucccuccucccucagaccagggguccaggccagaaggucccuccugucucacuucaccucccccaggauggacccuccaguccaucugcgucucuccauuuguggcugccguuucuguccagugccccugaggcccucggcugcugggguccguaggaagccgcgccaugaaugaccggagcagucggaggcggacaagugaggaagcuggguccccuucccuacccugggucccagugcggucggcuccaggcugccgugguugggggguggccugagaggcccggggaauucucugggguaacccggggccucuccucuccagugaaggacgaugagaccuucgagaucuccauucccuucgaugaggcaccccaccuagacccacagaucuuuuacagucugagccccucucggagaaacuucgagggugagcugaggggguguggagggacuggagucagcugggaagccaagcccugagucccagggugugaccugguccccccacccucgcugugucccuagagccuccggaggcugcguccuccgcccuggcucugaugaacagcgucaagacccagcugcacauggcucuggagaggaacuccuggcugcagaagcgcaucgaggaccuggaggaagagagggacuuccugcggugccagcuggacaaauucaucucuucugcucggauggaggcagguguguguggggugcucugauccacaugccucccugucccgcuacuggguacccgcucacccagacucaaggcuccacuguuuggcuggcugggugggaccugccauguuggcccuaucugcuaguccccugccuguuuugggcccccaggcccagcugccuccucacuugauuccagggccucauccccaugaacugucuacuggggcccguccuccugccuucuccgucagcuccccaaaucccaucagccuccagugcccugccaucugcuuccuuggcccauggugacuucagggacccuggcaccugagagccccucucuucugacuccuagggggaccuuccuucaucucuuuggccaagaggcccacccuaguucuuuggguuuccucagggggccccugcuccuccucccgucccugucuucuccaagauccaagaguccagccauccggccuccuccugucccccccuccccucugugacaccaggggccaucuucccacccacccugucccauccuugguuaaugagcacuccuuccccaucaaagacauuaagucccuuccuuugugggccuuuuuggguggugaccccagcaggugcugucccucaaacccugccugauuccugggcaguccccacccacauaccuugcucugcuauaauucauggccagaagcagcccagauagcucccacagcagcacccagccccagccaguucacagcuagcgucuucucuugacuggugggacccugugcccuguuuaauacauuuuggaccccagccccauccucuuccccggauggucaggccguuugcccgacagcccauggccuggagaacccacacucuaccccaccuacccucaucucagccuugcuagcuccuuggcugggaagaccccucaaaagcucccacaucucucuuugugaauucaacccuuuccccaaaaauccuaggcaagggggcuauggucuuguggugucucuguuacuggaagcccagcaucuggggaucuggcuuucccucugcucgggaacaaaccaccucuggcugcccuugggccugccacugucuccucucacugaugguuccauccugggugacugacuccuuugcacagacaguuuggcccugcggcuucggcacuuucccaguggggacccuggcaccagagcccuccccuaacccgccuucuagaggaaucugugucugggccuccgccugccggcucccucugucuagauggaggugggacccagccugcuggacccagggccccugauuucucucggucugaccccccgacuccagccaaggccuugccugc

SEQ ID NO: 19586 - RNA, 2935 nt, Homo sapiens
gcaggcaaggccuuggcuggagucggggggucagaccgagagaaaucaggggcccuggguccagcaggcugggucccaccuccaucuagacagagggagccggcaggcggaggcccagacacagauuccucuagaaggcggguuaggggagggcucuggugccaggguccccacugggaaagugccgaagccgcagggccaaacugucugugcaaaggagucagucacccaggauggaaccaucagugagaggagacaguggcaggcccaagggcagccagaggugguuuguucccgagcagagggaaagccagauccccagaugcugggcuuccaguaacagagacaccacaagaccauagcccccuugccuaggauuuuuggggaaaggguugaauucacaaagagagaugugggagcuuuugaggggucuucccagccaaggagcuagcaaggcugagaugaggguaggugggguagaguguggguucuccaggccaugggcugucgggcaaacggccugaccauccggggaagaggauggggcugggguccaaaauguauuaaacagggcacagggucccaccagucaagagaagacgcuagcugugaacuggcuggggcugggugcugcugugggagcuaucugggcugcuucuggccaugaauuauagcagagcaagguauguggguggggacugcccaggaaucaggcaggguuugagggacagcaccugcuggggucaccacccaaaaaggcccacaaaggaagggacuuaaugucuuugauggggaaggagugcucauuaaccaaggaugggacagggugggugggaagauggccccuggugucacagaggggagggggggacaggaggaggccggauggcuggacucuuggaucuuggagaagacagggacgggaggaggagcaggggcccccugaggaaacccaaagaacuagggugggccucuuggccaaagagaugaaggaaggucccccuaggagucagaagagaggggcucucaggugccagggucccugaagucaccaugggccaaggaagcagauggcagggcacuggaggcugaugggauuuggggagcugacggagaaggcaggaggacgggccccaguagacaguucauggggaugaggcccuggaaucaagugaggaggcagcugggccugggggcccaaaacaggcaggggacuagcagauagggccaacauggcaggucccacccagccagccaaacaguggagccuugagucugggugagcggguacccaguagcgggacagggaggcauguggaucagagcaccccacacacaccugccuccauccgagcagaagagaugaauuuguccagcuggcaccgcaggaagucccucucuuccuccagguccucgaugcgcuucugcagccaggaguuccucuccagagccaugugcagcugggucuugacgcuguucaucagagccagggcggaggacgcagccuccggaggcucuagggacacagcgaggguggggggaccaggucacacccugggacucagggcuuggcuucccagcugacuccagucccuccacacccccucagcucacccucgaaguuucuccgagaggggcucagacuguaaaagaucugugggucuagguggggugccucaucgaagggaauggagaucucgaaggucucaucguccuucacuggagaggagaggccccggguuaccccagagaauuccccgggccucucaggccaccccccaaccacggcagccuggagccgaccgcacugggacccaggguagggaaggggacccagcuuccucacuuguccgccuccgacugcuccggucauucauggcgcggcuuccuacggaccccagcagccgagggccucaggggcacuggacagaaacggcagccacaaauggagagacgcagauggacuggaggguccauccugggggaggugaagugagacaggagggaccuucuggccuggaccccuggucugagggaggagggagccuggaccccaggacugaggcaaaacgcgccugggcuucaaacuccugggcuccuggagucaggggcagggggcccagccgccuagguccugggggagaagugagcuggggacgugggcuccuggguaucgaaggaaaaggaagcugaagcccuaaauugcugggugccccaaggggucgccugaccagggacaccuagccugaaggggaaggacccucucucaucgcgggccacugccaggccuaaggaagaggcaggugcagggggaaacugccccaacuucccaggguaggaggagguccagcccgugcgcgcugccuccucuaccuucggggcccccacaccccucccccgcacucgcgugggcgggcggaccgucccccgguggugggggcugggcgcgugcgcaguacggggaaaggucacgcgugggggugcgccccccccgcccccgcccuuugucccgcgggugggagggggagcggucguggaacgauuccagcgggaacaugcacuagggcgggggugcaaacgcggccaccaucccccgcccgcgggugcccgggguccgaggggccgaggccccccgcgcucacccacccgcucgcggaauccggcucggggaccgacggcggcggcgcccaugcccggcgccggggagcgucugcaaagugucacggggagccgagggaagcgcccacccacccgcgaacaggcggggcggcaggggagcgugucguggaacugagcgacggaacgggcagggacgcggggacucgcccagucgggccaggcuagcgccccucguugaagaguccccggguccaggugaggcccgccguuugcggcagaagcagagggucugcacuugcgcgauagccccuuacag

SEQ ID NO: 19587 - RNA, 3214 nt, Homo sapiens
cccuccccgcccgucucccuucccuguccaggcggugaaaaccgaguuagggugggccgacugcaguaaagaugcuccuccccaccuccaccucuuccuagggcucccgccuucuccagguccagaaagaaccccaagccccguccaucgggacacgcccccagguacaccgaggggcacgcccccuuagaaaccccgccccggaccccuccccuucggucgcgccucugcaggccccgccuccgucgucggguccccacuggaaggcgcccucugugcaucucuuugucucucuggccgccucugccuccaucucugugugucugcgucuucgucccugucucugaguuucggcuugggugucucucuccuaccccggucucucuguguccugucugucucugccucuccugucccucucuccgcagcgcccuccccgucucugucucucugagucccuagcucgcuccuucucuaaaucugugucccuauagcccccugcgucucucugacucucccugcaucucccuccccugucugugaauuucucuguguccaucuucuguccucucccuccggucccuggcucccugccgugcuuccucuggucccgagucuccccuucaucucccgccuggcccuccucccuguggccaccuccucccugcggccucucggggcagggugggcgccugggcgugcugcgcgcgcccucauguggccggcagacgcugcgugugagcgccaaaaggggagugcuggggagcgggggacgcugguguucgcggugacacugggaaauggcgugugacaccuggaggcugugugaguguguacugccgggagacggcgugagacaucuggagagugugugaguguguacugccgugauggugugugacuccaggagaucugugaguguguacugcugugagaugguguacgacgccaggaaacugugugagugucgacugccgugagauggugugcagugccaggaccaggacaccaugaguguguacugccaugaugguguacuggugagaugguguguggugcugggagucugugugugacugauugauaugagauuaugugcgacaaggagagacugagugggacugcauaugucagagaugacaugucgcugacugugugugacacugagauuacuggugaugcugagagauugugggugacugugugugcugaugaaagguuaugugugaucgggugugggagagacacucuuuggggcucuguaugggacauugagagaccguaugugggagugagagaccgugugugacggugcgugugagggggcaguguguguggcugugugcaacauggugagcauacggugcugugugugucacacaaguagauucugugugagagagagugagacugaugacugauguacacugagagguggugugggcaggugucaugagaggcacauagggggccugggugggacagacacagugagugucagucuguguuggccacucuguguauggcuugugaaaaagugcgugauccgggcacauugcuguaaucccagcacuuuggguggcugaggcgggaggaucccuugaggccaggaguuugagaucagccugggcaacauagggagaccccuccccccacccccgccgucucuaccaaaauaaaaauaaaagaaauuaaccaggugcgguuauguaccucuguggucccagcuacugggaggcugagguuggaggaucgcuugagccugggaaguggaggcugcagugagcuaagaucgcgccacugcacuccagccugggugacagagagagagaccuugucucaaaaaacaaaacaaaacugcgugacuaugugugacacugagcuggugagagauggcagcguugugacagugcaugcgagaguuugcggcugugcagggcacucggaagcgagagcgugagggaggccuuguguguagaaggcaagagaugauggagaggugggagugagugugugaaacgcugcgagcuugugugggacucugugagacacugagccaucguggguagcuagguaugacaccaggagauggguugcgugcgugugugugacagggacagacuguguauggagggaaugugucagaugcgugugacaccaggagacugugagagaauguaugugaccuuccaugguugucacuggacaggcgacuggguguuacuaugaaauacuauaaaacaguguguacuugacagguuguauuggguaauugcaugccaccgugagacacagaaagugugagacugggacagggugugagauugagagaguuuaaauggcaugcaaggccaggcgcgguggcucacgccuguaaucccagcacuuugggaggccgaggcggguggaugaccugaggucaggaguucaagaccagccuggccaacauugugagacccugucucuacgaaaaauacaaaaaucagacgggcguggugucaggcaccuguaaucccagcuacucaggaggcugaggcaggagaauggcuugaacccaggaggcggagguugcagugagcugagauugggccacugcacuccagccugggcaacacagcgagacuucaucucaaaaaaaaaaaaaaaaaaaggcaugcaaaugugugugacauuuggagacauuaugugugacacugugguacauuuggugcucugagauaauuuaucugacuguguagcgcuuggagcugccauugguggcggcuguguguggcauuuggggcaaccgugugagguuguguugagcaaggucauucgugagguuguguggugcuaccgugugacagggcaagauaguuuuugucugugugagggacagugagcaugaggcuggagggggguggugacaccgagguggcgaguguggcugagugagcggcucugugggacacacuggagagguuuguugugacuguggauuaaauguagcgaggcccggggcccaccuagagagacuguguuuucuagugagugugagagaggcacagagagagucacacaauaggacagcagcggcagagacacagggagagggacaaagauaggacugacagacaagagagagggcccagagagggagccccaagguggcggggcggcggggacgguggcuccgggaggaggcggguccguaggggcugcgccccaggggagg

SEQ ID NO: 19588 - RNA, 3214 nt, Homo sapiens
ccuccccuggggcgcagccccuacggacccgccuccucccggagccaccguccccgccgccccgccaccuuggggcucccucucugggcccucucucuugucugucaguccuaucuuugucccucucccugugucucugccgcugcuguccuauugugugacucucucugugccucucucacacucacuagaaaacacagucucucuaggugggccccgggccucgcuacauuuaauccacagucacaacaaaccucuccagugugucccacagagccgcucacucagccacacucgccaccucggugucaccaccccccuccagccucaugcucacugucccucacacagacaaaaacuaucuugcccugucacacgguagcaccacacaaccucacgaaugaccuugcucaacacaaccucacacgguugccccaaaugccacacacagccgccaccaauggcagcuccaagcgcuacacagucagauaaauuaucucagagcaccaaauguaccacagugucacacauaaugucuccaaaugucacacacauuugcaugccuuuuuuuuuuuuuuuuuuugagaugaagucucgcuguguugcccaggcuggagugcaguggcccaaucucagcucacugcaaccuccgccuccuggguucaagccauucuccugccucagccuccugaguagcugggauuacaggugccugacaccacgcccgucugauuuuuguauuuuucguagagacagggucucacaauguuggccaggcuggucuugaacuccugaccucaggucauccacccgccucggccucccaaagugcugggauuacaggcgugagccaccgcgccuggccuugcaugccauuuaaacucucucaaucucacacccugucccagucucacacuuucugugucucacgguggcaugcaauuacccaauacaaccugucaaguacacacuguuuuauaguauuucauaguaacacccagucgccuguccagugacaaccauggaaggucacauacauucucucacagucuccuggugucacacgcaucugacacauucccuccauacacagucugucccugucacacacacgcacgcaacccaucuccuggugucauaccuagcuacccacgauggcucagugucucacagagucccacacaagcucgcagcguuucacacacucacucccaccucuccaucaucucuugccuucuacacacaaggccucccucacgcucucgcuuccgagugcccugcacagccgcaaacucucgcaugcacugucacaacgcugccaucucucaccagcucagugucacacauagucacgcaguuuuguuuuguuuuuugagacaaggucucucucucugucacccaggcuggagugcaguggcgcgaucuuagcucacugcagccuccacuucccaggcucaagcgauccuccaaccucagccucccaguagcugggaccacagagguacauaaccgcaccugguuaauuucuuuuauuuuuauuuugguagagacggcggggguggggggaggggucucccuauguugcccaggcugaucucaaacuccuggccucaagggauccucccgccucagccacccaaagugcugggauuacagcaaugugcccggaucacgcacuuuuucacaagccauacacagaguggccaacacagacugacacucacugugucugucccacccaggcccccuaugugccucucaugacaccugcccacaccaccucucaguguacaucagucaucagucucacucucucucacacagaaucuacuugugugacacacacagcaccguaugcucaccauguugcacacagccacacacacugcccccucacacgcaccgucacacacggucucucacucccacauacggucucucaaugucccauacagagccccaaagagugucucucccacacccgaucacacauaaccuuucaucagcacacacagucacccacaaucucucagcaucaccaguaaucucagugucacacacagucagcgacaugucaucucugacauaugcagucccacucagucucuccuugucgcacauaaucucauaucaaucagucacacacagacucccagcaccacacaccaucucaccaguacaccaucauggcaguacacacucaugguguccugguccuggcacugcacaccaucucacggcagucgacacucacacaguuuccuggcgucguacaccaucucacagcaguacacacucacagaucuccuggagucacacaccaucacggcaguacacacucacacacucuccagaugucucacgccgucucccggcaguacacacucacacagccuccaggugucacacgccauuucccagugucaccgcgaacaccagcgucccccgcuccccagcacuccccuuuuggcgcucacacgcagcgucugccggccacaugagggcgcgcgcagcacgcccaggcgcccacccugccccgagaggccgcagggaggagguggccacagggaggagggccaggcgggagaugaaggggagacucgggaccagaggaagcacggcagggagccagggaccggagggagaggacagaagauggacacagagaaauucacagacaggggagggagaugcagggagagucagagagacgcagggggcuauagggacacagauuuagagaaggagcgagcuagggacucagagagacagagacggggagggcgcugcggagagagggacaggagaggcagagacagacaggacacagagagaccgggguaggagagagacacccaagccgaaacucagagacagggacgaagacgcagacacacagagauggaggcagaggcggccagagagacaaagagaugcacagagggcgccuuccaguggggacccgacgacggaggcggggccugcagaggcgcgaccgaaggggagggguccggggcgggguuucuaagggggcgugccccucgguguaccugggggcgugucccgauggacggggcuugggguucuuucuggaccuggagaaggcgggagcccuaggaagagguggagguggggaggagcaucuuuacugcagucggcccacccuaacucgguuuucaccgccuggacagggaagggagacgggcggggaggg

SEQ ID NO: 19589 - RNA, 3638 nt, Homo sapiens
cagaggccacccugagacagcccaggccaagaccaccccacugaagccuggucaacugugcucuucaggucccuccuagaggcccccuacuaccccgggaggcuccaagccuaagugauggugacucaggaauuccccacccaggccagagagggagacacugggggagggaggagaccuguguguggggagguggcagguggcucagugaugggaaccaagagaggauguggggaggagaguggaggcagcgaugggagauggauguccuggauugggcggguggacggggaguggggagugugccagggggcccucuggagaacagugagggagggcggggcagagagaggaaaugaaaaagcuggggugagcaggcaagcugaggagggugggaaggagggagggacggagggaggagggaaggagaagcugacacacagaccgacacaggcagcgagagacacgaggagcaaagcaagugaaggcacagacgcacgggacaggagagccugggcaagacuggagaggugcggugaggggcuggggaugcagcaacacagagcaggagcagguagagggugugggguuagagggagaaagguacggggaggacaaggacaagggaggggacagagacagggagauaucagcaagagaccgagagacagggagggaaagaacuggcaaugcccggauguucucugucucuuuaauggcagaaacagagcuagagaaggaaagaaacaggaggugguggggggguggugggugucaggcaugguggcucacaccuguaaucucagcacuuugggaagccaagguggauggaucaccugaggucaggaguucgagaccagccugaccaacaugguggaaccccgucucuacugaaaauacaaaaauuagcugggcgugguaguggacgccuguaaucucaucuacuccagaggcuggggcaggagaaucgcuugaacccaggagguggagguugcagugagccgagaucaugccauugcucuccauccuggacaacagagugagacucugucucaaaagaaacgaaagaaaagaaagagagaaagagaaacaggaagguggggagagacagagagagauacuggagaagccagaggggagaggacugcauacccgcacacacaggagaacuggggguuggcugggaggccccagcugccaaaaggacuggccagcagggacaucugagugggcugggugguggggguagcccuggcucccucugaccccccaccuugggaacccuccagcccagaccugggauggcggauucgugcaggaaccucaccuacgugcggggcucgguggggccggccaccagcacccugauguucguggccgguguggugggcaacgggcuggcccugggcauccugagcgcacggcgaccggcgcgccccucggccuucgcggugcuggugaccggacuggcggccaccgaccugcugggcaccagcuuccugagcccggccguguucguggccuaugcgcgcaacagcucccugcugggccuggcccgaggcggccccgcccugugcgaugccuucgccuucgccaugaccuucuucggccuggcguccaugcucauccucuuugccauggccguggagcgcugccuggcgcugagccaccccuaccucuacgcgcagcuggacgggccccgcugcgcccgccuggcgcugccagccaucuacgccuucugcguccucuucugcgcgcugccccugcugggccugggccaacaccagcaguacugccccggcagcuggugcuuccuccgcaugcgcugggcccagccgggcggcgccgccuucucgcuggccuacgccggccugguggcccugcugguggcugccaucuuccucugcaacggcucggucacccucagccucugccgcauguaccgccagcagaagcgccaccagggcucucuggguccacggccgcgcaccggagaggacgagguggaccaccugauccugcuggcccucaugacaguggucauggccgugugcucccugccucucacggugaguccccuccggagcugggaggaguggggagaggaggagggcagcucuguggguugugcccaugucacagauggggagacugaggcucaaaagaggugagacaucgugggcaugguggcucacgccuguaaucccagcauguagaaaggccgaggcaggaccggaugcgguggcucacaccuguaaucccagcacuuugggaggccgaggccggcggaucauuugaggucaggaguucgagaccagucuggccaacaugaugaaacccugucucuacuaaaaauacaacaaauaaauaaauaaaaaguagccggacguaguggcacaugccugaagucccagcuacuugggaggcugagccaggagaaucgcuugaaccccggaggcggagguugcagugagcugagaucgugccacugcacuauagccugggugacagagugagaccccgucccaaaaaaaaaaaaaaaaaaauaagaaaaaaaagaaaaagaaaggcgaggcaggacgaucacuugagcccagagguuugagaccagccugggcaacauggugaaaccccaucucuaugaaacauuuaaaaauuagccuggcaugauggccugugccuguggucucagcuacuugugaggcugaggugggaggauugcuccggccugggagguugaggcugcagugagcugugauuauaccacugcaucccagccuagcugacagagcaagaccuugucucaaaacaaaaacaaagaaaacaaaaacaaaucagacagaggcuugguccucagucagacagcuccuggcuuucuggaggggucuuucugcaucugacuucuucugauaccuugucucccagcuuaggcauccugagccccccaugaugaaaugcaucccccauccuuccccaccccuguaaugacaagaccaccacucauugagcacuucucuaugcccgccccgugcuuaguggcuuacagauacuuccuaagauaauuuucaaaaugaucauagccacccauuccacaguauuuggcaggaaaccaagagaacguucucucccauccccguuuuuacagaugaggggcagugucuuucgcccagucacacagagccagguccugguccuggguccuuccauuguagagccugaucucccaccuaccuggcuccccucugccucagagcaggccccacccuugccucugcaccucgguuuccugcggggaccccguccugccccuccccaaugggaguggcacagacccugguacccacucagugucugugacaccuggucgugccaccuuucuucugagcuucaguuucuguuucuguaaaaugcaagaggccaggccggauugggggguccuuaaaucuuuuuuggggguuacucugacucagagacucagaugccguggacagauacacacaggcaccaccgcagcucugcggcaguuucagggggcccagccggguggcgccaccuucuugcagggacguuauacucaaaaaucuguggagcccgaggguccucccagcuuccaaggguggggggacccacauaccugg

SEQ ID NO: 19590 - RNA, 3638 nt, Homo sapiens
ccagguauguggguccccccacccuuggaagcugggaggacccucgggcuccacagauuuuugaguauaacgucccugcaagaagguggcgccacccggcugggcccccugaaacugccgcagagcugcgguggugccuguguguaucuguccacggcaucugagucucugagucagaguaacccccaaaaaagauuuaaggaccccccaauccggccuggccucuugcauuuuacagaaacagaaacugaagcucagaagaaagguggcacgaccaggugucacagacacugaguggguaccagggucugugccacucccauuggggaggggcaggacgggguccccgcaggaaaccgaggugcagaggcaaggguggggccugcucugaggcagaggggagccagguaggugggagaucaggcucuacaauggaaggacccaggaccaggaccuggcucugugugacugggcgaaagacacugccccucaucuguaaaaacggggaugggagagaacguucucuugguuuccugccaaauacuguggaauggguggcuaugaucauuuugaaaauuaucuuaggaaguaucuguaagccacuaagcacggggcgggcauagagaagugcucaaugagugguggucuugucauuacagggguggggaaggaugggggaugcauuucaucauggggggcucaggaugccuaagcugggagacaagguaucagaagaagucagaugcagaaagaccccuccagaaagccaggagcugucugacugaggaccaagccucugucugauuuguuuuuguuuucuuuguuuuuguuuugagacaaggucuugcucugucagcuaggcugggaugcagugguauaaucacagcucacugcagccucaaccucccaggccggagcaauccucccaccucagccucacaaguagcugagaccacaggcacaggccaucaugccaggcuaauuuuuaaauguuucauagagaugggguuucaccauguugcccaggcuggucucaaaccucugggcucaagugaucguccugccucgccuuucuuuuucuuuuuuuucuuauuuuuuuuuuuuuuuuuuugggacggggucucacucugucacccaggcuauagugcaguggcacgaucucagcucacugcaaccuccgccuccgggguucaagcgauucuccuggcucagccucccaaguagcugggacuucaggcaugugccacuacguccggcuacuuuuuauuuauuuauuuguuguauuuuuaguagagacaggguuucaucauguuggccagacuggucucgaacuccugaccucaaaugauccgccggccucggccucccaaagugcugggauuacaggugugagccaccgcauccgguccugccucggccuuucuacaugcugggauuacaggcgugagccaccaugcccacgaugucucaccucuuuugagccucagucuccccaucugugacaugggcacaacccacagagcugcccuccuccucuccccacuccucccagcuccggaggggacucaccgugagaggcagggagcacacggccaugaccacugucaugagggccagcaggaucaggugguccaccucguccucuccggugcgcggccguggacccagagagcccugguggcgcuucugcuggcgguacaugcggcagaggcugagggugaccgagccguugcagaggaagauggcagccaccagcagggccaccaggccggcguaggccagcgagaaggcggcgccgcccggcugggcccagcgcaugcggaggaagcaccagcugccggggcaguacugcugguguuggcccaggcccagcaggggcagcgcgcagaagaggacgcagaaggcguagauggcuggcagcgccaggcgggcgcagcggggcccguccagcugcgcguagagguagggguggcucagcgccaggcagcgcuccacggccauggcaaagaggaugagcauggacgccaggccgaagaaggucauggcgaaggcgaaggcaucgcacagggcggggccgccucgggccaggcccagcagggagcuguugcgcgcauaggccacgaacacggccgggcucaggaagcuggugcccagcaggucgguggccgccaguccggucaccagcaccgcgaaggccgaggggcgcgccggucgccgugcgcucaggaugcccagggccagcccguugcccaccacaccggccacgaacaucagggugcugguggccggccccaccgagccccgcacguaggugagguuccugcacgaauccgccaucccaggucugggcuggaggguucccaagguggggggucagagggagccagggcuacccccaccacccagcccacucagaugucccugcuggccaguccuuuuggcagcuggggccucccagccaacccccaguucuccugugugugcggguaugcaguccucuccccucuggcuucuccaguaucucucucugucucuccccaccuuccuguuucucuuucucucuuucuuuucuuucguuucuuuugagacagagucucacucuguuguccaggauggagagcaauggcaugaucucggcucacugcaaccuccaccuccuggguucaagcgauucuccugccccagccucuggaguagaugagauuacaggcguccacuaccacgcccagcuaauuuuuguauuuucaguagagacgggguuccaccauguuggucaggcuggucucgaacuccugaccucaggugauccauccaccuuggcuucccaaagugcugagauuacaggugugagccaccaugccugacacccaccacccccccaccaccuccuguuucuuuccuucucuagcucuguuucugccauuaaagagacagagaacauccgggcauugccaguucuuucccucccugucucucggucucuugcugauaucucccugucucuguccccucccuuguccuuguccuccccguaccuuucucccucuaaccccacacccucuaccugcuccugcucuguguugcugcauccccagccccucaccgcaccucuccagucuugcccaggcucuccugucccgugcgucugugccuucacuugcuuugcuccucgugucucucgcugccugugucggucugugugucagcuucuccuucccuccucccuccgucccucccuccuucccacccuccucagcuugccugcucaccccagcuuuuucauuuccucucucugccccgcccucccucacuguucuccagagggcccccuggcacacuccccacuccccguccacccgcccaauccaggacauccaucucccaucgcugccuccacucuccuccccacauccucucuugguucccaucacugagccaccugccaccuccccacacacaggucuccucccucccccagugucucccucucuggccuggguggggaauuccugagucaccaucacuuaggcuuggagccucccgggguaguagggggccucuaggagggaccugaagagcacaguugaccaggcuucagugggguggucuuggccugggcugucucaggguggccucug

SEQ ID NO: 19591 - RNA, 2041 nt, Homo sapiens
acgccuccaccccacccacacaguugucaaggagacaaagcgcuucccuucagcgcugucucccuccccuuugguuagagggcagggugggcuggaagacuguccgaaagguuggguacuggcgcgcucccagcaucucucccauccaagcucgcaacgccugcgccgagacccgguaccggguacaacccgaggcacgcgcaugcgcgcgauggaguuuuugcgcgugcgccguuguggccccaggaagcugggguacccgcgcggcgcuaacguugcggcugcgcaguugcggccugcugguggggcucggcggagcgcaguucugcgccugcgcugugcugggguaggugggaaugaaacccuggcgguaagggcauuggggccgacuggcccugggcgcgccugcgccuuggcaugcggggcggccggaggcggggccgaaagaggggagggagggaggcggggggugggaacaggccgcagaagcccgagcccugacccaccggcggcugcggcggagccggugagugacccguggcccgacucgguccccacccuccgcgaccuucgcucucccugccgucccccguagccuccguugucuccuugugauacgggacccccguuauuuccagagcuccccuuaauuucuggcaauccccagagcccccacaauccucgcagacccugaucccuaauauuugaucguuccagcucuuccagugauacaggagcucccaccucaccauuauuccuggacaucccucuaagggcccuucucauaucggucuuacagacgccccguugcccccuagagccccuagagcgccuccucugcuccagauuccccccuucuugcugcauccccccuuccgcaucuccuuaucuucaugcaucuaagacccccccgaggcacccccauccucccuccauuuccuauccucccgugcccccauucucuaacuccugcagacaccuccucuccucgcacuuuuccuccuuuccuuccaucccuccagacccucccccaauuucuaucaacucuucagcguggcacuucgcgccgcgcgaaguccgagccaagcgcucagccggugucagcuacucuuaggcgcuuccgacuuacccgggugcccgucgcccccgcccgccccccgcccccacuccugcccccggggacuaaggagcucucggcccggcggucugggagaggcggcggcggggggaccccgaaccccagccagccccgugcgcccuuugcccgcagcgccggcgccccccaugcgccagacggcaggacggcggcgucggggggcgccauggccucggcggcggcgggcgaagcggaggaaaccacccgguugcgcaagccgcgcuucucauucgaagagaaccagauccugauccgcgaggugcgcgcccacuacccgcagcucuacggcgcgcagagccgucgggugagcguggcagagcggcggcgcgugugggacggcaucgccgccaagaucaacgguaucaccagcuggaagcgcacgggccaggaggugcagaagcgcuggaacgacuucaagcgccgcaccaaggagaagcucgcucgcgugccgcacuccacgcagggcgccgggcccgccgcggaggacgcuuucuccgcggaagaggagaccauuuuugccauccuggggccagguguggcggcgccgggggcaggugcuggggcggaggagcccccugcggcccccucuucacagccgccgcccccaagcgccugcccucagcgcuacguguugucggaagaccgccgggaggaccgacgugcaggugagugucuucagaguaggcugugugccugcgcuguugcaagccuuuuacaugucucaucaaagccuugcugcagcccugugagguggaugcuguccuucgccccauuuuauagcuagggaaacugaagcucagaaaaaugaaaugacuugccucaguuccgauagcuaguaacugucaagagccaggaauggaaccagauuuaggaggccugacucag

SEQ ID NO: 19592 - RNA, 2041 nt, Homo sapiens
cugagucaggccuccuaaaucugguuccauuccuggcucuugacaguuacuagcuaucggaacugaggcaagucauuucauuuuucugagcuucaguuucccuagcuauaaaauggggcgaaggacagcauccaccucacagggcugcagcaaggcuuugaugagacauguaaaaggcuugcaacagcgcaggcacacagccuacucugaagacacucaccugcacgucgguccucccggcggucuuccgacaacacguagcgcugagggcaggcgcuugggggcggcggcugugaagagggggccgcagggggcuccuccgccccagcaccugcccccggcgccgccacaccuggccccaggauggcaaaaauggucuccucuuccgcggagaaagcguccuccgcggcgggcccggcgcccugcguggagugcggcacgcgagcgagcuucuccuuggugcggcgcuugaagucguuccagcgcuucugcaccuccuggcccgugcgcuuccagcuggugauaccguugaucuuggcggcgaugccgucccacacgcgccgccgcucugccacgcucacccgacggcucugcgcgccguagagcugcggguagugggcgcgcaccucgcggaucaggaucugguucucuucgaaugagaagcgcggcuugcgcaaccgggugguuuccuccgcuucgcccgccgccgccgaggccauggcgccccccgacgccgccguccugccgucuggcgcauggggggcgccggcgcugcgggcaaagggcgcacggggcuggcugggguucgggguccccccgccgccgccucucccagaccgccgggccgagagcuccuuaguccccgggggcaggagugggggcggggggcgggcgggggcgacgggcacccggguaagucggaagcgccuaagaguagcugacaccggcugagcgcuuggcucggacuucgcgcggcgcgaagugccacgcugaagaguugauagaaauugggggagggucuggagggauggaaggaaaggaggaaaagugcgaggagaggaggugucugcaggaguuagagaaugggggcacgggaggauaggaaauggagggaggaugggggugccucgggggggucuuagaugcaugaagauaaggagaugcggaaggggggaugcagcaagaaggggggaaucuggagcagaggaggcgcucuaggggcucuagggggcaacggggcgucuguaagaccgauaugagaagggcccuuagagggauguccaggaauaauggugaggugggagcuccuguaucacuggaagagcuggaacgaucaaauauuagggaucagggucugcgaggauugugggggcucuggggauugccagaaauuaaggggagcucuggaaauaacgggggucccguaucacaaggagacaacggaggcuacgggggacggcagggagagcgaaggucgcggaggguggggaccgagucgggccacgggucacucaccggcuccgccgcagccgccggugggucagggcucgggcuucugcggccuguucccaccccccgccucccucccuccccucuuucggccccgccuccggccgccccgcaugccaaggcgcaggcgcgcccagggccagucggccccaaugcccuuaccgccaggguuucauucccaccuaccccagcacagcgcaggcgcagaacugcgcuccgccgagccccaccagcaggccgcaacugcgcagccgcaacguuagcgccgcgcggguaccccagcuuccuggggccacaacggcgcacgcgcaaaaacuccaucgcgcgcaugcgcgugccucggguuguacccgguaccgggucucggcgcaggcguugcgagcuuggaugggagagaugcugggagcgcgccaguacccaaccuuucggacagucuuccagcccacccugcccucuaaccaaaggggagggagacagcgcugaagggaagcgcuuugucuccuugacaacugugugggugggguggaggcgu

SEQ ID NO: 19593 - RNA, 2641 nt, Homo sapiens
ccaccgagcgucgagaagagggggcugggcuggcagcgcgcgcggccauccuccuuccacugcgccugcgcacgccacgcgcauccgcuccugggacgcaagcucgagaaaaguugcugcaaacuuucuagcccguuccccgccccuccucccggccagacccgcccccccugcggagccgggaauuccgaggggcggagcgcaggccgagauggggaaugugggggccugcagaggacccuggagacggaggcgugcagaagcucagucucggggcggaggcuucgcgcccuuaguccuccuggacggcccguuaccuucugcguugucccgauggggaaacugaggcccugagccagaagcacacgcuggggggaggcagaaagcgcggccagaggcggagggaaaacaaagggagaaucacagacagacgggagggggacggacacacacaaggggacagagacccgaguggagagcuggaucucgccuucccggcguggggcgcagggucggccagaaagaagaucgagaagagcggggagugggggcgaaaaggggggacaggugggggaggaggcuggggaaagcccgagggaggaagagagggagggaggaacuucccaaaguugcaaaacauggcuaccuugccugcggagccgagcgcggggccggcggcugggggggaggcgguggcggcggcggcggcgaccgaagaggaggaggaggaagcgcgccagcucuugcagacuuugcaggcggccgagggugaggcggcggcggcggccggggccggggcgggcgcagcggcugcgggagcugagggcccgggauccccgggcguccccgggucgccccccgaggccgcuuccgaaccgcccacgggccuccgcuucucgcccgagcagguggcgugcgucugcgaggcgcugcuccaggcgggccacgccggccgcuugagccgcuuccugggcgcacugcccccggccgagcgccuacguggcagcgacccgguguugcgcgcgcgggcccugguggccuuccagcggggcgaguacgccgagcucuaccggcuacucgagagccgccccuuccccgccgcccaccacgccuuccugcaggaccucuaccugcgcgcgcgcuaccaugaggccgagcgggcccgcggccgcgcgcuuggcgcaguggacaaguaucgacugcgcaagaaguucccgcugcccaagaccaucugggacggcgaggagacagucuacugcuucaaggagcgcucccgcgcagcgcucaaggccugcuaccgcggcaaccgcuaccccacgccggacgagaagcgccgccuggccacacucaccggccugucgcucacgcaggucagcaacugguucaagaaccggcgacagcgcgaccggaccggggccggaggcggcgcgcccugcaagaggugaggggccucgggcggcgcaaguccagcucucccggggacaucccguccaccagcccucuucccccgugcccacugcuggggccggcgcgccgagguccucggacaucucccgggaccagcucacaaucucaggcgcccgcggggcgcggggacuaaguguggacgggacaggcacccgcccgggcccucuccccgcacgcgucuccucuuccagcggcuccauuccgagcuccuucccaaaucccaucgguguuggggaaucacacugcggggggcacuagagggacugaggaaaaaggacagggccuguggccacuccacuccgcguaggggcugccucccagcccccuuucuucacugaccguuacucuuacccacccgcccccacacucccuccgggcccggacggcgugguccgucuucugccuuuguugugaaacgugaaccuuucccagcuccgguuucccuguaacccaaacccuucuccucccacccugagcgccggccucucccuucucugacgccccgcggggagggcaccgggaacugggcuggcggcugcugcucccucucuccaggccacucgcccgcuuuccgcccaaccaaggaacuuuuagggcaaccugggagcucagccucuggggacccgaggccgaggugggggagagcaagggccucuucccuccccagcgcuucucugcagugguguccacgcagggcuugcaaaaggcccuggaguuuggaguggucucagagaggcgucauaaccccuggaaugauccaccgaaacuugggccagggaaaggugggggagcagcuggcuggcuaugcgggaggccccacaggcuaagggaccccagcugacagccauuucuccggccagcgagucugaugggaaucccacgacugaggacgaguccagccgaaguccugaggaccuggagagaggggcggccccaguguccgccgaggccgcugcccagggcuccauauuccuggcagggaccggcccucccgcgccuugcccggcuuccuccuccauccuggugaacgggagcuuccuggcagccagcggcuccccagcagugcuccucaacgggggccccgucaucaucaacggccuggcccugggcgaggccuccagccugggcccgcugcugcucacugggggcgggggugccccuccaccgcagccca

SEQ ID NO: 19594 - RNA, 2641 nt, Homo sapiens
ugggcugcgguggaggggcacccccgcccccagugagcagcagcgggcccaggcuggaggccucgcccagggccaggccguugaugaugacggggcccccguugaggagcacugcuggggagccgcuggcugccaggaagcucccguucaccaggauggaggaggaagccgggcaaggcgcgggagggccggucccugccaggaauauggagcccugggcagcggccucggcggacacuggggccgccccucucuccagguccucaggacuucggcuggacucguccucagucgugggauucccaucagacucgcuggccggagaaauggcugucagcuggggucccuuagccuguggggccucccgcauagccagccagcugcucccccaccuuucccuggcccaaguuucgguggaucauuccagggguuaugacgccucucugagaccacuccaaacuccagggccuuuugcaagcccugcguggacaccacugcagagaagcgcuggggagggaagaggcccuugcucucccccaccucggccucggguccccagaggcugagcucccagguugcccuaaaaguuccuugguugggcggaaagcgggcgaguggccuggagagagggagcagcagccgccagcccaguucccggugcccuccccgcggggcgucagagaagggagaggccggcgcucagggugggaggagaaggguuuggguuacagggaaaccggagcugggaaagguucacguuucacaacaaaggcagaagacggaccacgccguccgggcccggagggagugugggggcggguggguaagaguaacggucagugaagaaagggggcugggaggcagccccuacgcggaguggaguggccacaggcccuguccuuuuuccucagucccucuagugccccccgcagugugauuccccaacaccgaugggauuugggaaggagcucggaauggagccgcuggaagaggagacgcgugcggggagagggcccgggcgggugccugucccguccacacuuaguccccgcgccccgcgggcgccugagauugugagcuggucccgggagauguccgaggaccucggcgcgccggccccagcagugggcacgggggaagagggcugguggacgggauguccccgggagagcuggacuugcgccgcccgaggccccucaccucuugcagggcgcgccgccuccggccccgguccggucgcgcugucgccgguucuugaaccaguugcugaccugcgugagcgacaggccggugaguguggccaggcggcgcuucucguccggcgugggguagcgguugccgcgguagcaggccuugagcgcugcgcgggagcgcuccuugaagcaguagacugucuccucgccgucccagauggucuugggcagcgggaacuucuugcgcagucgauacuuguccacugcgccaagcgcgcggccgcgggcccgcucggccucaugguagcgcgcgcgcagguagagguccugcaggaaggcguggugggcggcggggaaggggcggcucucgaguagccgguagagcucggcguacucgccccgcuggaaggccaccagggcccgcgcgcgcaacaccgggucgcugccacguaggcgcucggccgggggcagugcgcccaggaagcggcucaagcggccggcguggcccgccuggagcagcgccucgcagacgcacgccaccugcucgggcgagaagcggaggcccgugggcgguucggaagcggccucggggggcgacccggggacgcccggggaucccgggcccucagcucccgcagccgcugcgcccgccccggccccggccgccgccgccgccucacccucggccgccugcaaagucugcaagagcuggcgcgcuuccuccuccuccucuucggucgccgccgccgccgccaccgccucccccccagccgccggccccgcgcucggcuccgcaggcaagguagccauguuuugcaacuuugggaaguuccucccucccucucuuccucccucgggcuuuccccagccuccucccccaccuguccccccuuuucgcccccacuccccgcucuucucgaucuucuuucuggccgacccugcgccccacgccgggaaggcgagauccagcucuccacucgggucucuguccccuuguguguguccgucccccucccgucugucugugauucucccuuuguuuucccuccgccucuggccgcgcuuucugccuccccccagcgugugcuucuggcucagggccucaguuuccccaucgggacaacgcagaagguaacgggccguccaggaggacuaagggcgcgaagccuccgccccgagacugagcuucugcacgccuccgucuccaggguccucugcaggcccccacauuccccaucucggccugcgcuccgccccucggaauucccggcuccgcagggggggcgggucuggccgggaggaggggcggggaacgggcuagaaaguuugcagcaacuuuucucgagcuugcgucccaggagcggaugcgcguggcgugcgcaggcgcaguggaaggaggauggccgcgcgcgcugccagcccagcccccucuucucgacgcucggugg

SEQ ID NO: 19595 - RNA, 4138 nt, Homo sapiens
ugguggaaaaggacggggaagacagggaacuuccuuacucucggaucuucaguucccgcgccaucuggcagagggcgcagggcagacaaaaggugagggccgcccagucgugcccgacggagcccuagaggguaggagagagcggucaggagccccgcggugggucccaggaggccaguccccagcucccugcucccgcggguccccagcccggcgcgcaccuggaugugguagcgcucccgcaugccggugcggauggagugcaggccuccgggcagguagggcgcgcagcagcacucgccaaagucgucggagaugcggcaggcaaggcacagaggagcaaaagugccgcacagaccugggcggggcgcaggcgcucaggggcggggccagccggggccucccgacggcuccgccccggggggggcgcgguugauucgccgcggaggggcauugagggucccagccaaggagaggucccagagggaauuagagguccgaggagaggauggcuuagcgauuggaaggcaggguuuuucuuuuuuuuuuuuucuucuuuuuuuuuuuuuuuagaaauuggaggcugggugcaguggcuuacgccuguaaucccagcacuuugggaggccuaggcgggaggaucacgaggucagggguuugagaccagccuacccaacauagugaaaccccgucucuacuaaaaauacaaaaauuagccgggcgugguggugugugccuguaaucucagcuacuagggaggcugaggcaggagaaucgcuugaacccgggaagcggagguugcagugagcauagacugugccauugcauuccagccugggcgacagagcaauacuccgucucaaaaaaaacaaaaaacaaaacaaaaaaaaaaacgaaagaaagaaaaaaaaagaaaaagaaauuaaagucucggucugucauccaggcuggagugcaguggugugaucacaugucucacuguagccucgaccuccugggcucaagcaauccucccgccucggccucccgaguagcugggacuacuggugugugccaccaccucgggcuaauuuuauuuuuuauuuuuauuuuugagacggaaucucgcucuguugcccagacuggagugcaguggcgugaucucggcucacugcaaccucugucucccggguucaaucaauucucuuucucagccucccgaguagcugaguuuacaggcgcccgccaccacgcccgguuuuuuuuuuuguauuuuuaguagagacgggguuucaccaucuuggccagacuggucuugaacuccugaccuugugguccaccugccauggccucccaaaguccugggauuacaggcgugagccacugcgcccgaccuauuuuuuauuuuuauuuuuguagagauggggaucucauuauguugcccaggcugaucuugaauuccuggccucaagggauugucaugccuuggccucccaaaguguugggauuacaggcaugagccacugcacugggccaggagcuaggguuugaagagggaguugggggucacagugaggaaagcugagcaugcaaaggggagguugagggccugauaaguugagugugggaaggcaugagguaguauccuaaggaguguugggggucugaggaaagggugacuguuagagugggaauuccaaguccagggaagggaggugggagugggguuagcaagcggugggaggagguuggaggugagcuucccucuccugauuccccccaaacccaucuuccaccaggccuggagagggagcaggcaggcacucacagacaggcaugucguugcagcaguccgugagaccugugugccagucacugagcugggucugguagcagcuggugguggcgcacuggggcugacuggucacaggguaggacauagcugcagaggugggaggguaggggucagcuggcagccucgcagcaucuccugggccccgcacuucggccacccuucccugugccgggcagucugggcggggccgccaggccgcccacugaagggacaccacugugccucccccuucccuucugcuacaucugggcaccggcaaccccagucugucccuguugcugcuggcuccugcacgucugguuaggcugggggugggggucuccugcacaucugaggaaggguggggaccacaucuggguggggccuggcggugccgccuccuccuccacgucugggccuggguucuggguugcagcauuucuggggccucugggguggaagcaggcgccgucugucuucgaagcaagggugcccaggggagggaggcggccagguuccaguacugagaggguugcugguccacccagcggucccaccuuugccuuucacguugucgugcaucucaaacugcaucuugcuggcccugaggagguggcguuggggacggcagaaguggcuguggcaacaguggcagagucuguccaagggacgcuggauacuggggaggugggggcaagggacuggggcacugggggcugggcucucagggggaggggagcuggggagaaagaggccaagucagccugucaaccaggagagacauggaauagggaauggauagggcgggggcgagaaacucgcccaugucuuuccaacugcccgacagauugcagaggacccuccccauacccgagauagagcuugagggagaacaagaaauggagauggacagagucagagacaaggggagaaagaucagagccaggugcccguagagaugucaccaguaaugcccacaugugcccagcacuuugacuccucugcaagcccaucucacagaugagcacugaggcucagagacaugaggaggaacgccccacgucugacggcccaggccaaggggguucauagaggugaugcugggccccaagacuucuaaauucagcucagcacaccccaguuaagaaggacagauuugggggcauugggaaggacagagaugucccgagagaccgacaaucagcgauaugaaaggagacagagugauaugagugggaugaggaggagggagaacagagcagaggcgcccaaccucaaagaagagggcugcggaggggauguuccuaccugcaggaucgcgauggcagugauggaggcagacguguggagacacgggcacugacuucuccgucucagcccagagccacuuauaugggcggccacgcagcccugggcggggcucugacagaggugcccagggagccaagccggucugaucgacccucuccccacacugggauuucccgcccucccucuccacucccauccccccacuucuccuccugccucagcucccaggacccagggaaaagaagguggcggggggugggagguuuggcgggggcggggggccacagccgggucaaugcgcagagaccaaaagagagggagagacagaaacacagugucagaaaggcaggcagggaagucccucuagacagaaaggagagagaggagauucagagagauggagagacgcaggaagauguagagagauggagaggugccaagaaacagaggggcacaaaaaugugaaaagaaauaacaagaagaggggagaugggccaggcaugguggcucucgccuguaaucccaacccuguaaucgccugaggugagaggaucgcuugagcccaggaguugaagaccagccugggcaacauagggauaccccaucucuacaaaaaauacaaauagaauuagccgggcaugguggcaugugccuguagucccagcuacuugagaggcugaggcaggaggaucgcuugaguccagaaguuugaggcugcagugagccguguucccgccacuacacuccggccucagugacagagcaagacccugucuuaaaaaaaaaaaaggaaagaaaaggggagaugggagacagaagagagacggagauggaaaaguggagaggcagguggggggaucacugaacaggcuuagagggcagggaaauggggagaggugauggguggggagagaaaaaggccggguggagugggagagagugcugugugggacuccccuuucagggucucgcucaucucucucagugauauccccacuuuccugggagaggggg

SEQ ID NO: 19596 - RNA, 4138 nt, Homo sapiens
cccccucucccaggaaaguggggauaucacugagagagaugagcgagacccugaaaggggagucccacacagcacucucucccacuccacccggccuuuuucucuccccacccaucaccucuccccauuucccugcccucuaagccuguucagugauccccccaccugccucuccacuuuuccaucuccgucucucuucugucucccaucuccccuuuucuuuccuuuuuuuuuuuuaagacagggucuugcucugucacugaggccggaguguaguggcgggaacacggcucacugcagccucaaacuucuggacucaagcgauccuccugccucagccucucaaguagcugggacuacaggcacaugccaccaugcccggcuaauucuauuuguauuuuuuguagagaugggguaucccuauguugcccaggcuggucuucaacuccugggcucaagcgauccucucaccucaggcgauuacaggguugggauuacaggcgagagccaccaugccuggcccaucuccccucuucuuguuauuucuuuucacauuuuugugccccucuguuucuuggcaccucuccaucucucuacaucuuccugcgucucuccaucucucugaaucuccucucucuccuuucugucuagagggacuucccugccugccuuucugacacuguguuucugucucucccucucuuuuggucucugcgcauugacccggcuguggccccccgcccccgccaaaccucccaccccccgccaccuucuuuucccuggguccugggagcugaggcaggaggagaaguggggggaugggaguggagagggagggcgggaaaucccaguguggggagagggucgaucagaccggcuuggcucccugggcaccucugucagagccccgcccagggcugcguggccgcccauauaaguggcucugggcugagacggagaagucagugcccgugucuccacacgucugccuccaucacugccaucgcgauccugcagguaggaacauccccuccgcagcccucuucuuugagguugggcgccucugcucuguucucccuccuccucaucccacucauaucacucugucuccuuucauaucgcugauugucggucucucgggacaucucuguccuucccaaugcccccaaaucuguccuucuuaacuggggugugcugagcugaauuuagaagucuuggggcccagcaucaccucuaugaacccccuuggccugggccgucagacguggggcguuccuccucaugucucugagccucagugcucaucugugagaugggcuugcagaggagucaaagugcugggcacaugugggcauuacuggugacaucucuacgggcaccuggcucugaucuuucuccccuugucucugacucuguccaucuccauuucuuguucucccucaagcucuaucucggguauggggaggguccucugcaaucugucgggcaguuggaaagacaugggcgaguuucucgcccccgcccuauccauucccuauuccaugucucuccugguugacaggcugacuuggccucuuucuccccagcuccccucccccugagagcccagcccccagugccccagucccuugcccccaccuccccaguauccagcgucccuuggacagacucugccacuguugccacagccacuucugccguccccaacgccaccuccucagggccagcaagaugcaguuugagaugcacgacaacgugaaaggcaaaggugggaccgcuggguggaccagcaacccucucaguacuggaaccuggccgccucccuccccugggcacccuugcuucgaagacagacggcgccugcuuccaccccagaggccccagaaaugcugcaacccagaacccaggcccagacguggaggaggaggcggcaccgccaggccccacccagaugugguccccacccuuccucagaugugcaggagacccccacccccagccuaaccagacgugcaggagccagcagcaacagggacagacugggguugccggugcccagauguagcagaagggaagggggaggcacaguggugucccuucagugggcggccuggcggccccgcccagacugcccggcacagggaaggguggccgaagugcggggcccaggagaugcugcgaggcugccagcugaccccuacccucccaccucugcagcuauguccuacccugugaccagucagccccagugcgccaccaccagcugcuaccagacccagcucagugacuggcacacaggucucacggacugcugcaacgacaugccugucugugagugccugccugcucccucuccaggccugguggaagauggguuuggggggaaucaggagagggaagcucaccuccaaccuccucccaccgcuugcuaaccccacucccaccucccuucccuggacuuggaauucccacucuaacagucacccuuuccucagacccccaacacuccuuaggauacuaccucaugccuucccacacucaacuuaucaggcccucaaccuccccuuugcaugcucagcuuuccucacugugacccccaacucccucuucaaacccuagcuccuggcccagugcaguggcucaugccuguaaucccaacacuuugggaggccaaggcaugacaaucccuugaggccaggaauucaagaucagccugggcaacauaaugagauccccaucucuacaaaaauaaaaauaaaaaauaggucgggcgcaguggcucacgccuguaaucccaggacuuugggaggccauggcagguggaccacaaggucaggaguucaagaccagucuggccaagauggugaaaccccgucucuacuaaaaauacaaaaaaaaaaaccgggcgugguggcgggcgccuguaaacucagcuacucgggaggcugagaaagagaauugauugaacccgggagacagagguugcagugagccgagaucacgccacugcacuccagucugggcaacagagcgagauuccgucucaaaaauaaaaauaaaaaauaaaauuagcccgaggugguggcacacaccaguagucccagcuacucgggaggccgaggcgggaggauugcuugagcccaggaggucgaggcuacagugagacaugugaucacaccacugcacuccagccuggaugacagaccgagacuuuaauuucuuuuucuuuuuuuuucuuucuuucguuuuuuuuuuuguuuuguuuuuuguuuuuuuugagacggaguauugcucugucgcccaggcuggaaugcaauggcacagucuaugcucacugcaaccuccgcuucccggguucaagcgauucuccugccucagccucccuaguagcugagauuacaggcacacaccaccacgcccggcuaauuuuuguauuuuuaguagagacgggguuucacuauguuggguaggcuggucucaaaccccugaccucgugauccucccgccuaggccucccaaagugcugggauuacaggcguaagccacugcacccagccuccaauuucuaaaaaaaaaaaaaaagaagaaaaaaaaaaaaagaaaaacccugccuuccaaucgcuaagccauccucuccucggaccucuaauucccucugggaccucuccuuggcugggacccucaaugccccuccgcggcgaaucaaccgcgccccccccggggcggagccgucgggaggccccggcuggccccgccccugagcgccugcgccccgcccaggucugugcggcacuuuugcuccucugugccuugccugccgcaucuccgacgacuuuggcgagugcugcugcgcgcccuaccugcccggaggccugcacuccauccgcaccggcaugcgggagcgcuaccacauccaggugcgcgccgggcuggggacccgcgggagcagggagcuggggacuggccuccugggacccaccgcggggcuccugaccgcucucuccuacccucuagggcuccgucgggcacgacugggcggcccucaccuuuugucugcccugcgcccucugccagauggcgcgggaacugaagauccgagaguaaggaaguucccugucuuccccguccuuuuccacca

SEQ ID NO: 19597 - RNA, 2627 nt, Homo sapiens
agugacaggaggcugcuuagccacaugggaggugcucaguaaaggagagcaauucuuacaggugucugccuccugacccuuccauccuucagguguccuguugcccccuccucccacugacacccuccggaggcccccauguugacagacccucuucuccuaccuuguuucccagccugacucuccuuccguucugggucccccuccucuggucggcuccccugugucucaucccccggauuaagccuucuccgccugguccucuuucucuggugacccacaccgcccgcaaagccacagcgcaucuggaucacccgcuuugguggcgcuuggccgccaggaggcagcacccuguuugcggggcggagccggggugcccgcccccuuucccccagggcugaagggaccccccucggagcccgcccacgcgagaugaggacgguggcccagcccccccaugcccucccccugggggccgcccccgcucccgccccgugcgcuuccuggguggggccgggggcggcuucaaaacccccugccgacccagccgguccccgccgccgccgcccuucgcgcccugggccaucucccucccaccucccuccgcggagcagccagacagcgagggccccggccgggggcaggggggacgccccguccggggcacccccccggcucugagccgcccgcggggccggccucggcccggagcggaggaaggagucgccgaggagcagccugaggccccagagucugagacgagccgccgccgcccccgccacugcggggaggagggggaggaggagcgggaggagggacgagcuggucgggagaagaggaaaaaaacuuuugagacuuuuccguugccgcugggagccggaggcgcggggaccucuuggcgcgacgcugccccgcgaggaggcaggacuuggggaccccagaccgccucccuuugccgccggggacgcuugcucccucccugcccccuacacggcgucccucaggcgcccccauuccggaccagcccucgggagucgccgacccggccucccgcaaagacuuuuccccagaccucgggcgcacccccugcacgccgccuucauccccggccugucuccugagcccccgcgcauccuagacccuuucuccuccaggagacggaucucucuccgaccugccacagauccccuauucaagaccacccaccuucugguaccagaucgcgcccaucuagguuauuuccgugggauacugagacacccccgguccaagccuccccuccaccacugcgcccuucucccugaggaccucagcuuucccucgaggcccuccuaccuuuugccgggagacccccagccccugcaggggcggggccuccccaccacaccagcccuguucgcgcucucggcagugccggggggcgccgccucccccaugccgcccuccgggcugcggcugcugccgcugcugcuaccgcugcuguggcuacuggugcugacgccuggccggccggccgcgggacuauccaccugcaagacuaucgacauggagcuggugaagcggaagcgcaucgaggccauccgcggccagauccuguccaagcugcggcucgccagccccccgagccagggggaggugccgcccggcccgcugcccgaggccgugcucgcccuguacaacagcacccgcgaccggguggccggggagagugcagaaccggagcccgagccugaggccgacuacuacgccaaggaggucacccgcgugcuaaugguggaaacccacaacggugagcucggaggggcaggggagccgggaggggggcccccagggggcgccggagugccggggccacggguaggaagugacuggcagaagaaacuggcuggaggaagaggacaccccggggcaaagggaacgugugauggugggagggggguguccgaaagaggauggcacugagcccccuaccacccaggugucuggucuuggagaggaggagauagcgaaguggaccgcuucuagagugcgacagaaacaugcggggucgugggggcaguccccuagagggagacaagcaauagggggaggguagaaggcucccucuuccaggacgcguugaaugggggggggggucguggggugccaggugcagagaagggagccuggugugggagaagcgaagaccccagcauuugggaaaggagaggcgcuggagaaaguugacccagagcuuggggguccugagguggaaagauucaagaaggacagaaaagcuagaugaaggcaaccccagagggugccaggaaagugagagcggacccacuuccagaggcugccaggaacacgcgggaugcgggggugggggagagucguagaaagagaaacagaggugcgugugauaaauguggggagaaagggacgggagguuauuggaaggaggaggcaagcgggagaggagcggagacucgggagggcgcccgggaugcagagguguccucgguguuucacacagggacgugagggacagaguggggagcccagcggaggaaucgagcuuccagaagaccuagaguccugggucaugggaagggcuuuaccgagaggggagacaggcgugggaaagg

SEQ ID NO: 19598 - RNA, 2627 nt, Homo sapiens
ccuuucccacgccugucuccccucucgguaaagcccuucccaugacccaggacucuaggucuucuggaagcucgauuccuccgcugggcuccccacucugucccucacgucccugugugaaacaccgaggacaccucugcaucccgggcgcccucccgagucuccgcuccucucccgcuugccuccuccuuccaauaaccucccgucccuuucuccccacauuuaucacacgcaccucuguuucucuuucuacgacucucccccacccccgcaucccgcguguuccuggcagccucuggaaguggguccgcucucacuuuccuggcacccucugggguugccuucaucuagcuuuucuguccuucuugaaucuuuccaccucaggacccccaagcucugggucaacuuucuccagcgccucuccuuucccaaaugcuggggucuucgcuucucccacaccaggcucccuucucugcaccuggcaccccacgacccccccccccauucaacgcguccuggaagagggagccuucuacccucccccuauugcuugucucccucuaggggacugcccccacgaccccgcauguuucugucgcacucuagaagcgguccacuucgcuaucuccuccucuccaagaccagacaccugggugguagggggcucagugccauccucuuucggacaccccccucccaccaucacacguucccuuugccccgggguguccucuuccuccagccaguuucuucugccagucacuuccuacccguggccccggcacuccggcgcccccugggggccccccucccggcuccccugccccuccgagcucaccguuguggguuuccaccauuagcacgcgggugaccuccuuggcguaguagucggccucaggcucgggcuccgguucugcacucuccccggccacccggucgcgggugcuguuguacagggcgagcacggccucgggcagcgggccgggcggcaccucccccuggcucggggggcuggcgagccgcagcuuggacaggaucuggccgcggauggccucgaugcgcuuccgcuucaccagcuccaugucgauagucuugcagguggauagucccgcggccggccggccaggcgucagcaccaguagccacagcagcgguagcagcagcggcagcagccgcagcccggagggcggcaugggggaggcggcgccccccggcacugccgagagcgcgaacagggcuggugugguggggaggccccgccccugcaggggcugggggucucccggcaaaagguaggagggccucgagggaaagcugagguccucagggagaagggcgcagugguggaggggaggcuuggaccgggggugucucaguaucccacggaaauaaccuagaugggcgcgaucugguaccagaagguggguggucuugaauaggggaucuguggcaggucggagagagauccgucuccuggaggagaaagggucuaggaugcgcgggggcucaggagacaggccggggaugaaggcggcgugcagggggugcgcccgaggucuggggaaaagucuuugcgggaggccgggucggcgacucccgagggcugguccggaaugggggcgccugagggacgccguguagggggcagggagggagcaagcguccccggcggcaaagggaggcggucugggguccccaaguccugccuccucgcggggcagcgucgcgccaagagguccccgcgccuccggcucccagcggcaacggaaaagucucaaaaguuuuuuuccucuucucccgaccagcucgucccuccucccgcuccuccucccccuccuccccgcaguggcgggggcggcggcggcucgucucagacucuggggccucaggcugcuccucggcgacuccuuccuccgcuccgggccgaggccggccccgcgggcggcucagagccgggggggugccccggacggggcguccccccugcccccggccggggcccucgcugucuggcugcuccgcggagggaggugggagggagauggcccagggcgcgaagggcggcggcggcggggaccggcugggucggcaggggguuuugaagccgcccccggccccacccaggaagcgcacggggcgggagcgggggcggcccccagggggagggcaugggggggcugggccaccguccucaucucgcgugggcgggcuccgaggggggucccuucagcccugggggaaagggggcgggcaccccggcuccgccccgcaaacagggugcugccuccuggcggccaagcgccaccaaagcgggugauccagaugcgcuguggcuuugcgggcggugugggucaccagagaaagaggaccaggcggagaaggcuuaauccgggggaugagacacaggggagccgaccagaggagggggacccagaacggaaggagagucaggcugggaaacaagguaggagaagagggucugucaacaugggggccuccggagggugucagugggaggagggggcaacaggacaccugaaggauggaagggucaggaggcagacaccuguaagaauugcucuccuuuacugagcaccucccauguggcuaagcagccuccugucacu

SEQ ID NO: 19599 - RNA, 2260 nt, Homo sapiens
ucaagguucuaaagaggugguggucuacgcuguggcuugggugccuggcagaguucgauaagggguggggcgagaggggagccuucacaagugggugggguuggagggccuggguauaaggagguuuggaugcugcaggcgaggacuagugcgugcgucacgaaggggcgggcccacgguggaugggccuucucggcgcccggggggaaggagagggucuugagaagcgauguugccgggucuuaaaaaggcggagcuuagagguaaauugccuuaggggcggggcagaugagagguccaaaggggaggagcgacgcaucgguguucgcgugggcggggccucgggagggaaugagaggggcgggacauucuaaaggggaggggcuaaggagaacaacccaaagggguggagcuuagaaccagaaggccugggggcgaggaacaagaccucggaguauuucaaggggagaccuagguucguaaggggccgggcucccgcgggcucgcaggagggcggggccucgagcuccgggggcggggccuacaucucgggguccgcccuaguugucucgcccacuugccuucacccgcacccccguucuuuucgguuauuuucugcuacggcaguucccugcccugccccgggcccagggcgccgcggucugaacucugcucggcuggaggacucggugaguggguuccucuggggggaggcggggccagggcggagcuuggggacagggguggagcuugacuguggaugccagcuaguagaccuggagcgggaagagguuuaggggugaggccugaggaucugccccugccugggaagagggcgggacccaggugcucuagagagaggcggggagucggagaguuagaggagaggacugagggaucagcaugaccagccaaggggacaggcauggaaccuuaguacauaauggggcugguagugaaguaucuuaacagcagcuguguuggggacaugggcaagaaggcgugagugucgaaggucggggaacaggagugcgaccuaaggacuugggccugaucggaucuuggagaacaggggcggggccggugcggacgcauuagaucaaguacagccagccucguaggguccccacggcccuggcaggcugacuggaguaaauuuuucugacuagucuccgagcuccgucagaaauggggaacuugcagucggagccauccgcgggcgggggcucccgaaaagugcagcccucggaccgcgcccccgacucccgccggacgucccugguggagcccgagaugaccucccaggccaugcgccugacucgugggcugggugucugguucccuggcagcgccacacccccgggacucaugguaccccgggagccccaggccucacccucgacccugccccucaccuuagaacggcccucuccagugaugcccccuccugaagaggcggccgcggucucugcaccacccccggcccccgcggggacucugcugcccggcccgucuaaauggcaaaagcccgcgggcacuccaguuccccggauccgccgccugcuggaggcgagccaucgcggccagggcgacccuccgagccuccgcccgcugaagccgccgccgccgccccggcaacuauccgugaaggacacugucccgagggccccaucccaauuuccgccgccccuggagacuuggaagccgccaccaccauuaccuucugaacggcagccggcggaccgcagaaucacuccugcucuggccacacccgccucacccccgacagaaagccaggcugggccccgcaaccagggccagacggccggcagggcucgcggaggggcgccuccccaugcgggcgaaggcgaaauggcccagccugcggauuccgaguccggucugagccugcuguguaaaaucaccuucaagucgaggcccucuuuggccccuccggcagccucgaguuccuuagcagccaaagcuucgcuggggggcggcggaggcggcggccucuuugcugccucaggugccaucucuuacgccgagguccugaagcaagggccccugccuccuggagccgcucgccccuugggagagguuucucgaggggcacaggaagccgagggaggugauggagacggcgaagggugcucugguccucccucggcgccugcgucccaagcccgggcccuaccgccgccacccuacaccaccuucccaggcucgaagcccaaauucgacuggguuagcgcucccg

SEQ ID NO: 19600 - RNA, 2260 nt, Homo sapiens
cgggagcgcuaacccagucgaauuugggcuucgagccugggaaggugguguaggguggcggcgguagggcccgggcuugggacgcaggcgccgagggaggaccagagcacccuucgccgucuccaucaccucccucggcuuccugugccccucgagaaaccucucccaaggggcgagcggcuccaggaggcaggggcccuugcuucaggaccucggcguaagagauggcaccugaggcagcaaagaggccgccgccuccgccgccccccagcgaagcuuuggcugcuaaggaacucgaggcugccggaggggccaaagagggccucgacuugaaggugauuuuacacagcaggcucagaccggacucggaauccgcaggcugggccauuucgccuucgcccgcauggggaggcgccccuccgcgagcccugccggccgucuggcccugguugcggggcccagccuggcuuucugucgggggugaggcggguguggccagagcaggagugauucugcgguccgccggcugccguucagaagguaauggugguggcggcuuccaagucuccaggggcggcggaaauugggauggggcccucgggacaguguccuucacggauaguugccggggcggcggcggcggcuucagcgggcggaggcucggagggucgcccuggccgcgauggcucgccuccagcaggcggcggauccggggaacuggagugcccgcgggcuuuugccauuuagacgggccgggcagcagaguccccgcgggggccggggguggugcagagaccgcggccgccucuucaggagggggcaucacuggagagggccguucuaaggugaggggcagggucgagggugaggccuggggcucccgggguaccaugagucccggggguguggcgcugccagggaaccagacacccagcccacgagucaggcgcauggccugggaggucaucucgggcuccaccagggacguccggcgggagucgggggcgcgguccgagggcugcacuuuucgggagcccccgcccgcggauggcuccgacugcaaguuccccauuucugacggagcucggagacuagucagaaaaauuuacuccagucagccugccagggccguggggacccuacgaggcuggcuguacuugaucuaaugcguccgcaccggccccgccccuguucuccaagauccgaucaggcccaaguccuuaggucgcacuccuguuccccgaccuucgacacucacgccuucuugcccauguccccaacacagcugcuguuaagauacuucacuaccagccccauuauguacuaagguuccaugccuguccccuuggcuggucaugcugaucccucaguccucuccucuaacucuccgacuccccgccucucucuagagcaccugggucccgcccucuucccaggcaggggcagauccucaggccucaccccuaaaccucuucccgcuccaggucuacuagcuggcauccacagucaagcuccaccccuguccccaagcuccgcccuggccccgccuccccccagaggaacccacucaccgaguccuccagccgagcagaguucagaccgcggcgcccugggcccggggcagggcagggaacugccguagcagaaaauaaccgaaaagaacgggggugcgggugaaggcaagugggcgagacaacuagggcggaccccgagauguaggccccgcccccggagcucgaggccccgcccuccugcgagcccgcgggagcccggccccuuacgaaccuaggucuccccuugaaauacuccgaggucuuguuccucgcccccaggccuucugguucuaagcuccaccccuuuggguuguucuccuuagccccuccccuuuagaaugucccgccccucucauucccucccgaggccccgcccacgcgaacaccgaugcgucgcuccuccccuuuggaccucucaucugccccgccccuaaggcaauuuaccucuaagcuccgccuuuuuaagacccggcaacaucgcuucucaagacccucuccuuccccccgggcgccgagaaggcccauccaccgugggcccgccccuucgugacgcacgcacuaguccucgccugcagcauccaaaccuccuuauacccaggcccuccaaccccacccacuugugaaggcuccccucucgccccaccccuuaucgaacucugccaggcacccaagccacagcguagaccaccaccucuuuagaaccuuga

SEQ ID NO: 19601 - RNA, 1870 nt, Homo sapiens
ggggcugcugaauugggagucccagguccagagggaacagguggugucccuauugggaggaaaauccugcauugagagugaccccauauaggggagaugucaagauggggugggguaccuagggaaggguuuugugucuggggucagaguugccugcuggggaguauggggccaggagacagaugacagucuggagcagaggcccagguccagagggccaggagucccagauggcggugccagguccuugcugaggaaucucuguugggagggaggucuuuagugaggacacccugagaggucuggagauuuaggguccucgcuaaggcgccagggucaggaggagguugagaugggguuucuccagggggguuucccagaaggacauaucuggagggucaggagacauggcaaggguggcaggcccagacuagagauaaagucagggguccuggcaugguugaguucuggguccagagggggcaaggaucucccuuggaggguggcguguccuggguccuugcuggaggucucugaggacaguccuaggcuuagagggggcuggacagacccgggucaccaagaggauuaagaccggggaaugcagucccagugcaguggcucaagccuguaaugccagcaauuugggagggcgaggcgggcugaucaccugaagucaggaguuugggaccagccuggccaacauggugaaacuccgucuccacugaaaauacaaaaauuagccaggcauggugguaugugccuguaaucccagcuacucggcaggcugaagcaggagaauagcuugaaaccgggaggcggaggcugccgugauccgagaucgugccacugcacuccagccugggcgacagaguaagcccugucucaaaaaaagaaaaagaaaagaaaaaaaaaaaagaccgaggaacggggucccagcuggucucugcaaagguacucugaggggagcuggguguuuccuacuuaggaggaagggcucggacuugggcuccccgagcagagcagauaucaugagccugggucccggguccucacuggggucuuuucgggggauccgaagcccagaggggauugggauaaggguauucgugagggccccgggguccccagggguuaaggaugaaguggggaucccggguccucgccgccuugcggugaggcgcuuacguacccacgguggugaucagcgugcuggcgaagaagagagcagaggcgaagucccaggcgggguccgaggcguuggcggaccccgaagcguuagcaagcacgacccgccccagccguccggccgccagcacucgcuccacgaaggcguccagggcgggggcagccacacacgggcugcgcugaagcagcugcgcccgcagcgucuccagcucggcucggagccuggcuucgugcggccccuccagccgcgccaccaacagcgcgcccagcaccagguacgcggcguacgcggccaaggcgcccgccagaagcgcgccccuccgcauggcacccaccgggaccccgcgagcccuggguggccccgcugacguggcccccgccuccggaccgucuggcaccuaguuccaguuccgggagugcuacaggcgcggcagcagaugccccaagaggaagaggaaaaaggggagguggggggcggcgacggaggaaugccccgccuccgggaaacugaggcacgcccaaccgccagguguucguucggagaggguggagcccagugcucccagacccagcagaccaacgggauggaaaggguggagguaguccucucuuccccucauuccuuccuucucguccuccuggaaggcugguucucuauguuagaagaaucugaacuuuccuc

SEQ ID NO: 19602 - RNA, 1870 nt, Homo sapiens
gaggaaaguucagauucuucuaacauagagaaccagccuuccaggaggacgagaaggaaggaaugaggggaagagaggacuaccuccacccuuuccaucccguuggucugcugggucugggagcacugggcuccacccucuccgaacgaacaccuggcgguugggcgugccucaguuucccggaggcggggcauuccuccgucgccgccccccaccuccccuuuuuccucuuccucuuggggcaucugcugccgcgccuguagcacucccggaacuggaacuaggugccagacgguccggaggcgggggccacgucagcggggccacccagggcucgcggggucccggugggugccaugcggaggggcgcgcuucuggcgggcgccuuggccgcguacgccgcguaccuggugcugggcgcgcuguugguggcgcggcuggaggggccgcacgaagccaggcuccgagccgagcuggagacgcugcgggcgcagcugcuucagcgcagcccguguguggcugcccccgcccuggacgccuucguggagcgagugcuggcggccggacggcuggggcgggucgugcuugcuaacgcuucgggguccgccaacgccucggaccccgccugggacuucgccucugcucucuucuucgccagcacgcugaucaccaccguggguacguaagcgccucaccgcaaggcggcgaggacccgggauccccacuucauccuuaaccccuggggaccccggggcccucacgaauacccuuaucccaauccccucugggcuucggaucccccgaaaagaccccagugaggacccgggacccaggcucaugauaucugcucugcucggggagcccaaguccgagcccuuccuccuaaguaggaaacacccagcuccccucagaguaccuuugcagagaccagcugggaccccguuccucggucuuuuuuuuuuuucuuuucuuuuucuuuuuuugagacagggcuuacucugucgcccaggcuggagugcaguggcacgaucucggaucacggcagccuccgccucccgguuucaagcuauucuccugcuucagccugccgaguagcugggauuacaggcacauaccaccaugccuggcuaauuuuuguauuuucaguggagacggaguuucaccauguuggccaggcuggucccaaacuccugacuucaggugaucagcccgccucgcccucccaaauugcuggcauuacaggcuugagccacugcacugggacugcauuccccggucuuaauccucuuggugacccgggucuguccagcccccucuaagccuaggacuguccucagagaccuccagcaaggacccaggacacgccacccuccaagggagauccuugcccccucuggacccagaacucaaccaugccaggaccccugacuuuaucucuagucugggccugccacccuugccaugucuccugacccuccagauauguccuucugggaaaccccccuggagaaaccccaucucaaccuccuccugacccuggcgccuuagcgaggacccuaaaucuccagaccucucaggguguccucacuaaagaccucccucccaacagagauuccucagcaaggaccuggcaccgccaucugggacuccuggcccucuggaccugggccucugcuccagacugucaucugucuccuggccccauacuccccagcaggcaacucugaccccagacacaaaacccuucccuagguaccccaccccaucuugacaucuccccuauauggggucacucucaaugcaggauuuuccucccaauagggacaccaccuguucccucuggaccugggacucccaauucagcagcccc

SEQ ID NO: 19603 - RNA, 3329 nt, Homo sapiens
gucccuuuccucaccuggggcucgugucgggaccugaauguccaugauaguugagucugcugaagaacuggacgugguaucuuucaacgucuguccuggggaaucaaggaugagaagucaggagggagccuggucccccuccucucaccacccccgcccucgccucccuggugaaaccuuagggguccugucugcugguggaaucacucagcuuuggcugcaucaauccauaauucugaaaguguuuucagcuaugccaaugccugggaacccuucuucuagucccccuccccgcccaucccugugggaugggaaagucaguuuagucuagugagcccaggugcuagggugagccugggcccugguuucaaauccugcccccaacaacuuucuugcugugugaccuggaacaagugaaguccuuucucugagccucaguugcuucaucugcaaagcagggauaauaacugaaucuacuucacagggcuguagauagggugaaaugacacagagcagggaaagggucucccacacggcuuaccauguggucagugcuggauaacuccacugcccccauccugguccugccucuguacccuccagccuggacaucccagcagccuccuucuugggcucccugcuccugucuccgcccccacagucuguuccaaccugcagccagagggagccugggaccaccugagucaggucggggcccgccugguucagagcccugcccuggcugcacuucacuccacauaaaagcaaagcccucacguggcccguaaguccuccuccaucuggucccaucacuucucuguccucucgucaucccacucugccccuucucaucccaacccagccaccccaccugccugcuauucuuaaaacacaccagacaacacucagcccccagacaccugcaaagcucauucccucauuuccuccaaguguuuguugguccaaaugucaccuccucagugaggcccucccugaccacccaguuuaaacaauccucauuaccucuacuuuucugcaagcacguaucaccuccuagcacacgauauaauuuacuaacuugucucucuccacuagagugugaccucuuguuuuauucagugcuguuuccccagugcacagaauaucuagcacauaguaggugcucaauaaauauuugucaaaugacugaacgaguauaugaaaaucauuuuaugaaggagaaaugagggcgccuucaguggggcaugcacccuggguucugggggcaggcaggacaguuguuuucucagcuccuccacccauucuccucugacacagggcacuucccuucgcugagccucaguuuccucaucaguaaaaugggcaagacaacaggugugacugacugucagaggcaaagccuaacugaccuaacacacaccacaccugccacacagaaagaacgaucaauaccccccugugguucccaucuuucaggagacacuuuccaggcaaggcugagauguugccaacucuuuggacuaaccccagcucaacagcuuugccuaacuguguaaugccuggggacucugggagccuagguuuccuggcugcugaguagaaaaccgacaccaaucuccccgccaaaugaaacucagugaguucuucuuggaggugaaauuggaggaugcucagcaggacaggcccuggccagacucacuggaagcagccacccgggucugagguguccaaagaggguguaacgucgccccgccauagggauccccacuuccuggugccggcucagcgggagggugacagggcaggacaacguucacacgggccaaccacccaccccgcagcacacguggggcuggccuggcugggggcucuggggcaggguggaggccagagaugggucuuaccucugguggggagaaucaggccaacgauggugagaagacacaggcgaccagagggcgacaucugugggaccaggcgaugcuggggucagccaugaugucagugagaccgaccuccggcagcccccggggauccugcagcccuuucccugcccugagcaaaaaccucuggcuuccaagacccccugccaggggcugacggcuggccucaggggaaaggggagggucuuagguggggauaccaaaccgucacccugcuuccuuccccugcagguccccaaagaaaacaagaagcaugagauaaaugggucuuccagcagcugcaagggccggcgggcacuccugaagcagagaaacaccucccugcgccuuccgccaggcgcuuaucccucacugggacugacgcaaggaggggacuggggcagaggaguagauaggaggccucuucccucccccaggggcccagagcccgggagucggcgaggaggggaaggaggaagagugaguaacgccucccgcgcucagaggaaaaagugaguuggugucaggggccgccuugcagggauggcgcgcuggagagaccuaagaggcacugguccgagggggguggcagagagcuggggagacugaggcaggcgggcgggagcgaggcagagcggcccacuguagcccaggagaggaggcagagagaugugggcguggauggggggcggagaggagcggaaggggucaaaccccuacccaccugagcccggcccgugggcagaggggcagcggauggagguggcgcacgagagggacuuacgucggagcuggggguccuaagccggcagccucguggagagagggacgcggcgguggcugcugcguccaggcggaggguguggccaggggagcgcgagcgggcggggacccagacgggcucagucauuuccucuuggguuuccuggcuucagagcccggggugggagcaggagggggaaucgcugagggcgacggggggcaggggugagggcauaguggugggagagggugggaacggggauggggcaggcaggucuagggugaguggacgccucugagagagcagggggagaaacgggagggcucuauucuggggucgcuggaggaagggaaaggacaaauccggagguguugaggaaggagaagggauugaaggggggcaucucggggcacugggggaggagaaugaagagggggcgacuccgggcacgcaggggagagcuaccccagguucaguucugcaccccuacccacaccgugccccacagaugagaacacacagacagaacagaggaaaaaaccaaaugcacauuuauuaagcucaagacauggacacugaggggccagggggacggaucuucggggaugagacaaggaggugcaggggggccauacacggggaug

SEQ ID NO: 19604 - RNA, 3329 nt, Homo sapiens
cauccccguguauggccccccugcaccuccuugucucauccccgaagauccgucccccuggccccucaguguccaugucuugagcuuaauaaaugugcauuugguuuuuuccucuguucugucuguguguucucaucuguggggcacgguguggguaggggugcagaacugaaccugggguagcucuccccugcgugcccggagucgcccccucuucauucuccucccccagugccccgagaugccccccuucaaucccuucuccuuccucaacaccuccggauuuguccuuucccuuccuccagcgaccccagaauagagcccucccguuucucccccugcucucucagaggcguccacucacccuagaccugccugccccauccccguucccacccucucccaccacuaugcccucaccccugccccccgucgcccucagcgauucccccuccugcucccaccccgggcucugaagccaggaaacccaagaggaaaugacugagcccgucuggguccccgcccgcucgcgcuccccuggccacacccuccgccuggacgcagcagccaccgccgcgucccucucuccacgaggcugccggcuuaggacccccagcuccgacguaagucccucucgugcgccaccuccauccgcugccccucugcccacgggccgggcucagguggguagggguuugaccccuuccgcuccucuccgccccccauccacgcccacaucucucugccuccucuccugggcuacagugggccgcucugccucgcucccgcccgccugccucagucuccccagcucucugccaccccccucggaccagugccucuuaggucucuccagcgcgccaucccugcaaggcggccccugacaccaacucacuuuuuccucugagcgcgggaggcguuacucacucuuccuccuuccccuccucgccgacucccgggcucugggccccugggggagggaagaggccuccuaucuacuccucugccccaguccccuccuugcgucagucccagugagggauaagcgccuggcggaaggcgcagggagguguuucucugcuucaggagugcccgccggcccuugcagcugcuggaagacccauuuaucucaugcuucuuguuuucuuuggggaccugcaggggaaggaagcagggugacgguuugguauccccaccuaagacccuccccuuuccccugaggccagccgucagccccuggcagggggucuuggaagccagagguuuuugcucagggcagggaaagggcugcaggauccccgggggcugccggaggucggucucacugacaucauggcugaccccagcaucgccuggucccacagaugucgcccucuggucgccugugucuucucaccaucguuggccugauucuccccaccagagguaagacccaucucuggccuccacccugccccagagcccccagccaggccagccccacgugugcugcggggugggugguuggcccgugugaacguuguccugcccugucacccucccgcugagccggcaccaggaaguggggaucccuauggcggggcgacguuacacccucuuuggacaccucagacccggguggcugcuuccagugagucuggccagggccuguccugcugagcauccuccaauuucaccuccaagaagaacucacugaguuucauuuggcggggagauuggugucgguuuucuacucagcagccaggaaaccuaggcucccagaguccccaggcauuacacaguuaggcaaagcuguugagcugggguuaguccaaagaguuggcaacaucucagccuugccuggaaagugucuccugaaagaugggaaccacagggggguauugaucguucuuucuguguggcaggugugguguguguuaggucaguuaggcuuugccucugacagucagucacaccuguugucuugcccauuuuacugaugaggaaacugaggcucagcgaagggaagugcccugugucagaggagaauggguggaggagcugagaaaacaacuguccugccugcccccagaacccagggugcaugccccacugaaggcgcccucauuucuccuucauaaaaugauuuucauauacucguucagucauuugacaaauauuuauugagcaccuacuaugugcuagauauucugugcacuggggaaacagcacugaauaaaacaagaggucacacucuaguggagagagacaaguuaguaaauuauaucgugugcuaggaggugauacgugcuugcagaaaaguagagguaaugaggauuguuuaaacuggguggucagggagggccucacugaggaggugacauuuggaccaacaaacacuuggaggaaaugagggaaugagcuuugcaggugucugggggcugaguguugucugguguguuuuaagaauagcaggcaggugggguggcuggguugggaugagaaggggcagagugggaugacgagaggacagagaagugaugggaccagauggaggaggacuuacgggccacgugagggcuuugcuuuuauguggagugaagugcagccagggcagggcucugaaccaggcgggccccgaccugacucagguggucccaggcucccucuggcugcagguuggaacagacugugggggcggagacaggagcagggagcccaagaaggaggcugcugggauguccaggcuggaggguacagaggcaggaccaggaugggggcaguggaguuauccagcacugaccacaugguaagccgugugggagacccuuucccugcucugugucauuucacccuaucuacagcccugugaaguagauucaguuauuaucccugcuuugcagaugaagcaacugaggcucagagaaaggacuucacuuguuccaggucacacagcaagaaaguuguugggggcaggauuugaaaccagggcccaggcucacccuagcaccugggcucacuagacuaaacugacuuucccaucccacagggaugggcggggagggggacuagaagaaggguucccaggcauuggcauagcugaaaacacuuucagaauuauggauugaugcagccaaagcugagugauuccaccagcagacaggaccccuaagguuucaccagggaggcgagggcggggguggugagaggagggggaccaggcucccuccugacuucucauccuugauuccccaggacagacguugaaagauaccacguccaguucuucagcagacucaacuaucauggacauucaggucccgacacgagccccaggugaggaaagggac

SEQ ID NO: 19605 - RNA, 2528 nt, Homo sapiens
cagccccgcugcucugcgcugcagccuccccgggacgcggguccgggacaggccugguucuggcuuugaaagagaauccgcgccccagcagcucaagaccaagacucgcccuccgccccccaccccuaccccgugcagccucgggauacuccugggcucccggccguggcuggauacgggcgccuagggcaggcaggaggagggggcccccgcuaccgaccacgugggcgcgggggcgacggccgggccgggggcggagcuuggagcgagcgccgcggcucugcugggcgcgcuggaggcggugggcguugcgccgcggccugccuggggagcgcggcgcugugccgcgcugguucgccgccccaugccggccgcgcgcuaggacccagcaggcgccgcgccgccgcagcccggggacagaggccgccucggacucuagggggcgacgcggccugccggguauaaaagcugggccggcgcgggccgggccauucgcgacccggaggugcgcgggcgcgggcgagcagggucuccgggugggcggcggcgacgccccgcgcaggcuggaggccgccgaggcucgccaugccgggagaacucuaacucccccauggagucggccgacuucuacgaggcggagccgcggcccccgaugagcagccaccugcagagccccccgcacgcgcccagcagcgccgccuucggcuuuccccggggcgcgggccccgcgcagccucccgccccaccugccgccccggagccgcugggcggcaucugcgagcacgagacguccaucgacaucagcgccuacaucgacccggccgccuucaacgacgaguuccuggccgaccuguuccagcacagccggcagcaggagaaggccaaggcggccgugggccccacgggcggcggcggcggcggcgacuuugacuacccgggcgcgcccgcgggccccggcggcgccgucaugcccgggggagcgcacgggcccccgcccggcuacggcugcgcggccgccggcuaccuggacggcaggcuggagccccuguacgagcgcgucggggcgccggcgcugcggccgcuggugaucaagcaggagccccgcgaggaggaugaagccaagcagcuggcgcuggccggccucuucccuuaccagccgccgccgccgccgccgcccucgcacccgcacccgcacccgccgcccgcgcaccuggccgccccgcaccugcaguuccagaucgcgcacugcggccagaccaccaugcaccugcagcccggucaccccacgccgccgcccacgcccgugcccagcccgcaccccgcgcccgcgcucggugccgccggccugccgggcccuggcagcgcgcucaaggggcugggcgccgcgcaccccgaccuccgcgcgaguggcggcagcggcgcgggcaaggccaagaagucgguggacaagaacagcaacgaguaccgggugcggcgcgagcgcaacaacaucgcggugcgcaagagccgcgacaaggccaagcagcgcaacguggagacgcagcagaaggugcuggagcugaccagugacaaugaccgccugcgcaagcggguggaacagcugagccgcgaacuggacacgcugcggggcaucuuccgccagcugccagagagcuccuuggucaaggccaugggcaacugcgcgugaggcgcgcggcugugggaccgcccugggccagccuccggcggggacccagggagugguuuggggucgccggaucucgaggcuugcccgagccgugcgagccaggacuaggagauuccggugccuccugaaagccuggccugcuccgcguguccccucccuuccucugcgccggacuuggugcgucuaagaugagggggccaggcgguggcuucucccugcgaggaggggagaauucuuggggcugagcugggagcccggcaacucuaguauuuaggauaaccuugugccuuggaaaugcaaacucaccgcuccaaugccuacugaguagggggagcaaaucgugccuugucauuuuauuuggagguuuccugccuccuucccgaggcuacagcagacccccaugagagaaggaggggagcaggcccguggcaggaggagggcucagggagcugagaucccgacaagcccgccagccccagccgcuccuccacgccuguccuuagaaagggguggaaacauagggacuuggggcuuggaaccuaagguuguuccccuaguucuacaugaagguggagggucucuaguuccacgccucucccaccucccuccgcacacaccccaccccagccugcuauaggcugggcuuccccuuggggcggaacucacugcgaugggggucaccaggugaccagugggagcccccaccccgagucacaccagaaagcuaggucgugggucagcucugaggauguauaccccuggugggagagggagaccuagagaucuggcuguggggcgggcauggggggugaagggccacugggacccucagccuuguuug

SEQ ID NO: 19606 - RNA, 2528 nt, Homo sapiens
caaacaaggcugagggucccaguggcccuucaccccccaugcccgccccacagccagaucucuaggucucccucucccaccagggguauacauccucagagcugacccacgaccuagcuuucuggugugacucggggugggggcucccacuggucaccuggugacccccaucgcagugaguuccgccccaaggggaagcccagccuauagcaggcugggguggggugugugcggagggaggugggagaggcguggaacuagagacccuccaccuucauguagaacuaggggaacaaccuuagguuccaagccccaagucccuauguuuccaccccuuucuaaggacaggcguggaggagcggcuggggcuggcgggcuugucgggaucucagcucccugagcccuccuccugccacgggccugcuccccuccuucucucaugggggucugcuguagccucgggaaggaggcaggaaaccuccaaauaaaaugacaaggcacgauuugcucccccuacucaguaggcauuggagcggugaguuugcauuuccaaggcacaagguuauccuaaauacuagaguugccgggcucccagcucagccccaagaauucuccccuccucgcagggagaagccaccgccuggcccccucaucuuagacgcaccaaguccggcgcagaggaagggaggggacacgcggagcaggccaggcuuucaggaggcaccggaaucuccuaguccuggcucgcacggcucgggcaagccucgagauccggcgaccccaaaccacucccuggguccccgccggaggcuggcccagggcggucccacagccgcgcgccucacgcgcaguugcccauggccuugaccaaggagcucucuggcagcuggcggaagaugccccgcagcguguccaguucgcggcucagcuguuccacccgcuugcgcaggcggucauugucacuggucagcuccagcaccuucugcugcgucuccacguugcgcugcuuggccuugucgcggcucuugcgcaccgcgauguuguugcgcucgcgccgcacccgguacucguugcuguucuuguccaccgacuucuuggccuugcccgcgccgcugccgccacucgcgcggaggucggggugcgcggcgcccagccccuugagcgcgcugccagggcccggcaggccggcggcaccgagcgcgggcgcggggugcgggcugggcacgggcgugggcggcggcguggggugaccgggcugcaggugcaugguggucuggccgcagugcgcgaucuggaacugcaggugcggggcggccaggugcgcgggcggcgggugcgggugcgggugcgagggcggcggcggcggcggcggcugguaagggaagaggccggccagcgccagcugcuuggcuucauccuccucgcggggcuccugcuugaucaccagcggccgcagcgccggcgccccgacgcgcucguacaggggcuccagccugccguccagguagccggcggccgcgcagccguagccgggcgggggcccgugcgcucccccgggcaugacggcgccgccggggcccgcgggcgcgcccggguagucaaagucgccgccgccgccgccgcccguggggcccacggccgccuuggccuucuccugcugccggcugugcuggaacaggucggccaggaacucgucguugaaggcggccgggucgauguaggcgcugaugucgauggacgucucgugcucgcagaugccgcccagcggcuccggggcggcagguggggcgggaggcugcgcggggcccgcgccccggggaaagccgaaggcggcgcugcugggcgcgugcggggggcucugcagguggcugcucaucgggggccgcggcuccgccucguagaagucggccgacuccaugggggaguuagaguucucccggcauggcgagccucggcggccuccagccugcgcggggcgucgccgccgcccacccggagacccugcucgcccgcgcccgcgcaccuccgggucgcgaauggcccggcccgcgccggcccagcuuuuauacccggcaggccgcgucgcccccuagaguccgaggcggccucuguccccgggcugcggcggcgcggcgccugcuggguccuagcgcgcggccggcauggggcggcgaaccagcgcggcacagcgccgcgcuccccaggcaggccgcggcgcaacgcccaccgccuccagcgcgcccagcagagccgcggcgcucgcuccaagcuccgcccccggcccggccgucgcccccgcgcccacguggucgguagcgggggcccccuccuccugccugcccuaggcgcccguauccagccacggccgggagcccaggaguaucccgaggcugcacgggguagggguggggggcggagggcgagucuuggucuugagcugcuggggcgcggauucucuuucaaagccagaaccaggccugucccggacccgcgucccggggaggcugcagcgcagagcagcggggcug

SEQ ID NO: 19607 - RNA, 3202 nt, Homo sapiens
gccccuuaguucugaccucgccuuaggggccgccuccguuuccuaagccccguccugaucuaaaugaagucccgcccuuauuuccaggggcuugauugaaaaauguagaguccgccccaacaucagguucccuagggguugccccugccccauuuuggaccuacuagcaauuuugcucacgccuguaccccaagcucauguccccgggucacaucuauuuaaucucagucccaucucagguuccucccugaaugugauccuuuuuugaaacccugccacugccuacgucccacugcauguguugugucccuuaucuaaagacccacagggucucccaggcuacggugcaguggggccauugcucugucgcccaagcuggagugcaguggcaccaucacugcagccucgaacuccugggcucaagugacucuccugccucagccuucugagcagcugggacuacaggcgugcgccggcauacccagcuaacauuuuuauuuuuaucuuuguagagacaaggucucacuauguugcccaggcuggucucggacuccugggcucaagcgauccuccugccuuggccucccaguccugggaguacaggcgugagccaccgugcccuguccuuucuccuauuuuaauuucagcauaggccuugccccugcaucagaaaagaguccugauuugugccuuuguccuaccugaaguuccuccccuugcucccuuccaaucugguccgcccccuuggcugcuucguguccccgccuggacccugugcaggucacuccgcaaacgcucauaagcuggauauaaguggagagagucaucaucauacaugggccccuaggcuuucauggaggcaaggaagcaggcaaagcaaggcgucuagguggugauggacucuguuguuaaggcagcauaggcccuagcaacguggaagagcggaguuuguagacuuuaauugacagaaagauagugugagcuuugauuggcaggcuuuuggaggugggagggguuccucguugcugauaggucgagacgcuaagucugugggugcugauugguggagcggcagagccuggacagggcggcugauuuaauguacauuuuggcccgcagaaagcccaguucagcugggauccagagacugucggccucauacacggcuccuuuuucuggggcuacauugucacucagauuccaggaggauuuaucugucaaaaauuugcagccaacagguacagugguggggucucaaagugggcgguaacuacaguuguguggguggaguuagagggcguggucuugaauuugcgggcuggcucugguaaaugggagaagccuggauuugggggugggucuuagagaaagguggggcuugcgauugaggaagguguaagucagagagguggugggaccuggggucccggggaccacugggccuagcuugcugugggcgggaaaggcagaaucccgggcauggcuggauagcuuggauucuuuucucugacccuucccaucagaguuuucggcuuugcuauuguggcaacauccacucuaaacaugcugauccccucagcugcccgcguccacuauggcugugucaucuucgugaggauccugcagggguugguagagguaaauccccgccugauaugacccugcccucgcucggacccugccucuucucagugaccuugguuuucuccucuuuagggggucacauaccccgccugccaugggaucuggagcaaaugggccccacccuuagaacggagucgccuggcgacgacagccuuuuguggugagaggaagagggauccucacuccugaaucugagggaggagggguuggggccuggacuguugggucugagcggggaggggcugggggggcugaacuccugugucugagggaggaggaggagacucuggaccuggacucccaggucugagggaagaggggcuggggcuggacuccugggucugagagaggaggggcugggggccuggacucuugggucugagggaggagggacuggaggcccgcacuccugggucugagaggaggagcugggggccugcacuccugugucugagagaggagggguugggccuggacuccugggucugagggaggaggagcugggggccuggacuccugggucugggggaggaggagcugggggccuggauuccuggguccgagcgaggaggggcuaggccuggauuccugggucuaagggaggaggggcuguggccuguaauucagugucuggaaagggggaagcgguggggguccgcacuccuugaucugagggaagaugggccuguucucucccccgcauccucccccuuagguuccuaugcuggggcgguggucgcgaugccccucgccgggguccuugugcaguacucaggauggagcucuguuuucuacgucuacggugagggacccggaugccugguuccggguggcgcuggggcggagcggggccgguccucaccucgcucccaucccccuccugacccccccaggcagcuucgggaucuucugguaccuguucuggcugcucgucuccuacgagucccccgcgcugcaccccagcaucucggaggaggagcgcaaguacaucgaggacgccaucggagagagcgcgaaacucaugaacccccucacgguccgggaccaaaucuucggggaaggggcggggagagauagcaagccacgaaccugcacagcguguagaucagggacgguuccugcagacucuagaggagacgggacuggaacgcaaagagaggggcuagaaccuaggaggcggguugcaacccgcggaggacgagauucucaggugcugggggcaggguuaggucgggaguugagcaggauuagaaccacugacagggcauaguuaaagccagcagagaagggauuagaauguggggguuuugcuuagaccuugaguugaggcuguauuuugggagcauuuuugauaaaaagagacuccuagggcaggcucaguggcuuccgccugcaaucccaacacuuuggggguggaggcugcaggaucgcuugagcccaggaguuccagaccagcuugggcaacauggcgaaacccccgucucuacucaaaauacaaaauacaaaaaguaaaaauaaaaagaaaaaaagaaaaagacaggucccugaggggcccgga

SEQ ID NO: 19608 - RNA, 3202 nt, Homo sapiens
uccgggccccucagggaccugucuuuuucuuuuuuucuuuuuauuuuuacuuuuuguauuuuguauuuugaguagagacggggguuucgccauguugcccaagcuggucuggaacuccugggcucaagcgauccugcagccuccacccccaaaguguugggauugcaggcggaagccacugagccugcccuaggagucucuuuuuaucaaaaaugcucccaaaauacagccucaacucaaggucuaagcaaaacccccacauucuaaucccuucucugcuggcuuuaacuaugcccugucagugguucuaauccugcucaacucccgaccuaacccugcccccagcaccugagaaucucguccuccgcggguugcaacccgccuccuagguucuagccccucucuuugcguuccagucccgucuccucuagagucugcaggaaccgucccugaucuacacgcugugcagguucguggcuugcuaucucuccccgccccuuccccgaagauuuggucccggaccgugaggggguucaugaguuucgcgcucucuccgauggcguccucgauguacuugcgcuccuccuccgagaugcuggggugcagcgcgggggacucguaggagacgagcagccagaacagguaccagaagaucccgaagcugccugggggggucaggagggggaugggagcgaggugaggaccggccccgcuccgccccagcgccacccggaaccaggcauccgggucccucaccguagacguagaaaacagagcuccauccugaguacugcacaaggaccccggcgaggggcaucgcgaccaccgccccagcauaggaaccuaagggggaggaugcgggggagagaacaggcccaucuucccucagaucaaggagugcggacccccaccgcuucccccuuuccagacacugaauuacaggccacagccccuccucccuuagacccaggaauccaggccuagccccuccucgcucggacccaggaauccaggcccccagcuccuccucccccagacccaggaguccaggcccccagcuccuccucccucagacccaggaguccaggcccaaccccuccucucucagacacaggagugcaggcccccagcuccuccucucagacccaggagugcgggccuccagucccuccucccucagacccaagaguccaggcccccagccccuccucucucagacccaggaguccagccccagccccucuucccucagaccugggaguccagguccagagucuccuccuccucccucagacacaggaguucagcccccccagccccuccccgcucagacccaacaguccaggccccaaccccuccucccucagauucaggagugaggaucccucuuccucucaccacaaaaggcugucgucgccaggcgacuccguucuaaggguggggcccauuugcuccagaucccauggcaggcgggguaugugacccccuaaagaggagaaaaccaaggucacugagaagaggcaggguccgagcgagggcagggucauaucaggcggggauuuaccucuaccaaccccugcaggauccucacgaagaugacacagccauaguggacgcgggcagcugaggggaucagcauguuuagaguggauguugccacaauagcaaagccgaaaacucugaugggaagggucagagaaaagaauccaagcuauccagccaugcccgggauucugccuuucccgcccacagcaagcuaggcccagugguccccgggaccccaggucccaccaccucucugacuuacaccuuccucaaucgcaagccccaccuuucucuaagacccacccccaaauccaggcuucucccauuuaccagagccagcccgcaaauucaagaccacgcccucuaacuccacccacacaacuguaguuaccgcccacuuugagaccccaccacuguaccuguuggcugcaaauuuuugacagauaaauccuccuggaaucugagugacaauguagccccagaaaaaggagccguguaugaggccgacagucucuggaucccagcugaacugggcuuucugcgggccaaaauguacauuaaaucagccgcccuguccaggcucugccgcuccaccaaucagcacccacagacuuagcgucucgaccuaucagcaacgaggaaccccucccaccuccaaaagccugccaaucaaagcucacacuaucuuucugucaauuaaagucuacaaacuccgcucuuccacguugcuagggccuaugcugccuuaacaacagaguccaucaccaccuagacgccuugcuuugccugcuuccuugccuccaugaaagccuaggggcccauguaugaugaugacucucuccacuuauauccagcuuaugagcguuugcggagugaccugcacaggguccaggcggggacacgaagcagccaagggggcggaccagauuggaagggagcaaggggaggaacuucagguaggacaaaggcacaaaucaggacucuuuucugaugcaggggcaaggccuaugcugaaauuaaaauaggagaaaggacagggcacgguggcucacgccuguacucccaggacugggaggccaaggcaggaggaucgcuugagcccaggaguccgagaccagccugggcaacauagugagaccuugucucuacaaagauaaaaauaaaaauguuagcuggguaugccggcgcacgccuguagucccagcugcucagaaggcugaggcaggagagucacuugagcccaggaguucgaggcugcagugauggugccacugcacuccagcuugggcgacagagcaauggccccacugcaccguagccugggagacccugugggucuuuagauaagggacacaacacaugcagugggacguaggcaguggcaggguuucaaaaaaggaucacauucagggaggaaccugagaugggacugagauuaaauagaugugacccggggacaugagcuugggguacaggcgugagcaaaauugcuaguagguccaaaauggggcaggggcaaccccuagggaaccugauguuggggcggacucuacauuuuucaaucaagccccuggaaauaagggcgggacuucauuuagaucaggacggggcuuaggaaacggaggcggccccuaaggcgaggucagaacuaaggggc

SEQ ID NO: 19609 - RNA, 2933 nt, Homo sapiens
cuccuaggggaucccccggccccguuaaggcagccccaggcagagacccaguggagcccuggggcggggaaggggggcugcgggcgcuggggcggcuccaaccugggucccagcgagcagggggacccugcauccgccaaggccggcggcccccagcauggagacuuccgaagccacucccagcuccaccuuaagcgcccccccuuccccuugcugcggaggauggaaacagccugcucccggccccaggugucccggccacccccgcccgcguggccccagcgcggcugggagccgaggaccagcccccuaccuccuuccgaauccugcccuuucgcacaucccaccccaagccaacccgaggaguguuugccgcuaugagaucaccugcucccccagcccaacaacaaaauuaaauaacaccacgggagaggagagagggagggggaggagggaggaagggacaagagagaagagagacugaaacagggagaagaggcaggagaggaggagguggggagagcacgaagcuggaggccgacacugagggagggcgggaggaggugaagaaggagagaggggagaagaggcaggagcuggaaaggagagagggaggaggaggaggagaugcgggauggagaccuggaguuagguggcuugggagagcuuaaugaaaagagaacggagaggagguguggguuaggaaccaagagguagcccugggggcagcagaaggcugagaggaguaggaagaucaggagcuagagggagacuggaggguuccgggaaaagagcagaggaaagaggaaagacacagagagacgggagagagaagaagaguggguuugaagggcggaucucagucccuggcugcuuuggcauuuggggaacugggacucccuguggggaggagaggaaagcuggaaguccuggagggacagggucccagaaggaggggacagaggagcugagagaggggggcagggcguugggcaggggucccucggaggccuccuggggaugggggcugcagcucgucugagcgccccucgagcgcugguacucugggcugcacugggggcagcagguaagaccugggguucccgggaggagcccccgagggaggguggagguggggaugccaaggagagggauucaggcugcucucuucccagcucacaucggaccagcaccugaccccgaggacugguggagcuacaaggauaaucuccagggaaacuucgugccaggugccgccaaggcggggacccaggaguccggcccucccggcgccuccuucuucagacucaggaaccuggguucccagcucccuccucccccccaggaccaggagucccagcccccuccucugucccucaggagucgggccagcuucugaaccccaggggcucaccaugggacauuauacaugcgcauuucaaguagugagugggagugaguggaaggaaaguguggggguggagauuauguguguguuugccgggagaggaagguccuggcuccugcuaggaaccagaggcuggguggccccgucccccaccuuguccagccuucucuugcagcuccucuccccaacacauuaauaauaauccagcugugggauaagagcgauuaaaaaaaagaacuacaacucccacggggcucuggggcagguaggcagcagagggguaggcugguagcacuggggccugcugggaguuguaguuccaucuacaguggcuuaagauggguuugaucggcugggcgcgguggcucacgcuugaaaucccagcacuuuaggaggccgagguggguggauuaccuguggucaggaguucaagaccagccuggccaacuuggugaaacccgucucugcuaaacuuggaaacuauuccaagauucuucuaggacccagaauucuggaucugagcccaguccucccucagacccaggagucuaggucccuagccccuccuccccugggaucugggaguccagaccacagcccacucagcagauaccagcccugggauccagucucuauuucugacuccuuguccuccuacuccgaccccacccccagggccuccuuucuggggccuggugaaugcagcguggagucugugugcuguggggaagcggcagagccccguggauguggagcugaagaggguucuuuaugaccccuuucugcccccauuaaggcucagcacuggaggagagaagguaaggggcuuggagggaggagcuauugaacccacuggggaugggcaugaauagaggcuggggaauggggugcugagguaggagagcagccuugggggaggaggggacacccaguggguggagaggaggcugcuuacacuguaaaauggaucacccauucuucccaucccaagcaugguccccuagucuccccaucucugcagaagcaaugaaaagcagaacauuuccugugccaggcagauuuaaaaccuugauaagccucucaucucauaaccaccccacaaaauggguacaauuauuauuauuguuauuauuauuauuauuauuuugagauggaguuuugcucuuguugcccaggcuggagugcaaugaugugaucucagcucacugcaaccuccaccucccagguucaagcgauucuccugccccagccucccgaguaguugggauuacaggcaugcgcaccaucacgcccagcuaauuuuuuguauuuuuagcagagauggguuuucuccauuuuggucaggcuggucuugaacuccugaccucaggugauccaccugccucggccucccaaagugcuaggauuacaggcaugagccacugcguccagccaaaauggguacaauuauuaaccuuauuauauacaugcagaaacugacacacagagguuaaguuacuugccuaggaucacacagagagccagc

SEQ ID NO: 19610 - RNA, 2933 nt, Homo sapiens
gcuggcucucugugugauccuaggcaaguaacuuaaccucugugugucaguuucugcauguauauaauaagguuaauaauuguacccauuuuggcuggacgcaguggcucaugccuguaauccuagcacuuugggaggccgaggcagguggaucaccugaggucaggaguucaagaccagccugaccaaaauggagaaaacccaucucugcuaaaaauacaaaaaauuagcugggcgugauggugcgcaugccuguaaucccaacuacucgggaggcuggggcaggagaaucgcuugaaccugggagguggagguugcagugagcugagaucacaucauugcacuccagccugggcaacaagagcaaaacuccaucucaaaauaauaauaauaauaauaacaauaauaauaauuguacccauuuuguggggugguuaugagaugagaggcuuaucaagguuuuaaaucugccuggcacaggaaauguucugcuuuucauugcuucugcagagauggggagacuaggggaccaugcuugggaugggaagaaugggugauccauuuuacaguguaagcagccuccucuccacccacuggguguccccuccucccccaaggcugcucuccuaccucagcaccccauuccccagccucuauucaugcccauccccaguggguucaauagcuccucccuccaagccccuuaccuucucuccuccagugcugagccuuaaugggggcagaaaggggucauaaagaacccucuucagcuccacauccacggggcucugccgcuuccccacagcacacagacuccacgcugcauucaccaggccccagaaaggaggcccuggggguggggucggaguaggaggacaaggagucagaaauagagacuggaucccagggcugguaucugcugagugggcuguggucuggacucccagaucccaggggaggaggggcuagggaccuagacuccugggucugagggaggacugggcucagauccagaauucuggguccuagaagaaucuuggaauaguuuccaaguuuagcagagacggguuucaccaaguuggccaggcuggucuugaacuccugaccacagguaauccacccaccucggccuccuaaagugcugggauuucaagcgugagccaccgcgcccagccgaucaaacccaucuuaagccacuguagauggaacuacaacucccagcaggccccagugcuaccagccuaccccucugcugccuaccugccccagagccccgugggaguuguaguucuuuuuuuuaaucgcucuuaucccacagcuggauuauuauuaauguguuggggagaggagcugcaagagaaggcuggacaaggugggggacggggccacccagccucugguuccuagcaggagccaggaccuuccucucccggcaaacacacacauaaucuccacccccacacuuuccuuccacucacucccacucacuacuugaaaugcgcauguauaaugucccauggugagccccugggguucagaagcuggcccgacuccugagggacagaggagggggcugggacuccugguccugggggggaggagggagcugggaacccagguuccugagucugaagaaggaggcgccgggagggccggacuccuggguccccgccuuggcggcaccuggcacgaaguuucccuggagauuauccuuguagcuccaccaguccucggggucaggugcugguccgaugugagcugggaagagagcagccugaaucccucuccuuggcauccccaccuccacccucccucgggggcuccucccgggaaccccaggucuuaccugcugcccccagugcagcccagaguaccagcgcucgaggggcgcucagacgagcugcagcccccauccccaggaggccuccgagggaccccugcccaacgcccugccccccucucucagcuccucuguccccuccuucugggacccugucccuccaggacuuccagcuuuccucuccuccccacagggagucccaguuccccaaaugccaaagcagccagggacugagauccgcccuucaaacccacucuucuucucucucccgucucucugugucuuuccucuuuccucugcucuuuucccggaacccuccagucucccucuagcuccugaucuuccuacuccucucagccuucugcugcccccagggcuaccucuugguuccuaacccacaccuccucuccguucucuuuucauuaagcucucccaagccaccuaacuccaggucuccaucccgcaucuccuccuccuccucccucucuccuuuccagcuccugccucuucuccccucucuccuucuucaccuccucccgcccucccucagugucggccuccagcuucgugcucuccccaccuccuccucuccugccucuucucccuguuucagucucucuucucucuugucccuuccucccuccucccccucccucucuccucucccgugguguuauuuaauuuuguuguugggcugggggagcaggugaucucauagcggcaaacacuccucggguuggcuuggggugggaugugcgaaagggcaggauucggaaggagguagggggcugguccucggcucccagccgcgcuggggccacgcgggcggggguggccgggacaccuggggccgggagcaggcuguuuccauccuccgcagcaaggggaagggggggcgcuuaagguggagcugggaguggcuucggaagucuccaugcugggggccgccggccuuggcggaugcagggucccccugcucgcugggacccagguuggagccgccccagcgcccgcagccccccuuccccgccccagggcuccacugggucucugccuggggcugccuuaacggggccgggggauccccuaggag

SEQ ID NO: 19611 - RNA, 2596 nt, Homo sapiens
cuucucuguauagggacucuccugccuccuuuuuaguuuugaccaguggcagaguuuuugagccauaguuugaaucaucagugagguuacaggaagaaaaccugguggaagcugccuaagguguugcuguuuuaggcugggacacaauuaugggcuuucuucuaacugcuucuuauuuugcaagaucaacgguauuuuauaauacagggugggaaaggaguaugagaagggguuuggaaaucaggcuggaaauagguugggauugggggaggaucuaaucccccucccccugggcgacccuaggcaucccacacaagagggcaccccauguggucuugugaaaagcccgaagcccugaaugagucuuaaagagaaauuagccccggcugguaggugucucucggcggcguggagggacuagggccggucuguguguggcugcccggaggagcugaccaauuggucauggugcugaaaccuuuguggggaaucguggccaagugcacugacucugugggaaaacggcggcgugaagggaugccaacagcuccucgccgggaagggaaccgccucaaauugggaccaugacaauuccugcuaauuuguagagcagggaauuggugcaaagugucaagcagucacugcuugugcucaauagggcaucaaauuggcgcgacggauucaugaauguuauacgccucgcaaccucugaaccagagcauaaccccgagggguggacggagaaauacggcuucggagcagggagcgaugggccggggcuggggcgccgcccugccucgcgcaaagaagggggacgagaccuaccugggaaauaagaagaucugaugaaaggcugaaaagacccuucgaaguagggaaaggcgaaggucuugggagggacgcucuggagcaaggcuggggauguuucuggugggcgauggaggggggacagaaggagagagggagacagaaagaaucugauuacguacuugccuauuguauagcacacugaacacacgauauaauuagcccuucaucugguuucaaagacaucuuucuuauacguugacaggguaaaauaaaucuucccaacauugucuuaucuguaaaacucuuuucuuucuccccaacguaauucucugcgccgucccacucuaccccaaucuccauccuaggcacuaacgagauaggacugaguggggaggaaagaaauugcagauuuauaauauuugcuaauccaauaaauauaucauauugaguuuaaaaaaaaaaacugucuccuagaagcucgaaggcagaaacgcagacguccaggagcgugcgcucagcguuacugcaccagaugacugcgcacagucuccgacugcgugugcucaaguucacuccgaggauggggcgagccuggaggcuuuucuuccccggaauugacuggacuauucucacauugccugacguagggucucagaguucgugcguauugugugugcaccgaugugugugugggggcccgcucgcuagaggaaacugaggccaggaugacuccgcgcaugccuaguaccugaaugggcccuuaggguucugaccucgcuuaccuguucugggccccgaggagaggauggcguucacuccaaacuucagaaacgucgucucgcuggcaggggagaaggcagucggcggagagccgccccgucggcugccgggacccggggagcccagguccgaggcccccgugucggugagggccgugggggcccccugccugggcggcgacaugcuggcggugggcacgcugcggggcagguaggcggggggucggcugaugcggaucagauccuccaccaggaagcuggaguggccggaaaaugccgacugcaaggacuggggcagcgucaaggugggcgugggccgcaggaggcuaggguacccggcggggggcgcgaggaggccggggaacaucaugguaggcgcgggcgggcgaaauaacccuucuuucaguggccggaggguaaacgccucgcuucccgccccucccgcccccacaguguccucucucuugggcuuagcaaacgucuccaaguaacaaucccacuugggcgucugcgaguccuccgugguccucucgucgaggugaugguuuuauaguggcccgcccgcuaaagcacuuugaaaagugacagcucugacaaugaaguucaacaaaguucuccacucgagcuucauucgccggaggcucuggacucucugauuggcgcaggggugcaauuuaugauuggauuagucuucauaagcauggcccgcacaaugggccggcaacaaaggcccgcgcgcaucaauuuugcauaucgaccgccucuuugcaauacagugcgcccccaaagcucucgccaaagguuuuuguuccgaagcaacacccgggcuaauuaaaugccuauuuagaaguuucagaugacaucuugccucauagaaaaggaauuauuuaaagaacccacuaaauuuauuugcagcuccccugcuaagccuggaaaauaaaucaauaaauauucauagaaauacaucuucaggcuaucagcaaaguugcccucccucuugugggggu

SEQ ID NO: 19612 - RNA, 2596 nt, Homo sapiens
acccccacaagagggagggcaacuuugcugauagccugaagauguauuucuaugaauauuuauugauuuauuuuccaggcuuagcaggggagcugcaaauaaauuuaguggguucuuuaaauaauuccuuuucuaugaggcaagaugucaucugaaacuucuaaauaggcauuuaauuagcccggguguugcuucggaacaaaaaccuuuggcgagagcuuugggggcgcacuguauugcaaagaggcggucgauaugcaaaauugaugcgcgcgggccuuuguugccggcccauugugcgggccaugcuuaugaagacuaauccaaucauaaauugcaccccugcgccaaucagagaguccagagccuccggcgaaugaagcucgaguggagaacuuuguugaacuucauugucagagcugucacuuuucaaagugcuuuagcgggcgggccacuauaaaaccaucaccucgacgagaggaccacggaggacucgcagacgcccaagugggauuguuacuuggagacguuugcuaagcccaagagagaggacacugugggggcgggaggggcgggaagcgaggcguuuacccuccggccacugaaagaaggguuauuucgcccgcccgcgccuaccaugauguuccccggccuccucgcgccccccgccggguacccuagccuccugcggcccacgcccaccuugacgcugccccaguccuugcagucggcauuuuccggccacuccagcuuccugguggaggaucugauccgcaucagccgaccccccgccuaccugccccgcagcgugcccaccgccagcaugucgccgcccaggcagggggcccccacggcccucaccgacacgggggccucggaccugggcuccccgggucccggcagccgacggggcggcucuccgccgacugccuucuccccugccagcgagacgacguuucugaaguuuggagugaacgccauccucuccucggggcccagaacagguaagcgaggucagaacccuaagggcccauucagguacuaggcaugcgcggagucauccuggccucaguuuccucuagcgagcgggcccccacacacacaucggugcacacacaauacgcacgaacucugagacccuacgucaggcaaugugagaauaguccagucaauuccggggaagaaaagccuccaggcucgccccauccucggagugaacuugagcacacgcagucggagacugugcgcagucaucuggugcaguaacgcugagcgcacgcuccuggacgucugcguuucugccuucgagcuucuaggagacaguuuuuuuuuuuaaacucaauaugauauauuuauuggauuagcaaauauuauaaaucugcaauuucuuuccuccccacucaguccuaucucguuagugccuaggauggagauugggguagagugggacggcgcagagaauuacguuggggagaaagaaaagaguuuuacagauaagacaauguugggaagauuuauuuuacccugucaacguauaagaaagaugucuuugaaaccagaugaagggcuaauuauaucguguguucagugugcuauacaauaggcaaguacguaaucagauucuuucugucucccucucuccuucuguccccccuccaucgcccaccagaaacauccccagccuugcuccagagcgucccucccaagaccuucgccuuucccuacuucgaagggucuuuucagccuuucaucagaucuucuuauuucccagguaggucucgucccccuucuuugcgcgaggcagggcggcgccccagccccggcccaucgcucccugcuccgaagccguauuucuccguccaccccucgggguuaugcucugguucagagguugcgaggcguauaacauucaugaauccgucgcgccaauuugaugcccuauugagcacaagcagugacugcuugacacuuugcaccaauucccugcucuacaaauuagcaggaauugucauggucccaauuugaggcgguucccuucccggcgaggagcuguuggcaucccuucacgccgccguuuucccacagagucagugcacuuggccacgauuccccacaaagguuucagcaccaugaccaauuggucagcuccuccgggcagccacacacagaccggcccuagucccuccacgccgccgagagacaccuaccagccggggcuaauuucucuuuaagacucauucagggcuucgggcuuuucacaagaccacauggggugcccucuugugugggaugccuagggucgcccagggggagggggauuagauccucccccaaucccaaccuauuuccagccugauuuccaaaccccuucucauacuccuuucccacccuguauuauaaaauaccguugaucuugcaaaauaagaagcaguuagaagaaagcccauaauugugucccagccuaaaacagcaacaccuuaggcagcuuccaccagguuuucuuccuguaaccucacugaugauucaaacuauggcucaaaaacucugccacuggucaaaacuaaaaaggaggcaggagagucccuauacagagaag

SEQ ID NO: 19613 - RNA, 2619 nt, Homo sapiens
ucauaguucacauggguugauaggaaauuacguuaacgacacacugcauuuccccuuuucuuauagccuaucugauuugguagggagucgaucauuuuuuauuggaauuucucaggauuccaaccucagacauccacuuuacaguuuacacauuuucuuggacaagcccgacuguuccucucacugguucgcauaaagcucauguuuacaaagccgcccagaccuuucucugggacucucauauuuaacuuaauucuggauauacccagguaagcguuucccaagaaacuugaccccaacaucccaaaaacuuaagguaucuuucccuuaaacuggccccuucuccaguacgcauccaucucacuucucuccugcccuagaucuucucagcccaaacaggaaaccccgggaucgcucucccagcaggugaagccucgccauggacccuccccgucggggccccgcgcugccccgcccgcccccagccgcuggccaaggccgcggucgcgcaggcgcagugccgcgucccgccgccgccccgcccugcccgucgcugcggaaggcgccgcgcgcagcaacgcgcacuuccucuccaggaauccgcggagggagcgcaggcucgaagagcuccuggacgcagaggcccugcccuugccagacggcgcagacaugucagaacaaaguaaggaucugagcgacccuaacuuugcagccgaggcccccaacuccgaggugcacagcagcccugggguuucggaggggguuccuccguccgcgacccuggcagagccgcagagcccuccucuaggcccgacggccgcuccgcaggccgcgccgccuccccaggccccgaacgacgagggcgacccgaaggcccugcagcaggcugcggaggagggccgcgcccaccaggccccgagcgcggcccagccgggcccggcaccgccagccccggcgcagcuggugcagaaggcgcacgagcucaugugguacgugcuggucaaggaccagaagaagaugaucaucugguuuccagacauggugaaagaugucaucggcagcuacaagaaguggugcaggagcauccuccggcgcaccagccucauccucgcccggguguucgggcugcaccugaggcuaaccagccugcacaccauggaguuugcgcuggucaaagcgcuggagcccgaggagcuggacaggguggcgcugagcaaccgcaugcccaugacaggccuccugcucaugauccugagccucaucuacgugaagggccgcggcgccagagagagcgccgucuggaacgugcugcgcauccuggggcugcggcccuggaagaagcacuccaccuucggggacgugcggaagcucaucacugaggaguucguccaaaugaauuaccugaaguaccagcgcgucccauacguggagccgcccgaauacgaguucuuuuggggcucccgggccagccgcgaaaucaccaagaugcaaaucauggaguuccuggccagggucuuuaagaaagacccccaggccuggcccucccgauacagagaagcucuggaggaggccagagcucugcgggaggcuaaucccacugcccacuacccucgcagcagugucucugaggacuagcaaagucuggaggcagaugaaugguuucugacccucaccagggcuguggaagggugggggugggucauuauaguauucaggauuuacagugcaguauucacguguaacuuuuaaguuuucaguacagugcuuuuauaccuuuaaugcaauguuguauucauuuggguacuauuguguaguauuuaggauguaugcauguuuguuuauauguaagcuugguuggugcuuucgcuuuugugcuaccuuucuuggauuuuuguaccagagaugugcuaaacugaugaaauacauugagaaaguuuccaucuuauucuuuuauaugggacugaugauguguguugggguagacugcuccugcagaguuuggaagaagucaccagcaaagccggccuaaccaagaaaagucaaggcccuucaugaccuugcugggcacagaaaacacccucguggaguacacuaauuugaacuggacuggucucagugugagcacuuggcacacuuuacuaaacacauauacaaccccaccgugagucaacuuuaaaguaaacauuaaagauucuugugauacaaucauuuuuggaaaaguguacuuuaucauuuuaacaaagcaguaugguugggaaugagacaauucucuauuuuacaguguauacagauacaacuauuuccccuaauagggugggaaaaaucgcuacucaugauuacuccuaaauuugugaaguuuauaguucuauugucuuuaaauguaacucauguuuauuucaaaaacauucacaaauauagaaaaguauacaaaacaaaacaguaagauugucuguaaucacaucauaugggaauaaaaaacaaaaauaauuuccuucccuuaaguuucuacauuuuaucaaaauuaauagaugucuugugacaucuauuaauauacauauaacauauuuauaauauaaaagagugagacauugugcuaagcccuaacauguauuuuucucc

SEQ ID NO: 19614 - RNA, 2619 nt, Homo sapiens
ggagaaaaauacauguuagggcuuagcacaaugucucacucuuuuauauuauaaauauguuauauguauauuaauagaugucacaagacaucuauuaauuuugauaaaauguagaaacuuaagggaaggaaauuauuuuuguuuuuuauucccauaugaugugauuacagacaaucuuacuguuuuguuuuguauacuuuucuauauuugugaauguuuuugaaauaaacaugaguuacauuuaaagacaauagaacuauaaacuucacaaauuuaggaguaaucaugaguagcgauuuuucccacccuauuaggggaaauaguuguaucuguauacacuguaaaauagagaauugucucauucccaaccauacugcuuuguuaaaaugauaaaguacacuuuuccaaaaaugauuguaucacaagaaucuuuaauguuuacuuuaaaguugacucacggugggguuguauauguguuuaguaaagugugccaagugcucacacugagaccaguccaguucaaauuaguguacuccacgaggguguuuucugugcccagcaaggucaugaagggccuugacuuuucuugguuaggccggcuuugcuggugacuucuuccaaacucugcaggagcagucuaccccaacacacaucaucagucccauauaaaagaauaagauggaaacuuucucaauguauuucaucaguuuagcacaucucugguacaaaaauccaagaaagguagcacaaaagcgaaagcaccaaccaagcuuacauauaaacaaacaugcauacauccuaaauacuacacaauaguacccaaaugaauacaacauugcauuaaagguauaaaagcacuguacugaaaacuuaaaaguuacacgugaauacugcacuguaaauccugaauacuauaaugacccacccccacccuuccacagcccuggugagggucagaaaccauucaucugccuccagacuuugcuaguccucagagacacugcugcgaggguagugggcagugggauuagccucccgcagagcucuggccuccuccagagcuucucuguaucgggagggccaggccugggggucuuucuuaaagacccuggccaggaacuccaugauuugcaucuuggugauuucgcggcuggcccgggagccccaaaagaacucguauucgggcggcuccacguaugggacgcgcugguacuucagguaauucauuuggacgaacuccucagugaugagcuuccgcacguccccgaagguggagugcuucuuccagggccgcagccccaggaugcgcagcacguuccagacggcgcucucucuggcgccgcggcccuucacguagaugaggcucaggaucaugagcaggaggccugucaugggcaugcgguugcucagcgccacccuguccagcuccucgggcuccagcgcuuugaccagcgcaaacuccauggugugcaggcugguuagccucaggugcagcccgaacacccgggcgaggaugaggcuggugcgccggaggaugcuccugcaccacuucuuguagcugccgaugacaucuuucaccaugucuggaaaccagaugaucaucuucuucugguccuugaccagcacguaccacaugagcucgugcgccuucugcaccagcugcgccggggcuggcggugccgggcccggcugggccgcgcucggggccuggugggcgcggcccuccuccgcagccugcugcagggccuucgggucgcccucgucguucggggccuggggaggcggcgcggccugcggagcggccgucgggccuagaggagggcucugcggcucugccagggucgcggacggaggaacccccuccgaaaccccagggcugcugugcaccucggaguugggggccucggcugcaaaguuagggucgcucagauccuuacuuuguucugacaugucugcgccgucuggcaagggcagggccucugcguccaggagcucuucgagccugcgcucccuccgcggauuccuggagaggaagugcgcguugcugcgcgcggcgccuuccgcagcgacgggcagggcggggcggcggcgggacgcggcacugcgccugcgcgaccgcggccuuggccagcggcugggggcgggcggggcagcgcggggccccgacggggaggguccauggcgaggcuucaccugcugggagagcgaucccgggguuuccuguuugggcugagaagaucuagggcaggagagaagugagauggaugcguacuggagaaggggccaguuuaagggaaagauaccuuaaguuuuugggauguuggggucaaguuucuugggaaacgcuuaccuggguauauccagaauuaaguuaaauaugagagucccagagaaaggucugggcggcuuuguaaacaugagcuuuaugcgaaccagugagaggaacagucgggcuuguccaagaaaauguguaaacuguaaaguggaugucugagguuggaauccugagaaauuccaauaaaaaaugaucgacucccuaccaaaucagauaggcuauaagaaaaggggaaaugcagugugucguuaacguaauuuccuaucaacccaugugaacuauga

SEQ ID NO: 19615 - RNA, 2247 nt, Homo sapiens
cauuccauaugacaacccccauguuccucucacuucuaauuuuuaaaagucagucucaaaucuuuaacucacagcugcaaacuguacucuuaaaauauuugugaaauugugcagauguuauuuccaucuguccuuuugagaacuacugauagugugauuugggaauauuuccaauucuggcugaggcagggcagggcgagggccaaacgcuagggcuggacugggcauaguuuacaucagccacaggugucaccccgccggugucagaggguuugcuucccugaaauaguaacuguuuauaucacucugcacuuguaauaacauccugccaaagggccccacuuucccacaacuuuuacacuacgcagagaucugacgucagcgugugcugugagcaaaacaucuucgaucaagcucuguucugcaugaggguugcugccccucccaagaucaaacaaggcagccgcccagagagccacaacugcggcuuccaacugggaaaucauauuggcaaaauaaaaaccguuuuggaaauuaauuugaguuuuccccugaggagcgcuauagacagcggggcuaccauaagccgucacuucugcaagugagagagguuucucgguugacucuuagaucugggucuacugagucuacggagcacggaaaauggaaggaaaaccuagagcuaacaggguggccuaucaggaugcgcccagucacgcuugucaagaguuaaagcagcugccaccuaaccccaugacgaggacggggcuauccgcuaggaccugccgccccgcgcucgcccgcugagucgauggaccagcggaccgaguccggguccccaugccauucgggcacccucugggcgggcccuaccgguccgcgacgccgcgccccuggugaaggggccgcugccccacgccgucaagggcagggugcuggggcgacggcagcggguauggggucagcgcgccauccccgcgcacggaccugccgcuccucggccuguaucccguacuccucgcgcauccgcagcagcgcguccuccagccgcgcgcgcagcugcuccaacccgagcgccucgcgccgcagcgccuugccuccugcgcgcacagccgcgucucuuccuccgccuggagucugcucuccuggccgcgccgcagcgccuccuccagcucgcgcaccucguccucguacagcugcaccgucucccgccacgacucggccaccagcagugcguagcugucgugcaccucccgcaggcguggcggcggcgcggcggggccgguggcgcgggcgcggaaaugcaugguaaggcuggcggcgcgcgcgcgcagcucccucacgucgcguucgugggccgcgucgaggccucggcgcucggccugcagccggcccagcagcgccucgagggcggcgcgcgcgcccagcgccuccugcagcucgcgcugcugcgcacccagcucggcguccaggcggccgcgggcggcgcgcuccuccgcauccaggcgcugcagcucccgcagcucgcgccgcagagcgucccgcucgcccuccgccagcgcaguggcccagcucagcucguccagcugcugccgcaagcugcgcgccuccucggcgcagcgggccugccccucggcccacaggcccucucgcccgcgccggccgcgcagcuccuccuccaggaguagguuuucgcgcuccagcucccgcacccgacacacguagucauagagccgggcguugagcuccuggagcucggccuucucggggcccgucugcagccgccaggacagcaucuugccgggcgugcgggguucucgcggcuggccggcucccuccugcccuggucuugucccggucucguccucuccgccgcgacgcuccggccucgccgcugccccggaggcccgcagacugggacgcgagcgggagagcccaggcacuuagcggacggggcgggcagacugggcgggcggccugggcgagggccgcggccuccagccaaucagagcgcggcccggcgcggccucugcggccgcacagcgcccccugccgcaccuuggcggccgcagguggucggugcgggcagucggguaacagcgggcgggguggcgggcuagccaggccgggcucagcgaagggacgccggagagggcguccgggagcauacgaguguccuggccuugguggauggaaauagaagccuauugaguugcuguggugcuggcgauuuuggagcgacuucuu

SEQ ID NO: 19616 - RNA, 2247 nt, Homo sapiens
aagaagucgcuccaaaaucgccagcaccacagcaacucaauaggcuucuauuuccauccaccaaggccaggacacucguaugcucccggacgcccucuccggcgucccuucgcugagcccggccuggcuagcccgccaccccgcccgcuguuacccgacugcccgcaccgaccaccugcggccgccaaggugcggcagggggcgcugugcggccgcagaggccgcgccgggccgcgcucugauuggcuggaggccgcggcccucgcccaggccgcccgcccagucugcccgccccguccgcuaagugccugggcucucccgcucgcgucccagucugcgggccuccggggcagcggcgaggccggagcgucgcggcggagaggacgagaccgggacaagaccagggcaggagggagccggccagccgcgagaaccccgcacgcccggcaagaugcuguccuggcggcugcagacgggccccgagaaggccgagcuccaggagcucaacgcccggcucuaugacuacgugugucgggugcgggagcuggagcgcgaaaaccuacuccuggaggaggagcugcgcggccggcgcgggcgagagggccugugggccgaggggcaggcccgcugcgccgaggaggcgcgcagcuugcggcagcagcuggacgagcugagcugggccacugcgcuggcggagggcgagcgggacgcucugcggcgcgagcugcgggagcugcagcgccuggaugcggaggagcgcgccgcccgcggccgccuggacgccgagcugggugcgcagcagcgcgagcugcaggaggcgcugggcgcgcgcgccgcccucgaggcgcugcugggccggcugcaggccgagcgccgaggccucgacgcggcccacgaacgcgacgugagggagcugcgcgcgcgcgccgccagccuuaccaugcauuuccgcgcccgcgccaccggccccgccgcgccgccgccacgccugcgggaggugcacgacagcuacgcacugcugguggccgagucguggcgggagacggugcagcuguacgaggacgaggugcgcgagcuggaggaggcgcugcggcgcggccaggagagcagacuccaggcggaggaagagacgcggcugugcgcgcaggaggcaaggcgcugcggcgcgaggcgcucggguuggagcagcugcgcgcgcggcuggaggacgcgcugcugcggaugcgcgaggaguacgggauacaggccgaggagcggcagguccgugcgcggggauggcgcgcugaccccauacccgcugccgucgccccagcacccugcccuugacggcguggggcagcggccccuucaccaggggcgcggcgucgcggaccgguagggcccgcccagagggugcccgaauggcauggggacccggacucgguccgcugguccaucgacucagcgggcgagcgcggggcggcagguccuagcggauagccccguccucgucaugggguuagguggcagcugcuuuaacucuugacaagcgugacugggcgcauccugauaggccacccuguuagcucuagguuuuccuuccauuuuccgugcuccguagacucaguagacccagaucuaagagucaaccgagaaaccucucucacuugcagaagugacggcuuaugguagccccgcugucuauagcgcuccucaggggaaaacucaaauuaauuuccaaaacgguuuuuauuuugccaauaugauuucccaguuggaagccgcaguuguggcucucugggcggcugccuuguuugaucuugggaggggcagcaacccucaugcagaacagagcuugaucgaagauguuuugcucacagcacacgcugacgucagaucucugcguaguguaaaaguugugggaaaguggggcccuuuggcaggauguuauuacaagugcagagugauauaaacaguuacuauuucagggaagcaaacccucugacaccggcggggugacaccuguggcugauguaaacuaugcccaguccagcccuagcguuuggcccucgcccugcccugccucagccagaauuggaaauauucccaaaucacacuaucaguaguucucaaaaggacagauggaaauaacaucugcacaauuucacaaauauuuuaagaguacaguuugcagcugugaguuaaagauuugagacugacuuuuaaaaauuagaagugagaggaacauggggguugucauauggaaug

SEQ ID NO: 19617 - RNA, 2534 nt, Homo sapiens
acgucuuggggaaccgggcuccgguuuuuugcgcgcgccggccugggccgggcccucggcgcgccgcugcugcggcgguggccgcucgagugugcgagcgggcgcgugugcgcgggccagggcgcgcgcgcgcgcgcgagcccccaguguguggcagcggcggcggcggcgcggcgaggcuggggcucuuguuuaccagcauuaacuccgcugagcggaaaaaaaaagggaaaaaacccgaggaggagcgagcgcaccaggcgaacucgagagaggcgggagagcgagagggacgccgccagcgagccugcccacggccggcgcucgcagacccucggccccgcuccccggauccccccgcgcccuccacgccccucccgcgcgggggcagcuccacggcgcgccucgccucggcugugaccuucagcgagccggagcccccgcgcagagcaggcggcggcgggcgggggccgggcgggggccggcgcggggcgggcggcggcgcagagccgggcggcgcggcgggagugcugagcgcggcgcggccggcccgccgcuuuguguguguccuggauuugggaaggagcucgccgcggcggcggcggcgcugagggaggaggcggcggcgagcggagccaggaggaggaggaggagggggagccgcucauucauuuugacuccgcguuucugccccucgccggccucgccugugacccggacuucggggcgaucuugcgaacugcgucgcgcccucccgcggcggaagcucgggcguccggccgccucccgcgcggccagggccgggcuuguuuuuccucgccuaggcagauuugggcuuugcccccuuucuuugcaguuuuccccccuuccugccucuccggguuugaaaauggaggccgacgacgccgacagcccgccccggcgcgccucggguucccgacuccgccgagcccugggccgcugcugccggcgcugaggggccgccccgcgccgcccgccccguccgcgcacccggagggccccggcggcgccgccuucggaguauuguuuccuucgcccuuguuuuuggagggggagcgaagacugaguuugagacuuguuuccuuucauuuccuuuuuuucuuuucuuuucuuuuuuuuuuuuuuuuuuuuuuuugagaaaggggaauuucaucccaaauaaaaggaaugaagucuggcuccggaggaggguccccgaccucgcugugggggcuccuguuucucuccgccgcgcucucgcucuggccgacgaguggagaaagugaguaugugcccgccgcccgcggccacugcgggaacuuuuccuccgaggggcugcgcccuguuugcgaaacccgaguugccaccgucgcagcugucgggcccccgggcucgggagcggcgggguggggcgcagggcggcucugccgggagggaggcugcagcggacccgggacccgggcucguucgucuggagccccgcgggcccuggcuccgcgcauccccgcgcgggaagggcuuuucucuuucuccguccugacagcccagccguguuucccggcuaggcgcgaggacucgguagggaaguuggugccggggcgggcuccgcgguucccgggccccgcgacccgcaccucgccccuuccaugcgcaagagccucuccgcacacagcgcugauccccugcggcgcgcaggcagcagcgacagcacccugggccgcaccgcgucuccgcugcuggggcugaccgggcaguggggagcgggcagccgcccggcccgcggggugcgaguugcccucgaggggggaggugcccugcggagaggccccgaagccccaggacacgucuccaagcgcccgucgcugccucccgucgcccaacgugcuuuugccccucgggcuccucggguuccuggccuugcccgucacuuuggcccgcuccucguuggguuaccugcccccggcgucccggggcugggcgguggggugaggggaagcgcucucugggcagccccccgggaagugcgaggccgggagucuuccucagcuugucucuuccggggagcgccacuggguccccaguucagagggcucugggauggucucccaguuucucccgggccgggggauggagggguacuagggccgcauccgagugugcguugguggguguguggucggagccgacgugcauuccgacacacgugcucgcagcgcgggguguagucgccgccucacggggacaccuagacgcccgucccuggcgagaggugucguacgcugugguuucagcgccagggucugcggcggcgcggggaggguguuguguuuugcgagcgcggagcccuggccuugguuuuguuguggucggcgucgugucgcccucucuucugccgccccgcacuuccuuuguacguaguuaauaagcagugucgcuccacauucgcugucuuuugcaaucugauagcuuuuguuuugguggugucggguggggguuaguagggaagcgcggggaugcggggagcgagaacuccc

SEQ ID NO: 19618 - RNA, 2534 nt, Homo sapiens
gggaguucucgcuccccgcauccccgcgcuucccuacuaacccccacccgacaccaccaaaacaaaagcuaucagauugcaaaagacagcgaauguggagcgacacugcuuauuaacuacguacaaaggaagugcggggcggcagaagagagggcgacacgacgccgaccacaacaaaaccaaggccagggcuccgcgcucgcaaaacacaacacccuccccgcgccgccgcagacccuggcgcugaaaccacagcguacgacaccucucgccagggacgggcgucuagguguccccgugaggcggcgacuacaccccgcgcugcgagcacgugugucggaaugcacgucggcuccgaccacacacccaccaacgcacacucggaugcggcccuaguaccccuccaucccccggcccgggagaaacugggagaccaucccagagcccucugaacuggggacccaguggcgcuccccggaagagacaagcugaggaagacucccggccucgcacuucccggggggcugcccagagagcgcuuccccucaccccaccgcccagccccgggacgccgggggcagguaacccaacgaggagcgggccaaagugacgggcaaggccaggaacccgaggagcccgaggggcaaaagcacguugggcgacgggaggcagcgacgggcgcuuggagacguguccuggggcuucggggccucuccgcagggcaccuccccccucgagggcaacucgcaccccgcgggccgggcggcugcccgcuccccacugcccggucagccccagcagcggagacgcggugcggcccagggugcugucgcugcugccugcgcgccgcaggggaucagcgcugugugcggagaggcucuugcgcauggaaggggcgaggugcgggucgcggggcccgggaaccgcggagcccgccccggcaccaacuucccuaccgaguccucgcgccuagccgggaaacacggcugggcugucaggacggagaaagagaaaagcccuucccgcgcggggaugcgcggagccagggcccgcggggcuccagacgaacgagcccgggucccggguccgcugcagccucccucccggcagagccgcccugcgccccaccccgccgcucccgagcccgggggcccgacagcugcgacgguggcaacucggguuucgcaaacagggcgcagccccucggaggaaaaguucccgcaguggccgcgggcggcgggcacauacucacuuucuccacucgucggccagagcgagagcgcggcggagagaaacaggagcccccacagcgaggucggggacccuccuccggagccagacuucauuccuuuuauuugggaugaaauuccccuuucucaaaaaaaaaaaaaaaaaaaaaaaagaaaagaaaagaaaaaaaggaaaugaaaggaaacaagucucaaacucagucuucgcucccccuccaaaaacaagggcgaaggaaacaauacuccgaaggcggcgccgccggggcccuccgggugcgcggacggggcgggcggcgcggggcggccccucagcgccggcagcagcggcccagggcucggcggagucgggaacccgaggcgcgccggggcgggcugucggcgucgucggccuccauuuucaaacccggagaggcaggaaggggggaaaacugcaaagaaagggggcaaagcccaaaucugccuaggcgaggaaaaacaagcccggcccuggccgcgcgggaggcggccggacgcccgagcuuccgccgcgggagggcgcgacgcaguucgcaagaucgccccgaaguccgggucacaggcgaggccggcgaggggcagaaacgcggagucaaaaugaaugagcggcucccccuccuccuccuccuccuggcuccgcucgccgccgccuccucccucagcgccgccgccgccgcggcgagcuccuucccaaauccaggacacacacaaagcggcgggccggccgcgccgcgcucagcacucccgccgcgccgcccggcucugcgccgccgcccgccccgcgccggcccccgcccggcccccgcccgccgccgccugcucugcgcgggggcuccggcucgcugaaggucacagccgaggcgaggcgcgccguggagcugcccccgcgcgggaggggcguggagggcgcggggggauccggggagcggggccgagggucugcgagcgccggccgugggcaggcucgcuggcggcgucccucucgcucucccgccucucucgaguucgccuggugcgcucgcuccuccucggguuuuuucccuuuuuuuuuccgcucagcggaguuaaugcugguaaacaagagccccagccucgccgcgccgccgccgccgcugccacacacugggggcucgcgcgcgcgcgcgcgcccuggcccgcgcacacgcgcccgcucgcacacucgagcggccaccgccgcagcagcggcgcgccgagggcccggcccaggccggcgcgcgcaaaaaaccggagcccgguuccccaagacgu

SEQ ID NO: 19619 - RNA, 2611 nt, Homo sapiens
cuaaacauagacccgguuagguauuauguacuuugcauaugucacaguacagacccacauauauuuuauuaaugugaauuugcaucucuguaauacauguacuuauuuaaauauuuuaacaguuaaauuuccccuaaggaagugccgauaaacugacucccaaaacacaauuauccccuaucccucaaauuccaagggcuaauagguacugucugcaacugcauauuauaacuauagacacaauaaguguauuuuauagaacagaaaacaagguaugcuuuugacuacaggguucacuugcagucuacaaguuacgaaugcacaagacagagaccgggauguaaacgcuuuucgucucagaaugagcaacagaaauguauuugauuuucaaaagcccugaaauucugucaccccaggaacagagcugaguuugaagacccccucucucacaaccaccuaacuuccucaacaccggagaccaagcacugcuuguauuucccuuuaacagugagcccugagccuuaagagauaguuuaugaaugguauacagcccccagcgucuggcccucaugaacuuuaccccaaggccaggaaugagggauuaaucauagcaucaggauacgcgugguucuaucucuggaugugguuauucaauggccaaaaucuuguccaauucuaucuccaucaaacuugcucaggaauacucaaagucuaugacauuugauuccaguugcgggucaauagccaaguaaugauuuaacacuauaaacucucaaaaaaaauuucccguuuagacaggacuguacuuagguguggaagcacgcucucuggaacucaaguugcgaccaccugagcagaggaggcgaaagcgacaaaguagguaccugacagugcugagucauuacaagcuguuuccucugaaauguuacgcacccaugggcccucugagcauuaacauccccuuucuggaggcaaauaaaauacauauucauuguggaaaauggugcaaccuucuguaggcgacagaccacgauggggaauuuagcacuaagaguggauagcaggaacuacacaaacucgcagcugcucucuagguaccguaacuuuaucccagacgcucaaagagggcuauagggauaccggguggcaauauucccccugcagccccggcucaggccagggccacacuagggcgcauuucacucuaagcuguuauaucccccuguaauuggcggauguagaaagcgcccggagaaaaugaugcauaauagauuuguucucgaggaggaugcaauggagaguagaggacgcaggaugcuaacugguuuuucuucccaugugcaggucaccugaaaaccccgacgcuuuuucguuccucuccaaggagaacccugaacucaccgucucgcuccgcucuuauggggggagaggaauaguuucacgcccaccugcccgccgccucuccucccccggcacccccugccccagccggacgcgcgcgagcugcuaccggcaucaacggucccgcccgcuacccgcucgcuggcagccccggccggcagcucccccggcggccgccucugcaccacucgccaaccuccacgccgggccgaggucaugcccgccugcccccagcgccgggcggcccccucgucgggccaggcggccgcucgagagccgggcuggggaaggggcccgcggcggaguuggcucggggacucaccagguaggcgcccaccgugcccugcgccagcaucagggcgcacucggacaccaggaagaucuugauguuggaaaagcaggacaccuucuuuuucuuuuucuuguuccucugcgccucgucccccugcagcucgccgcuccggccgccgcccgacgaaccgcccggcuucuuccccugcauccuucccccgccgccgccgccgccgccgccgcugccgcuuucccgcucgccccgggugucggggccgcugccgggcgggggugcgcgccucgaggcugcgugcuguccccgccccggguucgcggcggccgcccccguccugccggggcuggagagguggaaggcacagcuccucgccgccgccgccgccgccgcgaucgccccuuccuccuccuccucccccgccuccgcccuccccuggccuccuccuccggcuccggcugugccaaucacaggggcucgucgcgccgcccgccgccgccgcugccucgccucccgcggccgcccgccgcugccaucgcccgguuccccuugcccgccggccgcgccugcucucacccccucagccccagccccaaggccugggccugggccgccgcugcgcgcccucgccgagccgcuccucgcugccggugcgcccccggggaggcacgggaggcgggcuugggaugcggagggcggcccggcggccgaggcugggaggguccggcugccgggagaacuggggagacccggaguccuugcggaguaaggggggugccccugagggcgggaggcggcgcccggccccuagguggcgcugcggggcacggggccccgcggcggagacuggcggcucugcgccgggcgcggagauggggugcggaggcgcccccgcggggcugggac

SEQ ID NO: 19620 - RNA, 2611 nt, Homo sapiens
gucccagccccgcgggggcgccuccgcaccccaucuccgcgcccggcgcagagccgccagucuccgccgcggggccccgugccccgcagcgccaccuaggggccgggcgccgccucccgcccucaggggcaccccccuuacuccgcaaggacuccgggucuccccaguucucccggcagccggacccucccagccucggccgccgggccgcccuccgcaucccaagcccgccucccgugccuccccgggggcgcaccggcagcgaggagcggcucggcgagggcgcgcagcggcggcccaggcccaggccuuggggcuggggcugagggggugagagcaggcgcggccggcgggcaaggggaaccgggcgauggcagcggcgggcggccgcgggaggcgaggcagcggcggcggcgggcggcgcgacgagccccugugauuggcacagccggagccggaggaggaggccaggggagggcggaggcgggggaggaggaggaggaaggggcgaucgcggcggcggcggcggcggcgaggagcugugccuuccaccucuccagccccggcaggacgggggcggccgccgcgaacccggggcggggacagcacgcagccucgaggcgcgcacccccgcccggcagcggccccgacacccggggcgagcgggaaagcggcagcggcggcggcggcggcggcggcgggggaaggaugcaggggaagaagccgggcgguucgucgggcggcggccggagcggcgagcugcagggggacgaggcgcagaggaacaagaaaaagaaaaagaagguguccugcuuuuccaacaucaagaucuuccugguguccgagugcgcccugaugcuggcgcagggcacggugggcgccuaccuggugaguccccgagccaacuccgccgcgggccccuuccccagcccggcucucgagcggccgccuggcccgacgagggggccgcccggcgcugggggcaggcgggcaugaccucggcccggcguggagguuggcgaguggugcagaggcggccgccgggggagcugccggccggggcugccagcgagcggguagcgggcgggaccguugaugccgguagcagcucgcgcgcguccggcuggggcagggggugccgggggaggagaggcggcgggcaggugggcgugaaacuauuccucuccccccauaagagcggagcgagacggugaguucaggguucuccuuggagaggaacgaaaaagcgucgggguuuucaggugaccugcacaugggaagaaaaaccaguuagcauccugcguccucuacucuccauugcauccuccucgagaacaaaucuauuaugcaucauuuucuccgggcgcuuucuacauccgccaauuacagggggauauaacagcuuagagugaaaugcgcccuaguguggcccuggccugagccggggcugcagggggaauauugccacccgguaucccuauagcccucuuugagcgucugggauaaaguuacgguaccuagagagcagcugcgaguuuguguaguuccugcuauccacucuuagugcuaaauuccccaucguggucugucgccuacagaagguugcaccauuuuccacaaugaauauguauuuuauuugccuccagaaaggggauguuaaugcucagagggcccaugggugcguaacauuucagaggaaacagcuuguaaugacucagcacugucagguaccuacuuugucgcuuucgccuccucugcucagguggucgcaacuugaguuccagagagcgugcuuccacaccuaaguacaguccugucuaaacgggaaauuuuuuuugagaguuuauaguguuaaaucauuacuuggcuauugacccgcaacuggaaucaaaugucauagacuuugaguauuccugagcaaguuugauggagauagaauuggacaagauuuuggccauugaauaaccacauccagagauagaaccacgcguauccugaugcuaugauuaaucccucauuccuggccuugggguaaaguucaugagggccagacgcugggggcuguauaccauucauaaacuaucucuuaaggcucagggcucacuguuaaagggaaauacaagcagugcuuggucuccgguguugaggaaguuaggugguugugagagagggggucuucaaacucagcucuguuccuggggugacagaauuucagggcuuuugaaaaucaaauacauuucuguugcucauucugagacgaaaagcguuuacaucccggucucugucuugugcauucguaacuuguagacugcaagugaacccuguagucaaaagcauaccuuguuuucuguucuauaaaauacacuuauugugucuauaguuauaauaugcaguugcagacaguaccuauuagcccuuggaauuugagggauaggggauaauuguguuuugggagucaguuuaucggcacuuccuuaggggaaauuuaacuguuaaaauauuuaaauaaguacauguauuacagagaugcaaauucacauuaauaaaauauaugugggucuguacugugacauaugcaaaguacauaauaccuaaccgggucuauguuuag

SEQ ID NO: 19621 - RNA, 2746 nt, Homo sapiens
cccaaauagaaacacuguucaaaugacuuuucagacuaacuucucaugacgcuauuaggagaggggguaaaggcaccaaaucaccgugaucuuaaguggccucccgaaggucucauguacagcgcucuacugugauucucugcguggccuuuacugccugacauuuacuuggguauuugcuuacugccugugaucuucccaccagaaagugagucccacauaaacaggggucuaguccuaauucaacacaucagcgcucccuacgugagcacccagcccguaacaggaccucagaaaauguucacugaaacaaacuauuaagcugggcccccaugccugcuuauguccccaacccugccccuacuuaccaggccgagggggauauggccaccgccaauguggggcaaguucccucugccaagcagaccuccacgucgaacaccagggcccgcuccucggggauggccacggguacggccucccccucggggccguaccggguccagcccuccgcccaggcccaagccgggggcuucgggggcagcugggccugcaacagcaaguuggccgccuccagguagggcaggcucugcuucugggccaggaggcggaagugcugguccagguuguccccguagaggggcggcaggcgcagcuccacgucgggcaagggcacggcuggcugcccccagagcccgugcuucugcaggugcucgacgcugcggcgcaccgcggccucgccaggcaucuccccuccuugcccgaagauuugcucgugcagcccucucgagagcaucuggauguccaauggguugugccgcagcugcccgcccuccgaggauagcacuugcggcugcugaggcugcuguugcugcugcugcugcugcugcugcugcugcugccgccgccgcugcccgucgcuggggucggacgcggggacggagcuggagacccagcgccccggagcuggaaccggcccuggcccgacgguggcgccggccaccuuccuccagagcaggcggcucaugguuggugcagggacccccacgcugggagucagaacaccuggcuuugggcuccagcuuggcuucuuuuacuggcuggaagacguggagagagacacguccugucucugcucuccugucagugaaauggguuugaccaugccugccuuccaccccaaauccuaaaggagacagaugauauaaagcguuauuuuaccauauauguaauagguguauccauaaucaucauuccuugagcauuuacugcguccccaacacugugccaggcgcuucaguugcauuuuccguuaagccucaaaacuugggaaacgucaauaccccuccugggggaaccgggguccacgcaacuucgucagugaacccacguggggaagccgagggcagcgaguaagagagcaguaucuggaguagggcgacgcgguuuugaaccccgcuucuggcucucucgagcugugugaccuugggcaaagcuccuuaggcccugauauccuauucuguaaaaugggauuacggauucugccugucacaccgggcugcugucugggggacacagggcgccuaugucgugcggcccugcucuuggcaagcgcucggcaaaugguggcugccauuaccgcgaccggcgcgggccuagcgucgagaggugccagcgcccggauucgaacccgcagggugggccgccgucccccgggacccacacccacacccggaccacggcccacccggccgagagcguccugcaggaggagucggcggccacccccgugcgccccgccgcccgccugcgcccggcagaggcgccgcggugcgcccugggacuagccgccgcccugcuccgggccucgcucccugacuggagagggaggggccgcgccgucgcucagcgacccggccuccccgccgccgaccccgccggaaaccucgguccucacggugcuucccggucugcugcucccccgaccccaggcccacggcacggcgucccccuucgcgcggccuacgcagccucgggguagcguguggccuccacccggccgguccgcuucgcuggcagccgcaacuucccgucugcacccagcuaggucccgcggcuacccgagaggcaagcgggagacucccagcgcgaccaauaggagggccgccaauggagcgguccgcccgcggggggagaagggggacuucugggugggcucucccugcggaacgcgcgaaccaaaggccaaccuccccuucucaaggagcagguggauuggucccgagcuagcuggugggcggaggugacguuuuuauaaguugcucaagagacgguaacaaccgacgggccgcguggccuaauggauaaggcgucugacuucggaucagaagauugcagguucgaguccugccgcggucgaagggagguuaugauuaacuuuuaguuuauuccucccucaggaacgaaguauugggacaaugugaacguagucgccgccgauucccaccgcacuucaaagaugugggaacgccaagauccgcggaaguaaccacgcccagcaagucccugcgagauugcccgccuacgugucucagcggaggcacauuucuaaaauguaccaggucucucgcaccccgacgcagguggaggaaaguggagagggaggggcauccuguacagaaaucucaauuuauacucaauugaugguuggcaagaguuggggcucgcagccaaagcgaggcucccu

SEQ ID NO: 19622 - RNA, 2746 nt, Homo sapiens
agggagccucgcuuuggcugcgagccccaacucuugccaaccaucaauugaguauaaauugagauuucuguacaggaugccccucccucuccacuuuccuccaccugcgucggggugcgagagaccugguacauuuuagaaaugugccuccgcugagacacguaggcgggcaaucucgcagggacuugcugggcgugguuacuuccgcggaucuuggcguucccacaucuuugaagugcggugggaaucggcggcgacuacguucacauugucccaauacuucguuccugagggaggaauaaacuaaaaguuaaucauaaccucccuucgaccgcggcaggacucgaaccugcaaucuucugauccgaagucagacgccuuauccauuaggccacgcggcccgucgguuguuaccgucucuugagcaacuuauaaaaacgucaccuccgcccaccagcuagcucgggaccaauccaccugcuccuugagaaggggagguuggccuuugguucgcgcguuccgcagggagagcccacccagaagucccccuucuccccccgcgggcggaccgcuccauuggcggcccuccuauuggucgcgcugggagucucccgcuugccucucggguagccgcgggaccuagcugggugcagacgggaaguugcggcugccagcgaagcggaccggccggguggaggccacacgcuaccccgaggcugcguaggccgcgcgaagggggacgccgugccgugggccuggggucgggggagcagcagaccgggaagcaccgugaggaccgagguuuccggcggggucggcggcggggaggccgggucgcugagcgacggcgcggccccucccucuccagucagggagcgaggcccggagcagggcggcggcuagucccagggcgcaccgcggcgccucugccgggcgcaggcgggcggcggggcgcacggggguggccgccgacuccuccugcaggacgcucucggccgggugggccgugguccgggugugggugugggucccgggggacggcggcccacccugcggguucgaauccgggcgcuggcaccucucgacgcuaggcccgcgccggucgcgguaauggcagccaccauuugccgagcgcuugccaagagcagggccgcacgacauaggcgcccugugucccccagacagcagcccggugugacaggcagaauccguaaucccauuuuacagaauaggauaucagggccuaaggagcuuugcccaaggucacacagcucgagagagccagaagcgggguucaaaaccgcgucgcccuacuccagauacugcucucuuacucgcugcccucggcuuccccacguggguucacugacgaaguugcguggaccccgguucccccaggagggguauugacguuucccaaguuuugaggcuuaacggaaaaugcaacugaagcgccuggcacaguguuggggacgcaguaaaugcucaaggaaugaugauuauggauacaccuauuacauauaugguaaaauaacgcuuuauaucaucugucuccuuuaggauuugggguggaaggcaggcauggucaaacccauuucacugacaggagagcagagacaggacgugucucucuccacgucuuccagccaguaaaagaagccaagcuggagcccaaagccagguguucugacucccagcgugggggucccugcaccaaccaugagccgccugcucuggaggaagguggccggcgccaccgucgggccagggccgguuccagcuccggggcgcugggucuccagcuccguccccgcguccgaccccagcgacgggcagcggcggcggcagcagcagcagcagcagcagcagcagcagcaacagcagccucagcagccgcaagugcuauccucggagggcgggcagcugcggcacaacccauuggacauccagaugcucucgagagggcugcacgagcaaaucuucgggcaaggaggggagaugccuggcgaggccgcggugcgccgcagcgucgagcaccugcagaagcacgggcucugggggcagccagccgugcccuugcccgacguggagcugcgccugccgccccucuacggggacaaccuggaccagcacuuccgccuccuggcccagaagcagagccugcccuaccuggaggcggccaacuugcuguugcaggcccagcugcccccgaagcccccggcuugggccugggcggagggcuggacccgguacggccccgagggggaggccguacccguggccauccccgaggagcgggcccugguguucgacguggaggucugcuuggcagagggaacuugccccacauuggcgguggccauaucccccucggccugguaaguaggggcaggguuggggacauaagcaggcaugggggcccagcuuaauaguuuguuucagugaacauuuucugagguccuguuacgggcugggugcucacguagggagcgcugauguguugaauuaggacuagaccccuguuuaugugggacucacuuucuggugggaagaucacaggcaguaagcaaauacccaaguaaaugucaggcaguaaaggccacgcagagaaucacaguagagcgcuguacaugagaccuucgggaggccacuuaagaucacggugauuuggugccuuuacccccucuccuaauagcgucaugagaaguuagucugaaaagucauuugaacaguguuucuauuuggg

SEQ ID NO: 19623 - RNA, 2449 nt, Homo sapiens
gcugagcgcugggacucuggaggccuaccugggcuugagcgcugauccucauccuucuguaaaaugguuacuugaguauaauagguaccugauguacauacaauaaauacucaauaauggaguuguauuucuacacagauauuuugguuuuaaccaguuccccaccagguucaaagaaaagaugagcagauucuacuugccgcugccuucucacaggacgucccuccccacccauuccaggcugacccaucuggacuagaugcugagccagggcuggggguaaggccaaaggggucugggccugugggggucggggggcuaaagauugcaagaaccccucccaccucucccaugcucuucuuuggagggagagagggagcucuguguccacggguaggaagaagaaauugccaacugacaccaguacaguuuauucacaaauaaauaaauucacauuaggcagagccuccugcuugccucaaagugucuagcccuaugggucccuccauggagggaggggcugagaagggccgccgcgguggggacggcucucacccgcaggaaugcccccgucgggaucgcccgugcccucuuccaggaaaggcagucugccaaggaaccacuucgaaggugcugaggccaaaaagccucggugcucacagagacggcgucaguugucccuugucacuugggcuccucaggcagccacuccagaggcgagaggggcauccaggucuccaacagagccagcacgucgcccggaaggagcuguagggagagacggaacagcgcagcccucaagcacugguggccuugugcggguguccgcgcucgugggcuccacucucagggggccccuagcgaggggagacccaguccucugcguggccuuucccugccuucgcuucuuggagcccugggcauacuaugguggccagguggccaggcugccggcggggagcagcagggugccugguccucaccuuggcgggcgguggggcugugcgcgggggcacggacgaagggggcgcggggaaggggacacuaaccggggacggugggcuuggcuccaucgccugcccuucagggcacgccgccucggcgaacagcgcaggcgggucgcgcggcucgggugcagcucgggcuccggggcaggcaggcggggauccccaggacgccccggcgcggacggcggauaccaggcccagcccgcgccccugccccugccccucagccugcguccgugucugcaucugcgcggggcagucgucggggcacagcgggcagccccgaggggaccccgcgucaccgcgcugccggcaccggcgcuggagacucuccucgcugaggccuagcacggccgacagguggccgauauagcggauagccaggcgcagcgucucgaucuuggucaggcucuggcccgcgggcgccacggacggcgguagaaagcggcgcagcucgugcagggcgcgggccagcgugcgcaugcgcaguuucucccgcucacuggcgcucugccucugcccgcugcccaggcggcugcugcgcgcgccgcgccuaccuacggagggggcgcgggggucccggagggugccuggccgcgcggggcucgccacggggcugucggcuggggugcugccccaugagucuggggacgagacgagggagcggccgcaguccuugucggagggcggcggccgccgaguugggccccaggccgcagagagcauccaggacucggagagcggcgggcacaggggcugggccauggcagcggcggcgcgucugggggccggcggccggcggccgcuuuaugccgagcccgaggugugaaguggccccuuccaggccgcaucagcacaucaaagugggcucggggcuuggagggggcggagccugacccuuugaauccacggcggggggccaaggugccagccccuugacugcgccuguuucgccccaccugggcccucgcuugggcgcccgacccagccucucggccuucccgccugcgcccaguguugggugaagcccggggcguugggccagcccugcagguuaaaggaagcggggucagaaaaacgaaaucuagauccuagguuuggggccugccuucaccuguuggggaccuuaugcaaauucuuaguucuuuugcaccuuagcuuccaauuuguauaaugagagccucagggcaugcgccaauuggacaguggaguagaguaaggaccaggagcagggacccucauucccucuaaagguggagaaaacaguaaaccacuucuccuuugaggcaggauggcccuggguagacccuucccugguaagaacauguggacagugcaaggaagcuugcaccccggcaaauucaauaagcugccgagucuggucaggaugcuggaccuucugagcagagggaggggguuaagccugcuccaaccccaggcca

SEQ ID NO: 19624 - RNA, 2449 nt, Homo sapiens
uggccugggguuggagcaggcuuaacccccucccucugcucagaagguccagcauccugaccagacucggcagcuuauugaauuugccggggugcaagcuuccuugcacuguccacauguucuuaccagggaagggucuacccagggccauccugccucaaaggagaagugguuuacuguuuucuccaccuuuagagggaaugagggucccugcuccugguccuuacucuacuccacuguccaauuggcgcaugcccugaggcucucauuauacaaauuggaagcuaaggugcaaaagaacuaagaauuugcauaagguccccaacaggugaaggcaggccccaaaccuaggaucuagauuucguuuuucugaccccgcuuccuuuaaccugcagggcuggcccaacgccccgggcuucacccaacacugggcgcaggcgggaaggccgagaggcugggucgggcgcccaagcgagggcccagguggggcgaaacaggcgcagucaaggggcuggcaccuuggccccccgccguggauucaaagggucaggcuccgcccccuccaagccccgagcccacuuugaugugcugaugcggccuggaaggggccacuucacaccucgggcucggcauaaagcggccgccggccgccggcccccagacgcgccgccgcugccauggcccagccccugugcccgccgcucuccgaguccuggaugcucucugcggccuggggcccaacucggcggccgccgcccuccgacaaggacugcggccgcucccucgucucguccccagacucauggggcagcaccccagccgacagccccguggcgagccccgcgcggccaggcacccuccgggacccccgcgcccccuccguagguaggcgcggcgcgcgcagcagccgccugggcagcgggcagaggcagagcgccagugagcgggagaaacugcgcaugcgcacgcuggcccgcgcccugcacgagcugcgccgcuuucuaccgccguccguggcgcccgcgggccagagccugaccaagaucgagacgcugcgccuggcuauccgcuauaucggccaccugucggccgugcuaggccucagcgaggagagucuccagcgccggugccggcagcgcggugacgcgggguccccucggggcugcccgcugugccccgacgacugccccgcgcagaugcagacacggacgcaggcugaggggcaggggcaggggcgcgggcugggccugguauccgccguccgcgccggggcguccuggggauccccgccugccugccccggagcccgagcugcacccgagccgcgcgacccgccugcgcuguucgccgaggcggcgugcccugaagggcaggcgauggagccaagcccaccguccccgguuaguguccccuuccccgcgcccccuucguccgugcccccgcgcacagccccaccgcccgccaaggugaggaccaggcacccugcugcuccccgccggcagccuggccaccuggccaccauaguaugcccagggcuccaagaagcgaaggcagggaaaggccacgcagaggacugggucuccccucgcuaggggcccccugagaguggagcccacgagcgcggacacccgcacaaggccaccagugcuugagggcugcgcuguuccgucucucccuacagcuccuuccgggcgacgugcuggcucuguuggagaccuggaugccccucucgccucuggaguggcugccugaggagcccaagugacaagggacaacugacgccgucucugugagcaccgaggcuuuuuggccucagcaccuucgaagugguuccuuggcagacugccuuuccuggaagagggcacgggcgaucccgacgggggcauuccugcgggugagagccguccccaccgcggcggcccuucucagccccucccuccauggagggacccauagggcuagacacuuugaggcaagcaggaggcucugccuaaugugaauuuauuuauuugugaauaaacuguacuggugucaguuggcaauuucuucuuccuacccguggacacagagcucccucucucccuccaaagaagagcaugggagaggugggagggguucuugcaaucuuuagccccccgacccccacaggcccagaccccuuuggccuuacccccagcccuggcucagcaucuaguccagaugggucagccuggaauggguggggagggacguccugugagaaggcagcggcaaguagaaucugcucaucuuuucuuugaaccugguggggaacugguuaaaaccaaaauaucuguguagaaauacaacuccauuauugaguauuuauuguauguacaucagguaccuauuauacucaaguaaccauuuuacagaaggaugaggaucagcgcucaagcccagguaggccuccagagucccagcgcucagc

SEQ ID NO: 19625 - RNA, 2787 nt, Homo sapiens
gcaaaacccggcccggaucacggagccggagccggagccguaccgccagcaacuccugggugcgcgcagccguuucugcgcuucucgacggugcggccccaggccccgcuggagccgagcugcuccccucccuacccuggcggacguggcccggccgcuccgagggguuucccucggaccccgcgccuaaaccccggccagcgggagcgucuaaggcuagccuuguaccccaccggcacucggccugggggggcuuuuccgcgaggcggcggcccagcgggcggagcggcguggguguccacaucuaggcggagucuggagccggggaggcggcggcggcggcggcgggagcggggccgggcgcggccgggagcucgccucccccgggggucgugccgcagcucggcgagggcagcguggcucgcgcggcguggacucagccgcuccuggguaaggagagcgcaaaucuccucccccuauuuccccggaagcgcggccgaggcgagcccggcgaugugagaggcggccgucggcuccugccucaggaagggcauguucggaggggcggccucggcacgccacccgccuaagcgcccccuucccaccgcagccgccgccgccgcagcgcccgcaccgcgauaaaaggggcggccgcguuuccugacgcgagauccgcgcucgccgccgcccgcccaggcggcgaugacacggcgcccgcggcggcccggaggcgccgggugggccguuugcugaccggaucgcggcuacccgccagcguguccgcggcgccgccgccagcaugggcugugccccgagcauccacauuuccgagcgccugguggccgaggacgcgccuagccccgcggcaccgccgcugucguccggcgggccgcgccucccgcagggccagaagacggccgccuugccccggacccgcggcgccggccucuuggagucggagcuucgcgacggcagcggcaagaagguaaggggcgccgggcacucuggggccgccgcgaaacucgggcccggccaguaagcaacuuucccgcaggggccgggcggggucccccccacccggccucggugcccucuugucccgcuuuggaugguucugauugacgccagucucccgccuugccggggcagcguucagagaaggaccgacccaggucccgcgacccugauuuccuaggguugcgauuaggacgccgccugugucgcggcgucgguuuuuuggacacauccgacucccggagcggcggggcccgaugugaaguugacugaggcgcuugcaucaauuuccucuccaagagcggguguuugagggaaacccccaggauauucuggcgcgccccugcaauguuaaaucagugugaacuuuguucuuuuccugugguagaaagggaagggcgacuggccucaccacucuuuucccucugucagcuuugcacaugcaguugcagguuaccauuuucuucgggacugcuagaauguaaucuggaacaucagcuuugcuucauugcacauguauuugagguccacguuuauuagcauacauacuguauuuaaagcauauguaauuagaaaauacugugaaacgcgauuuuugaagcauucagcagaacaaaguuaaucuuuuauuaagccgacuuacugggacauuuugugacugggguuuuuuguuuuuuuacauugcgugucuucuccagcgcauguugccuuggcuuauguuuugucaaaguuucugggcuuagucuuuguugagguuuucuaaaggaaaguuaaaaaggaaaaagaaaaacgugaucauuaaggcacacagcagcagcuuuccaguucucucauuucagaauuuaaagcuggaacucaugcguugguuuauguuuuguuaaaccaguaaaagacaacaacaacaaaauucgugcauggcugcagauuguuggcugucaucccucucaucacgaccaguuuuugaaagaguaauuugcaaaauuuguuugauuuuuccuugcuugcugagaacugcugaaccuccgaaguuugagggauauaguuugauguacuuucugucuuacauuucuagcagucgucaugauacuuuuucuguacgaaaggggaaagucuuuuucaguguugcauaacaguugauuuccccaccauucccauacccuaagugaaaauucaacuuuguucugauuaucagaaauugaauuccuucuccuauagauucuuuaaagaaaccucugaugguuuaggcuuacuaacucaaggugcucuuaauaucaguguuaagcuguguguuaagccuacuuggcuuuaaaaaaguguuacacaggugcauauggaaacuuuaacagcuuucaaguuuucaguccaaaucuaacauuuugcagacuaaugugauaauuucagauuaccaaaguagcccuuuuauagugaggggccuuugugucuuacaggcuuuuuuugugguggauuggguguccuaaaauucaccuaggugucuuguaagccuccccagugcagcagcagcuugcucuugugcuaucgcagugccguuaggucccugaguuuuuaaguacuuacuucaaccauucuucuguauuggcagaccauugucuuguguugggggcucagaaaauacuuucauccuuaaagugccuaacccaguggcauacacauaguagguacuaaauaaauguuuacugauuucuuaaaaaauuguuaacugauugaugaaacuuuuucagucauuggaauuugauuucauaaagccuccuaugu

SEQ ID NO: 19626 - RNA, 2787 nt, Homo sapiens
acauaggaggcuuuaugaaaucaaauuccaaugacugaaaaaguuucaucaaucaguuaacaauuuuuuaagaaaucaguaaacauuuauuuaguaccuacuauguguaugccacuggguuaggcacuuuaaggaugaaaguauuuucugagcccccaacacaagacaauggucugccaauacagaagaaugguugaaguaaguacuuaaaaacucagggaccuaacggcacugcgauagcacaagagcaagcugcugcugcacuggggaggcuuacaagacaccuaggugaauuuuaggacacccaauccaccacaaaaaaagccuguaagacacaaaggccccucacuauaaaagggcuacuuugguaaucugaaauuaucacauuagucugcaaaauguuagauuuggacugaaaacuugaaagcuguuaaaguuuccauaugcaccuguguaacacuuuuuuaaagccaaguaggcuuaacacacagcuuaacacugauauuaagagcaccuugaguuaguaagccuaaaccaucagagguuucuuuaaagaaucuauaggagaaggaauucaauuucugauaaucagaacaaaguugaauuuucacuuaggguaugggaaugguggggaaaucaacuguuaugcaacacugaaaaagacuuuccccuuucguacagaaaaaguaucaugacgacugcuagaaauguaagacagaaaguacaucaaacuauaucccucaaacuucggagguucagcaguucucagcaagcaaggaaaaaucaaacaaauuuugcaaauuacucuuucaaaaacuggucgugaugagagggaugacagccaacaaucugcagccaugcacgaauuuuguuguuguugucuuuuacugguuuaacaaaacauaaaccaacgcaugaguuccagcuuuaaauucugaaaugagagaacuggaaagcugcugcugugugccuuaaugaucacguuuuucuuuuuccuuuuuaacuuuccuuuagaaaaccucaacaaagacuaagcccagaaacuuugacaaaacauaagccaaggcaacaugcgcuggagaagacacgcaauguaaaaaaacaaaaaaccccagucacaaaaugucccaguaagucggcuuaauaaaagauuaacuuuguucugcugaaugcuucaaaaaucgcguuucacaguauuuucuaauuacauaugcuuuaaauacaguauguaugcuaauaaacguggaccucaaauacaugugcaaugaagcaaagcugauguuccagauuacauucuagcagucccgaagaaaaugguaaccugcaacugcaugugcaaagcugacagagggaaaagaguggugaggccagucgcccuucccuuucuaccacaggaaaagaacaaaguucacacugauuuaacauugcaggggcgcgccagaauauccuggggguuucccucaaacacccgcucuuggagaggaaauugaugcaagcgccucagucaacuucacaucgggccccgccgcuccgggagucggauguguccaaaaaaccgacgccgcgacacaggcggcguccuaaucgcaacccuaggaaaucagggucgcgggaccugggucgguccuucucugaacgcugccccggcaaggcgggagacuggcgucaaucagaaccauccaaagcgggacaagagggcaccgaggccgggugggggggaccccgcccggccccugcgggaaaguugcuuacuggccgggcccgaguuucgcggcggccccagagugcccggcgccccuuaccuucuugccgcugccgucgcgaagcuccgacuccaagaggccggcgccgcggguccggggcaaggcggccgucuucuggcccugcgggaggcgcggcccgccggacgacagcggcggugccgcggggcuaggcgcguccucggccaccaggcgcucggaaauguggaugcucggggcacagcccaugcuggcggcggcgccgcggacacgcuggcggguagccgcgauccggucagcaaacggcccacccggcgccuccgggccgccgcgggcgccgugucaucgccgccugggcgggcggcggcgagcgcggaucucgcgucaggaaacgcggccgccccuuuuaucgcggugcgggcgcugcggcggcggcggcugcggugggaagggggcgcuuaggcggguggcgugccgaggccgccccuccgaacaugcccuuccugaggcaggagccgacggccgccucucacaucgccgggcucgccucggccgcgcuuccggggaaauagggggaggagauuugcgcucuccuuacccaggagcggcugaguccacgccgcgcgagccacgcugcccucgccgagcugcggcacgacccccgggggaggcgagcucccggccgcgcccggccccgcucccgccgccgccgccgccgccuccccggcuccagacuccgccuagauguggacacccacgccgcuccgcccgcugggccgccgccucgcggaaaagcccccccaggccgagugccggugggguacaaggcuagccuuagacgcucccgcuggccgggguuuaggcgcgggguccgagggaaaccccucggagcggccgggccacguccgccaggguagggaggggagcagcucggcuccagcggggccuggggccgcaccgucgagaagcgcagaaacggcugcgcgcacccaggaguugcuggcgguacggcuccggcuccggcuccgugauccgggccggguuuugc

SEQ ID NO: 19627 - RNA, 2972 nt, Homo sapiens
agaugauauucaaauuaaauuaugcagaugccugaacauaauuacgaguucccaaagugugagcaucaugugugcuaggugaagauuucaccaccucuucucagcauuuaacuacaacaggaacacguucaaccaacaguugacuugaaauaguaauaguuucuuggugaaauuaguuagcaaacuuauuagaugagaaaucaaacgaugacucguaucuuauucguuuuaaccaucugaaaguaugccaaaaagaauaaaguuauuucuuaaaauucaucaucacaaaaggagaagccaucuuuucacaccucuuuaaagagcaaaucaaauccaguacaauuuguaacaucugaaguaauguucuuuuauaugauguacaaaauuuuauuuugacaaacuauuuuaacaagguuuuaauauguaucaacgaaucugggaagggaucaaugaaaagagagucaguguauccaucacugaacaaaaguuucaauacauuaacacguauuugcaaacucagggucgaagacuuagaaucuuaucaagagaucccauaaaaucgaauagcaaauuaaauaaacagcgaaugaaaaaaaaucugccaaaugcuguuuuucaauucacuuacugucaagccaaaaucuugucgcuuugaugaaaagaauauauuuuuaaaaaaauuguugcuacaucugcucugugguccuaugcaguaacacauguucucucucccucacacacacacucucucucucccugacagggauucccaggacaccgguggggccucuuuuaggccccuuaaguguuaacagcaagaggccuggcugagaccaggcgucugggccgcuuuaaaugcccuggccuucagaggacugaggcgagcacagccauaaaaccaggggacguuaccgaacccccgagcgucugaugccccccgccccccaaccacacacaacuucacucacacaauuaaggcugggagauggcauuccacuuaacugucagacucggagcgguggcagccccgcagccacaaagagaugccuuaaaugagaagaacauguuucuacaccgcauuugugaaaguuuggcucggagcuacgcgcugauuaauaucagaucuccuucacucgccucgccacaaucuugucacaucuggcugacaaaucccgaggaacuccggcaaagccaggcggcggcggggcuccgggucugggcggcggcuccggaggagcagcgggagaccccgcagcggccuccuccuucuccgcccgcggcccccagccucgccgccgccgcccggcucccagcacggaaccgacggggcgcucccgagacgggcgagccacgcgcucgcaggucccaaggccaggcugggcgggacuguuaagggagcucgaagucgggggccgggggcuucccgucccggcgcuucccaugcaaaccccugaaggaagcggcaggcgcagccgcgggcuccgcagcccaggcccacuuccugucacuccaggaaaaccucggagcggcggacgcggcucggcccggcuuccagcccagagcccaagcgccuuagccccgucccagcgcuuucugaaagacgggccaccucgcgcggagccgcgacaaggacuccaggguccgcagugaagcuggucaaaucugccccgcacacggucaacgcucggucugugucccggaagcuuucggaccggaccugucuaaauagcgacuuucagucguggguuuuuuguucuuguggguuuguuuuguuuuuuguuguuguuguugcucuacaaaagauuugucccgcaguggacgggagccuccucacggccgcccgcccgucuccgcaguucuccucagugaccggaggcugccgcgcgccccguucuccagagaaacaauccccggagagaaagacggccagugugaaauaucagcuguuucacaaauucugagguaaaagaaaaaaaaaaaaagaaggggucgacccccacagguggaaacagcaaguccuaacguccugggcugaagccuggggugcgggcggcagagaguggcguguaggguacccgccgagugccgccgccgauuuccacaggcuggcccgccggcaccuccgacgcgcccgcagauccggcgcggagaccguuugccagcuccgggacgucgggcagggacgggucccagagccccaacccccccgccgccgccucccggccggagaccacggucccucccgccgcgccucggggccgcgcugccgcgcagguagccagcuggcccucgggagguggcccucggguacccacgggagccggagcccagcggcgucccgggccgccugcuccgcgcacagagaauccccgcgcccgcggagggcgccgcgcuuaccucggccauccugcgaccgcugcggugccggggcugccggcgcgucucccgggcccgggccgccccgcguccgccccggcucggcgggcgccgccgcauccacgcuccggccgucggggcgcgacccggcgaagugggcggcuccccaagcgcccaggcugcgcagcacgauggccgcccccgccgcgcaccgcgugugcccgcacgcccgcccccugcgccccggggacgccucuccgccccucccccugccccuccgcccaccgcgcggucgccccacgccgcgggcgcugcuucgccgcccgggaggccgccucccgccccgggaccggauaacgcccuaaaucagcgcagcugaggcgaggccguggcccccgcagaccgcggagaccucgccggcggccggcgcggaggugucugcccccgccgggcuugaaggcacuuguugguaaaagacacagacgugucgguguuugccucucccggggaagggcgaaacgcucugaaguucucuggcgcucuucucaggagaugauucggccuccccuccuacccuggggcgcccucggggucuc

SEQ ID NO: 19628 - RNA, 2972 nt, Homo sapiens
gagaccccgagggcgccccaggguaggaggggaggccgaaucaucuccugagaagagcgccagagaacuucagagcguuucgcccuuccccgggagaggcaaacaccgacacgucugugucuuuuaccaacaagugccuucaagcccggcgggggcagacaccuccgcgccggccgccggcgaggucuccgcggucugcgggggccacggccucgccucagcugcgcugauuuagggcguuauccggucccggggcgggaggcggccucccgggcggcgaagcagcgcccgcggcguggggcgaccgcgcggugggcggaggggcagggggaggggcggagaggcguccccggggcgcagggggcgggcgugcgggcacacgcggugcgcggcgggggcggccaucgugcugcgcagccugggcgcuuggggagccgcccacuucgccgggucgcgccccgacggccggagcguggaugcggcggcgcccgccgagccggggcggacgcggggcggcccgggcccgggagacgcgccggcagccccggcaccgcagcggucgcaggauggccgagguaagcgcggcgcccuccgcgggcgcggggauucucugugcgcggagcaggcggcccgggacgccgcugggcuccggcucccguggguacccgagggccaccucccgagggccagcuggcuaccugcgcggcagcgcggccccgaggcgcggcgggagggaccguggucuccggccgggaggcggcggcggggggguuggggcucugggacccgucccugcccgacgucccggagcuggcaaacggucuccgcgccggaucugcgggcgcgucggaggugccggcgggccagccuguggaaaucggcggcggcacucggcggguacccuacacgccacucucugccgcccgcaccccaggcuucagcccaggacguuaggacuugcuguuuccaccugugggggucgaccccuucuuuuuuuuuuuuucuuuuaccucagaauuugugaaacagcugauauuucacacuggccgucuuucucuccggggauuguuucucuggagaacggggcgcgcggcagccuccggucacugaggagaacugcggagacgggcgggcggccgugaggaggcucccguccacugcgggacaaaucuuuuguagagcaacaacaacaacaaaaaacaaaacaaacccacaagaacaaaaaacccacgacugaaagucgcuauuuagacagguccgguccgaaagcuuccgggacacagaccgagcguugaccgugugcggggcagauuugaccagcuucacugcggacccuggaguccuugucgcggcuccgcgcgagguggcccgucuuucagaaagcgcugggacggggcuaaggcgcuugggcucugggcuggaagccgggccgagccgcguccgccgcuccgagguuuuccuggagugacaggaagugggccugggcugcggagcccgcggcugcgccugccgcuuccuucagggguuugcaugggaagcgccgggacgggaagcccccggcccccgacuucgagcucccuuaacagucccgcccagccuggccuugggaccugcgagcgcguggcucgcccgucucgggagcgccccgucgguuccgugcugggagccgggcggcggcggcgaggcugggggccgcgggcggagaaggaggaggccgcugcggggucucccgcugcuccuccggagccgccgcccagacccggagccccgccgccgccuggcuuugccggaguuccucgggauuugucagccagaugugacaagauuguggcgaggcgagugaaggagaucugauauuaaucagcgcguagcuccgagccaaacuuucacaaaugcgguguagaaacauguucuucucauuuaaggcaucucuuuguggcugcggggcugccaccgcuccgagucugacaguuaaguggaaugccaucucccagccuuaauugugugagugaaguugugugugguuggggggcggggggcaucagacgcucggggguucgguaacguccccugguuuuauggcugugcucgccucaguccucugaaggccagggcauuuaaagcggcccagacgccuggucucagccaggccucuugcuguuaacacuuaaggggccuaaaagaggccccaccgguguccugggaaucccugucagggagagagagagugugugugugagggagagagaacauguguuacugcauaggaccacagagcagauguagcaacaauuuuuuuaaaaauauauucuuuucaucaaagcgacaagauuuuggcuugacaguaagugaauugaaaaacagcauuuggcagauuuuuuuucauucgcuguuuauuuaauuugcuauucgauuuuaugggaucucuugauaagauucuaagucuucgacccugaguuugcaaauacguguuaauguauugaaacuuuuguucagugauggauacacugacucucuuuucauugaucccuucccagauucguugauacauauuaaaaccuuguuaaaauaguuugucaaaauaaaauuuuguacaucauauaaaagaacauuacuucagauguuacaaauuguacuggauuugauuugcucuuuaaagaggugugaaaagauggcuucuccuuuugugaugaugaauuuuaagaaauaacuuuauucuuuuuggcauacuuucagaugguuaaaacgaauaagauacgagucaucguuugauuucucaucuaauaaguuugcuaacuaauuucaccaagaaacuauuacuauuucaagucaacuguugguugaacguguuccuguuguaguuaaaugcugagaagagguggugaaaucuucaccuagcacacaugaugcucacacuuugggaacucguaauuauguucaggcaucugcauaauuuaauuugaauaucaucu

SEQ ID NO: 19629 - RNA, 2447 nt, Homo sapiens
accuaaucacauaaucguuuaagaauuacagucuuguacaggaaacuacaaggcacuuacaaguccaagcaacccuaaacacaaucuuguggucaaaugaaguuuagccucuucucuaucggauuucagguaaacuaaauugagccugggacaaaccuggcagaacaagaacagagugcaaaaaaaccugcuaauauugagaacaugagaaacaaauucccuggagucugugggaguuaggcaugaauaaugccugguggaugaaauccuaagggaucuaugagaagaguuacugggagaaccugagacuauuaaccauugcagacuggggacaaaaauguucucagaugcauuaauggacacuuaugcuacaaccagaaaaugcauccauguuaaccauccagcugaauaagucgucaguguuacaaaaaugagauccauauuaggcaccuuggaaaaaggcuuccuucccaguucaggcacaggaaaggacaaguuaccgcuugacuuuauuuaacuaggaaaacugcaagugaaacaaccuuuucguacgcagauggggugcaaacacuuucacaaauaaacauaguggcuucugggggcauuuucuaaguuccuucuccccacuucaccuccaauccacuccugacagacuucaugguaggcacgguuauaaaccugucacaaauacucgcaugcacaaguaggaucuugaaacaacaugcaauaaauauccugauacuacuuugacauagggcuuuugaccacagcugaccucaucuauaaauucaauucuuucucacaugaccaugugaugaggauucuggcacuggccuaccuguuccuaaggagugcacagggagcccucaaauuuaguuucaggagcugagagaagcaagcccuauuccaauaccuacacugagcugcuuaauucuuacuggugucacccagugggcaguaaaacaaacaggauuuuuaucagcugcuuucuccugaggugcuggaaagcaaaccuaauuuguauucuggagaggaguggugguguuccuucaucugaacaagucuucucccgcuccuuuuaaaacuuuaaaacuuuuauuuaaaaguuaacucgugaugaaugccuacaggcagaagaacuauuugcuuacaacaacuguuguuaguucagacuguagugucuaggguuagcacccccggaacgcacacggacaaccacuccggagaaaagauucuauuucccagccuguauuugcugcacuuuugcacuucucuugcuugcuuagguguguucacaaucacaugcccaggguuaaaacuuaauauucagaacuugauggaauccgguauaugcaaaacucaaggaaaagaaguagugguggugguguguugggggggugcauggggguguagccaucgcccccgccgaaggacagcuugccgagagccggcucucucugcuucccaaccaacauccugcacccaagacagcaggaucuucuuuccccauccguuucaugggugacacugcaugaauccaaaugaccugcagcccccgccgucuccccagagcuccuucaggcccccagcccguguccuggaaccccgaggacugcccuggcgaaguccugcggugccuccggcagcccgcaguuacccuaccccgcgcauacccggcccuuugucccgcuccucccggcgccucgccucucccgcgcccgggcggaugccccagucggugcccgcacucacccgcgccgagcagcccgcccgggccgcggcucgcugcgccgcucagacaggugugggcgccgggagagagcgcgcggcucccaugccugccccgccgcacagccgagugcgagcaagcuggcgagcagcgcaggcagcuggcggguccgccccccgcgccacccgaggcccgcccgccccgccuccggccucggggaagccgcgcggacgccgcccgccccacugcacauaaaccgugccccccuccccucgccgcucgccugcggccggagcaggguggagcagcccagagggccugaggccgagcgucccugcgcaggugggccccgguggcgcggcagcagucgccaguccgggccucucggcgccaggcagcaccggcucuggcgggcucuccugcccgggacccgcgcgccgucacccuuugaacaccgcgcauccccgggucuggcgcgcggccuccugagcgagacuacggccuucgcugcugggagcacgcugccagcucgcaaaaagaccagguccccuacaaaaggcgaccccucccccaacagccuagaacuagggacgcgggccacaccugguguauggggagcccugggcaaauuugaagaauugguucagaaccugugugcgccccacccccacguacacuuuuagcgccuuaaggugcugaccgaacuccuaguuucucc

SEQ ID NO: 19630 - RNA, 2447 nt, Homo sapiens
ggagaaacuaggaguucggucagcaccuuaaggcgcuaaaaguguacguggggguggggcgcacacagguucugaaccaauucuucaaauuugcccagggcuccccauacaccagguguggcccgcgucccuaguucuaggcuguugggggaggggucgccuuuuguaggggaccuggucuuuuugcgagcuggcagcgugcucccagcagcgaaggccguagucucgcucaggaggccgcgcgccagacccggggaugcgcgguguucaaagggugacggcgcgcgggucccgggcaggagagcccgccagagccggugcugccuggcgccgagaggcccggacuggcgacugcugccgcgccaccggggcccaccugcgcagggacgcucggccucaggcccucugggcugcuccacccugcuccggccgcaggcgagcggcgaggggaggggggcacgguuuaugugcaguggggcgggcggcguccgcgcggcuuccccgaggccggaggcggggcgggcgggccucggguggcgcggggggcggacccgccagcugccugcgcugcucgccagcuugcucgcacucggcugugcggcggggcaggcaugggagccgcgcgcucucucccggcgcccacaccugucugagcggcgcagcgagccgcggcccgggcgggcugcucggcgcgggugagugcgggcaccgacuggggcauccgcccgggcgcgggagaggcgaggcgccgggaggagcgggacaaagggccggguaugcgcgggguaggguaacugcgggcugccggaggcaccgcaggacuucgccagggcaguccucgggguuccaggacacgggcugggggccugaaggagcucuggggagacggcgggggcugcaggucauuuggauucaugcagugucacccaugaaacggauggggaaagaagauccugcugucuugggugcaggauguugguugggaagcagagagagccggcucucggcaagcuguccuucggcgggggcgauggcuacacccccaugcacccccccaacacaccaccaccacuacuucuuuuccuugaguuuugcauauaccggauuccaucaaguucugaauauuaaguuuuaacccugggcaugugauugugaacacaccuaagcaagcaagagaagugcaaaagugcagcaaauacaggcugggaaauagaaucuuuucuccggagugguuguccgugugcguuccgggggugcuaacccuagacacuacagucugaacuaacaacaguuguuguaagcaaauaguucuucugccuguaggcauucaucacgaguuaacuuuuaaauaaaaguuuuaaaguuuuaaaaggagcgggagaagacuuguucagaugaaggaacaccaccacuccucuccagaauacaaauuagguuugcuuuccagcaccucaggagaaagcagcugauaaaaauccuguuuguuuuacugcccacugggugacaccaguaagaauuaagcagcucaguguagguauuggaauagggcuugcuucucucagcuccugaaacuaaauuugagggcucccugugcacuccuuaggaacagguaggccagugccagaauccucaucacauggucaugugagaaagaauugaauuuauagaugaggucagcuguggucaaaagcccuaugucaaaguaguaucaggauauuuauugcauguuguuucaagauccuacuugugcaugcgaguauuugugacagguuuauaaccgugccuaccaugaagucugucaggaguggauuggaggugaaguggggagaaggaacuuagaaaaugcccccagaagccacuauguuuauuugugaaaguguuugcaccccaucugcguacgaaaagguuguuucacuugcaguuuuccuaguuaaauaaagucaagcgguaacuuguccuuuccugugccugaacugggaaggaagccuuuuuccaaggugccuaauauggaucucauuuuuguaacacugacgacuuauucagcuggaugguuaacauggaugcauuuucugguuguagcauaaguguccauuaaugcaucugagaacauuuuuguccccagucugcaaugguuaauagucucagguucucccaguaacucuucucauagaucccuuaggauuucauccaccaggcauuauucaugccuaacucccacagacuccagggaauuuguuucucauguucucaauauuagcagguuuuuuugcacucuguucuuguucugccagguuugucccaggcucaauuuaguuuaccugaaauccgauagagaagaggcuaaacuucauuugaccacaagauuguguuuaggguugcuuggacuuguaagugccuuguaguuuccuguacaagacuguaauucuuaaacgauuaugugauuaggu

SEQ ID NO: 19631 - RNA, 2499 nt, Homo sapiens
cagcuguuucauguggggcagcagugcuggcagggacgccggccgggagcggccgggagcgggagccggucgugcgcgcgcggcuggaggcucgcuggggcuccgcuccccgcgggagcuauuguuggucucgcuggagcugagcgcagagcccggaccugcuccuuccugggcgccccgcuacggcucgcggagcagaggagccgcgccgccgagagagagaggagccaccggcgcggcgccuugccucccugccgccguccucgccgcuuccccggcgguagcagccugcagccacgguaaggcggcgugauccgcucuacggaaaagcgccuuggggaccgcggcgacgccucgccagcuccaucgcccucugcacugcuggcccgggcaggguucggguagcucacgcggcugccgagggcuccgggagauguuugcuugcuccccuggcccaggaggagggaggcuagggcgcggguggccgaagaggcaagcuguucuggagccuggagccgccgcagcccccggagcccgccgcggacuggagccugggagcaaggguugggggagggcagggaggugggaagcgggugggagggaggcggcgcgccccagguucgucugccucucccggaucccguuccccgccccggcccggucgccugcagccccucugcagacuagcucgccccaggcccccgucgggcgcuggaggagcccgcgaggcggcgccgggcuucagcggcugcagccugcccugcggggcaagugccggcugcagcagccccgcacgggcggugguuggagcucagauccuggagaugcgaccccagcuccucgcccucugcaacccgcggggcgcccgccucuccucaccgggcgcccggccgcgguauugauguucgucuaggagccaacugaggcugcagccgccagauggacgcuuggagggcucccgggugugagugugacuguaugacuacucucacccccagcuucgggaaaugugcucuggguugaaaugugaucaccgagcuccucagucauuuuaauugccauuuuuaaaugcggucguuacauuggaggagcagacuggaagguaguggggcggcguguguguguguguguguguguguguguggacacacacacgcaaccgaggaauacacaaccaacuacuugggugaagggcgggggguucaccuagugaguccuucuuggcgggggggucgggcgaguuagcugcccgcugcccgccccuucucugccugcccccgccuaggcgagguuggaaaguacuggaaauucagcugcgugguccuuaacuuuggaaauuggcuccgcuuucagggcaaaauguuaaggcgauuuaugcacccgcguccauguggaugaguguauuacugcucaguugggugcagagcccucaacaguaccgcgccaagcccccacccgaucucuaacucccucccacccccuaaccguggagagaggguuuauagaaaugcaguuaucuguaaaccaucgacgcagugaaaggggcgcagggaggcagccagaguuuugccugaaccugcauacuggcuugguguuuguagcacacgagaucaccccgcugcuuuguagaaggcggugguggggcaagcucgggauuccaaucgccggggugggggguggggggaagagggugcccauguacugagcucugaggccgaguaaggagagagaucugcugagcggcaucgcgggcaauuacauaagcugccucggugauuacccggaacugugaugcgagcucccgguucucgaaagacaagccugaaaguuugccugcuuggggaguguaaguaccggggcgcccccaccccggccuggguagcuaggauacgccucgcaccacggcgcccacuugugcgaugggcgucgggugcugaugcugcuguccccaaagaaccgguuaccgaggcagggacuaagugggggcauccggaauugaucgcagaggaggagucagucagaacugagguuucauugggucuucagagcuccaagucuucccucggagguguuggaaggccuuccagggaacgccguuuucagaaacugacuugguguccuggggagccccaaagccccucuuuuccgcccuuccugggcgccccuccuugucuuucaagcccugugcccuucacguguuuagaaaccugcccgcggugccuggucccccuuggagaugcccaggcagcccagccauccaggcccacgcuggcgagggguuagagggaguagaacgcuggcucugccgggcugccacccuuaccuacaccuauuccugguuuccugcgcuagcccggcgcugauggggacgggauggggcuggggucggguauggcuuccguuccuucgccucucgccucugcagacagcaguuugcuucuguugcguuuauucuccccguuucgccgcuucccuccagcgccgcagccuguguaucac

SEQ ID NO: 19632 - RNA, 2499 nt, Homo sapiens
gugauacacaggcugcggcgcuggagggaagcggcgaaacggggagaauaaacgcaacagaagcaaacugcugucugcagaggcgagaggcgaaggaacggaagccauacccgaccccagccccaucccguccccaucagcgccgggcuagcgcaggaaaccaggaauagguguagguaaggguggcagcccggcagagccagcguucuacucccucuaaccccucgccagcgugggccuggauggcugggcugccugggcaucuccaagggggaccaggcaccgcgggcagguuucuaaacacgugaagggcacagggcuugaaagacaaggaggggcgcccaggaagggcggaaaagaggggcuuuggggcuccccaggacaccaagucaguuucugaaaacggcguucccuggaaggccuuccaacaccuccgagggaagacuuggagcucugaagacccaaugaaaccucaguucugacugacuccuccucugcgaucaauuccggaugcccccacuuagucccugccucgguaaccgguucuuuggggacagcagcaucagcacccgacgcccaucgcacaagugggcgccguggugcgaggcguauccuagcuacccaggccggggugggggcgccccgguacuuacacuccccaagcaggcaaacuuucaggcuugucuuucgagaaccgggagcucgcaucacaguuccggguaaucaccgaggcagcuuauguaauugcccgcgaugccgcucagcagaucucucuccuuacucggccucagagcucaguacaugggcacccucuuccccccaccccccaccccggcgauuggaaucccgagcuugccccaccaccgccuucuacaaagcagcggggugaucucgugugcuacaaacaccaagccaguaugcagguucaggcaaaacucuggcugccucccugcgccccuuucacugcgucgaugguuuacagauaacugcauuucuauaaacccucucuccacgguuagggggugggagggaguuagagaucgggugggggcuuggcgcgguacuguugagggcucugcacccaacugagcaguaauacacucauccacauggacgcgggugcauaaaucgccuuaacauuuugcccugaaagcggagccaauuuccaaaguuaaggaccacgcagcugaauuuccaguacuuuccaaccucgccuaggcgggggcaggcagagaaggggcgggcagcgggcagcuaacucgcccgacccccccgccaagaaggacucacuaggugaaccccccgcccuucacccaaguaguugguuguguauuccucgguugcguguguguguccacacacacacacacacacacacacacacgccgccccacuaccuuccagucugcuccuccaauguaacgaccgcauuuaaaaauggcaauuaaaaugacugaggagcucggugaucacauuucaacccagagcacauuucccgaagcugggggugagaguagucauacagucacacucacacccgggagcccuccaagcguccaucuggcggcugcagccucaguuggcuccuagacgaacaucaauaccgcggccgggcgcccggugaggagaggcgggcgccccgcggguugcagagggcgaggagcuggggucgcaucuccaggaucugagcuccaaccaccgcccgugcggggcugcugcagccggcacuugccccgcagggcaggcugcagccgcugaagcccggcgccgccucgcgggcuccuccagcgcccgacgggggccuggggcgagcuagucugcagaggggcugcaggcgaccgggccggggcggggaacgggauccgggagaggcagacgaaccuggggcgcgccgccucccucccacccgcuucccaccucccugcccucccccaacccuugcucccaggcuccaguccgcggcgggcuccgggggcugcggcggcuccaggcuccagaacagcuugccucuucggccacccgcgcccuagccucccuccuccugggccaggggagcaagcaaacaucucccggagcccucggcagccgcgugagcuacccgaacccugcccgggccagcagugcagagggcgauggagcuggcgaggcgucgccgcgguccccaaggcgcuuuuccguagagcggaucacgccgccuuaccguggcugcaggcugcuaccgccggggaagcggcgaggacggcggcagggaggcaaggcgccgcgccgguggcuccucucucucucggcggcgcggcuccucugcuccgcgagccguagcggggcgcccaggaaggagcagguccgggcucugcgcucagcuccagcgagaccaacaauagcucccgcggggagcggagccccagcgagccuccagccgcgcgcgcacgaccggcucccgcucccggccgcucccggccggcgucccugccagcacugcugccccacaugaaacagcug

SEQ ID NO: 19633 - RNA, 2277 nt, Homo sapiens
acgagcuugggacuugaacccacuacguccccagauucugcuguugcccgggaguagaggagggaggagcugccagggcggagggugguggggagggaaggcaagcucccagcagcgcaagcugacgacagcagguguuuuuguuuuguuuuguuuuuuucugcagcacucuuucagucagcaucguuccuggauuuuuuucucacugcugagcagcauaaaaggguggggccgcuucccugcagcagaggcagaggcggcggcggcagcggcugcagcaucauucgcgggcagcggcggagaccgagagcugcagaaaaggguggggucgcuucccaggagaagaggcgguggcggcggcggcugcggcauccucgcgggcagcggcggaggcagcaaugcucggucuccgcuggaggugauggccucccagcccugcuagguggccggcugcacuaggacgccggcaggaaggagacucgagcccgguccgcggacccugcggccacaccgcccggccccuccucugcgccauggcuuaagccuguagccaccucuccucacgucgccucgcucgaccgaggucugugcgccgccgcagccgcagggaggggcgcgucccagacacccucgccggggacucgggaacgccgugcgucucacccuucggcgcucgcagcagacugcgcucccaaaggcguuugcgaccgguaaucgagggacucuacagacucuccuaggacagcucuccccgggugcucgcugagggaggagggcgaacuagcuccggcugaucggggguagaaaacggugggaaccacauuggccggucaggaucggaggcugaaggaagauuauagagacuugcuuuagaaccacaagaagaaagaggaggccggcuuuucagcuagcaucauggcguggccgugcaucacgagggccugcugcaucgcccgcuucuggaaccaguuggacaaagcggacaucgcugugccgcugguuuucaccaaguacucggaggccaccgagcacccgggcgccccgccgcagccaccgccgccgcagcagcaggcgcagccggcgcucgcgccccccucggcgcgcgcgguugccauagagacgcagccagcccagggcgaguuggaugcaguugcccgggcaacggggccagcgccugggccuaccggcgagcgcgagccggcggcgggccccggccggagcgggccgggcccgggccugggcuccggcuccaccuccggccccgcggacucggugaugcggcaggauuaccgagccuggaaggugcagcggcccgagcccagcugccggccgcgcagcgaauaccagcccuccgacgcucccuucgagcgcgagacccaguaccagaaggacuuccgcgccuggccgcugccgcgccgcggggaccacccguggauccccaagcccgugcagaucucugcggccucccaggcgucggcgcccauucucggggcgcccaagcgccggccgcagagccaggagcgcuggccagugcaggccgccgcugaggcccgggagcaggaggcggcccccggcggagcggguggccuggcggccggaaaggcguccggggcggacgagcgcgacacgcgcaggaaggccgggccugccuggauugugcgccgcgccgagggccuggggcacgagcagacgccgcugcccgcggcccaggcccagguccaggccaccggccccgaggcuggcagggggcgcgccgcggcggacgcccucaaccggcaaauccgcgaggagguggcgagugcagugagcagcuccuacaggugagacgcggccgcugcuagcgcgggggagucaccacgcagacccuccccgcgggcugcccggggcccaggauccccagcgcaggccuagcgugcagccucccuccagucccaggccacacccucuccccagccgccucccaggccaccuccugucgaagccuucucuucugcccugucccaugcgcaagcuguuaguauauuccaucucagccugccuggcucuuucacuuuaccgcuguagcccuuuucuccaucccucccaccucagaucccugccuucccacagagacccuuugcaaugucagcagaggcugugcuuccgucgugcccccauccaacucaccugcugcguuagccuggauguugcccuuugcaggguccccauucuuccagaagaagaauucuuuccaaguggccucucgcccuccucccuagcccaguucccuuggcccuu

SEQ ID NO: 19634 - RNA, 2277 nt, Homo sapiens
aagggccaagggaacugggcuagggaggagggcgagaggccacuuggaaagaauucuucuucuggaagaauggggacccugcaaagggcaacauccaggcuaacgcagcaggugaguuggaugggggcacgacggaagcacagccucugcugacauugcaaagggucucugugggaaggcagggaucugaggugggagggauggagaaaagggcuacagcgguaaagugaaagagccaggcaggcugagauggaauauacuaacagcuugcgcaugggacagggcagaagagaaggcuucgacaggagguggccugggaggcggcuggggagaggguguggccugggacuggagggaggcugcacgcuaggccugcgcuggggauccugggccccgggcagcccgcggggagggucugcguggugacucccccgcgcuagcagcggccgcgucucaccuguaggagcugcucacugcacucgccaccuccucgcggauuugccgguugagggcguccgccgcggcgcgcccccugccagccucggggccgguggccuggaccugggccugggccgcgggcagcggcgucugcucgugccccaggcccucggcgcggcgcacaauccaggcaggcccggccuuccugcgcgugucgcgcucguccgccccggacgccuuuccggccgccaggccacccgcuccgccgggggccgccuccugcucccgggccucagcggcggccugcacuggccagcgcuccuggcucugcggccggcgcuugggcgccccgagaaugggcgccgacgccugggaggccgcagagaucugcacgggcuuggggauccacgggugguccccgcggcgcggcagcggccaggcgcggaaguccuucugguacugggucucgcgcucgaagggagcgucggagggcugguauucgcugcgcggccggcagcugggcucgggccgcugcaccuuccaggcucgguaauccugccgcaucaccgaguccgcggggccggagguggagccggagcccaggcccgggcccggcccgcuccggccggggcccgccgccggcucgcgcucgccgguaggcccaggcgcuggccccguugcccgggcaacugcauccaacucgcccugggcuggcugcgucucuauggcaaccgcgcgcgccgaggggggcgcgagcgccggcugcgccugcugcugcggcggcgguggcugcggcggggcgcccgggugcucgguggccuccgaguacuuggugaaaaccagcggcacagcgauguccgcuuuguccaacugguuccagaagcgggcgaugcagcaggcccucgugaugcacggccacgccaugaugcuagcugaaaagccggccuccucuuucuucuugugguucuaaagcaagucucuauaaucuuccuucagccuccgauccugaccggccaaugugguucccaccguuuucuacccccgaucagccggagcuaguucgcccuccucccucagcgagcacccggggagagcuguccuaggagagucuguagagucccucgauuaccggucgcaaacgccuuugggagcgcagucugcugcgagcgccgaagggugagacgcacggcguucccgaguccccggcgagggugucugggacgcgccccucccugcggcugcggcggcgcacagaccucggucgagcgaggcgacgugaggagagguggcuacaggcuuaagccauggcgcagaggaggggccgggcgguguggccgcaggguccgcggaccgggcucgagucuccuuccugccggcguccuagugcagccggccaccuagcagggcugggaggccaucaccuccagcggagaccgagcauugcugccuccgccgcugcccgcgaggaugccgcagccgccgccgccaccgccucuucuccugggaagcgaccccacccuuuucugcagcucucggucuccgccgcugcccgcgaaugaugcugcagccgcugccgccgccgccucugccucugcugcagggaagcggccccacccuuuuaugcugcucagcagugagaaaaaaauccaggaacgaugcugacugaaagagugcugcagaaaaaaacaaaacaaaacaaaaacaccugcugucgucagcuugcgcugcugggagcuugccuucccuccccaccacccuccgcccuggcagcuccucccuccucuacucccgggcaacagcagaaucuggggacguaguggguucaagucccaagcucgu

SEQ ID NO: 19635 - RNA, 2526 nt, Homo sapiens
uugaguguggggcgcgugccaggugaugcuggggcugggauggguauggguucaaguugccccacagggccaccugcggauggugagucucugccaucuaggggguugcuuccacgguccccggagcucccaccagguuuucggacccucagcucugaaaggucugagcgcaggaaacugagaagcgucagggucucugaggcgauaucuggauuugacagggacuuccgcugucgacucuuuucaggcucaaauccuccaucccucaaugcccuagaggugccuccagguccuuuggcacggguucgagccugggaccgcaggagcccuuccccagcuccaaagcuaggggagcgguacacgccccagcccccagaaccccuacuagaccauaggucgucguccuugagggucuccgugcuggaauaacggcugcuaccgcgggagccugcggggcuggccagguacgagggaaagcucaccuuggccacacggaaagcuccucccacagagucagacauaggccgaagucccuccuggggaccugggacgcagggcggagagccacuaccccacucccggaguccuucuucucuaggggcucuuggagauguugggggcucagggcucccagaaaccccugcugaguucaugcugcuuagauuuaacccaucacugucaggccugcaguccugauccaauagggagcuuccaggccugagcccgggccucccuccccagcgguggccgcccucaccgucucggucgucgucacugcccgaggaguggccgccgugguaggccggacucugggcuccaggcagcugcggcgggcccuccucuuccuccucgcuggagcuggcagcacgacugcggcugacaggauaggaggcggcgauggaggaggaggagcaggaggcccgggccccggccugcgguugggagaagauaugccaagaauguaaaccauccgcuggacgcugcgcccgcuccuguugcugcugcggccggcgcagccucccuucggucuccggcccggucaggggccgcgccgaacgcagacccgccagggggaagcauguccgaggggguggcgucgguggcugccgcgacucccgagccggaggcucccacgcggcaccgucggggcugggcguuccuggggauucagagucggcgcugggccuccuggagccaggaccgccgaagagcuugcgcaucucggugacgcugggccaggcuccucgcgcugggcccucggccgcuucuuccgcggccgcggguaagacgccuccgucucgggucccagcggagccgucguccagacgcggcgcgucgaagcgccgggagagcuggcgaaccgacggcgagaggcugcggagcgggcgcggcugcgcgggggcggccaggggcccagacgccagcuuggacacgcgccgagagggcuggccccgggcagccguggucggccggcacgaggcgcgucgccucaagccggggguguccguguccuccucccucagcccggggccgccgcuccagcgcuccagcagcuugaacgagacgcugcgguaaagcuggggccggggugccccguccgccauaguggcguaacucacuccgggggggcuggccucgggcagccgcggccaacccccccugcgcccccacucccuaggagcgcagcggcccacgccgaaagcagcgcacgggagugugggaagaggacgcagagaccggagcagagguuucucugccgcggcucaaguuucuguggccaccggccgcaacgucuccaucccgggcggccccucccgccucagcgccgacccccaggcccagcccccgccgcggcuggagcgaccaggggcaccgcggcaccgccugggcgggaucccagcgcuugguuccucgacucugcguccgccugcccaacgcccuuggcugcucgcuccuggcacccuuuuguugcaaauaaacuuugcggcagaggcaagggggcggggggcggggccucgcgcccaaaagagggggugggcuccgggcgugcgcgagccugggaaccgcguggugggagggaaucagggaggagccgaagaagaaaaagccugcuggaggacuugcagacugaggcgacccucuggcccuccagagaggucccucgggagcccagcaggccgagcugcccccagggagucgcugagacacacacaaccgcugagcgugcucagcuccgcagacucgcagccagggcgccgcguccaccgcgggccaccagccuccgcgcggaaacaccuccugcccaggggcuccaacauggcaaccucggacucacaaacucucguacacacugacacucaggugcacgcagacgcacacucucugggccgggaaaggggugggacucggcgccagggagagcccggggagccgcgggcuaacugaaggguccgucgcgcccuacuccccgcccaggccacgccuccuccccuucccucccccuccccgcccgcccucugcggcgaa

SEQ ID NO: 19636 - RNA, 2526 nt, Homo sapiens
uucgccgcagagggcgggcggggagggggagggaaggggaggaggcguggccugggcggggaguagggcgcgacggacccuucaguuagcccgcggcuccccgggcucucccuggcgccgagucccaccccuuucccggcccagagagugugcgucugcgugcaccugagugucaguguguacgagaguuugugaguccgagguugccauguuggagccccugggcaggagguguuuccgcgcggaggcugguggcccgcgguggacgcggcgcccuggcugcgagucugcggagcugagcacgcucagcgguugugugugucucagcgacucccugggggcagcucggccugcugggcucccgagggaccucucuggagggccagagggucgccucagucugcaaguccuccagcaggcuuuuucuucuucggcuccucccugauucccucccaccacgcgguucccaggcucgcgcacgcccggagcccacccccucuuuugggcgcgaggccccgccccccgcccccuugccucugccgcaaaguuuauuugcaacaaaagggugccaggagcgagcagccaagggcguugggcaggcggacgcagagucgaggaaccaagcgcugggaucccgcccaggcggugccgcggugccccuggucgcuccagccgcggcgggggcugggccugggggucggcgcugaggcgggaggggccgcccgggauggagacguugcggccgguggccacagaaacuugagccgcggcagagaaaccucugcuccggucucugcguccucuucccacacucccgugcgcugcuuucggcgugggccgcugcgcuccuagggagugggggcgcaggggggguuggccgcggcugcccgaggccagcccccccggagugaguuacgccacuauggcggacggggcaccccggccccagcuuuaccgcagcgucucguucaagcugcuggagcgcuggagcggcggccccgggcugagggaggaggacacggacacccccggcuugaggcgacgcgccucgugccggccgaccacggcugcccggggccagcccucucggcgcguguccaagcuggcgucugggccccuggccgcccccgcgcagccgcgcccgcuccgcagccucucgccgucgguucgccagcucucccggcgcuucgacgcgccgcgucuggacgacggcuccgcugggacccgagacggaggcgucuuacccgcggccgcggaagaagcggccgagggcccagcgcgaggagccuggcccagcgucaccgagaugcgcaagcucuucggcgguccuggcuccaggaggcccagcgccgacucugaauccccaggaacgcccagccccgacggugccgcgugggagccuccggcucgggagucgcggcagccaccgacgccacccccucggacaugcuucccccuggcgggucugcguucggcgcggccccugaccgggccggagaccgaagggaggcugcgccggccgcagcagcaacaggagcgggcgcagcguccagcggaugguuuacauucuuggcauaucuucucccaaccgcaggccggggcccgggccuccugcuccuccuccuccaucgccgccuccuauccugucagccgcagucgugcugccagcuccagcgaggaggaagaggagggcccgccgcagcugccuggagcccagaguccggccuaccacggcggccacuccucgggcagugacgacgaccgagacggugagggcggccaccgcuggggagggaggcccgggcucaggccuggaagcucccuauuggaucaggacugcaggccugacagugauggguuaaaucuaagcagcaugaacucagcagggguuucugggagcccugagcccccaacaucuccaagagccccuagagaagaaggacuccgggagugggguaguggcucuccgcccugcgucccagguccccaggagggacuucggccuaugucugacucugugggaggagcuuuccguguggccaaggugagcuuucccucguaccuggccagccccgcaggcucccgcgguagcagccguuauuccagcacggagacccucaaggacgacgaccuauggucuaguagggguucugggggcuggggcguguaccgcuccccuagcuuuggagcuggggaagggcuccugcggucccaggcucgaacccgugccaaaggaccuggaggcaccucuagggcauugagggauggaggauuugagccugaaaagagucgacagcggaagucccugucaaauccagauaucgccucagagacccugacgcuucucaguuuccugcgcucagaccuuucagagcugaggguccgaaaaccuggugggagcuccggggaccguggaagcaacccccuagauggcagagacucaccauccgcagguggcccuguggggcaacuugaacccauacccaucccagccccagcaucaccuggcacgcgccccacacucaa

SEQ ID NO: 19637 - RNA, 3208 nt, Homo sapiens
ugggguggagauuuugcccacaucuggccagcuugugaaccuugagccuuguggguuggaucggcuuccugcuggguuugcacagcccagugggaaugggguuggguguguguaggcuuggugugccucuagcuuggugggggaugcaagcugugggcaucucugagcugcuguggggcugucaucccugcgaguuagucucuugauugucaugggggugugugcccaucuuuggaucucugggguauugcaugggggcgucucuggguuguucuggggacagcgugccuguguguaaauacuguagguuguugcagagguguguaccugugaguaugggaggugguggagagaagggguucaccguuaacuuccagaauuccucuucuugcaccucguggcccuuccucgcagagcccacucugucuuggcaucuccucaccccuuucccuguccccgcuggggacuugccccucgcgcgcaggguccccucccagggccggcgggggcgggcgcuaggacccugcgggguggggcggggcggggcucggagauccgucagcuucaccuccgcagccuggaaaaucccgagccgcggccgccgagcccccgagcccccgagcccccagccuagccgggaggggcgcgcggggcuggggcccggggcggggccgggcggcgggacccacugcuccucccaccagagcccccgcgcggccccgggucucccgggcagcugcggcggcggcgcuggcaccccggccccggcgggccccggcggagcggcgggcaaaggugagcagcccggccuggagggcgccccuccugccccgccacccgccccgcgcccgcccggcgucgcugcgaguuaguugagcaggucgcuccgcgggccccgccgcaccgucccuccccucgggucccggccagucccugggucccgacgggcgcccgccggccaccgcgucccauacgcaguccccacgccggccccagggggucuggggcgcuccucgggagggggaccccgaggcuguccagcgcccguccgcccuucccuggggccagccccuaccucucuccagcuccccacccgccaggaccccgaacagccccacccgcgcccccagcgcacugauucccguccccaaaccggucuugcaggucccaggaagguggcgucagcaucugcagccgcgucgacguugucggagccuccgcggaggacccaggagagccggacuaggaccagggcccugggccuccccacacuccccauggagaagcuggcggccucuacagagccccaagggccucggccgguccugggccgugagaguguccaggugcccgaugaccaagacuuucgcagcuuccggucagagugugaggcugaggugggcuggaaccugaccuauagcagggcuggggugucugucugggugcaggcuguggagauggaucggacgcugcacaagaucaagguaggguugcccgcuauaccugcagccuccacugcacccuuacugccucucucccggagucuccugguccucucuccgggcuagacaccuggcuguauaucugggcccagagagagucuccuuccagggaccgggaggagacacagucugcugggccaagccccaucacacagaugggccaaccgaggccuggagagcaggagugacucacccugccucucucagcuggaacccaggcuucugcaugccccugccuguuccagggaucugggcugcugccaggcccuucuaggagaguggucucccucagggaccccucugcuggggaagccugcaccugguuccugacuugaguuacuccaggugggagacugggcccuucucucccugauuccugguucucagccugagcugggucuccuuccccgcuuucugcacccuggguugcccaggacccgauuccuuacugcccgaugcccugcucuugcucuuucccuucccucccucccuggcugcucccuuagccuccugcagggacucaggauuguggcuggcagauccugaaggcagggcuccaauaccccugccuugcacagagccaggcuacaggugggcuggggaaggaaggggccuggggucaagggaagccaacauagggagcaguugcagacacaucagucgcucacagccaucuccccugcucuucccaaccccacaauucuccucucuuugccgugcagggcaggcuugggguuugggacccugggaacgcauaucccccaggggaccagauggggcaggggcucgugaagacucugguuuaagggccucaauagcugcccccaacacaucugauguugcugugggugcugcauuuccagggcugguagguccccuugcaaugggcucuggcaauaggcugugcccuucgccuuccucuuccuugccuucucccuucugcuauccuccuggaaauguggaggaguccacccuccccuucugccugggaccuagucucagacuuaguucaggcauguaucuuggccccuuaccaagaccugagaugucugaccuuuccccucugacccugagcccuucugccucacuuugucuuaaucauuuacauauaguucuguccauccccacacgauuaucugcuuuucacuuucugccuccccuucuccccucugacucugucugcaccuuggccaucugacuguuuuucccucuggguuuccaugugugucucccacuuugggauucgcugcccagggccucagaaccugugucugagccugaggagcagggauggggaaggcagcuggcaugucccagcugguuguucccugagagcagggacaggucuccuauccuuuuuucuuuuuuuuuugagaagccucacucugucucucaggcugaaguguaguagcgagaucuuagcucacugcaaucuccaccucccagguucaagugauucuccugccucccagcaguagcugggacugcuggugcacaccaccacacucagcuaauuuuuguauuuguaguagagauaggguuucaccacauuggccaggcuggucuugaacuccugaccucaagugauccacccgcuucagccucucagguccuguccucuuugcguccccagcauccaacacaguuagagcagggauauugguggaagagaggggggaggaaagaaccaaggaacaaauugaaug

SEQ ID NO: 19638 - RNA, 3208 nt, Homo sapiens
cauucaauuuguuccuugguucuuuccuccccccucucuuccaccaauaucccugcucuaacuguguuggaugcuggggacgcaaagaggacaggaccugagaggcugaagcggguggaucacuugaggucaggaguucaagaccagccuggccaauguggugaaacccuaucucuacuacaaauacaaaaauuagcugagugugguggugugcaccagcagucccagcuacugcugggaggcaggagaaucacuugaaccugggagguggagauugcagugagcuaagaucucgcuacuacacuucagccugagagacagagugaggcuucucaaaaaaaaaagaaaaaaggauaggagaccugucccugcucucagggaacaaccagcugggacaugccagcugccuuccccaucccugcuccucaggcucagacacagguucugaggcccugggcagcgaaucccaaagugggagacacacauggaaacccagagggaaaaacagucagauggccaaggugcagacagagucagaggggagaaggggaggcagaaagugaaaagcagauaaucguguggggauggacagaacuauauguaaaugauuaagacaaagugaggcagaagggcucagggucagaggggaaaggucagacaucucaggucuugguaaggggccaagauacaugccugaacuaagucugagacuaggucccaggcagaaggggaggguggacuccuccacauuuccaggaggauagcagaagggagaaggcaaggaagaggaaggcgaagggcacagccuauugccagagcccauugcaaggggaccuaccagcccuggaaaugcagcacccacagcaacaucagauguguugggggcagcuauugaggcccuuaaaccagagucuucacgagccccugccccaucugguccccugggggauaugcguucccagggucccaaaccccaagccugcccugcacggcaaagagaggagaauugugggguugggaagagcaggggagauggcugugagcgacugaugugucugcaacugcucccuauguuggcuucccuugaccccaggccccuuccuuccccagcccaccuguagccuggcucugugcaaggcagggguauuggagcccugccuucaggaucugccagccacaauccugagucccugcaggaggcuaagggagcagccagggagggagggaagggaaagagcaagagcagggcaucgggcaguaaggaaucggguccugggcaacccagggugcagaaagcggggaaggagacccagcucaggcugagaaccaggaaucagggagagaagggcccagucucccaccuggaguaacucaagucaggaaccaggugcaggcuuccccagcagaggggucccugagggagaccacucuccuagaagggccuggcagcagcccagaucccuggaacaggcaggggcaugcagaagccuggguuccagcugagagaggcagggugagucacuccugcucuccaggccucgguuggcccaucugugugauggggcuuggcccagcagacugugucuccucccggucccuggaaggagacucucucugggcccagauauacagccaggugucuagcccggagagaggaccaggagacuccgggagagaggcaguaagggugcaguggaggcugcagguauagcgggcaacccuaccuugaucuugugcagcguccgauccaucuccacagccugcacccagacagacaccccagcccugcuauaggucagguuccagcccaccucagccucacacucugaccggaagcugcgaaagucuuggucaucgggcaccuggacacucucacggcccaggaccggccgaggcccuuggggcucuguagaggccgccagcuucuccauggggaguguggggaggcccagggcccugguccuaguccggcucuccuggguccuccgcggaggcuccgacaacgucgacgcggcugcagaugcugacgccaccuuccugggaccugcaagaccgguuuggggacgggaaucagugcgcugggggcgcggguggggcuguucgggguccuggcggguggggagcuggagagagguaggggcuggccccagggaagggcggacgggcgcuggacagccucggggucccccucccgaggagcgccccagacccccuggggccggcguggggacugcguaugggacgcgguggccggcgggcgcccgucgggacccagggacuggccgggacccgaggggagggacggugcggcggggcccgcggagcgaccugcucaacuaacucgcagcgacgccgggcgggcgcggggcggguggcggggcaggaggggcgcccuccaggccgggcugcucaccuuugcccgccgcuccgccggggcccgccggggccggggugccagcgccgccgccgcagcugcccgggagacccggggccgcgcgggggcucuggugggaggagcagugggucccgccgcccggccccgccccgggccccagccccgcgcgccccucccggcuaggcugggggcucgggggcucgggggcucggcggccgcggcucgggauuuuccaggcugcggaggugaagcugacggaucuccgagccccgccccgccccaccccgcaggguccuagcgcccgcccccgccggcccugggaggggacccugcgcgcgaggggcaaguccccagcggggacagggaaaggggugaggagaugccaagacagagugggcucugcgaggaagggccacgaggugcaagaagaggaauucuggaaguuaacggugaaccccuucucuccaccaccucccauacucacagguacacaccucugcaacaaccuacaguauuuacacacaggcacgcuguccccagaacaacccagagacgcccccaugcaauaccccagagauccaaagaugggcacacacccccaugacaaucaagagacuaacucgcagggaugacagccccacagcagcucagagaugcccacagcuugcaucccccaccaagcuagaggcacaccaagccuacacacacccaaccccauucccacugggcugugcaaacccagcaggaagccgauccaacccacaaggcucaagguucacaagcuggccagaugugggcaaaaucuccacccca

SEQ ID NO: 19639 - RNA, 2647 nt, Homo sapiens
cccccacucccgcccagcuguggagggcuccuugggacccuuaagugcaagccugaguguuaagccucagacaggagauggagggugcggagacagaugcaggagcuaccccaggcccgcagcgaggagcugcagggaacuacgguagcaauagugucacggucacugcggccacugcaacacaguacgguaaaugcggcucuaggcucagacuaaagcauccgcgccucagcaggugacgcacgcagaccuggucuccaacgccaccuccacguucccugauacaccagagaaagaugcuggauccguggcagccgucucuacccaaccccuccuacccucccuuccccgaaaccucccccuacgcugccaauacucuugucuucaaucucucucucucucucucucucucucucucucucucucucucucucucauuccugggaaucgggggugggggcgggugauaaagagaggugggcaggagagaaaucucuaagaggagacgggacacaucuagggagggggcgagccuggaggacagucgcacagggaggggcagaacucccgagccagggagggggugcacagucaccuggcgggacagaggcuggcggagggacgggaacccaggcggggcgagccgcgggagaguggagggcaggcgccugggcugggggcggggaccaggcggggcagggggcagggagaggagggcggcgggagccugagccggaaucgcagcgugagcagguggagccgcguugggagcccgccgggucgagcugaguaaggcggcgggcucggcgggggccauggagcugcuaaagcugaaccggagcgugcagggaaccggacccgggccgggggcuucccugugccgcccgggggcgccucuccucaacagcagcagugugggcaaccucagcugcgagcccccucgcauucgcggagccgggacacgaggugggugccucccucagccccccccacaagcuauuucucacuguaccccagaacacuaauagaguccccccaacgagcuccacacuaccuucucaaacguccacaccgugccucucauaguacucccucagcccccaaacagcuccccucacaccuucacccccacagccuacaacuucaucacagcuucacaccaccuggucggaacuccuucacauccugguccccugaauacaccuagagccccugcucaccccaaagcacagccccuuccccaacacgcagccccuccuagacaccagucagaaggcgaggaccuccucuugccaacccugcagaucuccuuuucccucuuacauccaguucacagagccacaacagagaagggaaggaagaaaggaaggcaggacugggaaaagaagggggcugguugagggagggagcacucuggaaagcuugaaugcgaagcugaaguugugaucacaucugacaccccagcccccagccaucccaaaaaagauccucaaaucugaauuaggcuggacacuaggggaugcuccuuagagcugccugccuccauuucacuccuucucaaaccccucugccucccuaguuggagcuuucgaggcucugugcccucucucuuugucugcaaguaaugucuccagcuaucuuccaagcucucucuccagcccuaggcuaggugcugggggcacagggcaaacuagacccagucuggacccucauggcccauagccaagugcagagagaaaccaagcaaauggaaaaaucacagacacaauggaagucccaugaaagggucuaaacugugggcaccaaaagaacuucacagaggcuagaaccuuagagcugggucuugaaguugaguaggcagaaaaggaaggagugggauucuaggugaaggagcaauguuaagcagaaggaaauuuuucuaaacucaaaaagggaaaguuggaauaaauuguaauccaaguauuuauuuaccccacgaaauaaucuaugcuuucucagccgaguuguuacacacucacacuuggauucugucauucagccaauauuuauugaaccagagauugugcuaggcagugggaauguaaguugaacaaaaccgacacaauuccuacuucacagagcucaaaguuuaaugggcgagacagaaaagcaggggauugcagcacaaaguggaagagccuugacagggaaaagauagugggaacacaaguggaacaccucuagcccagcccagccuccuugagaauuaaaguuggccucuugaggaaaugagcuacaaagucaaaaaaauuagggaggcuggcucuaagcuuccuguuggcaaaaaaaaaaaaaaaaaaaaauauauauacacacacacacacacacacacacacacacacacacauauacauaugggagagccagccaagugaacgggcagaagaggcagaaagcaucccaaauaaaaggacaagauguauaagaagcucaaaguuugaauucauggcacuuuuauccacugugacauaguuuugagugacuagaacauauaucuuaagaagggaauaaugaacaggcuggagaccagccuagaggguuugcagagagccugcuaggccugaccauggaacauggacuuucucccgagggcaauaggaacuacuaa

SEQ ID NO: 19640 - RNA, 2647 nt, Homo sapiens
uuaguaguuccuauugcccucgggagaaaguccauguuccauggucaggccuagcaggcucucugcaaacccucuaggcuggucuccagccuguucauuauucccuucuuaagauauauguucuagucacucaaaacuaugucacaguggauaaaagugccaugaauucaaacuuugagcuucuuauacaucuuguccuuuuauuugggaugcuuucugccucuucugcccguucacuuggcuggcucucccauauguauauguguguguguguguguguguguguguguguguguguauauauauuuuuuuuuuuuuuuuuuuuugccaacaggaagcuuagagccagccucccuaauuuuuuugacuuuguagcucauuuccucaagaggccaacuuuaauucucaaggaggcugggcugggcuagagguguuccacuuguguucccacuaucuuuucccugucaaggcucuuccacuuugugcugcaauccccugcuuuucugucucgcccauuaaacuuugagcucugugaaguaggaauugugucgguuuuguucaacuuacauucccacugccuagcacaaucucugguucaauaaauauuggcugaaugacagaauccaagugugaguguguaacaacucggcugagaaagcauagauuauuucgugggguaaauaaauacuuggauuacaauuuauuccaacuuucccuuuuugaguuuagaaaaauuuccuucugcuuaacauugcuccuucaccuagaaucccacuccuuccuuuucugccuacucaacuucaagacccagcucuaagguucuagccucugugaaguucuuuuggugcccacaguuuagacccuuucaugggacuuccauugugucugugauuuuuccauuugcuugguuucucucugcacuuggcuaugggccaugaggguccagacugggucuaguuugcccugugcccccagcaccuagccuagggcuggagagagagcuuggaagauagcuggagacauuacuugcagacaaagagagagggcacagagccucgaaagcuccaacuagggaggcagagggguuugagaaggagugaaauggaggcaggcagcucuaaggagcauccccuaguguccagccuaauucagauuugaggaucuuuuuugggauggcugggggcuggggugucagaugugaucacaacuucagcuucgcauucaagcuuuccagagugcucccucccucaaccagcccccuucuuuucccaguccugccuuccuuucuuccuucccuucucuguuguggcucugugaacuggauguaagagggaaaaggagaucugcaggguuggcaagaggagguccucgccuucugacuggugucuaggaggggcugcguguuggggaaggggcugugcuuuggggugagcaggggcucuagguguauucaggggaccaggaugugaaggaguuccgaccagguggugugaagcugugaugaaguuguaggcugugggggugaaggugugaggggagcuguuugggggcugagggaguacuaugagaggcacgguguggacguuugagaagguaguguggagcucguuggggggacucuauuaguguucugggguacagugagaaauagcuuguggggggggcugagggaggcacccaccucgugucccggcuccgcgaaugcgagggggcucgcagcugagguugcccacacugcugcuguugaggagaggcgcccccgggcggcacagggaagcccccggcccggguccgguucccugcacgcuccgguucagcuuuagcagcuccauggcccccgccgagcccgccgccuuacucagcucgacccggcgggcucccaacgcggcuccaccugcucacgcugcgauuccggcucaggcucccgccgcccuccucucccugcccccugccccgccugguccccgcccccagcccaggcgccugcccuccacucucccgcggcucgccccgccuggguucccgucccuccgccagccucugucccgccaggugacugugcacccccucccuggcucgggaguucugccccucccugugcgacuguccuccaggcucgcccccucccuagaugugucccgucuccucuuagagauuucucuccugcccaccucucuuuaucacccgcccccacccccgauucccaggaaugagagagagagagagagagagagagagagagagagagagagagagagauugaagacaagaguauuggcagcguagggggagguuucggggaagggaggguaggagggguuggguagagacggcugccacggauccagcaucuuucucugguguaucagggaacguggagguggcguuggagaccaggucugcgugcgucaccugcugaggcgcggaugcuuuagucugagccuagagccgcauuuaccguacuguguugcaguggccgcagugaccgugacacuauugcuaccguaguucccugcagcuccucgcugcgggccugggguagcuccugcaucugucuccgcacccuccaucuccugucugaggcuuaacacucaggcuugcacuuaagggucccaaggagcccuccacagcugggcgggaguggggg

SEQ ID NO: 19641 - RNA, 2333 nt, Homo sapiens
aaaacugcaacuguguguucccaugaggaaaguguuuaaagagcaaguggucagaaggauauuucuaugugucacuggaggcuagaacccaggacuccguggaaacuggagaaauuguacgauuccagguuccaacauuugucuuauuccuuguaacugccuucccacauccaaccgcuuccccaucccuucucacggagucugguucgggugaaauuacuuuuauugauggugagcgcaagcaggugugagugacugcaccucuuucagaggacacaggacugggcuuaaggaagggagggccagagcgcccgccuugguggauguaggauucgcuccuuauuagggcgugagugcuacauucugaaaggauuuauuuugggacaaggcacaagcacaggggaggcaggcaacaccagcccucaggcuacacucuccauuuggagcagagcuucuucggcagccccaggucucccgggaucuuccucgguguccugcggaggcucuggcuccagcgugggcuccagcgcaggcugggcuuccggcugggcuucagcgcuccggccaggcccaaggcgaggcggcuugaccggggugggcgguggcgcugcagggccuuuccggcccgaaagggcccuucggaggcucuguaccuucugcaauccggugcgccgcagccgcugggcccuggacuccaccggcuccucguccgagcucucuccaacuucggccuccagcugcucugggcccagcucggacugguccgccgggcccaagggcucuggugccuucuggaaagcgcuggcugggacuucacccuccuccugcaugugacggacacagcacugauccuggcagcuccuuacccccagcagcccgaaacucacuccuuaauuacacaagggaaaccuuuuaccuccgcagccagagucuggggggaaaggcaggcgugggaagguaaggggagggaaagcugcgugcgaacugcaaaacgcuguaaaguaggugaggccuggugaggggcgagaagaggauagugcccgcagucacggaaugcccuuucaaccaccguuauuuuagggauuggcugggacucagaccaaauucugcggacguggccugagcuagagcugggcgggcuuggauuggccaggcggggcucaggcgugagagggagggauggggcugggucuugggaagugggugcggcucugugagucuguuccacagcaacagacggcgggaggggucaggaaugugggugugguagguggauggaagcggggagcccccagcugguggcccacaggccggcaaaggccucggauuggggaccguuugaggucacugaccuugaagagcagaacguggagcuucccgcgcgccaccagcagcccgugguuggccuccagccgcugcaccugggcugcgcggcgcaccgcgcgcucuugggcggcguuggcgugcgagcucacgcgcuccgccuuggccagcagcugcgccaagguguugcugguggugucguggcugcgacucagagcgcccaggccgcucuggaugcggcgcacggacccugccaggccucccugccuucgagccaggccucccugccgcucccgcagagucuccagcauggaggccagcuucuccagcagggucaccaccgucacggcgugcacgggaccccccgccggcgccucgggcacaggcccccgcuccaacgcacucucccucaugaucccugaccgcucugcuccgucugccugcaacugcuggccgcacuacggucaggggccuccuuucccuggcuccuccccagcuccagcugugacucaggcaggcggaguuggccuucuggggcggcgggagggcgcgagggcguggggauguuggcagcggggucucuugaaagcguuucgccuuccgcugucccgcgccgggggccugcugggaagccuguuggccccaaaucggcccccugcaaacccucucacucugaguuugaguuacccuccuccgcuccaauucccuggugugccuguuucaguucuccacugcaaagggcgagucacggaaauuuuuauuucaugcaucuuagugggcgcagagacuguguuggcacggcaaagagauaaccagaggggccuccgucgccguccacuuucggccucccacaccagugaagauugcccccaggcuggaugcaggcgacagggaggcccuggaacauucugcuuacagaucgcgaacugucaaggcccgaggccccgcuuugugacuuggacaggcugcucauugugggcuggcgggcggggcauccucugguguuuucc

SEQ ID NO: 19642 - RNA, 2333 nt, Homo sapiens
ggaaaacaccagaggaugccccgcccgccagcccacaaugagcagccuguccaagucacaaagcggggccucgggccuugacaguucgcgaucuguaagcagaauguuccagggccucccugucgccugcauccagccugggggcaaucuucacuggugugggaggccgaaaguggacggcgacggaggccccucugguuaucucuuugccgugccaacacagucucugcgcccacuaagaugcaugaaauaaaaauuuccgugacucgcccuuugcaguggagaacugaaacaggcacaccagggaauuggagcggaggaggguaacucaaacucagagugagaggguuugcagggggccgauuuggggccaacaggcuucccagcaggcccccggcgcgggacagcggaaggcgaaacgcuuucaagagaccccgcugccaacauccccacgcccucgcgcccucccgccgccccagaaggccaacuccgccugccugagucacagcuggagcuggggaggagccagggaaaggaggccccugaccguagugcggccagcaguugcaggcagacggagcagagcggucagggaucaugagggagagugcguuggagcgggggccugugcccgaggcgccggcggggggucccgugcacgccgugacgguggugacccugcuggagaagcuggccuccaugcuggagacucugcgggagcggcagggaggccuggcucgaaggcagggaggccuggcaggguccgugcgccgcauccagagcggccugggcgcucugagucgcagccacgacaccaccagcaacaccuuggcgcagcugcuggccaaggcggagcgcgugagcucgcacgccaacgccgcccaagagcgcgcggugcgccgcgcagcccaggugcagcggcuggaggccaaccacgggcugcugguggcgcgcgggaagcuccacguucugcucuucaaggucagugaccucaaacgguccccaauccgaggccuuugccggccugugggccaccagcugggggcuccccgcuuccauccaccuaccacacccacauuccugaccccucccgccgucuguugcuguggaacagacucacagagccgcacccacuucccaagacccagccccaucccucccucucacgccugagccccgccuggccaauccaagcccgcccagcucuagcucaggccacguccgcagaauuuggucugagucccagccaaucccuaaaauaacggugguugaaagggcauuccgugacugcgggcacuauccucuucucgccccucaccaggccucaccuacuuuacagcguuuugcaguucgcacgcagcuuucccuccccuuaccuucccacgccugccuuuccccccagacucuggcugcggagguaaaagguuucccuuguguaauuaaggagugaguuucgggcugcuggggguaaggagcugccaggaucagugcuguguccgucacaugcaggaggagggugaagucccagccagcgcuuuccagaaggcaccagagcccuugggcccggcggaccaguccgagcugggcccagagcagcuggaggccgaaguuggagagagcucggacgaggagccgguggaguccagggcccagcggcugcggcgcaccggauugcagaagguacagagccuccgaagggcccuuucgggccggaaaggcccugcagcgccaccgcccaccccggucaagccgccucgccuugggccuggccggagcgcugaagcccagccggaagcccagccugcgcuggagcccacgcuggagccagagccuccgcaggacaccgaggaagaucccgggagaccuggggcugccgaagaagcucugcuccaaauggagaguguagccugagggcugguguugccugccuccccugugcuugugccuugucccaaaauaaauccuuucagaauguagcacucacgcccuaauaaggagcgaauccuacauccaccaaggcgggcgcucuggcccucccuuccuuaagcccaguccuguguccucugaaagaggugcagucacucacaccugcuugcgcucaccaucaauaaaaguaauuucacccgaaccagacuccgugagaagggauggggaagcgguuggaugugggaaggcaguuacaaggaauaagacaaauguuggaaccuggaaucguacaauuucuccaguuuccacggaguccuggguucuagccuccagugacacauagaaauauccuucugaccacuugcucuuuaaacacuuuccucaugggaacacacaguugcaguuuu

SEQ ID NO: 19643 - RNA, 2513 nt, Homo sapiens
cagacuagagucagaaaagcggauggaauucuuacacagcaugaaguaguauaagaaauccuaggcagaaggaaguucagguagcucucagggcuaggaaacuccucgacaacgagggacaaccaaauccagcauuuaaaaacucuguauuuuaauucuucucuuaauauaauacuuccuucuuuauugauugcugagcauucuaggaacuaggauaggauuauuuggccugaaggaaagaauacuucucgaaccugauuuguuaaaugaaucgagauugcuuuaaagugaaagaagggaaaagagaguuaucucuuuugcaggagcacauuucaaucacuuaucacucuggguuagcauaaaucagauaaacuauccuguggguugugcaaaaagcaaaacaaaacaaaaaaacacaacuuguaaaaaaaacagagcaagauaacugaaguagacaaacucugcacagaaguaacuaauggcagggaggagaaaaauuuuuguauauuauauuauacuguguauaauauaauguaccuguguaucauuagagcuguuaaauuaaaaaaaaaaaaaaaaaaaaaaggaaauggaugcagaagcucugcccuccuggggccagaaauggcaauuucagugaacuagggccgacaaccacauccaaaauuaaauauuucaaaagcuuaaaauaaaaaauacuagaaaaauuaugcagagcaccuauuucauuuguuaaaagacauuuaauuaguguuucacauauuaccacccaaaugaauaaagcgauugugaaauucaagaaaacaaucaaacuacaagaaaacuccagauaaaacuacaaaguuaaacauaaacuuggcccaggaccacuacaguggcugagggaugacaaauacaguucuuuauauugguaacccuuagccauccaucccauucuauagaaagaggacaguaccaucuuugaccccaggcccccuguccugaggugcuucuacuuaaugccaggaacaacugugcuagaaaaaaagacugcacccaccccagcuccagaugcacacauuagcuggucggugagaugcagcagccuggcuuccucccucuacccacuccuugggggcggggcuggaagaggagaaugaugaagagauguuggggguucaggaaaccuucacauuuggccccuuuucucucuccccacucaggauggaaggucaaaguuaggaccaaaacuagagaaguggguuuugcauagggggacaauggauucaacagaaguccucuggaucuggcaacugucaaaaaacccucuuuccacuucuuucccccucacggaaagccauuaggaaucaccucugucugggucauaggaacagccacacagcauaggaggcacaagccccgugaacaaaauucgguauuaagaauaaggaaaaagaaagaagacccgagggcaagagggcagggcaggaccucuucuuucuacuggagaagagacauccagggaggaggcacagccgaggggagcgcaagcuagaaaagcuacgacggaauccccaccgaaaccgcagcagggguacuggaaggggaggaauccgcgacgcagcgaccgcgagccaagggcagcggcgggccgggccgugacucagugaaagccgcaacggccgggccucggaaaacggcgggcgcgaagccgccggggccggggcgagaacggcggcgggggcucaccauguccuuggacgagcccagcuucuugaggccguccaggggcagcaggucggcggaguccuuguggaugaacugcaccgccugcuucauccggcgcugcugucgcagugacgccgccucccgcaugucggucuccuugcggccgcccucagugaggagcccugaguaaaacaucgcugaggcgccggcggcccgguagcccacagccccccggcagccucagccucgagcuccuccagcgccgcaagggccccgagccgcgccuuuuauagccgagcgugacgucgcggggagcagccagugcgcgcgcggggggcggggccggcacagaguccacgccccgcgcggcucccucgcgucccgcgucccgcgucccgcguccccugcucacccgguggcaaagccggcgaggaggcggcggcgcugguggggacugacccggcaguccgagaauccaccgcggccuuuucacccaaccgcccccuccugcgugggggccccgcauccccuggacuggcgugggcucuggggcccgaugcccuggcagccccggccaucucugccgcuggccgcggguaccugcucaccuguccacgccguggccgacccggggaucaccgacagccgggccaugccucgagucccgccgcccgcgccgcugcucggcuucucagaaacgcaccuccacgccgccagccggggcuccaggguccaccgcccgggcccggaggacuggcgacucccuccgagguugggagcgcuccggauuucuccaacuucagguc

SEQ ID NO: 19644 - RNA, 2513 nt, Homo sapiens
gaccugaaguuggagaaauccggagcgcucccaaccucggagggagucgccaguccuccgggcccgggcgguggacccuggagccccggcuggcggcguggaggugcguuucugagaagccgagcagcggcgcgggcggcgggacucgaggcauggcccggcugucggugauccccgggucggccacggcguggacaggugagcagguacccgcggccagcggcagagauggccggggcugccagggcaucgggccccagagcccacgccaguccaggggaugcggggcccccacgcaggagggggcgguugggugaaaaggccgcgguggauucucggacugccgggucaguccccaccagcgccgccgccuccucgccggcuuugccaccgggugagcaggggacgcgggacgcgggacgcgggacgcgagggagccgcgcggggcguggacucugugccggccccgccccccgcgcgcgcacuggcugcuccccgcgacgucacgcucggcuauaaaaggcgcggcucggggcccuugcggcgcuggaggagcucgaggcugaggcugccggggggcugugggcuaccgggccgccggcgccucagcgauguuuuacucagggcuccucacugagggcggccgcaaggagaccgacaugcgggaggcggcgucacugcgacagcagcgccggaugaagcaggcggugcaguucauccacaaggacuccgccgaccugcugccccuggacggccucaagaagcugggcucguccaaggacauggugagcccccgccgccguucucgccccggccccggcggcuucgcgcccgccguuuuccgaggcccggccguugcggcuuucacugagucacggcccggcccgccgcugcccuuggcucgcggucgcugcgucgcggauuccuccccuuccaguaccccugcugcgguuucgguggggauuccgucguagcuuuucuagcuugcgcuccccucggcugugccuccucccuggaugucucuucuccaguagaaagaagagguccugcccugcccucuugcccucgggucuucuuucuuuuuccuuauucuuaauaccgaauuuuguucacggggcuugugccuccuaugcuguguggcuguuccuaugacccagacagaggugauuccuaauggcuuuccgugagggggaaagaaguggaaagaggguuuuuugacaguugccagauccagaggacuucuguugaauccauugucccccuaugcaaaacccacuucucuaguuuugguccuaacuuugaccuuccauccugaguggggagagagaaaaggggccaaaugugaagguuuccugaacccccaacaucucuucaucauucuccucuuccagccccgcccccaaggaguggguagagggaggaagccaggcugcugcaucucaccgaccagcuaaugugugcaucuggagcuggggugggugcagucuuuuuuucuagcacaguuguuccuggcauuaaguagaagcaccucaggacagggggccuggggucaaagaugguacuguccucuuucuauagaaugggauggauggcuaaggguuaccaauauaaagaacuguauuugucaucccucagccacuguagugguccugggccaaguuuauguuuaacuuuguaguuuuaucuggaguuuucuuguaguuugauuguuuucuugaauuucacaaucgcuuuauucauuugggugguaauaugugaaacacuaauuaaaugucuuuuaacaaaugaaauaggugcucugcauaauuuuucuaguauuuuuuauuuuaagcuuuugaaauauuuaauuuuggaugugguugucggcccuaguucacugaaauugccauuucuggccccaggagggcagagcuucugcauccauuuccuuuuuuuuuuuuuuuuuuuuuuaauuuaacagcucuaaugauacacagguacauuauauuauacacaguauaauauaauauacaaaaauuuuucuccucccugccauuaguuacuucugugcagaguuugucuacuucaguuaucuugcucuguuuuuuuuacaaguuguguuuuuuuguuuuguuuugcuuuuugcacaacccacaggauaguuuaucugauuuaugcuaacccagagugauaagugauugaaaugugcuccugcaaaagagauaacucucuuuucccuucuuucacuuuaaagcaaucucgauucauuuaacaaaucagguucgagaaguauucuuuccuucaggccaaauaauccuauccuaguuccuagaaugcucagcaaucaauaaagaaggaaguauuauauuaagagaagaauuaaaauacagaguuuuuaaaugcuggauuugguugucccucguugucgaggaguuuccuagcccugagagcuaccugaacuuccuucugccuaggauuucuuauacuacuucaugcuguguaagaauuccauccgcuuuucugacucuagucug

SEQ ID NO: 19645 - RNA, 2682 nt, Homo sapiens
cccggccccuccgcgggagucuggggucgcggcccggucaggcgccaagccggcaggggggcgcgguccacuugaggccacagcuccccagguccagggcucgggccauccgcgcugucccuuccgcgggcucuugcuguucuucgccaggaggcuuugcacuccgggccgcauggguccuggauaaggaccucaagagguuguaguggcgccccuucgcuccggcguacugucugaacccugugcccaaagagggcuguggcaguuccugcaccaaccgccuggagcccauaccuaagcccucugggcacgagggaccuccucucccccgcuccccccuccccccaucccaacuccagccccaaaggaagcaaugcgcgcguccgagagcaggagcgcgcguggcugaggaaagaaagggaaggcaaccgggcagcccaggccccgccccgccgcucccccacccgugcgcuuauaaagcacaggaaccagagcuggccacucagugguuucuuggugacacuggauagaacagcucaagccuugccacuucgggcuucucacugcagcugggcuuggacuucggaguuuugccauugccagugggacgucugagacuuucuccuucaaguacuuggcagaucacucucuuagcagguaggugccgcagacccugcggguuaagaggugggguggggggcagugcuugccaaggcccuaaacugggagcgcugggugaggggaacaacccacuuuggaggguucucugagagauagauacaccccauauccugggcccagcucgugcacacagcuggagguccagagacccaguccccucugcuccgucagccaaguuccaagaaguugagcagagacccucugggagccuggcggggugcagcggccuccccugcggggccugucacccggccggcgcgugcaaacgccucuggcgccucucugcgcggagggagauaagcgucugagccagggaaagcgcgggcuaaacccgccucgccggggccccugcccgcccuccgugccccgcccgggcggugcagcuggcccgggugcucacgcucgacucucuuucuucuuuuccagggucugcgcuucgcagccgggaugaagcugguuuccgucgcccugauguaccuggguucgcucgccuuccuaggcgcugacaccgcucgguuggaugucgcgucggaguuucgaaagaagugaguccgggcagcgccuucccccuugcugguaccuggcaggcaaggggaacugaccguuggucccgaaggucuagaagugaaugggagcagggacaggccugggcgucaccugaacgcacgcgaaucgggucugcuuguguuuuccagguggaauaagugggcucugagucgugggaagagggaacugcggauguccagcagcuaccccaccgggcucgcugacgugaaggccgggccugcccagacccuuauucggccccaggacaugaagggugccucucgaagccccgaagacagguaacuacgcccugugcuguccagggacgggagggaaggaaggugugcgggaggaguucucugucuccacuccccuggcccgggggaucgucggggcuggaccgcagcucagauggcgcgagcaguuuccagcucccucuggcucuagaauggcucccguucccgguguuggggccaaagcucugcuugauggggucucaaguugccuuucuucccccuccccccgcccgcagcaguccggaugccgcccgcauccgagucaagcgcuaccgccagagcaugaacaacuuccagggccuccggagcuuuggcugccgcuucgggacgugcacggugcagaagcuggcacaccagaucuaccaguucacagauaaggacaaggacaacgucgcccccaggagcaagaucagcccccagggcuacggccgccggcgccggcgcucccugcccgaggccggcccgggucggacucuggugucuucuaagccacaagcacacggggcuccagcccccccgaguggaagugcuccccacuuucuuuaggauuuaggcgcccaugguacaaggaauagucgcgcaagcaucccgcuggugccucccgggacgaaggacuucccgagcgguguggggaccgggcucugacagcccugcggagacccugaguccgggaggcaccguccggcggcgagcucuggcuuugcaagggccccuccuucugggggcuucgcuuccuuagccuugcucaggugcaagugccccagggggcggggugcagaagaauccgaguguuugccaggcuuaaggagaggagaaacugagaaaugaaugcugagacccccggagcaggggucugagccacagccgugcucgcccacaaacugauuucucacggcgugucaccccaccagggcgcaagccucacuauuacuugaacuuuccaaaaccuaaagaggaaaagugcaaugcguguuguacauacagagguaacuaucaauauuuaaguuuguugcugucaagauuuuuuuuguaacuucaaauauagagauauuuuuguacguuauauauuguauuaagggcauuuuaaaagcaauuauauuguccuccccuauuuuaagacgugaaugucucagcgagguguaaaguuguucgccgcgug

SEQ ID NO: 19646 - RNA, 2682 nt, Homo sapiens
cacgcggcgaacaacuuuacaccucgcugagacauucacgucuuaaaauaggggaggacaauauaauugcuuuuaaaaugcccuuaauacaauauauaacguacaaaaauaucucuauauuugaaguuacaaaaaaaaucuugacagcaacaaacuuaaauauugauaguuaccucuguauguacaacacgcauugcacuuuuccucuuuagguuuuggaaaguucaaguaauagugaggcuugcgcccugguggggugacacgccgugagaaaucaguuugugggcgagcacggcuguggcucagaccccugcuccgggggucucagcauucauuucucaguuucuccucuccuuaagccuggcaaacacucggauucuucugcaccccgcccccuggggcacuugcaccugagcaaggcuaaggaagcgaagcccccagaaggaggggcccuugcaaagccagagcucgccgccggacggugccucccggacucagggucuccgcagggcugucagagcccgguccccacaccgcucgggaaguccuucgucccgggaggcaccagcgggaugcuugcgcgacuauuccuuguaccaugggcgccuaaauccuaaagaaaguggggagcacuuccacucgggggggcuggagccccgugugcuuguggcuuagaagacaccagaguccgacccgggccggccucgggcagggagcgccggcgccggcggccguagcccugggggcugaucuugcuccugggggcgacguuguccuuguccuuaucugugaacugguagaucuggugugccagcuucugcaccgugcacgucccgaagcggcagccaaagcuccggaggcccuggaaguuguucaugcucuggcgguagcgcuugacucggaugcgggcggcauccggacugcugcgggcggggggagggggaagaaaggcaacuugagaccccaucaagcagagcuuuggccccaacaccgggaacgggagccauucuagagccagagggagcuggaaacugcucgcgccaucugagcugcgguccagccccgacgaucccccgggccaggggaguggagacagagaacuccucccgcacaccuuccuucccucccgucccuggacagcacagggcguaguuaccugucuucggggcuucgagaggcacccuucauguccuggggccgaauaagggucugggcaggcccggccuucacgucagcgagcccggugggguagcugcuggacauccgcaguucccucuucccacgacucagagcccacuuauuccaccuggaaaacacaagcagacccgauucgcgugcguucaggugacgcccaggccugucccugcucccauucacuucuagaccuucgggaccaacggucaguuccccuugccugccagguaccagcaagggggaaggcgcugcccggacucacuucuuucgaaacuccgacgcgacauccaaccgagcggugucagcgccuaggaaggcgagcgaacccagguacaucagggcgacggaaaccagcuucaucccggcugcgaagcgcagacccuggaaaagaagaaagagagucgagcgugagcacccgggccagcugcaccgcccgggcggggcacggagggcgggcaggggccccggcgaggcggguuuagcccgcgcuuucccuggcucagacgcuuaucucccuccgcgcagagaggcgccagaggcguuugcacgcgccggccgggugacaggccccgcaggggaggccgcugcaccccgccaggcucccagagggucucugcucaacuucuuggaacuuggcugacggagcagaggggacugggucucuggaccuccagcugugugcacgagcugggcccaggauaugggguguaucuaucucucagagaacccuccaaaguggguuguuccccucacccagcgcucccaguuuagggccuuggcaagcacugccccccaccccaccucuuaacccgcagggucugcggcaccuaccugcuaagagagugaucugccaaguacuugaaggagaaagucucagacgucccacuggcaauggcaaaacuccgaaguccaagcccagcugcagugagaagcccgaaguggcaaggcuugagcuguucuauccagugucaccaagaaaccacugaguggccagcucugguuccugugcuuuauaagcgcacgggugggggagcggcggggcggggccugggcugcccgguugccuucccuuucuuuccucagccacgcgcgcuccugcucucggacgcgcgcauugcuuccuuuggggcuggaguugggauggggggaggggggagcgggggagaggaggucccucgugcccagagggcuuagguaugggcuccaggcgguuggugcaggaacugccacagcccucuuugggcacaggguucagacaguacgccggagcgaaggggcgccacuacaaccucuugagguccuuauccaggacccaugcggcccggagugcaaagccuccuggcgaagaacagcaagagcccgcggaagggacagcgcggauggcccgagcccuggaccuggggagcuguggccucaaguggaccgcgccccccugccggcuuggcgccugaccgggccgcgaccccagacucccgcggaggggccggg

SEQ ID NO: 19647 - RNA, 2687 nt, Homo sapiens
agcacauugccgaaucuuguucuccuuagauaugcaaauauugcuuccugucgagaaggacugggaggccuuccgcuuuagaggcagcgcuuauagcgcuagcuggucguggaaugcgauuacagcgucuccauuggagaccgcugagugccucgguuucccugucugugcaaagugcacuccccagacgccgcugccucgagggaccaggaaaugcgucugggggcgccaggaaagaugagaagauaaagucacgaugcguccagcuagcuauagacacaagcagaggagccaguaggccaaaggagacgcacagcugauccgugccgaggcgcgggcuccacucccugaaguggagggacccuugaaucuuuccuugcguaggcgcgcggcagagcagcgauuuggcgaaaagggccgagacucaggaugccugcaaugcgagcgaggggcggacagggcgcacggggcgcggcaaggcugcgaggggcgggccugggcccugagccuccugcacuuccagccacagcucugggccuugggggcgggaagggguggagccacguggggaggagcaaaacccggaggucccgggcaccuugggcagagccagagcggcgggagccgguccugggcgcguugccccgggagcgcccgucguccgggcagagcgcagccgcaaccgcgaccacagccgcagucgcuuuccagccugccuucggugcgcagcgggggaacagggcuagugcagccgccggaggggggcacgggcuccucucccaucccagagcuacugggcugcccuugcuguccucgccgccccagcagaccccggccggaccugccaccugcgcccugguugcgccauggauccuucggaaaagaagauaucgguguggaucugccaggaagagaagcugguguccggccucucccgccgcaccacuugcuccgacguugugcgagugcuuuuggaggacggcugccggcggcgacggagacagcggcggagccggcggcuggggucggccggcgacccgcauggcccgggagagcugcccgaacccccgaacgaggacgacgaggacgacgacgaggcgcugccgcagggcaugcugugcgggcccccgcagugcuauugcaucguggagaaguggcgcggcuuugagcgcauccuccccaacaagacgcgcaucuugcgccucugggcugccuggggcgaagagcaagagaaugugcgcuucgugcuagugcgcagcgaggcaucgcugccuaacgccggcccccgcagcgccgaggcgcgcguagugcugagccgagagcgccccuguccggcccgcggggccccggcgcggcccagccuggccaugacccaggagaaacagcggcgaguggugcgcaaggccuuucgcaaacuggccaagcucaaccggcggcgccagcagcagacaccgucguccuguucguccacuucgucguccacugccucguccugcucuucgucgccgcggacccacgagagcgcgucgguggagcgcauggagacgcuggugcaucuggugcuuucccaggaccacacaauucgccagcaggugcagcggcuccacgagcuggaccgcgagaucgaucacuacgaggccaaggugcaccuggaccgcaugcggcgucacggggucaacuacgugcaggacacuuacuugguuggggcaggcaucgagcucgacggguccagaccgggagaggagccagaagagguggcggcggaggcggaggaggcggcggcggcgcccccucuagccggcgaggcgcaggcggcggcgcuggaggagcuggcccggcgcugcgacgacuugcugcggcuucaggagcaacggguucagcaggaggaguugcuggagcgccuuucagccgagauucaggaggaacucaaccagagguggaugcgacggcgccaggaggagcuggcggcgcgggaggagccccuggagcccgacgguggccccgacggcgagcugcugcuggagcaggaacgggucaggacgcagcucaguaccagccuuuacauugggcugcggcucaacacggaccuagaggccgucaagucggacuuggauuacagccagcagcaaugggacagcaagaagcgcgagcuacagggccuucugcaaacuuugcacacuuuggagcugacgguggcaccggauggggcuccuggcucuggcagucccucgcgggaaccugggccucaagccugcgccgacauguggguggaccaggcccguggacuggccaagagcgguccuggcaacgacgaagacucggauacgggacugagcucuaugcauagccaagacucggacuccuugcccaugugcgaaucccuuguguagggguggggggcggggggcggggggcgggaacagggggauucuuuuuucuugcagaaugcagugggccagccggcucgcggacuugaaaccaggcuguugcgagcccagagcuccggcugggcagcagcgcucugcgcagccucgcgcucaucuggcuccggggugagugcagagcagggugaggguagaagaaguaggauccucaauacaagcucauuaaagagagggaaggagggaggaggcaagaacccccuauacuggaaaacaaacaacccaaggaaauugacgugguccgag

SEQ ID NO: 19648 - RNA, 2687 nt, Homo sapiens
cucggaccacgucaauuuccuuggguuguuuguuuuccaguauaggggguucuugccuccucccuccuucccucucuuuaaugagcuuguauugaggauccuacuucuucuacccucacccugcucugcacucaccccggagccagaugagcgcgaggcugcgcagagcgcugcugcccagccggagcucugggcucgcaacagccugguuucaaguccgcgagccggcuggcccacugcauucugcaagaaaaaagaaucccccuguucccgccccccgccccccgccccccaccccuacacaagggauucgcacaugggcaaggaguccgagucuuggcuaugcauagagcucagucccguauccgagucuucgucguugccaggaccgcucuuggccaguccacgggccugguccacccacaugucggcgcaggcuugaggcccagguucccgcgagggacugccagagccaggagccccauccggugccaccgucagcuccaaagugugcaaaguuugcagaaggcccuguagcucgcgcuucuugcugucccauugcugcuggcuguaauccaaguccgacuugacggccucuagguccguguugagccgcagcccaauguaaaggcugguacugagcugcguccugacccguuccugcuccagcagcagcucgccgucggggccaccgucgggcuccaggggcuccucccgcgccgccagcuccuccuggcgccgucgcauccaccucugguugaguuccuccugaaucucggcugaaaggcgcuccagcaacuccuccugcugaacccguugcuccugaagccgcagcaagucgucgcagcgccgggccagcuccuccagcgccgccgccugcgccucgccggcuagagggggcgccgccgccgccuccuccgccuccgccgccaccucuucuggcuccucucccggucuggacccgucgagcucgaugccugccccaaccaaguaaguguccugcacguaguugaccccgugacgccgcaugcgguccaggugcaccuuggccucguagugaucgaucucgcgguccagcucguggagccgcugcaccugcuggcgaauugugugguccugggaaagcaccagaugcaccagcgucuccaugcgcuccaccgacgcgcucucguggguccgcggcgacgaagagcaggacgaggcaguggacgacgaaguggacgaacaggacgacggugucugcugcuggcgccgccgguugagcuuggccaguuugcgaaaggccuugcgcaccacucgccgcuguuucuccugggucauggccaggcugggccgcgccggggccccgcgggccggacaggggcgcucucggcucagcacuacgcgcgccucggcgcugcgggggccggcguuaggcagcgaugccucgcugcgcacuagcacgaagcgcacauucucuugcucuucgccccaggcagcccagaggcgcaagaugcgcgucuuguuggggaggaugcgcucaaagccgcgccacuucuccacgaugcaauagcacugcgggggcccgcacagcaugcccugcggcagcgccucgucgucguccucgucguccucguucggggguucgggcagcucucccgggccaugcgggucgccggccgaccccagccgccggcuccgccgcugucuccgucgccgccggcagccguccuccaaaagcacucgcacaacgucggagcaaguggugcggcgggagaggccggacaccagcuucucuuccuggcagauccacaccgauaucuucuuuuccgaaggauccauggcgcaaccagggcgcagguggcagguccggccggggucugcuggggcggcgaggacagcaagggcagcccaguagcucugggaugggagaggagcccgugccccccuccggcggcugcacuagcccuguucccccgcugcgcaccgaaggcaggcuggaaagcgacugcggcuguggucgcgguugcggcugcgcucugcccggacgacgggcgcucccggggcaacgcgcccaggaccggcucccgccgcucuggcucugcccaaggugcccgggaccuccggguuuugcuccuccccacguggcuccaccccuucccgcccccaaggcccagagcuguggcuggaagugcaggaggcucagggcccaggcccgccccucgcagccuugccgcgccccgugcgcccuguccgccccucgcucgcauugcaggcauccugagucucggcccuuuucgccaaaucgcugcucugccgcgcgccuacgcaaggaaagauucaagggucccuccacuucagggaguggagcccgcgccucggcacggaucagcugugcgucuccuuuggccuacuggcuccucugcuugugucuauagcuagcuggacgcaucgugacuuuaucuucucaucuuuccuggcgcccccagacgcauuuccuggucccucgaggcagcggcgucuggggagugcacuuugcacagacagggaaaccgaggcacucagcggucuccaauggagacgcuguaaucgcauuccacgaccagcuagcgcuauaagcgcugccucuaaagcggaaggccucccaguccuucucgacaggaagcaauauuugcauaucuaaggagaacaagauucggcaaugugcu

SEQ ID NO: 19649 - RNA, 3101 nt, Homo sapiens
aacggagccuuuuguuaugucuaaccacgguaccuccagcugcagugggaccucugucucccuuggaggcugagaacagcugggccccaggucccggugaacaacacagccuguuggauuccuggccaguguguucucuccuaccucucgggauccaccuuccuguguaugcugcggggagaggaggcccugugcugagcgcuuggggagccucaccuggagcccucucucucuugcuccugcuccagcucacuggccuucaucugcacauaguucugcaccagugcagccagcaggaggcgcgcuucguccucacugagcguggccgggucugcugggcugcucuccagggcagaccuguggaggggaagcaaacucagugcaggcugugagccccugccugccccuccccaggauaagcagccaggcuuccuggucuuugcuucuuccccugaggauguggccagcgggaguccuaggggacagggcacaaggccaguguccuccucaggacccaggcacugguguggccucuaaacaguggugugcuggagccaguuuguauaggcuugugaaagcuaaugguuaaauuuucaagaauuuugcaagcugagugcagccauuauuaaaaauuaaaugcaaaaacuuacaguuagugcugaaccugaaaauaguuucaguuuaauagauuuauaugugggugagaaauagaucaacagguaaaauaccagauuuaacaauaacaaauuuaguggcaaacuauuuaacagaauaggaugcaauucauuuuucaaaucauggcugaauaggauaaauaggauggcuacacauacaaaaguuuggcuaaaagcaacaaaagcauuuugugagacucagugggcuauauaaaauuuauaauaggccgggcgcgguggcucacggcuguaaucucagcacuuugggaggcugaggcagguggaucaccugaggucaggaguuugagaccagccuggccaacauggugaaacccuaucucuacuaaaaauacaaaaauuagccgggcaugguggugggcgccuguaaucccggcuacuugggaggcugaggcaggagaauugcuugaacccaggagauggaaguugcagugagccgacacggugccauugcacuccagcauggaugacagagugagacucugucucaaaaaaauuauaaugaagaauauugucuaaauauuuaucacuacuuauaaauuguguaccacacauuuuuauaucaaaaaauuauauaugugcaugaguacauaccuuaccccggcccccugucgguuuuuaagcauucaguacaccacacuuaagaggcauggaauugucugauaccagugugguucuggcuucaggcugucuuaccugaauggugcugcauggaggcugccugccugcaacaggaccaagaugcugagagccaggaagggggagaacuuuuggaagcccaugacaccucucugcaagggaagaaugagauaaaccaccugcgccaguucgaaguucuaggagcccacagaccuuggcuccuauccugguuuucugucuugcuucuaacgcucuggcuuuguggcuucagacuggucauuauauuucucuucuuuuuuguuuccucaucagcacaguggacuucugggagguucagugggccuguagcaugcacagucugauagagcuggaggagcgauccuagagggagagcugagugggggaggucucaguccuacccuucuccccaaagccacacagauacauauaaaccuguuagccaggucucuguggaggacaugcucccaggccccugucacagaagcugaucccauaaggaaacccagagcuguccuccucuucuggggcuuuugcauacaccuuggugggaggggugggaucuauccacagagauuaucucugcaauuggaaucugagaaauaaaagaaucaauuuuagugcucagccuaagcuccgccugcuggcaccucaguccccugcaggaaccaaguuuuacucuuaaauugggacccaagacuuucucucuuugcucccagagccugugacuggggcuugcaguuuagggcugcuugucccucagucgucgugccuauuugccacccauccgcucuguuccagguucugaaccaauuucccugggacugcugggcuccagacgccgucccugaucgcaccgucugcggaaaguuucucuugccucaggcucugugcgcggucccuggggagccugagugucccgagacuggccuaagccugugugcagugcgagagaguaagacuggaguccgcagccgagcaggaagagcgagccgggggauugagacuguccgauccaaccuagggcacgagccugguauaaaucgcggacuaacagagacuaucugaugaagagacuaacggagagagagggagaggaggaaagggagugagaaaaugacgaauggagggagagggagggagagacauauaccugagccaggaucucggggcucaccuggcgggagguggcuuggaucagaggcgguggcagcggcggcggcggcguccagccagagcccuguggaagcggcggcgacacuugggcugggcagugucucugaugccucccagcgccagcgacugcucuuauucccgccgcugugggucgggaaaguuccgccagugcacagcaaccaaugggcggagggguccuuugccccuggguugcgucacccucaugcuuccagaaccuggaggauccagcaggaccgucccacuuguauuugcauugaggucauugauggaaauggugggggauggugggggcaccaacaaguaacgcccuuaaagugagcgggaauuugagggcaguuugacgucauggugaauuucaccucucaguccggccugguuuugaacccucgccccacuccaccccugguuucacgauuuggcggaaaggguccaggauuguagggacucuuccaacucugaucccagaccccugcccaagugagauuuuaaagguuaaugccccuaaggguggguucugggcccaagaaaucugacuccaguagcugguauuaccca

SEQ ID NO: 19650 - RNA, 3101 nt, Homo sapiens
uggguaauaccagcuacuggagucagauuucuugggcccagaacccacccuuaggggcauuaaccuuuaaaaucucacuugggcaggggucugggaucagaguuggaagagucccuacaauccuggacccuuuccgccaaaucgugaaaccagggguggaguggggcgaggguucaaaaccaggccggacugagaggugaaauucaccaugacgucaaacugcccucaaauucccgcucacuuuaagggcguuacuuguuggugcccccaccaucccccaccauuuccaucaaugaccucaaugcaaauacaagugggacgguccugcuggauccuccagguucuggaagcaugagggugacgcaacccaggggcaaaggaccccuccgcccauugguugcugugcacuggcggaacuuucccgacccacagcggcgggaauaagagcagucgcuggcgcugggaggcaucagagacacugcccagcccaagugucgccgccgcuuccacagggcucuggcuggacgccgccgccgccgcugccaccgccucugauccaagccaccucccgccaggugagccccgagauccuggcucagguauaugucucucccucccucucccuccauucgucauuuucucacucccuuuccuccucucccucucucuccguuagucucuucaucagauagucucuguuaguccgcgauuuauaccaggcucgugcccuagguuggaucggacagucucaaucccccggcucgcucuuccugcucggcugcggacuccagucuuacucucucgcacugcacacaggcuuaggccagucucgggacacucaggcuccccagggaccgcgcacagagccugaggcaagagaaacuuuccgcagacggugcgaucagggacggcgucuggagcccagcagucccagggaaauugguucagaaccuggaacagagcggauggguggcaaauaggcacgacgacugagggacaagcagcccuaaacugcaagccccagucacaggcucugggagcaaagagagaaagucuugggucccaauuuaagaguaaaacuugguuccugcaggggacugaggugccagcaggcggagcuuaggcugagcacuaaaauugauucuuuuauuucucagauuccaauugcagagauaaucucuguggauagaucccaccccucccaccaagguguaugcaaaagccccagaagaggaggacagcucuggguuuccuuaugggaucagcuucugugacaggggccugggagcauguccuccacagagaccuggcuaacagguuuauauguaucuguguggcuuuggggagaaggguaggacugagaccucccccacucagcucucccucuaggaucgcuccuccagcucuaucagacugugcaugcuacaggcccacugaaccucccagaaguccacugugcugaugaggaaacaaaaaagaagagaaauauaaugaccagucugaagccacaaagccagagcguuagaagcaagacagaaaaccaggauaggagccaaggucugugggcuccuagaacuucgaacuggcgcaggugguuuaucucauucuucccuugcagagaggugucaugggcuuccaaaaguucucccccuuccuggcucucagcaucuugguccuguugcaggcaggcagccuccaugcagcaccauucagguaagacagccugaagccagaaccacacugguaucagacaauuccaugccucuuaagugugguguacugaaugcuuaaaaaccgacagggggccgggguaagguauguacucaugcacauauauaauuuuuugauauaaaaaugugugguacacaauuuauaaguagugauaaauauuuagacaauauucuucauuauaauuuuuuugagacagagucucacucugucauccaugcuggagugcaauggcaccgugucggcucacugcaacuuccaucuccuggguucaagcaauucuccugccucagccucccaaguagccgggauuacaggcgcccaccaccaugcccggcuaauuuuuguauuuuuaguagagauaggguuucaccauguuggccaggcuggucucaaacuccugaccucaggugauccaccugccucagccucccaaagugcugagauuacagccgugagccaccgcgcccggccuauuauaaauuuuauauagcccacugagucucacaaaaugcuuuuguugcuuuuagccaaacuuuuguauguguagccauccuauuuauccuauucagccaugauuugaaaaaugaauugcauccuauucuguuaaauaguuugccacuaaauuuguuauuguuaaaucugguauuuuaccuguugaucuauuucucacccacauauaaaucuauuaaacugaaacuauuuucagguucagcacuaacuguaaguuuuugcauuuaauuuuuaauaauggcugcacucagcuugcaaaauucuugaaaauuuaaccauuagcuuucacaagccuauacaaacuggcuccagcacaccacuguuuagaggccacaccagugccuggguccugaggaggacacuggccuugugcccuguccccuaggacucccgcuggccacauccucaggggaagaagcaaagaccaggaagccuggcugcuuauccuggggaggggcaggcaggggcucacagccugcacugaguuugcuuccccuccacaggucugcccuggagagcagcccagcagacccggccacgcucagugaggacgaagcgcgccuccugcuggcugcacuggugcagaacuaugugcagaugaaggccagugagcuggagcaggagcaagagagagagggcuccaggugaggcuccccaagcgcucagcacagggccuccucuccccgcagcauacacaggaagguggaucccgagagguaggagagaacacacuggccaggaauccaacaggcuguguuguucaccgggaccuggggcccagcuguucucagccuccaagggagacagaggucccacugcagcuggagguaccgugguuagacauaacaaaaggcuccguu

SEQ ID NO: 19651 - RNA, 2320 nt, Homo sapiens
caguggaagagcguauggcgucgcagcaggcagucccuaaggaacugcaccaacuccuccaaacaccuucccaggugcuccucgucccagccuugcccaggggcccccuugcgcagcagcacugccagcagcacugucuugagcacauaugaggauaggaugcguccccacuggguggcggccgcugaguccagcccacgggcccccagaucgcgcagagccuuaagcaacugcaggcacuugagguagcaggcaccuggagcugcccguuccugcagccaacucagcagcuucugcuccuggcgugcuguguucacaccccacagugccuccgcacgcaggcccucagggagcuccaacaggggcgcgcugggcaaggguggcggugguggcgccacaaggaagaccccaucucccagauggacagcggggaugagacgcacagccauagaaaggcggcagcagccguagucagugcggcagggcaagauguguaagguggggggcuguuccaggccaccuggggucaaggugacccgacagcgccccuccaggcuguaacgcacaguggccaaggagcgcugcagaugcgacuggaaccagcgcagcaccagaguagcagagaggugacgccgcccgcgcacauccacgcagaaggcaucagcaaaggguuugcagucccgaagccaguggccccccgaggcccccgauggugaggguggugccuugagggcgcacaagaagcagccgcggaaggccggggccagcgcuggcuccucgcccaggcuccguggcuccagcgccacaagcggcgggaggcgcaguggcaccagcacgucgaagcugucgggccggcggauuuuauguugcucguaggcgcugcccaccuggaugaagucuccgcggaaggccaaggccagcgcucccccaggaaugagaccgggggacccccgggcgcggccagcccgcaccagcucgcccacgauccggcucacgugcgccuugcuguggcccaacacgugcggagacaggcgcaccucaugcucguaguaacucuccagcaggaugcugaggcccggcucucggaagugucucgaggagaaggcggcgugacccuccagacggggagacccgggcaggaagcgcugccggacagcguggcgacagcgcaggaggacauagcugaggaggagcaggacggccaccuuaagcaacgggaagccgccauccacgccgucggcgggcucggcccgggcgcccccgcuuccccgcaggacaugguagaggcacaccagggcggugcacaggccggucaccaggggccagaagacgcguagauugaggguguagugcaccgacaugccgggcgcccggggcggcgguggccgagcagcccagggggcaagccccggcggcgacccaagcccagcaugcgcacagcgcccgggcagccccgcuguccccgucuccuccuccgcggcggcuucccgaacgcaggcccgagggaggccgcccuccagcucggccuccucucccagcucaaguguuccuuccagcugcggcccgcccugcgcucucgggccccgggccgcgcccugccccggcugcgcgcugaguccggcccagcggcccuccccgcccggcgcccccgcgcgccgccgucggccagcuucuggcccggccuggcucgccuccuacccugggcggcccuccuggcucucccgccgcuccucuccgcgccugacccuguuacucggaccccgggaguuuccucuuccgagggggaggcgaggccgcgccagcuagcggggaggaaaugccggagucuggagccgagcguggagcuggcgagccgggucggcccccucccgggccuccgccuuaaagcgacgcggggcggcgggagggacuucaggacgcucuuggaacuggccucccgcggcccacccccauccucccuccccgaaggcagaauugggaaggcccugauuccggggcgguagcuucguccagggagccucuggaguugcgcucccuugaaguuauacugggacguugaaaaggagaaaagggcgcacagccagacuguccaguccuccccacccccaccgcacaagcugcgguggcguggcaggcccuggcacaggaguggcccuugccgucugccgcagucgucuguucaaaccaguauucaccgagcaccuaccaugugccaggucggagccacagugcuggggaaaucauaguugacaagauggacaagguuucuguccuucgugaagcuuacagccuuguaaaaaugggaaucaaaaaaggaagg

SEQ ID NO: 19652 - RNA, 2320 nt, Homo sapiens
ccuuccuuuuuugauucccauuuuuacaaggcuguaagcuucacgaaggacagaaaccuuguccaucuugucaacuaugauuuccccagcacuguggcuccgaccuggcacaugguaggugcucggugaauacugguuugaacagacgacugcggcagacggcaagggccacuccugugccagggccugccacgccaccgcagcuugugcgguggggguggggaggacuggacagucuggcugugcgcccuuuucuccuuuucaacgucccaguauaacuucaagggagcgcaacuccagaggcucccuggacgaagcuaccgccccggaaucagggccuucccaauucugccuucggggagggaggaugggggugggccgcgggaggccaguuccaagagcguccugaagucccucccgccgccccgcgucgcuuuaaggcggaggcccgggagggggccgacccggcucgccagcuccacgcucggcuccagacuccggcauuuccuccccgcuagcuggcgcggccucgccucccccucggaagaggaaacucccgggguccgaguaacagggucaggcgcggagaggagcggcgggagagccaggagggccgcccaggguaggaggcgagccaggccgggccagaagcuggccgacggcggcgcgcgggggcgccgggcggggagggccgcugggccggacucagcgcgcagccggggcagggcgcggcccggggcccgagagcgcagggcgggccgcagcuggaaggaacacuugagcugggagaggaggccgagcuggagggcggccucccucgggccugcguucgggaagccgccgcggaggaggagacggggacagcggggcugcccgggcgcugugcgcaugcugggcuugggucgccgccggggcuugcccccugggcugcucggccaccgccgccccgggcgcccggcaugucggugcacuacacccucaaucuacgcgucuucuggccccuggugaccggccugugcaccgcccuggugugccucuaccauguccugcggggaagcgggggcgcccgggccgagcccgccgacggcguggauggcggcuucccguugcuuaagguggccguccugcuccuccucagcuauguccuccugcgcugucgccacgcuguccggcagcgcuuccugcccgggucuccccgucuggagggucacgccgccuucuccucgagacacuuccgagagccgggccucagcauccugcuggagaguuacuacgagcaugaggugcgccugucuccgcacguguugggccacagcaaggcgcacgugagccggaucgugggcgagcuggugcgggcuggccgcgcccgggggucccccggucucauuccugggggagcgcuggccuuggccuuccgcggagacuucauccaggugggcagcgccuacgagcaacauaaaauccgccggcccgacagcuucgacgugcuggugccacugcgccucccgccgcuuguggcgcuggagccacggagccugggcgaggagccagcgcuggccccggccuuccgcggcugcuucuugugcgcccucaaggcaccacccucaccaucgggggccucggggggccacuggcuucgggacugcaaacccuuugcugaugccuucugcguggaugugcgcgggcggcgucaccucucugcuacucuggugcugcgcugguuccagucgcaucugcagcgcuccuuggccacugugcguuacagccuggaggggcgcugucgggucaccuugaccccagguggccuggaacagccccccaccuuacacaucuugcccugccgcacugacuacggcugcugccgccuuucuauggcugugcgucucauccccgcuguccaucugggagauggggucuuccuuguggcgccaccaccgccacccuugcccagcgcgccccuguuggagcucccugagggccugcgugcggaggcacuguggggugugaacacagcacgccaggagcagaagcugcugaguuggcugcaggaacgggcagcuccaggugccugcuaccucaagugccugcaguugcuuaaggcucugcgcgaucugggggcccgugggcuggacucagcggccgccacccaguggggacgcauccuauccucauaugugcucaagacagugcugcuggcagugcugcugcgcaagggggccccugggcaaggcugggacgaggagcaccugggaagguguuuggaggaguuggugcaguuccuuagggacugccugcugcgacgccauacgcucuuccacug

SEQ ID NO: 19653 - RNA, 2689 nt, Homo sapiens
ggcuggucccuaccauuccccuauccccacccccaaaucugccuacagcuccagccacaauggccuuuguucaguuccucuaagcucauucccaccuccaagcuuuugcaggcacagugccuuccuccugguucagucuuccuccaagaccucccagcggagggccccucuucuagcugggcuccacucaaaugucacucccggaacagucaucucagguacauacaccccugucaccuucuuuuacaucaccccaucuuauuuuccuggccguccucaccccaaucggauuucauagccauuugcuauggguuuguuuaauguuuguccacucacuuccccagccccgggagagcagggguuuuguccguuuuauacaaggcacccaguucugucccuggcacguuucuugaaauaacauauuaauccaguaaagauucugaguuuaucuuucuaacaaaacugccugucuugcugccugugcccccaaauggcggcuccuuccuccuggaaucuccuucccuucccaacucagcugaccccuuuccaggcuuagagcagggagcagauagcaaacuguucacuccacagucuuagauaccaaacuggccgggagggcuuccaaacgacagaugccaauuugcauucuauuuacaugucauuugcaugcaguuuaacucaaagccuggauccuccgcaagcccgaguccccaccgaagaaacuucugaauuaagaagguuccuuggcugaagugccgggguuuuugugccagaucccucccccacuucucuugucuuugcggggucccccagggcuuucugggcucuguucaggugccccccggccuggugcaguugggcggccaauguggcgcgugggcuggggccccaggcggggacgccgcugcccgccacacuccaggggccuuuguccgcgcuccaaggagccgcccccuuagcgaacgggggacggaaagggaggacuggcuaggccugggugugacagagcaaggacggaggagugaacccgcugcacgggggagauuucuggggcaaggucguuggccccuucccaggcuguucaaccggcugcccggggccaaggcgggugcgggcuccucccgcgcgcucccuuuucggccuaagcgcuagggaccccgggaugugugggguccuuguggggcuggaagccugugucccccaaggagaggggaccgagaacaggucuaguccuuaucuccagccuagccgccucuuccagagguccaagugcccccugucuggaagggaaacgccacugccccccccgccauuguaugcagccgcccccuccuccccaccccuccccgucauucguccccagcccaggucucagcucugccaucucccaccgccgugucccccccuccccuugcugaguaaugcgcacucaagccggcugcgggcuugacccccagcccccgcgacaggugcggcuguucacccccaaaguccagcccuugugcccccggcugcgucugcccuguccacagucagcccccaacgcggccccaggaccagcccgcagcuccucacacaugacgagucacuaggacacggcugggcuccuuuacccucccagcugcccuucaccuguggucgcccccacacccuccugggagacuuggaucucuaccugguccgggcacagucucccuccccccguaaagguccccagauccuccccucccccgcccaccccucuacggcucugcucucgucgcaccgugguuccccucgcccagauuccacaucucccccagcaauaaacucccuggcuuggguugggggggcgcuuagaaaaacacaagaagcggaccccccaauucucccaaauccacggcgggaaaaguuucugggguccccacagcguccuccacugcaucggcgcagcucgcacuuaccgacccccgcggccccgcagcgccgacgcuccagcuggccuucggcccgagucacaucucugcggcgcggccgcggcccccgcuccacgcacgcccgccugcggguccagcuucacugcagcgccugccagagucgcugccgcgcgaggcgcccccuggcccggcccgcgcugcugcagcggccgcggccccgcccccgcccccgcccccggccggccccgcccccgggccuccgagccccacccccggucccgccggcgguuccgcgcggggcuaggcgccgucugcaugcacccccggagcccaagcucguagcuucuagcccggaucucagagacgauucccccgaccucgugcccccaauucggggacauuccccccacaacgucagugcgcccguaagcaguccagacgagccgggcaacuccccaggguagauccauuugcgggaacacuccccuagccaauacacuuaccgagggagguaucgcgacccaggggucccagcgcggaagccuuccugcccccaggccacgcuccaagggggguucauaagcaguaacuuccccgaaacacaccagcaccagguccaggacgcagagaggaucgaucccgcccggugccucucgaagucaccaacgccccgguauacaccuaggcgcacacacaccgcuaggccuccuccaggcagguuccuccuggacacacucuucucucuccucacugcccaacucccagaugucguu

SEQ ID NO: 19654 - RNA, 2689 nt, Homo sapiens
aacgacaucugggaguugggcagugaggagagagaagaguguguccaggaggaaccugccuggaggaggccuagcggugugugugcgccuagguguauaccggggcguuggugacuucgagaggcaccgggcgggaucgauccucucugcguccuggaccuggugcugguguguuucggggaaguuacugcuuaugaaccccccuuggagcguggccugggggcaggaaggcuuccgcgcugggaccccugggucgcgauaccucccucgguaaguguauuggcuaggggaguguucccgcaaauggaucuacccuggggaguugcccggcucgucuggacugcuuacgggcgcacugacguuguggggggaauguccccgaauugggggcacgaggucgggggaaucgucucugagauccgggcuagaagcuacgagcuugggcuccgggggugcaugcagacggcgccuagccccgcgcggaaccgccggcgggaccggggguggggcucggaggcccgggggcggggccggccgggggcgggggcgggggcggggccgcggccgcugcagcagcgcgggccgggccagggggcgccucgcgcggcagcgacucuggcaggcgcugcagugaagcuggacccgcaggcgggcgugcguggagcgggggccgcggccgcgccgcagagaugugacucgggccgaaggccagcuggagcgucggcgcugcggggccgcgggggucgguaagugcgagcugcgccgaugcaguggaggacgcuguggggaccccagaaacuuuucccgccguggauuugggagaauugggggguccgcuucuuguguuuuucuaagcgcccccccaacccaagccagggaguuuauugcugggggagauguggaaucugggcgaggggaaccacggugcgacgagagcagagccguagaggggugggcgggggaggggaggaucuggggaccuuuacggggggagggagacugugcccggaccagguagagauccaagucucccaggagggugugggggcgaccacaggugaagggcagcugggaggguaaaggagcccagccguguccuagugacucgucaugugugaggagcugcgggcugguccuggggccgcguugggggcugacuguggacagggcagacgcagccgggggcacaagggcuggacuuugggggugaacagccgcaccugucgcgggggcugggggucaagcccgcagccggcuugagugcgcauuacucagcaaggggagggggggacacggcggugggagauggcagagcugagaccugggcuggggacgaaugacggggagggguggggaggagggggcggcugcauacaauggcggggggggcaguggcguuucccuuccagacagggggcacuuggaccucuggaagaggcggcuaggcuggagauaaggacuagaccuguucucgguccccucuccuugggggacacaggcuuccagccccacaaggaccccacacaucccggggucccuagcgcuuaggccgaaaagggagcgcgcgggaggagcccgcacccgccuuggccccgggcagccgguugaacagccugggaaggggccaacgaccuugccccagaaaucucccccgugcagcggguucacuccuccguccuugcucugucacacccaggccuagccaguccucccuuuccgucccccguucgcuaagggggcggcuccuuggagcgcggacaaaggccccuggaguguggcgggcagcggcguccccgccuggggccccagcccacgcgccacauuggccgcccaacugcaccaggccggggggcaccugaacagagcccagaaagcccugggggaccccgcaaagacaagagaagugggggagggaucuggcacaaaaaccccggcacuucagccaaggaaccuucuuaauucagaaguuucuucgguggggacucgggcuugcggaggauccaggcuuugaguuaaacugcaugcaaaugacauguaaauagaaugcaaauuggcaucugucguuuggaagcccucccggccaguuugguaucuaagacuguggagugaacaguuugcuaucugcucccugcucuaagccuggaaaggggucagcugaguugggaagggaaggagauuccaggaggaaggagccgccauuugggggcacaggcagcaagacaggcaguuuuguuagaaagauaaacucagaaucuuuacuggauuaauauguuauuucaagaaacgugccagggacagaacugggugccuuguauaaaacggacaaaaccccugcucucccggggcuggggaagugaguggacaaacauuaaacaaacccauagcaaauggcuaugaaauccgauuggggugaggacggccaggaaaauaagauggggugauguaaaagaaggugacagggguguauguaccugagaugacuguuccgggagugacauuugaguggagcccagcuagaagaggggcccuccgcugggaggucuuggaggaagacugaaccaggaggaaggcacugugccugcaaaagcuuggaggugggaaugagcuuagaggaacugaacaaaggccauuguggcuggagcuguaggcagauuuggggguggggauaggggaaugguagggaccagcc

SEQ ID NO: 19655 - RNA, 2898 nt, Homo sapiens
gggugauaagccccuucgugucuucgggaugguaaguuuggggcacaggugagugaagaccgaaggccagggguggacugacacuccguggcaggcgcagggccgggcaggggggcggcuuggggguggcaagguuugggugagaaauggcagcccauggggaacuaccgcagggcucugagaccuucagagccaagccccgacgccccuucccaccugcggggcagaacuggggauggcaggggggagggugguucccaaaggagauaccaucccugguaaggggacaugggccccugggaguuggguugggccacaaggagagaggccugaacggccaaagggagggggcgugggggaagccgcagcaucagaccucugccuccucccucagaucgugaggcuccccagccuggcucgggagaccccgagauccccggccggugacagcaggcgacccccugcuccugucaaccugugggucccuacggacguggggaagggaggagggaggccccagcucccugcgggggaggggcgugaagacgcgcggggguggggggagaugagccggcgucgccaugacaacgaggccggugguccggccuuggggacccgggagggagggaggcgccguggccgcgcgcgcgggcgggggcggggggccaggucucccaggaguaguuggggaacacccggcgauucuggcggcugcuuccugguggcgcagggagcccgcguguuugcgagugcgugugugugcgaaguucuccggguaagugugccagcgcgcgccugggugugugcaagggugugagcgugcacacgugggcacgggcgugugcgcgcgggggugcccgguuggaugugugcacacgagugugugccgguccgcgugccccugcgugagugugcgcgcgcgagcacacgugugugugcgcgcucgcgugcgcucccgagcgggccccgggugggaguccgagaucccgcccccuccccagccccagcgccccuccccgucccccgccgccgcgccggcugcauccucgccuccaccucgcucacccccuccuccccgcacuuucucggcgcucccucccucucggcucgcacagcucgacuccgcgcucuccucgccggccgccgccgcccagccugcgcccgccguccccccagugccugggcaccuguuggaggcagaggcaggugcagggggcugggcaggccgggggcgugagggugcggggaagcgugccagccugugugcgcuacggggguguucggcucuccugcggcugcaauuucuggcuccccugaggagccagagguggcaucugaggcuggggucuccaccgugggcuguggugagcgagcgggggaaccaggcaggcagacagguccuggggcugaaugaggggacagugggcaguuggagccuagaggggugggugacacccugacuagaccagcgccuggugcagaggaggacagagccuccgagaaacagaggcggggcccugcagggccccuugggggacaggcaggcucaggagcagaggggagccccggaggagaggaaggagcuggcaagaugauacagggacaaccuagaagugggugggugaggacgggguggugcaaccucgacuucugcaaggaguggguuggcagcccagccccuguggagucagcuuggggucugcagggcccaggccucccaccugccaccggcuggcacacaccacccucucccucgacaccuaggaagggaggccagugagggccccacagaccgaggaggccgucgccuggcccucagccaggauggcuagguaugaugggcucacuggcucacacgcccucuccuagccaggggugcugcaugaggggccgcaggggcgaucgcaugaccaucaacauccaggagcacauggccaucaacgugugccccgggcccauccggcccauccgccagaucucugacuacuucccccggggaccaggaccugaagggggcggcgggggcggcggggaggcccccgcccaucuggucccccuggcucuggcccccccugcagcccuccuuggggccaccacgccugaggauggugcggagguggacagcuaugacucggaugaugccagugagucugggggcuuggaggccccaugugcuggugggggucuccaggcuugccgugguggggggagagggggaugggcccugcuggcugugcauguagguaggggaggagggcaguggggggguggcagggacggccaccacagcugcagucagcguggagauuacagcuucagcaaggcucaauauucaguauuucugcugagacacuccaccacccacacagccccaguugcggccgagccagggacccagacgcacacacgcaugggcccacucagccucuugcacucacacucgcgggcuggcaagagagagagacacacagagccagugcccaccugcuggccucucgcacacaccugucuccauaccgacccaugcugccuuuccucucucuccagccgcccuaggcacgcuggaguuugaccuucucuacgaccgggccuccugcacucugcacuguagcauccucagggccaaggugggcacucccugccacccaagcccgggcccgguuugcgugcagcccccagagggggcccauuccuccuucccuucccaggccugcuccuucguccugcccuugcccccuccuucugggcuccuccaggguccagcucuacaagagggauggagagaggugccgggagccucuagcccucuccccugcccuccucuccagggccucaagcccauggauuucaauggccucgccgaccccuacgucaagcugcacuugcugccuggagccu

SEQ ID NO: 19656 - RNA, 2898 nt, Homo sapiens
aggcuccaggcagcaagugcagcuugacguaggggucggcgaggccauugaaauccaugggcuugaggcccuggagaggagggcaggggagagggcuagaggcucccggcaccucucuccaucccucuuguagagcuggacccuggaggagcccagaaggagggggcaagggcaggacgaaggagcaggccugggaagggaaggaggaaugggcccccucugggggcugcacgcaaaccgggcccgggcuuggguggcagggagugcccaccuuggcccugaggaugcuacagugcagagugcaggaggcccggucguagagaaggucaaacuccagcgugccuagggcggcuggagagagaggaaaggcagcaugggucgguauggagacaggugugugcgagaggccagcaggugggcacuggcucugugugucucucucucuugccagcccgcgagugugagugcaagaggcugagugggcccaugcgugugugcgucugggucccuggcucggccgcaacuggggcugugugggugguggagugucucagcagaaauacugaauauugagccuugcugaagcuguaaucuccacgcugacugcagcugugguggccgucccugccacccccccacugcccuccuccccuaccuacaugcacagccagcagggcccaucccccucuccccccaccacggcaagccuggagacccccaccagcacauggggccuccaagcccccagacucacuggcaucauccgagucauagcuguccaccuccgcaccauccucaggcgugguggccccaaggagggcugcagggggggccagagccagggggaccagaugggcgggggccuccccgccgcccccgccgcccccuucagguccugguccccgggggaaguagucagagaucuggcggaugggccggaugggcccggggcacacguugauggccaugugcuccuggauguugauggucaugcgaucgccccugcggccccucaugcagcaccccuggcuaggagagggcgugugagccagugagcccaucauaccuagccauccuggcugagggccaggcgacggccuccucggucuguggggcccucacuggccucccuuccuaggugucgagggagaggguggugugugccagccgguggcaggugggaggccugggcccugcagaccccaagcugacuccacaggggcugggcugccaacccacuccuugcagaagucgagguugcaccaccccguccucacccacccacuucuagguugucccuguaucaucuugccagcuccuuccucuccuccggggcuccccucugcuccugagccugccugucccccaaggggcccugcagggccccgccucuguuucucggaggcucuguccuccucugcaccaggcgcuggucuagucagggugucacccaccccucuaggcuccaacugcccacuguccccucauucagccccaggaccugucugccugccugguucccccgcucgcucaccacagcccacgguggagaccccagccucagaugccaccucuggcuccucaggggagccagaaauugcagccgcaggagagccgaacacccccguagcgcacacaggcuggcacgcuuccccgcacccucacgcccccggccugcccagcccccugcaccugccucugccuccaacaggugcccaggcacuggggggacggcgggcgcaggcugggcggcggcggccggcgaggagagcgcggagucgagcugugcgagccgagagggagggagcgccgagaaagugcggggaggagggggugagcgagguggaggcgaggaugcagccggcgcggcggcgggggacggggaggggcgcuggggcuggggagggggcgggaucucggacucccacccggggcccgcucgggagcgcacgcgagcgcgcacacacacgugugcucgcgcgcgcacacucacgcaggggcacgcggaccggcacacacucgugugcacacauccaaccgggcacccccgcgcgcacacgcccgugcccacgugugcacgcucacacccuugcacacacccaggcgcgcgcuggcacacuuacccggagaacuucgcacacacacgcacucgcaaacacgcgggcucccugcgccaccaggaagcagccgccagaaucgccggguguuccccaacuacuccugggagaccuggccccccgcccccgcccgcgcgcgcggccacggcgccucccucccucccggguccccaaggccggaccaccggccucguugucauggcgacgccggcucaucuccccccacccccgcgcgucuucacgccccucccccgcagggagcuggggccucccuccucccuuccccacguccguagggacccacagguugacaggagcagggggucgccugcugucaccggccggggaucucggggucucccgagccaggcuggggagccucacgaucugagggaggaggcagaggucugaugcugcggcuucccccacgcccccucccuuuggccguucaggccucucuccuuguggcccaacccaacucccaggggcccauguccccuuaccagggaugguaucuccuuugggaaccacccuccccccugccauccccaguucugccccgcaggugggaaggggcgucggggcuuggcucugaaggucucagagcccugcgguaguuccccaugggcugccauuucucacccaaaccuugccacccccaagccgccccccugcccggcccugcgccugccacggagugucaguccaccccuggccuucggucuucacucaccugugccccaaacuuaccaucccgaagacacgaaggggcuuaucaccc

SEQ ID NO: 19657 - RNA, 2845 nt, Homo sapiens
aucucaguuuggugcuacuguaacuuugacaccccaccaacccuuuuaaaaaagaagguguagggcuaggcacgguggcucaugccuguaaucccagcacuuugggaggccgaggcggauugaucacgaggucaggagauggagaccauccuggcuaacauggugaaacccugucuucacuaaaaauacaaaauaaaaaaaaauuagccagguguaguggcaggugccuguagucccagauacucgggaggcugaggcaggagaaugguaugaacccgggagguggagcuugcagugagccaagaucgugccacugcacucucgccugggcgacagagcgagacuccucaaaaaagaaaaaaguguaggcuucaggaucagagagacuagagcacuuaacuagaauguucuagacuguugaaagcuuucuuuuuuaaauuucagcuuguguuuaugaguacuuucuugucacccaggcuggagugcaguagcacaaucucagcucacugcagccucaaacugcugagcuccagugaaccucccaccucacccucuccaguagcugggaccauaggcaugggccaccgcgcccggcuaauuguuuuauuauuuguagagacaaggucucacuguguuguccaggcuuuuuaugaguacuauuuagggcaaguaauacugauagugcuauaaauauuucuuuuaaauacguagaacaaaaggucggggggagagccaaggugaagaaacgcaguacagaugggaaugaccacggcaaagcuuaugaagguggugugcagauaaccgaggcugaggaaaugcugcuguggguggcaacagggagccauggaagaagagaggcacaaugagaaccagacagcagacggcucuggcggagagaagggucugggggggaaaucaucgaggcaaggagguugucaguaggcggcagcuacuuacccagauggcaucugacccgggcauuggugggcccacagcggcccucgagccgggccccaggcaggagaacggaaaagccggcauugccgaagguguuggcacucauaaagcuucgaagcccccucagugcccgauaggcccccgggcaccggcggcaguugcuggguuggcaccggccugcuugguacagcaggagcugguagcacccgggggccagagguggggaccagccccgaggcggagggguagucccugagaagucccagcucacagccccgaagucccgcaaaauggcagggaagcugcucuccaggagcuccacgucgugccgcugggcgucccgcggcacaaagggggcugaaggcaggucugguaggaaaagcaggccugggcgcugaauaccuaggaccccuggcccucucccagggccugggccacccugagcugcccgccucacucuacccaucccagcccaggaguagcgccuugcguaggcccgaagccgccggcucacuaggccuuccguccuagguccuuccccgggauccccaggacccccugggcuuggcccgccggccuccgagcaucccacaggcccaccacgaacacccccagcucggcucccagccccuagggccugcaugucuugggagcccaggcgguagcaguaccagaggaacagggaagugagggccccgaagagcaaggugagggccgaggaggccagggguaguggccacgggagcaugaucagggaggcccuggccaagaggccuggggcguccuccggaccccaguuccccuguccccccagcuccccaccugucccuuccauggcugcccccuggcuccccgcuggacuguuucccuuccacauuccacucugggcugucucucucuccuuccgcgguccucucuccacgcugaagcucccucuccccuccuucaugcaccuccaacccuccucucuccuuucucuccccuuucucucuccuucuaccucuucuuccuccucucccucugucgccuccucacccucuucuuucuccuuccagcagccuccucucucucgcucugcuucucucucccaccucaaucucccccuuuccuccccacccccgcuuuucgcucgcucucucuccccgcuuccuccuagcuccccugggcagcgguuccuacccugccuggaccugcagucccgggaacccgcagccugucuuccuccgcggcagcuucuuucucuccggccucacugcucucuccuugcccucgcuccucacuagccccgacccugcgguccugccuggcucucgcucccucucuccuacucgcuccuuccugggcucccacucacccugacgucacuccuucccggagcccucucagcucagccacccccgaacccucccaguggcacagcaaaucagccgggugccgggggaggggggagaguugucgcuggaggugccuccccaccccccccgcccggaaagggcgccacguggggcgcaggggccacggugccagccuccagccgucccgcaaugcgaaagaaggggcgggucguaucgggcggggccugaggggcggggccugaggggcggggcgagcgcggacugacggcugggcaggcgcccgggacugcgggcaaggaugcugaggccaguccgucgggcggcugguccgucggucggucggccugugacucccgcuggcccuaggcagcccgggagcccgcgagccuggcaaacaccgaaagcggccucagccaaucgcgggcggcgucgggccgggcccgccccggcggggcgaggggagcuguccgcgcgccgcuggugcugaaaagggcgcuccggagggaaaaucagagccgaggccgccuguuagc

SEQ ID NO: 19658 - RNA, 2845 nt, Homo sapiens
gcuaacaggcggccucggcucugauuuucccuccggagcgcccuuuucagcaccagcggcgcgcggacagcuccccucgccccgccggggcgggcccggcccgacgccgcccgcgauuggcugaggccgcuuucgguguuugccaggcucgcgggcucccgggcugccuagggccagcgggagucacaggccgaccgaccgacggaccagccgcccgacggacuggccucagcauccuugcccgcagucccgggcgccugcccagccgucaguccgcgcucgccccgccccucaggccccgccccucaggccccgcccgauacgacccgccccuucuuucgcauugcgggacggcuggaggcuggcaccguggccccugcgccccacguggcgcccuuuccgggcgggggggguggggaggcaccuccagcgacaacucuccccccucccccggcacccggcugauuugcugugccacugggaggguucggggguggcugagcugagagggcuccgggaaggagugacgucagggugagugggagcccaggaaggagcgaguaggagagagggagcgagagccaggcaggaccgcagggucggggcuagugaggagcgagggcaaggagagagcagugaggccggagagaaagaagcugccgcggaggaagacaggcugcggguucccgggacugcagguccaggcaggguaggaaccgcugcccaggggagcuaggaggaagcggggagagagagcgagcgaaaagcggggguggggaggaaagggggagauugaggugggagagagaagcagagcgagagagaggaggcugcuggaaggagaaagaagagggugaggaggcgacagagggagaggaggaagaagagguagaaggagagagaaaggggagagaaaggagagaggaggguuggaggugcaugaaggaggggagagggagcuucagcguggagagaggaccgcggaaggagagagagacagcccagaguggaauguggaagggaaacaguccagcggggagccagggggcagccauggaagggacagguggggagcuggggggacaggggaacugggguccggaggacgccccaggccucuuggccagggccucccugaucaugcucccguggccacuaccccuggccuccucggcccucaccuugcucuucggggcccucacuucccuguuccucugguacugcuaccgccugggcucccaagacaugcaggcccuaggggcugggagccgagcuggggguguucguggugggccugugggaugcucggaggccggcgggccaagcccaggggguccuggggaucccggggaaggaccuaggacggaaggccuagugagccggcggcuucgggccuacgcaaggcgcuacuccugggcugggauggguagagugaggcgggcagcucaggguggcccaggcccugggagagggccagggguccuagguauucagcgcccaggccugcuuuuccuaccagaccugccuucagcccccuuugugccgcgggacgcccagcggcacgacguggagcuccuggagagcagcuucccugccauuuugcgggacuucggggcugugagcugggacuucucagggacuaccccuccgccucggggcugguccccaccucuggcccccgggugcuaccagcuccugcuguaccaagcaggccggugccaacccagcaacugccgccggugcccgggggccuaucgggcacugagggggcuucgaagcuuuaugagugccaacaccuucggcaaugccggcuuuuccguucuccugccuggggcccggcucgagggccgcugugggcccaccaaugcccgggucagaugccaucuggguaaguagcugccgccuacugacaaccuccuugccucgaugauuucccccccagacccuucucuccgccagagccgucugcugucugguucucauugugccucucuucuuccauggcucccuguugccacccacagcagcauuuccucagccucgguuaucugcacaccaccuucauaagcuuugccguggucauucccaucuguacugcguuucuucaccuuggcucuccccccgaccuuuuguucuacguauuuaaaagaaauauuuauagcacuaucaguauuacuugcccuaaauaguacucauaaaaagccuggacaacacagugagaccuugucucuacaaauaauaaaacaauuagccgggcgcgguggcccaugccuauggucccagcuacuggagagggugaggugggagguucacuggagcucagcaguuugaggcugcagugagcugagauugugcuacugcacuccagccugggugacaagaaaguacucauaaacacaagcugaaauuuaaaaaagaaagcuuucaacagucuagaacauucuaguuaagugcucuagucucucugauccugaagccuacacuuuuuucuuuuuugaggagucucgcucugucgcccaggcgagagugcaguggcacgaucuuggcucacugcaagcuccaccucccggguucauaccauucuccugccucagccucccgaguaucugggacuacaggcaccugccacuacaccuggcuaauuuuuuuuuauuuuguauuuuuagugaagacaggguuucaccauguuagccaggauggucuccaucuccugaccucgugaucaauccgccucggccucccaaagugcugggauuacaggcaugagccaccgugccuagcccuacaccuucuuuuuuaaaaggguugguggggugucaaaguuacaguagcaccaaacugagau

SEQ ID NO: 19659 - RNA, 2439 nt, Homo sapiens
agaaggccuuuccgcagucaucgcacuuguaaggccgcucgccacuguggacccggugaugcugcagaagcguggaggagcggcagaagcccuugccgcacacggcgcaccuguagggccgcucgcccgugugggagcgcuggugcuggaugagaguggaggagcgauugaaggucuugccgcagucggggcagcuguaggugcggccuggcaggugggugcgggcguggauggccagcaccgagcucuggccaaagcgcuugccgcacucagggcacuugaagggcuucucccgggcguggcugcgggcaugggggauaagggccgaccgcugggagaagcucuugccgcagaugccacagcugaagggccucugaccggugugcacccucugauggcugcgcagggacgaguucuggcuauagcacuugccgcacucggugcagcuguagggccgcucguggcugugggugcgcuggugucgcaggagguaggagcugucgccgaaggccuugccacaaugugggcacuuguagggcuucuggccagagugagugcgcugguggcgaagcagguaagagcugucggcgaaggccuugccgcaacggggacauuuguagggccgcucgccagugugggugcgcugguguuugaugaggucagagcucugggagaaggccuugcugcagaccucacauuuguagggcuucucaccgguguggaugcgcuggugcuggaucaggguggagccccgcccgaagcucuucccgcagaugccacagauguuaggccgagggcccugcccaccccuggcccggccaccccgccgaccuggaccucgaagggcuccugugagacccaggggauucugaagcaucucaaacugcgguguagacagcagggccccugugggcaucucaaaagguggcccuaugggcagguccccugugggcugcuccccaaaccccugagugaaggaguccagggggugaacuccuacggagauauucaaaggacucuuuuccucgggguucagaagcaucuccgcaccuuccuggaauuuggaacuuugagcuucaaauucugggcuuuggguuuugagcucaguguucugggauucauaucuagagcucucagauucauagccagggcuccgggguucauacccggggcuccgagguucauagccagggcuuugggguucauaccuagggcucugggauucaaacucagggcucugagaaucugauucagggcuucugggugcaaacucagggcuugggggcacaagcccagggcuucgggacucaaaccccgggcuuucaggcucaaaucuggggcuuugggguucaaacucugggcuuuguggcucaaacccagggcucugggguucaagcccaaaugguaucucuucgacuucauaguccccacugccuucuugcugagaaauuuccucuuccucauucucacucauguugccugcaggaugagagaauccagaucgugugagaccuggaaggucauuugguccauuagcaaccacacaccucccaccucacaugcagggucgcuggccccuagacaagugcugaaauucccacgccccccucagcugacccaagacaccccaguccccgccggccccuccuucgagucccaggugucccagccccgggcccucgcucccucccuggagccacagccccuucuccugcgcgcaaguccacuccucggacgggcgcucccuccucaccucugagguacccuucggggcuccucauuucgucagaacucugcacauccuggggcucgaggccccacggcaacgccucccgcuccauccccgcgggcucccagugcagcggcggcggcgauggcggccgaucccgcgacccggccucgguugccccgagccgcgggcccccgccucccgcccgcucagcgccgcccaggggacucggcggcccagcccgggcccccgaggccggacgucuugaccccgcgccucuccagcgcgccgggccccuccccugcccgcggccccgcccccucccaaggucucggccuccccguggcccucacuggcccccgcgcgucgcggccucggggaugaggggcuucgcgacuaccccggcggcccccggcccccgcucccgcccgagcccccaccuucuggaccccggccccgggcugggcugcacuguccaacggccgcccagcacccccccacccucccccgcacaggaaguguccguccgcggccagguccccccgccggcucgcgccgcggccucucuaggagccgcuggagguggaaacucguuggcauuaacccugggcuggaggggcccggccacggggugggugaggaccggacgccccggagcccgcggggcuaccggggcagugugugugccuauguucuaggucuccgucccu

SEQ ID NO: 19660 - RNA, 2439 nt, Homo sapiens
agggacggagaccuagaacauaggcacacacacugccccgguagccccgcgggcuccggggcguccgguccucacccaccccguggccgggccccuccagcccaggguuaaugccaacgaguuuccaccuccagcggcuccuagagaggccgcggcgcgagccggcggggggaccuggccgcggacggacacuuccugugcgggggagggugggggggugcugggcggccguuggacagugcagcccagcccggggccgggguccagaaggugggggcucgggcgggagcgggggccgggggccgccgggguagucgcgaagccccucauccccgaggccgcgacgcgcgggggccagugagggccacggggaggccgagaccuugggagggggcggggccgcgggcaggggaggggcccggcgcgcuggagaggcgcggggucaagacguccggccucgggggcccgggcugggccgccgaguccccugggcggcgcugagcgggcgggaggcgggggcccgcggcucggggcaaccgaggccgggucgcgggaucggccgccaucgccgccgccgcugcacugggagcccgcggggauggagcgggaggcguugccguggggccucgagccccaggaugugcagaguucugacgaaaugaggagccccgaaggguaccucagaggugaggagggagcgcccguccgaggaguggacuugcgcgcaggagaaggggcuguggcuccagggagggagcgagggcccggggcugggacaccugggacucgaaggaggggccggcggggacuggggugucuugggucagcugaggggggcgugggaauuucagcacuugucuaggggccagcgacccugcaugugaggugggaggugugugguugcuaauggaccaaaugaccuuccaggucucacacgaucuggauucucucauccugcaggcaacaugagugagaaugaggaagaggaaauuucucagcaagaaggcaguggggacuaugaagucgaagagauaccauuugggcuugaaccccagagcccuggguuugagccacaaagcccagaguuugaaccccaaagccccagauuugagccugaaagcccgggguuugagucccgaagcccugggcuugugcccccaagcccugaguuugcacccagaagcccugaaucagauucucagagcccugaguuugaaucccagagcccuagguaugaaccccaaagcccuggcuaugaaccucggagccccggguaugaaccccggagcccuggcuaugaaucugagagcucuagauaugaaucccagaacacugagcucaaaacccaaagcccagaauuugaagcucaaaguuccaaauuccaggaaggugcggagaugcuucugaaccccgaggaaaagaguccuuugaauaucuccguaggaguucacccccuggacuccuucacucagggguuuggggagcagcccacaggggaccugcccauagggccaccuuuugagaugcccacaggggcccugcugucuacaccgcaguuugagaugcuucagaauccccugggucucacaggagcccuucgagguccaggucggcgggguggccgggccaggggugggcagggcccucggccuaacaucuguggcaucugcgggaagagcuucgggcggggcuccacccugauccagcaccagcgcauccacaccggugagaagcccuacaaaugugaggucugcagcaaggccuucucccagagcucugaccucaucaaacaccagcgcacccacacuggcgagcggcccuacaaauguccccguugcggcaaggccuucgccgacagcucuuaccugcuucgccaccagcgcacucacucuggccagaagcccuacaagugcccacauuguggcaaggccuucggcgacagcuccuaccuccugcgacaccagcgcacccacagccacgagcggcccuacagcugcaccgagugcggcaagugcuauagccagaacucgucccugcgcagccaucagagggugcacaccggucagaggcccuucagcuguggcaucugcggcaagagcuucucccagcggucggcccuuaucccccaugcccgcagccacgcccgggagaagcccuucaagugcccugagugcggcaagcgcuuuggccagagcucggugcuggccauccacgcccgcacccaccugccaggccgcaccuacagcugccccgacugcggcaagaccuucaaucgcuccuccacucucauccagcaccagcgcucccacacgggcgagcggcccuacaggugcgccgugugcggcaagggcuucugccgcuccuccacgcuucugcagcaucaccggguccacaguggcgagcggccuuacaagugcgaugacugcggaaaggccuucu

SEQ ID NO: 19661 - RNA, 2853 nt, Homo sapiens
ucuauucgaauuacuucugcucucugcuuuuaucacuucacugugggucugggcgcgggcuuucugccagcuccgcggacgcugccuucguccggccgcagaggccccgcggucagggucccgcgugcgggguaccgggggcagaaccagcgcgugaccgggguccgcggugccgcaacgccccgggucugcgcagaggccccugcagucccugcccggcccaguccgagcuucccgggcgggcccccaguccggcgauuugcaggaacuuuccccggcgcucccacgcgaagccgccgcagggcccccuugcaaaguuccauuaguuugaaggacgcgaaucucagcgagagaaccugcggaaagcgaauauguggggcgcgcagacggggaaacugagucccgcgagagggccggccugugcgcugccccgcccgcgccccgccagcaccgccgugcccgggcgcgcccgcccugcccccuccgcgggcggucccgguccagccgcccgcccucccucccgccauccggccagcccccaucccgggcgccgugcccguccccaaggcggcucgucaccgcugcgaggccaaugggcugggccgcgcggccgcgcgcacucgcacccgcugcccccgaggcccuccugcacucuccccggcgccgcucuccggcccucgcccuguccgccgccaccgccgccgccgccagagucgccaugcagaucccgcgcgccgcucuucucccgcugcugcugcugcugcuggcggcgcccgccucggcgcagcugucccgggccggccgcucggcgccuuuggccgccgggugcccagaccgcugcgagccggcgcgcugcccgccgcagccggagcacugcgagggcggccgggcccgggacgcgugcggcugcugcgaggugugcggcgcgcccgagggcgccgcgugcggccugcaggagggcccgugcggcgaggggcugcagugcguggugcccuucggggugccagccucggccacggugcggcggcgcgcgcaggccggccucugugugugcgccagcagcgagccggugugcggcagcgacgccaacaccuacgccaaccugugccagcugcgcgccgccagccgccgcuccgagaggcugcaccggccgccggucaucguccugcagcgcggagccugcggccaagguacuccgccgcgcuccugggcagcuccccacucucuccaucccagcucggaccugcuucugcgggacuggugggcagguugaggggcagcgaagcguugugggguggccagggcaacucucggggacaggcaggugggccccgggguggcggauuuccgcgggcugccucggaaccgagcuucgcgcccagcccggggccgguucugcgcccagacgaugccaguacgcccggccugcacucuggggcucgagacgccgggcgaccggccauggagugcccugagggcaaccacacagcgcggggaccccaggacaaauaagaggaaugggggcauaaaggaaggagagaaguucaggacugggaauuggcgccucgcagagcggcuucaggaccacaagaagucauuucgguugcuuuuucuucuauuuacguccuccguccccuuuaaaauucacugcuuugaucacgggaccgcucagugaaaacuguauguaacucuuuuggaaaggaacaguguuugccggcccgccccggaguuucuccaaaaagucuaccccgagcagggaacgguuuggcaccgcucucguuucggcggcguugcugccugucuugcuuuccucguuuugagccagcccuacaaaaaugaaaguggcuccuuuugaauaagcugaaucgggcuuuggaucacgaaaucugcagaggcggagaagggaccggguuagugaugaggaagaagucuaccccucuguuccuacagccgcacacaggaccuguucuggcaggggagacgguggugaugggggaaggaguggaauggagcaaugucuaacucucucgcgggaccuuccggagagaugcuccucaucuucaggcagaggccauguggaaaaauaauaucgaguucagcagcggccagccccgcguuguaggaaccagacagcggggcuuggcagugcgcuugggcgcagccgugccgcugcugccggaccccagugcugccuccucaacacgggcagugccaggagaggggcauaggggagcacagugcagagggacuggucuagaguuuacuuuauaggaauaugguucggugugaccaacuagggcuuagcauaguuuggcuuacguggacgggaagaugccagagccgaacugggugaaauucgagauugcguauuucaccaacacaggagcacagcccucgggaaacucagccuagucaggcaguagagaguugucccggagagaagugauccugcagacucgagaaggggcaugaugauagcacacgucuguugagcacccagucugugugccggguguguuaccucugugaccucauuuggucaaacgaggaggcaguugcuccucucucucucuuuuuuuuucuuaagagacagggucucccucugucgcccaugcuggaguguaguggugugaucauggcucacugcagccuccgaccccugggcucaaugauucuccugcuucagccucccaaguggcugggacuacaggcggaugccaccacacccagcuucucauucccguuuuacagauagcggagcuaagguugaaaaacuugcccaaggucauucagcuggaauuuaaacccagacagccucauucagaggagucagcccagcacuuaacuccaagg

SEQ ID NO: 19662 - RNA, 2853 nt, Homo sapiens
ccuuggaguuaagugcugggcugacuccucugaaugaggcugucuggguuuaaauuccagcugaaugaccuugggcaaguuuuucaaccuuagcuccgcuaucuguaaaacgggaaugagaagcugggugugguggcauccgccuguagucccagccacuugggaggcugaagcaggagaaucauugagcccaggggucggaggcugcagugagccaugaucacaccacuacacuccagcaugggcgacagagggagacccugucucuuaagaaaaaaaaagagagagagaggagcaacugccuccucguuugaccaaaugaggucacagagguaacacacccggcacacagacugggugcucaacagacgugugcuaucaucaugccccuucucgagucugcaggaucacuucucuccgggacaacucucuacugccugacuaggcugaguuucccgagggcugugcuccuguguuggugaaauacgcaaucucgaauuucacccaguucggcucuggcaucuucccguccacguaagccaaacuaugcuaagcccuaguuggucacaccgaaccauauuccuauaaaguaaacucuagaccagucccucugcacugugcuccccuaugccccucuccuggcacugcccguguugaggaggcagcacugggguccggcagcagcggcacggcugcgcccaagcgcacugccaagccccgcugucugguuccuacaacgcggggcuggccgcugcugaacucgauauuauuuuuccacauggccucugccugaagaugaggagcaucucuccggaaggucccgcgagagaguuagacauugcuccauuccacuccuucccccaucaccaccgucuccccugccagaacagguccugugugcggcuguaggaacagagggguagacuucuuccucaucacuaacccggucccuucuccgccucugcagauuucgugauccaaagcccgauucagcuuauucaaaaggagccacuuucauuuuuguagggcuggcucaaaacgaggaaagcaagacaggcagcaacgccgccgaaacgagagcggugccaaaccguucccugcucgggguagacuuuuuggagaaacuccggggcgggccggcaaacacuguuccuuuccaaaagaguuacauacaguuuucacugagcggucccgugaucaaagcagugaauuuuaaaggggacggaggacguaaauagaagaaaaagcaaccgaaaugacuucuugugguccugaagccgcucugcgaggcgccaauucccaguccugaacuucucuccuuccuuuaugcccccauuccucuuauuuguccugggguccccgcgcugugugguugcccucagggcacuccauggccggucgcccggcgucucgagccccagagugcaggccgggcguacuggcaucgucugggcgcagaaccggccccgggcugggcgcgaagcucgguuccgaggcagcccgcggaaauccgccaccccggggcccaccugccuguccccgagaguugcccuggccaccccacaacgcuucgcugccccucaaccugcccaccagucccgcagaagcagguccgagcugggauggagagaguggggagcugcccaggagcgcggcggaguaccuuggccgcaggcuccgcgcugcaggacgaugaccggcggccggugcagccucucggagcggcggcuggcggcgcgcagcuggcacagguuggcguagguguuggcgucgcugccgcacaccggcucgcugcuggcgcacacacagaggccggccugcgcgcgccgccgcaccguggccgaggcuggcaccccgaagggcaccacgcacugcagccccucgccgcacgggcccuccugcaggccgcacgcggcgcccucgggcgcgccgcacaccucgcagcagccgcacgcgucccgggcccggccgcccucgcagugcuccggcugcggcgggcagcgcgccggcucgcagcggucugggcacccggcggccaaaggcgccgagcggccggcccgggacagcugcgccgaggcgggcgccgccagcagcagcagcagcagcgggagaagagcggcgcgcgggaucugcauggcgacucuggcggcggcggcgguggcggcggacagggcgagggccggagagcggcgccggggagagugcaggagggccucgggggcagcgggugcgagugcgcgcggccgcgcggcccagcccauuggccucgcagcggugacgagccgccuuggggacgggcacggcgcccgggaugggggcuggccggauggcgggagggagggcgggcggcuggaccgggaccgcccgcggagggggcagggcgggcgcgcccgggcacggcggugcuggcggggcgcgggcggggcagcgcacaggccggcccucucgcgggacucaguuuccccgucugcgcgccccacauauucgcuuuccgcagguucucucgcugagauucgcguccuucaaacuaauggaacuuugcaagggggcccugcggcggcuucgcgugggagcgccggggaaaguuccugcaaaucgccggacugggggcccgcccgggaagcucggacugggccgggcagggacugcaggggccucugcgcagacccggggcguugcggcaccgcggaccccggucacgcgcugguucugcccccgguaccccgcacgcgggacccugaccgcggggccucugcggccggacgaaggcagcguccgcggagcuggcagaaagcccgcgcccagacccacagugaagugauaaaagcagagagcagaaguaauucgaauaga

SEQ ID NO: 19663 - RNA, 2194 nt, Homo sapiens
ucggacggacgguuuuccugcuugggaauguuccugggcugugagauccacucuucugggcaggugguuagcaccuaacguuuuucccucacuuccccccaaauucuuaaguccuuugguccauuucacugcuucuuuuggggagggucagauuccucaggggcucaguggcagaaccagccugaugucgccucccugcccgugagucaccacggccccugggcaggcgaggggagccgggguggcuuggguuccuggccuuggcaccucccuuugggcggcgauggagcguggcugggcgguugguacaggagccacaggcagcugccuuuuuggcugaggggacccuaacauccuggaguggguggggcagggcccauggucuccucuaggugggagguggcaggcugaggcggcgugggcaggacgguggauggcggguccacagggacagccagcagcuccugcacccaguggggcuccaagaccgugggcaagggaggaagggggagcccaggccggaggauccugggggauggcgcgggccgggggccagaugugguccccgagcccagccaggccuagggccgcagcagccccagggcuccgagggcgccgcccagcacgagacagagacgcgggccgcgcguggguccagcgcccgaaguccacgcccgguagcuguagaugccggggccugucccguugccuccgggcaccccguccuccucguccuccaggccgcguuccccgggucccgcggcccuucuccagcccgagcccgccgccaggcccgcggccgcucccgccgccgccccggcugccgccccggcggcagccacgcgcagggaggagcccggggcaccguagcgcugcgccggccucacgcgcacccucgaggccccgcgcgcacccccgcggaccccuccccgggcacugccccgcgcaccuccgcggccgcccuuggcugcgccgcugucgcagaggaaggcggccgccaguagcagagcccagcacguugcgggugcccaguucaucuucguggggcuaaaccugcgggaagagagggaaagggcccuuaguuuccauggagaucgggugcccaggggcggagggcucaaggcuggagagcagagggacccccaucuuuugugggaucagggugcccccagcaucuuggaggcccacugaggccugggggggcgcgguuuaaccucuagcaucagggacuuaggccugggggaggcgcugggaaguggcagguggggcaggaggguucugcaccugaagguugugcaccuggauuggggguguagaagcggggcaggagcguucaggccucugggggcguccaggcccgggcgggggagcaagccugggggagggagcucugcacgcguugcugggauguggggggcggggggaggcggcauggggggaggggcguuguguuuggaggacgcgguagccgggaccaagagcuggcucagaucagggucuggaacggggacgggccgugccugggccugguccccaccuuuggggccaaagccugggugcgggccuugcggaugcugcggaggacaagcggcugcugacaucgugcggacuccgccccagcagacccgugccccaggggcagucccucccgcgcgcgcccggcgcucaaugccguccccggccgccuaguucagcagcuggcugggggcgggacggggucgaguugcggggccgcguccagacacggcugugcgggcgacagcugcauccccuccccgcgccgccccucgcucccggccccguacccgccccagccucccggccuuacccgccacgggccucgguuggaaccgcgcgcuggaguauccgucccugaggccgcggccgagcgggaaggagcgggcgggcggcggcgcggacccucagccggagcgcggagccgcggcgccuggguuuugcgcgaggccuccgcccugggauuggggcgggcagucgcggaggcgcaucccuggugagccggugggaggggaaaaggaugucgcgucccccauccuugcggccucccguccuccgucaccagcccccuccgucuccugcaucacaaggccccguccccgcggucccccgcgacccccgcacccggccccgcuccacccgccgugcuuccugccccuccacacccucguccccaccc

SEQ ID NO: 19664 - RNA, 2194 nt, Homo sapiens
ggguggggacgaggguguggaggggcaggaagcacggcggguggagcggggccgggugcgggggucgcgggggaccgcggggacggggccuugugaugcaggagacggagggggcuggugacggaggacgggaggccgcaaggaugggggacgcgacauccuuuuccccucccaccggcucaccagggaugcgccuccgcgacugcccgccccaaucccagggcggaggccucgcgcaaaacccaggcgccgcggcuccgcgcuccggcugaggguccgcgccgccgcccgcccgcuccuucccgcucggccgcggccucagggacggauacuccagcgcgcgguuccaaccgaggcccguggcggguaaggccgggaggcuggggcggguacggggccgggagcgaggggcggcgcggggaggggaugcagcugucgcccgcacagccgugucuggacgcggccccgcaacucgaccccgucccgcccccagccagcugcugaacuaggcggccggggacggcauugagcgccgggcgcgcgcgggagggacugccccuggggcacgggucugcuggggcggaguccgcacgaugucagcagccgcuuguccuccgcagcauccgcaaggcccgcacccaggcuuuggccccaaagguggggaccaggcccaggcacggcccguccccguuccagacccugaucugagccagcucuuggucccggcuaccgcguccuccaaacacaacgccccuccccccaugccgccuccccccgccccccacaucccagcaacgcgugcagagcucccucccccaggcuugcucccccgcccgggccuggacgcccccagaggccugaacgcuccugccccgcuucuacacccccaauccaggugcacaaccuucaggugcagaacccuccugccccaccugccacuucccagcgccucccccaggccuaagucccugaugcuagagguuaaaccgcgcccccccaggccucagugggccuccaagaugcugggggcacccugaucccacaaaagaugggggucccucugcucuccagccuugagcccuccgccccugggcacccgaucuccauggaaacuaagggcccuuucccucucuucccgcagguuuagccccacgaagaugaacugggcacccgcaacgugcugggcucugcuacuggcggccgccuuccucugcgacagcggcgcagccaagggcggccgcggaggugcgcggggcagugcccggggagggguccgcgggggugcgcgcggggccucgagggugcgcgugaggccggcgcagcgcuacggugccccgggcuccucccugcgcguggcugccgccggggcggcagccggggcggcggcgggagcggccgcgggccuggcggcgggcucgggcuggagaagggccgcgggacccggggaacgcggccuggaggacgaggaggacggggugcccggaggcaacgggacaggccccggcaucuacagcuaccgggcguggacuucgggcgcuggacccacgcgcggcccgcgucucugucucgugcugggcggcgcccucggagcccuggggcugcugcggcccuaggccuggcugggcucggggaccacaucuggcccccggcccgcgccaucccccaggauccuccggccugggcucccccuuccucccuugcccacggucuuggagccccacugggugcaggagcugcuggcugucccuguggacccgccauccaccguccugcccacgccgccucagccugccaccucccaccuagaggagaccaugggcccugccccacccacuccaggauguuaggguccccucagccaaaaaggcagcugccuguggcuccuguaccaaccgcccagccacgcuccaucgccgcccaaagggaggugccaaggccaggaacccaagccaccccggcuccccucgccugcccaggggccguggugacucacgggcagggaggcgacaucaggcugguucugccacugagccccugaggaaucugacccuccccaaaagaagcagugaaauggaccaaaggacuuaagaauuuggggggaagugagggaaaaacguuaggugcuaaccaccugcccagaagaguggaucucacagcccaggaacauucccaagcaggaaaaccguccguccga

SEQ ID NO: 19665 - RNA, 2475 nt, Homo sapiens
cuggugcacauaccuucuuguuccccugcccagccuccugccaguacacagggcagggcugggauauggaggcaggugagguccuagcugaaggggacucagcccugugcuggggaagugguuuccugagggcauccucuucauggcagggaggccaugaggggagaaggccagcccuccuuggcaaccaaaaaggccccauggccugagggugcuggagccagcccccaccugcuccucccagaaggcgugggguggcugugguggcagcccccugccaacaauaacgguugguucugggaucugggacugggcgagccggccaggcaggucccugaugugccugugccagaggccaccccccuuggucucaagguccuguccuauaagcccagccuuuugugguucagcugggucgcacgcuggaucccaggccccuuccuugaaaagcagaggccuuguaccccccaggguugccgggcgggacagugauuccagcccuucaggugggugcaggggccaggcuggggcuggggcuggggagggcuccucggucugggguggaauuuucuccccccacaggaggguuucacucgggccucaagcagcuccuccuuccaauccucccccaaggggagccccagucagggcugggccccagaaggagagccaggaggggcuacugaggugggaccugccugaguccccagcucguucacccauacauauacacugaauacugcuaaguuaaacauuuucuagcauuacacguucauuguuuuguuuugagauggaguuucguucuuguugcccagugcaauggcacaaucucggcucacugcaaacucugccucccgaguucaagugauucuccuggcucagccucccaaagugcugggauuacaggcgcccaccaccacaccuggcuaauuuuuuguauuuuuaguagagacgggguuucgccauguugggcaggcuggucucgaacuccugaccucaggugaucugccccugucucagccccccaaagugcugggauuacaggcgcccggccuacauguuuauuguuuaaaaaccgggaaaguauagagaagaaaguaaaggcuccccaccccuagagauaaccgcugaaaguauuuggucuguuuccugcccggcuuuuuccuacacacacuuuuuggcgccuuaagucgggcuccccccggacaggaggggccccucccaggcgcuggugucugcgcccgccccccgcagccuugucccugcuccggggggucccugggucucuggggcauaucguugcuucacugcucgcucgagccuccagggaucgggccgccggggcagcgcagagaggcggggacaggcgacagcggcgcagaguggcuccucccggggccggcccaagcgggggucucggugccugcgaagcggcaggggucgcucggggcccagugcccucuacgucccguccgggucccagcuggggcggggcgcgcccaguguuuccgggaggagcggcccgggcgcgcggcaggugcggcggcgcaacucgcggguaggcgaccgcuggucccgccgcugaggccccuccacugccgcccgcccggcacccccuccgggccgccguggcccgcgccaaaccugagcgucucggucgggaacuccgguuacccccucggggcgcaaggcggcagggguaagggcgggguugucccccagaguuucggggagcacaggaggcuggccgccccaccccaccagcccauccucccaccucccuggggcccugcugccgcgcggcuuccggcugggguggaccucaggucuagccggcaagccggagggcgggcgagacaacaacguggccuggaggcaauggcccuggccucucguguccccuucucucacccgcccagacuugcccucuuuggaggucgcccgggcuaaggaacauggaaggacgcuggguggagagugaggggagaggaucccagcuccccggugggggaaggcggguguugguggggagcagcuuugggaaauccgggaucaggacauugugugaaggacagguggcucugguuagggggcggggcgucccugcaaggaggugggaagggaggccccagggaguucugaaacggggaagggccucaguguuguggggcaaggguguuaggucucgaaucuggaaguguuccugaguggggcgucagaggcgaagggcucugcaggcugggaccuugccccugcacucugugggcucaguuguggggagggaggggccggugggcaggagggagaagucugcccugccugccagcugucaugaggcugggccacacaggcccaggccaggggcuaaggacuuggucaggacuggcugagcccucacuugggaucagaucuccaguugcagagugugaggggcuccucccucacugaccccaagccugcuccucucagcuuuca

SEQ ID NO: 19666 - RNA, 2475 nt, Homo sapiens
ugaaagcugagaggagcaggcuuggggucagugagggaggagccccucacacucugcaacuggagaucugaucccaagugagggcucagccaguccugaccaaguccuuagccccuggccugggccuguguggcccagccucaugacagcuggcaggcagggcagacuucucccuccugcccaccggccccucccuccccacaacugagcccacagagugcaggggcaaggucccagccugcagagcccuucgccucugacgccccacucaggaacacuuccagauucgagaccuaacacccuugccccacaacacugaggcccuuccccguuucagaacucccuggggccucccuucccaccuccuugcagggacgccccgcccccuaaccagagccaccuguccuucacacaauguccugaucccggauuucccaaagcugcuccccaccaacacccgccuucccccaccggggagcugggauccucuccccucacucuccacccagcguccuuccauguuccuuagcccgggcgaccuccaaagagggcaagucugggcgggugagagaaggggacacgagaggccagggccauugccuccaggccacguuguugucucgcccgcccuccggcuugccggcuagaccugagguccaccccagccggaagccgcgcggcagcagggccccagggaggugggaggaugggcuggugggguggggcggccagccuccugugcuccccgaaacucugggggacaaccccgcccuuaccccugccgccuugcgccccgaggggguaaccggaguucccgaccgagacgcucagguuuggcgcgggccacggcggcccggagggggugccgggcgggcggcaguggaggggccucagcggcgggaccagcggucgccuacccgcgaguugcgccgccgcaccugccgcgcgcccgggccgcuccucccggaaacacugggcgcgccccgccccagcugggacccggacgggacguagagggcacugggccccgagcgaccccugccgcuucgcaggcaccgagacccccgcuugggccggccccgggaggagccacucugcgccgcugucgccuguccccgccucucugcgcugccccggcggcccgaucccuggaggcucgagcgagcagugaagcaacgauaugccccagagacccagggaccccccggagcagggacaaggcugcggggggcgggcgcagacaccagcgccugggaggggccccuccuguccggggggagcccgacuuaaggcgccaaaaaguguguguaggaaaaagccgggcaggaaacagaccaaauacuuucagcgguuaucucuagggguggggagccuuuacuuucuucucuauacuuucccgguuuuuaaacaauaaacauguaggccgggcgccuguaaucccagcacuuuggggggcugagacaggggcagaucaccugaggucaggaguucgagaccagccugcccaacauggcgaaaccccgucucuacuaaaaauacaaaaaauuagccaggugugguggugggcgccuguaaucccagcacuuugggaggcugagccaggagaaucacuugaacucgggaggcagaguuugcagugagccgagauugugccauugcacugggcaacaagaacgaaacuccaucucaaaacaaaacaaugaacguguaaugcuagaaaauguuuaacuuagcaguauucaguguauauguaugggugaacgagcuggggacucaggcaggucccaccucaguagccccuccuggcucuccuucuggggcccagcccugacuggggcuccccuugggggaggauuggaaggaggagcugcuugaggcccgagugaaacccuccuguggggggagaaaauuccaccccagaccgaggagcccuccccagccccagccccagccuggccccugcacccaccugaagggcuggaaucacugucccgcccggcaacccugggggguacaaggccucugcuuuucaaggaaggggccugggauccagcgugcgacccagcugaaccacaaaaggcugggcuuauaggacaggaccuugagaccaagggggguggccucuggcacaggcacaucagggaccugccuggccggcucgcccagucccagaucccagaaccaaccguuauuguuggcagggggcugccaccacagccaccccacgccuucugggaggagcaggugggggcuggcuccagcacccucaggccauggggccuuuuugguugccaaggagggcuggccuucuccccucauggccucccugccaugaagaggaugcccucaggaaaccacuuccccagcacagggcugaguccccuucagcuaggaccucaccugccuccauaucccagcccugcccuguguacuggcaggaggcugggcaggggaacaagaagguaugugcaccag

SEQ ID NO: 19667 - RNA, 2585 nt, Homo sapiens
gucagugccucagcuuuuaugugugagccgacuccucccagcccgggcuccacccuaccccccaccccucucccugcugaccacucccccgcgccuuugcucccgcccucucccuccucccagccagucucuucucuccugcacccccaaccgggagcccuggaccaucccguagcgaagugccaugggcucccauccugcacccccggcucaucucugcacagggcagugaagggggggggggucuccuucccaccuccuuguauggaaacuuccacgcugcccacugggcaggggccgcggccucucuccgggucgaaggcucugcccuucuuagccucagaccagcagccccucucccccucucccgggacuccuguuuggaaauguugcggacagagccagagggggugugggggagaugucgcgaauguggcgucugccaugacuccugccaacucggccccucuccauccuggccccgcccacccccgucuuccucucgcggucucgcuggcaccgcgucaacauaccagggugggcuucugcggcuccgcgccccuccucguuacccagcaccccggaggccagggcccgcaaggcacgaaucacacaugugaggcggcacccccugcacccacagaccgaccgggaagucgccccugcagacaccucacaccucccucggcccuucccgacgcccccaccccacccccagcuccgccgccagggugagcgcggggcuccgcgcagggaacgggacccgcagccguccguccuccuccuccuccuccuccucccccccgggcucagccgccccgccgagccccgcaggccccgggccgggagcgggcggaggaagggccgggcguccggcgcaagcccgcgccgccccagccccggccccggcccggcccgcacacgccgcuuaccuggaagccggcgacgcugccgcccaccucccugcugcgugucgcaaaccgaacagcgggcguuggcccuccugccggacacuccucugccagcgccgcucuggccgagucgcgggggccgaaugugcgacggggcagagcggggggauggcuuuuuuuuggggggggggggagaauucgucugauuguccagggaggacgggcugucuucgggcuggggcgggccagauguuguacuuuucgggggggaaaagguaucgggaaaugaggucagcuguuguaucaaggauagaggggggcagagauagugggagagacagagugaacgugaaaggggggggccgaagagagggcgagggggagagaggacagcgagaggcgggcaggcgcacagcgggagagaacagcacggagagaaacagaaagcguguaauuaauccacuuugguucggcgaaggcgagagggcgggcgugagggggggagggagucggaggcuaggagcugggggggacgggagggagcgaagggaagguugcgggagaaagagcgggggccggggccagacgccaagaggggcgcggggagcacagagaagcggagggaagggcgccacgucgaggggccgggggaggcggugacuggggggcggaguggaggcugcacccggaccgcgggcgcccagcucgguuugggccgacggagcccucugccgucgcgagcccgggccucgggagggggacaggcgguggcggcaccggggccgcuccgggacgcagcgcggaaaggggagcggcccgaggcugcgcgccggggggagggcuggagggggagcgcgggggggggugacaacgccggcggccugcgagccggacugccugcggggggaaccgccuccucgggcgaagcggggauggggggaguugagguagaugaagaggaggcggcggggaauccgcaggcccggcggagcgcgaccccgcggacggcgcccgggacgggagucagcagcgaggcagcgggcggcgucgacgcggggccgccuugcccgauggaggcgcuggugggcagagcgcgggcaggcgugggccaggaggcgggggcggccggaaggggggggccggggccggccgggccucacgcagcuccgccggagagcaggcgaacugcgggcgcccacgcccggcucuuauagucgcgccagcccgcggcccagggcccgcgcgggccucgcuggccucgcgcccgcgccaaugggcgcccgcggagcccucgccccgcccccggcccgcccccgcaacccgagccaagagcggggcggggggugcgggcugggggcccuggggccccggggggggggcggcggucgcaggggcuggggggugcgcgggggcgaggcuggguggggggcagggagccgcagagcgccaaggccaugcugaaugcccguucuagagaauucaggggccccaucccggguuucuggggugcccgggcggccugugcucgugagcuggggucuccgggcaggcaggggcaggcgggcucccagcgccccaccaggaggcugcacugcgggugcgccccgucugagugcagaugcagguggcuuggggcugagucgggggguccuugcugguuguugcggcugaggg

SEQ ID NO: 19668 - RNA, 2585 nt, Homo sapiens
cccucagccgcaacaaccagcaaggaccccccgacucagccccaagccaccugcaucugcacucagacggggcgcacccgcagugcagccuccugguggggcgcugggagcccgccugccccugccugcccggagaccccagcucacgagcacaggccgcccgggcaccccagaaacccgggauggggccccugaauucucuagaacgggcauucagcauggccuuggcgcucugcggcucccugccccccacccagccucgcccccgcgcaccccccagccccugcgaccgccgccccccccccggggccccagggcccccagcccgcaccccccgccccgcucuuggcucggguugcgggggcgggccgggggcggggcgagggcuccgcgggcgcccauuggcgcgggcgcgaggccagcgaggcccgcgcgggcccugggccgcgggcuggcgcgacuauaagagccgggcgugggcgcccgcaguucgccugcucuccggcggagcugcgugaggcccggccggccccggccccccccuuccggccgcccccgccuccuggcccacgccugcccgcgcucugcccaccagcgccuccaucgggcaaggcggccccgcgucgacgccgcccgcugccucgcugcugacucccgucccgggcgccguccgcggggucgcgcuccgccgggccugcggauuccccgccgccuccucuucaucuaccucaacuccccccauccccgcuucgcccgaggaggcgguuccccccgcaggcaguccggcucgcaggccgccggcguugucacccccccccgcgcucccccuccagcccuccccccggcgcgcagccucgggccgcuccccuuuccgcgcugcgucccggagcggccccggugccgccaccgccugucccccucccgaggcccgggcucgcgacggcagagggcuccgucggcccaaaccgagcugggcgcccgcgguccgggugcagccuccacuccgccccccagucaccgccucccccggccccucgacguggcgcccuucccuccgcuucucugugcuccccgcgccccucuuggcgucuggccccggcccccgcucuuucucccgcaaccuucccuucgcucccucccgucccccccagcuccuagccuccgacucccucccccccucacgcccgcccucucgccuucgccgaaccaaaguggauuaauuacacgcuuucuguuucucuccgugcuguucucucccgcugugcgccugcccgccucucgcuguccucucucccccucgcccucucuucggccccccccuuucacguucacucugucucucccacuaucucugccccccucuauccuugauacaacagcugaccucauuucccgauaccuuuucccccccgaaaaguacaacaucuggcccgccccagcccgaagacagcccguccucccuggacaaucagacgaauucuccccccccccccaaaaaaaagccauccccccgcucugccccgucgcacauucggcccccgcgacucggccagagcggcgcuggcagaggaguguccggcaggagggccaacgcccgcuguucgguuugcgacacgcagcagggaggugggcggcagcgucgccggcuuccagguaagcggcgugugcgggccgggccggggccggggcuggggcggcgcgggcuugcgccggacgcccggcccuuccuccgcccgcucccggcccggggccugcggggcucggcggggcggcugagcccgggggggaggaggaggaggaggaggaggacggacggcugcgggucccguucccugcgcggagccccgcgcucacccuggcggcggagcuggggguggggugggggcgucgggaagggccgagggaggugugaggugucugcaggggcgacuucccggucggucugugggugcagggggugccgccucacaugugugauucgugccuugcgggcccuggccuccggggugcuggguaacgaggaggggcgcggagccgcagaagcccacccugguauguugacgcggugccagcgagaccgcgagaggaagacgggggugggcggggccaggauggagaggggccgaguuggcaggagucauggcagacgccacauucgcgacaucucccccacacccccucuggcucuguccgcaacauuuccaaacaggagucccgggagagggggagaggggcugcuggucugaggcuaagaagggcagagccuucgacccggagagaggccgcggccccugcccagugggcagcguggaaguuuccauacaaggaggugggaaggagacccccccccccuucacugcccugugcagagaugagccgggggugcaggaugggagcccauggcacuucgcuacgggaugguccagggcucccgguugggggugcaggagagaagagacuggcugggaggagggagagggcgggagcaaaggcgcgggggaguggucagcagggagaggggugggggguaggguggagcccgggcugggaggagucggcucacacauaaaagcugaggcacugac

SEQ ID NO: 19669 - RNA, 2707 nt, Homo sapiens
ccagcuccaagcccguuuccaccgcggcauuggucaggcugggccggacgaacgaggcggcgucggcggugcggggggugguggguggguccccggcucgcugggggcggagcgcgggccgguccaccuggcgggcuccccggcgaugagcgcgccggccgcucgcucggcuuccggggcugaggcugcggggggaagguggggaaccaaacgcgcgucaacgcgggcgcgggcccggggcagaccccgcccgggccggcccugcccgcaccucccccaagcgaagucggcaguuucguuugcucgguugguuuuggagucuugaguccgugggugccgcgacucggucugagacacggcgggggcggggcgggcgcucggagccgcggugagucagggcuccgcgcccgccgacucauuucugccgccccggcccgggagcgcgauuugcaaugcaaagucaccccgccuccagcaccccaaucugccccaggauccgccagcacuagagaccucaacggcccgacggccgcuccccuccccucgucuaccccucccucgucggcggcugagccgcgaggggaaguuuugcaaucccggacaaacaaacgccggucuugcacgggcuugaaaaacuuugggggaaaugaagagugagcgaaaucgaagccaucgcucgggccuggcgcucggcuccgcgggcuccugggggcgcgacccgccgggccugcccaccccgucccuccaccccggcccccggcccucccuccucccugccucccggcuguuaccucauaggucgagggcgcucaguagcccccuaaccagcuggagaagucgaguagcucgcgcuccgcaggacucagcgcgccuucgcagccgcugucguccgacgaguaggcggaacgcggggagccgggcuccgagcugcccccgcggcccggggacgaagaagcgcgggagggcgaggcggcgaccgggguggucccuggcggcccgcggggcgcagacggccgcacggccugcggccucagcccucccgccagcgcguugcgcacggcgucgugcucggccagcaggcgcugcagcgcgcggauguacuccacggcugagcgcagcgucuccaccuugcucagcuucuugcuggcgccgccgugcggcacgugcugccgcagcgccuggaagcccaaguucaccagcuucacgcgguugcgcucgcgcucauugcgccgcgcuacggccgcugcgccgccuccggucucugcgguggccggucgccgccgccggcugcagcgcaacaguuccggggacgcgggucuccgccgggcagcgcagccgacagggacggggggcgcagggggcgcggaccugggcagugugccgccguccaucgcgccugcauccacccgcccgcuccaggucccggcgcgccgcaggaaggugcaggcagaggaaccggaggcgacggggaaaacuguggcgccccaagggggcuucuggcacggcgccgccaggcaacuccccagggcacgcguccuaggucgucuggagcccggggauaggaggccuagugguggcaggccguacgcgccagggagcgugggacgcucgugucccgcgcgugcggccggacucucccaggucuccgcaggcgcggcgcaggcggcugguuuuuaaauguauagauaacccuccuccgcgccgccgccgucgccuuucucacgcccuccuuccuucgccucgcccucccgccacgcuucgcccucccccucgcgcgaucacauucuguaaggcccaaagcgugcgcaugucccccuagcccaucccccggacgcaguccacagauccccagugcgcccaacuggcgaaaucugcgaguucccggugcgcccccugcucccggcaggugcuuagugcgcccccaaagcaagguacgcagguccuggguugagccuucccguacccccacccuaaccccgcgcgcagccccgccagucccaagagccgccagaccuucgcacgcgcagcgcgcgcugugggagggaaggcgcggcccuggcgacaacacggcuguucgggaggcgcgcaagauccccgggggcagcacgcgccgcgcagcccacacccacgccccacccuccuggggccgaggaggcgggggccagggucucagccaaucgugggccacccguuuggccaaucgcgcagggcgcggcuccacgcccggccccauugaggaagcgcguacgcguggcgcguggcucacggggagcaucgcuaacaaagcuggguuccugcugggccccgcccugcuccucgcccccgcgacugggcugggcgcgcuguccccuagcgcagcuaugucccgagcgcgcccccaccugugcguuaaucuacugggaauggggguggacugcgccuuaccuggggcgggguggggcuuaaggaguggucgagacugaggcggggugggagguucagguucccggggcgccuuccccaacccgccccgcuuuccccgucccuccacgcgcacccugccugugguuuccgugcgcccccggccugagggcucugggcggcaccuuaacccggagggccuggaggucugcacccgaccgccuugugccaggacggucagguccacgcccucccccaccguggcucccuccaucugcaguaucccccaccuccagcccguccugcc

SEQ ID NO: 19670 - RNA, 2707 nt, Homo sapiens
ggcaggacgggcuggaggugggggauacugcagauggagggagccacggugggggagggcguggaccugaccguccuggcacaaggcggucgggugcagaccuccaggcccuccggguuaaggugccgcccagagcccucaggccgggggcgcacggaaaccacaggcagggugcgcguggagggacggggaaagcggggcggguuggggaaggcgccccgggaaccugaaccucccaccccgccucagucucgaccacuccuuaagccccaccccgccccagguaaggcgcaguccacccccauucccaguagauuaacgcacaggugggggcgcgcucgggacauagcugcgcuaggggacagcgcgcccagcccagucgcgggggcgaggagcagggcggggcccagcaggaacccagcuuuguuagcgaugcuccccgugagccacgcgccacgcguacgcgcuuccucaauggggccgggcguggagccgcgcccugcgcgauuggccaaacggguggcccacgauuggcugagacccuggcccccgccuccucggccccaggaggguggggcgugggugugggcugcgcggcgcgugcugcccccggggaucuugcgcgccucccgaacagccguguugucgccagggccgcgccuucccucccacagcgcgcgcugcgcgugcgaaggucuggcggcucuugggacuggcggggcugcgcgcgggguuaggguggggguacgggaaggcucaacccaggaccugcguaccuugcuuugggggcgcacuaagcaccugccgggagcagggggcgcaccgggaacucgcagauuucgccaguugggcgcacuggggaucuguggacugcguccgggggaugggcuagggggacaugcgcacgcuuugggccuuacagaaugugaucgcgcgagggggagggcgaagcguggcgggagggcgaggcgaaggaaggagggcgugagaaaggcgacggcggcggcgcggaggaggguuaucuauacauuuaaaaaccagccgccugcgccgcgccugcggagaccugggagaguccggccgcacgcgcgggacacgagcgucccacgcucccuggcgcguacggccugccaccacuaggccuccuauccccgggcuccagacgaccuaggacgcgugcccuggggaguugccuggcggcgccgugccagaagcccccuuggggcgccacaguuuuccccgucgccuccgguuccucugccugcaccuuccugcggcgcgccgggaccuggagcgggcggguggaugcaggcgcgauggacggcggcacacugcccagguccgcgcccccugcgccccccgucccugucggcugcgcugcccggcggagacccgcguccccggaacuguugcgcugcagccggcggcggcgaccggccaccgcagagaccggaggcggcgcagcggccguagcgcggcgcaaugagcgcgagcgcaaccgcgugaagcuggugaacuugggcuuccaggcgcugcggcagcacgugccgcacggcggcgccagcaagaagcugagcaagguggagacgcugcgcucagccguggaguacauccgcgcgcugcagcgccugcuggccgagcacgacgccgugcgcaacgcgcuggcgggagggcugaggccgcaggccgugcggccgucugcgccccgcgggccgccagggaccaccccggucgccgccucgcccucccgcgcuucuucguccccgggccgcgggggcagcucggagcccggcuccccgcguuccgccuacucgucggacgacagcggcugcgaaggcgcgcugaguccugcggagcgcgagcuacucgacuucuccagcugguuagggggcuacugagcgcccucgaccuaugagguaacagccgggaggcagggaggagggagggccgggggccgggguggagggacggggugggcaggcccggcgggucgcgcccccaggagcccgcggagccgagcgccaggcccgagcgauggcuucgauuucgcucacucuucauuucccccaaaguuuuucaagcccgugcaagaccggcguuuguuuguccgggauugcaaaacuuccccucgcggcucagccgccgacgagggagggguagacgaggggaggggagcggccgucgggccguugaggucucuagugcuggcggauccuggggcagauuggggugcuggaggcggggugacuuugcauugcaaaucgcgcucccgggccggggcggcagaaaugagucggcgggcgcggagcccugacucaccgcggcuccgagcgcccgccccgcccccgccgugucucagaccgagucgcggcacccacggacucaagacuccaaaaccaaccgagcaaacgaaacugccgacuucgcuugggggaggugcgggcagggccggcccgggcggggucugccccgggcccgcgcccgcguugacgcgcguuugguuccccaccuuccccccgcagccucagccccggaagccgagcgagcggccggcgcgcucaucgccggggagcccgccagguggaccggcccgcgcuccgcccccagcgagccggggacccacccaccaccccccgcaccgccgacgccgccucguucguccggcccagccugaccaaugccgcgguggaaacgggcuuggagcugg

SEQ ID NO: 19671 - RNA, 2575 nt, Homo sapiens
cgggauagaugacacgagcggggcuaagcaggugggcucgggcgggggugggggugggggcgggggcgcaggcgggggcgggggcgcggacaggccaagccagggggugaggcggaggcagggccaggccgguccguggggagagggcgggccaagccggugggcgcgggcagggacgcccugugcgcgccggaccggcgggggcggggcgugcaggcgggggcggggcacgccgucccaugggaccggcccucggccacugcccccuccggccccgccccgagcgcccgggcugggccggcagcggccccccgcggcggggcuggcagcaguggcugcccgcacugcgcccgggcgcucgccuucgcugcagcucccggugccgccgcucgggccggccccccggcaggcccuccucguuauggccgcggccuccuccccgcccagggccgagaggaagcgcugggguuggggccgccugccaggcgcccggcggggcagcgcgggccuggccaagaagugccccuucucgcuggagcuggcggagggcggcccggcgggcggcgcgcucuacgcgcccaucgcgcccggcgccccaggucccgcgcccccugcguccccggccgcgcccgccgcgcccccaguugccuccgaccuuggcccgcggccgccggugagccuagacccgcgcgucuccaucuacagcacgcgccgcccgguguuggcgcgcacccacguccagggccgcgucuacaacuuccucgagcgucccaccggcuggaaaugcuucguuuaccacuucgccgugugaguaucgccaccggcgacggccggcacgaaggugcuuccugagagcuggugugggggagcucugucccagcgccaccugccccgucggagcugcgaccccggagcagaggagggaaggaaguggggaaacgcagaaacacaaacucugcacucucccuugaaguucagaggcgcugcugugucugggggugcgcaucuucucgcaggcccggcguggggagggagccggcuggggaggggaccaccuggagcccagaauuuggcuccacaccuccgggaggguaguccaggugugaauccuucugggaagagaagcgugcuggggagcgcacccuugggugcaguaagauaacuccucaaggucggcugagacucgaggcucaggagcccccaagagagaaggccccugauguccggugccgcaucucagacccccugaggcccagguggacucuggggcagggggcuguccaggauaggaaggugacgguggcggugcucccugagggcucagcaugccacgggccguccccacgggccccacauuaacuaauugaaccaagcucaugaaaaccuggcuugaugcagagagcggagaggcacguuugcagcucucacuaagaggcagcugugcucccggagaaagcagcgcugguagcagaggcaccuggccccccuguuaccaggugguuccaauucccgguacagcgugccugagcagggcugggcacuggauuucucagggacaggccugggaagucaccuccgggaagguccaggcugcucuccuccaugccugccuggggccuucccccgcugccccaguggcccuacuuccuggcugcccagccagcggccuuuugguguggugccagccucuggccugggagccucuacccagacaucccauggcugauggcuguggggcucaccugagggcugaaggguggucucccugagcguccucagguggaagcaucuccucugccucgggcaggcucaguagagaacuggcuggagggcauccagaggccuguccaugccugcuggcagcugccaccagggccucagggcgggugacagcaggagccaggccccaaauggcuucaagcaucgucucaggugagggggugggguaggggucgcagggcuacugccuuccuugcuaagagguggccuuccacaucaggaaggggaagucuuacccaccucccuccucaaagaugugguuggggggugaucuuggagacuuuuccccaccccagcucccaagccccugucuccugacaugucagugggugccugagccacagccgcugcuggucugugagaggagcuggcucugcucguggcugcaacagcgggggcucggcuugggguuugggagauauuugugugcagugaccccaggggaacccaguccgaugccacugugcaaaugucuagcagaugccagguucacaggugcugugugcugguggccaccugccucccggaccccagacucucugagauguccaagggugggaagaccuccucagccagaggccaaggcaaagugcccgcagacccccucaauucucacuuguauucagguuuguggacacaugccuccgggcucacugcagccacccguguggaggaagaggaggaagagggcucgccacgccccagaggaagucucugcuugcacuuguguuuucuuccucauuuggauuguuuaggucucggaaguuugcucagcaagagucuaccuucgcccagc

SEQ ID NO: 19672 - RNA, 2575 nt, Homo sapiens
gcugggcgaagguagacucuugcugagcaaacuuccgagaccuaaacaauccaaaugaggaagaaaacacaagugcaagcagagacuuccucuggggcguggcgagcccucuuccuccucuuccuccacacggguggcugcagugagcccggaggcauguguccacaaaccugaauacaagugagaauugagggggucugcgggcacuuugccuuggccucuggcugaggaggucuucccacccuuggacaucucagagagucugggguccgggaggcagguggccaccagcacacagcaccugugaaccuggcaucugcuagacauuugcacaguggcaucggacuggguuccccuggggucacugcacacaaauaucucccaaaccccaagccgagcccccgcuguugcagccacgagcagagccagcuccucucacagaccagcagcggcuguggcucaggcacccacugacaugucaggagacaggggcuugggagcugggguggggaaaagucuccaagaucaccccccaaccacaucuuugaggagggagguggguaagacuuccccuuccugauguggaaggccaccucuuagcaaggaaggcaguagcccugcgaccccuaccccacccccucaccugagacgaugcuugaagccauuuggggccuggcuccugcugucacccgcccugaggcccugguggcagcugccagcaggcauggacaggccucuggaugcccuccagccaguucucuacugagccugcccgaggcagaggagaugcuuccaccugaggacgcucagggagaccacccuucagcccucaggugagccccacagccaucagccaugggaugucuggguagaggcucccaggccagaggcuggcaccacaccaaaaggccgcuggcugggcagccaggaaguagggccacuggggcagcgggggaaggccccaggcaggcauggaggagagcagccuggaccuucccggaggugacuucccaggccugucccugagaaauccagugcccagcccugcucaggcacgcuguaccgggaauuggaaccaccugguaacaggggggccaggugccucugcuaccagcgcugcuuucuccgggagcacagcugccucuuagugagagcugcaaacgugccucuccgcucucugcaucaagccagguuuucaugagcuugguucaauuaguuaauguggggcccguggggacggcccguggcaugcugagcccucagggagcaccgccaccgucaccuuccuauccuggacagcccccugccccagaguccaccugggccucagggggucugagaugcggcaccggacaucaggggccuucucucuugggggcuccugagccucgagucucagccgaccuugaggaguuaucuuacugcacccaagggugcgcuccccagcacgcuucucuucccagaaggauucacaccuggacuacccucccggagguguggagccaaauucugggcuccaggugguccccuccccagccggcucccuccccacgccgggccugcgagaagaugcgcacccccagacacagcagcgccucugaacuucaagggagagugcagaguuuguguuucugcguuuccccacuuccuucccuccucugcuccggggucgcagcuccgacggggcagguggcgcugggacagagcucccccacaccagcucucaggaagcaccuucgugccggccgucgccgguggcgauacucacacggcgaagugguaaacgaagcauuuccagccggugggacgcucgaggaaguuguagacgcggcccuggacgugggugcgcgccaacaccgggcggcgcgugcuguagauggagacgcgcgggucuaggcucaccggcggccgcgggccaaggucggaggcaacugggggcgcggcgggcgcggccggggacgcagggggcgcgggaccuggggcgccgggcgcgaugggcgcguagagcgcgccgcccgccgggccgcccuccgccagcuccagcgagaaggggcacuucuuggccaggcccgcgcugccccgccgggcgccuggcaggcggccccaaccccagcgcuuccucucggcccugggcggggaggaggccgcggccauaacgaggagggccugccggggggccggcccgagcggcggcaccgggagcugcagcgaaggcgagcgcccgggcgcagugcgggcagccacugcugccagccccgccgcggggggccgcugccggcccagcccgggcgcucggggcggggccggagggggcaguggccgagggccggucccaugggacggcgugccccgcccccgccugcacgccccgcccccgccgguccggcgcgcacagggcgucccugcccgcgcccaccggcuuggcccgcccucuccccacggaccggccuggcccugccuccgccucacccccuggcuuggccuguccgcgcccccgcccccgccugcgcccccgcccccacccccacccccgcccgagcccaccugcuuagccccgcucgugucaucuaucccg

SEQ ID NO: 19673 - RNA, 2437 nt, Homo sapiens
gguucccucggggcucuuugggcucuaaacugcgaggagaggggcggucagcaaagccggcggggacccggcgggucggcccuccgcgcccccccaggugcgcuguacucacuuggcucaccgcagccucuugcgcggggucugcuccaccgagcccacgccaggggcggcgcuuggagagggacacggcgcggggacaucgcccgacgacuucucaggcgcugaucucuugcgcuuggcgaagaaaucugcgggcgacagcgcgcgcggccggucagggcggggccggcccggagacccgagagggggccgggagagggcgcggggcgcgggccggccggggugggggcgccguccccgcccgcgccgagguccgcggcgggucagcuuuguuuacgucgccgcgcaaugugcuguguaagcauuuccccuugucccgcggccaagccccccggggccgccgccgcgcuuaacccccuccacgccgugcucacggcgcccggccgcgcccggggaggggcucccgcggccgggggcgaaaacugcgcucccggggggucgcggccgggauucagccucccaccccgcccgcgcgaagccgcuggagggcacaacaacggggcggggagggggguaagggcgcagccgcgcccugagcgcugcgggcccuuuaaugccacgggaggaggcgggaacccagcgaggcccccgagggcuggggggaccggccggccggacaaagcggggccgggccgggccggggcggggccgugcggggcucaccggagaucagaggcccggacagcuucuugaucgccgcgccguuggcgcuggcggccgcggugccggccgcgggacgucccgaaauccccgagugcagcuggucagcgagaggcuccuggccgcgcugccccugguucgcgcccugcucggcgcucucuugaggcgccgcguccggggccggggccggggcgggggccggggccggggccggggccggggcuggggccggggccgcgacuggagccggggccggagccggagccggagccggggccggggccggggccaggaccgcgaccgcgaccggagccgcgaccggagccgcgaccggagccggagccggggccggggcuggagccaggaccgggacugggggcgggguggacgccggggccgggaccgggacacuaggcagcugcuccggcgccuccucgaggccgucgagggacucagcggccggcucgaggggcgggcugacagccaccgcgaccgcgacgggccgcggcgccagcagcaggcggcagcgccccaccugcaccgucucgcgguagaacgcgggcaccgagucgcuguccacuucgguccacugcaggcguccagggccccgcagcggcauguccugcuggaagucguaaucccagcgguucugguccucggcguucagcucggccaggcgggccugcagcucgcggcucagcuccucgugguccaccggcccgaagaggcugcggcaggcgcuggugcgcacuaguacugggaaggucccacgggcgacaagacgcuccaucguggaugugcugcggagggacgcgucggacauggcccggggcugcgcaaacgcgggcagcgagagaggagaggacagcgagaagaaggggaaaggagaggaggagagggcggaggccgggcgcaagggagaccccgcgccgcccgacucugcgugugcgagggacgcggcggcuaccuggcuguccggugguggacucuucugcgucggguucgccugucucguccggacggcagccgcgcccccucgaugccugcuggcuagcucgcucgcucaggccuggccggcaccccucgagcacagcgcacuuggccuguggaacgcccagcccgccugcgcccccuuuauacgcgcgggccccacccccgugcgcgcgggcccggccgcgauuagcauaauguaguauuuucaguuucaacaacaccacggcgauuggcggccgccccgcugccccgccccgccgcggcccggcccccgcgcaccgcccauuggccgcgcgcacacccaccgggggcggggcggggcgcgcggccggggcgcgcggcugauuggcggccgcggggcgagcgcgcuguagcaggggaagggggcggugagcggggcgggggcgggaguuaaagggcgcugcgggcgguaacgugacaccgcgacgcccgcccccucgccccauccccccugcaacacucccccacccccccggcucccgccccccgccggcuccuuugucugcaggcgggggccucagcccagcgcggcaggggccggcuccuggcggguccgguguccggccaggcccaacucgaccccggcccgguccggaccccggcgcccagcuccgucccgcgcucgcccgugggccuccugcgc

SEQ ID NO: 19674 - RNA, 2437 nt, Homo sapiens
gcgcaggaggcccacgggcgagcgcgggacggagcugggcgccgggguccggaccgggccggggucgaguugggccuggccggacaccggacccgccaggagccggccccugccgcgcugggcugaggcccccgccugcagacaaaggagccggcggggggcgggagccgggggggugggggaguguugcaggggggauggggcgagggggcgggcgucgcggugucacguuaccgcccgcagcgcccuuuaacucccgcccccgccccgcucaccgcccccuuccccugcuacagcgcgcucgccccgcggccgccaaucagccgcgcgccccggccgcgcgccccgccccgcccccggugggugugcgcgcggccaaugggcggugcgcgggggccgggccgcggcggggcggggcagcggggcggccgccaaucgccgugguguuguugaaacugaaaauacuacauuaugcuaaucgcggccgggcccgcgcgcacggggguggggcccgcgcguauaaagggggcgcaggcgggcugggcguuccacaggccaagugcgcugugcucgaggggugccggccaggccugagcgagcgagcuagccagcaggcaucgagggggcgcggcugccguccggacgagacaggcgaacccgacgcagaagaguccaccaccggacagccagguagccgccgcgucccucgcacacgcagagucgggcggcgcggggucucccuugcgcccggccuccgcccucuccuccucuccuuuccccuucuucucgcuguccucuccucucucgcugcccgcguuugcgcagccccgggccauguccgacgcgucccuccgcagcacauccacgauggagcgucuugucgcccgugggaccuucccaguacuagugcgcaccagcgccugccgcagccucuucgggccgguggaccacgaggagcugagccgcgagcugcaggcccgccuggccgagcugaacgccgaggaccagaaccgcugggauuacgacuuccagcaggacaugccgcugcggggcccuggacgccugcaguggaccgaaguggacagcgacucggugcccgcguucuaccgcgagacggugcagguggggcgcugccgccugcugcuggcgccgcggcccgucgcggucgcgguggcugucagcccgccccucgagccggccgcugagucccucgacggccucgaggaggcgccggagcagcugccuagugucccggucccggccccggcguccaccccgcccccagucccgguccuggcuccagccccggccccggcuccggcuccggucgcggcuccggucgcggcuccggucgcggucgcgguccuggccccggccccggccccggcuccggcuccggcuccggccccggcuccagucgcggccccggccccagccccggccccggccccggccccggcccccgccccggccccggccccggacgcggcgccucaagagagcgccgagcagggcgcgaaccaggggcagcgcggccaggagccucucgcugaccagcugcacucggggauuucgggacgucccgcggccggcaccgcggccgccagcgccaacggcgcggcgaucaagaagcuguccgggccucugaucuccggugagccccgcacggccccgccccggcccggcccggccccgcuuuguccggccggccgguccccccagcccucgggggccucgcuggguucccgccuccucccguggcauuaaagggcccgcagcgcucagggcgcggcugcgcccuuaccccccuccccgccccguuguugugcccuccagcggcuucgcgcgggcggggugggaggcugaaucccggccgcgaccccccgggagcgcaguuuucgcccccggccgcgggagccccuccccgggcgcggccgggcgccgugagcacggcguggaggggguuaagcgcggcggcggccccggggggcuuggccgcgggacaaggggaaaugcuuacacagcacauugcgcggcgacguaaacaaagcugacccgccgcggaccucggcgcgggcggggacggcgcccccaccccggccggcccgcgccccgcgcccucucccggcccccucucgggucuccgggccggccccgcccugaccggccgcgcgcgcugucgcccgcagauuucuucgccaagcgcaagagaucagcgccugagaagucgucgggcgauguccccgcgccgugucccucuccaagcgccgccccuggcgugggcucgguggagcagaccccgcgcaagaggcugcggugagccaagugaguacagcgcaccugggggggcgcggagggccgacccgccggguccccgccggcuuugcugaccgccccucuccucgcaguuuagagcccaaagagccccgagggaacc

SEQ ID NO: 19675 - RNA, 3053 nt, Homo sapiens
ggaggggcggguaggggaccuuucagagccaggagggcuuucgggggcguggggcgcgcugcggagcggagccgcggcucgacggcggugcgcuggcggcgaguguaugcagacggcgcccggcccgaaccccgagccccgcggggcuccccacccgccggccucccgccccucccgcgccuccgccuggggaccacgucggccuuuuguuggcgaaccguccuuucuuucagcgcuuugcgcagcaacggaaauuucauugcuccuggguggaaauuaaagggacucgcguucccucucucccucucccucucccacucucccucucuuucucucucucgcccacccuucccccuucuucccccaccuuucccgcgaagccggagucagcaucuccaggcgcgggaucccgcuccgagcaccucgcagcuguccggcugccgccccuuccaugggcgccgcgcucgccugcagccgccgccgccgcggggcgggcgcgaugccacgaugggccuaaucuggcugcuacugcucagccugcuggagcccggcuggcccgcagcgggcccuggggcgcgguugcggcgcgaugcgggcggccguggcggcgucuacgagcaccuuggcggggcgccccggcgccgcaagcucuacugcgccacgaaguaccaccuccagcugcacccgagcggccgcgucaacggcagccuggagaacagcgccuacagugagugccggacgcugcggggccccgggggaagcggcgccgggaggggucgggcccgggagaaggcgcgcugcggggccccgcgggggaggcggcgccggggaggggucuggcccgggagaaggcauggugcgcccgggguguccgggaaaagaccgucugccucccgcugccagaaggggaaugccagggugcccuccucaaccuacacguccgggagaagagcgcgcgcugggguucgagcagaacucgggggcaugggcguucacguccgaagagggcgccggcggcugucagaguccguccccgguccggcccgcuggucugaggggacgcgagcuaggcgaccccggggcuccaggcucugcugcuuugggcagcucugacaaguuuaagcccuuugaaugugucggagaaaaggagccggacaaggcauuuaucauccucuuuauuauuuugacgacuucuccuccuccugccgaccccuggacgccccgccguccccuccgcccuccccgcucgcggcugcccagguggccgcccccgcugcugccucugcgcggaggacucuugcccugcggagcucgguucccuggccgcggccgccaccgacaguuauuccccgcgcuggaaucugcaccucccccgccuccgcccuggccgcacagcgacaggaggguggaggcccucgccgucgggacgugcggaucacgagcgcggaacgguguccgcccgggccugggggugcagacacacacacuccggcccccgcacgcaggacccgcggcccgggcugcgcucaccgcgggagucugccggacuacacgguugggcuccucuggucacagggaccugaggcccgcgccgagcccuuugaggagcaggauagcggagcucagggcccgggaggaccgcguggggagcgugggagggcagucaagaccacagcuguccucgggugcuccgcgcggcgcucggcuccggccccgggcgcaggaagcgguuccgccgcuugaagguggcggcggcggccucagcaaaccgcggcuuccuccaggaaagccgcagcccugagagggcguccuggggacaugcgccuccggagccgcacggugggcaccagcugucaccaggggguccgagugcgcggaauucgucucacuaagacacuccgguucucuccaaagccaggcucccccucggagucgcacagcauccaaacuucuugguguaggcugcucacggggaggggagggcgcgcgcccgcagccgccccuguccugcgucgagacucgugcuucgcugguccccggucaggcaccgccgaugccgcccagccugcgcacugggaaggcgggaggcucgcagccugcaccacagcaccccugggcuggagcaaaagcccgguggugaccgcgucugugcucggaccgcgugccaggagggcgcuccugagaggcaugccuuggagagggugcaggcagucgccccaauccccucgcagccucuauugggagacaaugaccccaacccguccuuugauguagucccccgcccccagcccccaccacagcacucguguauccagaaggaaaggcgggaggggagauuuaaacuuucuuaucccuggggagugggugagacccguccagcuucccucugcgggcuccagggucuaaacuggcuuccugcccuuccaggucccccggcgaguacaaugaucucccgccaggucuauugccagcaugaucuggguggcaggcacccuggcuguguuauugccagugguuuauauuaucagccuggcucaucagggcccagcuuucccgcuggcaggcacaggcauuggggaccgugcagucccagagcucagacucccauggcugccgccagggcuugauuucccgcucaagcacaugugcaggggccugacagucacccagccauagugguccccacuugcuugucugucggaugaugauggcagcuggcaagguguugugaggcucgaaugaaagccagggugcaggcagcgucagcaggugggaauguuaauuucauuguuacccucccaaguuugaaugaagagaagccuucccugauguucccuucucuaccuccuguccggugacuucucccuuccugaacuuccacucacuccccgaccuguggggugugugcuacccuccccagcccugagcccgggguguggcuuugggcagggccagcugggccucagccgcccccuccgugggggcggcgggagugaggcaccucucauuucuucuagguauuuuggagauaacggcaguggaggugggcauug

SEQ ID NO: 19676 - RNA, 3053 nt, Homo sapiens
caaugcccaccuccacugccguuaucuccaaaauaccuagaagaaaugagaggugccucacucccgccgcccccacggagggggcggcugaggcccagcuggcccugcccaaagccacaccccgggcucagggcuggggaggguagcacacaccccacaggucggggagugaguggaaguucaggaagggagaagucaccggacaggagguagagaagggaacaucagggaaggcuucucuucauucaaacuugggaggguaacaaugaaauuaacauucccaccugcugacgcugccugcacccuggcuuucauucgagccucacaacaccuugccagcugccaucaucauccgacagacaagcaaguggggaccacuauggcugggugacugucaggccccugcacaugugcuugagcgggaaaucaagcccuggcggcagccaugggagucugagcucugggacugcacgguccccaaugccugugccugccagcgggaaagcugggcccugaugagccaggcugauaauauaaaccacuggcaauaacacagccagggugccugccacccagaucaugcuggcaauagaccuggcgggagaucauuguacucgccgggggaccuggaagggcaggaagccaguuuagacccuggagcccgcagagggaagcuggacgggucucacccacuccccagggauaagaaaguuuaaaucuccccucccgccuuuccuucuggauacacgagugcuguggugggggcugggggcgggggacuacaucaaaggacggguuggggucauugucucccaauagaggcugcgaggggauuggggcgacugccugcacccucuccaaggcaugccucucaggagcgcccuccuggcacgcgguccgagcacagacgcggucaccaccgggcuuuugcuccagcccaggggugcuguggugcaggcugcgagccucccgccuucccagugcgcaggcugggcggcaucggcggugccugaccggggaccagcgaagcacgagucucgacgcaggacaggggcggcugcgggcgcgcgcccuccccuccccgugagcagccuacaccaagaaguuuggaugcugugcgacuccgagggggagccuggcuuuggagagaaccggagugucuuagugagacgaauuccgcgcacucggacccccuggugacagcuggugcccaccgugcggcuccggaggcgcauguccccaggacgcccucucagggcugcggcuuuccuggaggaagccgcgguuugcugaggccgccgccgccaccuucaagcggcggaaccgcuuccugcgcccggggccggagccgagcgccgcgcggagcacccgaggacagcuguggucuugacugcccucccacgcuccccacgcgguccucccgggcccugagcuccgcuauccugcuccucaaagggcucggcgcgggccucaggucccugugaccagaggagcccaaccguguaguccggcagacucccgcggugagcgcagcccgggccgcggguccugcgugcgggggccggagugugugugucugcacccccaggcccgggcggacaccguuccgcgcucgugauccgcacgucccgacggcgagggccuccacccuccugucgcugugcggccagggcggaggcgggggaggugcagauuccagcgcggggaauaacugucgguggcggccgcggccagggaaccgagcuccgcagggcaagaguccuccgcgcagaggcagcagcgggggcggccaccugggcagccgcgagcggggagggcggaggggacggcggggcguccaggggucggcaggaggaggagaagucgucaaaauaauaaagaggaugauaaaugccuuguccggcuccuuuucuccgacacauucaaagggcuuaaacuugucagagcugcccaaagcagcagagccuggagccccggggucgccuagcucgcguccccucagaccagcgggccggaccggggacggacucugacagccgccggcgcccucuucggacgugaacgcccaugcccccgaguucugcucgaaccccagcgcgcgcucuucucccggacguguagguugaggagggcacccuggcauuccccuucuggcagcgggaggcagacggucuuuucccggacaccccgggcgcaccaugccuucucccgggccagaccccuccccggcgccgccucccccgcggggccccgcagcgcgccuucucccgggcccgaccccucccggcgccgcuucccccggggccccgcagcguccggcacucacuguaggcgcuguucuccaggcugccguugacgcggccgcucgggugcagcuggaggugguacuucguggcgcaguagagcuugcggcgccggggcgccccgccaaggugcucguagacgccgccacggccgcccgcaucgcgccgcaaccgcgccccagggcccgcugcgggccagccgggcuccagcaggcugagcaguagcagccagauuaggcccaucguggcaucgcgcccgccccgcggcggcggcggcugcaggcgagcgcggcgcccauggaaggggcggcagccggacagcugcgaggugcucggagcgggaucccgcgccuggagaugcugacuccggcuucgcgggaaaggugggggaagaagggggaagggugggcgagagagagaaagagagggagagugggagagggagagggagagagggaacgcgagucccuuuaauuuccacccaggagcaaugaaauuuccguugcugcgcaaagcgcugaaagaaaggacgguucgccaacaaaaggccgacgugguccccaggcggaggcgcgggaggggcgggaggccggcggguggggagccccgcggggcucgggguucgggccgggcgccgucugcauacacucgccgccagcgcaccgccgucgagccgcggcuccgcuccgcagcgcgccccacgcccccgaaagcccuccuggcucugaaagguccccuacccgccccucc

SEQ ID NO: 19677 - RNA, 3776 nt, Homo sapiens
cgcggcuuccauuguuuccccgccggccgagagcgcgcccggccccccgucggggggcaauuuacccggauaaaaggggcggggcaggaauugcaagaagaugaagcugaaagaaccugagacugucggaacugccggggaaaauucuacgggacggcuuugacgucagaugugcggggcugcgaaagucgggggagggagugcgagugggcuuuuaaggggaagggcacuaaggccgaggugaggcuuuucccgacagagggugaagggggcaaaacucggugccccccaaccucuggccccgggguuccugaccccgcccccgcuagugccccacgccgagugcauccacugggagccugaggccugggggaagggccccaguugucgauugcuuuacaaagucaaacucucccagccaagaaccucggggccgcugcgcgguggggaggaguuccccgaaacccggccgcuaagcgaggccuccuccucccgcagauccgaacggccugggcggggucaccccggcugggacaagaagccgccgccugccugcccgggcccggggagggggcuggggcuggggccggaggcggggugugagugggugugugcggggggcggaggcuugaugcaaucccgauaagaaaugcucgggugucuugggcaccuacccguggggcccguaaggcgcuacuauauaaggcugccggcccggagccgccgcgccgucagagcaggagcgcugcguccaggaucuagggccacgaccaucccaacccggcacucacagccccgcagcgcaucccggucgccgcccagccucccgcacccccaucgccggagcugcgccgagagccccagggaggugccaugcggagcggguguguggugguccacguauggauccuggccggccucuggcuggccguggccgggcgcccccucgccuucucggacgcggggccccacgugcacuacggcuggggcgaccccauccgccugcggcaccuguacaccuccggcccccacgggcucuccagcugcuuccugcgcauccgugccgacggcgucguggacugcgcgcggggccagagcgcgcacagugagugcccgccagcacccccgcccgccccgccgcgcgcaccccaccccgcugcgcgcgccccaccccagcgcccuuccuuccuuugccacccuuaggcuccugcggaccccucaacuccugggaaccccagguuuuggcaccuggacguuaggaucccuccguuaguccccaaacagcgcgggacgcuagggagaagcacaggcuuguggaccgaccgcacccacguggugcgggcccagcgguccuugcugcagcuucucgcuuccccugcgccuagguuugcuggagaucaaggcagucgcucugcggaccguggccaucaagggcgugcacagcgugcgguaccucugcaugggcgccgacggcaagaugcaggggcugguaaguguccccacggggcggaugcgccggggcgggggaccggcgccuguccccgggcggaggccugaaggagagaaaggcgcugguucgaauccaggguuuccucgccuccuccgcccagacccgcgugcaacuucgagggaaagauugcaaagaccgauuaagugcauguccgacgauuuccuacggaaauuuagggucucagccagcagccagagaauaggcaaaagcugccuuugcauuuccaauugagucaaaggccggccuagccggaccgaggaaacccauuauucggccuccuuugauauuaaacaggaaaacccaccucgggccuuuucagccucugccugcgcgugugugguccucgccuccguuucccucccuccaguauaaaagaagaaaaaaagaaugggaaagaaaaaagaggaucuacccauaacuuuccuuuaaaaacaaaucaauugucaagcaaggcagaaaacagugcauuugggauaggagagauuuuuuuuuuagaauuaauuuuuaaucuaccaggagcacgguguggcuuagacgcagaugcgcuggagucauguugcgccaggggagugcuuuuccuccugcgggccucaccuguccuguaaacgcuuucuggugggggcagggggugggggcuggcagggaaggcccagguaaccgcagaggucccggggccggaaguguacgagcgcuggggcucugguggccgggaacaaaggcugggaguucaaaggaacgaacccgcgccccucccgcggccccgcgcgcagaggaggcugugugaggucucggcccgcgcaggccucacacgcagccccggacucccuggcggagcaggggccagggcggggguggccgcgccugcccggggcccccaccccagaaaggaugcagaggcggggccgccuccggcccaaccagcuccuuugugaacagcgggacaaagcauuuuagagucucaaaauugcucggugccucugccgugcuccguguacucggagcgccuguuucagguuuuauggcggaguccugcgugagaggacugcagagaaaggggguggucggcacgcuggacgcugacucccacccagagccgcuccaaacccacccuugcaacuuuaauuuugacauuuacuauggcaggggguguggggguuccuaaugaugggaggccagcaggggacgucaaccuaacccgccauucugcccaaauuggggguugggucaccugaaaucccucugugccuuuuuuuuuuuuuuuuuuuuuuuuuuuuggcagagucuugcucugucgcccaggcuggaaugcaguggccagaucucggcucacugcaaccugugccucccagguucaagcguuucugcuaccucagccucccauggagcugggauuacagguacccaccaccaagcccagcuaccuuuuguauuuuggguagagaugggguuucaccauguugguggccaggcuggucuugaacucccgaccucaagugauccggccgucucggccucccaaagugcuuugggauuagaggugugagccaccgcgcccagcccccuuugugccucuugauccccugugcauggucuaacagaaauugaggaucuuuuuuuuuuuuuuuuuuuuuuugagacggagucucgcuugcucugucgcccaggcuggaguacagugguaugaucuuggcucacugcaaccuccaccugcgggguucaagcaauucuccugccucagccucccaaguagcugggauuacgggcaccgugccaccaugaccggcuaguuuuuuuguauuuuuaguagagaugagguuucaccauccuggccaggcuggucucgaacuccugacaucacgaucugccugccucagccgcccaaagugcugggauuacaggcaugagccaccucgccuggccucuuucuuaaauaaaaaugccacauucuucuagaaacuugaagucauuucguuuucuguauggagaaagugauacuaauuucucccaaaggacaagccaaguaaauagaagaagguccuccaaucauucgguuuuguguuccuuguuuauugaucauuuggcauuuuugggaguuugggagaaaucacgcuugcuguccgaugcuuugucccagccauccgugggcucggcaggagccuggguugcugcaaugagccucuuaucaggagcuuauuagcacagguaccucgucacccaccugcaguucagugaccuuugcagacuuaggcaggaaccugacugaggc

SEQ ID NO: 19678 - RNA, 3776 nt, Homo sapiens
gccucagucagguuccugccuaagucugcaaaggucacugaacugcaggugggugacgagguaccugugcuaauaagcuccugauaagaggcucauugcagcaacccaggcuccugccgagcccacggauggcugggacaaagcaucggacagcaagcgugauuucucccaaacucccaaaaaugccaaaugaucaauaaacaaggaacacaaaaccgaaugauuggaggaccuucuucuauuuacuuggcuuguccuuugggagaaauuaguaucacuuucuccauacagaaaacgaaaugacuucaaguuucuagaagaauguggcauuuuuauuuaagaaagaggccaggcgagguggcucaugccuguaaucccagcacuuugggcggcugaggcaggcagaucgugaugucaggaguucgagaccagccuggccaggauggugaaaccucaucucuacuaaaaauacaaaaaaacuagccggucaugguggcacggugcccguaaucccagcuacuugggaggcugaggcaggagaauugcuugaaccccgcagguggagguugcagugagccaagaucauaccacuguacuccagccugggcgacagagcaagcgagacuccgucucaaaaaaaaaaaaaaaaaaaaaaagauccucaauuucuguuagaccaugcacaggggaucaagaggcacaaagggggcugggcgcgguggcucacaccucuaaucccaaagcacuuugggaggccgagacggccggaucacuugaggucgggaguucaagaccagccuggccaccaacauggugaaaccccaucucuacccaaaauacaaaagguagcugggcuuggugguggguaccuguaaucccagcuccaugggaggcugagguagcagaaacgcuugaaccugggaggcacagguugcagugagccgagaucuggccacugcauuccagccugggcgacagagcaagacucugccaaaaaaaaaaaaaaaaaaaaaaaaaaaaggcacagagggauuucaggugacccaacccccaauuugggcagaauggcggguuagguugacguccccugcuggccucccaucauuaggaacccccacacccccugccauaguaaaugucaaaauuaaaguugcaaggguggguuuggagcggcucugggugggagucagcguccagcgugccgaccacccccuuucucugcaguccucucacgcaggacuccgccauaaaaccugaaacaggcgcuccgaguacacggagcacggcagaggcaccgagcaauuuugagacucuaaaaugcuuugucccgcuguucacaaaggagcugguugggccggaggcggccccgccucugcauccuuucuggggugggggccccgggcaggcgcggccacccccgcccuggccccugcuccgccagggaguccggggcugcgugugaggccugcgcgggccgagaccucacacagccuccucugcgcgcggggccgcgggaggggcgcggguucguuccuuugaacucccagccuuuguucccggccaccagagccccagcgcucguacacuuccggccccgggaccucugcgguuaccugggccuucccugccagcccccacccccugcccccaccagaaagcguuuacaggacaggugaggcccgcaggaggaaaagcacuccccuggcgcaacaugacuccagcgcaucugcgucuaagccacaccgugcuccugguagauuaaaaauuaauucuaaaaaaaaaaucucuccuaucccaaaugcacuguuuucugccuugcuugacaauugauuuguuuuuaaaggaaaguuauggguagauccucuuuuuucuuucccauucuuuuuuucuucuuuuauacuggagggagggaaacggaggcgaggaccacacacgcgcaggcagaggcugaaaaggcccgagguggguuuuccuguuuaauaucaaaggaggccgaauaauggguuuccucgguccggcuaggccggccuuugacucaauuggaaaugcaaaggcagcuuuugccuauucucuggcugcuggcugagacccuaaauuuccguaggaaaucgucggacaugcacuuaaucggucuuugcaaucuuucccucgaaguugcacgcgggucugggcggaggaggcgaggaaacccuggauucgaaccagcgccuuucucuccuucaggccuccgcccggggacaggcgccggucccccgccccggcgcauccgccccguggggacacuuaccagccccugcaucuugccgucggcgcccaugcagagguaccgcacgcugugcacgcccuugauggccacgguccgcagagcgacugccuugaucuccagcaaaccuaggcgcaggggaagcgagaagcugcagcaaggaccgcugggcccgcaccacgugggugcggucgguccacaagccugugcuucucccuagcgucccgcgcuguuuggggacuaacggagggauccuaacguccaggugccaaaaccugggguucccaggaguugagggguccgcaggagccuaaggguggcaaaggaaggaagggcgcugggguggggcgcgcgcagcgggguggggugcgcgcggcggggcgggcgggggugcuggcgggcacucacugugcgcgcucuggccccgcgcgcaguccacgacgccgucggcacggaugcgcaggaagcagcuggagagcccgugggggccggagguguacaggugccgcaggcggauggggucgccccagccguagugcacguggggccccgcguccgagaaggcgagggggcgcccggccacggccagccagaggccggccaggauccauacguggaccaccacacacccgcuccgcauggcaccucccuggggcucucggcgcagcuccggcgaugggggugcgggaggcugggcggcgaccgggaugcgcugcggggcugugagugccggguugggauggucguggcccuagauccuggacgcagcgcuccugcucugacggcgcggcggcuccgggccggcagccuuauauaguagcgccuuacgggccccacggguaggugcccaagacacccgagcauuucuuaucgggauugcaucaagccuccgccccccgcacacacccacucacaccccgccuccggccccagccccagcccccuccccgggcccgggcaggcaggcggcggcuucuugucccagccggggugaccccgcccaggccguucggaucugcgggaggaggaggccucgcuuagcggccggguuucggggaacuccuccccaccgcgcagcggccccgagguucuuggcugggagaguuugacuuuguaaagcaaucgacaacuggggcccuucccccaggccucaggcucccaguggaugcacucggcguggggcacuagcgggggcggggucaggaaccccggggccagagguuggggggcaccgaguuuugcccccuucacccucugucgggaaaagccucaccucggccuuagugcccuuccccuuaaaagcccacucgcacucccucccccgacuuucgcagccccgcacaucugacgucaaagccgucccguagaauuuuccccggcaguuccgacagucucagguucuuucagcuucaucuucuugcaauuccugccccgccccuuuuauccggguaaauugccccccgacggggggccgggcgcgcucucggccggcggggaaacaauggaagccgcg

SEQ ID NO: 19679 - RNA, 2335 nt, Homo sapiens
acagagacacagagaaaggaacagagaugggaagacagggacagagacagagaaugaacagagauagagagauagggacggagagagacagagagagggacagggauggagagaaagagauagggccagggccacagagggacugagacaggcccaggaggagacuagggauggggccagggcugcgugcgggcggggcacggugcagacaaaggcgcggccgcgcggucgggguggccuggccggggacaaaggccugcccggggggcgggggcagcgauggcgacggccgcggcgggcgcgggcgaacuacaagucccagcagcucccgcugcggcccucggccggccccucucgcuccccgggagcgccuggcggggccgcugggccgagggggccgccggcggggcuggcgggcggggggcuuccugcgggcccggggggagccggcggccggcgcgggcgcggcgggccgggcaggggcgaggggcgccgggugagugucccugcgagcgggcuggggccggggcggggggcuggguggggggcgggcgggcgggggagcuccaggcgcggggcgcagcccggggcgaccucuaaucgucccccgcccugcgcgccgccggcccuggcccaggcgagcgggggucgcgggagcgauggggaggggacucugcggccagcuccggccuagcgcacccaucccgccgcuggggcccggggggaaagggccaggagguugggagccuucaaucgggcgggguggggggcgcccgccagcucuggggucuggagcucaggacgcccccucccuaggaggcgauccaggacccccuccccuccugauucgagguauuguucccaccucccgccuggggucuggaguucaggaggcccuguccucaaaagggggaccuagggguucccucuucccccaggacccuaggaagggucccagcgauuguucccuugccccuccagucuuggggucugcaguucuggaagcuccuuucccuggaggugauccagggguccaccugcccucaccccugggaacucaggaaagacuuaagugauuucuccucccaccuuccaguuaagagaugggaauucagggggcuccuuccccuggaggcaaucuaaggguuccucugccccugaugcaggaggggucccaggucuuguuucccccacucuccaacuauggggucuggguugaggaccgccguccaggaacucggcucuguuugccugcacacucccagcuaugggguuguggcucaguguauuccuuuccccagaaggggagccacagguccccccacagcuucucccaggagcagaucauucauuguugacaccucaacacccagccaugggguggggagcucaaggcauccucccggcaggucauccugggcucccauugcuccccagaagugguuccagcuuuugucccucuaccucccagucugccccuagccacaagcuggcaauucaguucaggauccuuccugcaggaagggcuacaagugugcugacacuacccgccaugucccagccaugggaggagaugacucaggcguucccccauuaacuucagaggguccccagguauuauuuuugccuauccuccagcuagaaguuaaaaugcaggaccuucuagccaauagggaaaacagguauacuggccgggcaugguggcucaugccuguaaucaccauacuuugggaggcugaggugggaggaucauuugagcccaggaguuugaguccagccugggcaacauaccaagaccccaucucaaacauaaauaaauaaauaaaacagguauacuaacaacuguccccaccauccugccuaugggguucaugagucucccuacccaucccuccucaccaggaggggucccaaauaucacucuaccaugcucacuaucuggcuguaggaaagggcauuuccgaucugucuaagagagaggauuugacacugacucccaccuggagcugugagcucuggaauucagguuuucuuuuccccagagggcaagccagagucuucuugucuuuccccagugacuugggagggauaccugauguuauuuguuccauauucuuaucccccagacauggguucuagagcucagaaugcugcugcuggaggggggccucccuaccagaacucgcccccuaaauuaaucugccgccuccaaguaugggacaagaauucaggccaugugcucaggagcacagaaacgcugacacccacacuguuccccauguggggacgcccagcaaggggguaggaagcuaggacugucuccuccacaggaccc

SEQ ID NO: 19680 - RNA, 2335 nt, Homo sapiens
ggguccuguggaggagacaguccuagcuuccuacccccuugcugggcguccccacauggggaacagugugggugucagcguuucugugcuccugagcacauggccugaauucuugucccauacuuggaggcggcagauuaauuuagggggcgaguucugguagggaggccccccuccagcagcagcauucugagcucuagaacccaugucugggggauaagaauauggaacaaauaacaucagguaucccucccaagucacuggggaaagacaagaagacucuggcuugcccucuggggaaaagaaaaccugaauuccagagcucacagcuccaggugggagucagugucaaauccucucucuuagacagaucggaaaugcccuuuccuacagccagauagugagcaugguagagugauauuugggaccccuccuggugaggagggauggguagggagacucaugaaccccauaggcaggaugguggggacaguuguuaguauaccuguuuuauuuauuuauuuauguuugagauggggucuugguauguugcccaggcuggacucaaacuccugggcucaaaugauccucccaccucagccucccaaaguauggugauuacaggcaugagccaccaugcccggccaguauaccuguuuucccuauuggcuagaagguccugcauuuuaacuucuagcuggaggauaggcaaaaauaauaccuggggacccucugaaguuaaugggggaacgccugagucaucuccucccauggcugggacauggcggguagugucagcacacuuguagcccuuccugcaggaaggauccugaacugaauugccagcuuguggcuaggggcagacugggagguagagggacaaaagcuggaaccacuucuggggagcaaugggagcccaggaugaccugccgggaggaugccuugagcuccccaccccauggcuggguguugaggugucaacaaugaaugaucugcuccugggagaagcuguggggggaccuguggcuccccuucuggggaaaggaauacacugagccacaaccccauagcugggagugugcaggcaaacagagccgaguuccuggacggcgguccucaacccagaccccauaguuggagagugggggaaacaagaccugggaccccuccugcaucaggggcagaggaacccuuagauugccuccaggggaaggagcccccugaauucccaucucuuaacuggaaggugggaggagaaaucacuuaagucuuuccugaguucccaggggugagggcagguggaccccuggaucaccuccagggaaaggagcuuccagaacugcagaccccaagacuggaggggcaagggaacaaucgcugggacccuuccuaggguccugggggaagagggaaccccuaggucccccuuuugaggacagggccuccugaacuccagaccccaggcgggaggugggaacaauaccucgaaucaggaggggaggggguccuggaucgccuccuagggagggggcguccugagcuccagaccccagagcuggcgggcgccccccaccccgcccgauugaaggcucccaaccuccuggcccuuuccccccgggccccagcggcgggaugggugcgcuaggccggagcuggccgcagaguccccuccccaucgcucccgcgacccccgcucgccugggccagggccggcggcgcgcagggcgggggacgauuagaggucgccccgggcugcgccccgcgccuggagcucccccgcccgcccgccccccacccagccccccgccccggccccagcccgcucgcagggacacucacccggcgccccucgccccugcccggcccgccgcgcccgcgccggccgccggcuccccccgggcccgcaggaagccccccgcccgccagccccgccggcggcccccucggcccagcggccccgccaggcgcucccggggagcgagaggggccggccgagggccgcagcgggagcugcugggacuuguaguucgcccgcgcccgccgcggccgucgccaucgcugcccccgccccccgggcaggccuuuguccccggccaggccaccccgaccgcgcggccgcgccuuugucugcaccgugccccgcccgcacgcagcccuggccccaucccuagucuccuccugggccugucucagucccucuguggcccuggcccuaucucuuucucuccaucccugucccucucucugucucucuccgucccuaucucucuaucucuguucauucucugucucugucccugucuucccaucucuguuccuuucucugugucucugu

SEQ ID NO: 19681 - RNA, 1850 nt, Homo sapiens
caagucucuauuuucccaucugugaaaugggcaugugcccucucugaggaccaauaauggcuuucacccaauuugugcccagugaccugcaagugcucccgcgccccaacucguguaaaauaaaagguuccagacucugugacgcuaacccuggcuuaggagacugggggagagggagcagguuaccugguggucccgcuggcacgcccugggcuagaaacagggccugggcugguguucuuggcaggaggagcucucuccccucucccagaggcugggggccuggaggcugcggggagaaggccgagucacaggugccccggagagguggcaguggaggugagacuggacagguauuggaagggggagggaagaugggggcggagcugaggaaggaggcugggguaccagguuucgggaacuugucccagcacuccgcguuggucccgcucggggagcagacucgggaauaguggccccgccgaugccccccgcucgcucugccagaggcuuucgccccacugcucccgcagcucccagaacucggagggcugcgggaguuacugggggagggggucgaggagagccugggggccugggggucagaaguccaggagcgcgagcagccggcguccgcgcggcggccccugccuucgccuugucucucuuguuguccaucuugcaccugaagagacaaaccgguccgcaucccagguucuggacagcuacgccgccuccagagaccuggacccugcuaccucacugcccuuucgcagcaucgccacccauggacacucaaaccucggccucggcuuccauccgcucggcucccacgcaccuacacccacucgccagccccacugcuccucgcuguccccaagucccaccccccaccgcuuuucccuaaagcgaagaggcccugcccgccccagcccaccgccucccccgccucggcuccaauucaggaccgaucuccacgccccugccccuugccccuucagggacucagaccgccagccucgagagcgggggacugccacgggcucaggaugucgcaucccuccagacccggagcgcacgcccgggucuccccgccagcccccaucggccuccccuggccuccccgagggaugccugcaccugccgggaggcagagcggccccgcugcccgcgaacgggcuccgggagacaaagagccgcgucccgggcccgaccccucccccagccgggccuggcccgcgcccagccucuccaccugcucgcgucgcgcucaccuccgccuccggccuccggccgcuccucacagagucgccugggguggggcccgggccggagcgacgcgguggccgccagcggcgaggaggcgaggggagggggcugcgggcugcggcgccgggggagccgagccggucccgccccucggccgcgggcgggagagccgggggcgcgcgcucgauccggacccgggagcgcggccggcggaagcgcgccgagggggaugggggagaagcgcgcuuuggagagaaggguggcuucucugcgguccgggggaagccuguuuccccagcugcgccugaggaacccagauagucaacgguugggacugggggagcaaaucccugggguccuccacuguccuucccaacacauacaccugccccgacccccaccacaaccaccuggcaccaaggaccgccuggacgcggauaggcugggcccuggcaaccaggaggcgggaccaccgcgccucuggcccacacaccaauccggccgcucgguggcccuggcacuauccaguccuucgcgucugcgaaagcuaggccgcccagggucucuggggggcagccgcc

SEQ ID NO: 19682 - RNA, 1850 nt, Homo sapiens
ggcggcugccccccagagacccugggcggccuagcuuucgcagacgcgaaggacuggauagugccagggccaccgagcggccggauuggugugugggccagaggcgcgguggucccgccuccugguugccagggcccagccuauccgcguccaggcgguccuuggugccaggugguuguggugggggucggggcagguguauguguugggaaggacaguggaggaccccagggauuugcucccccagucccaaccguugacuaucuggguuccucaggcgcagcuggggaaacaggcuucccccggaccgcagagaagccacccuucucuccaaagcgcgcuucucccccaucccccucggcgcgcuuccgccggccgcgcucccggguccggaucgagcgcgcgcccccggcucucccgcccgcggccgaggggcgggaccggcucggcucccccggcgccgcagcccgcagcccccuccccucgccuccucgccgcuggcggccaccgcgucgcuccggcccgggccccaccccaggcgacucugugaggagcggccggaggccggaggcggaggugagcgcgacgcgagcagguggagaggcugggcgcgggccaggcccggcugggggaggggucgggcccgggacgcggcucuuugucucccggagcccguucgcgggcagcggggccgcucugccucccggcaggugcaggcaucccucggggaggccaggggaggccgaugggggcuggcggggagacccgggcgugcgcuccgggucuggagggaugcgacauccugagcccguggcagucccccgcucucgaggcuggcggucugagucccugaaggggcaaggggcaggggcguggagaucgguccugaauuggagccgaggcgggggaggcggugggcuggggcgggcagggccucuucgcuuuagggaaaagcgguggggggugggacuuggggacagcgaggagcaguggggcuggcgaguggguguaggugcgugggagccgagcggauggaagccgaggccgagguuugaguguccauggguggcgaugcugcgaaagggcagugagguagcaggguccaggucucuggaggcggcguagcuguccagaaccugggaugcggaccgguuugucucuucaggugcaagauggacaacaagagagacaaggcgaaggcaggggccgccgcgcggacgccggcugcucgcgcuccuggacuucugacccccaggcccccaggcucuccucgacccccucccccaguaacucccgcagcccuccgaguucugggagcugcgggagcaguggggcgaaagccucuggcagagcgagcggggggcaucggcggggccacuauucccgagucugcuccccgagcgggaccaacgcggagugcugggacaaguucccgaaaccugguaccccagccuccuuccucagcuccgcccccaucuucccucccccuuccaauaccuguccagucucaccuccacugccaccucuccggggcaccugugacucggccuucuccccgcagccuccaggcccccagccucugggagaggggagagagcuccuccugccaagaacaccagcccaggcccuguuucuagcccagggcgugccagcgggaccaccagguaaccugcucccucucccccagucuccuaagccaggguuagcgucacagagucuggaaccuuuuauuuuacacgaguuggggcgcgggagcacuugcaggucacugggcacaaauugggugaaagccauuauugguccucagagagggcacaugcccauuucacagaugggaaaauagagacuug

SEQ ID NO: 19683 - RNA, 3601 nt, Homo sapiens
agggcagaccacaguguugggcagggacagacaggagggcauccccacucuacucaacuuccguugguucagcccaguucccgcccauggccagagcuugaagggagaagccguccccuccccguccucuccucccgcaacuccacucccagcaccugaaaacugcagucaccugugccuuggcugggcuuuaaggccaggugacugggccuugcgggguuagaaggagcccuuccgcacuuccucuuuuucuuuuuuuucuuuuggagacaggguccuucuugguggcccaggcuggagugcaguggcaugaucguagcucgcugcagccucucaacuucccagauucaggugauccuuccaccucggccuccagaguagcugggacuacaggcacacaccaccacaccuggcuaauuuuuaaaauuuuguuuuuguagguuuuaaaauuuuuuguagagauguggucccacuauauugcucaggcugguuucaaacuccuaggcccaagguauccuccugccucggccucccaaaguguuggauuacaggcgugagucacagagcccggccuccacauuuucucgacaggguccguaagaccugguucccagaaagguggccguagaauggcuuugggaguucagcguccccagcucccucaguuuccccagcugccaggguccagccagacugcaaaguugcaaaguucuaagaccccugcaucucccgccagccccgagcccaccagggcaaagcagccuaagacggcugucuucccccaacccugcugaucgcgcggcgccuggaguagggucgaccugggcgcgccugcggcgaggcggggccgagucguccgggggcggggcggggcggcuccgggucuccuguccccgccugcccugacucacccucgcggcccgcccgggaacucugcgggagucgcggcagcuccgcucccagagacccaggaguugggcccagcgucccucccggaacggugaguagguggcucuuugccucuggacaccccacgagguggcagggugggggucgggcugggaguccccgggucuggacaaggggcagagccgcuccaggugcgccggcccuguggccggggcaggccgucccgacacaccaggagcuggggugggggugccggccggugcaaagggaaaccuggcccacgaggugcccguccugggagccaggcagacgcggccaagucucagagugaagauaaacaggcugaagauaaacuugacuuugggggucucaaccacuuuccccuccccuuggcaucugggaagacauugacaacucauccccgggagacucucagagcuccagaaccuaccacuugggguggguucaaccaagccugaccucuggugcucuugaacuuacacaugucccagaucuucaagucugcuggcagaggcggcuuggaaaaccacucggcugggaauccgcaggccuggggccugacccaggacgggcuacaaagaugccacccucccccacccuagacccucaguuucucccuugcauaaaugguugaggcucagccggacaccgugccuuacgucuauaaucccagcacuuugggaggccgaggugggcaggucaccugaggucagguguuugagaccagccuggcuaacacggugaaaccccaucucuacuaaaaauacaaaaauuaguggcgugucccuguagucccagcuacuggggaggcugaggcuugaguacugcucggacccaagagguggagguugcagugaguugagauugggccacugcacuccagccugggcaacagagcgacacuccaucucaaaaaaaaaaaaagauugaggccaggcacaguggcucacaccuguaaucccagcacuuugggaggcugaggugggaggauugcuuggacucagaaguucaagaccagccugggcaacauagcgagacuccaucucuacaaaaaaucuaaaaguuggcugggcaugguagcacgcaccuguggucccagcuacuggggaggcugaggcaggaggaucacuugagcccaggaguucgagacuacuaugagcuaugaucgugccacugaacuccagccugggugacagagcaagacucuaucucucucucucucucuuuuuuuuuuuuucaagauagagucuugcucuguugccaggccggagcgcaguggcacgaucuuggcucacggcaaccuccaccucccagguucaagcgauucuccugccucagccuccugaguagcugggacuacaagcauguggcaccauacccagcuaaucuuuguauuuuuagagaugggguuucaucauguuggccaggauggucuugaucucuugaccucgugauccaccugccucaaccucucaaagugcugggauuacaggcgugauccacuguguccgucaggacucuaugucuaaaaaaaaaaaaagguugggccuuguuuucuacaaaaccccucuuagggcugaaaacugcuggauguuucuugcuucuucccugccucuuagcaugggcuguggguguggagggucucacucucccacccuucccccagcaggaacucaucaccacauuuuuuggaggcaaguggcuugaggaggaccugggagggaggaggggugaggcauggguggauggagccagggcuggugggagccacauggucucaggcuggaaagccuuccagccuggccugccacaaugcaacaccgcucuuaggugcuuuuggcaaagaugcugugguuuuuuuguuguuguuuguuuuuugagauagagucuugcucuguugcccaggcuggauugcaguggcgcaaucacggcucacugcaacuuccaccuccuggguucaagagauucuccugcuucagccgggcacgguggcgcacgccuguaaucccagcucuuugggaggccgaggcaggcagaucaugagaucaggagauugagaccauccuggcuaauacagugaaaccccgucucuacuaaaauuacaaaaaauuagccgggcgagguggcgggcgccuguagucccagcuacucgggaggcugaagcaggagaauggugugaacccgggaggcggagcuugcagugagccgagaucacaccacugcacuccagccugggcgacagagugagacucugucucaaaaaaaaaagagauucuccugcuucagcuuccccauuagcugggauuauaggugcccaccaccacuccagcuaauuuuguauuuuuaguagacaugggguuuuaccauguugggcuagccuggucucaaacuccugaccucaaaugaucugccuaccuuggccucccaaaguguugggauuacaggcgugagccaccgugccuggcaagaugcugcauuuuaauuagaggcugucucccaagagggaacagagcaguugcaauccuacaggcaggaccuggagguuggaugggucaggcuucgaaugccgcuuggaacuguagaagcuugagcaaguuauuucucuccccugagucuggaaagcaaagucuccgacauccacgcugccuggguugggauaaaaugaggcauu

SEQ ID NO: 19684 - RNA, 3601 nt, Homo sapiens
aaugccucauuuuaucccaacccaggcagcguggaugucggagacuuugcuuuccagacucaggggagagaaauaacuugcucaagcuucuacaguuccaagcggcauucgaagccugacccauccaaccuccagguccugccuguaggauugcaacugcucuguucccucuugggagacagccucuaauuaaaaugcagcaucuugccaggcacgguggcucacgccuguaaucccaacacuuugggaggccaagguaggcagaucauuugaggucaggaguuugagaccaggcuagcccaacaugguaaaaccccaugucuacuaaaaauacaaaauuagcuggagugguggugggcaccuauaaucccagcuaauggggaagcugaagcaggagaaucucuuuuuuuuuugagacagagucucacucugucgcccaggcuggagugcaguggugugaucucggcucacugcaagcuccgccucccggguucacaccauucuccugcuucagccucccgaguagcugggacuacaggcgcccgccaccucgcccggcuaauuuuuuguaauuuuaguagagacgggguuucacuguauuagccaggauggucucaaucuccugaucucaugaucugccugccucggccucccaaagagcugggauuacaggcgugcgccaccgugcccggcugaagcaggagaaucucuugaacccaggagguggaaguugcagugagccgugauugcgccacugcaauccagccugggcaacagagcaagacucuaucucaaaaaacaaacaacaacaaaaaaaccacagcaucuuugccaaaagcaccuaagagcgguguugcauuguggcaggccaggcuggaaggcuuuccagccugagaccauguggcucccaccagcccuggcuccauccacccaugccucaccccuccucccucccagguccuccucaagccacuugccuccaaaaaauguggugaugaguuccugcugggggaagggugggagagugagacccuccacacccacagcccaugcuaagaggcagggaagaagcaagaaacauccagcaguuuucagcccuaagagggguuuuguagaaaacaaggcccaaccuuuuuuuuuuuuuagacauagaguccugacggacacaguggaucacgccuguaaucccagcacuuugagagguugaggcagguggaucacgaggucaagagaucaagaccauccuggccaacaugaugaaaccccaucucuaaaaauacaaagauuagcuggguauggugccacaugcuuguagucccagcuacucaggaggcugaggcaggagaaucgcuugaaccugggagguggagguugccgugagccaagaucgugccacugcgcuccggccuggcaacagagcaagacucuaucuugaaaaaaaaaaaaagagagagagagagagauagagucuugcucugucacccaggcuggaguucaguggcacgaucauagcucauaguagucucgaacuccugggcucaagugauccuccugccucagccuccccaguagcugggaccacaggugcgugcuaccaugcccagccaacuuuuagauuuuuuguagagauggagucucgcuauguugcccaggcuggucuugaacuucugaguccaagcaauccucccaccucagccucccaaagugcugggauuacaggugugagccacugugccuggccucaaucuuuuuuuuuuuuugagauggagugucgcucuguugcccaggcuggagugcaguggcccaaucucaacucacugcaaccuccaccucuuggguccgagcaguacucaagccucagccuccccaguagcugggacuacagggacacgccacuaauuuuuguauuuuuaguagagaugggguuucaccguguuagccaggcuggucucaaacaccugaccucaggugaccugcccaccucggccucccaaagugcugggauuauagacguaaggcacgguguccggcugagccucaaccauuuaugcaagggagaaacugagggucuagggugggggaggguggcaucuuuguagcccguccugggucaggccccaggccugcggauucccagccgagugguuuuccaagccgccucugccagcagacuugaagaucugggacauguguaaguucaagagcaccagaggucaggcuugguugaacccaccccaagugguagguucuggagcucugagagucucccggggaugaguugucaaugucuucccagaugccaaggggaggggaaagugguugagacccccaaagucaaguuuaucuucagccuguuuaucuucacucugagacuuggccgcgucugccuggcucccaggacgggcaccucgugggccagguuucccuuugcaccggccggcacccccaccccagcuccuggugugucgggacggccugccccggccacagggccggcgcaccuggagcggcucugccccuuguccagacccggggacucccagcccgacccccacccugccaccucgugggguguccagaggcaaagagccaccuacucaccguuccgggagggacgcugggcccaacuccugggucucugggagcggagcugccgcgacucccgcagaguucccgggcgggccgcgagggugagucagggcaggcggggacaggagacccggagccgccccgccccgcccccggacgacucggccccgccucgccgcaggcgcgcccaggucgacccuacuccaggcgccgcgcgaucagcaggguugggggaagacagccgucuuaggcugcuuugcccuggugggcucggggcuggcgggagaugcaggggucuuagaacuuugcaacuuugcagucuggcuggacccuggcagcuggggaaacugagggagcuggggacgcugaacucccaaagccauucuacggccaccuuucugggaaccaggucuuacggacccugucgagaaaauguggaggccgggcucugugacucacgccuguaauccaacacuuugggaggccgaggcaggaggauaccuugggccuaggaguuugaaaccagccugagcaauauagugggaccacaucucuacaaaaaauuuuaaaaccuacaaaaacaaaauuuuaaaaauuagccaggugugguggugugugccuguagucccagcuacucuggaggccgagguggaaggaucaccugaaucugggaaguugagaggcugcagcgagcuacgaucaugccacugcacuccagccugggccaccaagaaggacccugucuccaaaagaaaaaaaagaaaaagaggaagugcggaagggcuccuucuaaccccgcaaggcccagucaccuggccuuaaagcccagccaaggcacaggugacugcaguuuucaggugcugggaguggaguugcgggaggagaggacggggaggggacggcuucucccuucaagcucuggccaugggcgggaacugggcugaaccaacggaaguugaguagaguggggaugcccuccugucugucccugcccaacacuguggucugcccu

SEQ ID NO: 19685 - RNA, 2413 nt, Homo sapiens
gcaaagacaguggccgggaauguaauugagcuuuaggaaaugauuaaagggaaguaaaaucaucuccaacucaacauuaaugcguuugauuucccgggugagaacaggauuugcguaacugagugguucuuucuuucuacaguccuggauguuuggaaagccagcucuuacaguuagcuuucuuugcuuugcuaacauuauccaucagaaaaucgaaaugcaaacagcuccuauuucccaaugaagaacuuucucugauuuaccuuaccaucaucaggcuucaccaucucaccuuggaagcguucaaucuuuuggucaauauuucuagaccaaaauaaagugcucucaagccuguucuuuggaaaguauuuugucaucauuaccaaagaguguuuaaauaacuggcuaugaaguuuggggagacugggcugggagguacaaucugaaguuaauugcugauguaaucauuaguccuuucaauacccaguggagaagcugccuccagggagauaagcucucaauuaggagacguguguguauaucaccaguucucucuggcauguaacaguuaacaauuucuauacaguuaaguggauuuagugaguaucauucuuccaggagagaaguaaaauuuuuuuuuaaagaggaaaacaaagaacaagauuaagaacaguaaaagaauaaguauggaaaaucugguaaguagcaaaaaucauuuuuaagcauuugagggagaaacugcaaaaucuguucagaagccacaccuuccggccugugggacugcauggcugugacacugagcaacagcugaagucuuuauucucucggaggggaaggaaaaaaggaaacaacagucaguccaggcuuguccacggcuggaagccucgacuccugcaaaccuccugcaaaccgaucucccagauccuuucugggcaagcacauaaccaaaggaaaugaaaacuagaaaaacaauuugugcauggaacaaugacauggaguuucacuuugguuucaugcucaaauaugaaugugguuauaauuuuuuaaaauauauauuaauagaaggcaacgaguugaggaugguggcuucuucaagccgggcguccagaagagccccacuucugccuuggagcgcgccuuaggcagcagucgugggaaagcucagauacagcuguuuccaggcaaagggcccagagcuuuucagccucagccaccagggucuccagacaaggagaaauacgcccaaagcugcucccaggggcuaggagcucggagcucccagugugggucucugagcagcgcggggugggcgcucccggcccuccagcccccaacucccucgcgcacccgggacgggugaaggcgcccagcugccgagcauacccgcgacgcggguucaaaucccgccggcucccaggcacccucaccccgccacagcgcgggcuguuucuccucccuuccccggaggaauuccuuaacucuccaguacccauaccauaacaaaggaggcucgguccaccaaugcgcgaucguagccuacagggacccccaacgaaccccggcccagagaaugcaccuggccgugccacgcgcgacccccgaggggcaggcggacggguccaggcgcggacaaaggggccucucggggcgcccaagcucggggcgggacgccgggagcggagcuggccgggaacucaccuucgcagcggcccggcugugcuccucguggagcagaagggcggcgggcagcagcagcagccagacgcugagccggggccccaugguggcgcgcccgaggcggcgagggacggcugcccggcgugcgggggccgcggcggacagcuagcucucggaaggccggacuuccagcgcuacgcaccgucccgggugcggcggcuccaagcggagaccugagcgcggcgggccgagcuccccaauuuguuggcgcugcccccucccccccggcggugcgcgggcggcgccucaaaggggaggacccugcggcgcggguaagaggcggcgggagcgcgcggcccgggaguguggcugcagugcgccgggacaccagggcuccgcgcuccgcacucaagaggcucccgcgucccaaccccucgcgcccgcgcguucgcggauccaggccgaggaccgaaaggggccgcccgagcccccggggccggcgcccagagagcccagcaaggccggccgcccugccggugugccgccggcgggugcuucuggaagggccaaugcguucgggcagcagccccugaagccgagcccgaggugagagcgacccccgagcggcgcccagacccuggcccgagagcaccgacuuggagcgccuugugcaggcuagggcugcacgcucuccugcuugggaguagaaagggggagggugggagagcgaagaccg

SEQ ID NO: 19686 - RNA, 2413 nt, Homo sapiens
cggucuucgcucucccacccucccccuuucuacucccaagcaggagagcgugcagcccuagccugcacaaggcgcuccaagucggugcucucgggccagggucugggcgccgcucgggggucgcucucaccucgggcucggcuucaggggcugcugcccgaacgcauuggcccuuccagaagcacccgccggcggcacaccggcagggcggccggccuugcugggcucucugggcgccggccccgggggcucgggcggccccuuucgguccucggccuggauccgcgaacgcgcgggcgcgagggguugggacgcgggagccucuugagugcggagcgcggagcccuggugucccggcgcacugcagccacacucccgggccgcgcgcucccgccgccucuuacccgcgccgcaggguccuccccuuugaggcgccgcccgcgcaccgccgggggggagggggcagcgccaacaaauuggggagcucggcccgccgcgcucaggucuccgcuuggagccgccgcacccgggacggugcguagcgcuggaaguccggccuuccgagagcuagcuguccgccgcggcccccgcacgccgggcagccgucccucgccgccucgggcgcgccaccauggggccccggcucagcgucuggcugcugcugcugcccgccgcccuucugcuccacgaggagcacagccgggccgcugcgaaggugaguucccggccagcuccgcucccggcgucccgccccgagcuugggcgccccgagaggccccuuuguccgcgccuggacccguccgccugccccucgggggucgcgcguggcacggccaggugcauucucugggccgggguucguugggggucccuguaggcuacgaucgcgcauugguggaccgagccuccuuuguuaugguauggguacuggagaguuaaggaauuccuccggggaagggaggagaaacagcccgcgcuguggcggggugagggugccugggagccggcgggauuugaacccgcgucgcggguaugcucggcagcugggcgccuucacccgucccgggugcgcgagggaguugggggcuggagggccgggagcgcccaccccgcgcugcucagagacccacacugggagcuccgagcuccuagccccugggagcagcuuugggcguauuucuccuugucuggagacccugguggcugaggcugaaaagcucugggcccuuugccuggaaacagcuguaucugagcuuucccacgacugcugccuaaggcgcgcuccaaggcagaaguggggcucuucuggacgcccggcuugaagaagccaccauccucaacucguugccuucuauuaauauauauuuuaaaaaauuauaaccacauucauauuugagcaugaaaccaaagugaaacuccaugucauuguuccaugcacaaauuguuuuucuaguuuucauuuccuuugguuaugugcuugcccagaaaggaucugggagaucgguuugcaggagguuugcaggagucgaggcuuccagccguggacaagccuggacugacuguuguuuccuuuuuuccuuccccuccgagagaauaaagacuucagcuguugcucagugucacagccaugcagucccacaggccggaagguguggcuucugaacagauuuugcaguuucucccucaaaugcuuaaaaaugauuuuugcuacuuaccagauuuuccauacuuauucuuuuacuguucuuaaucuuguucuuuguuuuccucuuuaaaaaaaaauuuuacuucucuccuggaagaaugauacucacuaaauccacuuaacuguauagaaauuguuaacuguuacaugccagagagaacuggugauauacacacacgucuccuaauugagagcuuaucucccuggaggcagcuucuccacuggguauugaaaggacuaaugauuacaucagcaauuaacuucagauuguaccucccagcccagucuccccaaacuucauagccaguuauuuaaacacucuuugguaaugaugacaaaauacuuuccaaagaacaggcuugagagcacuuuauuuuggucuagaaauauugaccaaaagauugaacgcuuccaaggugagauggugaagccugaugaugguaagguaaaucagagaaaguucuucauugggaaauaggagcuguuugcauuucgauuuucugauggauaauguuagcaaagcaaagaaagcuaacuguaagagcuggcuuuccaaacauccaggacuguagaaagaaagaaccacucaguuacgcaaauccuguucucacccgggaaaucaaacgcauuaauguugaguuggagaugauuuuacuucccuuuaaucauuuccuaaagcucaauuacauucccggccacugucuuugc

SEQ ID NO: 19687 - RNA, 2709 nt, Homo sapiens
agcggcccggcugugcuccucguggagcagaagggcggcgggcagcagcagcagccagacgcugagccggggccccaugguggcgcgcccgaggcggcgagggacggcugcccggcgugcgggggccgcggcggacagcuagcucucggaaggccggacuuccagcgcuacgcaccgucccgggugcggcggcuccaagcggagaccugagcgcggcgggccgagcuccccaauuuguuggcgcugcccccucccccccggcggugcgcgggcggcgccucaaaggggaggacccugcggcgcggguaagaggcggcgggagcgcgcggcccgggaguguggcugcagugcgccgggacaccagggcuccgcgcuccgcacucaagaggcucccgcgucccaaccccucgcgcccgcgcguucgcggauccaggccgaggaccgaaaggggccgcccgagcccccggggccggcgcccagagagcccagcaaggccggccgcccugccggugugccgccggcgggugcuucuggaagggccaaugcguucgggcagcagccccugaagccgagcccgaggugagagcgacccccgagcggcgcccagacccuggcccgagagcaccgacuuggagcgccuugugcaggcuagggcugcacgcucuccugcuugggaguagaaagggggagggugggagagcgaagaccgagcuccucggccaaggagcacccacaggggccuaacgggaggcucuccuucuuuccgggucgugggggggacggcccuccggucaccccugcaugcgggccgcgcaccgcgcuguccccgcgucucgcggaccgagaccggcggugaggaugggcugccucccucauccugcgcuaaacucgcuuugucugucgccucuaggcuaagugggacugaccggggcccagaguggacgaaccgccagcauggggagagaccagcgcgcgguggccggcccugcccuacggcgguaagcgacuuucugccugguccccgugggucacgcgcgcauggacccuucgguguaacucucggggacugacaagccgggcccgcacguucacgucucucuuccucccuuucccaugcagguggcugcugcuggggacagugaccgugggguuccucgcccagagcgucuuggcgguaaguccuggcucccgcgcuuggacuugcgcgcccgagagugguugggacguuugaguggccuuggagaaggcagcucguccgugcgcucccgagugugugugugcguguggauguucgccaggcugcccaccaagguucugagaaagcuugcucuucccucaucaugcuuuccaccuuuccuuccccuuggguucccagcgucaauccuguguuuugcaagcgucggccuuucacgggaacugggaacuuaaaauguagccugaggcaccguuuucguugcuuugggcaaagcugcagccguagaggccaggaaagugugucagucacuaggcagugagacgccaggcuuagggcgaaaaaaguuuuccuggaacucgggagcugguggggagucucugucacggacugaggguuuuuuguguuuuuaaaugggagucucuggguaaaggggcggggcgaggaggcgaacgagacaaccuuaguauuguuugaauugaagcauugcgagggaacaauggcagaaaaaccgcguuuucucccaaguccuguuccggcccuggaagagcugcuccgggcgccacacugggauccuguucgccgagccugccccuccacgccggccgugcacagcccugccgauaccgugggugcagcuggcgacugcacugcgaggcuuuguccauuuuauacguuuuguuuaaagaguaggagccacuuuuacugagcuuuauguaaccauggcuaaaaugaagagguuugguaggugaauucggugcaggacucaaauguuuagacaggagcugaaagcggagggagcuuucgagauguccgcugucccuccucuccuuacuguggccgauggaguagcccugcccuguggcagccggggcccagguggauuccuccugggaacgaccccucccuccucagcgcgcacugugccagagcaguacacagguacaaagggcaaacguguucaugauuucauuugaauucuguuguuuuuacaucguucugcccugauguaaaacaaaccaggauuuuaaaggcagugagugaugaggagcuacucccacuuggggaagagcugcuaacuuuacuuuuccgcugcuguugguuccgguucaaagcucgguuugggaaguaagaggaggacucggagacuuugaccagagcacuccaggccaaaguuuucuuccaguucaggucugucucuucgucccagccccgacuuaagaucagaaccuagauauuugaacuagcccagugacccugugaauucuaaugcacaggucuguacugcauguaagacuuggcucagauuuaugaaccagaagcaaugcaugcacgcgcacgcacgcacacucaaagaagggggcgaucccuagaaaauaccacaucgggcugugugugcuuugguugugcugccaccugcaccccuuugucccuuagagccacuuuuauaauuuccauauguucaugccuaaggauggugggagucccagguauucuuuucugaacucauccuaaaa

SEQ ID NO: 19688 - RNA, 2709 nt, Homo sapiens
uuuuaggaugaguucagaaaagaauaccugggacucccaccauccuuaggcaugaacauauggaaauuauaaaaguggcucuaagggacaaaggggugcagguggcagcacaaccaaagcacacacagcccgaugugguauuuucuagggaucgcccccuucuuugagugugcgugcgugcgcgugcaugcauugcuucugguucauaaaucugagccaagucuuacaugcaguacagaccugugcauuagaauucacagggucacugggcuaguucaaauaucuagguucugaucuuaagucggggcugggacgaagagacagaccugaacuggaagaaaacuuuggccuggagugcucuggucaaagucuccgaguccuccucuuacuucccaaaccgagcuuugaaccggaaccaacagcagcggaaaaguaaaguuagcagcucuuccccaagugggaguagcuccucaucacucacugccuuuaaaauccugguuuguuuuacaucagggcagaacgauguaaaaacaacagaauucaaaugaaaucaugaacacguuugcccuuuguaccuguguacugcucuggcacagugcgcgcugaggagggaggggucguucccaggaggaauccaccugggccccggcugccacagggcagggcuacuccaucggccacaguaaggagaggagggacagcggacaucucgaaagcucccuccgcuuucagcuccugucuaaacauuugaguccugcaccgaauucaccuaccaaaccucuucauuuuagccaugguuacauaaagcucaguaaaaguggcuccuacucuuuaaacaaaacguauaaaauggacaaagccucgcagugcagucgccagcugcacccacgguaucggcagggcugugcacggccggcguggaggggcaggcucggcgaacaggaucccaguguggcgcccggagcagcucuuccagggccggaacaggacuugggagaaaacgcgguuuuucugccauuguucccucgcaaugcuucaauucaaacaauacuaagguugucucguucgccuccucgccccgccccuuuacccagagacucccauuuaaaaacacaaaaaacccucaguccgugacagagacuccccaccagcucccgaguuccaggaaaacuuuuuucgcccuaagccuggcgucucacugccuagugacugacacacuuuccuggccucuacggcugcagcuuugcccaaagcaacgaaaacggugccucaggcuacauuuuaaguucccaguucccgugaaaggccgacgcuugcaaaacacaggauugacgcugggaacccaaggggaaggaaagguggaaagcaugaugagggaagagcaagcuuucucagaaccuuggugggcagccuggcgaacauccacacgcacacacacacucgggagcgcacggacgagcugccuucuccaaggccacucaaacgucccaaccacucucgggcgcgcaaguccaagcgcgggagccaggacuuaccgccaagacgcucugggcgaggaaccccacggucacuguccccagcagcagccaccugcaugggaaagggaggaagagagacgugaacgugcgggcccggcuugucaguccccgagaguuacaccgaaggguccaugcgcgcgugacccacggggaccaggcagaaagucgcuuaccgccguagggcagggccggccaccgcgcgcuggucucuccccaugcuggcgguucguccacucugggccccggucagucccacuuagccuagaggcgacagacaaagcgaguuuagcgcaggaugagggaggcagcccauccucaccgccggucucgguccgcgagacgcggggacagcgcggugcgcggcccgcaugcaggggugaccggagggccgucccccccacgacccggaaagaaggagagccucccguuaggccccugugggugcuccuuggccgaggagcucggucuucgcucucccacccucccccuuucuacucccaagcaggagagcgugcagcccuagccugcacaaggcgcuccaagucggugcucucgggccagggucugggcgccgcucgggggucgcucucaccucgggcucggcuucaggggcugcugcccgaacgcauuggcccuuccagaagcacccgccggcggcacaccggcagggcggccggccuugcugggcucucugggcgccggccccgggggcucgggcggccccuuucgguccucggccuggauccgcgaacgcgcgggcgcgagggguugggacgcgggagccucuugagugcggagcgcggagcccuggugucccggcgcacugcagccacacucccgggccgcgcgcucccgccgccucuuacccgcgccgcaggguccuccccuuugaggcgccgcccgcgcaccgccgggggggagggggcagcgccaacaaauuggggagcucggcccgccgcgcucaggucuccgcuuggagccgccgcacccgggacggugcguagcgcuggaaguccggccuuccgagagcuagcuguccgccgcggcccccgcacgccgggcagccgucccucgccgccucgggcgcgccaccauggggccccggcucagcgucuggcugcugcugcugcccgccgcccuucugcuccacgaggagcacagccgggccgcu

SEQ ID NO: 19689 - RNA, 2456 nt, Homo sapiens
uaaauguuaaauucugaauuuccaacaauuauagaaaagguaucuguuccuaccucucuuuucccuucaaguacccggucaggccacaggccaccgaggaggcaggcaagggugcccugugucccugccaacucugggcaagggccgccugaguguguacacaggaagucaggaauguggagaaggggccuggccacucucuguucugaggagcucuaguaauucacccuuaggaucuuucgaacaagcagcagcagccucggaugccaggaaaugagcugcugccccccaguaacgcuucaagacaucuggggcgucacaucagcacaacugcaaaaucucuggugaucaggauuccggcugcaucacguccuuggugcugaagaagcaagaggccaguggaaacgaaacugcugcuucauucccuccgaugcaggggccguuccagcacugcagggcagcucuuguuccagaaacacaccguguguuaagagucugccuccaacgguggccacuacagggguuucgguuagggucccccaauaacacuccugcauuaaccuugcuacuuguaaaccaagggcagcaguaaaucccagccaaccagcaaaagcagcagaggggcaaagcuuuguacaaaaccaaauuggguucaauuugacuuuguacagaagcaaauuggguucgugaauuggguucgauuugacuucuagagcguguguuccaucguuaccaaaugcucagugugagggagucagcucaguaaaccucauccugcagccugaggcagaagacagaguuggagcaaagaucagggaaaugcaccucuuuaccugggggacauuguuuucacaagaugauugccaauaaauuagucacgauguuaacugggauaauaauaaaaaagcaucaaagaaggcaaaagggagggggagaacuggaaguaccucugugagcuucguuaauucaguuuuaaagagagaauucauuaucaucuuguuuauucagcauacugauacacccaagauggcaauuuaagaauucuggacggggccuuuggguauaugacuuuuuaagaugcuaacauaaaagaagucagaacuuucagaguuucaggcuucuaaaaacucacacucauugaaaaugugucacacuauuuccaguuucuucauucacuuacaauaucuuauucuuuuguaaggagaaggaaauauauuccauugcaaugcuacaaucaccaguguuauuuuccaaaguuaaacagaaagccugaauugagauccucuaaguuguacuuuugaaaagucacaaauacuacacaauaaaaauaacucauuaccuaucuuaaaaaugcuuccaccggaagucacuccaacccaaacccauaugacguaucugagccaagaucaagcagaagauuaacuguaaaaggcagauaugcuccgggcuaagagguccggaggcuccaguuuuauuuccucucuccugacuaaacccaacaggggggaacacucugugccucauuuuacuuuuucuuagaaaggggcuaauaacaccagcucugcucaccccucaagugaaucucaaaggauaucauguuccuacggguacgugaaaacugaaaauaccuaacaaagcagccacagaggagcgucucugguucccagggcggcagagcaggaacgcggggcucgggagcaaaggcagcuuagguacacaaaugaccagcggguucucugcaacuuggguugucccugaggucacugaguggcugagaggcagcgcucagcccaaccagcaagggaggacgagugggaaaccccgagaaggaggcauuugcuguccgaggccgggacccugugcgcggccgggugcccugcuggaagccccgcgccccccguccccggcggagccccagggcgguguggcucaugcggcgccggccucaccugcggugucccagauggagauguuguaggagcgccacugcuucagguagaaggcgccgcccaccgugcugaccguguccgggaagcgccgcuccauauaccgcugcagcagcgacgucuuccccacguucaugucccccaggagcacgaucuugcugucgggcuuccucaucuucccguaagaacccccagcgcccccgcgcccucuccccgaggcuggccggcucgugcgcccugggcgcagcuggaggagcggaccccggacucgccgggacccggauucucgugaacgcuccgggaccuucgccuccggacgcccgggagcucaagagaggaagcgcgugugcgcgcccgggaaggagcugggugcagagcacggagcccacgucgggggcccggaccgcggcggccucgccucgccccgcccccgcccccgcccccgggcccuuucaccgccgcggccccgcccuauccuccuccgcccaccgcccccgucccgccccugcu

SEQ ID NO: 19690 - RNA, 2456 nt, Homo sapiens
agcaggggcgggacgggggcggugggcggaggaggauagggcggggccgcggcggugaaagggcccgggggcgggggcgggggcggggcgaggcgaggccgccgcgguccgggcccccgacgugggcuccgugcucugcacccagcuccuucccgggcgcgcacacgcgcuuccucucuugagcucccgggcguccggaggcgaaggucccggagcguucacgagaauccgggucccggcgaguccgggguccgcuccuccagcugcgcccagggcgcacgagccggccagccucggggagagggcgcgggggcgcuggggguucuuacgggaagaugaggaagcccgacagcaagaucgugcuccugggggacaugaacguggggaagacgucgcugcugcagcgguauauggagcggcgcuucccggacacggucagcacggugggcggcgccuucuaccugaagcaguggcgcuccuacaacaucuccaucugggacaccgcaggugaggccggcgccgcaugagccacaccgcccuggggcuccgccggggacggggggcgcggggcuuccagcagggcacccggccgcgcacagggucccggccucggacagcaaaugccuccuucucgggguuucccacucguccucccuugcugguugggcugagcgcugccucucagccacucagugaccucagggacaacccaaguugcagagaacccgcuggucauuuguguaccuaagcugccuuugcucccgagccccgcguuccugcucugccgcccugggaaccagagacgcuccucuguggcugcuuuguuagguauuuucaguuuucacguacccguaggaacaugauauccuuugagauucacuugaggggugagcagagcugguguuauuagccccuuucuaagaaaaaguaaaaugaggcacagaguguuccccccuguuggguuuagucaggagagaggaaauaaaacuggagccuccggaccucuuagcccggagcauaucugccuuuuacaguuaaucuucugcuugaucuuggcucagauacgucauauggguuuggguuggagugacuuccgguggaagcauuuuuaagauagguaaugaguuauuuuuauuguguaguauuugugacuuuucaaaaguacaacuuagaggaucucaauucaggcuuucuguuuaacuuuggaaaauaacacuggugauuguagcauugcaauggaauauauuuccuucuccuuacaaaagaauaagauauuguaagugaaugaagaaacuggaaauagugugacacauuuucaaugagugugaguuuuuagaagccugaaacucugaaaguucugacuucuuuuauguuagcaucuuaaaaagucauauacccaaaggccccguccagaauucuuaaauugccaucuuggguguaucaguaugcugaauaaacaagaugauaaugaauucucucuuuaaaacugaauuaacgaagcucacagagguacuuccaguucucccccucccuuuugccuucuuugaugcuuuuuuauuauuaucccaguuaacaucgugacuaauuuauuggcaaucaucuugugaaaacaaugucccccagguaaagaggugcauuucccugaucuuugcuccaacucugucuucugccucaggcugcaggaugagguuuacugagcugacucccucacacugagcauuugguaacgauggaacacacgcucuagaagucaaaucgaacccaauucacgaacccaauuugcuucuguacaaagucaaauugaacccaauuugguuuuguacaaagcuuugccccucugcugcuuuugcugguuggcugggauuuacugcugcccuugguuuacaaguagcaagguuaaugcaggaguguuauugggggacccuaaccgaaaccccuguaguggccaccguuggaggcagacucuuaacacacgguguguuucuggaacaagagcugcccugcagugcuggaacggccccugcaucggagggaaugaagcagcaguuucguuuccacuggccucuugcuucuucagcaccaaggacgugaugcagccggaauccugaucaccagagauuuugcaguugugcugaugugacgccccagaugucuugaagcguuacuggggggcagcagcucauuuccuggcauccgaggcugcugcugcuuguucgaaagauccuaagggugaauuacuagagcuccucagaacagagaguggccaggccccuucuccacauuccugacuuccuguguacacacucaggcggcccuugcccagaguuggcagggacacagggcacccuugccugccuccucgguggccuguggccugaccggguacuugaagggaaaagagagguaggaacagauaccuuuucuauaauuguuggaaauucagaauuuaacauuua

SEQ ID NO: 19691 - RNA, 2244 nt, Homo sapiens
caggcccaccugccucagccagcagcacaggccaggauucaucauuaaagaaacaggaaaacagagaggccggggagagcgaccaagcuaggcugagcugaaggagggcacgggccuguggggcugugggcagcccccgggcaacagccccaggugcgucaucucugcagggaugagcuauguccacaagugcacaguggccaucugacagccucagagcuuucagaaaggcagaucuaagaggggucaagucaaccacuagaaauguaagcggaaacaggccuccaugguucauccagaaccacucuuucaucccgggugacauuuauuccaccccaggagaauucuuuaaaaggaacauuccagcagaacggaaaacuucgcuaugaaaucacccugacuucagggcgggagggacgucaacgggaauccacaccuucucggacuuuccaaagucacccgcucccgagcccgcaggauagaguggccaggccguccucacacggcggcuccugcgggaggcggccccgggcgccccgccuucuccaaggacauuccuaaccgaggugccggggccagcaccgucgggcuccugaaagcacccgcugccuccaggagagcaccuggcagaacggggccgcggagccgcccuccccucccgcaugcggccccgcucgauuccuggaaucuuauuuuuggaccugcugccgcaagcaguucccgcccucggcccuuucaauuccucuuucgggaggggacugcucuccaccccucucaggaggacgaggcgcggcccggggguuccucaccuccagcccagcagagggagggccgcggggaagcgguuuggguuuuaaccauuguguuucucucgcacuuuggaaacggacucccggcuuccccgcggggaggcgucugacagcgagcguuucccggacagccccgcagcgucucaccggccugcgcggggaucccggggucgccgggggaugggcgugggggacgcggggcgggccggggcuccugggacccugaggccaggccucgccgcgcggagcuggggggcggcagcagcgcugccucucgggagcgguuggaggcgcgcgggcgccagggguucccccgcaucccgcccgccggcugcucaccgucucggggucguucucgaacaccucccgcgccuccucgcggcugcacagcuccuccacgcacucccucuccagguggcccugcuuggccuccucgaagaccugaaaggcgcggcgcugccugggccgcaggaacugcguggccucgcgcgccggcaacagcgcggcugcccggagggagagagggggacgcgucaagccgcgcccggagccuccucccgccgcccggggacggggucucgggcccgcgggacucaccaagcgcgcacuccgcggccagcagcagcagcagcagcugcggcgcgcggcgcagggcggcgggcccgggcgagagcgaaggggccauggcgggccggggacgcgcggucagagcgcccgggaggccgaggcgagccgcgggcgccgcggggcggaggcuccggucaucccguccuggcggcccugaaggucacaucgcggcggcggcggcggcggcggcugcggcaccucaagcgcucggucugggcguguucgggcggcugcgcgcggggaggcggcgggggcgggaccagcgcgcgggcggggcgcggguucccgggaggauccgggcgcggggaaagcggagcguccgggacgcggcgggacucgaguguuucggaaaaggagcgucuccccaggcggugguugucuucacuagcgaugggguaaaaggaggacgcaauaccugguucaacuugagcagguacauuuugaccauauuccaggugucaugugaagauuuaagccucuuuccaacccccacuccccccgaaucuacugcauccuuuuuggagucuucauucuuaggcacauuuugucaagacuuaaaaccuaccaaagaaaagauacacugaggucagauccaaucccacugggggccagcgagugaaaugcgacgguuuccuuuuauaaucucuguuuuucauaaugaugacauuaaaaaucuugagguuucccaguagauauuuaagcugaaagcaacauugugcuugucuucagagaccaagacuuucuggcucuugucuuggaauauuucgcaaagucauaggcaaaacacacacaaacaaacagaaccaaa

SEQ ID NO: 19692 - RNA, 2244 nt, Homo sapiens
uuugguucuguuuguuuguguguguuuugccuaugacuuugcgaaauauuccaagacaagagccagaaagucuuggucucugaagacaagcacaauguugcuuucagcuuaaauaucuacugggaaaccucaagauuuuuaaugucaucauuaugaaaaacagagauuauaaaaggaaaccgucgcauuucacucgcuggcccccagugggauuggaucugaccucaguguaucuuuucuuugguagguuuuaagucuugacaaaaugugccuaagaaugaagacuccaaaaaggaugcaguagauucggggggaguggggguuggaaagaggcuuaaaucuucacaugacaccuggaauauggucaaaauguaccugcucaaguugaaccagguauugcguccuccuuuuaccccaucgcuagugaagacaaccaccgccuggggagacgcuccuuuuccgaaacacucgagucccgccgcgucccggacgcuccgcuuuccccgcgcccggauccucccgggaacccgcgccccgcccgcgcgcuggucccgcccccgccgccuccccgcgcgcagccgcccgaacacgcccagaccgagcgcuugaggugccgcagccgccgccgccgccgccgccgcgaugugaccuucagggccgccaggacgggaugaccggagccuccgccccgcggcgcccgcggcucgccucggccucccgggcgcucugaccgcgcguccccggcccgccauggccccuucgcucucgcccgggcccgccgcccugcgccgcgcgccgcagcugcugcugcugcugcuggccgcggagugcgcgcuuggugagucccgcgggcccgagaccccguccccgggcggcgggaggaggcuccgggcgcggcuugacgcgucccccucucucccuccgggcagccgcgcuguugccggcgcgcgaggccacgcaguuccugcggcccaggcagcgccgcgccuuucaggucuucgaggaggccaagcagggccaccuggagagggagugcguggaggagcugugcagccgcgaggaggcgcgggagguguucgagaacgaccccgagacggugagcagccggcgggcgggaugcgggggaaccccuggcgcccgcgcgccuccaaccgcucccgagaggcagcgcugcugccgccccccagcuccgcgcggcgaggccuggccucagggucccaggagccccggcccgccccgcgucccccacgcccaucccccggcgaccccgggauccccgcgcaggccggugagacgcugcggggcuguccgggaaacgcucgcugucagacgccuccccgcggggaagccgggaguccguuuccaaagugcgagagaaacacaaugguuaaaacccaaaccgcuuccccgcggcccucccucugcugggcuggaggugaggaacccccgggccgcgccucguccuccugagagggguggagagcaguccccucccgaaagaggaauugaaagggccgagggcgggaacugcuugcggcagcagguccaaaaauaagauuccaggaaucgagcggggccgcaugcgggaggggagggcggcuccgcggccccguucugccaggugcucuccuggaggcagcgggugcuuucaggagcccgacggugcuggccccggcaccucgguuaggaauguccuuggagaaggcggggcgcccggggccgccucccgcaggagccgccgugugaggacggccuggccacucuauccugcgggcucgggagcgggugacuuuggaaaguccgagaagguguggauucccguugacgucccucccgcccugaagucagggugauuucauagcgaaguuuuccguucugcuggaauguuccuuuuaaagaauucuccugggguggaauaaaugucacccgggaugaaagagugguucuggaugaaccauggaggccuguuuccgcuuacauuucuagugguugacuugaccccucuuagaucugccuuucugaaagcucugaggcugucagauggccacugugcacuuguggacauagcucaucccugcagagaugacgcaccuggggcuguugcccgggggcugcccacagccccacaggcccgugcccuccuucagcucagccuagcuuggucgcucuccccggccucucuguuuuccuguuucuuuaaugaugaauccuggccugugcugcuggcugaggcaggugggccug

SEQ ID NO: 19693 - RNA, 3167 nt, Homo sapiens
ugacucagcccugaaauacucacauuugauucaaucuuaaucaccgcaagauccaauuuaaggucaauauccuugacaacagcuucauaacgggccccauucuggagcaccaccucaauccacugcugguuccugacaacaugggcauugguaauaaugagcccguccucagacacuaugaacccagagccacuguacacaggaacaagccugcugccgugaaguaaccugucuccacaagacaauaguguaaacagagggcaagaaaguuaggggauacagccauauaaucugagucaugggaaccucacucuuauuaaacauaccuccaucauaguuuucuuuucuuuucuuuuuucuuuuuugagacagaaucucgcucuguugcccaagcuggagugcaguggcgcaaucucggcucacugcaaccaccucccaggcuccugccucagccucccaaguagcugggauaacaggcaugcaccaccacgccuggcuaauuuuuguauuuuuaguggagaugggguuucaccauguuggccaggcugcucucgaacgccugaccucaggugauccacccgccucggccucccaaagugcugggauuacaggcaugagccaccguacccagccuuccuucaguuuucucagacauuucacuuuucccuggcuaugcguaaauuuucuccauguaucaguggacuuggcagguacagggccccagccaucucuugugagcaugguugagagugggguccagcucuccuuuuccagggacacugcuucuucagagcugguuaguguagcagcccauggguucucugcugcgaaaagacugaacccaauccuaauacuagaggcaaaagucagccucuuaccacaguaucaaggacccaggcaggagagaaucaaagggcucugauucuggcuuaguuuccaccgccaacuggccucguaacauaguaacauaggacaaauuaacccugcucucugggucuggauuuccuuguauccaaagugggggcugagcaagaucacaaccaaaaugccuacuaagcuggaugugguggcuacacccguaaucccagcacgucgggaggcuaagguggcagaucguuugggcccaggaguucgagaccagccugagcaauauaacaagaccucgucucuacaaaaaaauacaaauauuagcuggguaugguggcaccugccuauagucccaguuacuccagaggcuggguugggaggauuacuugagcccagcagauggagcugcagugagccgugaucugucacugcauuucagcccuggcgacagagcaagaccuugucucaaaaaaagaaaagaaauugccuacuagcucuuauaucugaccuuaaauuuugucuguggcaggagggggaaaaagcaccagccaccuaagugggcagggggagcugggauuuagaagucagcauccuugugccucugcucuuugguuaaaugaccuugaacagguuauucaaccucuuuacgucucaguuuccucacugguuuuuuaggauuaaaugacgcuugcgaagggucuggagcagguaggcacgcagaaaccauuagcugggacaguggaggucuuccuccuccuccuuuaccugccccacagcugcacgugaaccaccgauggcgccaccuucuccaccaccgcggcgaugaaguuguaauuccuccugagcgggccugcgcuucuggucccuaugaaaaaauacuggcucaagaguacgccucgagggaaccagaccugcuauccuaguuggaaaaauguuaaaggcaagacaguguucaaaaggugcauggggagggagaaaccacguagcagccgguaaagagccccuguuaaggaggaaaggaaaucaggaacacagaggugucgaauccaggaggcaaaugacgcaggaggaccaggcgcgaacugugcggucucagugaggucuuguuccuuuacgcuccuccagaguuagaaaguguuccgagggcgcgcgcccccgcggcucaccuguauccccgcaguucccccacugcacaggcacggccgggaccuugcccaggcggcgcgcggcgcgguuuucggcccggagcgcgcacaugcugggguaggugcgccugucgcugccgcacacggccccucccagcgucgggcaaccgcaggugcuggggaacccggggcgcagcggcuggaggcacugcagccccggggcgcacgguuggcccugcgccccgccgcagacuucacgcucggccgcggggcagacgcggcaacagcggcacaggucgaacaccggcgugguccccagcgcgcaggugggcagcgcggggcagcgcgugggcuggcagaccgcggggcaggagggcuggguauguagcuuuucagccccggcccagaggacgggcaccaggagcagcagcagccccggcaggaggcaucgucccagccccgcgguccgcagcugaggucuaaucauccuguuccuuccucgcuuccacucuucagugacuuuacucuggaccugcaaacccuccuaaaugagagacacuuucucccggccacggcgccgccuccgccggcccccaaacuuuaaggggcagagccuggcauaccucugcauauacacacccguacauccccuaccacccgcccccgucggcgccccggagccagguucucccccaggcaaugaggggaaggucucuagcccuacccggagcaggaaccuaccuccugaaaucccuaaaaccgacaaugagggcagacugauaagaaagcucacccacccauggucagaaggucaguauuaggaaaacacaugaccauauuucaguauuucacaugguuuuauuacaaaacaagccacaaaacaguuuuagaaaauuuuugcuacauaccaauuaggagaucacauaaaaugagaagcguaacaguuuccaugcacucagccuagagcuuacagcgagugcauuucacagcugaaacaucacugcuuuaaaacacagaaucaugcuaccccuucauaagcagagggggaggaggucaaacaguauguuuuugccaaacguuugcuuuaucugaacucuaucuaguaugaaggacuggcugccgcaggcaauaacacagagaggaaaaggaacaaag

SEQ ID NO: 19694 - RNA, 3167 nt, Homo sapiens
cuuuguuccuuuuccucucuguguuauugccugcggcagccaguccuucauacuagauagaguucagauaaagcaaacguuuggcaaaaacauacuguuugaccuccucccccucugcuuaugaagggguagcaugauucuguguuuuaaagcagugauguuucagcugugaaaugcacucgcuguaagcucuaggcugagugcauggaaacuguuacgcuucucauuuuaugugaucuccuaauugguauguagcaaaaauuuucuaaaacuguuuuguggcuuguuuuguaauaaaaccaugugaaauacugaaauauggucauguguuuuccuaauacugaccuucugaccaugggugggugagcuuucuuaucagucugcccucauugucgguuuuagggauuucaggagguagguuccugcuccggguagggcuagagaccuuccccucauugccugggggagaaccuggcuccggggcgccgacgggggcgggugguaggggauguacggguguguauaugcagagguaugccaggcucugccccuuaaaguuugggggccggcggaggcggcgccguggccgggagaaagugucucucauuuaggaggguuugcagguccagaguaaagucacugaagaguggaagcgaggaaggaacaggaugauuagaccucagcugcggaccgcggggcugggacgaugccuccugccggggcugcugcugcuccuggugcccguccucugggccggggcugaaaagcuacauacccagcccuccugccccgcggucugccagcccacgcgcugccccgcgcugcccaccugcgcgcuggggaccacgccgguguucgaccugugccgcuguugccgcgucugccccgcggccgagcgugaagucugcggcggggcgcagggccaaccgugcgccccggggcugcagugccuccagccgcugcgccccggguuccccagcaccugcgguugcccgacgcugggaggggccgugugcggcagcgacaggcgcaccuaccccagcaugugcgcgcuccgggccgaaaaccgcgccgcgcgccgccugggcaaggucccggccgugccugugcagugggggaacugcggggauacaggugagccgcgggggcgcgcgcccucggaacacuuucuaacucuggaggagcguaaaggaacaagaccucacugagaccgcacaguucgcgccugguccuccugcgucauuugccuccuggauucgacaccucuguguuccugauuuccuuuccuccuuaacaggggcucuuuaccggcugcuacgugguuucucccuccccaugcaccuuuugaacacugucuugccuuuaacauuuuuccaacuaggauagcaggucugguucccucgaggcguacucuugagccaguauuuuuucauagggaccagaagcgcaggcccgcucaggaggaauuacaacuucaucgccgcggugguggagaagguggcgccaucggugguucacgugcagcuguggggcagguaaaggaggaggaggaagaccuccacugucccagcuaaugguuucugcgugccuaccugcuccagacccuucgcaagcgucauuuaauccuaaaaaaccagugaggaaacugagacguaaagagguugaauaaccuguucaaggucauuuaaccaaagagcagaggcacaaggaugcugacuucuaaaucccagcucccccugcccacuuagguggcuggugcuuuuucccccuccugccacagacaaaauuuaaggucagauauaagagcuaguaggcaauuucuuuucuuuuuuugagacaaggucuugcucugucgccagggcugaaaugcagugacagaucacggcucacugcagcuccaucugcugggcucaaguaauccucccaacccagccucuggaguaacugggacuauaggcaggugccaccauacccagcuaauauuuguauuuuuuuguagagacgaggucuuguuauauugcucaggcuggucucgaacuccugggcccaaacgaucugccaccuuagccucccgacgugcugggauuacggguguagccaccacauccagcuuaguaggcauuuugguugugaucuugcucagcccccacuuuggauacaaggaaauccagacccagagagcaggguuaauuuguccuauguuacuauguuacgaggccaguuggcgguggaaacuaagccagaaucagagcccuuugauucucuccugccuggguccuugauacugugguaagaggcugacuuuugccucuaguauuaggauuggguucagucuuuucgcagcagagaacccaugggcugcuacacuaaccagcucugaagaagcagugucccuggaaaaggagagcuggaccccacucucaaccaugcucacaagagauggcuggggcccuguaccugccaaguccacugauacauggagaaaauuuacgcauagccagggaaaagugaaaugucugagaaaacugaaggaaggcuggguacgguggcucaugccuguaaucccagcacuuugggaggccgaggcggguggaucaccugaggucaggcguucgagagcagccuggccaacauggugaaaccccaucuccacuaaaaauacaaaaauuagccaggcgugguggugcaugccuguuaucccagcuacuugggaggcugaggcaggagccugggaggugguugcagugagccgagauugcgccacugcacuccagcuugggcaacagagcgagauucugucucaaaaaagaaaaaagaaaagaaaagaaaacuaugauggagguauguuuaauaagagugagguucccaugacucagauuauauggcuguauccccuaacuuucuugcccucuguuuacacuauugucuuguggagacagguuacuucacggcagcaggcuuguuccuguguacaguggcucuggguucauagugucugaggacgggcucauuauuaccaaugcccauguugucaggaaccagcaguggauugagguggugcuccagaauggggcccguuaugaagcuguugucaaggauauugaccuuaaauuggaucuugcggugauuaagauugaaucaaaugugaguauuucagggcugaguca

SEQ ID NO: 19695 - RNA, 2580 nt, Homo sapiens
gaaugggccugauggcgagcacccggcgcccuguuuacuccgcucuuugugacgucgaguucccgugaccgggagccagcggccgcgcuccauucaagcuccggggagggggugggaggaggggcccggagggggcggggagucagcgcggggggcgggggacagcgcggggggcgggggacggcgcggggcccggaauggaacggggcggggccuggcgggguaguaccuagcgcccccucccccgggagcgcggaggagcauuaauaaaccucuaagccgaggagaaaacucuggcuggggcagugcgcugagcgccggaggagcguaggcagggcagcgcuggcgccaguggcgacaggagccgcgcgaccggcaaaaauacacgggaggccgucgccgaaaagaguccgcgguccucucucguaaacacacucuccuccaccggcgccucccccuccgcucugcgcgccgcccggcugggcgcccgaggccgcuccgacugcuaugugaccgcgaggcugcgggaggaaggggacagggaagaagaggcucucccgcgggagcccuugaggaccaaguuugcggccacuucugcaggcgucccuucuuagcucucgcccgccccuuucugcagccuaggcggcccggguucucuucucuuccucgcgcgcccagccgccucgguucccggcgaccauggugacgauggaggagcugcgggagauggacugcagugugcucaaaaggcugaugaaccgggacgagaauggcggcggcgcgggcggcagcggcagccacggcacccuggggcugccgagcggcggcaagugccugcugcuggacugcagaccguuccuggcgcacagcgcgggcuacauccuagguucggucaacgugcgcuguaacaccaucgugcggcggcgggcuaagggcuccgugagccuggagcagauccugcccgccgaggaggagguacgcgcccgcuugcgcuccggccucuacucggcggucaucgucuacgacgagcgcagcccgcgcgccgagagccuccgcgaggacagcaccgugucgcugguggugcaggcgcugcgccgcaacgccgagcgcaccgacaucugccugcucaaagguaaacgagggcuccgggcgcuagcuggagucggggagauggagggggucuuggcggccugcgccuuauuggcacgggaaggaguccccggcgugauucgugguugcggggauccccgcgcgccccuuuguguguguugguguguagggguuugcaagguuucugugcaagugcgagguucaaguccucagggaaagugcggacggguuucuccggucaccugcaauuccgcaccguccuagcgaggccccguuuauugacauuaacgguccuagccucgaggaugaagcgacuccucugcgcgguccaucuugagucccgggaacaguuuccaaguaccacggggcgcguggggacaagauaggccuguugguuuggcgugcuggggcccuacacugagccggaccgggagaaucccagagguggagaaaaggugaagaggggugggcgccgagguacaauuggccuugccaguuucacugaaaacaagacccuggcaaaugcagaaagggagauuggguugcacacacuguguagagcgaucuguaucugcguucccgcugcccaacuccaagcucagcuuggaagguggccaauccccgucccgggcuagauccaggcucugggagcgggaggcugaaggacuggguaucugggggacgccgggcggaaccgguccucuagcgccugcaaauccgggcagcggagaaugaucaccuuuuguucagcccggauuuucgacuaucugauggcggcgcgugccggauuuuagcgagcccuggcgaaacucucggcggcgagacugucuugucacauuugguagucggaaauccuggaaaaaucgcgugcuguccgagucccuggagggaccuggcgcccgccacaccugcagggcaggguggguccgcggcccucgggcuagggagcgggcagggcgcgugggguccgggcgccccccgccgcgcugcgccuccgccucccgccgccgcauuccgcgcauucuuccgcgcggguagggucugcgcuuccgagcccgguaggcaguucagacccccccacacccaucaaagagccgcuccucccccccgcaggcgccuucgccgccucccucccuuccuuuccuuuccgcuccucuuccgaccuguccacccgggaggaagggagcuggaaagggggcggaaaccucuccccuccaaaaagcacaacaaaacuguucagugcggaggagccggguucgccccugccggacagcggggggcuuuguuccccgcaguuguuuccugcccauuugaccugucagcugcuggggaaacgcugcuguugaccuuugguugaacugcuaaggcgauuuugcugauuuuucuuucuuuuuccgcgagggcugucuuuugcuccuccaaaugagcccagucccccucccuucuccccaaagcgcuccaagagaaagu

SEQ ID NO: 19696 - RNA, 2580 nt, Homo sapiens
acuuucucuuggagcgcuuuggggagaagggagggggacugggcucauuuggaggagcaaaagacagcccucgcggaaaaagaaagaaaaaucagcaaaaucgccuuagcaguucaaccaaaggucaacagcagcguuuccccagcagcugacaggucaaaugggcaggaaacaacugcggggaacaaagccccccgcuguccggcaggggcgaacccggcuccuccgcacugaacaguuuuguugugcuuuuuggaggggagagguuuccgcccccuuuccagcucccuuccucccggguggacaggucggaagaggagcggaaaggaaaggaagggagggaggcggcgaaggcgccugcgggggggaggagcggcucuuugaugggugugggggggucugaacugccuaccgggcucggaagcgcagacccuacccgcgcggaagaaugcgcggaaugcggcggcgggaggcggaggcgcagcgcggcggggggcgcccggaccccacgcgcccugcccgcucccuagcccgagggccgcggacccacccugcccugcagguguggcgggcgccaggucccuccagggacucggacagcacgcgauuuuuccaggauuuccgacuaccaaaugugacaagacagucucgccgccgagaguuucgccagggcucgcuaaaauccggcacgcgccgccaucagauagucgaaaauccgggcugaacaaaaggugaucauucuccgcugcccggauuugcaggcgcuagaggaccgguuccgcccggcgucccccagauacccaguccuucagccucccgcucccagagccuggaucuagcccgggacggggauuggccaccuuccaagcugagcuuggaguugggcagcgggaacgcagauacagaucgcucuacacagugugugcaacccaaucucccuuucugcauuugccagggucuuguuuucagugaaacuggcaaggccaauuguaccucggcgcccaccccucuucaccuuuucuccaccucugggauucucccgguccggcucaguguagggccccagcacgccaaaccaacaggccuaucuuguccccacgcgccccgugguacuuggaaacuguucccgggacucaagauggaccgcgcagaggagucgcuucauccucgaggcuaggaccguuaaugucaauaaacggggccucgcuaggacggugcggaauugcaggugaccggagaaacccguccgcacuuucccugaggacuugaaccucgcacuugcacagaaaccuugcaaaccccuacacaccaacacacacaaaggggcgcgcggggauccccgcaaccacgaaucacgccggggacuccuucccgugccaauaaggcgcaggccgccaagacccccuccaucuccccgacuccagcuagcgcccggagcccucguuuaccuuugagcaggcagaugucggugcgcucggcguugcggcgcagcgccugcaccaccagcgacacggugcuguccucgcggaggcucucggcgcgcgggcugcgcucgucguagacgaugaccgccgaguagaggccggagcgcaagcgggcgcguaccuccuccucggcgggcaggaucugcuccaggcucacggagcccuuagcccgccgccgcacgaugguguuacagcgcacguugaccgaaccuaggauguagcccgcgcugugcgccaggaacggucugcaguccagcagcaggcacuugccgccgcucggcagccccagggugccguggcugccgcugccgcccgcgccgccgccauucucgucccgguucaucagccuuuugagcacacugcaguccaucucccgcagcuccuccaucgucaccauggucgccgggaaccgaggcggcugggcgcgcgaggaagagaagagaacccgggccgccuaggcugcagaaaggggcgggcgagagcuaagaagggacgccugcagaaguggccgcaaacuugguccucaagggcucccgcgggagagccucuucuucccuguccccuuccucccgcagccucgcggucacauagcagucggagcggccucgggcgcccagccgggcggcgcgcagagcggagggggaggcgccgguggaggagaguguguuuacgagagaggaccgcggacucuuuucggcgacggccucccguguauuuuugccggucgcgcggcuccugucgccacuggcgccagcgcugcccugccuacgcuccuccggcgcucagcgcacugccccagccagaguuuucuccucggcuuagagguuuauuaaugcuccuccgcgcucccgggggagggggcgcuagguacuaccccgccaggccccgccccguuccauuccgggccccgcgccgucccccgccccccgcgcugucccccgccccccgcgcugacuccccgcccccuccgggccccuccucccacccccuccccggagcuugaauggagcgcggccgcuggcucccggucacgggaacucgacgucacaaagagcggaguaaacagggcgccgggugcucgccaucaggcccauuc

SEQ ID NO: 19697 - RNA, 3103 nt, Homo sapiens
cugucauucuaacgggacgcccuccuguaggaaguugcccccuggcgcccguccuccggcuucugaugaaacggcgacccaccacccccuucccagacccuggcccgcagccggaucacuccgggcgcgcugccgaucacguggcgaagcggugcuccccagcgccguggcugcgcgcccauuggucggcggcuggagucccgggcgcgcccauuggcugcggggggcguucacguggcagggggccugggauggaccccggggucccgagagcuggcaggaaaguuaaagggggcagcgcggccgcggggagcucgagucccgggugacugcuggagggaggaggugaccgcgcagcucucgugcacggacggacuucgccgcccgcggggggcgcgaacccgagcccgggcccagcuccugccgucacggcagcugucccuguucccccagggcguaugcugccgcgggcuggcgcgucugcccucgggacuuaugagcugaacccgguacguagcuccccaagucucgaguccgagggaagggcuggggacaacaaggcgagggcgugcagcggggaccucuuuggguuccugucaccuacauuuucaccgugcgacuugcacuggcacaccggggcuggaacacucuagguagcuggccccagggagcuguugcuucagcguggagagggcgauccagggaccgcagcugggaagcgccucccgggcccacgugcuccaccgcgcugcugggcccggcugcgaccgugacccgggagcugcggcugcggcggcugaucccuuuaccaccuguuguucuggcuucgaaacuagcacaaguucccagccccgggucccgagaggucuggagacuucuccaaaguuggguagugggguuuggagcuuaaggacaagccgcuucgucucucuccgggccuuauuuucccuauaaaacgcgaggaaauacacuugguaggcucucaggccaccgagggcgacgggaccuagcacgauccccgucccgggcuggcggaggccaggcggccgcgcgggggugcuggugucgcgcugcuugcuccggccgggguugccccuuugccggccccgcccgggugcgauaacgggcuccuccuccucgucgucuuccucccaccgccgacaucuccgggaacccagcccaggcccugccucccggacacaccgacgcucacguagucgcgcuugccacaacccugcgggcucuccgaugcggcgagcgagcuggggagggggcuucuccgcggcccaaaaggugggugcggcgcgaggccaaggaggcuuguagggagguugggggcggagugcagcccuggucaaacuggacggaggggacagagucggagaguaacuugugggauccuccagccuggagagcacuggccugcuccugcgucucuuuggaauccagaaaaagggguguggaaggcacaguagcugcaaaagagggagugggggccgguaaugacuuacuggaagauuuggggccugucagagcacuguuuucugaaaaagaggagaaaacagaggaaagacuggacuugggaacuuggagacuuggaagguguuggaaccuguggucugaguggcgggggccugccugggagacccagggugcagcagaagagacaauuagagcuuuggucugggaggaagaggaggagaggaggaaauguuuccuugggcagaguuguccaggagccaaaacuaaagugaagacagcuggaggacuuacacaaaaguacaguugagguauuuaggaaaaaaaguuagugggaagagaagcggcaccaggggugggucgcaacauacaaugucagggccagcagggaccuuggaggggaccucaagcccagagcagcugagugacucgcucaaguagcaaagcaaggugcgggcauucuuagccuaguacucuguuuucccucguacguuuuuagacggcaggggcugugucauuugaacuugccucuuuccuagaauaugcaacuguauucacaaaugucagucuccaagaugcuuuggaugauggggacaggaucaagggguacaaggagccuuuaaggcugugaauaggcccccauggucugaguacaaaggggaaagacaugcacucucuucaugcuggaucagugaaaccuuuuggaagggaacacagaauuguuggagggagguagauggccaugucuuuaaaaaugaaaauuauaaccugguugugaauguuuacugaaugcaguucggcagcuuucaguguuccugguggguugcuugugcaucugauuuuuuuguuuguuugguuuuguuuguuuguuuugagacggagugucgcucugucgcccaggcuggagugcaguggcgccaucucuggcucauuguaagcuccgccucccggguucacgccauucuccugccucggccuccugaguagcugggacuacaggcgcccgccaccacgcccagcuaauuuuuauuuguauuuuuaguagagacgggguuucaccguguuagccaggauggugucgaucuccugaccucgugaucugcccgccucggccucccaaagugcugggauuacaggcgugagccaccacgcccggccuuuuuuugccuuuuuuuuuuuuuuuugagacguaguuucgcucugucgcccaggcuggacugcaguggcgccaucucggcucacugcaagcuccgccucccggguucgcgccauucuccugccucggccuccugaguagcugggacuacaggcgcccgccgccacgcccggcuaauuuuuuuuuuuuguauuuuuaguagagacgggguuucaccguguucgccaggauggucucgaucuccugaucucgugauccgcccgccucggccucccaaagugcugggauuacaggcgugagccaccacgcccggccuuuuugucuuuucuuaccagaagaaagagagagagagaauaagagaauggaggggauaaugucguggcccugauacaaaaaagauuuccucccuaugaaagguacagccagaaagucaguaguucagcugccugaaaccgugaaggucauagg

SEQ ID NO: 19698 - RNA, 3103 nt, Homo sapiens
ccuaugaccuucacgguuucaggcagcugaacuacugacuuucuggcuguaccuuucauagggaggaaaucuuuuuuguaucagggccacgacauuauccccuccauucucuuauucucucucucucuuucuucugguaagaaaagacaaaaaggccgggcgugguggcucacgccuguaaucccagcacuuugggaggccgaggcgggcggaucacgagaucaggagaucgagaccauccuggcgaacacggugaaaccccgucucuacuaaaaauacaaaaaaaaaaaauuagccgggcguggcggcgggcgccuguagucccagcuacucaggaggccgaggcaggagaauggcgcgaacccgggaggcggagcuugcagugagccgagauggcgccacugcaguccagccugggcgacagagcgaaacuacgucucaaaaaaaaaaaaaaaaggcaaaaaaaggccgggcgugguggcucacgccuguaaucccagcacuuugggaggccgaggcgggcagaucacgaggucaggagaucgacaccauccuggcuaacacggugaaaccccgucucuacuaaaaauacaaauaaaaauuagcugggcgugguggcgggcgccuguagucccagcuacucaggaggccgaggcaggagaauggcgugaacccgggaggcggagcuuacaaugagccagagauggcgccacugcacuccagccugggcgacagagcgacacuccgucucaaaacaaacaaacaaaaccaaacaaacaaaaaaaucagaugcacaagcaacccaccaggaacacugaaagcugccgaacugcauucaguaaacauucacaaccagguuauaauuuucauuuuuaaagacauggccaucuaccucccuccaacaauucuguguucccuuccaaaagguuucacugauccagcaugaagagagugcaugucuuuccccuuuguacucagaccaugggggccuauucacagccuuaaaggcuccuuguaccccuugauccuguccccaucauccaaagcaucuuggagacugacauuugugaauacaguugcauauucuaggaaagaggcaaguucaaaugacacagccccugccgucuaaaaacguacgagggaaaacagaguacuaggcuaagaaugcccgcaccuugcuuugcuacuugagcgagucacucagcugcucugggcuugagguccccuccaaggucccugcuggcccugacauuguauguugcgacccaccccuggugccgcuucucuucccacuaacuuuuuuuccuaaauaccucaacuguacuuuuguguaaguccuccagcugucuucacuuuaguuuuggcuccuggacaacucugcccaaggaaacauuuccuccucuccuccucuuccucccagaccaaagcucuaauugucucuucugcugcacccugggucucccaggcaggcccccgccacucagaccacagguuccaacaccuuccaagucuccaaguucccaaguccagucuuuccucuguuuucuccucuuuuucagaaaacagugcucugacaggccccaaaucuuccaguaagucauuaccggcccccacucccucuuuugcagcuacugugccuuccacaccccuuuuucuggauuccaaagagacgcaggagcaggccagugcucuccaggcuggaggaucccacaaguuacucuccgacucuguccccuccguccaguuugaccagggcugcacuccgcccccaaccucccuacaagccuccuuggccucgcgccgcacccaccuuuugggccgcggagaagcccccuccccagcucgcucgccgcaucggagagcccgcaggguuguggcaagcgcgacuacgugagcgucgguguguccgggaggcagggccugggcuggguucccggagaugucggcggugggaggaagacgacgaggaggaggagcccguuaucgcacccgggcggggccggcaaaggggcaaccccggccggagcaagcagcgcgacaccagcacccccgcgcggccgccuggccuccgccagcccgggacggggaucgugcuaggucccgucgcccucgguggccugagagccuaccaaguguauuuccucgcguuuuauagggaaaauaaggcccggagagagacgaagcggcuuguccuuaagcuccaaaccccacuacccaacuuuggagaagucuccagaccucucgggacccggggcugggaacuugugcuaguuucgaagccagaacaacaggugguaaagggaucagccgccgcagccgcagcucccgggucacggucgcagccgggcccagcagcgcgguggagcacgugggcccgggaggcgcuucccagcugcggucccuggaucgcccucuccacgcugaagcaacagcucccuggggccagcuaccuagaguguuccagccccggugugccagugcaagucgcacggugaaaauguaggugacaggaacccaaagagguccccgcugcacgcccucgccuuguuguccccagcccuucccucggacucgagacuuggggagcuacguaccggguucagcucauaagucccgagggcagacgcgccagcccgcggcagcauacgcccugggggaacagggacagcugccgugacggcaggagcugggcccgggcucggguucgcgccccccgcgggcggcgaaguccguccgugcacgagagcugcgcggucaccuccucccuccagcagucacccgggacucgagcuccccgcggccgcgcugcccccuuuaacuuuccugccagcucucgggaccccgggguccaucccaggcccccugccacgugaacgccccccgcagccaaugggcgcgcccgggacuccagccgccgaccaaugggcgcgcagccacggcgcuggggagcaccgcuucgccacgugaucggcagcgcgcccggagugauccggcugcgggccagggucugggaaggggguggugggucgccguuucaucagaagccggaggacgggcgccagggggcaacuuccuacaggagggcgucccguuagaaugacag

SEQ ID NO: 19699 - RNA, 2625 nt, Homo sapiens
agcaaucagggacuuaaguggggcccguuggcuuuuuuuaguaaccuuaugcuaagaggugcaaagauuugagugcuagauuucagacacaagugccgaggcagccaggaaauuguuaguaaugaauguuuaaacucccaaacguuguacugaagacaaaagagcuuuuguggcuauacugaaacuauuguuuuaaaauuuuauuuauaaauaaaagauauauacauaugugcuuuaauaugauuaacagguuccauuuuguacaaaauguuaaaccuagaguccucugcguccuggaugaggcguccaaaggguggaauaguacagcauuaggaccuuuguucuccucuuggcuucuggaagagaaacucuugcaugcccucgacuuucaccgcaaaaauaagugagaaaaaagauaaaucccauuuaugcaaugauauguagcuaugaguuaaucacgguauuucauuccaugaaauccauuaagcugcuggcauuugcauggcucuaaguuuauuuuaagaggcucauucaaacauggccaggaauauauuggccucuugagaguuugcauggcaaggaguuauacagcaggaaaaagaaaaaaaacccaauaauuauauugaugcaagauucaucaguauuuuagaauauugucguuucaacauguuaaauuguuucugagcacugcugauuucagcacugucccugguccacgugacgcaaaugccacccuuuccauauauucuucagcaaaaauauaugaaaagcccgucacucccuaagaggacccugaucccucuggagaggaaaacuaaacucuuuaagaagaaaaccaaacccaaccugaacuaaucguccaaggaguccuguuuggucccacgaaaggcagauuuccauccacaccagugaggggcaaguguccggguuccaacucgaagccaggcgggccugugcgggggugaguccuuugccacccggcgccccccaggcucuacaagcgucuagaggucggagucgcagggcagcgagcugucgcaggggugggugcugcacgagggagcguccugggacucccaccccuccccgucgaggacguccaccgaguugguguaggccuugggccgcggccgcggcauggggaagccgaccuugggcuugggcuugggcuugcggugcugggcaggcggcggucggugcuggccgucgcuguaguacuugauggcgggcgccaggucgggcucgggccacuccacuuggauggugcugacgcugcugcggcgaggcccggcggagggucccuugcggcggcggcgacaacgcucgucgcaccagggcgcgaagcugagcgccagcgagaagccgcccagcagcaggaggcagcugcccagguagcccaggaccaggcuguagcugaccugcaccgugaccgggcuggccggggcgggcagcacgucgcggucccccaagaagugguuguaccaggacaccgggaugaggccgaggaggccagcgacgaagagcacgacgcccgagagcccugccagcacgaaguugggcucguccugccagcagcgcacgcccagcgacgccagcagaagccccaggaccguggcggccagcgaggugaccaugagugcccgcgccaccagcacgggcugggccucgaaguagccccacugguccgucuggccgcacucgcgcucgcggcugcucugcucgcgacacaugucccacaggcccugguacaacuccacguccacuggcugguucaggaagcccuucaccagccgccagccgggcgccagggugccggucagguugagcaggagcccgcagggcgccaacaccaugcccagcgucaucaccaccggcguccgcaucccggcccgccgcgccgacggcgccccugcagccugccuuccuucuccgcugucgccuucuccgccgucgucuucucccugccgugccccaggcuccggggacccgaagucagcgcggacgccccgggcuccgggucgggcuccugagcccugaucgcuccagggacgcucuuugucuccugcacggggaccguccccacuuaggcuaguucccuccuggcgucccggccgcuccgcccuccuacuggcccuaaucgaaaccagcccgcgggcgggucugaccgaaaccgcggguccgggcgcgggcgcccaggggcggcugccgcggccaaaccuggcccgggagggagggacccgaggugagcgcaggaagcggcggggccaccucgcccgcggcaggugagauggggauccgagcggcggggacaccccaccuugcagccgggcggcugggccacgccuggccuggacugcucacggccggagcaaaggucgccccgccccuggguccucgcgccgccccgccgggccaggcgggcggugggcggggagggaaagaggcggcgcuggcgggacgcgguggcugcgcagcuucccugcugcucagcggaucucgguuccuagaauuuguuuccggucccugcccgucgacccugcgcuuauagcuuagcccuuuacucccagaggguuccagaucgcccccugguuugcucugcaacuugcagccacucgcagagaagug

SEQ ID NO: 19700 - RNA, 2625 nt, Homo sapiens
cacuucucugcgaguggcugcaaguugcagagcaaaccagggggcgaucuggaacccucugggaguaaagggcuaagcuauaagcgcagggucgacgggcagggaccggaaacaaauucuaggaaccgagauccgcugagcagcagggaagcugcgcagccaccgcgucccgccagcgccgccucuuucccuccccgcccaccgcccgccuggcccggcggggcggcgcgaggacccaggggcggggcgaccuuugcuccggccgugagcaguccaggccaggcguggcccagccgcccggcugcaaggugggguguccccgccgcucggauccccaucucaccugccgcgggcgagguggccccgccgcuuccugcgcucaccucgggucccucccucccgggccagguuuggccgcggcagccgccccugggcgcccgcgcccggacccgcgguuucggucagacccgcccgcgggcugguuucgauuagggccaguaggagggcggagcggccgggacgccaggagggaacuagccuaaguggggacgguccccgugcaggagacaaagagcgucccuggagcgaucagggcucaggagcccgacccggagcccggggcguccgcgcugacuucggguccccggagccuggggcacggcagggagaagacgacggcggagaaggcgacagcggagaaggaaggcaggcugcaggggcgccgucggcgcggcgggccgggaugcggacgccgguggugaugacgcugggcaugguguuggcgcccugcgggcuccugcucaaccugaccggcacccuggcgcccggcuggcggcuggugaagggcuuccugaaccagccaguggacguggaguuguaccagggccugugggacaugugucgcgagcagagcagccgcgagcgcgagugcggccagacggaccaguggggcuacuucgaggcccagcccgugcugguggcgcgggcacucauggucaccucgcuggccgccacgguccuggggcuucugcuggcgucgcugggcgugcgcugcuggcaggacgagcccaacuucgugcuggcagggcucucgggcgucgugcucuucgucgcuggccuccucggccucaucccgguguccugguacaaccacuucuugggggaccgcgacgugcugcccgccccggccagcccggucacggugcaggucagcuacagccugguccugggcuaccugggcagcugccuccugcugcugggcggcuucucgcuggcgcucagcuucgcgcccuggugcgacgagcguugucgccgccgccgcaagggacccuccgccgggccucgccgcagcagcgucagcaccauccaaguggaguggcccgagcccgaccuggcgcccgccaucaaguacuacagcgacggccagcaccgaccgccgccugcccagcaccgcaagcccaagcccaagcccaaggucggcuuccccaugccgcggccgcggcccaaggccuacaccaacucgguggacguccucgacggggaggggugggagucccaggacgcucccucgugcagcacccaccccugcgacagcucgcugcccugcgacuccgaccucuagacgcuuguagagccuggggggcgccggguggcaaaggacucacccccgcacaggcccgccuggcuucgaguuggaacccggacacuugccccucacugguguggauggaaaucugccuuucgugggaccaaacaggacuccuuggacgauuaguucagguuggguuugguuuucuucuuaaagaguuuaguuuuccucuccagagggaucaggguccucuuagggagugacgggcuuuucauauauuuuugcugaagaauauauggaaaggguggcauuugcgucacguggaccagggacagugcugaaaucagcagugcucagaaacaauuuaacauguugaaacgacaauauucuaaaauacugaugaaucuugcaucaauauaauuauuggguuuuuuuucuuuuuccugcuguauaacuccuugccaugcaaacucucaagaggccaauauauuccuggccauguuugaaugagccucuuaaaauaaacuuagagccaugcaaaugccagcagcuuaauggauuucauggaaugaaauaccgugauuaacucauagcuacauaucauugcauaaaugggauuuaucuuuuuucucacuuauuuuugcggugaaagucgagggcaugcaagaguuucucuuccagaagccaagaggagaacaaagguccuaaugcuguacuauuccacccuuuggacgccucauccaggacgcagaggacucuagguuuaacauuuuguacaaaauggaaccuguuaaucauauuaaagcacauauguauauaucuuuuauuuauaaauaaaauuuuaaaacaauaguuucaguauagccacaaaagcucuuuugucuucaguacaacguuugggaguuuaaacauucauuacuaacaauuuccuggcugccucggcacuugugucugaaaucuagcacucaaaucuuugcaccucuuagcauaagguuacuaaaaaaagccaacgggccccacuuaagucccugauugcu

SEQ ID NO: 19701 - RNA, 2500 nt, Homo sapiens
cccuccuggaaccuucaggccacccugaggauggagacucgggugcccgcucuccuccccuaccgccgcgggccugcgccccccgccccggaccccgacucggacguucuagccgcacgugcgggcgccccugggugcgagccgcggacucacgagccgcugcuuguugcucccgccgccgcgaccuggggaagcgaaaaugaaauugacuuuuccgagaaaugaugaaagcggcgcugcccgccaaugagcugcugcggcgaacuuccgcaccucccggccgggccgcucgcgcccucccuccgccuccaccucccgguugcacaagcuugaaacaaacacuggggaggaagggcggagggaggagggcggagaggggaggcgagggagggagcgcggccggaggagggcgggggguggggggauuuccagccgcggcucuucgcaguuuccucuccuuguuuugcuuucgaucuggacuguucucaggcaagccggggaguaacuuuuaguuuugcuccugcgauuauucaacugacgggcuuucauuuccauuucacauacccuagcaacacuuauaccuugcggaauuguauugguagcgugaaaaaagcacacugagagguaacauuuuucaaauaauaguugugacuguguguguuucucucgagggcauguuucuggggacuguggggggccguguguguaugcguguccugaugccuugacacgauguuuugcagacggaaaaugccgggguucauaaauauuaauacugauuuuuggaggaacagucggcgcaauuauggaucaucugauuuuaggggaagcagguucugcugcuguugcugcugcuacuggggcugcugaggcugcgaggaggaggaggaggaggagguagagagggaggaggaggaggagguugguggagguuuaauuucacuuuuggauuugcagaugcggagagguggcuccauggacacagaccugcugugugugcuucugcgccccagguguugugugugggggugcaggucagcuggagucgggccucauuuaaaacaaaauuguguguaugugcguguuugugugugcgcgcgugugugugugugcagccaccgccgccaccggauccgaaggaggggagcggguccuucucggugcccgcggcggcgccucuccaggcugccuccagcguaaauaagcaggcaccgcuccccggccgggaggagcgccuccagccacggccagaggaaacuugcuggggcgccccgcggcgguccaggggcucgccugccugccgggcucggggucgggucgcgggcgucgggugccagcggccggggcgggagggcgggcucggagccgggccgggcgccgggccuggccgacgcgcccugcuuccugggggcugggccgccgccgccgccgcucagaagggacgccgcguccuccuucccgccggccagcgcccggucgggcccuggggcuuugucauugcacuugucccagcgcgccaggggcucgggcggcgcgucccaggaaggcaccgugccgaggggucagccgcccgggccgcggccuagcgccgugcgcccccggguccccgcaggcgcccccggccggccucgcgcgcugggccugacccgccucggcuacggagcgggcgaggugggggcggggagccuccggggaccgagcggcgcagugggggccggcguccccucggggucccggggcgcgggccgcggcgggguggggacgcgagugcccgccccgugcccuccgacccggcuccgggcgccgggugacauucgcccgcuggccgaacaugguuggugcaaagccgcggcggccgccacuuccuuuccgccucgccgguagggcucgcccaccgagugaagccggccgcggccaaucgcggcgcccgccugcucccaguggcacggccugggggccggcguccgccggggcuggggaagccguuccaaguuccaagggucgcggguguaacucaugccccucccagcacgcgccggcgucuccccuuggcccccggucugggugcguuugccacccucuccuccuuguucccuaagaagcgggggaggggaaggaggcgggcagccugggcagggcgccagagccguggucgggcaccaggugaaacgcccgggucagucuguguaggccggacccuuggcgcucggcugcggaugugaucccggggacuggcggccgagguagcucagaagagcgagguggcuuucgcucguuucugacccgcuacugucugaaacuuggggacauauugcccgcccccucccucuucaaccuccucccuccgguugcuccuuguccuugguuauggaaggaaaaaacucaguuguucuaaaugaggaaaaguggugcuggcauucgucuucagccaccggccuccuuauggcugugacucggucugcuuuugaugaauggccaggagguauggaggauaguuaga

SEQ ID NO: 19702 - RNA, 2500 nt, Homo sapiens
ucuaacuauccuccauaccuccuggccauucaucaaaagcagaccgagucacagccauaaggaggccgguggcugaagacgaaugccagcaccacuuuuccucauuuagaacaacugaguuuuuuccuuccauaaccaaggacaaggagcaaccggagggaggagguugaagagggagggggcgggcaauauguccccaaguuucagacaguagcgggucagaaacgagcgaaagccaccucgcucuucugagcuaccucggccgccaguccccgggaucacauccgcagccgagcgccaaggguccggccuacacagacugacccgggcguuucaccuggugcccgaccacggcucuggcgcccugcccaggcugcccgccuccuuccccucccccgcuucuuagggaacaaggaggagaggguggcaaacgcacccagaccgggggccaaggggagacgccggcgcgugcugggaggggcaugaguuacacccgcgacccuuggaacuuggaacggcuuccccagccccggcggacgccggcccccaggccgugccacugggagcaggcgggcgccgcgauuggccgcggccggcuucacucggugggcgagcccuaccggcgaggcggaaaggaaguggcggccgccgcggcuuugcaccaaccauguucggccagcgggcgaaugucacccggcgcccggagccgggucggagggcacggggcgggcacucgcguccccaccccgccgcggcccgcgccccgggaccccgaggggacgccggcccccacugcgccgcucgguccccggaggcuccccgcccccaccucgcccgcuccguagccgaggcgggucaggcccagcgcgcgaggccggccgggggcgccugcggggacccgggggcgcacggcgcuaggccgcggcccgggcggcugaccccucggcacggugccuuccugggacgcgccgcccgagccccuggcgcgcugggacaagugcaaugacaaagccccagggcccgaccgggcgcuggccggcgggaaggaggacgcggcgucccuucugagcggcggcggcggcggcccagcccccaggaagcagggcgcgucggccaggcccggcgcccggcccggcuccgagcccgcccucccgccccggccgcuggcacccgacgcccgcgacccgaccccgagcccggcaggcaggcgagccccuggaccgccgcggggcgccccagcaaguuuccucuggccguggcuggaggcgcuccucccggccggggagcggugccugcuuauuuacgcuggaggcagccuggagaggcgccgccgcgggcaccgagaaggacccgcuccccuccuucggauccgguggcggcgguggcugcacacacacacacgcgcgcacacacaaacacgcacauacacacaauuuuguuuuaaaugaggcccgacuccagcugaccugcacccccacacacaacaccuggggcgcagaagcacacacagcaggucuguguccauggagccaccucuccgcaucugcaaauccaaaagugaaauuaaaccuccaccaaccuccuccuccuccucccucucuaccuccuccuccuccuccuccucgcagccucagcagccccaguagcagcagcaacagcagcagaaccugcuuccccuaaaaucagaugauccauaauugcgccgacuguuccuccaaaaaucaguauuaauauuuaugaaccccggcauuuuccgucugcaaaacaucgugucaaggcaucaggacacgcauacacacacggccccccacaguccccagaaacaugcccucgagagaaacacacacagucacaacuauuauuugaaaaauguuaccucucagugugcuuuuuucacgcuaccaauacaauuccgcaagguauaaguguugcuaggguaugugaaauggaaaugaaagcccgucaguugaauaaucgcaggagcaaaacuaaaaguuacuccccggcuugccugagaacaguccagaucgaaagcaaaacaaggagaggaaacugcgaagagccgcggcuggaaauccccccaccccccgcccuccuccggccgcgcucccucccucgccuccccucuccgcccuccucccuccgcccuuccuccccaguguuuguuucaagcuugugcaaccgggagguggaggcggagggagggcgcgagcggcccggccgggaggugcggaaguucgccgcagcagcucauuggcgggcagcgccgcuuucaucauuucucggaaaagucaauuucauuuucgcuuccccaggucgcggcggcgggagcaacaagcagcggcucgugaguccgcggcucgcacccaggggcgcccgcacgugcggcuagaacguccgagucgggguccggggcggggggcgcaggcccgcggcgguaggggaggagagcgggcacccgagucuccauccucaggguggccugaagguuccaggaggg

SEQ ID NO: 19703 - RNA, 2570 nt, Homo sapiens
acccaaggcgaucccacaccggcuuucucgaguccccgcgcgaggaucacugccuuaccaauccuugugugaucuuucucuggguggcacuuaccugcugcuccccgggcuccgcugacuucaccaggugcuuauccuuguacagagaccagagaccaacguuaggcaggaaaauuaaagccaccgugaacaacaaagucaucugcagaaaucucuucuguuuccucuucauugcaaaugguaacagagaagaaaaguuaaaggagauggcucccugacugcuucuuguguuuaaugucaaauuccuuuccucuccccugcgaagcaccagaaacugagaagcuacaaacuuuuguugcgugcucagcaccaaucugcaggauucagagggaguuggccaucugcagaacaaacgcacaguuacuuuccccccagaaaacuaugacgaaggcauuaucuauuggcuuagaaauaaaugacuugacuaaagaaaucauuaagcccauugaccuccauuaauauaaagcaauagaguaaauauggucguuucauugacuaaagguaaguuauaaaaaagucaacagccugcuagauacuuagguaacugggaguuuuuguugcuguuguuguuguucgccccccaccuccuuagugugggagggcugggucgggguggagcggguuaggagacagaacugagaggaacuggcucaaccccuucaagugucaggaagaaaaguguccgcuuuugacauuggaacagcgucaccuucuucgucuucccugaacaucuuuuccugugcuccccuugggauaacccaccugaacucaaguucaacucccuccggagccagcuugccggcgggcuccaccgggauccagggacucgggauccgggcagaacuccgguucggauggagguccacgaagugccggacccucgcgcgcugucuacacgcuccucugcaggcagcggcugggagccccgggaaccugguggaaaggaggcuacagaugucagcggaguccagccaggaagugguggcgccgcgacgucccuuccucgcgcgguccucggaaugcgauccucugagaagugagcgcucugcccaucaaucucgucccuucccccggugacgcucucacgcuccgcuguucauguuaccauucuuuucuggcaacugaacgaacccacaggaccaucacgagcaccuaaagggcaauauuuuuugaucuccucuucucguaaaggggauggaggcggagaaaccgaagucugugcugggcuuggaagcggacgagggcgcugcgaggaggagcggaaggcggagaugcgccgcggcugcacacggucgcccgcgccccacuccccggcgccugccuuccgcggagacgucgcuggugucugccacgugcggcagcccggagcccaggaggggagggcgggccgccuggcgggggugggcaaugccucccggccuccagacgcuauauaaacagacccggacgcgaggcagcggcggagggcgagcgugacgcuggaggaggagugggagcucccagccugcgcggguccucucuuuaccugccagggcuuuuccggguaaucugggaccgacagggaugccagcaccccgucaucucacccaaagggcgccaggccagagauuccuggggaaaagucgccggcugcaggcgguugucccaggaauuccuccauggugccggcgggagcgcggcgagccggggcgcggcggcugcgggagguggaggcgacccgggacagggccggucccagggagaggggaucccccgagccgcgcguuccgccguucaggccagguaggggguggggaaggaggaggaagaggaucccgaagcaagacagagcugaggcucagaguucucaggcagcagcuucuggaggacaccguggagacccaaggcggcuuuauuugggucugcaaacacccggggccccgguuaagauucggcagggccaccccgcuccucccccgccuugcacgaccgcacuccgcgcgccuugucacugcgagggcuaccuguccucgcacacuccuccgcgauggccagaaaacgugggacucgagauaagacucuggcagaugguacuccucccuccgccuaacguaucaaugcaccaacgccccugaccgcacacucaggaaccuguggcagccucgccaagggacagcgugcccagcaccgugcacugggcacucuuggaucuggagcucacaacuccggaaggaauggggacuuagaugaggugacagacaugcaugcaugcaaugcaggcugaauccgccugucuggagccaaaaauaaacgccauggucaccucuuuguuacaaccuggauaugaugcccacaugcgugggguagacaugcuugggauagauaagccuguggacuucagacgguauuuucucuuucccuuuuuucuucuuucucguccucaucucugucccucccuccuuuucuucucgcccuaucucuuccucccuuucuacucucucuagugucucacuugagaaagaccuagauuu

SEQ ID NO: 19704 - RNA, 2570 nt, Homo sapiens
aaaucuaggucuuucucaagugagacacuagagagaguagaaagggaggaagagauagggcgagaagaaaaggagggagggacagagaugaggacgagaaagaagaaaaaagggaaagagaaaauaccgucugaaguccacaggcuuaucuaucccaagcaugucuaccccacgcaugugggcaucauauccagguuguaacaaagaggugaccauggcguuuauuuuuggcuccagacaggcggauucagccugcauugcaugcaugcaugucugucaccucaucuaaguccccauuccuuccggaguugugagcuccagauccaagagugcccagugcacggugcugggcacgcugucccuuggcgaggcugccacagguuccugagugugcggucaggggcguuggugcauugauacguuaggcggagggaggaguaccaucugccagagucuuaucucgagucccacguuuucuggccaucgcggaggagugugcgaggacagguagcccucgcagugacaaggcgcgcggagugcggucgugcaaggcgggggaggagcgggguggcccugccgaaucuuaaccggggccccggguguuugcagacccaaauaaagccgccuugggucuccacgguguccuccagaagcugcugccugagaacucugagccucagcucugucuugcuucgggauccucuuccuccuccuuccccacccccuaccuggccugaacggcggaacgcgcggcucgggggauccccucucccugggaccggcccugucccgggucgccuccaccucccgcagccgccgcgccccggcucgccgcgcucccgccggcaccauggaggaauuccugggacaaccgccugcagccggcgacuuuuccccaggaaucucuggccuggcgcccuuugggugagaugacggggugcuggcaucccugucggucccagauuacccggaaaagcccuggcagguaaagagaggacccgcgcaggcugggagcucccacuccuccuccagcgucacgcucgcccuccgccgcugccucgcguccgggucuguuuauauagcgucuggaggccgggaggcauugcccacccccgccaggcggcccgcccuccccuccugggcuccgggcugccgcacguggcagacaccagcgacgucuccgcggaaggcaggcgccggggaguggggcgcgggcgaccgugugcagccgcggcgcaucuccgccuuccgcuccuccucgcagcgcccucguccgcuuccaagcccagcacagacuucgguuucuccgccuccauccccuuuacgagaagaggagaucaaaaaauauugcccuuuaggugcucgugaugguccuguggguucguucaguugccagaaaagaaugguaacaugaacagcggagcgugagagcgucaccgggggaagggacgagauugaugggcagagcgcucacuucucagaggaucgcauuccgaggaccgcgcgaggaagggacgucgcggcgccaccacuuccuggcuggacuccgcugacaucuguagccuccuuuccaccagguucccggggcucccagccgcugccugcagaggagcguguagacagcgcgcgaggguccggcacuucguggaccuccauccgaaccggaguucugcccggaucccgagucccuggaucccgguggagcccgccggcaagcuggcuccggagggaguugaacuugaguucagguggguuaucccaaggggagcacaggaaaagauguucagggaagacgaagaaggugacgcuguuccaaugucaaaagcggacacuuuucuuccugacacuugaagggguugagccaguuccucucaguucugucuccuaacccgcuccaccccgacccagcccucccacacuaaggagguggggggcgaacaacaacaacagcaacaaaaacucccaguuaccuaaguaucuagcaggcuguugacuuuuuuauaacuuaccuuuagucaaugaaacgaccauauuuacucuauugcuuuauauuaauggaggucaaugggcuuaaugauuucuuuagucaagucauuuauuucuaagccaauagauaaugccuucgucauaguuuucuggggggaaaguaacugugcguuuguucugcagauggccaacucccucugaauccugcagauuggugcugagcacgcaacaaaaguuuguagcuucucaguuucuggugcuucgcaggggagaggaaaggaauuugacauuaaacacaagaagcagucagggagccaucuccuuuaacuuuucuucucuguuaccauuugcaaugaagaggaaacagaagagauuucugcagaugacuuuguuguucacgguggcuuuaauuuuccugccuaacguuggucucuggucucuguacaaggauaagcaccuggugaagucagcggagcccggggagcagcagguaagugccacccagagaaagaucacacaaggauugguaaggcagugauccucgcgcggggacucgagaaagccggugugggaucgccuugggu

SEQ ID NO: 19705 - RNA, 2212 nt, Homo sapiens
gcgugggcccccgcggccccuuuaauacaccccgccucgcccgccuuccuccuccccuugcaggcagacgccgggauugcgccgccugcagggaccugcccagucuuaaccgggugugcggggagcgcaguccgggugcguaggggccgcucggcgggggccgcgcgggcaagaugguaaguggggcugcgggcgcggguggugugugccccgucuccccaaucuuggauucuauaucucucugccucugaaucuauaucccucugaguuucuucugucucuuccuuuucucugucucucacccucuuugaucucucuuuuuggcacucuagguucucucccucuccauuucucccugccucucuccaucucugucauccucucugccuuuuuccucuccucuccguuucugucuuucccugucccuaucucucccuccucuucucugagucucucugccucuggcacucuccugucucucccucucccuuucugucucucccucucccucucugucgcucccucugccucucugucucucccucugccucucugucucccucugccucucugucucucccucuccaucugugucucucccucuccaucucugucucuuccucugccucucucucucucccucugcuucucugucucuuccucucugucucucccuuuccaucucugucuuucccucuccaucucuguaucuuccucugccccucugucucucccucugccucucugucucucccucuccaucucugucucucccucuacaucugucucuucuuuuccaucugucucucccucuccaucucugccucucucucuucccuuccccuuuuucugugucgcgcacucucuucucugccucucccugccuuucucucugucccuguucucuccccgcgucucucccucuuucucuccagcucuccccccucccugcccgccccggcccgguuugcugcagucuccuggcgcacggauaaccuugcugccgccgcuccuccagcucuuccccaccccccuauccccggcccgggccagggccagaagggggcggggcagcgagccucggguuuuggggugggggggaaugaggcgggaucuggggcaggacugagggcgggggggagucuaggggcguggguucuugcagaagcuaggaugugaggucccaagaggaggagggggaguucuccaggaccccggaaaggguggggacaugggcgugagagagguccucgcuguggggaaggcaggcccgggagggagccaggccuccgaaaagccaaggcugggaggcuggacugagcgccccgugcccgccccccaggugugcgcucgggcggcccucggucccggcgcgcucugggccgcggccuggggcguccugcugcucacagccccugcgggggcgcagcguggccggaagaaggucgugcacgugcugggugagucagggccgcuaaaaguggucuucuccgcgaaaagcagaaguggccaagugcggagagggguagcggguagggcguuccugacguccgcgguucccccagccacuccccaucugagccccucgcccucucccugagccccuggacccuucugauuccccgacccccacccgagucuucccacguuccccuccccagagacaccuuccccagaggcccccuucugccccuaggccccuccucugaacccugcuugguuguccucagagggugagucgggcucgguagugguacagacagcgccugggcaggugguaagccaccgugguggcaccaucgucuugcccugccgcuaccacuaugaggcagccgcccacggucacgacggcguccggcucaaguggacaaaggugguggacccgcuggccuucaccgacgucuucguggcacuaggcccccagcaccgggcauucggcagcuaccgugggcgggcugagcugcagggcgacgggccuggggaugccucccugguccuccgcaacgucacgcugcaagacuacgggcgcuaugagugcgaagucaccaaugagcuggaagaugacgcuggcauggucaagcuggaccuggaaggugaucagccgguggggaggauaaaccuugcuucugaggaaggaggggggcggggauggcaagggacauaaaccaaaucaaguuggccugcaggcauuuagaagguugguugggguaga

SEQ ID NO: 19706 - RNA, 2212 nt, Homo sapiens
ucuaccccaaccaaccuucuaaaugccugcaggccaacuugauuugguuuaugucccuugccauccccgccccccuccuuccucagaagcaagguuuauccuccccaccggcugaucaccuuccagguccagcuugaccaugccagcgucaucuuccagcucauuggugacuucgcacucauagcgcccguagucuugcagcgugacguugcggaggaccagggaggcauccccaggcccgucgcccugcagcucagcccgcccacgguagcugccgaaugcccggugcugggggccuagugccacgaagacgucggugaaggccagcggguccaccaccuuuguccacuugagccggacgccgucgugaccgugggcggcugccucauagugguagcggcagggcaagacgauggugccaccacgguggcuuaccaccugcccaggcgcugucuguaccacuaccgagcccgacucacccucugaggacaaccaagcaggguucagaggaggggccuaggggcagaagggggccucuggggaaggugucucuggggaggggaacgugggaagacucgggugggggucggggaaucagaaggguccaggggcucagggagagggcgaggggcucagauggggaguggcugggggaaccgcggacgucaggaacgcccuacccgcuaccccucuccgcacuuggccacuucugcuuuucgcggagaagaccacuuuuagcggcccugacucacccagcacgugcacgaccuucuuccggccacgcugcgcccccgcaggggcugugagcagcaggacgccccaggccgcggcccagagcgcgccgggaccgagggccgcccgagcgcacaccuggggggcgggcacggggcgcucaguccagccucccagccuuggcuuuucggaggccuggcucccucccgggccugccuuccccacagcgaggaccucucucacgcccauguccccacccuuuccgggguccuggagaacucccccuccuccucuugggaccucacauccuagcuucugcaagaacccacgccccuagacucccccccgcccucaguccugccccagaucccgccucauucccccccaccccaaaacccgaggcucgcugccccgcccccuucuggcccuggcccgggccggggauagggggguggggaagagcuggaggagcggcggcagcaagguuauccgugcgccaggagacugcagcaaaccgggccggggcgggcagggaggggggagagcuggagagaaagagggagagacgcggggagagaacagggacagagagaaaggcagggagaggcagagaagagagugcgcgacacagaaaaaggggaagggaagagagagaggcagagauggagagggagagacagauggaaaagaagagacagauguagagggagagacagagauggagagggagagacagagaggcagagggagagacagaggggcagaggaagauacagagauggagagggaaagacagagauggaaagggagagacagagaggaagagacagagaagcagagggagagagagagaggcagaggaagagacagagauggagagggagagacacagauggagagggagagacagagaggcagagggagacagagaggcagagggagagacagagaggcagagggagcgacagagagggagagggagagacagaaagggagagggagagacaggagagugccagaggcagagagacucagagaagaggagggagagauagggacagggaaagacagaaacggagaggagaggaaaaaggcagagaggaugacagagauggagagaggcagggagaaauggagagggagagaaccuagagugccaaaaagagagaucaaagagggugagagacagagaaaaggaagagacagaagaaacucagagggauauagauucagaggcagagagauauagaauccaagauuggggagacggggcacacaccacccgcgcccgcagccccacuuaccaucuugcccgcgcggcccccgccgagcggccccuacgcacccggacugcgcuccccgcacacccgguuaagacugggcaggucccugcaggcggcgcaaucccggcgucugccugcaaggggaggaggaaggcgggcgaggcgggguguauuaaaggggccgcgggggcccacgc

SEQ ID NO: 19707 - RNA, 4222 nt, Homo sapiens
agaaguaggaacaugauccagaccaagccagugaauugccugagagauggucauaugauccagccagggccaaucagaguaaaucccagcucaguuaaaaccccagagggagccggggcaguggcucaugccuguaaucccagcacuuugggaggccgaggcaggugaaacaccugaggucaggaguucgagaccagccuggccaacauggcgaaaccccgucuccacuaaaaauacaaaaauuagguggguguggugguggccgccuguaaucccagcuacucaggaggcugaagcaggagaaucacuugaaccugggagguggagguugcagugagcuaagaucaugccauugcacuccaucuugggcaacaagaaugggaguccaucucaaaacaacaacaacaacaacaaaaaaaaaccacagcguuuguaaccuagagccucuggcauccaccuuacugccaagaagaaguaaaugccugggaaugaagccaccacaaaagaaagcagagucaaggcauggagugagacacugagccccuggauccagcugugccugaagcucgcccacuguggacuuugcaucucaugagcuaagagccaaugcaucccaucuucuuacccugcccacccaucugccacucuggcguggccccugucagaggucucaccugaaacaccaccacuuucccauugucagucugcaaguaguauguccagguggaggagacaaaucccugggcugaguugacaaggucauugcagaggguggaaaacaaguccaagagggagagggccccacuuggagccuccaggaccuuucucuggugaaaaaagguccaagacacaaagauggcaccgaaauagggcauuaaccaaugaaugggagggggcaggaugugguggcucacgccuguaaucccaacacuuuggaaggcugaggcaggccgaucacuugaggccagaaguuugagaccagccuggacaacaucgugaaacccugucucuacuaaaaauacaaaaauuagccaggcaugauggcgcacgccuggaaucucagcuacuccagaggcugaggcaggagauuugcuugaacccaggaggcagagguugcagugagccaagaucacaccacugaacucuagccugggugaaagagugagacuccaucucaaauaaauaaaugaauaaauaaacuaacaggagaggagcuaggagaauucacuuggauuggauguggcuaagugauuugggccaauaggacuucuuauagugaacacagaucucagcguggcaguuggcuuccuguguacccuuagggaaguggauugugcucucugagcccuaaaauggguaucguucucuuccuucauggaguagccaugaaauuucaacuagaggaugccugccaggugccuggcacggcacaggcacuuaaugcguaguagucccuauuacuaaaaauaucaucauccucauuauucuuauuuugacagcgucaagacggaggucugauggccggccaugguggcucaugccuguaaucccagcacuuugggaggccgacgugggaagaucacuugaggucaggaguucaagaucagccuggccaacaugaugaaacccugucucuccuaaaaauacaaaaauuagccgauuguaguggggggugccuguaaucucaccuacaaaggaggcugaggcaggagaaccacuugaacccgggaggcggaggcugcagugagccaagauuguaccacugcacuccaggcuaggcaacagagcaagacuucaucucaaaaaauaaauaaauaaauaagagggagcucugaauuggaagggcugacagugcagugagcuuuucugaacagcagugaaagcugggaagggguggaggaaaaugggggaaguggggaaagggcuuucuggggagucccagccccuaggucucuggcuaugcuacaugauuuucugugccucaguuuccccaugaugcagcauugcuuggacuacaauagaugaaccguuauuauuucucccauaaggcagugugugcgugcuugcgaggcaagccugcucuacccugagccgcaguucugagccccuccaggugacagugaccaccagcucaucacaggggaagggcuuagaccagcaccuggcagcucugggggcgccuaagaggagugaggugaggaguggccacagcucugguggcuucaaaucucgccccuugcacagcccuguguaugaccugggagguugcccccugggcacuaaaugggggugacauuguccuuugugccuccaagugacacaaaaacauuugggacagguugaagucaggcccgaaccaggacagauguuugauaaaugauggcuguuuucugccacuuauuccugaaaaggugguggggcauggggggcguuguugcauguaacuaaggcuggagacaugacggggcuggauggagguugcccugcaggccugguauagaacgcagagucuggcagagccucugcacgugaaugaagauuucccacggggugaagaggguggggguauugggaaaagggaccccaggccgcagugggaggcccaccuucugcuccggcucaggcuccgcgggcuggcuccagcagccguggcuacaggccugcugcucugccuccuucacauaggcuuccacgcaggcugugggaggugggagcgggugacuggggacggcccuucccaggccaccucuccccacgcuggcccacccugccggcgggcccucaccugcuucacacucaguuuggguggcauugggcuuggagcuucuggccacaaaucggcagauggagaagaggcggcagccacgcucgcaagcgcugaucagaacggcucugucauagggagacucggaggcgcccuccagccccgccugggggaggggaggacagggggcucaggccauggggaggggcaggaggaggguggggggaccggagcauucagcagaggcagggaaaggcuuccccgcuccccacgacaucuagccagauggagaugaaguugggagaggcuacaaauauuagugggggcucuuagcucugaggagggagauggggagggagcuugagaagagaaauggacagugaagguggagagaaaugagccuuccccccacuagguuccagggaggaggggagacauggagaaggauucucagaccuggaggaggagggggaggcucagaggaggggguuuuggucacacgcagaucaggcuugaauccuggggaguggugguaugaguaggggcugguagcucugaguggggagggaacacgauguggaggaggaggaaugagguggggggaccaucaggccugagggagcuggggguugggugcuagaggguccuuacccagcagagugcggaaggagcccgggaggugguaucggccccuuaucgcaaggaccugcauccccaagcacucccccaucagagggaaccccagcccgucaacuacuggagagaucuccccauucccgacccccaccuccccacggacacccccaccaaagucuccugcugucauccaagagaagcccaucccaacgccuccuccuucggagagaucccgcgucccccgcuggcaccuggcaccgcacgcgccucaccugcgagggcugcgggccgaggucgcggucgcggcaccgcagcuggcaguucugcguguccccgagcuggggggcgaagggaucgcgggcggacggcgcggaggcggcgggcggcgacgccaacagcagcagcagcagcagcggcgguggcaucagcgccaccgcagccauggccgggcggaacgcggggggcgcgggggacuccagcucaggccgggcacggaggaugcagcggcugcggcggggaccggggcgcugacgucacccgagcgaggcagccugggaagcggggggugggagaugcggagagcgggcgggguagcugcgcugcggcacccgaggcgugcgggucgggcggggcaggugcaucgcggcccccaccgucuaucccaucgcgggggucccaggacaccucccuggugcccacgggcgggggaucucugcuggcgcuuggggccaaaaggaaauauauagggggaugggauggaggggacuauuccccaggggugucgaggagagcggagagcuuggcggaggaggcgacguguga

SEQ ID NO: 19708 - RNA, 4222 nt, Homo sapiens
ucacacgucgccuccuccgccaagcucuccgcucuccucgacaccccuggggaauaguccccuccaucccaucccccuauauauuuccuuuuggccccaagcgccagcagagaucccccgcccgugggcaccagggagguguccugggacccccgcgaugggauagacggugggggccgcgaugcaccugccccgcccgacccgcacgccucgggugccgcagcgcagcuaccccgcccgcucuccgcaucucccaccccccgcuucccaggcugccucgcucgggugacgucagcgccccgguccccgccgcagccgcugcauccuccgugcccggccugagcuggagucccccgcgccccccgcguuccgcccggccauggcugcgguggcgcugaugccaccgccgcugcugcugcugcugcuguuggcgucgccgcccgccgccuccgcgccguccgcccgcgaucccuucgccccccagcucggggacacgcagaacugccagcugcggugccgcgaccgcgaccucggcccgcagcccucgcaggugaggcgcgugcggugccaggugccagcgggggacgcgggaucucuccgaaggaggaggcguugggaugggcuucucuuggaugacagcaggagacuuugguggggguguccguggggaggugggggucgggaauggggagaucucuccaguaguugacgggcugggguucccucugaugggggagugcuuggggaugcagguccuugcgauaaggggccgauaccaccucccgggcuccuuccgcacucugcuggguaaggacccucuagcacccaacccccagcucccucaggccugaugguccccccaccucauuccuccuccuccacaucguguucccuccccacucagagcuaccagccccuacucauaccaccacuccccaggauucaagccugaucugcgugugaccaaaacccccuccucugagccucccccuccuccuccaggucugagaauccuucuccaugucuccccuccucccuggaaccuaguggggggaaggcucauuucucuccaccuucacuguccauuucucuucucaagcucccuccccaucucccuccucagagcuaagagcccccacuaauauuuguagccucucccaacuucaucuccaucuggcuagaugucguggggagcggggaagccuuucccugccucugcugaaugcuccgguccccccacccuccuccugccccuccccauggccugagcccccuguccuccccucccccaggcggggcuggagggcgccuccgagucucccuaugacagagccguucugaucagcgcuugcgagcguggcugccgccucuucuccaucugccgauuuguggccagaagcuccaagcccaaugccacccaaacugagugugaagcaggugagggcccgccggcagggugggccagcguggggagagguggccugggaagggccguccccagucacccgcucccaccucccacagccugcguggaagccuaugugaaggaggcagagcagcaggccuguagccacggcugcuggagccagcccgcggagccugagccggagcagaaggugggccucccacugcggccuggggucccuuuucccaauacccccacccucuucaccccgugggaaaucuucauucacgugcagaggcucugccagacucugcguucuauaccaggccugcagggcaaccuccauccagccccgucaugucuccagccuuaguuacaugcaacaacgccccccaugccccaccaccuuuucaggaauaaguggcagaaaacagccaucauuuaucaaacaucuguccugguucgggccugacuucaaccugucccaaauguuuuugugucacuuggaggcacaaaggacaaugucacccccauuuagugcccagggggcaaccucccaggucauacacagggcugugcaaggggcgagauuugaagccaccagagcuguggccacuccucaccucacuccucuuaggcgcccccagagcugccaggugcuggucuaagcccuuccccugugaugagcugguggucacugucaccuggaggggcucagaacugcggcucaggguagagcaggcuugccucgcaagcacgcacacacugccuuaugggagaaauaauaacgguucaucuauuguaguccaagcaaugcugcaucauggggaaacugaggcacagaaaaucauguagcauagccagagaccuaggggcugggacuccccagaaagcccuuuccccacuucccccauuuuccuccaccccuucccagcuuucacugcuguucagaaaagcucacugcacugucagcccuuccaauucagagcucccucuuauuuauuuauuuauuuuuugagaugaagucuugcucuguugccuagccuggagugcagugguacaaucuuggcucacugcagccuccgccucccggguucaagugguucuccugccucagccuccuuuguaggugagauuacaggcaccccccacuacaaucggcuaauuuuuguauuuuuaggagagacaggguuucaucauguuggccaggcugaucuugaacuccugaccucaagugaucuucccacgucggccucccaaagugcugggauuacaggcaugagccaccauggccggccaucagaccuccgucuugacgcugucaaaauaagaauaaugaggaugaugauauuuuuaguaauagggacuacuacgcauuaagugccugugccgugccaggcaccuggcaggcauccucuaguugaaauuucauggcuacuccaugaaggaagagaacgauacccauuuuagggcucagagagcacaauccacuucccuaaggguacacaggaagccaacugccacgcugagaucuguguucacuauaagaaguccuauuggcccaaaucacuuagccacauccaauccaagugaauucuccuagcuccucuccuguuaguuuauuuauucauuuauuuauuugagauggagucucacucuuucacccaggcuagaguucaguggugugaucuuggcucacugcaaccucugccuccuggguucaagcaaaucuccugccucagccucuggaguagcugagauuccaggcgugcgccaucaugccuggcuaauuuuuguauuuuuaguagagacaggguuucacgauguuguccaggcuggucucaaacuucuggccucaagugaucggccugccucagccuuccaaaguguugggauuacaggcgugagccaccacauccugcccccucccauucauugguuaaugcccuauuucggugccaucuuugugucuuggaccuuuuuucaccagagaaagguccuggaggcuccaaguggggcccucucccucuuggacuuguuuuccacccucugcaaugaccuugucaacucagcccagggauuugucuccuccaccuggacauacuacuugcagacugacaaugggaaaguggugguguuucaggugagaccucugacaggggccacgccagaguggcagaugggugggcaggguaagaagaugggaugcauuggcucuuagcucaugagaugcaaaguccacagugggcgagcuucaggcacagcuggauccaggggcucagugucucacuccaugccuugacucugcuuucuuuugugguggcuucauucccaggcauuuacuucuucuuggcaguaagguggaugccagaggcucuagguuacaaacgcugugguuuuuuuuuguuguuguuguuguuguuuugagauggacucccauucuuguugcccaagauggagugcaauggcaugaucuuagcucacugcaaccuccaccucccagguucaagugauucuccugcuucagccuccugaguagcugggauuacaggcggccaccaccacacccaccuaauuuuuguauuuuuaguggagacgggguuucgccauguuggccaggcuggucucgaacuccugaccucagguguuucaccugccucggccucccaaagugcugggauuacaggcaugagccacugccccggcucccucugggguuuuaacugagcugggauuuacucugauuggcccuggcuggaucauaugaccaucucucaggcaauucacuggcuuggucuggaucauguuccuacuucu

SEQ ID NO: 19709 - RNA, 3695 nt, Homo sapiens
uaucgccaucaaggucagaccugagccagccaaagguagcccucccugggaccucagccagccccaggaugaagcaggagcucacuuccugcuggacuggaagccagaagagguggaagccuggauccagccaugccugaagcuaccauaccucuagauucucagcaauaagcuuuucagaucauuuuucacuauaaagaugaggacacugggucccagcugggacagaggcuuccucaggagaaaggggcaagcccagagucuccccacaagagacacagugggcccgaucccccguauggagugaguucccagggccacucaccacagccguguagaaggugcagauaauuccgguggacaggagcgacgcccagauguccagcccggucacuaugcaaaaagaggucccccuguuaggccccugggcggggcgcaaacuuagucuuggguucuccucucccucccuuucucuucccagacaugcuucccuaaucucccagagucacaccuugguucaggaugagggccggugcguagauuacgaugccgguguacagcaucuguagacagaguguggggcgggugagcagggagggcgucugggcgaguuggggauggggagaggaggcagaaggguggucccagaauaugggcggggcagauaggccgggucuuccagagugcaggcggggucaggccggcuguggugugggaggggacugaugggggcggggucagaacgggagcauggggggcggggucugggcggggucuugaauggugggggccgggcuagugaaggcugacgcucucggggcccugagcggagggcggggccgaggccacucaccguggcuacaauguacugcaaagucccgcagagccgcacugcgcggcugaagcgcaucuccagguacugcaaggagggacucgaggucaccuggacaguccuuacccaggagccgaggccucucgggucccuggucugcucucuaggugggccccucccuccggaagccaaccgcgcccgccagauucuugcacgugggggccccgccgcacgcacacacccgugcacaggugccaucccgugccugugcguaccccguggaccuggaggacugguccaugcgugugcacgcgcccucccacuugcgccugacgggcgcgggcuccuggagcagccaccgcucagcagacaccgacguggcccgcaagcgcacaguguagacagugccccgggccaaugguguuggccgccuaggauauaccugucacgauuuuuuugggggggaggggggacggagucucgcucugucgcccaggcuagggugcacuggcacgaucucggcucacugcaaccuccgccucccagguucaagcaauucuucugccucagccuccugaguagcugggauuacaggcgcgcgcgaccaugcccggcuaauuuuuguauuuuuaguaaagacgggguuucaccauguuagccaggcuggucuugaacuccugaccucgugauccacccaccucggccucccaaagugcugggauuacaggcgugagccacugcgcccugccacaauauuuuuuuuuccuuugagacaagagucucgcucugucgcccaggcuggagugcagugacgcgauaucggcucacugcaaccucccggguucaagcaauucuccugucuuagccucccaaguagcugggauuacaggugcccaccaccacauccggcuaauuuuuguauuuuuaguagagacgggguuucgccauguuggccaggcuggucuugaacuccugaccucaggugaucugcaugcuuuggccucccaaagugcugggauuacaggcgugagccaccgcaccgggccccggucacgauuuuaaucgcuuuacccucuccccuggagggagguccuguaauucgcccauuggacagcugggaaacccaaacagagaggcacgccccuugcccaagauacaagaaagcagugaagccagguuucgaaccccggagccgucagcaguccccucuagcgcgcacacgugggucugcacgcccgggcagguggggggcagguguguguccacccgugaggacacaccuggucgagccgggccccgccccgcgcgcgcuuccaccgaaggagcaggacgccaggcucucucuuccuccuuccugccccucgccgggcgccuggggccucuuccuagaacccuccccacgugucugccuaggggccccuuccguuaaagcaccgaggugccauccgcguccuccuguacagcggcccaaagccccagcgccucccccacacggggucccagcacugccaguggggcagguccuacccccgggccucuguccgguaccucguaggugcuggugaggcccaggcgguagaagacgggcaugaagagcagggcggugaggaccgaguucagaagcuggcccaggcacauccagaggaacuugaggccauagcgauaggccuccgacggcacgcccagcaccugcacggccgacaugaagcuggcagacagcgacaggcccacgggcagggccgccaggcgccggcccccggugaagaaguccucagcgcugcgcugcccgccccgagccagcccgacccacagcccgaugccaguggacaccaggagcaugagggcaaagaccccguagucccaggcuccgaaggugggccguuccccggucuccacggccuccaugagggcgggugcggaggcccagcgcguccucggacgcccugcgugcucaagcgggggaagcuggcaggggccgaggaggcaggacggggagggcgggugggaggaugcucggcagccuguccccgcuccgucuggggugggaagcggcgagaggggccggggcucccuggguuaggaaucuaugggcugucgauguccgugucggccucccuguccccgcugucugucucugcguccgccccugcugucugucuguccugccaccuccccucucacucuggguuccgcugucccaugcagccggcugucugucccucucccugggcgcugugcucagcgcugacagcuggaggucgccuuggggcuuacgggagcagcucgugauuguggguugcagauuuauugggcucccgggucaccgcgacuccgccuccagaccuaggggcgggcaggacccgcacccuuucagcccuggacugggacagacaggccaggacaggcuaucuggguggcugcagggggugguaucggggagggcucccaaaugccccuccauccccaugcacccacccauccccaugcacugugauccccugaucacagcugucacugucugcuguugacagguggggaaauugaggcucagagagggcaugucacuauccaagccugcacagccugcuucagcacucaaagccguauugugcuugaauaccuugagcuauggggagcucacuuucaugcaggacugggguucacuuucaggguuucaggggacccauaaagaaaacuuaccuggcuuuaccacccccaaacuggcaugugggccuacccccuuucucuagagccuuagggggugggcaucacugaaccccgcucuugggcuaagcugggugggagacauucagagcucaaguucugaguggguacauacuuggggaagacuuugcuccucccu

SEQ ID NO: 19710 - RNA, 3695 nt, Homo sapiens
agggaggagcaaagucuuccccaaguauguacccacucagaacuugagcucugaaugucucccacccagcuuagcccaagagcgggguucagugaugcccacccccuaaggcucuagagaaaggggguaggcccacaugccaguuugggggugguaaagccagguaaguuuucuuuauggguccccugaaacccugaaagugaaccccaguccugcaugaaagugagcuccccauagcucaagguauucaagcacaauacggcuuugagugcugaagcaggcugugcaggcuuggauagugacaugcccucucugagccucaauuuccccaccugucaacagcagacagugacagcugugaucaggggaucacagugcauggggaugggugggugcauggggauggaggggcauuugggagcccuccccgauaccacccccugcagccacccagauagccuguccuggccugucugucccaguccagggcugaaagggugcggguccugcccgccccuaggucuggaggcggagucgcggugacccgggagcccaauaaaucugcaacccacaaucacgagcugcucccguaagccccaaggcgaccuccagcugucagcgcugagcacagcgcccagggagagggacagacagccggcugcaugggacagcggaacccagagugagaggggagguggcaggacagacagacagcaggggcggacgcagagacagacagcggggacagggaggccgacacggacaucgacagcccauagauuccuaacccagggagccccggccccucucgccgcuucccaccccagacggagcggggacaggcugccgagcauccucccacccgcccuccccguccugccuccucggccccugccagcuucccccgcuugagcacgcagggcguccgaggacgcgcugggccuccgcacccgcccucauggaggccguggagaccggggaacggcccaccuucggagccugggacuacggggucuuugcccucaugcuccugguguccacuggcaucgggcugugggucgggcuggcucggggcgggcagcgcagcgcugaggacuucuucaccgggggccggcgccuggcggcccugcccgugggccugucgcugucugccagcuucaugucggccgugcaggugcugggcgugccgucggaggccuaucgcuauggccucaaguuccucuggaugugccugggccagcuucugaacucgguccucaccgcccugcucuucaugcccgucuucuaccgccugggccucaccagcaccuacgagguaccggacagaggcccggggguaggaccugccccacuggcagugcugggaccccgugugggggaggcgcuggggcuuugggccgcuguacaggaggacgcggauggcaccucggugcuuuaacggaaggggccccuaggcagacacguggggaggguucuaggaagaggccccaggcgcccggcgaggggcaggaaggaggaagagagagccuggcguccugcuccuucgguggaagcgcgcgcggggcggggcccggcucgaccagguguguccucacggguggacacacaccugccccccaccugcccgggcgugcagacccacgugugcgcgcuagaggggacugcugacggcuccgggguucgaaaccuggcuucacugcuuucuuguaucuugggcaaggggcgugccucucuguuuggguuucccagcuguccaaugggcgaauuacaggaccucccuccaggggagaggguaaagcgauuaaaaucgugaccggggcccggugcgguggcucacgccuguaaucccagcacuuugggaggccaaagcaugcagaucaccugaggucaggaguucaagaccagccuggccaacauggcgaaaccccgucucuacuaaaaauacaaaaauuagccggaugugguggugggcaccuguaaucccagcuacuugggaggcuaagacaggagaauugcuugaacccgggagguugcagugagccgauaucgcgucacugcacuccagccugggcgacagagcgagacucuugucucaaaggaaaaaaaaauauuguggcagggcgcaguggcucacgccuguaaucccagcacuuugggaggccgagguggguggaucacgaggucaggaguucaagaccagccuggcuaacauggugaaaccccgucuuuacuaaaaauacaaaaauuagccgggcauggucgcgcgcgccuguaaucccagcuacucaggaggcugaggcagaagaauugcuugaaccugggaggcggagguugcagugagccgagaucgugccagugcacccuagccugggcgacagagcgagacuccguccccccucccccccaaaaaaaucgugacagguauauccuaggcggccaacaccauuggcccggggcacugucuacacugugcgcuugcgggccacgucggugucugcugagcgguggcugcuccaggagcccgcgcccgucaggcgcaagugggagggcgcgugcacacgcauggaccaguccuccagguccacgggguacgcacaggcacgggauggcaccugugcacgggugugugcgugcggcggggcccccacgugcaagaaucuggcgggcgcgguuggcuuccggagggaggggcccaccuagagagcagaccagggacccgagaggccucggcuccuggguaaggacuguccaggugaccucgagucccuccuugcaguaccuggagaugcgcuucagccgcgcagugcggcucugcgggacuuugcaguacauuguagccacggugaguggccucggccccgcccuccgcucagggccccgagagcgucagccuucacuagcccggcccccaccauucaagaccccgcccagaccccgccccccaugcucccguucugaccccgcccccaucaguccccucccacaccacagccggccugaccccgccugcacucuggaagacccggccuaucugccccgcccauauucugggaccacccuucugccuccucuccccauccccaacucgcccagacgcccucccugcucacccgccccacacucugucuacagaugcuguacaccggcaucguaaucuacgcaccggcccucauccugaaccaaggugugacucugggagauuagggaagcaugucugggaagagaaagggagggagaggagaacccaagacuaaguuugcgccccgcccaggggccuaacagggggaccucuuuuugcauagugaccgggcuggacaucugggcgucgcuccuguccaccggaauuaucugcaccuucuacacggcuguggugaguggcccugggaacucacuccauacgggggaucgggcccacugugucucuuguggggagacucugggcuugccccuuucuccugaggaagccucugucccagcugggacccaguguccucaucuuuauagugaaaaaugaucugaaaagcuuauugcugagaaucuagagguaugguagcuucaggcauggcuggauccaggcuuccaccucuucuggcuuccaguccagcaggaagugagcuccugcuucauccuggggcuggcugaggucccagggagggcuaccuuuggcuggcucaggucugaccuugauggcgaua

SEQ ID NO: 19711 - RNA, 2633 nt, Homo sapiens
ccagagccauucugcccguguaggaggucggcucgaggggcucggcccagguuuuccaccagcaaccgcccauugcgguacacggugauccggcgcugacagcggaccaagccggagaggucccccugggcugcauccgaggaugcggaugaugguggagguggggcagcggcuggggcggguccugcaugcuucacccgcagcacgcggccgggcuugaccucuacaaagguguagccaucgcuggacucgacgcucuccaguggccccacggcguuggggggcgugcccagcaggcaacagaagauaccgucggucaccccggucagcaugguguguccugugagugaggacagcagccaguucaggugcugucucaaugagaacccugcaccgugcagcaggcacucccugagccuugggagaacuguuuuagacuccaguuuggggagcgccagaucaagugagccacggcacugagauuuuuuuguuuguguguguguguguguguguguguguguguguuuuugagacagucucgcuuugucauccaggcuggagggcaguggccggauuucggcuuacugcaaccucccccuccuggguucaagcgauucucuugccucagccuccugaguagcugggauuauaggcaggugccaccaugucuagcuaauuuuuguauuuuuuguagagaugggguuucaccauguuggccaggcuggucuugaacuccugaccucaaauuuuccuccugcuucggccucccaaagugcugggauuauaggugugagccaccgugcacugacauguuuugucugagcagugccuuugugguaguuacccuccugggucacccuagucuauccucagagagaaagacuuggcuauggcuuaccccacaggguguccacagggaaggugguggcgucuuguguggggauguuccuggagaaggggacauuguggcaaauguggaccagccggaagacacccccuccccccagcuggaguuuauaccauuuauggccuccuaacucauucauucagguauacacuaacucauccauucagguauacacuaacucauucauucagguauacacuaacucacuaacucauccagguaugcacucacuaacucacauauccccagggccuccuaaggcaucuaaaauaugcaaaucuuuggugagcccccagugaggcuccuggcucugaauuugacuccugaaaggugaggcccuaggagagggggauggggacugagccacagaaagccuugcucagcuccccuagaccggggugagccggggucuguuucauagagggccaagcugaggcccagacacucugagaggaagcuagacucugaacuuccuccuuggcacccuggauucuggggaucugcuauacaaguccccagagguggcgaagaggaugggagaggcagggcccuggcugggggccuccaagccuccaucccacuccuugggccacccccgcccccguguccauggcaaccacaggcgguuacauaaccuaagggggggauacccgagcagugcacccccauugucgaggugucuagggccuggagaugggaccagcugccugccugcccccuaccccagguugggcgccgcuaagguaacgcacgcccgagacugagccgcaguggccccagacauacuggaggggaagcaggccaugccccccaccucgaguggggcccuaaucccggauuguggagggcaacgcacaggcgccaccccagccccgcuuccccgcccccggcccccgccuuccagguguucgucaucccugcagcggggucgagcccacuggggcuccguggcuuccuacgagcccaaacgcgggguugguggacaccacuccuccgaaguggaggccccggggcuucgaucucuccuuuuggggcccguuccccgcucaccucaucgagggccgcggggcccgggucggggcggaggggucccaggcggagaagccagcguccgccugcuggcgccguuuacaugguggcgcggggucaggccgggugcgucuacgcgggcgggcaccugccccuggcggucagcgcaggggcaucccgcggccgccgaaacagccggcccuuuaaguuccucccccgaguaggcggagccacgugccgacgggcgggcacuucggccuaucgcagcugcggacugaccuggccuaguuaggagcccaaugagaggcggcaauuccguaguggaggcgggcucugggagcaacggccccgccccuuuuggggguucaccgagguugggggagggauggggccuggcucaaggcggagaaggggguugcagucuagggucugcgggacgccugggagugugcggccggggcccucucucugcaaaugggucucccaagcccuugccccccagccccugccucccaauugcccuguuccucuccaaacgaggcccccauacucuucucucuguauugaccuuuccauucuagaagcagagacuccaagaucuuuuuccaaucuccgguggggaaacugaggcucauaaagggcacaagagcauaaaucaagcaaggagcaaagcugggacuugaacccaaggcugugu

SEQ ID NO: 19712 - RNA, 2633 nt, Homo sapiens
acacagccuuggguucaagucccagcuuugcuccuugcuugauuuaugcucuugugcccuuuaugagccucaguuuccccaccggagauuggaaaaagaucuuggagucucugcuucuagaauggaaaggucaauacagagagaagaguaugggggccucguuuggagaggaacagggcaauugggaggcaggggcuggggggcaagggcuugggagacccauuugcagagagagggccccggccgcacacucccaggcgucccgcagacccuagacugcaacccccuucuccgccuugagccaggccccaucccucccccaaccucggugaacccccaaaaggggcggggccguugcucccagagcccgccuccacuacggaauugccgccucucauugggcuccuaacuaggccaggucaguccgcagcugcgauaggccgaagugcccgcccgucggcacguggcuccgccuacucgggggaggaacuuaaagggccggcuguuucggcggccgcgggaugccccugcgcugaccgccaggggcaggugcccgcccgcguagacgcacccggccugaccccgcgccaccauguaaacggcgccagcaggcggacgcuggcuucuccgccugggaccccuccgccccgacccgggccccgcggcccucgaugaggugagcggggaacgggccccaaaaggagagaucgaagccccggggccuccacuucggaggagugguguccaccaaccccgcguuugggcucguaggaagccacggagccccagugggcucgaccccgcugcagggaugacgaacaccuggaaggcgggggccgggggcggggaagcggggcugggguggcgccugugcguugcccuccacaauccgggauuagggccccacucgagguggggggcauggccugcuuccccuccaguaugucuggggccacugcggcucagucucgggcgugcguuaccuuagcggcgcccaaccugggguagggggcaggcaggcagcuggucccaucuccaggcccuagacaccucgacaaugggggugcacugcucggguaucccccccuuagguuauguaaccgccugugguugccauggacacgggggcggggguggcccaaggagugggauggaggcuuggaggcccccagccagggcccugccucucccauccucuucgccaccucuggggacuuguauagcagauccccagaauccagggugccaaggaggaaguucagagucuagcuuccucucagagugucugggccucagcuuggcccucuaugaaacagaccccggcucaccccggucuaggggagcugagcaaggcuuucuguggcucaguccccaucccccucuccuagggccucaccuuucaggagucaaauucagagccaggagccucacugggggcucaccaaagauuugcauauuuuagaugccuuaggaggcccuggggauaugugaguuagugagugcauaccuggaugaguuagugaguuaguguauaccugaaugaaugaguuaguguauaccugaauggaugaguuaguguauaccugaaugaaugaguuaggaggccauaaaugguauaaacuccagcuggggggagggggugucuuccggcugguccacauuugccacaauguccccuucuccaggaacauccccacacaagacgccaccaccuucccuguggacacccugugggguaagccauagccaagucuuucucucugaggauagacuagggugacccaggaggguaacuaccacaaaggcacugcucagacaaaacaugucagugcacgguggcucacaccuauaaucccagcacuuugggaggccgaagcaggaggaaaauuugaggucaggaguucaagaccagccuggccaacauggugaaaccccaucucuacaaaaaauacaaaaauuagcuagacaugguggcaccugccuauaaucccagcuacucaggaggcugaggcaagagaaucgcuugaacccaggagggggagguugcaguaagccgaaauccggccacugcccuccagccuggaugacaaagcgagacugucucaaaaacacacacacacacacacacacacacacacacaaacaaaaaaaucucagugccguggcucacuugaucuggcgcuccccaaacuggagucuaaaacaguucucccaaggcucagggagugccugcugcacggugcaggguucucauugagacagcaccugaacuggcugcuguccucacucacaggacacaccaugcugaccggggugaccgacgguaucuucuguugccugcugggcacgccccccaacgccguggggccacuggagagcgucgaguccagcgauggcuacaccuuuguagaggucaagcccggccgcgugcugcgggugaagcaugcaggacccgccccagccgcugccccaccuccaccaucauccgcauccucggaugcagcccagggggaccucuccggcuugguccgcugucagcgccggaucaccguguaccgcaaugggcgguugcugguggaaaaccugggccgagccccucgagccgaccuccuacacgggcagaauggcucugg

SEQ ID NO: 19713 - RNA, 2515 nt, Homo sapiens
aagugaaaagaggcagaagagaggagagaaaagagcggacgaggaaaggggcgucucuggagaggccaagagucuucuaaaugccggcggaauauuucauucuuuucuguuucugccucugguugcagaaccagacgcgcaccacguuuuucuucagguccagcuucuccgcgauggcggcgaucuuuucagaggagggccgaggcugaauggcaaaguaggcuucgagcgagcgcuucucuggcgcagcgauggacgugcgcuugcgcuucuucuccgcgccauugaagaguucaggcuuggugagcuucucgcggugggacuucucggccuccucgagccaugccugcaggauggguuugagcgcgaucauauuauugugggacagugugagggacucgaaccugcagauggugcucuggcuaagcgagcccacgccggggaucuugagguuggccagcgcggagcccacaucugccugggucacccccagcuugaugcgucgcugcuugaagcgcucggcgaaugccuccaggucccgcgggucggcguccacgucgcucaugcagcccaugugcgacggcagcccgugcgcgugggccaugcugagcgcugcuuggugcaugggguucaugguggccaugugcggcgcgugagccggcguggacaccacagcgccgucggggcccgccauagcgcccagggccagcccgggacucaggugcuccagcagcucgcccuccagcgccuggugcgguugguggugguggugguggugauggugguggugguggugcgugcccgccaacgcggaagggugcgagaugggcaccgaugaagaagaggcggccgacgugcacgggaugguauucauagugugguagguggcguccgguuugaaggggcuguggugggguggaugguggugguggcucuugcucugggagacgauguccacggcugccagagccucggcgcgggccagcagacucucauccagcccgccgaauauauugcucugcaauuguaaguagaaggcacacauuacgcucagcagggaauuguacgcccucucuccggaagccccggcccagggcucgacaccgucgccgcgccuacaacauucccagaucguuaaaauaauaauaauaauaauccugaaaacagaggugaagagaaaaagagggaagccacagaaagaagccgagagugcaggaggaggaggaaagugagccuguagacacaacgaaacacaacacaacacgcgcacaggcaacaucccaggucauaaaaauuaauaugaaaggcaagaccugcugaauacuuaagagagagagaggggaaaauugguuggagguguggggugauuugcugugcagacaugaaaaaaacaucaagcagauaaagggggcugucaaaaugugccuuuaagcggugauuaugcagaaauacgcaccggugggguuggaagacaggcucuccgcauagccuccgagcccccgccgccgcugcugccacugcugcuggagcugcugcuucggccuccgccgccgccgccgccgccgccgccgccgccgccaccaccagcguugcucgagcugcugggggagcuggccgagggcgcgaugggagccgaggagcccggcgaggugcugugcagugccgaguacuugggcuccacgugcaggcugccgccgugcggcaugcuaaacgccugcuugcuguucagggacaucaucaucaucuucccgcccgccggggcgcugguccguagaggcacucacuggucccggcugccgggacccuccgagaagugccgggccagccggggcuggagcugggaagggcugugcgaaguugagcucacccgccgccgccuccggacucuguacgccugaucucggcuacgcgcuccuucgccgccucugcugucagucugaacggaugccugacuccgcuugccgcuagcugcagaccucggcacccgaaacugcccccgcuccucgcggccggcgaguuauacuccccucuccccgcgccuacccccgcgccccccgcccucccucucucccucucucccgcgcgccuccgcccucccuugccaggaaacgccggcuccuguucgguuucucgcguugccccuucuuccucucuacuccccucaggcuugaguccuuucugcucucucagcacucgccucgcgcucccccaccgcgcccuccgccgccucuuuucugcccccgcccgugcucuguugccgccgccccuucgcagcgucccgcggcugcuacucacaaucgcgcccccacucaaccccacccaaauggccagguccgcgcuccagucgccgggcagugccuaccuaaggaccagccuccagccccucccgcuucuucugccgggucucugucucaccggaaaaagaaacucccaaauaaaguugcggcccaagccagcguuggguagguaagagugccucuuaccuggcugccaccuccuacgccuccugcuuacc

SEQ ID NO: 19714 - RNA, 2515 nt, Homo sapiens
gguaagcaggaggcguaggagguggcagccagguaagaggcacucuuaccuacccaacgcuggcuugggccgcaacuuuauuugggaguuucuuuuuccggugagacagagacccggcagaagaagcgggaggggcuggaggcugguccuuagguaggcacugcccggcgacuggagcgcggaccuggccauuugggugggguugagugggggcgcgauugugaguagcagccgcgggacgcugcgaaggggcggcggcaacagagcacgggcgggggcagaaaagaggcggcggagggcgcggugggggagcgcgaggcgagugcugagagagcagaaaggacucaagccugaggggaguagagaggaagaaggggcaacgcgagaaaccgaacaggagccggcguuuccuggcaagggagggcggaggcgcgcgggagagagggagagagggagggcggggggcgcggggguaggcgcggggagaggggaguauaacucgccggccgcgaggagcgggggcaguuucgggugccgaggucugcagcuagcggcaagcggagucaggcauccguucagacugacagcagaggcggcgaaggagcgcguagccgagaucaggcguacagaguccggaggcggcggcgggugagcucaacuucgcacagcccuucccagcuccagccccggcuggcccggcacuucucggagggucccggcagccgggaccagugagugccucuacggaccagcgccccggcgggcgggaagaugaugaugaugucccugaacagcaagcaggcguuuagcaugccgcacggcggcagccugcacguggagcccaaguacucggcacugcacagcaccucgccgggcuccucggcucccaucgcgcccucggccagcucccccagcagcucgagcaacgcuggugguggcggcggcggcggcggcggcggcggcggcggcggaggccgaagcagcagcuccagcagcaguggcagcagcggcggcgggggcucggaggcuaugcggagagccugucuuccaaccccaccggugcguauuucugcauaaucaccgcuuaaaggcacauuuugacagcccccuuuaucugcuugauguuuuuuucaugucugcacagcaaaucaccccacaccuccaaccaauuuuccccucucucucucuuaaguauucagcaggucuugccuuucauauuaauuuuuaugaccugggauguugccugugcgcguguuguguuguguuucguugugucuacaggcucacuuuccuccuccuccugcacucucggcuucuuucuguggcuucccucuuuuucucuucaccucuguuuucaggauuauuauuauuauuauuuuaacgaucugggaauguuguaggcgcggcgacggugucgagcccugggccggggcuuccggagagagggcguacaauucccugcugagcguaaugugugccuucuacuuacaauugcagagcaauauauucggcgggcuggaugagagucugcuggcccgcgccgaggcucuggcagccguggacaucgucucccagagcaagagccaccaccaccauccaccccaccacagccccuucaaaccggacgccaccuaccacacuaugaauaccaucccgugcacgucggccgccucuucuucaucggugcccaucucgcacccuuccgcguuggcgggcacgcaccaccaccaccaccaucaccaccaccaccaccaccaaccgcaccaggcgcuggagggcgagcugcuggagcaccugagucccgggcuggcccugggcgcuauggcgggccccgacggcgcugugguguccacgccggcucacgcgccgcacauggccaccaugaaccccaugcaccaagcagcgcucagcauggcccacgcgcacgggcugccgucgcacaugggcugcaugagcgacguggacgccgacccgcgggaccuggaggcauucgccgagcgcuucaagcagcgacgcaucaagcugggggugacccaggcagaugugggcuccgcgcuggccaaccucaagauccccggcgugggcucgcuuagccagagcaccaucugcagguucgagucccucacacugucccacaauaauaugaucgcgcucaaacccauccugcaggcauggcucgaggaggccgagaagucccaccgcgagaagcucaccaagccugaacucuucaauggcgcggagaagaagcgcaagcgcacguccaucgcugcgccagagaagcgcucgcucgaagccuacuuugccauucagccucggcccuccucugaaaagaucgccgccaucgcggagaagcuggaccugaagaaaaacguggugcgcgucugguucugcaaccagaggcagaaacagaaaagaaugaaauauuccgccggcauuuagaagacucuuggccucuccagagacgccccuuuccucguccgcucuuuucucuccucucuucugccucuuuucacuu

SEQ ID NO: 19715 - RNA, 3213 nt, Homo sapiens
ccgggugcuguggggugagggccauggaccaccaaguuggaguuaugugauccuguagccaagaggccuauaguuguggggaccuguugggcaucuacuggaaggucacaccagccccagcacccuaggaaauccaacuuccccaccccaccccugacagccauggcucuuccucucacccuccugggcuuggaaauguguggauacugugcugagggcuugggacaccugcccaggcuggacacccaaggccagacuguuagaacuguuccccuuugggugccccacucccggguaggggugguggagaggagggaagggccucuguaaaaagaggaaccaggcugggugaggagaggaggugggggcccagggucacgcggccccaacgggccggaaagggcucucccucacccccaucagcacagacauucgggcagggagugugcaaagccaaagggcagacucggacauaagaggaggcagcuucccugccucaguuuacccccugcgugcauccaggcaccucccuccccggcugcccuggggcccggguccccagaggcccggggucccuacaguggcugggggagcggaaggcgaagcccugagggguggcggaccgaguccugccagcgccggcugggggcggggccgggaggcccgcgcugcuagguccccgcccgcugguuuccuccggggucagccaggcuccuuaucaggcgcggccaggcagccuggcccuuaucugcacugggccagcauccuccggccgcugcgccgccaggggugagagggaggaaaccgggccgccgggggcggggagaaggcgggccggcccgggagccgcucacuuucccugggggggaccuacgcggagaccucggcuauccuggccuuccgaggcccacgaggaggcgcggcccaacgccggggccuggagcauugaggccggacccucgcgagacagcagagccuggccugacgcuggaaaccacacccuggcccagacugccagcccugacgggacagagccagggcacucaccaggcugcaagaacagugcugggguaagaggggagcgggccuaaagguggaggaucccgggccugggacccagccugcauuccuuuguucauuccuucauucauucauucaccagcagggacccacuagugaggggccaggccugcuuccccagggccuagcugaggaagacagggcagaggggccaacagucucacaccuugcugggacauccuggacucuggaaccaagagcaaacagggaugucaaaacaguaugcaaaacuguggaugaucgcggggcauuguggugcaugccuguaaucccagcacuuugggaggcugaggcaggaggaucacuugagcccaggaguuccagaccacccuggacaacagagugagaaccugccucuacaaaaaaaauuuuuuuuuuuaaauuagccgggcaugguggcacaugccuguacucucagcuacucaggaggcugagacaggaggauggcucgagcccaggaauuugaggcugcagugcacuaugauugcaccacugcacuccagccuggacaacagagggagacccugucucuaaaaaaauaaacaaauuuuaaaaagcguggaugcugaugaggaugggggcuuccaagccagagggaggguuggggcaugacuggacuggacugggcaguggggucaguguuugggggucuagggucagcauuugaggucauagugucaguaguggggucacaggguugcuaugggggauguuugcagugggagugggggucacucaagcaauuauggagcacuuucagggacagcaaugggaagaaccgcagggucauucuugaggugcagagggucagccugggugggggcugggggccuuccgugaagggucagaguccaucuuggagggauuccaagcucacauggcaucaaugaguuaaugaggagucucuggguuggaucuuuagaucugaggauaacaggguuaaucuugggguuucuggggaucccaggaucaguuaggggcucccugucuuguucccucuccaggcugcagaggugagggaauucuggaagaaggaauauuugcucagaggcugggcaacagcgccccuccugggucacaaagagcucagggacagugcgcugccuagcaccuggggggcgccuccuacucuaacguaggaccccccucccguguccuggaaguuucugggccugcccccgccaucugccuuugccuacugaaacuucucuccuccuccuuucccccucccccucccuccuucccauuugagggguuucuugagcuaagcaggugggagcggggcaccuaguccuccuccccacuggcugccuucuuucccacaggugaguacccccacgucgggguccaugugcccgccucaggcacaggcagaggugggccccaccaugacugagaaggcagagauggugugugcccccagcccagcgccugccccacccccuaagccugccucgccugggcccccgcagguggaggaggugggccaccgaggaggcuccucgccccccaggcugccaccugguguaccagugaucagccugggccacagcaggcccccagggguagccaugcccaccacagagcugggcacucugcggcccccgcugcugcaacucuccacccugggaacugccccgcccacuuuggcccugcacuaccacccucaccccuuccucaacaggucaguggggaucugggguggggggcaguggggauugggggccaggguccuugcccacaaggcauuagugacccacgaccccuuacagugucuacauugggccagcaggaccuuuuagcaucuucccuagcagccgguugaagcggagaccaagccacugugagcuggaccuggcugagggugaguguggguuugugugccuuguggguuuguaugccuguaugugcacuugugggugcacagaaggccuggccgucucuguguggggcucaugucuguccucuacuccaccucggggagacgugcuuccagcacacacagagaacagcccacauagguucuacccaugugcaaaaucgcagucccauagccagccccacacaaccaccgccacccaacaggccaagccauguagccgcagucacggcaaaacagagcaugccacacca

SEQ ID NO: 19716 - RNA, 3213 nt, Homo sapiens
ugguguggcaugcucuguuuugccgugacugcggcuacauggcuuggccuguuggguggcggugguuguguggggcuggcuaugggacugcgauuuugcacauggguagaaccuaugugggcuguucucugugugugcuggaagcacgucuccccgagguggaguagaggacagacaugagccccacacagagacggccaggccuucugugcacccacaagugcacauacaggcauacaaacccacaaggcacacaaacccacacucacccucagccagguccagcucacaguggcuuggucuccgcuucaaccggcugcuagggaagaugcuaaaagguccugcuggcccaauguagacacuguaaggggucgugggucacuaaugccuugugggcaaggacccuggcccccaauccccacugccccccaccccagauccccacugaccuguugaggaaggggugagggugguagugcagggccaaagugggcggggcaguucccaggguggagaguugcagcagcgggggccgcagagugcccagcucuguggugggcauggcuaccccugggggccugcuguggcccaggcugaucacugguacaccagguggcagccuggggggcgaggagccuccucgguggcccaccuccuccaccugcgggggcccaggcgaggcaggcuuaggggguggggcaggcgcugggcugggggcacacaccaucucugccuucucagucaugguggggcccaccucugccugugccugaggcgggcacauggaccccgacguggggguacucaccugugggaaagaaggcagccaguggggaggaggacuaggugccccgcucccaccugcuuagcucaagaaaccccucaaaugggaaggagggagggggagggggaaaggaggaggagagaaguuucaguaggcaaaggcagauggcgggggcaggcccagaaacuuccaggacacgggagggggguccuacguuagaguaggaggcgccccccaggugcuaggcagcgcacugucccugagcucuuugugacccaggaggggcgcuguugcccagccucugagcaaauauuccuucuuccagaauucccucaccucugcagccuggagagggaacaagacagggagccccuaacugauccugggauccccagaaaccccaagauuaacccuguuauccucagaucuaaagauccaacccagagacuccucauuaacucauugaugccaugugagcuuggaaucccuccaagauggacucugacccuucacggaaggcccccagcccccacccaggcugacccucugcaccucaagaaugacccugcgguucuucccauugcugucccugaaagugcuccauaauugcuugagugacccccacucccacugcaaacaucccccauagcaacccugugaccccacuacugacacuaugaccucaaaugcugacccuagacccccaaacacugaccccacugcccaguccaguccagucaugccccaacccucccucuggcuuggaagcccccauccucaucagcauccacgcuuuuuaaaauuuguuuauuuuuuuagagacagggucucccucuguuguccaggcuggagugcaguggugcaaucauagugcacugcagccucaaauuccugggcucgagccauccuccugucucagccuccugaguagcugagaguacaggcaugugccaccaugcccggcuaauuuaaaaaaaaaaauuuuuuuuguagaggcagguucucacucuguuguccaggguggucuggaacuccugggcucaagugauccuccugccucagccucccaaagugcugggauuacaggcaugcaccacaaugccccgcgaucauccacaguuuugcauacuguuuugacaucccuguuugcucuugguuccagaguccaggaugucccagcaaggugugagacuguuggccccucugcccugucuuccucagcuaggcccuggggaagcaggccuggccccucacuagugggucccugcuggugaaugaaugaaugaaggaaugaacaaaggaaugcaggcugggucccaggcccgggauccuccaccuuuaggcccgcuccccucuuaccccagcacuguucuugcagccuggugagugcccuggcucugucccgucagggcuggcagucugggccagggugugguuuccagcgucaggccaggcucugcugucucgcgaggguccggccucaaugcuccaggccccggcguugggccgcgccuccucgugggccucggaaggccaggauagccgaggucuccgcguaggucccccccagggaaagugagcggcucccgggccggcccgccuucuccccgcccccggcggcccgguuuccucccucucaccccuggcggcgcagcggccggaggaugcuggcccagugcagauaagggccaggcugccuggccgcgccugauaaggagccuggcugaccccggaggaaaccagcgggcggggaccuagcagcgcgggccucccggccccgcccccagccggcgcuggcaggacucgguccgccaccccucagggcuucgccuuccgcucccccagccacuguagggaccccgggccucuggggacccgggccccagggcagccggggagggaggugccuggaugcacgcaggggguaaacugaggcagggaagcugccuccucuuauguccgagucugcccuuuggcuuugcacacucccugcccgaaugucugugcugaugggggugagggagagcccuuuccggcccguuggggccgcgugacccugggcccccaccuccucuccucacccagccugguuccucuuuuuacagaggcccuucccuccucuccaccaccccuacccgggaguggggcacccaaaggggaacaguucuaacagucuggccuuggguguccagccugggcaggugucccaagcccucagcacaguauccacacauuuccaagcccaggagggugagaggaagagccauggcugucaggggugggguggggaaguuggauuuccuagggugcuggggcuggugugaccuuccaguagaugcccaacagguccccacaacuauaggccucuuggcuacaggaucacauaacuccaacuuggugguccauggcccucaccccacagcacccgg

SEQ ID NO: 19717 - RNA, 2450 nt, Homo sapiens
gucacauaaaagccugcaggggagcggggaaugggggcucaguggggacaccagggccagggguuugggggcccagguugugggagagggggcaacguaaggucugcaucagggaaacccgagcgugcuggccaaccugaccacguuugggcugggaacuuggggguccagcccugaggucagaaaggacaguugccgggcgcgguggcucacgccuguaaucccagcuccuugggaggcugaggaggguggaucaugaggucaggaguuugagaccagccugaccagcauggugaaacuccgucucuacuaaaaauacaaaaauuagccgggcaugguggcgcaccuguagucucagcuauucaggaggcugaggcagaagaaucacuugaacccgggaggcggagguugcagugagcugagaucgcaccauugcacuccagcuugggcaacagagcgagacuccaucucaaaaaaaaaaaaaaaaaaaaaaaaaaaaaaaggcagagcagcccuuugggucacuggcuacuugggagucaccucagaugugacauugggaucccaguauggggauagaggcacagagcccauguuaggggcacgugggcagacuguugcuugcugugaaggcauagggaccuaaaacaaggggagaggggccugguuuguggggguguacaucagagacaucuggucaggcuugucacaguagccacacccggccccugagccaggaacuucugaagggguuggggacagggucuacaucagggagccuugggcaggcuagggucacuuguggucacuagggguccaagacuugucagagaaaugcccccaggcuggaauugagaggauggaguccuauggggucccuggaggguuagggguuuguccccccuaauaacacaacagacacuggugagaauccccagggugaccaggaauaaguccugugugugagauggagcucuccugggggcaccucagggggcacugugaccccaggugacaccccaggucucagaguguagagccacaucuggcaucuucaugauauggauccaaaaaugggugggcagugcugucgggguuggauuugaggggggggaucucagaggggcaggaaugggggcuccucaaaaggcaugaauggauauggguuucucagggacaugggaacgggggacuugggguuggaccgcaccaagcacgaaggagacagggaugaggcuggcauacuggucacaauaaaucacaagcuucucgaaguagcgcuucugcccuucggucagcacaaagcugcgggauagagaugaggggucacaggucacaagggugacuccauccccagcuucagaucucucuugcugugccccucacccuggcuucuuuuauaauagcugcccccagccgggugcuaugggucacaccuguaaucccagcacuuugggaggccgaggcaggaggaucacuugaggucagaaguuugagaccagccuggucaacacggugaaaccccaucucuacuaaaaauacaaaaaaauuagccaggcaugguggcuggcacccauaaucccagcuacucgggaggcugaggcaggagaaucgcuugaacccgggaggcagagguggaaguaagagaagauuaugccacugcacuccagccugggugacagagugagacuccaucucaguuuaaaaaacauagauauauauacuuauauaucucuauauuuuuauaauuuuuauauauuauauauauauaauagcugcccccccuccgcuagaacaugagcaccucagggcagccucaccgguaggcagcacucagcgccauguagaacccaaggaagcagagcagcucucgccacaggaguuuguagaugcucccacgccacaguagcagcagcugggagaagccaccgaagcgggcguucgccacucgggcuguguaggugacggucaucguggcacccggcagguguggccaagggagaguggguggcccgggugggggcugcggguguggguggagaggugcggggauaacugagcacagggauuccacccauguuccggcccgccaccccuucaguccugacccuugccugaguugccuucuccucccagcuuuacucagucuaguccagcccccagugccccucccugaccuucaucucaggcuguccccuucccuggacuccuggccgugggcucugguaacugccgucccccaccaccaagacccuugagucccugcagucagcucccgagucacccucugcccgauccccuucacccagaggccaccuguagcaugccccauuccgcaaguccccagcaccugaguuucuagguucucaaggcuccaccucucccaaauucucucccucagccccuauuucuggcucccccuucuccacuuccccagcucccagucuuga

SEQ ID NO: 19718 - RNA, 2450 nt, Homo sapiens
ucaagacugggagcuggggaaguggagaagggggagccagaaauaggggcugagggagagaauuugggagagguggagccuugagaaccuagaaacucaggugcuggggacuugcggaauggggcaugcuacagguggccucugggugaaggggaucgggcagagggugacucgggagcugacugcagggacucaagggucuugguggugggggacggcaguuaccagagcccacggccaggaguccagggaaggggacagccugagaugaaggucagggaggggcacugggggcuggacuagacugaguaaagcugggaggagaaggcaacucaggcaagggucaggacugaagggguggcgggccggaacauggguggaaucccugugcucaguuauccccgcaccucuccacccacacccgcagcccccacccgggccacccacucucccuuggccacaccugccgggugccacgaugaccgucaccuacacagcccgaguggcgaacgcccgcuucgguggcuucucccagcugcugcuacuguggcgugggagcaucuacaaacuccuguggcgagagcugcucugcuuccuuggguucuacauggcgcugagugcugccuaccggugaggcugcccugaggugcucauguucuagcggagggggggcagcuauuauauauauauaauauauaaaaauuauaaaaauauagagauauauaaguauauauaucuauguuuuuuaaacugagauggagucucacucugucacccaggcuggagugcaguggcauaaucuucucuuacuuccaccucugccucccggguucaagcgauucuccugccucagccucccgaguagcugggauuaugggugccagccaccaugccuggcuaauuuuuuuguauuuuuaguagagaugggguuucaccguguugaccaggcuggucucaaacuucugaccucaagugauccuccugccucggccucccaaagugcugggauuacaggugugacccauagcacccggcugggggcagcuauuauaaaagaagccagggugaggggcacagcaagagagaucugaagcuggggauggagucacccuugugaccugugaccccucaucucuaucccgcagcuuugugcugaccgaagggcagaagcgcuacuucgagaagcuugugauuuauugugaccaguaugccagccucaucccugucuccuucgugcuuggugcgguccaaccccaagucccccguucccaugucccugagaaacccauauccauucaugccuuuugaggagcccccauuccugccccucugagauccccccccucaaauccaaccccgacagcacugcccacccauuuuuggauccauaucaugaagaugccagauguggcucuacacucugagaccuggggugucaccuggggucacagugcccccugaggugcccccaggagagcuccaucucacacacaggacuuauuccuggucacccuggggauucucaccagugucuguuguguuauuaggggggacaaaccccuaacccuccagggaccccauaggacuccauccucucaauuccagccugggggcauuucucugacaagucuuggaccccuagugaccacaagugacccuagccugcccaaggcucccugauguagacccuguccccaaccccuucagaaguuccuggcucaggggccggguguggcuacugugacaagccugaccagaugucucugauguacacccccacaaaccaggccccucuccccuuguuuuaggucccuaugccuucacagcaagcaacagucugcccacgugccccuaacaugggcucugugccucuauccccauacugggaucccaaugucacaucugaggugacucccaaguagccagugacccaaagggcugcucugccuuuuuuuuuuuuuuuuuuuuuuuuuuuuuuugagauggagucucgcucuguugcccaagcuggagugcaauggugcgaucucagcucacugcaaccuccgccucccggguucaagugauucuucugccucagccuccugaauagcugagacuacaggugcgccaccaugcccggcuaauuuuuguauuuuuaguagagacggaguuucaccaugcuggucaggcuggucucaaacuccugaccucaugauccacccuccucagccucccaaggagcugggauuacaggcgugagccaccgcgcccggcaacuguccuuucugaccucagggcuggacccccaaguucccagcccaaacguggucagguuggccagcacgcucggguuucccugaugcagaccuuacguugcccccucucccacaaccugggcccccaaaccccuggcccugguguccccacugagcccccauuccccgcuccccugcaggcuuuuaugugac

SEQ ID NO: 19719 - RNA, 2635 nt, Homo sapiens
uacugcugaggcuccaguggggcgaaagaccacacaucugggugacaggaagggccuguccccaaaacgggaguugcucuuauuccaguuucucaaaugagcgcgccaagcgaaucucgacugugcucugugauccaauuuaauaaacccaugagguggcucuagcgcccugagaccuuugaccucucucccguuuccccucagccucaaaaaacaaacaacaaacaaaaaaaacccagcaacucaggcuccuucuggcgcuaccggaaaaacaaaaacgaacaaacaaaaagccccugaucccuccuggacccagcugccaggacacaguggagaagccacugugauuugugauuagaagucucgcaccgagcggcacaauguauuuccuccccaaaccacgggcucaauucccucccccauccagccgcgcccgccaccgccugguuuugccccugugguggcaccgucagccaagggccucgcgcccucuccccagcugugcgucccaccucucucggcgcccaagggaaaccuggacaucuuuggggacccggagagccggcgagugauugcugggacacggcuggagccgggagagaguagcacuacgcccccucccucccuccucucucuaccccucacccuccggggcuaaaugcugcuagcucaaaaacccacaguccgcacgggguggggauuggggacaagugggagaaaacgggggccccguccguggugcugaagacaagcacgcaagccgcaucgcaggcuucugagccggggcaagggguaggguguacugucgcggugcuuccuggggaguccgggaaggcuucccaagcggcagcugucuggggcgcuaacaacagccguuacaaggaagucccugaaauccagggaacccuucggagaggcccggaaggcagaagcagaaaauucugucucucgggggauggggcuggaucccaagagccagagacagggaaagcagaggacaguugaagccacagaacugagaggccccgcuaucugucccuccaagcagcccgaaguacaugcagccgccacuucugccuaccaccuccggacagcccgagcaccccugaggccaguaaccccccuacggggccagggcccggcacgaggcgucggcugaccuguaugguuugucuguuguagacuuuuaccacguggaaguuaaaacuguagaucccuuugcgcggggcgaugaaagugcugcguucugaaucaaaguuguucccaauguucacuaguaccuauaacgagacgggaacgaaggggagugggcaggaaucggucccggacugucguccccgcgccuccgcagagcccuuggagaggaccgggcaucggucuuccauccaucccuccuucaccagcccaaucugcacgccgcgggaggaaggaacacucaccuggucgaaguagaugaucauggugcgauuacucaucucggacggcucgugguuggugcuccugauggcagagaaagccaccuuggcgcugccagagcgcacagagaugcccagggcagugcccguggggucggacgugggguuggagucgcacaccaccaggcacuugcccuccagcacgaugggcuccgucucauucugcccgcgggccgggcccgccagccacgcagcccccagcagcagcagcuccaggacgcccagcaucgcgccgccggcgcccaccccgccccccacccccagggcugcucgcgccagccgccccccccgucccagucccgcuccgaagcccccuccucagcuccgugcgcagcuccgccgccgccgcucuggacacuacaccucuuccucgcacuccgggacuagcguccccuccgcgacuagcguccccuccgcgcuguguucccggagccccucccgggccucaggggugccgcggcugcccagccgcacuuggaugcauagccgcugcugcucggucccgcugcugccgccgccuccugcccgcacccgccgcugccgccgccgccgccgcucugaauuauugaugcagccggcgcugcagccggagcgggcggagagcgcgcgccgggcacaaaggcgcggaccucggccuggccccgcccccgccgccucccggcccgccucccuccgaggcccugcccccgccccggccgaggccacgccccccagccaauccugacgcgccgcgcuccccaccgagccaauggcggcgcuguccgcgcucggccaccugaccccgggcgccguuguuauuaggcgcggcgaggcggguggcgcgcggcagcaggguugggcucucgccgugagucgacgaagggagcgcgggcgcgcgcccgcguccgcgcacugagagucgccucggccgcucgcuuucucgacucccgccucgcgccucgauccuguuccgccucccucggcccuccugcccgcccccacucgucggcccucagguaggaggcggcgcgccccggggucgggaguggaaucgcuggaggcugcgagucgccugcccgccugugggcgcgcccguugggaggggagcgccccccagcgggcgcgggcgcgagggcagccggcgcgcugggcgagccuggcucagggucccggcggccggg

SEQ ID NO: 19720 - RNA, 2635 nt, Homo sapiens
cccggccgccgggacccugagccaggcucgcccagcgcgccggcugcccucgcgcccgcgcccgcuggggggcgcuccccucccaacgggcgcgcccacaggcgggcaggcgacucgcagccuccagcgauuccacucccgaccccggggcgcgccgccuccuaccugagggccgacgagugggggcgggcaggagggccgagggaggcggaacaggaucgaggcgcgaggcgggagucgagaaagcgagcggccgaggcgacucucagugcgcggacgcgggcgcgcgcccgcgcucccuucgucgacucacggcgagagcccaacccugcugccgcgcgccacccgccucgccgcgccuaauaacaacggcgcccggggucagguggccgagcgcggacagcgccgccauuggcucgguggggagcgcggcgcgucaggauuggcuggggggcguggccucggccggggcgggggcagggccucggagggaggcgggccgggaggcggcgggggcggggccaggccgagguccgcgccuuugugcccggcgcgcgcucuccgcccgcuccggcugcagcgccggcugcaucaauaauucagagcggcggcggcggcggcagcggcgggugcgggcaggaggcggcggcagcagcgggaccgagcagcagcggcuaugcauccaagugcggcugggcagccgcggcaccccugaggcccgggaggggcuccgggaacacagcgcggaggggacgcuagucgcggaggggacgcuagucccggagugcgaggaagagguguaguguccagagcggcggcggcggagcugcgcacggagcugaggagggggcuucggagcgggacugggacggggggggcggcuggcgcgagcagcccuggggguggggggcggggugggcgccggcggcgcgaugcugggcguccuggagcugcugcugcugggggcugcguggcuggcgggcccggcccgcgggcagaaugagacggagcccaucgugcuggagggcaagugccugguggugugcgacuccaaccccacguccgaccccacgggcacugcccugggcaucucugugcgcucuggcagcgccaagguggcuuucucugccaucaggagcaccaaccacgagccguccgagaugaguaaucgcaccaugaucaucuacuucgaccaggugaguguuccuuccucccgcggcgugcagauugggcuggugaaggagggauggauggaagaccgaugcccgguccucuccaagggcucugcggaggcgcggggacgacaguccgggaccgauuccugcccacuccccuucguucccgucucguuauagguacuagugaacauugggaacaacuuugauucagaacgcagcacuuucaucgccccgcgcaaagggaucuacaguuuuaacuuccacgugguaaaagucuacaacagacaaaccauacaggucagccgacgccucgugccgggcccuggccccguagggggguuacuggccucaggggugcucgggcuguccggaggugguaggcagaaguggcggcugcauguacuucgggcugcuuggagggacagauagcggggccucucaguucuguggcuucaacuguccucugcuuucccugucucuggcucuugggauccagccccaucccccgagagacagaauuuucugcuucugccuuccgggccucuccgaaggguucccuggauuucagggacuuccuuguaacggcuguuguuagcgccccagacagcugccgcuugggaagccuucccggacuccccaggaagcaccgcgacaguacacccuaccccuugccccggcucagaagccugcgaugcggcuugcgugcuugucuucagcaccacggacggggcccccguuuucucccacuuguccccaauccccaccccgugcggacuguggguuuuugagcuagcagcauuuagccccggagggugagggguagagagaggagggagggagggggcguagugcuacucucucccggcuccagccgugucccagcaaucacucgccggcucuccggguccccaaagauguccagguuucccuugggcgccgagagaggugggacgcacagcuggggagagggcgcgaggcccuuggcugacggugccaccacaggggcaaaaccaggcgguggcgggcgcggcuggaugggggagggaauugagcccgugguuuggggaggaaauacauugugccgcucggugcgagacuucuaaucacaaaucacaguggcuucuccacuguguccuggcagcuggguccaggagggaucaggggcuuuuuguuuguucguuuuuguuuuuccgguagcgccagaaggagccugaguugcuggguuuuuuuuguuuguuguuuguuuuuugaggcugaggggaaacgggagagaggucaaaggucucagggcgcuagagccaccucauggguuuauuaaauuggaucacagagcacagucgagauucgcuuggcgcgcucauuugagaaacuggaauaagagcaacucccguuuuggggacaggcccuuccugucacccagauguguggucuuucgccccacuggagccucagcagua

SEQ ID NO: 19721 - RNA, 2496 nt, Homo sapiens
agucccccuggccccucaaccucgggguuucuuaccgccugggcacgggcuggaaagcugucuugaguaacuuuuucuccacuuccaaggcacuacagcgaucuaagggaagcgggggaagaaaaaggagggccuuuagagcgcucggugccggcgcccagggccgcagaaagcaggaguggagagggacgcgcgcccugcgccccccgggcccugccccucccggccagcuccggcacuacccgcagagcccgcccccgcuccgcgcccagcgcucagcagucaccuguuccgccuucgggcuccgcuggccgagcgaaggcggcggcggcagccggguggcccgcggcuccgggaagucccagcaggugcggaggggcagagcccagcagggagagcgggugcaggcgggggccgggcggugggccuggaaacggccgguugguccaagccgggaacuugcccagcggcgcugagaccagucugugagcggcggcggcggcggcggccggagagagcugcagggcggaaggcgcgaccgcugcccccgguggagacccccccgcgccgggaggcgagcggcgcggguuguccgggcuuguggcagucuccgcgagggaccagaucuugggcuucugcagggcggaggcgggggcuggugcgggagcgcagggguccaggcucacggggggcgacggcagagacggcgaggccacggccacuggugguggcgcuggagccagacucaggaccgguaguggccgguccucuaagcccucagagcuaucuuccgagucgcuauuuuuggaguccgaaaugggucccaggccuaggucgccaucccugcgcgccgccccagccagggacagcucaggcucgguggccgcgccgucuaaguucuccaaaucgaucuccucguccucgucgucgucagccaggcccucgccccccguguccuccuccucccccccgagcuccuccuccuccagcucuagcucgcguuugccguccuccucguccuccucuucgucuuccuccucgcgcucgcucccauaagcguuucccuccucgucagugcggcugcgaggcgcccaagucaucuuauucuccuucuugaggcgccggcgcgcguuggcgaaccagguggacaccugggugagggucaucuuggugaugauggccagcaugaucuucucgcccuuggugggguagggguucuugcggugcucguugagccaggccuucagcgugcuggugcucucccugguggcguucuugggacgggacggguccccgaacugguacuggccauacggguagaaggcggggugcgggugcggaaacgcggcagccgcggccggaugcugcaccccggggcuguccuucagcucauacugcgcgcccuguacgcacauggagaaggaagggacacgcgcggagggagcgcgagugagccccagccaucgcugccuccccccuccuggccugcaccccucuaguccggcccccgcgcgcucagcucgcccugcgccccagcgccaaccccuccuucccuggcuccgcgggcucuuaccagcugcgggaagaugggcagcuccgcggcguagggcaggaaggcgccguagccuugggcggcggcggccgcagcggccgcggcguagggcgccccguacacggacgagagcacguuggacagggaccccgaggcguucagcuccgaggcuccggcacccaggccgccccgggcccccgcgcugccgccgcugccgccagcggcccccgggcgcucggacggguaaagcgggcggauguauugguaucccagcugggggaaggacaugguggcccgcggggcacggacggagaggggggccgacccccgggccgcccagcucagcgccgcccgcgggcuccggcgcgcaucgggggcugggccgggcuuggggccgcgcugccgcccgcgcugcgcugugcuccgcguucgccuauugaucugcuccgcggcggcgacggcggcggcgagggcggcggcgaggagccaggucagguccgaacagauuggcggagauucccggggcuccgggcucugauugacauuucuacggggcgcaagccccuccucucugcgccgcgcucccuccucucggccgccggagcugccucugcccgcuccucgcuccucacugcccuccucuccccagcagugucgcgccucgcuuccuucgcccuccucuaguuuucacucccccuccucgcccuuccucuccccuccccucuccgcacuccucuuccccccaggaucgcuuccgcugcuucgggcuccugcacugcccuggacgcuaugaaacucuccuuucuccucuccccuucucuuucccuuucucacgagggcuuuugcucuccgguccguucccuucacuucuuccuuucucacuacuucuauuuuguaaaucucucucuuuacucacacgauacuccccgcgaccuuuccagccu

SEQ ID NO: 19722 - RNA, 2496 nt, Homo sapiens
aggcuggaaaggucgcggggaguaucgugugaguaaagagagagauuuacaaaauagaaguagugagaaaggaagaagugaagggaacggaccggagagcaaaagcccucgugagaaagggaaagagaaggggagaggagaaaggagaguuucauagcguccagggcagugcaggagcccgaagcagcggaagcgauccuggggggaagaggagugcggagaggggaggggagaggaagggcgaggagggggagugaaaacuagaggagggcgaaggaagcgaggcgcgacacugcuggggagaggagggcagugaggagcgaggagcgggcagaggcagcuccggcggccgagaggagggagcgcggcgcagagaggaggggcuugcgccccguagaaaugucaaucagagcccggagccccgggaaucuccgccaaucuguucggaccugaccuggcuccucgccgccgcccucgccgccgccgucgccgccgcggagcagaucaauaggcgaacgcggagcacagcgcagcgcgggcggcagcgcggccccaagcccggcccagcccccgaugcgcgccggagcccgcgggcggcgcugagcugggcggcccgggggucggccccccucuccguccgugccccgcgggccaccauguccuucccccagcugggauaccaauacauccgcccgcuuuacccguccgagcgcccgggggccgcuggcggcagcggcggcagcgcgggggcccggggcggccugggugccggagccucggagcugaacgccucggggucccuguccaacgugcucucguccguguacggggcgcccuacgccgcggccgcugcggccgccgccgcccaaggcuacggcgccuuccugcccuacgccgcggagcugcccaucuucccgcagcugguaagagcccgcggagccagggaaggagggguuggcgcuggggcgcagggcgagcugagcgcgcgggggccggacuagaggggugcaggccaggaggggggaggcagcgauggcuggggcucacucgcgcucccuccgcgcgugucccuuccuucuccaugugcguacagggcgcgcaguaugagcugaaggacagccccggggugcagcauccggccgcggcugccgcguuuccgcacccgcaccccgccuucuacccguauggccaguaccaguucggggacccgucccgucccaagaacgccaccagggagagcaccagcacgcugaaggccuggcucaacgagcaccgcaagaaccccuaccccaccaagggcgagaagaucaugcuggccaucaucaccaagaugacccucacccagguguccaccugguucgccaacgcgcgccggcgccucaagaaggagaauaagaugacuugggcgccucgcagccgcacugacgaggagggaaacgcuuaugggagcgagcgcgaggaggaagacgaagaggaggacgaggaggacggcaaacgcgagcuagagcuggaggaggaggagcucgggggggaggaggaggacacggggggcgagggccuggcugacgacgacgaggacgaggagaucgauuuggagaacuuagacggcgcggccaccgagccugagcugucccuggcuggggcggcgcgcagggauggcgaccuaggccugggacccauuucggacuccaaaaauagcgacucggaagauagcucugagggcuuagaggaccggccacuaccgguccugagucuggcuccagcgccaccaccaguggccguggccucgccgucucugccgucgccccccgugagccuggaccccugcgcucccgcaccagcccccgccuccgcccugcagaagcccaagaucuggucccucgcggagacugccacaagcccggacaacccgcgccgcucgccucccggcgcgggggggucuccaccgggggcagcggucgcgccuuccgcccugcagcucucuccggccgccgccgccgccgccgcucacagacuggucucagcgccgcugggcaaguucccggcuuggaccaaccggccguuuccaggcccaccgcccggcccccgccugcacccgcucucccugcugggcucugccccuccgcaccugcugggacuucccggagccgcgggccacccggcugccgccgccgccuucgcucggccagcggagcccgaaggcggaacaggugacugcugagcgcugggcgcggagcgggggcgggcucugcggguagugccggagcuggccgggaggggcagggcccggggggcgcagggcgcgcgucccucuccacuccugcuuucugcggcccugggcgccggcaccgagcgcucuaaaggcccuccuuuuucuucccccgcuucccuuagaucgcuguagugccuuggaaguggagaaaaaguuacucaagacagcuuuccagcccgugcccaggcgguaagaaaccccgagguugaggggccagggggacu

SEQ ID NO: 19723 - RNA, 2438 nt, Homo sapiens
ggggaagacgccagaggggggugggcaacgaauggccucggagcccagccugccggagaacaagaaauccgcuaaguccgcgaucuacuguggcuaggagagcgcagagcguucgccggcgcacagcccgcggccucguucccuuugugcuucggggcggcgggacugccacuccgccccgaguuagcagaagaggaaaguuggaagagaucggcgcuccugggaugugauugucauccuggggccggcgcucgagagucugagagaaagcgagagagagggagagaccggggaggggaaaaggggaggcaaagaggaggggugagagggggggccgcggaggggaggcgggcgcuagggaggggcgagaggagcgccagcgagcgggagagagagccgaggaggaagagggagagggcgaggcgcgccuggcggccggguuggcugcggccgcccagaagcuccugccaguccucccaccgacuacaccccgggaaggaggagcuucgggcgcgcacaaggcgucagaauccucaauuuccaacuuagcaucuuggcaggaccuuugcaaaggcaaaagcagagccccccggugcaaagagcgaggggaaaaaagagaaagcagcaagggaggggaggggaggggaaaaaaagcccagcuggggcgagcgaggcgcgcagaggagcgggcgcggcggucgcagccggaggcgcgcgggaagccagcgaggaggcgccgcgggccggagccccggagccggggccagaggagcggcggcccagggcagccagaggccaggugcccgcccgcucgcccucgcagggcgccgcccggcucguuggcggccgcggcgcggcgcgccccaugcccguguguggccauguccuauccgcagggcuacuuguaccagccguccgccucgcuggcgcucuacucgugcccggcguacagcaccagcgucauuucggggccccgcacggaugagcucggccgcucuucuucgggcuccgcguucucgcccuacgcuggcucgacugccuucacggcgcccucgccgggcuacaacucgcaccuccaguacggcgccgaccccgcggccgccgccgccgccgccuucuccucguacgugguaagugagcgggauccgcggcgggcgaggggcagcaggggccgggcgggaggacgggggcggagggggacacgggccuaggcgccaacaccgaccucccccgccaagcuucgcggccccuucaaacuugggcgauugucuccgccagcuucgcccaggccuuggacucaagaguugcucgcaaaagagagccgcgucuugcucggaucgcugagcuggcgggaagggguucuguggggagagguagcugcaauuaaagagcagcauuugguguaaacguaagcuccgggcugcccugcaaauuuuauauuuuugguuuugccauuuuggaaaaguaguucaaaagaaauagacucgaaauuugagcagaagcgugcuaagucuauguaaauguguuuggccuagccuuuaauuaguccuccaaaauguugcaaauccguaauccuaucuucgcaauccgauuugggaguauuaaauuucugaaaagucggucgagcugcggugcauccgggauuuuucggccggguuguaacuucggucugggguaguauuuuuggagggugggagugcgugggcauggcucagcuuuuuguuugcauuucuuagcuguugaaaaaagaaaaaaagagccuugacuucccuuguuuuccccccuugcgcccaacgugcguccgcucccccgccgagcgcggagucgccucaguugcccaggccucuaucugcauggagggccgggccgccguggccagaucugcgcacgggguacggacgugcccgggcagaugggggccuacggggugacaccgaggccgggacagcuucaggggccccagaaggaccugacccagaaauugagguccccgcugccuucugaggagggggaggaguugcuccuaggucugaaccccgccagccuugccccguaggaagcuggagugcgggccucguccacccacagaccccggggagcgcagggaaaagggugcuucggucguuccgauggcaguggagaccacgguccacacucaccucucugcgucuccaccgcagggcucucccuacgaccacacacccggcauggcgggcuccuugggguaccauccuuacgcggcgccccugggaucguacccuuacggggacccagcguaccggaagaacgccacaagggacgccacggcuacccucaaggccuggcucaacgagcaccgcaagaaccccuaccccaccaagggcgagaagaucaugcuggccaucaucaccaagaugacccucacccagguguccaccugguucgccaacgcgcgccgg

SEQ ID NO: 19724 - RNA, 2438 nt, Homo sapiens
ccggcgcgcguuggcgaaccagguggacaccugggugagggucaucuuggugaugauggccagcaugaucuucucgcccuuggugggguagggguucuugcggugcucguugagccaggccuugaggguagccguggcgucccuuguggcguucuuccgguacgcuggguccccguaaggguacgaucccaggggcgccgcguaaggaugguaccccaaggagcccgccaugccggguguguggucguagggagagcccugcgguggagacgcagagaggugaguguggaccguggucuccacugccaucggaacgaccgaagcacccuuuucccugcgcuccccggggucuguggguggacgaggcccgcacuccagcuuccuacggggcaaggcuggcgggguucagaccuaggagcaacuccucccccuccucagaaggcagcggggaccucaauuucugggucagguccuucuggggccccugaagcugucccggccucggugucaccccguaggcccccaucugcccgggcacguccguaccccgugcgcagaucuggccacggcggcccggcccuccaugcagauagaggccugggcaacugaggcgacuccgcgcucggcgggggagcggacgcacguugggcgcaaggggggaaaacaagggaagucaaggcucuuuuuuucuuuuuucaacagcuaagaaaugcaaacaaaaagcugagccaugcccacgcacucccacccuccaaaaauacuaccccagaccgaaguuacaacccggccgaaaaaucccggaugcaccgcagcucgaccgacuuuucagaaauuuaauacucccaaaucggauugcgaagauaggauuacggauuugcaacauuuuggaggacuaauuaaaggcuaggccaaacacauuuacauagacuuagcacgcuucugcucaaauuucgagucuauuucuuuugaacuacuuuuccaaaauggcaaaaccaaaaauauaaaauuugcagggcagcccggagcuuacguuuacaccaaaugcugcucuuuaauugcagcuaccucuccccacagaaccccuucccgccagcucagcgauccgagcaagacgcggcucucuuuugcgagcaacucuugaguccaaggccugggcgaagcuggcggagacaaucgcccaaguuugaaggggccgcgaagcuuggcgggggaggucgguguuggcgccuaggcccgugucccccuccgcccccguccucccgcccggccccugcugccccucgcccgccgcggaucccgcucacuuaccacguacgaggagaaggcggcggcggcggcggccgcggggucggcgccguacuggaggugcgaguuguagcccggcgagggcgccgugaaggcagucgagccagcguagggcgagaacgcggagcccgaagaagagcggccgagcucauccgugcggggccccgaaaugacgcuggugcuguacgccgggcacgaguagagcgccagcgaggcggacggcugguacaaguagcccugcggauaggacauggccacacacgggcauggggcgcgccgcgccgcggccgccaacgagccgggcggcgcccugcgagggcgagcgggcgggcaccuggccucuggcugcccugggccgccgcuccucuggccccggcuccggggcuccggcccgcggcgccuccucgcuggcuucccgcgcgccuccggcugcgaccgccgcgcccgcuccucugcgcgccucgcucgccccagcugggcuuuuuuuccccuccccuccccucccuugcugcuuucucuuuuuuccccucgcucuuugcaccggggggcucugcuuuugccuuugcaaagguccugccaagaugcuaaguuggaaauugaggauucugacgccuugugcgcgcccgaagcuccuccuucccgggguguagucggugggaggacuggcaggagcuucugggcggccgcagccaacccggccgccaggcgcgccucgcccucucccucuuccuccucggcucucucucccgcucgcuggcgcuccucucgccccucccuagcgcccgccuccccuccgcggcccccccucucaccccuccucuuugccuccccuuuuccccuccccggucucucccucucucucgcuuucucucagacucucgagcgccggccccaggaugacaaucacaucccaggagcgccgaucucuuccaacuuuccucuucugcuaacucggggcggaguggcagucccgccgccccgaagcacaaagggaacgaggccgcgggcugugcgccggcgaacgcucugcgcucuccuagccacaguagaucgcggacuuagcggauuucuuguucuccggcaggcugggcuccgaggccauucguugcccaccccccucuggcgucuucccc

SEQ ID NO: 19725 - RNA, 2026 nt, Homo sapiens
ggauaggggcagacgggugggagcuccgaaggggugccggggcggugaucgggaggucuccagcggcccgaaccagggugaagaagaagguggagucugcggaggccccaggccggggagggggcgggucgggcccagcaucccccgcagccgggguccgagggggaggggcgggcuggaggagcgggugggggcggggcggggcguggcggcgggggaugcgccccugcgcgagccagugucgccugcccuccuuccgcacagcccggguuuccgcuucccuccgggcgcgagaagaggggagccaggccgagccccggcccuaccgccgccgccgccauguggcccccagaccccgaccccgacccggaccccgagccugccggcggcucccgucccggccccgcgguccccgggcuccgcgcccugcugccggcgcgggcuuuccucugcucucucaaaggccgccuccugcuggccgagucggugagugcggcgggacccucggccgccccgcuaggacugcgcggcuccuuucggaggaggacgucggggcgcgggugggguccgggggcggccgccgugcuccgauacccccucuccgcgccgccucggccgacuucucucgggcgccuggcgaaguugggucgagguccccaaacuuuggacggcggggcggggcccgagcccaggccauccgcggcgcuguccccgcgaguccagagcugggggccgugggaaguggguggggcccggggauguggguccugcugugugagccaggcgcccccgcccucucugggccccggggacucgggcaacucggaccuccgggacucccgggccgcagcgggguccgcuuuccugcgagcggguagugcgggccggggccucgaccugcggggccgagccggcggggggccgugcggagcgggagggaucccccacccccgggacugggugaggcggccccgcggugacuucaucgcccuccuccccuccgcggccgggcuccuuccuacuccgcccucgcccccaccccggccgguggggcuucuuuguccucuggacaccggaggcgcccgcacuguccgcugugggguagggguggcgcugggccguuggggauggggagggagaggccgggccggagaccgggggaggcgggaggagagagcggcgcacggcggcggccacuuguugcuuagaucccaggaacuuggcgcuuccugcccuuguccccacuuuacagaugagagcgcucaggcgccugauuugacagguggcucaacugaggggcccagugagagcggccaggagggugggggcaggaggaagggggauucugcuccgggaccucucccuggucacucagggcagagggcagaaggugguccugcagccucucccacggucagcccagaggccaccugcccaacgcccaagugagacaccaaugccacacuccgagcccacacucccagccccacccuggagaccacugggagccacuugaggggagaagccucgaauccaccguccccagaguggcuugaacccccccauccccacccaagaccaccucauaagagggaggcauauguccagcaggagcauagaggccacccugggcccagcagaugucaggaauccaggucagggaggauaaggaagggugaacggucagcacucaggguucacaggagccgcugagggcacuccugccucccuaguccccucacucccacccccaggccaagcaagugcagaggcugagauggacagaaacagagagaggaaguggccccagaaaucgcgggaugaaaaaacaggaauugagaggggaauccccagaauuaggcuuuggggugcaggcauaggagacaggaaggggagggccagagcugggucagucccauggaaggccuuccugggaggccccagcagccucccagcccgucucuaugccuuagucuaucuuuccaaagggggcucagcugcacccaaggccaugugcagagcaaau

SEQ ID NO: 19726 - RNA, 2026 nt, Homo sapiens
auuugcucugcacauggccuugggugcagcugagcccccuuuggaaagauagacuaaggcauagagacgggcugggaggcugcuggggccucccaggaaggccuuccaugggacugacccagcucuggcccuccccuuccugucuccuaugccugcaccccaaagccuaauucuggggauuccccucucaauuccuguuuuuucaucccgcgauuucuggggccacuuccucucucuguuucuguccaucucagccucugcacuugcuuggccugggggugggagugaggggacuagggaggcaggagugcccucagcggcuccugugaacccugagugcugaccguucacccuuccuuauccucccugaccuggauuccugacaucugcugggcccaggguggccucuaugcuccugcuggacauaugccucccucuuaugagguggucuuggguggggauggggggguucaagccacucuggggacgguggauucgaggcuucuccccucaaguggcucccaguggucuccaggguggggcugggagugugggcucggaguguggcauuggugucucacuugggcguugggcagguggccucugggcugaccgugggagaggcugcaggaccaccuucugcccucugcccugagugaccagggagaggucccggagcagaaucccccuuccuccugcccccacccuccuggccgcucucacugggccccucaguugagccaccugucaaaucaggcgccugagcgcucucaucuguaaaguggggacaagggcaggaagcgccaaguuccugggaucuaagcaacaaguggccgccgccgugcgccgcucucuccucccgccucccccggucuccggcccggccucucccuccccauccccaacggcccagcgccaccccuaccccacagcggacagugcgggcgccuccgguguccagaggacaaagaagccccaccggccggggugggggcgagggcggaguaggaaggagcccggccgcggaggggaggagggcgaugaagucaccgcggggccgccucacccagucccgggggugggggaucccucccgcuccgcacggccccccgccggcucggccccgcaggucgaggccccggcccgcacuacccgcucgcaggaaagcggaccccgcugcggcccgggagucccggagguccgaguugcccgaguccccggggcccagagagggcgggggcgccuggcucacacagcaggacccacauccccgggccccacccacuucccacggcccccagcucuggacucgcggggacagcgccgcggauggccugggcucgggccccgccccgccguccaaaguuuggggaccucgacccaacuucgccaggcgcccgagagaagucggccgaggcggcgcggagaggggguaucggagcacggcggccgcccccggaccccacccgcgccccgacguccuccuccgaaaggagccgcgcaguccuagcggggcggccgagggucccgccgcacucaccgacucggccagcaggaggcggccuuugagagagcagaggaaagcccgcgccggcagcagggcgcggagcccggggaccgcggggccgggacgggagccgccggcaggcucgggguccgggucggggucggggucugggggccacauggcggcggcggcgguagggccggggcucggccuggcuccccucuucucgcgcccggagggaagcggaaacccgggcugugcggaaggagggcaggcgacacuggcucgcgcaggggcgcaucccccgccgccacgccccgccccgcccccacccgcuccuccagcccgccccucccccucggaccccggcugcgggggaugcugggcccgacccgcccccuccccggccuggggccuccgcagacuccaccuucuucuucacccugguucgggccgcuggagaccucccgaucaccgccccggcaccccuucggagcucccacccgucugccccuaucc

SEQ ID NO: 19727 - RNA, 2725 nt, Homo sapiens
gguucuuuccccagcccucuggggccuuccggagcccugugagcaggcaccagcucucucccauuucccuccccgccaguuuucuuucugaacauuuuuagccucugaugauccccagggacucaagcugagccaagacugccuggaucagggcccagcugggcucucccucccccugcaaccugccgccuacucaccauccaccgagaccucacgagagcgcaccaggucgcucuuguugcccacgaggaugaugggcacaucaucuguuugccgugcacgccgcagcuggacccgcaguucugaggccuucucgaagcugcccuuguccgucacugaguacacaaugacauaggcaucccccauggccaugcaguggccgggcaaccagcggcccccguccuggagaacacacaacacacaucugcccaacaguccucaugcccccgacacgagccuggcacucccagaccucuaacccaacucacuccucccuccccugcccugggucucugcuugcacccuaccugcucccaaaugucguagaccaugagugaugccucuucuccguccacuacaauggagcgaucauaggugugcccuaggcagaaggccaguagacagguuaccagcugguugucaaagccgcugcugccagguuuccuguucuggccacacccuccaacucuuccccagagcccuccuuacccuccacuccacuugcagaugcugguauguggcaacagcagugccaggcagggaagugggggcuggagggcauggugugccugaccuccacccacaugcccccccuggggaccuuggccaccuagggcuccucucuuagaaaucccucugguuagaaacucugaccugucccugauaggcagggagggauguccagucccaucccacagaguagccauaucuaugcccuggccuucuacucugggcauuucuucccuaccaaaggcuggggggugucccuucuccuuuccuuuccccauuuaugaaguggguagguagaggcaugauucugaaagcgccaauagaauuccacaguauuggccaggugcgguggcucacgccuguaaucccagcacuuugggaagccaaggugggcggaucacgaggucagaaauuccagaccagccuggccaacauggugaaaccccaacucuacuaaaaacacaaauauuagccgggcgugguagcaggcgccuguaauccuagcuacucuggaggcugaggcaggagaaucccuugaaaccugaaggcggagguugcagugagccuagaucgaggccacugcacuccagccugggaaaaagagcgaaacucugucucaaaauaauaauaaaauaauaauaauaauaauaauaacaacaacaacaacuauaauuccacgguauuugcggcuuugaguaccggucucagccccuaguccuagccccgggaucgccccuccccugaacagcuggguccccucaccugcugccucugcuucaggcccguccuccacaccgccgaagaugcgcgccagggcgcucuugcccacgccgggcgcccccagcagcagcaccuuguaaacgcucucgucugagucgcugcccccugagcugagcgaguccucggaguccucgggccaguccagccugggacccuggguccccgucccggccgcggccgccgucagggcacccggggucagcgccgccugcaggucgcgcucguccaccggcaugcugcggcggugcagcggcggggcggggccccagggugugcugccccgacggcgcucgcgcuccuggcccccaccgcggcucccgcccgcuccgcugccgccgccguucagggucaucgcguccgggaccgucuaggggaucaggaacccgaguggccguguaagccgcgagggaggcgggacccggggcgcaccugcccaacccggagucaggcgggaugcuccggccgaggucccgccgcagcccucccccagcccccaggucgcggcgcccucacccgggaccccuccggaccuggcgcauccaucugcagccgccccgaccccgcuccgccaggacacucacccacucgcacacagacacgcucaggacuaggauccggauuaggaggccacgcacucguaguccggacucggacuuuaggguuuccgccgccgcugcugcugcagccaccgccuucucagcccgcacugggcucuggcuccagagccgccuauuuaagccuccacccgcccccgcucccgcccccgguccacgcugcugcgggggcugacgugucuguccacccccaccaggggaaucccccacccucuuccucggaccuuacauccccgacaccccgcccuacccgccaggggaguagcgguagcugucugggaauagaggggcugaccgguaggcgagguccggagcugagggugugugugagaaggagagagagagcgagguugcggggggaguacgugauggggaggcaggcagcgggguaaacccaaucagccaaaagcagcaacugcccucuggagaagaauucggucuggccccgugagacugaauucucccuuuccucuccccaagucccggcucguccuuuuagcaaguaagcuaguuacaggcuggacagagaucccccuucucugcccaugacacccacuccccauaggcucaggucugagcuagaauuuaggggguguccuaaa
